United States Patent 11,640,849 (METHODS FOR HISTOLOGICAL DIAGNOSIS AND TREATMENT OF DISEASES) - sequence listing, part 72

SEQ ID NO: 2741483 - protein, 19 aa, Entamoeba histolytica
FIAFTYSFKCETIDITIPD

SEQ ID NO: 2741484 - protein, 17 aa, Entamoeba histolytica
FIAIAFAMCEHRDIIGK

SEQ ID NO: 2741485 - protein, 25 aa, Entamoeba histolytica
FIDNSIFYLYLSYNYKCKINEESCK

SEQ ID NO: 2741486 - protein, 24 aa, Entamoeba histolytica
FIFYSFALDYYKVLGVPRNANEKE

SEQ ID NO: 2741487 - protein, 17 aa, Entamoeba histolytica
FIGVPRNIFLTLTGGFD

SEQ ID NO: 2741488 - protein, 17 aa, Entamoeba histolytica
FIIFITTTLSNYCQAPL

SEQ ID NO: 2741489 - protein, 17 aa, Entamoeba histolytica
FIISNNPLMSKTPQKEI

SEQ ID NO: 2741490 - protein, 20 aa, Entamoeba histolytica
FILLVYGKLPNKWAYNYPTN

SEQ ID NO: 2741491 - protein, 18 aa, Entamoeba histolytica
FILVGLTLGKKAWIVTDT

SEQ ID NO: 2741492 - protein, 17 aa, Entamoeba histolytica
FIRTFLLNETKSLLNGS

SEQ ID NO: 2741493 - protein, 28 aa, Entamoeba histolytica
FITDRPLEEYILPPRLYPYVEYGKTVTL

SEQ ID NO: 2741494 - protein, 18 aa, Entamoeba histolytica
FIVLCLADLNVLTREDMV

SEQ ID NO: 2741495 - protein, 17 aa, Entamoeba histolytica
FIVLNIYAITPEQEEII

SEQ ID NO: 2741496 - protein, 18 aa, Entamoeba histolytica
FIVLSFGKTWCWSDDYND

SEQ ID NO: 2741497 - protein, 18 aa, Entamoeba histolytica
FIVLVFAVNHDIFRTCQQ

SEQ ID NO: 2741498 - protein, 28 aa, Entamoeba histolytica
FKNFDYIFAMDNDNYYELLDRCPEQYKQ

SEQ ID NO: 2741499 - protein, 25 aa, Entamoeba histolytica
FKQVSKTRIIWANKILFLDMMFPQT

SEQ ID NO: 2741500 - protein, 20 aa, Entamoeba histolytica
FLCVAFAYVPRTLSVIELFE

SEQ ID NO: 2741501 - protein, 31 aa, Entamoeba histolytica
FLEQVLKPYFTERVKFVYYIKSYEKAMKIDS

SEQ ID NO: 2741502 - protein, 17 aa, Entamoeba histolytica
FLFICYSSSFHVYQEIE

SEQ ID NO: 2741503 - protein, 18 aa, Entamoeba histolytica
FLFVLLSEANDSLCYRQM

SEQ ID NO: 2741504 - protein, 19 aa, Entamoeba histolytica
FLIGVFALNLRDSLDDFLD

SEQ ID NO: 2741505 - protein, 18 aa, Entamoeba histolytica
FLKGYPSLFLFYNNYIYP

SEQ ID NO: 2741506 - protein, 20 aa, Entamoeba histolytica
FLLLISFSLATLIPFNVCSE

SEQ ID NO: 2741507 - protein, 18 aa, Entamoeba histolytica
FLLVVINAETCPESLSTC

SEQ ID NO: 2741508 - protein, 19 aa, Entamoeba histolytica
FLNLVFGKDVLITEDLFRT

SEQ ID NO: 2741509 - protein, 17 aa, Entamoeba histolytica
FLNLYSNTPIKDYNFLT

SEQ ID NO: 2741510 - protein, 19 aa, Entamoeba histolytica
FLSFVFASIPMNATNTIQN

SEQ ID NO: 2741511 - protein, 17 aa, Entamoeba histolytica
FNGFRHCALGTHCRGAE

SEQ ID NO: 2741512 - protein, 26 aa, Entamoeba histolytica
FNGGKDWYKKRMQWLSKVGPGLDEES

SEQ ID NO: 2741513 - protein, 18 aa, Entamoeba histolytica
FNGIYAEAFGNHKPARAC

SEQ ID NO: 2741514 - protein, 23 aa, Entamoeba histolytica
FNNKSPFWVYPERSIEGLIKFIN

SEQ ID NO: 2741515 - protein, 20 aa, Entamoeba histolytica
FNPKILIGSLLQSGSTTSTS

SEQ ID NO: 2741516 - protein, 20 aa, Entamoeba histolytica
FNRLEKTIKLRMSLFGINKL

SEQ ID NO: 2741517 - protein, 17 aa, Entamoeba histolytica
FNSFRVLPNITKPTFHI

SEQ ID NO: 2741518 - protein, 25 aa, Entamoeba histolytica
FPLFHQVNMPLFRRIENLPVYTLWY

SEQ ID NO: 2741519 - protein, 25 aa, Entamoeba histolytica
FPNKIPSKTLLFPKVKRIQTIDGDI

SEQ ID NO: 2741520 - protein, 17 aa, Entamoeba histolytica
FPNYSFYCRVDDQILVT

SEQ ID NO: 2741521 - protein, 18 aa, Entamoeba histolytica
FPSKLFYQWVTRNGKYSQ

SEQ ID NO: 2741522 - protein, 29 aa, Entamoeba histolytica
FRRIENLPVYTLWYFYQGTIPKVHEDLFR

SEQ ID NO: 2741523 - protein, 19 aa, Entamoeba histolytica
FSAPYDWRYYHHDEYYEKV

SEQ ID NO: 2741524 - protein, 19 aa, Entamoeba histolytica
FTEESVFGGLFEIYKRLYG

SEQ ID NO: 2741525 - protein, 18 aa, Entamoeba histolytica
FTFAFSQDILIKADVKKY

SEQ ID NO: 2741526 - protein, 24 aa, Entamoeba histolytica
FTGFFICRAWCSPGYFDDNAPYTL

SEQ ID NO: 2741527 - protein, 20 aa, Entamoeba histolytica
FTITLSLSASIDYVFTDVTD

SEQ ID NO: 2741528 - protein, 22 aa, Entamoeba histolytica
FTPLQLPLDLDMNILFRAINSY

SEQ ID NO: 2741529 - protein, 20 aa, Entamoeba histolytica
FTYFPINTCTYYNERYYEYL

SEQ ID NO: 2741530 - protein, 26 aa, Entamoeba histolytica
FVATAVSPVFPPAAGVAGAALAVSQV

SEQ ID NO: 2741531 - protein, 27 aa, Entamoeba histolytica
FVDSFNKIGSFKLSVDGPFAAMTNEEY

SEQ ID NO: 2741532 - protein, 19 aa, Entamoeba histolytica
FVDSKTKISKVISDALEKA

SEQ ID NO: 2741533 - protein, 18 aa, Entamoeba histolytica
FVFIILASAIEEDEFELN

SEQ ID NO: 2741534 - protein, 17 aa, Entamoeba histolytica
FVILCHADIVGMYMTAP

SEQ ID NO: 2741535 - protein, 18 aa, Entamoeba histolytica
FVLLTFATEVIRVDPYIS

SEQ ID NO: 2741536 - protein, 19 aa, Entamoeba histolytica
FVPEKWVIPSLRKNSMQFG

SEQ ID NO: 2741537 - protein, 17 aa, Entamoeba histolytica
FVRFLEMFKMCIDSFEL

SEQ ID NO: 2741538 - protein, 23 aa, Entamoeba histolytica
FVSSLGMKWLSWVLKKSVIKKRQ

SEQ ID NO: 2741539 - protein, 25 aa, Entamoeba histolytica
FVVMSFYKIMGYPTGIGALLVKNEV

SEQ ID NO: 2741540 - protein, 18 aa, Entamoeba histolytica
FWAFPPKSQWMLNNMSLW

SEQ ID NO: 2741541 - protein, 26 aa, Entamoeba histolytica
FWTWSYKVYQYPKKVILVLLPHQLPQ

SEQ ID NO: 2741542 - protein, 26 aa, Entamoeba histolytica
FYQMYELFHYFLSSIPYCSSLKIFLI

SEQ ID NO: 2741543 - protein, 24 aa, Entamoeba histolytica
GALRKLPVLPLTETDIFILNSDGD

SEQ ID NO: 2741544 - protein, 24 aa, Entamoeba histolytica
GANPLLFCFGNFFDEFRLCSDIPS

SEQ ID NO: 2741545 - protein, 32 aa, Entamoeba histolytica
GASKIITGLLDAKLPIVLAAVHAPILSIRSQY

SEQ ID NO: 2741546 - protein, 28 aa, Entamoeba histolytica
GCMTAEFFLGYPLFGATSEYNLLFKMIE

SEQ ID NO: 2741547 - protein, 23 aa, Entamoeba histolytica
GCNGGSLLLSFRYVKLNGIMQEK

SEQ ID NO: 2741548 - protein, 25 aa, Entamoeba histolytica
GCTTQYFRKVWVDPLRKRLPDAKTY

SEQ ID NO: 2741549 - protein, 40 aa, Entamoeba histolytica
GCVNTALWQFFPIWLQYLCWPILQVIFKTPLEGAQTCLHL

SEQ ID NO: 2741550 - protein, 20 aa, Entamoeba histolytica
GDKFLKLKNFKVNCGSLAKK

SEQ ID NO: 2741551 - protein, 23 aa, Entamoeba histolytica
GDMTIEAAFSKLTWLLAQGMTPD

SEQ ID NO: 2741552 - protein, 23 aa, Entamoeba histolytica
GDSDGMFFFNPLNNTLVLTGTNE

SEQ ID NO: 2741553 - protein, 25 aa, Entamoeba histolytica
GDSLDLPEIILPSDFFLKAIRSFES

SEQ ID NO: 2741554 - protein, 23 aa, Entamoeba histolytica
GDVNSNIPLLRKEERKLLHRMGI

SEQ ID NO: 2741555 - protein, 20 aa, Entamoeba histolytica
GDVVMFEGLYPFYNYKGMEM

SEQ ID NO: 2741556 - protein, 22 aa, Entamoeba histolytica
GEKQILVFDLGGGTFDVSLLNI

SEQ ID NO: 2741557 - protein, 20 aa, Entamoeba histolytica
GFHMNLPSYPEYFKKLNKFF

SEQ ID NO: 2741558 - protein, 24 aa, Entamoeba histolytica
GFKRRFPIYVAYTTGPLGIQIFPD

SEQ ID NO: 2741559 - protein, 19 aa, Entamoeba histolytica
GFMALNIKNNLFSGPIYMI

SEQ ID NO: 2741560 - protein, 23 aa, Entamoeba histolytica
GFPKVVFYHYNGMKFNFKNESPN

SEQ ID NO: 2741561 - protein, 18 aa, Entamoeba histolytica
GFTFLNYMKVCCQVLNFI

SEQ ID NO: 2741562 - protein, 18 aa, Entamoeba histolytica
GFTLSNEGPFAILTREES

SEQ ID NO: 2741563 - protein, 17 aa, Entamoeba histolytica
GGKYHDLIHKPGKNIFR

SEQ ID NO: 2741564 - protein, 20 aa, Entamoeba histolytica
GGRFVINKYAEKYNSLMLAI

SEQ ID NO: 2741565 - protein, 25 aa, Entamoeba histolytica
GGSYSGNLAAWMRQKYPNVVEGAWA

SEQ ID NO: 2741566 - protein, 26 aa, Entamoeba histolytica
GGSYSGNLAAWMRQKYPNVVEGAWAS

SEQ ID NO: 2741567 - protein, 24 aa, Entamoeba histolytica
GGVAGVMADVWWGLVETSPRNYNW

SEQ ID NO: 2741568 - protein, 26 aa, Entamoeba histolytica
GGVIPKSLAFGVIKESQGFVKKAECP

SEQ ID NO: 2741569 - protein, 27 aa, Entamoeba histolytica
GHDSTLLPYLALIGQDVFTWPPYASHI

SEQ ID NO: 2741570 - protein, 18 aa, Entamoeba histolytica
GILSLLEYDTQIAIPYAS

SEQ ID NO: 2741571 - protein, 27 aa, Entamoeba histolytica
GISKDQNMVLLLKKLLHHYGPFLVSVK

SEQ ID NO: 2741572 - protein, 18 aa, Entamoeba histolytica
GKCPLDIQAFTSLYNNLI

SEQ ID NO: 2741573 - protein, 19 aa, Entamoeba histolytica
GKDIRELNIKWLRNQIGIV

SEQ ID NO: 2741574 - protein, 27 aa, Entamoeba histolytica
GKFNKKALQKLIRKAAKKSMKKYSKKI

SEQ ID NO: 2741575 - protein, 22 aa, Entamoeba histolytica
GKLCERCFALAKTIRSAVFEKK

SEQ ID NO: 2741576 - protein, 22 aa, Entamoeba histolytica
GKNAIMRKAAISRLVDLKRNKI

SEQ ID NO: 2741577 - protein, 20 aa, Entamoeba histolytica
GKNIFRCPFEKYHGITKCDS

SEQ ID NO: 2741578 - protein, 23 aa, Entamoeba histolytica
GKNNNWLVLLDAAAYLSTAKLDL

SEQ ID NO: 2741579 - protein, 26 aa, Entamoeba histolytica
GKRLRPLSLLLFFIGGGGKIEEQKNI

SEQ ID NO: 2741580 - protein, 18 aa, Entamoeba histolytica
GKTALIYRYINSSFITQY

SEQ ID NO: 2741581 - protein, 23 aa, Entamoeba histolytica
GKTGRALLKGYDKFKNSGVGKAL

SEQ ID NO: 2741582 - protein, 31 aa, Entamoeba histolytica
GKTVIKTLKWPTYKRHFYLPYRLDVDLCYQA

SEQ ID NO: 2741583 - protein, 20 aa, Entamoeba histolytica
GKYFNILASHFSQFSPDSVK

SEQ ID NO: 2741584 - protein, 17 aa, Entamoeba histolytica
GKYGMPLHYKGTKFHRV

SEQ ID NO: 2741585 - protein, 20 aa, Entamoeba histolytica
GLAQLQIGLFLKELIDRAEM

SEQ ID NO: 2741586 - protein, 18 aa, Entamoeba histolytica
GLIALDYRRFNKNPINII

SEQ ID NO: 2741587 - protein, 17 aa, Entamoeba histolytica
GLIFFNHGQFDGLKNKL

SEQ ID NO: 2741588 - protein, 25 aa, Entamoeba histolytica
GLMEGLDFSFVLTRARFNELNLDLF

SEQ ID NO: 2741589 - protein, 26 aa, Entamoeba histolytica
GNAPSHFPLYVTLLTSQPISYFECKE

SEQ ID NO: 2741590 - protein, 19 aa, Entamoeba histolytica
GNDVAEVPVQEIKINKEHD

SEQ ID NO: 2741591 - protein, 24 aa, Entamoeba histolytica
GNELQFFEFAPYKMYTSFAIPRRV

SEQ ID NO: 2741592 - protein, 27 aa, Entamoeba histolytica
GNELQFFEFAPYRMYTYAPGTRNQRFV

SEQ ID NO: 2741593 - protein, 29 aa, Entamoeba histolytica
GNHCGVATNAFFPLFVRRVNDDPKPMSHT

SEQ ID NO: 2741594 - protein, 20 aa, Entamoeba histolytica
GNLATWIRQKYPNVVYAAVA

SEQ ID NO: 2741595 - protein, 24 aa, Entamoeba histolytica
GNTEVIGDFLFTCALEIYNASKAF

SEQ ID NO: 2741596 - protein, 27 aa, Entamoeba histolytica
GPTSTNPLYALRILSRFITSTTMPAYS

SEQ ID NO: 2741597 - protein, 20 aa, Entamoeba histolytica
GQAKFYLMVWEDGSNTVEEI

SEQ ID NO: 2741598 - protein, 22 aa, Entamoeba histolytica
GQCGSCWTFCTTAVLEGRVNKD

SEQ ID NO: 2741599 - protein, 21 aa, Entamoeba histolytica
GQDVFTWPPYASHIDIEIYSF

SEQ ID NO: 2741600 - protein, 24 aa, Entamoeba histolytica
GQMSAWYILSVMGFYSVTPGTDQF

SEQ ID NO: 2741601 - protein, 25 aa, Entamoeba histolytica
GRSNTFFSQLDYKADKFTGSLDIKH

SEQ ID NO: 2741602 - protein, 22 aa, Entamoeba histolytica
GSEFNLYVRCELLQLDIPECMK

SEQ ID NO: 2741603 - protein, 17 aa, Entamoeba histolytica
GSFLPFSIYINDDKKMH

SEQ ID NO: 2741604 - protein, 22 aa, Entamoeba histolytica
GSSISIFGYWIAVSSSLGNEFN

SEQ ID NO: 2741605 - protein, 27 aa, Entamoeba histolytica
GSYETYYYDIELWYSLLARSKVPFLTF

SEQ ID NO: 2741606 - protein, 17 aa, Entamoeba histolytica
GSYSGNLATWIRQKYPN

SEQ ID NO: 2741607 - protein, 22 aa, Entamoeba histolytica
GTISFLSIASLKYGFEQQDYFG

SEQ ID NO: 2741608 - protein, 17 aa, Entamoeba histolytica
GTMIAFSILLENPASSL

SEQ ID NO: 2741609 - protein, 19 aa, Entamoeba histolytica
GTMIAFSILLENPASSLDN

SEQ ID NO: 2741610 - protein, 17 aa, Entamoeba histolytica
GTSWGMDGYILMSRNKN

SEQ ID NO: 2741611 - protein, 25 aa, Entamoeba histolytica
GVAGVMADIWWGLVETSPRNYNWNG

SEQ ID NO: 2741612 - protein, 31 aa, Entamoeba histolytica
GVHNKQYYECATTFKGFRPCASGTWCQGEQE

SEQ ID NO: 2741613 - protein, 21 aa, Entamoeba histolytica
GVMGDVWWGLVETSPKSYNWN

SEQ ID NO: 2741614 - protein, 26 aa, Entamoeba histolytica
GVSEYWLGFYVRNYIIGLKGVKISFG

SEQ ID NO: 2741615 - protein, 18 aa, Entamoeba histolytica
GVYFDLYPRKGKRSGAWE

SEQ ID NO: 2741616 - protein, 26 aa, Entamoeba histolytica
GYGKTINGIPYWILKNCWGSSWGSNG

SEQ ID NO: 2741617 - protein, 25 aa, Entamoeba histolytica
GYPRHTLFELFPSKKPYRLFNVDPF

SEQ ID NO: 2741618 - protein, 18 aa, Entamoeba histolytica
GYYSYKWAESISADAFEY

SEQ ID NO: 2741619 - protein, 18 aa, Entamoeba histolytica
HCALGTHCRGAENNPYNF

SEQ ID NO: 2741620 - protein, 17 aa, Entamoeba histolytica
HCIECEYGYYLNSIYEC

SEQ ID NO: 2741621 - protein, 26 aa, Entamoeba histolytica
HDRDYYECSPDFNGFRHCALGTHCRG

SEQ ID NO: 2741622 - protein, 28 aa, Entamoeba histolytica
HDTEEELLIRWYQVGTFYPFFRAHAHLD

SEQ ID NO: 2741623 - protein, 27 aa, Entamoeba histolytica
HEWLLANLRYYWPGLKQCSFFNYEYLK

SEQ ID NO: 2741624 - protein, 19 aa, Entamoeba histolytica
HFTAIEKLRRRAIFNMNAK

SEQ ID NO: 2741625 - protein, 19 aa, Entamoeba histolytica
HGHLLILNSNDIWNYIKPK

SEQ ID NO: 2741626 - protein, 38 aa, Entamoeba histolytica
HGTWRGYYAMLRIYKVYDLFYGGRRLKMSFSSSPGLIH

SEQ ID NO: 2741627 - protein, 26 aa, Entamoeba histolytica
HHLEHLKLHLTFYKKELEKLVHSKDQ

SEQ ID NO: 2741628 - protein, 23 aa, Entamoeba histolytica
HHNMDNASTVFILLSIINLALLF

SEQ ID NO: 2741629 - protein, 23 aa, Entamoeba histolytica
HHNMNNASTFFILQSIFILALVF

SEQ ID NO: 2741630 - protein, 27 aa, Entamoeba histolytica
HHRRRYFRRYPWRRYRFWRKHHHRRHP

SEQ ID NO: 2741631 - protein, 28 aa, Entamoeba histolytica
HIISDLHLERRLNIIDDILGEAKTAPKV

SEQ ID NO: 2741632 - protein, 25 aa, Entamoeba histolytica
HKAIDIPHIIPLKPNFIKKVHIIFK

SEQ ID NO: 2741633 - protein, 26 aa, Entamoeba histolytica
HKENMNAWYLDHYLGKAKDYPKSLYK

SEQ ID NO: 2741634 - protein, 24 aa, Entamoeba histolytica
HKHTYALTRVLFTELNKLTYSNGT

SEQ ID NO: 2741635 - protein, 33 aa, Entamoeba histolytica
HLHLDHVGMPYKNGFWYLMEKAGITFGKFIDRD

SEQ ID NO: 2741636 - protein, 18 aa, Entamoeba histolytica
HLHPQQCIIAIKSPSLKK

SEQ ID NO: 2741637 - protein, 17 aa, Entamoeba histolytica
HLMHTLFSKQRYASLAG

SEQ ID NO: 2741638 - protein, 19 aa, Entamoeba histolytica
HLNLEFYYNSLLSNFSNFD

SEQ ID NO: 2741639 - protein, 32 aa, Entamoeba histolytica; identical to SEQ ID NO: 2556141

SEQ ID NO: 2741640 - protein, 18 aa, Entamoeba histolytica
HLSTIYAYLTKQVDNNKP

SEQ ID NO: 2741641 - protein, 27 aa, Entamoeba histolytica
HNPSTELLIRWYQAGALQPFFRQHSSQ

SEQ ID NO: 2741642 - protein, 34 aa, Entamoeba histolytica
HNTWRPYYAMLRIYKHYFFPWTKNAQPMSFASSP

SEQ ID NO: 2741643 - protein, 17 aa, Entamoeba histolytica
HPVIVLGGSYSGNLAAW

SEQ ID NO: 2741644 - protein, 17 aa, Entamoeba histolytica
HRRPRRHYRRKSHRRHF

SEQ ID NO: 2741645 - protein, 21 aa, Entamoeba histolytica
HRVHRFINGRWFEKYSRKHQN

SEQ ID NO: 2741646 - protein, 22 aa, Entamoeba histolytica
HRVHRFINGRWFEKYSRKHQNN

SEQ ID NO: 2741647 - protein, 35 aa, Entamoeba histolytica
HSHYQSFRILPNIENPFYHVILNPAVTTWGKINPK

SEQ ID NO: 2741648 - protein, 23 aa, Entamoeba histolytica
HSMGGLIIHNFLESMPQKWIDTY

SEQ ID NO: 2741649 - protein, 19 aa, Entamoeba histolytica
HSMGGLMFYKFLDYVGKEF

SEQ ID NO: 2741650 - protein, 26 aa, Entamoeba histolytica
HSRILKMLDYFMYYGHICIVTEMLGL

SEQ ID NO: 2741651 - protein, 19 aa, Entamoeba histolytica
HTCYSAAMSLMANFDSKVI

SEQ ID NO: 2741652 - protein, 30 aa, Entamoeba histolytica
HTHKYANQLKRIYNLYKTHLKSEEPEKVTP

SEQ ID NO: 2741653 - protein, 31 aa, Entamoeba histolytica
HTNNINERMYTRYNIHLKEETYVTGESITKE

SEQ ID NO: 2741654 - protein, 18 aa, Entamoeba histolytica
HVQGYPTVILYKGNENIE

SEQ ID NO: 2741655 - protein, 18 aa, Entamoeba histolytica
HVYLKVVSPYLCLVMLLG

SEQ ID NO: 2741656 - protein, 25 aa, Entamoeba histolytica
HYQNSFIVLNKFMSTKRFKECVDNI

SEQ ID NO: 2741657 - protein, 27 aa, Entamoeba histolytica
IAASSKKLFFLNNKNLEIFDITKATPV

SEQ ID NO: 2741658 - protein, 18 aa, Entamoeba histolytica
IACSSRFPIVFVPAFMSS

SEQ ID NO: 2741659 - protein, 18 aa, Entamoeba histolytica
IALILTVFAEDSFETETN

SEQ ID NO: 2741660 - protein, 17 aa, Entamoeba histolytica
IALYLAYVDVYGSHCNE

SEQ ID NO: 2741661 - protein, 26 aa, Entamoeba histolytica
IAMFLTLAFAVEEDATLDNKETENND

SEQ ID NO: 2741662 - protein, 17 aa, Entamoeba histolytica
IAQVFKNYGTRFDFTCL

SEQ ID NO: 2741663 - protein, 27 aa, Entamoeba histolytica
ICEKYTPDFEWYCNIVIHILEFNKVEP

SEQ ID NO: 2741664 - protein, 20 aa, Entamoeba histolytica
ICFYCNFVLSNYSGLWLNYC

SEQ ID NO: 2741665 - protein, 21 aa, Entamoeba histolytica
IDCGGGYIKLLPKKSIESEEK

SEQ ID NO: 2741666 - protein, 61 aa, Entamoeba histolytica
IDLMRQIPQIPIPPMTYQPIMPVYMSPIRFIPNPYYYYRRPYYRVNPYVRGLYLNPDMFGT

SEQ ID NO: 2741667 - protein, 23 aa, Entamoeba histolytica
IEESFMFFSLNNTNYSRCGSCVE

SEQ ID NO: 2741668 - protein, 20 aa, Entamoeba histolytica
IEIKQKYIYGSYKKLTNVEH

SEQ ID NO: 2741669 - protein, 18 aa, Entamoeba histolytica
IEMKKQIQMLMKKASQSP

SEQ ID NO: 2741670 - protein, 25 aa, Entamoeba histolytica
IENTKFQFFYKKFTLQDIQYYLYEL

SEQ ID NO: 2741671 - protein, 20 aa, Entamoeba histolytica
IENVLDILYDDMKLAVSIAD

SEQ ID NO: 2741672 - protein, 18 aa, Entamoeba histolytica
IEQLKLINKQRLKRLNDI

SEQ ID NO: 2741673 - protein, 23 aa, Entamoeba histolytica
IERPKWFIKYANNDIDWHLNWKL

SEQ ID NO: 2741674 - protein, 23 aa, Entamoeba histolytica
IESAERLLAELANHPYHGMYAPA

SEQ ID NO: 2741675 - protein, 19 aa, Entamoeba histolytica
IESRLLISGTTRYTAQTLD

SEQ ID NO: 2741676 - protein, 27 aa, Entamoeba histolytica
IETTRITIHSLLKKYKSKLLKKQSEFK

SEQ ID NO: 2741677 - protein, 19 aa, Entamoeba histolytica
IEWVSAMGIPLFYDGSKQL

SEQ ID NO: 2741678 - protein, 20 aa, Entamoeba histolytica
IFIFYLLVGYCFSSEIKILQ

SEQ ID NO: 2741679 - protein, 30 aa, Entamoeba histolytica
IFIVGVITLFLFEALVIYDYPTVSNSRLSH

SEQ ID NO: 2741680 - protein, 17 aa, Entamoeba histolytica
IFSSLSEDYGVCSPGFA

SEQ ID NO: 2741681 - protein, 18 aa, Entamoeba histolytica
IGDIRKFIRAIKEFIKMV

SEQ ID NO: 2741682 - protein, 19 aa, Entamoeba histolytica
IGESFPWTNNSKFMYLRQN

SEQ ID NO: 2741683 - protein, 29 aa, Entamoeba histolytica
IGSSIFINIKFIPNITFISSTPFPITYND

SEQ ID NO: 2741684 - protein, 20 aa, Entamoeba histolytica
IGYVFKKRPTKPAKLTVKMS

SEQ ID NO: 2741685 - protein, 17 aa, Entamoeba histolytica
IIDFLKNDKLWNVLDAI

SEQ ID NO: 2741686 - protein, 21 aa, Entamoeba histolytica
IIFLMFNFSYAKNHVAVSISN

SEQ ID NO: 2741687 - protein, 18 aa, Entamoeba histolytica
IIGIIYQFSISGTHCEPK

SEQ ID NO: 2741688 - protein, 18 aa, Entamoeba histolytica
IIKFVKSRLEIFGSKIIF

SEQ ID NO: 2741689 - protein, 20 aa, Entamoeba histolytica
IIKGYEHQIVGIKSIHMKIL

SEQ ID NO: 2741690 - protein, 17 aa, Entamoeba histolytica
IIKYLSPFIQYFKEITF

SEQ ID NO: 2741691 - protein, 20 aa, Entamoeba histolytica
IILVVYSRPIKPPRLGDGFI

SEQ ID NO: 2741692 - protein, 19 aa, Entamoeba histolytica
IISSFINILIDFIPLKVFQ

SEQ ID NO: 2741693 - protein, 18 aa, Entamoeba histolytica
IIVTMSVAVEQCGKVCEP

SEQ ID NO: 2741694 - protein, 27 aa, Entamoeba histolytica
IIVTSLSPLLLFVDNSLGITILTNNAV

SEQ ID NO: 2741695 - protein, 27 aa, Entamoeba histolytica
IIYAQKYTFFFPPFNQYFHFKDIPLHF

SEQ ID NO: 2741696 - protein, 17 aa, Entamoeba histolytica
IIYCVIAETITFNKYNN

SEQ ID NO: 2741697 - protein, 19 aa, Entamoeba histolytica
IKALGYYTSPYFGGHNFDK

SEQ ID NO: 2741698 - protein, 19 aa, Entamoeba histolytica
IKERKNLIAQWKLQMKELE

SEQ ID NO: 2741699 - protein, 25 aa, Entamoeba histolytica
IKHDKYFECNEFYEGIRTCPRNTKC

SEQ ID NO: 2741700 - protein, 24 aa, Entamoeba histolytica
IKKQKEEFVLRKASSSLLRTAGVI

SEQ ID NO: 2741701 - protein, 26 aa, Entamoeba histolytica
IKKYSKKRFTKLTKKLNRKLTKKLTK

SEQ ID NO: 2741702 - protein, 24 aa, Entamoeba histolytica
IKLEKQLIELKRYKKAKIACARDA

SEQ ID NO: 2741703 - protein, 25 aa, Entamoeba histolytica
ILAAILVLPLHPLFESIPEKYYYSS

SEQ ID NO: 2741704 - protein, 24 aa, Entamoeba histolytica
ILDTEMTPLYKKWNWTIPNGVKMD

SEQ ID NO: 2741705 - protein, 20 aa, Entamoeba histolytica
ILILKHLSTILPTYKQLIES

SEQ ID NO: 2741706 - protein, 17 aa, Entamoeba histolytica
ILIQVSFTYCYAEFCNV

SEQ ID NO: 2741707 - protein, 18 aa, Entamoeba histolytica
ILKLMKKNQRRIMNQLFR

SEQ ID NO: 2741708 - protein, 18 aa, Entamoeba histolytica
ILLLVQSKDVVDTVTFEI

SEQ ID NO: 2741709 - protein, 18 aa, Entamoeba histolytica
ILMKLKESNPKEFLYCYS

SEQ ID NO: 2741710 - protein, 32 aa, Entamoeba histolytica
ILNIELMYEKDGLYYYLLRTEKVSFNEYFNEA

SEQ ID NO: 2741711 - protein, 17 aa, Entamoeba histolytica
ILNKIRYKQSADIYSFA

SEQ ID NO: 2741712 - protein, 19 aa, Entamoeba histolytica
ILNTEAVIVLPFKQLHPYL

SEQ ID NO: 2741713 - protein, 17 aa, Entamoeba histolytica
IMKFFKRKQYQSKKISK

SEQ ID NO: 2741714 - protein, 19 aa, Entamoeba histolytica
INAGHIILGLGRSNYLRLP

SEQ ID NO: 2741715 - protein, 24 aa, Entamoeba histolytica
INDIKRFMLLNKFKTDPLTEGRPG

SEQ ID NO: 2741716 - protein, 24 aa, Entamoeba histolytica
INDKLLSWQRILSGLYYEKTAKEF

SEQ ID NO: 2741717 - protein, 24 aa, Entamoeba histolytica
INKGKKKVLRLEKNKRLKSKKSNL

SEQ ID NO: 2741718 - protein, 38 aa, Entamoeba histolytica
INNPEVMHTHMYSNKHKIIYNKYNIHLKSEAEVVNEKK

SEQ ID NO: 2741719 - protein, 18 aa, Entamoeba histolytica
INRKDLIPFNNSACFIEY

SEQ ID NO: 2741720 - protein, 26 aa, Entamoeba histolytica
INSLKKYKIQLRKGLKKIIINRIKDA

SEQ ID NO: 2741721 - protein, 27 aa, Entamoeba histolytica
INYVGHFLFNLKLLNALKIRHGRFIIT

SEQ ID NO: 2741722 - protein, 20 aa, Entamoeba histolytica
IPFNNSACFIEYMKTYWNSS

SEQ ID NO: 2741723 - protein, 18 aa, Entamoeba histolytica
IPKKTVAYYTNWAQYRFN

SEQ ID NO: 2741724 - protein, 20 aa, Entamoeba histolytica
IPKVQQLLKEFFNGKEPSRG

SEQ ID NO: 2741725 - protein, 26 aa, Entamoeba histolytica
IPTVTDGVIIIYLHPGITSTFIEAVL

SEQ ID NO: 2741726 - protein, 28 aa, Entamoeba histolytica
IQIEPKQHKIMYNGYNIQLKGGDISEAA

SEQ ID NO: 2741727 - protein, 24 aa, Entamoeba histolytica
IQLEKQLLELKRYKKAKIACARNA

SEQ ID NO: 2741728 - protein, 25 aa, Entamoeba histolytica
IQPSSSVIQPVPYPVPSGSASGATA

SEQ ID NO: 2741729 - protein, 17 aa, Entamoeba histolytica
IQRKLDLNGIQRKEIDK

SEQ ID NO: 2741730 - protein, 20 aa, Entamoeba histolytica
IRARVNLFRNWLDKTGIKEK

SEQ ID NO: 2741731 - protein, 25 aa, Entamoeba histolytica
IRDSYFLIYLYYDQGCKNLQYILNK

SEQ ID NO: 2741732 - protein, 21 aa, Entamoeba histolytica
IRKFVQQILRALLVLSKGNIV

SEQ ID NO: 2741733 - protein, 19 aa, Entamoeba histolytica
IRMNKFNVLYAPITGLNRL

SEQ ID NO: 2741734 - protein, 30 aa, Entamoeba histolytica
IRSERTKMRYLKIKALKDILSKKLAAEERI

SEQ ID NO: 2741735 - protein, 24 aa, Entamoeba histolytica
IRSLYRIFLLSDHDSQSIIKSALS

SEQ ID NO: 2741736 - protein, 20 aa, Entamoeba histolytica
ISAMSLFFKAKVTQSVNDIK

SEQ ID NO: 2741737 - protein, 32 aa, Entamoeba histolytica; identical to SEQ ID NO: 2556266

SEQ ID NO: 2741738 - protein, 34 aa, Entamoeba histolytica
ISILAYLGYLIYKKELTWPIEDSIIYKKVLVMIE

SEQ ID NO: 2741739 - protein, 22 aa, Entamoeba histolytica
ISKRKLMRYIKMNGTKKTYPVD

SEQ ID NO: 2741740 - protein, 25 aa, Entamoeba histolytica
ISLKNILTIILGKIPFEFDASIDSG

SEQ ID NO: 2741741 - protein, 26 aa, Entamoeba histolytica
ISNNYGAYIYIFDKSIIVYSKMDEKW

SEQ ID NO: 2741742 - protein, 24 aa, Entamoeba histolytica
ISVMKTFTQALFAAAVEYLLPFRR

SEQ ID NO: 2741743 - protein, 18 aa, Entamoeba histolytica
ITDFFRKFYRLRVSTFEY

SEQ ID NO: 2741744 - protein, 25 aa, Entamoeba histolytica
ITLINPFPNCIILTGKSKEAFKCIK

SEQ ID NO: 2741745 - protein, 21 aa, Entamoeba histolytica
ITLINPFPNLDILLIQTMNVK

SEQ ID NO: 2741746 - protein, 17 aa, Entamoeba histolytica
ITPILCYDFISSSICVN

SEQ ID NO: 2741747 - protein, 20 aa, Entamoeba histolytica
ITPNSLLSWQRILVSMYFGQ

SEQ ID NO: 2741748 - protein, 19 aa, Entamoeba histolytica
ITRLRREAERAKRALSVQQ

SEQ ID NO: 2741749 - protein, 18 aa, Entamoeba histolytica
IVFDDIPTYLFYKMNENT

SEQ ID NO: 2741750 - protein, 18 aa, Entamoeba histolytica
IVFTYSFEMWQLTDIHLD

SEQ ID NO: 2741751 - protein, 27 aa, Entamoeba histolytica
IVKDQEHFFILILKNLKKELKRAESQR

SEQ ID NO: 2741752 - protein, 18 aa, Entamoeba histolytica
IVRNSWGPYWGEQGYFRI

SEQ ID NO: 2741753 - protein, 19 aa, Entamoeba histolytica
IVRNSWGTIWGDQGYVLMS

SEQ ID NO: 2741754 - protein, 18 aa, Entamoeba histolytica
IVVSALAAPRCTPTTVAN

SEQ ID NO: 2741755 - protein, 19 aa, Entamoeba histolytica
IWFDFTIACSSRFPIVFVP

SEQ ID NO: 2741756 - protein, 18 aa, Entamoeba histolytica
IWKNWKYILDFHEIFMKE

SEQ ID NO: 2741757 - protein, 18 aa, Entamoeba histolytica
IWVLILLIENCVAAVITD

SEQ ID NO: 2741758 - protein, 19 aa, Entamoeba histolytica
IWVLILLIENCVAAVITDF

SEQ ID NO: 2741759 - protein, 17 aa, Entamoeba histolytica
IYFGTAQTMYEFDSDAL

SEQ ID NO: 2741760 - protein, 25 aa, Entamoeba histolytica
IYGSKYYWGNLFGSSYKYAYASSTP

SEQ ID NO: 2741761 - protein, 17 aa, Entamoeba histolytica
IYTNALTVFEEYNNRSK

SEQ ID NO: 2741762 - protein, 23 aa, Entamoeba histolytica
KAAHKMNKDSSWFISAEKGPSGS

SEQ ID NO: 2741763 - protein, 31 aa, Entamoeba histolytica
KADKKTFYSILYRSLLFPHNITENGYYKSPF

SEQ ID NO: 2741764 - protein, 25 aa, Entamoeba histolytica
KAEKKALLIRKMLLEKADEINEKRS

SEQ ID NO: 2741765 - protein, 31 aa, Entamoeba histolytica
KAEKKFIKKEKKLIKLQKRFAKASKSERKTL

SEQ ID NO: 2741766 - protein, 26 aa, Entamoeba histolytica
KAELQQFYLFLIQSILPREDIIKYLS

SEQ ID NO: 2741767 - protein, 32 aa, Entamoeba histolytica
KAFTKFNAKRRLLKAQMKKVKNLKKALRKAHG

SEQ ID NO: 2741768 - protein, 18 aa, Entamoeba histolytica
KAIAKRMKVLINRLRIKV

SEQ ID NO: 2741769 - protein, 30 aa, Entamoeba histolytica
KAKLVKGMKKLLASVPTYVKERIINTLHIE

SEQ ID NO: 2741770 - protein, 21 aa, Entamoeba histolytica
KAMNYIYLFNGKTKFFESKNK

SEQ ID NO: 2741771 - protein, 24 aa, Entamoeba histolytica
KATGSKVLIIYTGGTIGMLKGKNG

SEQ ID NO: 2741772 - protein, 21 aa, Entamoeba histolytica
KDALLVKKLRFENSIERDKEA

SEQ ID NO: 2741773 - protein, 55 aa, Entamoeba histolytica
KDISKVWKKKWASFMDKKLLKYLSKIKLPKKRREFYKLMKRRYWKECCNCSCCKH

SEQ ID NO: 2741774 - protein, 17 aa, Entamoeba histolytica
KDKKAIAKLAKKAKDAK

SEQ ID NO: 2741775 - protein, 23 aa, Entamoeba histolytica
KDLTLPPALIKSKQLVVKRLEEK

SEQ ID NO: 2741776 - protein, 27 aa, Entamoeba histolytica
KDLYEKYNYKLPFPIKMHCLISSGHES

SEQ ID NO: 2741777 - protein, 46 aa, Entamoeba histolytica
KDPEKLKQMLRLYVRRVFVSGDFYTTLPDYLTFIRGVIDSDDLPLN

SEQ ID NO: 2741778 - protein, 25 aa, Entamoeba histolytica
KDQLRMHYHDLRLAANPTSRVQLER

SEQ ID NO: 2741779 - protein, 25 aa, Entamoeba histolytica
KDQYYRLAALKERQKMQIKASKELL

SEQ ID NO: 2741780 - protein, 25 aa, Entamoeba histolytica
KDSKTFLSFFNKTQSQYLCIQLINL

SEQ ID NO: 2741781 - protein, 19 aa, Entamoeba histolytica
KDWFRAWVNVDIAVPWKSE

SEQ ID NO: 2741782 - protein, 17 aa, Entamoeba histolytica
KDYKYHFNIKTFSIIRT

SEQ ID NO: 2741783 - protein, 19 aa, Entamoeba histolytica
KDYPKHFYLPFSNNNLCYQ

SEQ ID NO: 2741784 - protein, 23 aa, Entamoeba histolytica
KEAPEIKIWKKERCPRNSDELAN

SEQ ID NO: 2741785 - protein, 23 aa, Entamoeba histolytica
KECQNLRVTTHTITNNINKSKNN

SEQ ID NO: 2741786 - protein, 43 aa, Entamoeba histolytica
KEERNREVTHIQIEPKQHKRMYNGYNIQLKGEVSQEPTMTLTH

SEQ ID NO: 2741787 - protein, 19 aa, Entamoeba histolytica
KEFYKYNYVGTGDDKNLTS

SEQ ID NO: 2741788 - protein, 21 aa, Entamoeba histolytica
KEIIKKRYRKQIKQLYSDMTT

SEQ ID NO: 2741789 - protein, 17 aa, Entamoeba histolytica
KEIRRRILQARKNYNSW

SEQ ID NO: 2741790 - protein, 29 aa, Entamoeba histolytica
KEKLYVNFNLRTPYLFVPIVKLVDAIAFR

SEQ ID NO: 2741791 - protein, 26 aa, Entamoeba histolytica
KENLFREKSYLRRKLIELEGLAEKRK

SEQ ID NO: 2741792 - protein, 30 aa, Entamoeba histolytica
KEPFMFINNIRFIKFAFSLRYQFIDYWYSS

SEQ ID NO: 2741793 - protein, 30 aa, Entamoeba histolytica
KERINKILNELYKKIAIKKTLLDMSKESQK

SEQ ID NO: 2741794 - protein, 24 aa, Entamoeba histolytica
KESLKVIHFYVWDSAITPNGRKIV

SEQ ID NO: 2741795 - protein, 27 aa, Entamoeba histolytica
KEVQRDLKLFPYKIINKNNKPFIEVKY

SEQ ID NO: 2741796 - protein, 20 aa, Entamoeba histolytica
KFCVYLLTSINPGFKYHTYI

SEQ ID NO: 2741797 - protein, 26 aa, Entamoeba histolytica
KFGIHGYPTITFFPKDFKYGKDFMYE

SEQ ID NO: 2741798 - protein, 18 aa, Entamoeba histolytica
KFGKKYIGFKSPHAQFEK

SEQ ID NO: 2741799 - protein, 25 aa, Entamoeba histolytica
KFSRAGSWPIWYPHYDGKKTFSDFK

SEQ ID NO: 2741800 - protein, 17 aa, Entamoeba histolytica
KFYRLRVSTFEYNINNY

SEQ ID NO: 2741801 - protein, 25 aa, Entamoeba histolytica
KGCKNLQYIFGKKKLCFPHDGRWWN

SEQ ID NO: 2741802 - protein, 31 aa, Entamoeba histolytica
KGCKNLQYIFGKKKLCFPQDGRWWNFTIVKN

SEQ ID NO: 2741803 - protein, 20 aa, Entamoeba histolytica
KGEFKKLFYGKSLLNINVTA

SEQ ID NO: 2741804 - protein, 26 aa, Entamoeba histolytica
KGEKPVFIKFFAPWCGHCKRLAPIYE

SEQ ID NO: 2741805 - protein, 26 aa, Entamoeba histolytica
KGEVSQEPTMTLTHESTEAQNIQTKQ

SEQ ID NO: 2741806 - protein, 26 aa, Entamoeba histolytica
KGGDFPCEYYYSNIPFKPIFNNNQRK

SEQ ID NO: 2741807 - protein, 21 aa, Entamoeba histolytica
KGRFEYERYLLYLTKQTNTTG

SEQ ID NO: 2741808 - protein, 18 aa, Entamoeba histolytica
KGRSHKYKDLLDASKKLA

SEQ ID NO: 2741809 - protein, 18 aa, Entamoeba histolytica
KGWFRSWVTVKDAISFTD

SEQ ID NO: 2741810 - protein, 20 aa, Entamoeba histolytica
KHFRRRIPPKFIRKVRHHHC

SEQ ID NO: 2741811 - protein, 18 aa, Entamoeba histolytica
KHIPIMIEDKPRLQWRGL

SEQ ID NO: 2741812 - protein, 23 aa, Entamoeba histolytica
KHIPRNKCIWKKDKYVYKQPKQK

SEQ ID NO: 2741813 - protein, 25 aa, Entamoeba histolytica
KIDTSYLNFVVLPVKTGNITEVFSP

SEQ ID NO: 2741814 - protein, 19 aa, Entamoeba histolytica
KIKAVKKNDAKLIKKSNKK

SEQ ID NO: 2741815 - protein, 17 aa, Entamoeba histolytica
KILEIYPYFIVNEIKNT

SEQ ID NO: 2741816 - protein, 18 aa, Entamoeba histolytica
KIPIGFGALIHDAKYYLP

SEQ ID NO: 2741817 - protein, 18 aa, Entamoeba histolytica
KIPSTLLIYSLNGNAIEL

SEQ ID NO: 2741818 - protein, 23 aa, Entamoeba histolytica
KIQKQVFAIIPPNSQAIGISEIT

SEQ ID NO: 2741819 - protein, 22 aa, Entamoeba histolytica
KKAAKILLKKYSKILARKNNHK

SEQ ID NO: 2741820 - protein, 18 aa, Entamoeba histolytica
KKAYRTLSLKYHPDKPTG

SEQ ID NO: 2741821 - protein, 25 aa, Entamoeba histolytica
KKCSCYKVKALKLKLKKLSKKMCDL

SEQ ID NO: 2741822 - protein, 24 aa, Entamoeba histolytica
KKDKKAIAKLAKKDKKALAKIAKK

SEQ ID NO: 2741823 - protein, 20 aa, Entamoeba histolytica
KKFNAFLHDDTWKNQMQLKW

SEQ ID NO: 2741824 - protein, 19 aa, Entamoeba histolytica
KKFVFFEKLGYFPNHYDFS

SEQ ID NO: 2741825 - protein, 24 aa, Entamoeba histolytica
KKGKKIHPFFLLVAKSETDKEIIN

SEQ ID NO: 2741826 - protein, 32 aa, Entamoeba histolytica
KKKHIATRKTILEKRIVVLRRIMTLNEKKLSQ

SEQ ID NO: 2741827 - protein, 18 aa, Entamoeba histolytica
KKKLGGVMFWSLDLDKNY

SEQ ID NO: 2741828 - protein, 24 aa, Entamoeba histolytica
KKKLKKEFMLKKKIMNLKRCLRTR

SEQ ID NO: 2741829 - protein, 37 aa, Entamoeba histolytica
KKMFNTPVVKKYVPQKPRYYKPTKFVTPVESTVGGFV

SEQ ID NO: 2741830 - protein, 22 aa, Entamoeba histolytica
KKMWYSSVFTLLYSQNPTLGTL

SEQ ID NO: 2741831 - protein, 26 aa, Entamoeba histolytica
KKNIKLVFTALPFIRTFLLNETKSLL

SEQ ID NO: 2741832 - protein, 23 aa, Entamoeba histolytica
KKNIKPLTKGLSGKKVPTFSVKG

SEQ ID NO: 2741833 - protein, 26 aa, Entamoeba histolytica
KKNKKLIQSIIFKSGAKMATKMAALA

SEQ ID NO: 2741834 - protein, 30 aa, Entamoeba histolytica
KKTMMKKMKMMKMMMMKKTMKKMMKTTMKT

SEQ ID NO: 2741835 - protein, 17 aa, Entamoeba histolytica
KKVKNLKKALRKAHGSS

SEQ ID NO: 2741836 - protein, 24 aa, Entamoeba histolytica
KKVSFSSYPGFVFSFDDFYMTSND

SEQ ID NO: 2741837 - protein, 18 aa, Entamoeba histolytica
KLCFPHDGRWWNFTIVKN

SEQ ID NO: 2741838 - protein, 19 aa, Entamoeba histolytica
KLEQIVHPILRRYGGVHHR

SEQ ID NO: 2741839 - protein, 24 aa, Entamoeba histolytica
KLHMERWIQVYTYLVPHMKKEIPI

SEQ ID NO: 2741840 - protein, 17 aa, Entamoeba histolytica
KLIDLVGSWREKLLDVE

SEQ ID NO: 2741841 - protein, 18 aa, Entamoeba histolytica
KLIDLVGSWREKLLDVEL

SEQ ID NO: 2741842 - protein, 31 aa, Entamoeba histolytica
KLIHLEDLCLLRLISMRLFSQNVIKTSFGFI

SEQ ID NO: 2741843 - protein, 19 aa, Entamoeba histolytica
KLIKKLKKAGVSKKVLRKV

SEQ ID NO: 2741844 - protein, 24 aa, Entamoeba histolytica
KLKEFRLRRTIAIILKQMATVLTS

SEQ ID NO: 2741845 - protein, 29 aa, Entamoeba histolytica
KLKKLQKRMGLCPLNRLRIKRRLRVYKKE

SEQ ID NO: 2741846 - protein, 17 aa, Entamoeba histolytica
KLPFDIKMQCMISSGYE

SEQ ID NO: 2741847 - protein, 20 aa, Entamoeba histolytica
KLPTGCYCTYSLISKQECIF

SEQ ID NO: 2741848 - protein, 19 aa, Entamoeba histolytica
KLQEINNLQLTAPVSSRSN

SEQ ID NO: 2741849 - protein, 24 aa, Entamoeba histolytica
KLQKKKVNSLLKKASKNASPKKIK

SEQ ID NO: 2741850 - protein, 25 aa, Entamoeba histolytica
KLSKTNPCFIYLQRFGFMKEEDYPE

SEQ ID NO: 2741851 - protein, 29 aa, Entamoeba histolytica
KLTLTGTRTIKTLKLSKSCPLIIDSQITI

SEQ ID NO: 2741852 - protein, 23 aa, Entamoeba histolytica
KLVTNFYGVLNRTLKQLAYAKQI

SEQ ID NO: 2741853 - protein, 26 aa, Entamoeba histolytica
KMDDELIYHYGKYTALLQKFISIVNS

SEQ ID NO: 2741854 - protein, 29 aa, Entamoeba histolytica
KMLESYNNLYVIYKSSLSQSLFVNQTQPT

SEQ ID NO: 2741855 - protein, 19 aa, Entamoeba histolytica
KMLTDHDFWKVFKAAGVVA

SEQ ID NO: 2741856 - protein, 26 aa, Entamoeba histolytica
KMVCRSAIDGLIRKLEHQYLIIVKSR

SEQ ID NO: 2741857 - protein, 25 aa, Entamoeba histolytica
KMVCRSAIDGLIRKLEHQYLTVVRS

SEQ ID NO: 2741858 - protein, 25 aa, Entamoeba histolytica
KNASPKKIKNLKKAEKKFIKKEKKL

SEQ ID NO: 2741859 - protein, 28 aa, Entamoeba histolytica
KNETSRFNFFILYHPLISFMSRNYQRSK

SEQ ID NO: 2741860 - protein, 18 aa, Entamoeba histolytica
KNGAYLRGAGFRSDDIEF

SEQ ID NO: 2741861 - protein, 32 aa, Entamoeba histolytica
KNIELMYEKDGLYYYLLRTEKALFNEYFNEAK

SEQ ID NO: 2741862 - protein, 24 aa, Entamoeba histolytica
KNLIGQFGVGFYSSFLVAENVTVI

SEQ ID NO: 2741863 - protein, 17 aa, Entamoeba histolytica
KNLILNVDKVKIVNKAK

SEQ ID NO: 2741864 - protein, 24 aa, Entamoeba histolytica
KNQDQFPFVVLGNKVDTYEGSPDA

SEQ ID NO: 2741865 - protein, 27 aa, Entamoeba histolytica
KNQNIIVMFIFLLSVVLLCHADSDVQK

SEQ ID NO: 2741866 - protein, 26 aa, Entamoeba histolytica
KNQRRIMNQLFRLKHRMFRVEEKIRR

SEQ ID NO: 2741867 - protein, 24 aa, Entamoeba histolytica
KNSPFKQVRVIRLMKKYVKKLERA

SEQ ID NO: 2741868 - protein, 26 aa, Entamoeba histolytica
KNTKSPLKFWLIEDFLSPEGRIKLKE

SEQ ID NO: 2741869 - protein, 23 aa, Entamoeba histolytica
KNYIDALDKSVKLEKETRVKSLS

SEQ ID NO: 2741870 - protein, 23 aa, Entamoeba histolytica
KNYMSAYYTIRQLSFGKIDLEIH

SEQ ID NO: 2741871 - protein, 30 aa, Entamoeba histolytica
KPITNIKFINSFINFFKNIFERHKTYTVKD

SEQ ID NO: 2741872 - protein, 22 aa, Entamoeba histolytica
KPKIPPMIPIVAQPPIIPVVPI

SEQ ID NO: 2741873 - protein, 17 aa, Entamoeba histolytica
KPPASINVPTKPESQGV

SEQ ID NO: 2741874 - protein, 23 aa, Entamoeba histolytica
KPRKSMGPTQILEAALKNAKKSK

SEQ ID NO: 2741875 - protein, 17 aa, Entamoeba histolytica
KPYINIFMQILANKTLS

SEQ ID NO: 2741876 - protein, 27 aa, Entamoeba histolytica
KQCENKKLFLIEKLHDFIPIENKEIET

SEQ ID NO: 2741877 - protein, 32 aa, Entamoeba histolytica; identical to SEQ ID NO: 2556406

SEQ ID NO: 2741878 - protein, 28 aa, Entamoeba histolytica
KQEQKPFKIPEPEPFKLPEHIETSKLTI

SEQ ID NO: 2741879 - protein, 24 aa, Entamoeba histolytica
KQQRKLVWKTLKNGMKKTITELKD

SEQ ID NO: 2741880 - protein, 26 aa, Entamoeba histolytica
KQRSQLFEPSFINTIPPELTANPMIG

SEQ ID NO: 2741881 - protein, 27 aa, Entamoeba histolytica
KQYKIKDFVPIDWYINSPYLDKEFKLF

SEQ ID NO: 2741882 - protein, 20 aa, Entamoeba histolytica
KRDKAILRRVTIKKNILKRK

SEQ ID NO: 2741883 - protein, 34 aa, Entamoeba histolytica; identical to SEQ ID NO: 2555628

SEQ ID NO: 2741884 - protein, 20 aa, Entamoeba histolytica
KRMKVIVNIIGIKQASFEEE

SEQ ID NO: 2741885 - protein, 18 aa, Entamoeba histolytica
KRMKVLINRLRIKVAIFK

SEQ ID NO: 2741886 - protein, 25 aa, Entamoeba histolytica
KRREMPIMVIYLQSNVIDDAIRKVL

SEQ ID NO: 2741887 - protein, 22 aa, Entamoeba histolytica
KRRGCPCIHKVPDVPCKCSSIK

SEQ ID NO: 2741888 - protein, 26 aa, Entamoeba histolytica
KRVKIVKMIVKLLKMIKKTAEILPKS

SEQ ID NO: 2741889 - protein, 24 aa, Entamoeba histolytica
KSDVYFSIGTFYLNKIKIQESVSN

SEQ ID NO: 2741890 - protein, 21 aa, Entamoeba histolytica
KSMKALKKSLKAKVKKAEKKA

SEQ ID NO: 2741891 - protein, 32 aa, Entamoeba histolytica
KSNAKPTLKKNKLNSPFKFKSANKTKVQNKKT

SEQ ID NO: 2741892 - protein, 23 aa, Entamoeba histolytica
KSPCKMCVELGRRAKESLALNMD

SEQ ID NO: 2741893 - protein, 17 aa, Entamoeba histolytica
KSPHAQFEKACSTFVFA

SEQ ID NO: 2741894 - protein, 21 aa, Entamoeba histolytica
KSQFQFPWSIADFVTQGNRRT

SEQ ID NO: 2741895 - protein, 18 aa, Entamoeba histolytica
KSQWMLNNMSLWWKDWLS

SEQ ID NO: 2741896 - protein, 24 aa, Entamoeba histolytica
KSSDKVPVNIKPEQPQSAQNQQLQ

SEQ ID NO: 2741897 - protein, 24 aa, Entamoeba histolytica
KTIEKKWRAQRKALIMLERARDAK

SEQ ID NO: 2741898 - protein, 21 aa, Entamoeba histolytica
KTLQLMLIEALTKENTLIQFE

SEQ ID NO: 2741899 - protein, 25 aa, Entamoeba histolytica
KTNKFDLTGHYKYKKLDANLNFNHI

SEQ ID NO: 2741900 - protein, 19 aa, Entamoeba histolytica
KTRVELMRTLYKLVGKLSV

SEQ ID NO: 2741901 - protein, 22 aa, Entamoeba histolytica
KTTHWKFKPTLRFIKELFMNQI

SEQ ID NO: 2741902 - protein, 29 aa, Entamoeba histolytica
KTTNLCGIGWRIGDYVYPLNMIVYANTCK

SEQ ID NO: 2741903 - protein, 21 aa, Entamoeba histolytica
KTVAYYTNWAQYRFNSIDGWT

SEQ ID NO: 2741904 - protein, 33 aa, Entamoeba histolytica
KVANEVFIDLWEGYLYFRGFKCNTAQQDNAINT

SEQ ID NO: 2741905 - protein, 21 aa, Entamoeba histolytica
KVIPSEYLLKASPIDKNPVYL

SEQ ID NO: 2741906 - protein, 17 aa, Entamoeba histolytica
KVLDAETLVKLQKLSLG

SEQ ID NO: 2741907 - protein, 22 aa, Entamoeba histolytica
KVSTLQRWIVRCMSDLLSKTDE

SEQ ID NO: 2741908 - protein, 19 aa, Entamoeba histolytica
KWKQQYIYSISKDGELTFE

SEQ ID NO: 2741909 - protein, 33 aa, Entamoeba histolytica
KYAVNLRYQMLPYWYSLWYYHRVDYKPVIRAMY

SEQ ID NO: 2741910 - protein, 17 aa, Entamoeba histolytica
KYFFGTFTDKECKTSSD

SEQ ID NO: 2741911 - protein, 27 aa, Entamoeba histolytica
KYHFNIKTFSIIRTFQHLFSNFIGYAC

SEQ ID NO: 2741912 - protein, 28 aa, Entamoeba histolytica
KYHPDFVSISFYKMFGFPTGVGCLIIKK

SEQ ID NO: 2741913 - protein, 40 aa, Entamoeba histolytica
KYLISFYLEIKLFLRYFLSPLLFFNLIKNDPYQYYCLLYK

SEQ ID NO: 2741914 - protein, 38 aa, Entamoeba histolytica
KYLISFYLEIKLFLRYFLSPLLLFNLIKNDPYQYYCLL

SEQ ID NO: 2741915 - protein, 23 aa, Entamoeba histolytica
KYNGKFIFFSFNKVISEDQVKHM

SEQ ID NO: 2741916 - protein, 19 aa, Entamoeba histolytica
KYPVILYTHGGPESPWTNN

SEQ ID NO: 2741917 - protein, 21 aa, Entamoeba histolytica
KYRPFVLTRSYYIGSQKYGAM

SEQ ID NO: 2741918 - protein, 17 aa, Entamoeba histolytica
KYYLELVEMIKNVGLKY

SEQ ID NO: 2741919 - protein, 24 aa, Entamoeba histolytica
LAFLVFLCLYISFPLTITETPRNL

SEQ ID NO: 2741920 - protein, 17 aa, Entamoeba histolytica
LAMFISFSYAEESEVEL

SEQ ID NO: 2741921 - protein, 21 aa, Entamoeba histolytica
LARERGIFTIRLNSFNPEIEM

SEQ ID NO: 2741922 - protein, 19 aa, Entamoeba histolytica
LARRFDLRHRFDFAIDQEE

SEQ ID NO: 2741923 - protein, 17 aa, Entamoeba histolytica
LCANAITFDQWQSKYKF

SEQ ID NO: 2741924 - protein, 22 aa, Entamoeba histolytica
LCAQNYILVDGKCKYFKEVVPY

SEQ ID NO: 2741925 - protein, 22 aa, Entamoeba histolytica
LCEDSYEWYTLKNECVLGGDDD

SEQ ID NO: 2741926 - protein, 20 aa, Entamoeba histolytica
LCFVIILAAILVLPLHPLFE

SEQ ID NO: 2741927 - protein, 21 aa, Entamoeba histolytica
LCPNNNLPLVLTTNSDDKINV

SEQ ID NO: 2741928 - protein, 37 aa, Entamoeba histolytica
LCVKFRRELPQHYCYFVLDELYFKILQYLESGNRSDQ

SEQ ID NO: 2741929 - protein, 20 aa, Entamoeba histolytica
LDAASSPFIVFCAIIIAIIF

SEQ ID NO: 2741930 - protein, 20 aa, Entamoeba histolytica
LDAETLVKLQKLSLGCHLNG

SEQ ID NO: 2741931 - protein, 21 aa, Entamoeba histolytica
LDLDHKNFYPWIIIADGNGNQ

SEQ ID NO: 2741932 - protein, 23 aa, Entamoeba histolytica
LDLKPIHPIPFPSAAPHNLSADY

SEQ ID NO: 2741933 - protein, 20 aa, Entamoeba histolytica
LDMNILFRAINSYANPIVSS

SEQ ID NO: 2741934 - protein, 19 aa, Entamoeba histolytica
LDPMGKSSLFQYNAEYKPN

SEQ ID NO: 2741935 - protein, 19 aa, Entamoeba histolytica
LDQRIVKCLYKCGMKAHLC

SEQ ID NO: 2741936 - protein, 22 aa, Entamoeba histolytica
LDRRVYHTNLMYGGYKPKATNV

SEQ ID NO: 2741937 - protein, 17 aa, Entamoeba histolytica
LDYEFIPFFVKGNTILL

SEQ ID NO: 2741938 - protein, 27 aa, Entamoeba histolytica
LECCPLPSFDIIFTDSFHSFWTYTNKN

SEQ ID NO: 2741939 - protein, 23 aa, Entamoeba histolytica
LEEEKMVVLFELLVDIATDFGFM

SEQ ID NO: 2741940 - protein, 26 aa, Entamoeba histolytica
LEFTNNIYFMLYKKYQFKFNSFNNKS

SEQ ID NO: 2741941 - protein, 17 aa, Entamoeba histolytica
LEKIGSIIDFKIGWIMT

SEQ ID NO: 2741942 - protein, 19 aa, Entamoeba histolytica
LEMDKLIYCTAEQALMDYV

SEQ ID NO: 2741943 - protein, 26 aa, Entamoeba histolytica
LEMMSFVFYLMRQTIPKAHLVLFLAE

SEQ ID NO: 2741944 - protein, 17 aa, Entamoeba histolytica
LERMVKRLAFKNRINRN

SEQ ID NO: 2741945 - protein, 23 aa, Entamoeba histolytica
LETKLTYNLDDKNKAYASFIKDQ

SEQ ID NO: 2741946 - protein, 29 aa, Entamoeba histolytica
LFDDDESMDLLLNDFSLSSIGSAIGRAVD

SEQ ID NO: 2741947 - protein, 18 aa, Entamoeba histolytica
LFFINYKSYAEDVTPHSL

SEQ ID NO: 2741948 - protein, 18 aa, Entamoeba histolytica
LFGLLLNCNGGKITKKYK

SEQ ID NO: 2741949 - protein, 19 aa, Entamoeba histolytica
LFICFCLSKECSIDSNDFT

SEQ ID NO: 2741950 - protein, 19 aa, Entamoeba histolytica
LFIFSSFGFNDLALMEMVD

SEQ ID NO: 2741951 - protein, 21 aa, Entamoeba histolytica
LFIITFYFRIVSGDWCEFSPN

SEQ ID NO: 2741952 - protein, 17 aa, Entamoeba histolytica
LFQCYGLYDFLDNIFSI

SEQ ID NO: 2741953 - protein, 18 aa, Entamoeba histolytica
LFSLGKYYKGEFKKLFYG

SEQ ID NO: 2741954 - protein, 18 aa, Entamoeba histolytica
LFSVFTFAEEEFTIDEDF

SEQ ID NO: 2741955 - protein, 18 aa, Entamoeba histolytica
LFVFMINAQFTTQENVQE

SEQ ID NO: 2741956 - protein, 18 aa, Entamoeba histolytica
LFVFMINAQFTTQETVQE

SEQ ID NO: 2741957 - protein, 21 aa, Entamoeba histolytica
LFVITCYSYQYICVETIEKKD

SEQ ID NO: 2741958 - protein, 20 aa, Entamoeba histolytica
LGDNQLYIRYTYPSIEHVRF

SEQ ID NO: 2741959 - protein, 18 aa, Entamoeba histolytica
LGKHGHLLILNSNDIWNY

SEQ ID NO: 2741960 - protein, 19 aa, Entamoeba histolytica
LGKPLQPDFFISKDSKLRV

SEQ ID NO: 2741961 - protein, 17 aa, Entamoeba histolytica
LGLQPSAFKSKSADIVL

SEQ ID NO: 2741962 - protein, 19 aa, Entamoeba histolytica
LGSFLPFSIYINDDKKMHL

SEQ ID NO: 2741963 - protein, 24 aa, Entamoeba histolytica
LGSIGCLFPMYEAKLRDVPELGYL

SEQ ID NO: 2741964 - protein, 32 aa, Entamoeba histolytica
LHLDHVGMPFTNGFWYLMEKAGITFGKFIDRD

SEQ ID NO: 2741965 - protein, 17 aa, Entamoeba histolytica
LHTIKDHTWNIFSTSAI

SEQ ID NO: 2741966 - protein, 25 aa, Entamoeba histolytica
LHYKGSIFHRVIPGFMIQGGDFTRF

SEQ ID NO: 2741967 - protein, 17 aa, Entamoeba histolytica
LIAASFALYEEDFLDNF

SEQ ID NO: 2741968 - protein, 17 aa, Entamoeba histolytica
LIAFSNGQMYAMVSTFG

SEQ ID NO: 2741969 - protein, 18 aa, Entamoeba histolytica
LIEKILEGGSAKLICGLI

SEQ ID NO: 2741970 - protein, 23 aa, Entamoeba histolytica
LIGVFLFLLKMYCSGRQNLVEKD

SEQ ID NO: 2741971 - protein, 20 aa, Entamoeba histolytica
LIGYCQFLNQSFDYLTILEL

SEQ ID NO: 2741972 - protein, 18 aa, Entamoeba histolytica
LIICIHAKAYDCIPLGDK

SEQ ID NO: 2741973 - protein, 19 aa, Entamoeba histolytica
LIILLVTVDARRSTKKSSV

SEQ ID NO: 2741974 - protein, 18 aa, Entamoeba histolytica
LIISIANAEGIYSEAKSE

SEQ ID NO: 2741975 - protein, 19 aa, Entamoeba histolytica
LIIVNFSFAINFDQWKIKY

SEQ ID NO: 2741976 - protein, 18 aa, Entamoeba histolytica
LIIVTFGKNTMDLCVVQK

SEQ ID NO: 2741977 - protein, 18 aa, Entamoeba histolytica
LIKQYKSTHLLVKNIKDT

SEQ ID NO: 2741978 - protein, 25 aa, Entamoeba histolytica
LINRLRIKVAIFKRKIDKCKNSPFK

SEQ ID NO: 2741979 - protein, 17 aa, Entamoeba histolytica
LIQYVNSLHPLMKQNLT

SEQ ID NO: 2741980 - protein, 17 aa, Entamoeba histolytica
LIVAQNPECSSAYCSSC

SEQ ID NO: 2741981 - protein, 18 aa, Entamoeba histolytica
LIVCINAYPYFGVSAVEK

SEQ ID NO: 2741982 - protein, 17 aa, Entamoeba histolytica
LIYLYKSLGYGEQAEPL

SEQ ID NO: 2741983 - protein, 17 aa, Entamoeba histolytica
LIYWFRVWDHKYRLKYS

SEQ ID NO: 2741984 - protein, 18 aa, Entamoeba histolytica
LKEVKCLLKKSGVKGSLN

SEQ ID NO: 2741985 - protein, 29 aa, Entamoeba histolytica
LKIRVRQNTLMLRALKRKINRATIAYNAK

SEQ ID NO: 2741986 - protein, 34 aa, Entamoeba histolytica
LKKVRVATIKQIKNLRIMLAARVAVYNKSKIVRI

SEQ ID NO: 2741987 - protein, 20 aa, Entamoeba histolytica
LKLFKVVKRIQKVNQLFFRH

SEQ ID NO: 2741988 - protein, 17 aa, Entamoeba histolytica
LKMIKKTAEILPKSMSK

SEQ ID NO: 2741989 - protein, 27 aa, Entamoeba histolytica
LKSGFTLHGWWPNFVSGYPSCCKSPYT

SEQ ID NO: 2741990 - protein, 19 aa, Entamoeba histolytica
LKSVIKRMKVIVNIIGIKQ

SEQ ID NO: 2741991 - protein, 27 aa, Entamoeba histolytica
LKVIQTFMFRYMAPLQFGIIPINIPTN

SEQ ID NO: 2741992 - protein, 25 aa, Entamoeba histolytica
LKVKNLQRVVSWMKKKLETRKLYIA

SEQ ID NO: 2741993 - protein, 20 aa, Entamoeba histolytica
LKVPSYFPAIKYCKNEELRK

SEQ ID NO: 2741994 - protein, 20 aa, Entamoeba histolytica
LLCLAFEDNLLFKATQKKQF

SEQ ID NO: 2741995 - protein, 19 aa, Entamoeba histolytica
LLFVILNSYALYYPSNPNI

SEQ ID NO: 2741996 - protein, 21 aa, Entamoeba histolytica
LLFVTLVLSSPLLDMKIKTEQ

SEQ ID NO: 2741997 - protein, 28 aa, Entamoeba histolytica
LLIFPFVQSKYFITFYDSYIQVLNEGHC

SEQ ID NO: 2741998 - protein, 18 aa, Entamoeba histolytica
LLILLILCCDGKKTNKYD

SEQ ID NO: 2741999 - protein, 17 aa, Entamoeba histolytica
LLLILHCNSKTTDGRDQ

SEQ ID NO: 2742000 - protein, 30 aa, Entamoeba histolytica
LLLLFIILSTGKYIGFFPSNHECSMNDTCV

SEQ ID NO: 2742001 - protein, 19 aa, Entamoeba histolytica
LLLSVIADDEFYHFRHGCI

SEQ ID NO: 2742002 - protein, 20 aa, Entamoeba histolytica
LLNPLTRDCIPEYLTLNYNN

SEQ ID NO: 2742003 - protein, 19 aa, Entamoeba histolytica
LLQKGYWASYNSPFSKKIR

SEQ ID NO: 2742004 - protein, 21 aa, Entamoeba histolytica
LLSNKRLMRFCPNGIDLDKNV

SEQ ID NO: 2742005 - protein, 17 aa, Entamoeba histolytica
LLTLVNSFQFNYFSLEL

SEQ ID NO: 2742006 - protein, 17 aa, Entamoeba histolytica
LLVILCVRGNDINEVLK

SEQ ID NO: 2742007 - protein, 27 aa, Entamoeba histolytica
LMGKMKRCLPIWKQDLPSLKRKLNVVD

SEQ ID NO: 2742008 - protein, 18 aa, Entamoeba histolytica
LMIRRWDTYWDGQFQHLF

SEQ ID NO: 2742009 - protein, 17 aa, Entamoeba histolytica
LMRFCPNGITLNKNVIC

SEQ ID NO: 2742010 - protein, 17 aa, Entamoeba histolytica
LMYSDPLSNRGIVYISR

SEQ ID NO: 2742011 - protein, 18 aa, Entamoeba histolytica
LNGVYVQTLWPLKPHDDM

SEQ ID NO: 2742012 - protein, 31 aa, Entamoeba histolytica
LNIELMYEKDGLYYYLLRTEKVSFNEYFNEA

SEQ ID NO: 2742013 - protein, 19 aa, Entamoeba histolytica
LNIIMKTAIFFKTTASIGL

SEQ ID NO: 2742014 - protein, 19 aa, Entamoeba histolytica
LNLDFWRESTYLDTNYVFD

SEQ ID NO: 2742015 - protein, 18 aa, Entamoeba histolytica
LNQQSRLLHKEEQSTKAP

SEQ ID NO: 2742016 - protein, 19 aa, Entamoeba histolytica
LNSTYIKELNFAKKSLMNE

SEQ ID NO: 2742017 - protein, 24 aa, Entamoeba histolytica
LPDKYYGMFLGYAMDAYGLNPGML

SEQ ID NO: 2742018 - protein, 21 aa, Entamoeba histolytica
LPINVIINGGYVLEKKLLRIC

SEQ ID NO: 2742019 - protein, 20 aa, Entamoeba histolytica
LPKEIIFPAQPPIGLQVTWS

SEQ ID NO: 2742020 - protein, 17 aa, Entamoeba histolytica
LPKKEAPEIKIWKKERC

SEQ ID NO: 2742021 - protein, 19 aa, Entamoeba histolytica
LPLNKLVHSLYSFYKSQIL

SEQ ID NO: 2742022 - protein, 17 aa, Entamoeba histolytica
LPNRFWIGESTTPKSER

SEQ ID NO: 2742023 - protein, 20 aa, Entamoeba histolytica
LPYYDIIELNPLLDSSAMTP

SEQ ID NO: 2742024 - protein, 17 aa, Entamoeba histolytica
LQGKLDKKYILKRQEVA

SEQ ID NO: 2742025 - protein, 26 aa, Entamoeba histolytica
LQSMLLTPPSFLLQAYIKALLKKETS

SEQ ID NO: 2742026 - protein, 20 aa, Entamoeba histolytica
LQTIFSKKKLCFPDNGRWLN

SEQ ID NO: 2742027 - protein, 34 aa, Entamoeba histolytica
LQYILNKKKFCFPLNGRWWNFTIVKNTIQGREYS

SEQ ID NO: 2742028 - protein, 26 aa, Entamoeba histolytica
LRGYIDLIFAIKRILKRITTSFLKQH

SEQ ID NO: 2742029 - protein, 19 aa, Entamoeba histolytica
LRLHKNNTFYPFRLNEIPS

SEQ ID NO: 2742030 - protein, 20 aa, Entamoeba histolytica
LRLVRGERTFIYLIGHGGEG

SEQ ID NO: 2742031 - protein, 25 aa, Entamoeba histolytica
LRPYWKCYYEKCSAIIFVVDSTAID

SEQ ID NO: 2742032 - protein, 24 aa, Entamoeba histolytica
LRRLDTKIALKKKVLKLQSQDANM

SEQ ID NO: 2742033 - protein, 19 aa, Entamoeba histolytica
LRRVTIKKNILKRKKNSAT

SEQ ID NO: 2742034 - protein, 21 aa, Entamoeba histolytica
LRSERKMVRVLIKSKERATKR

SEQ ID NO: 2742035 - protein, 23 aa, Entamoeba histolytica
LSEKIILRPFQLPVSIGSGIQQM

SEQ ID NO: 2742036 - protein, 20 aa, Entamoeba histolytica
LSFKFKTLKHQKLDKSYITI

SEQ ID NO: 2742037 - protein, 23 aa, Entamoeba histolytica
LSFLFIFCHALICNETNCSTIEN

SEQ ID NO: 2742038 - protein, 17 aa, Entamoeba histolytica
LSFLIISVSSQAECRGK

SEQ ID NO: 2742039 - protein, 18 aa, Entamoeba histolytica
LSICIHAKAYDCIPLGDK

SEQ ID NO: 2742040 - protein, 17 aa, Entamoeba histolytica
LSKFRIHNFQKQHAELL

SEQ ID NO: 2742041 - protein, 20 aa, Entamoeba histolytica
LSNKRLMRFCPNGITLNKNV

SEQ ID NO: 2742042 - protein, 34 aa, Entamoeba histolytica
LSQLVPYFNTVAAFFRPKIAIGLLPQGKKMKSLE

SEQ ID NO: 2742043 - protein, 25 aa, Entamoeba histolytica
LSRNLPRYYIYPGGYLSIFSQDIIK

SEQ ID NO: 2742044 - protein, 25 aa, Entamoeba histolytica
LSRYWLNYRHTNSGVLIYNTLKRLG

SEQ ID NO: 2742045 - protein, 20 aa, Entamoeba histolytica
LSWQRILGSMYYAPSIQKLL

SEQ ID NO: 2742046 - protein, 28 aa, Entamoeba histolytica
LTGIVMSESIVISLIKNLEGNTRIFTSI

SEQ ID NO: 2742047 - protein, 22 aa, Entamoeba histolytica
LTGVKVVKDLTLPPALIKSKQL

SEQ ID NO: 2742048 - protein, 35 aa, Entamoeba histolytica
LTTSSIQFKSISPSTLPLIISDTLTFTTMDITTTN

SEQ ID NO: 2742049 - protein, 25 aa, Entamoeba histolytica
LVEFVPMLLSQIQQLALKKLVIYVY

SEQ ID NO: 2742050 - protein, 20 aa, Entamoeba histolytica
LVFFSLLAVSFAAIVGMDVG

SEQ ID NO: 2742051 - protein, 24 aa, Entamoeba histolytica
LVGKLSVPQQGRLIRYLNLEHRID

SEQ ID NO: 2742052 - protein, 19 aa, Entamoeba histolytica
LVIFFTNNSIIIPLTEKVP

SEQ ID NO: 2742053 - protein, 27 aa, Entamoeba histolytica
LVIVLVSLIILYHFRPNGYDPKLNGCF

SEQ ID NO: 2742054 - protein, 18 aa, Entamoeba histolytica
LVKFFVPWCGHCNSLKPI

SEQ ID NO: 2742055 - protein, 24 aa, Entamoeba histolytica
LVKKLKQYFGTTPIIFAMGNNDTP

SEQ ID NO: 2742056 - protein, 17 aa, Entamoeba histolytica
LVLTNAHFFGDAPIYMP

SEQ ID NO: 2742057 - protein, 17 aa, Entamoeba histolytica
LVTTFSAVLNRTLKQLA

SEQ ID NO: 2742058 - protein, 17 aa, Entamoeba histolytica
LVVFVSATPKTNSTEKK

SEQ ID NO: 2742059 - protein, 18 aa, Entamoeba histolytica
LVYQVVSYSLCSGKIYYR

SEQ ID NO: 2742060 - protein, 20 aa, Entamoeba histolytica
LYSIIKKMVRRSVGKNAIMR

SEQ ID NO: 2742061 - protein, 24 aa, Entamoeba histolytica
MDASRSSFLLYHGGIYNDKKCRSD

SEQ ID NO: 2742062 - protein, 19 aa, Entamoeba histolytica
MFFIQFTLSVEIKQCITVN

SEQ ID NO: 2742063 - protein, 24 aa, Entamoeba histolytica
MFYLDYHVPYTNKFKLIYSVPSGS

SEQ ID NO: 2742064 - protein, 25 aa, Entamoeba histolytica
MGVNYLGHFLLTQKLLSALEKCNGR

SEQ ID NO: 2742065 - protein, 20 aa, Entamoeba histolytica
MIEDKPRLQWRGLMIDVARN

SEQ ID NO: 2742066 - protein, 19 aa, Entamoeba histolytica
MIKRAVIARLNSAKTARCV

SEQ ID NO: 2742067 - protein, 18 aa, Entamoeba histolytica
MKFKVQVEILKKNKAKSK

SEQ ID NO: 2742068 - protein, 27 aa, Entamoeba histolytica
MLDFNHQLPIFWYFSAKHNQTEHDTIK

SEQ ID NO: 2742069 - protein, 18 aa, Entamoeba histolytica
MLNDHDFWKVFKAAGVVA

SEQ ID NO: 2742070 - protein, 18 aa, Entamoeba histolytica
MNALPVGTQFPFVKLRDV

SEQ ID NO: 2742071 - protein, 21 aa, Entamoeba histolytica
MNRYPINWTPKVKLYCLYSSG

SEQ ID NO: 2742072 - protein, 19 aa, Entamoeba histolytica
MSIVFTYLYPRIDTNVSVQ

SEQ ID NO: 2742073 - protein, 19 aa, Entamoeba histolytica
MSKRNIMKFFKRKQYQSKK

SEQ ID NO: 2742074 - protein, 24 aa, Entamoeba histolytica
MSLKAKFNRKIKLQLARKAKKMAK

SEQ ID NO: 2742075 - protein, 18 aa, Entamoeba histolytica
MSLVVAFILTFTNAEEEL

SEQ ID NO: 2742076 - protein, 17 aa, Entamoeba histolytica
MTAIKMLTDHDFWKVFK

SEQ ID NO: 2742077 - protein, 18 aa, Entamoeba histolytica
MTCLKKFVFFEKLGYFPN

SEQ ID NO: 2742078 - protein, 20 aa, Entamoeba histolytica
MYECFGWCAAYPKSQFQFPW

SEQ ID NO: 2742079 - protein, 17 aa, Entamoeba histolytica
MYYKFITLNQPFEVLNF

SEQ ID NO: 2742080 - protein, 27 aa, Entamoeba histolytica
NAAGDVRKKLYDGLKSQCWFKALQSCG

SEQ ID NO: 2742081 - protein, 24 aa, Entamoeba histolytica
NAAQLRLNFLQKELALLKKGLHEN

SEQ ID NO: 2742082 - protein, 18 aa, Entamoeba histolytica
NAEMILGYLTIMLCIFSL

SEQ ID NO: 2742083 - protein, 30 aa, Entamoeba histolytica
NAEMINMIYKQLAELKIYKKKQIQCARRTF

SEQ ID NO: 2742084 - protein, 26 aa, Entamoeba histolytica
NAKLNRIHYVLQGLRKNLSELRMTKN

SEQ ID NO: 2742085 - protein, 27 aa, Entamoeba histolytica
NCCQVHFVQYFLPSSQLSFIPTSSTPS

SEQ ID NO: 2742086 - protein, 17 aa, Entamoeba histolytica
NCDLCQVGYYVNGNKCS

SEQ ID NO: 2742087 - protein, 17 aa, Entamoeba histolytica
NCWNVPVIGGWCSTKRS

SEQ ID NO: 2742088 - protein, 24 aa, Entamoeba histolytica
NDIDKEIFSVLSPEFRKLLQEMSD

SEQ ID NO: 2742089 - protein, 26 aa, Entamoeba histolytica
NDNIKQLIFKFKRLFKGEFKTTNLIT

SEQ ID NO: 2742090 - protein, 22 aa, Entamoeba histolytica
NDPNAPLFVLLGGEGPASPKVL

SEQ ID NO: 2742091 - protein, 33 aa, Entamoeba histolytica
NDTWIMMEYEDKMLLMLKSFTTVKMKEIHGMTL

SEQ ID NO: 2742092 - protein, 28 aa, Entamoeba histolytica
NDVCAPYLQIKLLRLLRIMNPSTKYYQQ

SEQ ID NO: 2742093 - protein, 23 aa, Entamoeba histolytica
NEFNGIVFLFKYNETIDTFEFYQ

SEQ ID NO: 2742094 - protein, 18 aa, Entamoeba histolytica
NEIKKLMMKGVESIIAQA

SEQ ID NO: 2742095 - protein, 17 aa, Entamoeba histolytica
NELIGIEIRCREGIRWS

SEQ ID NO: 2742096 - protein, 25 aa, Entamoeba histolytica
NEMRKVQRRLSFLSKAQLKARKDYD

SEQ ID NO: 2742097 - protein, 19 aa, Entamoeba histolytica
NENAPIIRKYITSNCYFDS

SEQ ID NO: 2742098 - protein, 23 aa, Entamoeba histolytica
NEQLRKRIIFSQEKCQSIAREIR

SEQ ID NO: 2742099 - protein, 24 aa, Entamoeba histolytica
NETQYLQVYIPKGIWYNYLIDERI

SEQ ID NO: 2742100 - protein, 25 aa, Entamoeba histolytica
NFERRFELFHFLQDLAALNECCFVH

SEQ ID NO: 2742101 - protein, 20 aa, Entamoeba histolytica
NFHYRWNPQVIAAQGYIVFA

SEQ ID NO: 2742102 - protein, 18 aa, Entamoeba histolytica
NFPLSIFAKCFHDLIKKF

SEQ ID NO: 2742103 - protein, 17 aa, Entamoeba histolytica
NFVLSNYSGLWLNYCPH

SEQ ID NO: 2742104 - protein, 19 aa, Entamoeba histolytica
NFWGPKISFSKSPYYTMGF

SEQ ID NO: 2742105 - protein, 25 aa, Entamoeba histolytica
NGGAILYYDYYLTDQPIRFKKLWEY

SEQ ID NO: 2742106 - protein, 23 aa, Entamoeba histolytica
NGGSILYVFAYTKRNGVMQEKDY

SEQ ID NO: 2742107 - protein, 26 aa, Entamoeba histolytica
NGKLSDYWIPTLLTTSIYTPPEVLNG

SEQ ID NO: 2742108 - protein, 33 aa, Entamoeba histolytica
NGLEGIKVKCTMCRNLAAFLLQKVRRDRMSPKE

SEQ ID NO: 2742109 - protein, 19 aa, Entamoeba histolytica
NGTEYWIVRNSWGTIWGDQ

SEQ ID NO: 2742110 - protein, 20 aa, Entamoeba histolytica
NGTTLTKSFYFLDNNYINIK

SEQ ID NO: 2742111 - protein, 22 aa, Entamoeba histolytica
NHGFKFNAFYLNGVFINPEKMV

SEQ ID NO: 2742112 - protein, 17 aa, Entamoeba histolytica
NICSSCVSGYYLNSNNK

SEQ ID NO: 2742113 - protein, 21 aa, Entamoeba histolytica
NIDGTTPTIIILSIVITFLFF

SEQ ID NO: 2742114 - protein, 24 aa, Entamoeba histolytica
NINAYIMALKLFPNYYFYTRVDDE

SEQ ID NO: 2742115 - protein, 19 aa, Entamoeba histolytica
NIWDIINLKKIRKLVIACE

SEQ ID NO: 2742116 - protein, 36 aa, Entamoeba histolytica
NKEVIHTHMYSKQHKIMYNLYKAELKGEVTTQITDE

SEQ ID NO: 2742117 - protein, 23 aa, Entamoeba histolytica
NKIERETFFLMKNKTDKNSKRLM

SEQ ID NO: 2742118 - protein, 25 aa, Entamoeba histolytica
NKKNIKRWLVICKTELIFKKNMEDF

SEQ ID NO: 2742119 - protein, 23 aa, Entamoeba histolytica
NKNIRRFMSLQFNFWRKHIKNNE

SEQ ID NO: 2742120 - protein, 17 aa, Entamoeba histolytica
NKPFIKVTLKGEEKIYS

SEQ ID NO: 2742121 - protein, 17 aa, Entamoeba histolytica
NKRLWRDMRISEMEAKM

SEQ ID NO: 2742122 - protein, 19 aa, Entamoeba histolytica
NKRLWRDMRISEMEAKMQF

SEQ ID NO: 2742123 - protein, 27 aa, Entamoeba histolytica
NKRSVQLCFLIGILSRFCSLTFQRPRK

SEQ ID NO: 2742124 - protein, 19 aa, Entamoeba histolytica
NKSYFKYKTLKELISLNQM

SEQ ID NO: 2742125 - protein, 26 aa, Entamoeba histolytica
NKTQSQYLCIQLINLLEKKKENQSNE

SEQ ID NO: 2742126 - protein, 17 aa, Entamoeba histolytica
NKYPLFIKEKYNPEWAD

SEQ ID NO: 2742127 - protein, 26 aa, Entamoeba histolytica
NLCDAYAFLLALLSKSCSIKVSKPRH

SEQ ID NO: 2742128 - protein, 30 aa, Entamoeba histolytica
NLHTFHSMFIFLLIIVITNATESIVNKEER

SEQ ID NO: 2742129 - protein, 28 aa, Entamoeba histolytica
NLKTFTEIVLIFLLAQKGWSFYIKKPHK

SEQ ID NO: 2742130 - protein, 17 aa, Entamoeba histolytica
NLPLHLVRFGTESQSCI

SEQ ID NO: 2742131 - protein, 23 aa, Entamoeba histolytica
NMVNYRFMLYKEYLKEHEGEIDR

SEQ ID NO: 2742132 - protein, 18 aa, Entamoeba histolytica
NMWPSYNVPFDKEIYSKS

SEQ ID NO: 2742133 - protein, 19 aa, Entamoeba histolytica
NNDGSLLYYLSMSAPKDES

SEQ ID NO: 2742134 - protein, 23 aa, Entamoeba histolytica
NNKKADLTLSYNPSDKFSVDGKV

SEQ ID NO: 2742135 - protein, 23 aa, Entamoeba histolytica
NNKLFKQFLTFKSVLSWQRILGS

SEQ ID NO: 2742136 - protein, 22 aa, Entamoeba histolytica
NNLDGTSPVFMLLAFVIQLIFF

SEQ ID NO: 2742137 - protein, 22 aa, Entamoeba histolytica
NNLDNSTSIFVILSGIITLFFF

SEQ ID NO: 2742138 - protein, 22 aa, Entamoeba histolytica
NNLDSTTNIFILLSFMIIFTIF

SEQ ID NO: 2742139 - protein, 23 aa, Entamoeba histolytica
NNNQQIFSCDGKMLFTSKLSDEE

SEQ ID NO: 2742140 - protein, 18 aa, Entamoeba histolytica
NNPYVLDEKTKQCMSACP

SEQ ID NO: 2742141 - protein, 21 aa, Entamoeba histolytica
NNQFKLWKKQFEEKKIEFEKR

SEQ ID NO: 2742142 - protein, 23 aa, Entamoeba histolytica
NNQRFVYVHPYKTEWYPEYNNRN

SEQ ID NO: 2742143 - protein, 24 aa, Entamoeba histolytica
NPAKYFVLYDLEDGSYRADVTLNE

SEQ ID NO: 2742144 - protein, 21 aa, Entamoeba histolytica
NPDGSTSMILSLALIISIGMF

SEQ ID NO: 2742145 - protein, 24 aa, Entamoeba histolytica
NPITLPIFAHLFDGIAFDHIMIKT

SEQ ID NO: 2742146 - protein, 26 aa, Entamoeba histolytica
NPKAREWWAQLYSFEKYQYSSPYLMI

SEQ ID NO: 2742147 - protein, 18 aa, Entamoeba histolytica
NQCAIASVAYFPTGAHDA

SEQ ID NO: 2742148 - protein, 23 aa, Entamoeba histolytica
NQFSLSVLSINTLLYGPKLTGDD

SEQ ID NO: 2742149 - protein, 25 aa, Entamoeba histolytica
NQKFKGIELLRRRAIFNMNSMFVAK

SEQ ID NO: 2742150 - protein, 20 aa, Entamoeba histolytica
NQLKEVISLAIIKNKELKAL

SEQ ID NO: 2742151 - protein, 25 aa, Entamoeba histolytica
NQLKSLFYSLQQLQQKFKDLENQEI

SEQ ID NO: 2742152 - protein, 19 aa, Entamoeba histolytica
NQRFVYIYDYPFTDSRHKP

SEQ ID NO: 2742153 - protein, 24 aa, Entamoeba histolytica
NSEALVLFYDYWCPFGREFSKYLE

SEQ ID NO: 2742154 - protein, 20 aa, Entamoeba histolytica
NSFFFKKLNKLITPNSLLSW

SEQ ID NO: 2742155 - protein, 23 aa, Entamoeba histolytica
NSIQYNIKLLIDPIMREAQKVSK

SEQ ID NO: 2742156 - protein, 27 aa, Entamoeba histolytica
NSLEKYWGKLLGFYVALGSNNFGESIY

SEQ ID NO: 2742157 - protein, 17 aa, Entamoeba histolytica
NSQLFVRFLEMFKMCID

SEQ ID NO: 2742158 - protein, 19 aa, Entamoeba histolytica
NSQWIFQFAAEQFAPFLSQ

SEQ ID NO: 2742159 - protein, 26 aa, Entamoeba histolytica
NSRGKRQVLLRKIKVLSRRIRRVDRS

SEQ ID NO: 2742160 - protein, 17 aa, Entamoeba histolytica
NSVILFSDKPKRTLLYK

SEQ ID NO: 2742161 - protein, 21 aa, Entamoeba histolytica
NSVTVSFIKVTGVSGKCDSNS

SEQ ID NO: 2742162 - protein, 28 aa, Entamoeba histolytica
NTEGDSVFRALLYIPAEGPNPFAPKDPE

SEQ ID NO: 2742163 - protein, 22 aa, Entamoeba histolytica
NTIPEHFLNYNKACTFTDSKVI

SEQ ID NO: 2742164 - protein, 23 aa, Entamoeba histolytica
NTKKNNYITLWDKYQKQMNDQKE

SEQ ID NO: 2742165 - protein, 38 aa, Entamoeba histolytica
NTKVIHTQIQSNKHKIMYKIYKLQLKGEEGITKTPSVQ

SEQ ID NO: 2742166 - protein, 23 aa, Entamoeba histolytica
NTMKFIMENALFKFEMPAPLPEE

SEQ ID NO: 2742167 - protein, 21 aa, Entamoeba histolytica
NTNILIETINIYGSLLFDDST

SEQ ID NO: 2742168 - protein, 24 aa, Entamoeba histolytica
NTNNSQFFIEMIPTYWLDGRHVVF

SEQ ID NO: 2742169 - protein, 17 aa, Entamoeba histolytica
NTNVIVESLLFQQSYHY

SEQ ID NO: 2742170 - protein, 21 aa, Entamoeba histolytica
NTQCFFKYFTPFWNNSNKHFE

SEQ ID NO: 2742171 - protein, 22 aa, Entamoeba histolytica
NTQKNYFYIDPSKELPGLNLDY

SEQ ID NO: 2742172 - protein, 22 aa, Entamoeba histolytica
NTYEQINDCYDWAVANKRIRGS

SEQ ID NO: 2742173 - protein, 26 aa, Entamoeba histolytica
NVFFDTPTALIYIPQRGRLIRFVGGF

SEQ ID NO: 2742174 - protein, 34 aa, Entamoeba histolytica; identical to SEQ ID NO: 2597356

SEQ ID NO: 2742175 - protein, 20 aa, Entamoeba histolytica
NVIYSQWIEKILSPYDDVDM

SEQ ID NO: 2742176 - protein, 18 aa, Entamoeba histolytica
NVVVKFYVPWCNICKSIQ

SEQ ID NO: 2742177 - protein, 18 aa, Entamoeba histolytica
NYFFINSPITDGVMNSTI

SEQ ID NO: 2742178 - protein, 25 aa, Entamoeba histolytica
NYIQNYVPIFSLPQEWLWCESWCNQ

SEQ ID NO: 2742179 - protein, 31 aa, Entamoeba histolytica
NYKSEYGKFFLGWYHQLLLDHTNKVLSIAKS

SEQ ID NO: 2742180 - protein, 20 aa, Entamoeba histolytica
NYMKVCCQVLNFIRNYKIFV

SEQ ID NO: 2742181 - protein, 17 aa, Entamoeba histolytica
NYRFWYHDSWQHALQNR

SEQ ID NO: 2742182 - protein, 19 aa, Entamoeba histolytica
NYTKFDYILFEELIEKLKN

SEQ ID NO: 2742183 - protein, 23 aa, Entamoeba histolytica
PAKKPIVFIPGILASILEAEVDI

SEQ ID NO: 2742184 - protein, 22 aa, Entamoeba histolytica
PAQASPIIVQPSSQPSIMPMQQ

SEQ ID NO: 2742185 - protein, 25 aa, Entamoeba histolytica
PDNQLRLFNYLILHLDDLDLKPIHP

SEQ ID NO: 2742186 - protein, 28 aa, Entamoeba histolytica
PESQWMLEIMIDLFKPWLSDSSLETFRK

SEQ ID NO: 2742187 - protein, 20 aa, Entamoeba histolytica
PFDIIRKFGKKYIGFKSPHA

SEQ ID NO: 2742188 - protein, 18 aa, Entamoeba histolytica
PFIKVTLKGEEKIYSPEE

SEQ ID NO: 2742189 - protein, 25 aa, Entamoeba histolytica
PFSGNLPTYIAYTTKDLKSCPNTFN

SEQ ID NO: 2742190 - protein, 28 aa, Entamoeba histolytica
PFSKRLNNEFYYLLCKDIFNVDKQRLDR

SEQ ID NO: 2742191 - protein, 23 aa, Entamoeba histolytica
PGANIYYPNFPSTKGIFALAPDN

SEQ ID NO: 2742192 - protein, 25 aa, Entamoeba histolytica
PGNCYKRRHLWKKIKKIQEIRKEIS

SEQ ID NO: 2742193 - protein, 19 aa, Entamoeba histolytica
PGQFILSRYDLRPKECIPS

SEQ ID NO: 2742194 - protein, 30 aa, Entamoeba histolytica; identical to SEQ ID NO: 2556788

SEQ ID NO: 2742195 - protein, 24 aa, Entamoeba histolytica
PGTDQFVIGVPFFEKLEFEVNGKT

SEQ ID NO: 2742196 - protein, 23 aa, Entamoeba histolytica
PHDGRWWNFTIVKNTIQGREYSD

SEQ ID NO: 2742197 - protein, 26 aa, Entamoeba histolytica
PIEEQIWLHAWKYSFNSHDWIAEIPE

SEQ ID NO: 2742198 - protein, 17 aa, Entamoeba histolytica
PIMIEDKPRLQWRGLMI

SEQ ID NO: 2742199 - protein, 18 aa, Entamoeba histolytica
PIPLLLIKSMKTIKNALP

SEQ ID NO: 2742200 - protein, 29 aa, Entamoeba histolytica
PITNIKFINSFINFFKNIFERHKTYTVKD

SEQ ID NO: 2742201 - protein, 18 aa, Entamoeba histolytica
PKAPRRQSSKPKAPRRQS

SEQ ID NO: 2742202 - protein, 19 aa, Entamoeba histolytica
PKEPFLLMRDYILEYNLTG

SEQ ID NO: 2742203 - protein, 31 aa, Entamoeba histolytica
PKQLESFFQYNPYRLFRYTSQDLYTFIATLD

SEQ ID NO: 2742204 - protein, 17 aa, Entamoeba histolytica
PLVLTTNSDDKINVQGF

SEQ ID NO: 2742205 - protein, 25 aa, Entamoeba histolytica
PMGTNALAIEMYKKALLSEEVKIPT

SEQ ID NO: 2742206 - protein, 20 aa, Entamoeba histolytica
PNCLSFMTFNFNHTITYPLQ

SEQ ID NO: 2742207 - protein, 26 aa, Entamoeba histolytica
PNLSQLMIYSLNKKILLPLTTINVGA

SEQ ID NO: 2742208 - protein, 26 aa, Entamoeba histolytica
PNSISINFILNKYRKINLPSSNNINF

SEQ ID NO: 2742209 - protein, 18 aa, Entamoeba histolytica
PPFRKIVSIIDSLESDER

SEQ ID NO: 2742210 - protein, 22 aa, Entamoeba histolytica
PPQNQWMLDFMGDLFKDWLSPN

SEQ ID NO: 2742211 - protein, 19 aa, Entamoeba histolytica
PQEHLIFISNARRLIHDES

SEQ ID NO: 2742212 - protein, 23 aa, Entamoeba histolytica
PQEWLWCESWCNQKVKSKAKTID

SEQ ID NO: 2742213 - protein, 19 aa, Entamoeba histolytica
PQGELLFRGLPVSKGYFNR

SEQ ID NO: 2742214 - protein, 26 aa, Entamoeba histolytica
PQYYRKRYIHKPITPYINTYYNKPFT

SEQ ID NO: 2742215 - protein, 29 aa, Entamoeba histolytica
PRQGKDFLFFILLFVSLVTLVVASLCVYV

SEQ ID NO: 2742216 - protein, 25 aa, Entamoeba histolytica
PSDGLALFIATLRYLQSLGSNAPKT

SEQ ID NO: 2742217 - protein, 24 aa, Entamoeba histolytica
PSLNQPQLIIWNSNRIHLYKPTTT

SEQ ID NO: 2742218 - protein, 25 aa, Entamoeba histolytica
PSLNQPQLIIWNSNRIHLYKPTTTS

SEQ ID NO: 2742219 - protein, 30 aa, Entamoeba histolytica
PSTLDIKSTLFYPLHGWGITNDLNQTIYVS

SEQ ID NO: 2742220 - protein, 19 aa, Entamoeba histolytica
PTKYYFNRLEKTIKLRMSL

SEQ ID NO: 2742221 - protein, 18 aa, Entamoeba histolytica
PVIKIKDYSFVFPQTEEN

SEQ ID NO: 2742222 - protein, 22 aa, Entamoeba histolytica
PWCSHCIALQPVFEALADEYKS

SEQ ID NO: 2742223 - protein, 19 aa, Entamoeba histolytica
PYFDPWPDTAQWNYFEPKT

SEQ ID NO: 2742224 - protein, 20 aa, Entamoeba histolytica
PYSISPKIQRLSFSSLQRLE

SEQ ID NO: 2742225 - protein, 25 aa, Entamoeba histolytica
PYSVHFMFVLLKSKKGQYYVRTYFN

SEQ ID NO: 2742226 - protein, 26 aa, Entamoeba histolytica
QADSQLILFPSGYSVLIDLGENLKDY

SEQ ID NO: 2742227 - protein, 26 aa, Entamoeba histolytica
QAGFTGVMGDVWWGLVETSPKNYNFK

SEQ ID NO: 2742228 - protein, 30 aa, Entamoeba histolytica
QAVLLGILNVNGFGFRIKRPERRSQKTLQL

SEQ ID NO: 2742229 - protein, 26 aa, Entamoeba histolytica
QCWFKALQSCGCCKTCMAQKPPSCGC

SEQ ID NO: 2742230 - protein, 24 aa, Entamoeba histolytica
QDGLFCVIDGVHNKQYYECATTFK

SEQ ID NO: 2742231 - protein, 23 aa, Entamoeba histolytica
QDKDICLYVYYRDLDDSFSCFAK

SEQ ID NO: 2742232 - protein, 39 aa, Entamoeba histolytica
QDNKGKAYFFSKCQEKKKFTIAGRYFQQLKYSDEECKTV

SEQ ID NO: 2742233 - protein, 20 aa, Entamoeba histolytica
QEAFTKFLNILRGKPSEVVR

SEQ ID NO: 2742234 - protein, 23 aa, Entamoeba histolytica
QEFPLSIINLLKRKNESLKIISE

SEQ ID NO: 2742235 - protein, 25 aa, Entamoeba histolytica
QEFQPTYELLIPDFSRQGYLDLAQI

SEQ ID NO: 2742236 - protein, 26 aa, Entamoeba histolytica
QEIIKDFLFLARGVRRIPFYSINDTH

SEQ ID NO: 2742237 - protein, 17 aa, Entamoeba histolytica
QELFSLGKYYKGEFKKL

SEQ ID NO: 2742238 - protein, 18 aa, Entamoeba histolytica
QEQPIPNMFDNMPTVAEL

SEQ ID NO: 2742239 - protein, 28 aa, Entamoeba histolytica
QERNLNDSLYYLYRDLKYATVAEDRARL

SEQ ID NO: 2742240 - protein, 21 aa, Entamoeba histolytica
QGRTPLQMYKDFMSSFKSTFS

SEQ ID NO: 2742241 - protein, 23 aa, Entamoeba histolytica
QHDEMIKAIKAKNLPYFVVDHLG

SEQ ID NO: 2742242 - protein, 17 aa, Entamoeba histolytica
QHLIYLYKSLGYGEQAE

SEQ ID NO: 2742243 - protein, 23 aa, Entamoeba histolytica
QHNIDNASSIFILLSTFTLTLLF

SEQ ID NO: 2742244 - protein, 26 aa, Entamoeba histolytica
QHNQQPPLLFAIYNQNQNQIFGNDEC

SEQ ID NO: 2742245 - protein, 32 aa, Entamoeba histolytica
QHQTYNRLTNTIQYIHNNIHLIAETTTSSQGA

SEQ ID NO: 2742246 - protein, 22 aa, Entamoeba histolytica
QIDFDIQYFISTDYLDNNSPNA

SEQ ID NO: 2742247 - protein, 17 aa, Entamoeba histolytica
QIGLFLKELIDRAEMAL

SEQ ID NO: 2742248 - protein, 17 aa, Entamoeba histolytica
QIIKERDISLYPAFIII

SEQ ID NO: 2742249 - protein, 25 aa, Entamoeba histolytica
QIINYLPQTFLKYKVIPLGEDVIPY

SEQ ID NO: 2742250 - protein, 20 aa, Entamoeba histolytica
QIVDKLMMKVAAQPSVEAAD

SEQ ID NO: 2742251 - protein, 21 aa, Entamoeba histolytica
QKEVLFWVTVPCAKNVGSCTY

SEQ ID NO: 2742252 - protein, 21 aa, Entamoeba histolytica
QKKAERLIKIADAFIQNTNDD

SEQ ID NO: 2742253 - protein, 19 aa, Entamoeba histolytica
QKKLIKRLSTMEGLLKEMA

SEQ ID NO: 2742254 - protein, 18 aa, Entamoeba histolytica
QKRFYYDSWSSDTIFEFL

SEQ ID NO: 2742255 - protein, 19 aa, Entamoeba histolytica
QLDPVFLIGSFTNSFHKII

SEQ ID NO: 2742256 - protein, 26 aa, Entamoeba histolytica
QLMNMRKNVLIPRFIRSITRYEHIQQ

SEQ ID NO: 2742257 - protein, 18 aa, Entamoeba histolytica
QLQKIRALLPQLHLKMKQ

SEQ ID NO: 2742258 - protein, 24 aa, Entamoeba histolytica
QLQNKFQWIKYIDNDLMTIKQNSI

SEQ ID NO: 2742259 - protein, 19 aa, Entamoeba histolytica
QMHHFLPKCYIPCISLNSA

SEQ ID NO: 2742260 - protein, 17 aa, Entamoeba histolytica
QNLRRLTDKYLLDESVK

SEQ ID NO: 2742261 - protein, 28 aa, Entamoeba histolytica
QNVDLSEPWIFHWQNKDLFYGLRLTHQP

SEQ ID NO: 2742262 - protein, 29 aa, Entamoeba histolytica
QPEQPVPHPPVIPLTPELQLNAPISNGPN

SEQ ID NO: 2742263 - protein, 20 aa, Entamoeba histolytica
QPHPYNEHQPMPEQNPHPHN

SEQ ID NO: 2742264 - protein, 21 aa, Entamoeba histolytica
QPIRFKKLWEYSGNSSSQFAG

SEQ ID NO: 2742265 - protein, 17 aa, Entamoeba histolytica
QPPIIPVVPIQSSITIT

SEQ ID NO: 2742266 - protein, 27 aa, Entamoeba histolytica
QPYGTSFLEFEAYTKALLSEDIKIPPE

SEQ ID NO: 2742267 - protein, 19 aa, Entamoeba histolytica
QRIAIARALIRNPKVLLLD

SEQ ID NO: 2742268 - protein, 17 aa, Entamoeba histolytica
QRKMQLMPPVPCTGTRA

SEQ ID NO: 2742269 - protein, 27 aa, Entamoeba histolytica
QRMKAMLFIVFALICFVSANELLEKEL

SEQ ID NO: 2742270 - protein, 18 aa, Entamoeba histolytica
QSGFNKVMNVGKGVVGIF

SEQ ID NO: 2742271 - protein, 25 aa, Entamoeba histolytica
QSNQHKRMFNLHKVQLKGEVTKEPE

SEQ ID NO: 2742272 - protein, 24 aa, Entamoeba histolytica
QSPKKMFPLNITQSNIRQILASNS

SEQ ID NO: 2742273 - protein, 25 aa, Entamoeba histolytica
QSQLYLQRPFQVSYLLKMMSQSQIY

SEQ ID NO: 2742274 - protein, 21 aa, Entamoeba histolytica
QSSTAYYIREFYEVQDKVSIL

SEQ ID NO: 2742275 - protein, 18 aa, Entamoeba histolytica
QTIFSKKKLCFPDNGRWL

SEQ ID NO: 2742276 - protein, 22 aa, Entamoeba histolytica
QTKELLLKVKIPIGFGALIHDA

SEQ ID NO: 2742277 - protein, 30 aa, Entamoeba histolytica
QVDEFVRNIIYFRIEAIRKEIKALKGEKIV

SEQ ID NO: 2742278 - protein, 17 aa, Entamoeba histolytica
QVFKNYGTRFDFTCLEM

SEQ ID NO: 2742279 - protein, 22 aa, Entamoeba histolytica
QVSMKLRIKFMLNAAKGISYLH

SEQ ID NO: 2742280 - protein, 24 aa, Entamoeba histolytica
QYVPKGIWYDWFTNTPVKNGLRTV

SEQ ID NO: 2742281 - protein, 17 aa, Entamoeba histolytica
QYYWGCIFGSGYSYGPA

SEQ ID NO: 2742282 - protein, 18 aa, Entamoeba histolytica
RAKCKTCCRVIFASDYNY

SEQ ID NO: 2742283 - protein, 27 aa, Entamoeba histolytica
RAKYALYQTILSRKGVQKTLIRDTKKN

SEQ ID NO: 2742284 - protein, 19 aa, Entamoeba histolytica
RANYVRCLGLRRNFLKGTG

SEQ ID NO: 2742285 - protein, 27 aa, Entamoeba histolytica
RARFNELNLDLFKKTLGPVRMVLSDAK

SEQ ID NO: 2742286 - protein, 19 aa, Entamoeba histolytica
RARHLAFELKNIEKKRRVV

SEQ ID NO: 2742287 - protein, 17 aa, Entamoeba histolytica
RATTSTYFRNRHVMLFC

SEQ ID NO: 2742288 - protein, 18 aa, Entamoeba histolytica
RCLGKRRGFLKGTGPLYT

SEQ ID NO: 2742289 - protein, 18 aa, Entamoeba histolytica
RDPLTFNTEQTCRKIGVC

SEQ ID NO: 2742290 - protein, 43 aa, Entamoeba histolytica; identical to SEQ ID NO: 2556908

SEQ ID NO: 2742291 - protein, 20 aa, Entamoeba histolytica
REERLMELQLTLKAIQQRVE

SEQ ID NO: 2742292 - protein, 35 aa, Entamoeba histolytica
RERMRRKRILALKKNLRKMYLERRDMLWKKRCIRF

SEQ ID NO: 2742293 - protein, 27 aa, Entamoeba histolytica
RFGLRSIIEYAPWINRIFLVTDGEIPE

SEQ ID NO: 2742294 - protein, 28 aa, Entamoeba histolytica
RFIASLEVYYCLCLMEFLVVKVKGFDVF

SEQ ID NO: 2742295 - protein, 17 aa, Entamoeba histolytica
RFISQPDSWKKDLVNRI

SEQ ID NO: 2742296 - protein, 22 aa, Entamoeba histolytica
RFNRGTLERIFNREINAFLIDF

SEQ ID NO: 2742297 - protein, 21 aa, Entamoeba histolytica
RGATLIIWMKKAPLDPGTNNQ

SEQ ID NO: 2742298 - protein, 22 aa, Entamoeba histolytica
RGHLGLLYCTKGSYYDHQIGGN

SEQ ID NO: 2742299 - protein, 26 aa, Entamoeba histolytica
RHMMTGIRLHSLLVTYGMGSGQQAVT

SEQ ID NO: 2742300 - protein, 26 aa, Entamoeba histolytica
RIKLTLIRESKFGSPLPPLGKGYYDV

SEQ ID NO: 2742301 - protein, 22 aa, Entamoeba histolytica
RIYINGVRYHKLYFTYKTLTEG

SEQ ID NO: 2742302 - protein, 18 aa, Entamoeba histolytica
RKEVYGKYVQLLEKEEKA

SEQ ID NO: 2742303 - protein, 29 aa, Entamoeba histolytica
RKGHRRRVTLWRAVPYYCYRWGMTEEELL

SEQ ID NO: 2742304 - protein, 22 aa, Entamoeba histolytica
RKGLNMISYDNQARLIRCLSLE

SEQ ID NO: 2742305 - protein, 18 aa, Entamoeba histolytica
RKNQFTYYYKYKGGDEHY

SEQ ID NO: 2742306 - protein, 19 aa, Entamoeba histolytica
RKNWKEDIAKAMKKILGGK

SEQ ID NO: 2742307 - protein, 22 aa, Entamoeba histolytica
RKPILILSGILASQLMIDADID

SEQ ID NO: 2742308 - protein, 23 aa, Entamoeba histolytica
RKTKLPFDSLWLSPYANFNFQSF

SEQ ID NO: 2742309 - protein, 34 aa, Entamoeba histolytica
RLIRCLSLEHRVIIRYRHIVIKEESSYIPTTSSS

SEQ ID NO: 2742310 - protein, 21 aa, Entamoeba histolytica
RLQGKLDKRYVLKREEVALKN

SEQ ID NO: 2742311 - protein, 21 aa, Entamoeba histolytica
RLSEEMGDILRTLPLVDQQHI

SEQ ID NO: 2742312 - protein, 17 aa, Entamoeba histolytica
RLWRDMRISEMEAKMQF

SEQ ID NO: 2742313 - protein, 17 aa, Entamoeba histolytica
RMIRRLRLEKRFNAIRD

SEQ ID NO: 2742314 - protein, 30 aa, Entamoeba histolytica
RNEDRIYPKKLWLAIIHSFPSKINHVENTR

SEQ ID NO: 2742315 - protein, 18 aa, Entamoeba histolytica
RNPNFYPIIKNGLLNELN

SEQ ID NO: 2742316 - protein, 23 aa, Entamoeba histolytica
RNQRFVYVHPYPDSWYPEYHTVI

SEQ ID NO: 2742317 - protein, 26 aa, Entamoeba histolytica
RNREIIRTQIKSNQYKRMYNEYNVHL

SEQ ID NO: 2742318 - protein, 35 aa, Entamoeba histolytica
RNTEILHTQIQSKQYKRMFNLHKVQLKGEIEEAKE

SEQ ID NO: 2742319 - protein, 19 aa, Entamoeba histolytica
RPRRHYRRKSHRRHFKRNN

SEQ ID NO: 2742320 - protein, 17 aa, Entamoeba histolytica
RQKYPNVVEGAWASSAP

SEQ ID NO: 2742321 - protein, 27 aa, Entamoeba histolytica
RQMVVDRLVMLKQRRKEVYGKYVQLLE

SEQ ID NO: 2742322 - protein, 17 aa, Entamoeba histolytica
RQSSKPKAPRRQSSKRS

SEQ ID NO: 2742323 - protein, 29 aa, Entamoeba histolytica
RRHRHFWHYRNWWLRRHWMRNWKRQMRRW

SEQ ID NO: 2742324 - protein, 30 aa, Entamoeba histolytica
RRHRHFWHYRNWWLRRHWMRNWKRQMRRWR

SEQ ID NO: 2742325 - protein, 28 aa, Entamoeba histolytica
RRRRRRRRGSWRRWFRRHHRRPRRHYRR

SEQ ID NO: 2742326 - protein, 18 aa, Entamoeba histolytica
RRSQKTLQLMLIEALTKE

SEQ ID NO: 2742327 - protein, 18 aa, Entamoeba histolytica
RRTETVALLLPIGGTKIF

SEQ ID NO: 2742328 - protein, 26 aa, Entamoeba histolytica
RSTRDVRLILRRLGIELHKIQKQVFA

SEQ ID NO: 2742329 - protein, 17 aa, Entamoeba histolytica
RTHEVTAFKPYWMNSDT

SEQ ID NO: 2742330 - protein, 20 aa, Entamoeba histolytica
RTHVIMNYKGKNNLIRKEIK

SEQ ID NO: 2742331 - protein, 38 aa, Entamoeba histolytica
RTKEIIHTQIQSKQHKRMFNLHKVQLKGEVTKEPEETP

SEQ ID NO: 2742332 - protein, 18 aa, Entamoeba histolytica
RTLLELYIKEGDGFILVY

SEQ ID NO: 2742333 - protein, 25 aa, Entamoeba histolytica
RTLRPLAPGLQRRLLRKHGLMYRFA

SEQ ID NO: 2742334 - protein, 19 aa, Entamoeba histolytica
RTTFRLRGTQRRRYFSSSP

SEQ ID NO: 2742335 - protein, 20 aa, Entamoeba histolytica
RTTMHITLKESLIGFTKEVK

SEQ ID NO: 2742336 - protein, 31 aa, Entamoeba histolytica
RVMDMLYNTKFGNPLIIWRRKEPLLESTNNQ

SEQ ID NO: 2742337 - protein, 18 aa, Entamoeba histolytica
RVQLKLFKVVKRIQKVNQ

SEQ ID NO: 2742338 - protein, 17 aa, Entamoeba histolytica
RVRLSEEMGDILRTLPL

SEQ ID NO: 2742339 - protein, 32 aa, Entamoeba histolytica
RVVEKTLEWPTYKRHFYLPYRLDVDLCYQARK

SEQ ID NO: 2742340 - protein, 20 aa, Entamoeba histolytica
RVYTEIIHIIRRNTLHGGNM

SEQ ID NO: 2742341 - protein, 18 aa, Entamoeba histolytica
RWSQKVLRRIAIEMREEL

SEQ ID NO: 2742342 - protein, 20 aa, Entamoeba histolytica
RYEWMAMLLACCRQGIIIVT

SEQ ID NO: 2742343 - protein, 23 aa, Entamoeba histolytica
SAQFNPNDKFGASLGGRISNING

SEQ ID NO: 2742344 - protein, 25 aa, Entamoeba histolytica
SCDDKMKYVILNNTVIKYEYSSGEE

SEQ ID NO: 2742345 - protein, 26 aa, Entamoeba histolytica
SDERYNLITLLRQATLYVSYHDLLIK

SEQ ID NO: 2742346 - protein, 25 aa, Entamoeba histolytica
SDGLPEWLYYFKDVNNKWAVPENAC

SEQ ID NO: 2742347 - protein, 21 aa, Entamoeba histolytica
SDHFFKRKQLRKIYNKMKYSV

SEQ ID NO: 2742348 - protein, 17 aa, Entamoeba histolytica
SDKLLLHTIKDHTWNIF

SEQ ID NO: 2742349 - protein, 17 aa, Entamoeba histolytica
SDLDLLCKQNSIVKVKK

SEQ ID NO: 2742350 - protein, 27 aa, Entamoeba histolytica
SDPNLKFQWWFPLVERLDAKDLQNLQS

SEQ ID NO: 2742351 - protein, 25 aa, Entamoeba histolytica
SELNYKIAIPLLDSIINGLKLAVVN

SEQ ID NO: 2742352 - protein, 25 aa, Entamoeba histolytica
SELRDGGFFPTCYDWYTGKISDFVE

SEQ ID NO: 2742353 - protein, 24 aa, Entamoeba histolytica
SESGVLDEFFLPGPKPINLIQEYL

SEQ ID NO: 2742354 - protein, 24 aa, Entamoeba histolytica
SESKLIFWLMDVVPGDVITQSKET

SEQ ID NO: 2742355 - protein, 20 aa, Entamoeba histolytica
SEYNLLFKMIEMLGTPPIEM

SEQ ID NO: 2742356 - protein, 24 aa, Entamoeba histolytica
SFDEFDLIEELSFGSHLYDSFEEE

SEQ ID NO: 2742357 - protein, 21 aa, Entamoeba histolytica
SFGFALPYSGQEEKVIVDRTK

SEQ ID NO: 2742358 - protein, 19 aa, Entamoeba histolytica
SFIFSFAYANTGLDIHLFD

SEQ ID NO: 2742359 - protein, 18 aa, Entamoeba histolytica
SFILIAYAQTNITQTNGT

SEQ ID NO: 2742360 - protein, 19 aa, Entamoeba histolytica
SFINFYKNIYERHKTYILK

SEQ ID NO: 2742361 - protein, 22 aa, Entamoeba histolytica
SFMPPTDYILLKGNVNVVIQPA

SEQ ID NO: 2742362 - protein, 26 aa, Entamoeba histolytica
SFNDDYSDFLDDAPSPKNSKKAQKPK

SEQ ID NO: 2742363 - protein, 22 aa, Entamoeba histolytica
SFNDPFLEYLQSFIPSEIVPQN

SEQ ID NO: 2742364 - protein, 20 aa, Entamoeba histolytica
SGIQQMLYVGIRFSVQLKFN

SEQ ID NO: 2742365 - protein, 30 aa, Entamoeba histolytica
SGKQNGTMFFFSDYLIFAKSEKDGYNVIEM

SEQ ID NO: 2742366 - protein, 24 aa, Entamoeba histolytica
SGKTLLVKFFAPWCGHCKRLAPTY

SEQ ID NO: 2742367 - protein, 17 aa, Entamoeba histolytica
SGPIYMIGTTMKWLHAD

SEQ ID NO: 2742368 - protein, 22 aa, Entamoeba histolytica
SGRSWFFQTCIAYGYYQAVSEQ

SEQ ID NO: 2742369 - protein, 26 aa, Entamoeba histolytica
SGSIGFFEFLALWNFMNLCNETFKHF

SEQ ID NO: 2742370 - protein, 18 aa, Entamoeba histolytica
SGVHWWYGSSSHAAEATA

SEQ ID NO: 2742371 - protein, 20 aa, Entamoeba histolytica
SGVRIIALYLAYVDVYGSHC

SEQ ID NO: 2742372 - protein, 19 aa, Entamoeba histolytica
SHCTGLIKLLPDYSDLFVA

SEQ ID NO: 2742373 - protein, 21 aa, Entamoeba histolytica
SHNRLWKVEKKFFKLHKQAHN

SEQ ID NO: 2742374 - protein, 22 aa, Entamoeba histolytica
SHSMGGLMFYKFLDYVGKEFAD

SEQ ID NO: 2742375 - protein, 18 aa, Entamoeba histolytica
SIAIAAPAVDAGKQTGIE

SEQ ID NO: 2742376 - protein, 30 aa, Entamoeba histolytica
SIFDITPKLEFPLINLVKYSEIPFIGTNDK

SEQ ID NO: 2742377 - protein, 18 aa, Entamoeba histolytica
SIHKCPVFAIYHQFISTF

SEQ ID NO: 2742378 - protein, 21 aa, Entamoeba histolytica
SIIDFKIGWIMTPSSSYSTGY

SEQ ID NO: 2742379 - protein, 17 aa, Entamoeba histolytica
SIILSFVHGSCWYVSND

SEQ ID NO: 2742380 - protein, 24 aa, Entamoeba histolytica
SINDKIIFEFLLHKWNSEGITDDK

SEQ ID NO: 2742381 - protein, 18 aa, Entamoeba histolytica
SIPIPPLDIPDGIEWLAS

SEQ ID NO: 2742382 - protein, 18 aa, Entamoeba histolytica
SISSLTVFNLLNTSKQLT

SEQ ID NO: 2742383 - protein, 20 aa, Entamoeba histolytica
SIWVQNIGAFLSFYNTAQKC

SEQ ID NO: 2742384 - protein, 20 aa, Entamoeba histolytica
SKDVAVLTLYPGITGKTVRS

SEQ ID NO: 2742385 - protein, 19 aa, Entamoeba histolytica
SKEGCLCKFLWNDTKGVHY

SEQ ID NO: 2742386 - protein, 25 aa, Entamoeba histolytica
SKFHQYIDWINLMTYDLHGSWDAVT

SEQ ID NO: 2742387 - protein, 18 aa, Entamoeba histolytica
SKFSQLLCLNLHALVNDA

SEQ ID NO: 2742388 - protein, 25 aa, Entamoeba histolytica
SKGIDYVWMMGVWQLGEYGLNLDRS

SEQ ID NO: 2742389 - protein, 24 aa, Entamoeba histolytica
SKIVFWMMDTLPATFLKQSKERNV

SEQ ID NO: 2742390 - protein, 23 aa, Entamoeba histolytica
SKKFYFHIISPQRMKAMLFIVFA

SEQ ID NO: 2742391 - protein, 23 aa, Entamoeba histolytica
SKKVGKFLGGGKKSKGASKKASK

SEQ ID NO: 2742392 - protein, 32 aa, Entamoeba histolytica
SKQLIELLFEIPKKYPIVWYFDKNITEQIKSY

SEQ ID NO: 2742393 - protein, 22 aa, Entamoeba histolytica
SLAVLESRLLIAGSKYNQNNLD

SEQ ID NO: 2742394 - protein, 23 aa, Entamoeba histolytica
SLEIDYPLKFATSNKFTHFANKN

SEQ ID NO: 2742395 - protein, 20 aa, Entamoeba histolytica
SLEMDKLIYCTAEQALMDYV

SEQ ID NO: 2742396 - protein, 17 aa, Entamoeba histolytica
SLEWCKLPGFAKVVKDL

SEQ ID NO: 2742397 - protein, 18 aa, Entamoeba histolytica
SLFQYNAEYKPNKNFTFG

SEQ ID NO: 2742398 - protein, 20 aa, Entamoeba histolytica
SLKRKFKQYQRKEITAINQL

SEQ ID NO: 2742399 - protein, 17 aa, Entamoeba histolytica
SLLILTTISKEIKDEDG

SEQ ID NO: 2742400 - protein, 22 aa, Entamoeba histolytica
SLNLYTDLWMKVGSSWISVPQL

SEQ ID NO: 2742401 - protein, 19 aa, Entamoeba histolytica
SLNRKNSLVNGINALLNTV

SEQ ID NO: 2742402 - protein, 17 aa, Entamoeba histolytica
SLYSFFSSLLNIVYIKS

SEQ ID NO: 2742403 - protein, 28 aa, Entamoeba histolytica
SLYYRLLLIMLFLFFTVKQTNIVVEKFF

SEQ ID NO: 2742404 - protein, 25 aa, Entamoeba histolytica
SMTFYDMFFYESFGDLLDLTAVLPA

SEQ ID NO: 2742405 - protein, 28 aa, Entamoeba histolytica
SNAGCFLDRLFLLKSFYSKFNISVGILS

SEQ ID NO: 2742406 - protein, 25 aa, Entamoeba histolytica
SNGKYWIIRNSWGTSWGDAGYFLLA

SEQ ID NO: 2742407 - protein, 33 aa, Entamoeba histolytica
SNILHKYPLFIQWGYKILGFFIFKSVEDGIQTA

SEQ ID NO: 2742408 - protein, 19 aa, Entamoeba histolytica
SNLSMVFVYPTVIMLNQDF

SEQ ID NO: 2742409 - protein, 29 aa, Entamoeba histolytica
SNLTIQSWMYRVALPLFQPINEDIKMILK

SEQ ID NO: 2742410 - protein, 25 aa, Entamoeba histolytica
SNNQKFPVWFEPYSFISEYQVKDIS

SEQ ID NO: 2742411 - protein, 24 aa, Entamoeba histolytica
SNNYGAYIYIFDKSIIVYSKMDEK

SEQ ID NO: 2742412 - protein, 20 aa, Entamoeba histolytica
SNPLPKIQKDFKKLAYLEFV

SEQ ID NO: 2742413 - protein, 30 aa, Entamoeba histolytica
SNQYKRMYNEYNVHLKSETDVKPPASINVP

SEQ ID NO: 2742414 - protein, 23 aa, Entamoeba histolytica
SNTAGWLSVLTPTVSVISCGELN

SEQ ID NO: 2742415 - protein, 21 aa, Entamoeba histolytica
SNYYPFILTSGFYSGIQQYGG

SEQ ID NO: 2742416 - protein, 43 aa, Entamoeba histolytica
SPEIKRIITNEFMYVNTLTLLIDRYYIDICNSPIILQCGISLQ

SEQ ID NO: 2742417 - protein, 22 aa, Entamoeba histolytica
SPEWNLNIIPKIYLVSEKNGET

SEQ ID NO: 2742418 - protein, 24 aa, Entamoeba histolytica
SPHCWWGFYGKLLNRRQLNKFLKV

SEQ ID NO: 2742419 - protein, 24 aa, Entamoeba histolytica
SPINSSFFKDAMKQTWRLKQKKLG

SEQ ID NO: 2742420 - protein, 25 aa, Entamoeba histolytica
SPKQFNGTLLTYITPWNLYGLNLLE

SEQ ID NO: 2742421 - protein, 23 aa, Entamoeba histolytica
SPRFKWRGLMVDLARNAISKLTL

SEQ ID NO: 2742422 - protein, 24 aa, Entamoeba histolytica
SQKPSTFYGLLPKKSIQPLLSSEI

SEQ ID NO: 2742423 - protein, 22 aa, Entamoeba histolytica
SQLEFKLRNQLPYLSPKEIDDL

SEQ ID NO: 2742424 - protein, 26 aa, Entamoeba histolytica
SQNINGQINFLPTTNTQISANGMYTK

SEQ ID NO: 2742425 - protein, 30 aa, Entamoeba histolytica; identical to SEQ ID NO: 2557072

SEQ ID NO: 2742426 - protein, 39 aa, Entamoeba histolytica
SRKALSNALLVYHILLEGATIQFFRSKISHYALKVLRGE

SEQ ID NO: 2742427 - protein, 18 aa, Entamoeba histolytica
SRLEIFGSKIIFYKNTQV

SEQ ID NO: 2742428 - protein, 37 aa, Entamoeba histolytica; identical to SEQ ID NO: 2557079

SEQ ID NO: 2742429 - protein, 23 aa, Entamoeba histolytica
SRSWCNLNRFRPVSHYNADVRSY

SEQ ID NO: 2742430 - protein, 24 aa, Entamoeba histolytica
SSCFKKLLPIVFPEDCLTISVMKT

SEQ ID NO: 2742431 - protein, 24 aa, Entamoeba histolytica
SSFHPNVPALLLDGLNNHITFTDN

SEQ ID NO: 2742432 - protein, 23 aa, Entamoeba histolytica
SSIIQNLLTIPLTLSFPSISFTL

SEQ ID NO: 2742433 - protein, 27 aa, Entamoeba histolytica
SSNKRLLSKSKAFIRKARKSGMSKKAF

SEQ ID NO: 2742434 - protein, 21 aa, Entamoeba histolytica
SSRFPIVFVPAFMSSSLHIKS

SEQ ID NO: 2742435 - protein, 24 aa, Entamoeba histolytica
SSSSYYIEMRYNCWNVPVIGGWCS

SEQ ID NO: 2742436 - protein, 30 aa, Entamoeba histolytica
SSTSIQFQVFEWYSIIPEPDKHYSFSVPEN

SEQ ID NO: 2742437 - protein, 18 aa, Entamoeba histolytica
SSVFKKEWKKMQSKISKA

SEQ ID NO: 2742438 - protein, 17 aa, Entamoeba histolytica
SSWFISAEKGPSGSPRY

SEQ ID NO: 2742439 - protein, 19 aa, Entamoeba histolytica
STALKWLCYATNSNIKNAM

SEQ ID NO: 2742440 - protein, 30 aa, Entamoeba histolytica
STDLITFISNGIFPLYSVFDPMYIHDINNR

SEQ ID NO: 2742441 - protein, 24 aa, Entamoeba histolytica
STDSVLFIGYFKSSGIPNTIRVGC

SEQ ID NO: 2742442 - protein, 29 aa, Entamoeba histolytica
STLRKKALIFCAVLLFIITLQADTHFCLY

SEQ ID NO: 2742443 - protein, 23 aa, Entamoeba histolytica
STRDVRLILRRLGIELHKIQKQV

SEQ ID NO: 2742444 - protein, 17 aa, Entamoeba histolytica
STSNPHLTYAISGPTHQ

SEQ ID NO: 2742445 - protein, 25 aa, Entamoeba histolytica
SVDYDSLYSMPFKEDIRFPKQKQIF

SEQ ID NO: 2742446 - protein, 24 aa, Entamoeba histolytica
SVNVKELQRVFNRIIRIKNAMRTN

SEQ ID NO: 2742447 - protein, 24 aa, Entamoeba histolytica
SVSSSRYIILQKNSKITVTDITGS

SEQ ID NO: 2742448 - protein, 27 aa, Entamoeba histolytica
SVYQLMPNYQWWNDTILIFNGTSYSAS

SEQ ID NO: 2742449 - protein, 24 aa, Entamoeba histolytica
SYGPAASLPLWYAHYDNWASFGDF

SEQ ID NO: 2742450 - protein, 19 aa, Entamoeba histolytica
SYRTAPYPGIILLSGDLAG

SEQ ID NO: 2742451 - protein, 24 aa, Entamoeba histolytica
SYRYTNNILSFKLKPTWSINKNIQ

SEQ ID NO: 2742452 - protein, 25 aa, Entamoeba histolytica
SYSSSSSYSTLFSSSLPFSSNSISS

SEQ ID NO: 2742453 - protein, 24 aa, Entamoeba histolytica
SYTNLDSSSSVFLILSITLTFLFF

SEQ ID NO: 2742454 - protein, 21 aa, Entamoeba histolytica
SYYYMDEMYFLETEFGYPMYE

SEQ ID NO: 2742455 - protein, 17 aa, Entamoeba histolytica
TAALAEGPVAVCIDAGK

SEQ ID NO: 2742456 - protein, 23 aa, Entamoeba histolytica
TADLLSFAFEQWDKMTTTEEGRK

SEQ ID NO: 2742457 - protein, 23 aa, Entamoeba histolytica
TAGGVMASIIPRGTHVPTKKSQI

SEQ ID NO: 2742458 - protein, 19 aa, Entamoeba histolytica
TCNSFVSDCIYYFTASSIS

SEQ ID NO: 2742459 - protein, 24 aa, Entamoeba histolytica
TCSDQYYEFLYNKFVDYIPTNQKE

SEQ ID NO: 2742460 - protein, 25 aa, Entamoeba histolytica
TCSHRNNMYLTYVTGVCGKCSEIGE

SEQ ID NO: 2742461 - protein, 31 aa, Entamoeba histolytica
TDEPNTCEYVLVLQTPCACNKKLLKSLHEKR

SEQ ID NO: 2742462 - protein, 24 aa, Entamoeba histolytica
TDGFTMHGWWPSFSSGSMPACCKY

SEQ ID NO: 2742463 - protein, 23 aa, Entamoeba histolytica
TDPGEMMMWFNATLKVLREKGQK

SEQ ID NO: 2742464 - protein, 21 aa, Entamoeba histolytica
TDSLLRYVGGIYKSESCTGKI

SEQ ID NO: 2742465 - protein, 18 aa, Entamoeba histolytica
TDVEGPIPPLYSSSLRHL

SEQ ID NO: 2742466 - protein, 19 aa, Entamoeba histolytica
TEDIVLLDTTPLTLGIETV

SEQ ID NO: 2742467 - protein, 18 aa, Entamoeba histolytica
TEEALTAALAEGPVAVCI

SEQ ID NO: 2742468 - protein, 26 aa, Entamoeba histolytica
TEEYQPFPLSYLGGPYPLQHPYYCGI

SEQ ID NO: 2742469 - protein, 17 aa, Entamoeba histolytica
TELPNFYELIREFKSEE

SEQ ID NO: 2742470 - protein, 42 aa, Entamoeba histolytica
TENPPSPILQWKFANPAIKGWGCCFLAACYIGGLNTYEQIND

SEQ ID NO: 2742471 - protein, 25 aa, Entamoeba histolytica
TETNNGILYYAKYANSIPSDLSKKQ

SEQ ID NO: 2742472 - protein, 29 aa, Entamoeba histolytica
TEVNDLTLNGLFTITKIPLDLTIEDGNVI

SEQ ID NO: 2742473 - protein, 22 aa, Entamoeba histolytica
TEYTYEEILLILSYYIAAEYNV

SEQ ID NO: 2742474 - protein, 29 aa, Entamoeba histolytica
TFDFRATINPLPRWGNYQRFGAYMRVIEL

SEQ ID NO: 2742475 - protein, 19 aa, Entamoeba histolytica
TFNFNHTITYPLQRQRNLE

SEQ ID NO: 2742476 - protein, 22 aa, Entamoeba histolytica
TFSPQIIQTAPATQAPIIIQGY

SEQ ID NO: 2742477 - protein, 17 aa, Entamoeba histolytica
TFTFSVNIPRNPKSLYD

SEQ ID NO: 2742478 - protein, 23 aa, Entamoeba histolytica
TGDPLPYIPLTKNDPSFIFENEI

SEQ ID NO: 2742479 - protein, 24 aa, Entamoeba histolytica
TGGVLTYYKWFSIGDNKTQLYDYD

SEQ ID NO: 2742480 - protein, 23 aa, Entamoeba histolytica
TGSLSAFNGLKGFMALNIKNNLF

SEQ ID NO: 2742481 - protein, 26 aa, Entamoeba histolytica
TGTLHFKYYCPYKPGSELKYFQITFV

SEQ ID NO: 2742482 - protein, 27 aa, Entamoeba histolytica
THHLEHLKLHLTFYKKELEKLVHSKDQ

SEQ ID NO: 2742483 - protein, 17 aa, Entamoeba histolytica
THIELLPTAGQLLISTA

SEQ ID NO: 2742484 - protein, 27 aa, Entamoeba histolytica
THLDYQRLWIALKDLNPFNNDCILGYL

SEQ ID NO: 2742485 - protein, 24 aa, Entamoeba histolytica
THLQNLPYLRFIKKLNVTITYHPA

SEQ ID NO: 2742486 - protein, 23 aa, Entamoeba histolytica
THQELMDLKGFYYTLAMQQFGTV

SEQ ID NO: 2742487 - protein, 29 aa, Entamoeba histolytica
THQPSPWIRDYDFLLLLPTEIEEPTNGYI

SEQ ID NO: 2742488 - protein, 29 aa, Entamoeba histolytica
TIARNEQQWLFPKILHKIFGQCEKVAPEQ

SEQ ID NO: 2742489 - protein, 27 aa, Entamoeba histolytica
TIEYCRFHWPYFMFKQVSKTRIIWANK

SEQ ID NO: 2742490 - protein, 19 aa, Entamoeba histolytica
TIFMTLSYGLNITFSQRTN

SEQ ID NO: 2742491 - protein, 18 aa, Entamoeba histolytica
TIIIPFYNSINNSVLYNP

SEQ ID NO: 2742492 - protein, 17 aa, Entamoeba histolytica
TIILVGGSGVGKTCLAN

SEQ ID NO: 2742493 - protein, 23 aa, Entamoeba histolytica
TIKKELEYTLYISYPNINTNDGT

SEQ ID NO: 2742494 - protein, 22 aa, Entamoeba histolytica
TIKLRMSLFGINKLFSNTIELI

SEQ ID NO: 2742495 - protein, 17 aa, Entamoeba histolytica
TILMLYAPWCGHCKHLA

SEQ ID NO: 2742496 - protein, 17 aa, Entamoeba histolytica
TILSGKYGKTYSAGIIS

SEQ ID NO: 2742497 - protein, 18 aa, Entamoeba histolytica
TILVVYSRPIKPPHLGDG

SEQ ID NO: 2742498 - protein, 18 aa, Entamoeba histolytica
TILVVYSRPIKPQRLGDG

SEQ ID NO: 2742499 - protein, 26 aa, Entamoeba histolytica
TIRNYKLRILRLKMADAKIRISEHQL

SEQ ID NO: 2742500 - protein, 21 aa, Entamoeba histolytica
TIVESLRRRAIFNNNARFIAK

SEQ ID NO: 2742501 - protein, 24 aa, Entamoeba histolytica
TKDNHLLGKFMLEGIKRAPRGIPK

SEQ ID NO: 2742502 - protein, 43 aa, Entamoeba histolytica
TKLPSNVYFACQDTMYVYIAESSYYTCPLPYTCTDTTNCQHQT

SEQ ID NO: 2742503 - protein, 24 aa, Entamoeba histolytica
TKNQRFVYVHPYSTDWYPEYHSKV

SEQ ID NO: 2742504 - protein, 27 aa, Entamoeba histolytica
TKPGFTLHGWWPNFVSGYPSCCKSPYT

SEQ ID NO: 2742505 - protein, 17 aa, Entamoeba histolytica
TKQFACNTPAVVSSCVA

SEQ ID NO: 2742506 - protein, 17 aa, Entamoeba histolytica
TKSFYFLDNNYINIKTL

SEQ ID NO: 2742507 - protein, 27 aa, Entamoeba histolytica
TKYCGYYFIPYDVFKFGNSRFLNYGDD

SEQ ID NO: 2742508 - protein, 20 aa, Entamoeba histolytica
TLEQKAFKKVVTGNQRIAKK

SEQ ID NO: 2742509 - protein, 17 aa, Entamoeba histolytica
TLIIRPNNTYVVKIDGV

SEQ ID NO: 2742510 - protein, 19 aa, Entamoeba histolytica
TLLFSVVKADLFSFDEFDL

SEQ ID NO: 2742511 - protein, 20 aa, Entamoeba histolytica
TLMLHKVIVYLTVNDTYHEN

SEQ ID NO: 2742512 - protein, 24 aa, Entamoeba histolytica
TLNFLGILGLKHAFNHFPNIDIIH

SEQ ID NO: 2742513 - protein, 30 aa, Entamoeba histolytica
TLRNIIITLIPLYIIIESLFISIPPQLFDS

SEQ ID NO: 2742514 - protein, 24 aa, Entamoeba histolytica
TLSGKFDYKASNAWRVTGDGFISN

SEQ ID NO: 2742515 - protein, 21 aa, Entamoeba histolytica
TLSMIATPLNLLFSAKASAYK

SEQ ID NO: 2742516 - protein, 22 aa, Entamoeba histolytica
TLSMVLKKYRKCKYHKVVVEES

SEQ ID NO: 2742517 - protein, 20 aa, Entamoeba histolytica
TLTCPILSLFYHQSLPNNAV

SEQ ID NO: 2742518 - protein, 18 aa, Entamoeba histolytica
TLTLANKKFWLITDTHFD

SEQ ID NO: 2742519 - protein, 29 aa, Entamoeba histolytica
TLVASYHPLYYYKVWSRDATFASIIMLAL

SEQ ID NO: 2742520 - protein, 18 aa, Entamoeba histolytica
TLWLVSSIPLKKENQLEK

SEQ ID NO: 2742521 - protein, 24 aa, Entamoeba histolytica
TMQKFIHILKYRMNALPVGTQFPF

SEQ ID NO: 2742522 - protein, 25 aa, Entamoeba histolytica
TNLMCEMYCQLITGMFVFLEDEQNS

SEQ ID NO: 2742523 - protein, 22 aa, Entamoeba histolytica
TNNQRFVYVHPYPTSYYQNSNQ

SEQ ID NO: 2742524 - protein, 22 aa, Entamoeba histolytica
TNPKKVPLWTRLQKYENETKIN

SEQ ID NO: 2742525 - protein, 19 aa, Entamoeba histolytica
TNVNTHIELLPTAGQLLIS

SEQ ID NO: 2742526 - protein, 17 aa, Entamoeba histolytica
TPLWYPHYDHNPSFSDF

SEQ ID NO: 2742527 - protein, 30 aa, Entamoeba histolytica
TPYGYFNATLLLFQNYNVWTTLRHYNYIPG

SEQ ID NO: 2742528 - protein, 29 aa, Entamoeba histolytica
TPYINTYYNKPFTHKIYKKVIKSIHHKPI

SEQ ID NO: 2742529 - protein, 28 aa, Entamoeba histolytica
TQNNYCNDYFFLNEYSKDNFKLYYGFNI

SEQ ID NO: 2742530 - protein, 23 aa, Entamoeba histolytica
TRNQRFVYVHPYPTEWYPEYNST

SEQ ID NO: 2742531 - protein, 25 aa, Entamoeba histolytica
TRRSELYARQAWLLSELKALAKRET

SEQ ID NO: 2742532 - protein, 26 aa, Entamoeba histolytica
TSIEFKGLLIDFYTTCKIGIKMQTET

SEQ ID NO: 2742533 - protein, 19 aa, Entamoeba histolytica
TSLGFRFQNIRFRGEMDRS

SEQ ID NO: 2742534 - protein, 25 aa, Entamoeba histolytica
TSLRKEIRIIRRQLFKLEERFGSLN

SEQ ID NO: 2742535 - protein, 25 aa, Entamoeba histolytica
TSMNDGVVPLTLPPILIAGNKCDLD

SEQ ID NO: 2742536 - protein, 23 aa, Entamoeba histolytica
TSTQPQMPTINMPAITITNTNDN

SEQ ID NO: 2742537 - protein, 27 aa, Entamoeba histolytica
TSTYFRNRHVMLFCYDITKKESFNHVE

SEQ ID NO: 2742538 - protein, 32 aa, Entamoeba histolytica; identical to SEQ ID NO: 2557186

SEQ ID NO: 2742539 - protein, 27 aa, Entamoeba histolytica
TTTYFRNRHCILFTYDITKRETLEHVE

SEQ ID NO: 2742540 - protein, 21 aa, Entamoeba histolytica
TTYNCPPIRCSYKQENKLPTG

SEQ ID NO: 2742541 - protein, 27 aa, Entamoeba histolytica
TVNSTLYLRWLQIQTFFPLFRGNGEIN

SEQ ID NO: 2742542 - protein, 23 aa, Entamoeba histolytica
TVWKDRRKVDLTKEVKFIPNIFD

SEQ ID NO: 2742543 - protein, 31 aa, Entamoeba histolytica
TVYKPNLILKVLGSFLPFSIYINDDKKMYLH

SEQ ID NO: 2742544 - protein, 26 aa, Entamoeba histolytica
TYDEEDLLAFDDYLDYLDEFVDMEED

SEQ ID NO: 2742545 - protein, 23 aa, Entamoeba histolytica
TYEGSYIVLPLQSGIEIFPIEDL

SEQ ID NO: 2742546 - protein, 19 aa, Entamoeba histolytica
TYLERLSNPLPKIQKDFKK

SEQ ID NO: 2742547 - protein, 34 aa, Entamoeba histolytica
TYNRLTNTIQNIYINIHLIAEAPSESVPQALKEG

SEQ ID NO: 2742548 - protein, 19 aa, Entamoeba histolytica
TYVVVLNTVLYYTFNKLTE

SEQ ID NO: 2742549 - protein, 17 aa, Entamoeba histolytica
TYWDGQFQHLFTFKEED

SEQ ID NO: 2742550 - protein, 18 aa, Entamoeba histolytica
TYWDGQFQHLFTFKEEDD

SEQ ID NO: 2742551 - protein, 25 aa, Entamoeba histolytica
TYYNERYYEYLFNESTLVLSIGTYT

SEQ ID NO: 2742552 - protein, 17 aa, Entamoeba histolytica
VALRKNQFTYYYKYKGG

SEQ ID NO: 2742553 - protein, 24 aa, Entamoeba histolytica
VDATPLTLGIMTAGGVMASIIPRG

SEQ ID NO: 2742554 - protein, 29 aa, Entamoeba histolytica
VDEIIQKFSPYYKELLIKCLTPKYRYKTR

SEQ ID NO: 2742555 - protein, 22 aa, Entamoeba histolytica
VDGHLYYNTLIPRQILPANETD

SEQ ID NO: 2742556 - protein, 34 aa, Entamoeba histolytica
VDHYGYYGHNGLWYLFEELGFTAGKYIERDFGSY

SEQ ID NO: 2742557 - protein, 17 aa, Entamoeba histolytica
VDLQSLEWCKLPGFAKV

SEQ ID NO: 2742558 - protein, 17 aa, Entamoeba histolytica
VDRPFVLSRSFYAGSQK

SEQ ID NO: 2742559 - protein, 32 aa, Entamoeba histolytica
VDVHLIDTLFPLRHAWTFTAVFLPGAIPRSYI

SEQ ID NO: 2742560 - protein, 22 aa, Entamoeba histolytica
VEDWERFWASYKLASECYLEYM

SEQ ID NO: 2742561 - protein, 19 aa, Entamoeba histolytica
VEFLCHCNALQVGRKEVYD

SEQ ID NO: 2742562 - protein, 17 aa, Entamoeba histolytica
VEFYFLVKATSVGATGT

SEQ ID NO: 2742563 - protein, 24 aa, Entamoeba histolytica
VEMKKRYTIIAKNLKKMLPNKLFE

SEQ ID NO: 2742564 - protein, 19 aa, Entamoeba histolytica
VEPFLIERCQWYLSQTNIK

SEQ ID NO: 2742565 - protein, 27 aa, Entamoeba histolytica
VERLRRKAIFISNFNYVKEFNKNHGFE

SEQ ID NO: 2742566 - protein, 18 aa, Entamoeba histolytica
VESIERRIRLIQKKRIAK

SEQ ID NO: 2742567 - protein, 27 aa, Entamoeba histolytica
VEVSRLMHLIIHSLYTNKEIFLRELIS

SEQ ID NO: 2742568 - protein, 18 aa, Entamoeba histolytica
VFCLVYQVVSYSLCSGKI

SEQ ID NO: 2742569 - protein, 23 aa, Entamoeba histolytica
VFDKRKPIELKIQALKKLKEQKE

SEQ ID NO: 2742570 - protein, 18 aa, Entamoeba histolytica
VFVISSIALITEIGHTGI

SEQ ID NO: 2742571 - protein, 26 aa, Entamoeba histolytica
VGDYLKFYLMQHITYPYTTYSPELEN

SEQ ID NO: 2742572 - protein, 28 aa, Entamoeba histolytica
VGKILMPAISFFPWLIKDKWDNLNEIKH

SEQ ID NO: 2742573 - protein, 18 aa, Entamoeba histolytica
VGNELYYSVAHHSIFYTK

SEQ ID NO: 2742574 - protein, 17 aa, Entamoeba histolytica
VHSLYSFYKSQILRQTF

SEQ ID NO: 2742575 - protein, 28 aa, Entamoeba histolytica
VHYNKWDCQLYSQYLDLIAYLPNSVIEG

SEQ ID NO: 2742576 - protein, 28 aa, Entamoeba histolytica
VIANEEIILFLQLLLEKEQLEFPTPTTY

SEQ ID NO: 2742577 - protein, 19 aa, Entamoeba histolytica
VIELFEKVYNSQTSEYLIS

SEQ ID NO: 2742578 - protein, 18 aa, Entamoeba histolytica
VIIYICNAQVPADLIDKI

SEQ ID NO: 2742579 - protein, 30 aa, Entamoeba histolytica
VIKVLPKREQYRLLRKMDLRHRFSLGTEMD

SEQ ID NO: 2742580 - protein, 30 aa, Entamoeba histolytica
VILFSDKPKRTLLYKALAMHLNGAFKFYDC

SEQ ID NO: 2742581 - protein, 17 aa, Entamoeba histolytica
VILLCIAVAGKTNKSVE

SEQ ID NO: 2742582 - protein, 17 aa, Entamoeba histolytica
VISSMALFLKPSLSEGI

SEQ ID NO: 2742583 - protein, 17 aa, Entamoeba histolytica
VITNATESINNKEVIHT

SEQ ID NO: 2742584 - protein, 17 aa, Entamoeba histolytica
VKCLLKKSGVKGSLNVK

SEQ ID NO: 2742585 - protein, 26 aa, Entamoeba histolytica
VKEIKRQIRLLREAAQKEFNEFKENL

SEQ ID NO: 2742586 - protein, 26 aa, Entamoeba histolytica
VKERGIFITGGIIKIGEKGKIIMKGG

SEQ ID NO: 2742587 - protein, 17 aa, Entamoeba histolytica
VKFFAPWCGHCNSLKPI

SEQ ID NO: 2742588 - protein, 20 aa, Entamoeba histolytica
VKIWQSWYPNEWGKCEGTID

SEQ ID NO: 2742589 - protein, 25 aa, Entamoeba histolytica
VKKAECPEMVMARLAQKAHLSPVIQ

SEQ ID NO: 2742590 - protein, 17 aa, Entamoeba histolytica
VKKIYKKKQPKQRKVVE

SEQ ID NO: 2742591 - protein, 18 aa, Entamoeba histolytica
VKKMKRFEKKAMKKGIKK

SEQ ID NO: 2742592 - protein, 36 aa, Entamoeba histolytica
VKLVDAIAFRPLAISLFGSYLKAIIIGGSALPCELQ

SEQ ID NO: 2742593 - protein, 25 aa, Entamoeba histolytica
VKNIPRKFRARMIRRLRLEKRFNAI

SEQ ID NO: 2742594 - protein, 28 aa, Entamoeba histolytica
VKQAKWYGLHSFTYLRMTRALLDDGTAW

SEQ ID NO: 2742595 - protein, 24 aa, Entamoeba histolytica
VKQKNNFYFSWWGGNHTLNSQTMD

SEQ ID NO: 2742596 - protein, 22 aa, Entamoeba histolytica
VKRIKKIVLLKRHINSLKERIS

SEQ ID NO: 2742597 - protein, 17 aa, Entamoeba histolytica
VKRLKELEMAKEEIRRI

SEQ ID NO: 2742598 - protein, 17 aa, Entamoeba histolytica
VLGLPYSCAIDMWSVGC

SEQ ID NO: 2742599 - protein, 18 aa, Entamoeba histolytica
VLGQMWKHIKTEGIPIEY

SEQ ID NO: 2742600 - protein, 30 aa, Entamoeba histolytica
VLIVETNRPKIIIWIYHKHGTDGLFVGIGC

SEQ ID NO: 2742601 - protein, 28 aa, Entamoeba histolytica
VLIYNTLKRLGYLDDQLLFFNADDHACH

SEQ ID NO: 2742602 - protein, 18 aa, Entamoeba histolytica
VLKKPLRKSMKTLSKKFK

SEQ ID NO: 2742603 - protein, 19 aa, Entamoeba histolytica
VLQFEWDWQHPEKGRRVRQ

SEQ ID NO: 2742604 - protein, 23 aa, Entamoeba histolytica
VLSFLFFCTFAQKFSIIKKGDSI

SEQ ID NO: 2742605 - protein, 24 aa, Entamoeba histolytica
VNKCNWCYHQFLRVNGSCIQTIDA

SEQ ID NO: 2742606 - protein, 17 aa, Entamoeba histolytica
VNTLKKAIQVNVKTASE

SEQ ID NO: 2742607 - protein, 26 aa, Entamoeba histolytica
VNVKDQLLLVPYPQNIQFNKGSTNGI

SEQ ID NO: 2742608 - protein, 26 aa, Entamoeba histolytica
VNVKNQLLLMPYPTTVNAQFGSNDCV

SEQ ID NO: 2742609 - protein, 21 aa, Entamoeba histolytica
VPKYSLGYHQCRWNYMSQNEA

SEQ ID NO: 2742610 - protein, 17 aa, Entamoeba histolytica
VQETLVRAHSGWAIKIA

SEQ ID NO: 2742611 - protein, 18 aa, Entamoeba histolytica
VQETLVRAHSGWAIKIAE

SEQ ID NO: 2742612 - protein, 19 aa, Entamoeba histolytica
VRDSLYDFLKRCLAYDPKE

SEQ ID NO: 2742613 - protein, 28 aa, Entamoeba histolytica
VRQLNLMNRLHVNHLMLLGADEAQAVFN

SEQ ID NO: 2742614 - protein, 19 aa, Entamoeba histolytica
VSFPALLENWKDLLIQMLN

SEQ ID NO: 2742615 - protein, 23 aa, Entamoeba histolytica
VSGNEFIFKSFKVTTTDNNNSNK

SEQ ID NO: 2742616 - protein, 26 aa, Entamoeba histolytica
VSQLPVKFIIPWEALTPAKDQGSRST

SEQ ID NO: 2742617 - protein, 21 aa, Entamoeba histolytica
VTESLYRYSGGIYKSQSCTGQ

SEQ ID NO: 2742618 - protein, 20 aa, Entamoeba histolytica
VTEYLVDVFKRKYGKDLRND

SEQ ID NO: 2742619 - protein, 21 aa, Entamoeba histolytica
VTLCLIFTQVNALDFHDFDLF

SEQ ID NO: 2742620 - protein, 21 aa, Entamoeba histolytica
VTLLNAMRLPKEIIFPAQPPI

SEQ ID NO: 2742621 - protein, 24 aa, Entamoeba histolytica
VVALFCHLTIQECIPLIKTLNKVG

SEQ ID NO: 2742622 - protein, 18 aa, Entamoeba histolytica
VVFASAKEFYKYTYTGTG

SEQ ID NO: 2742623 - protein, 25 aa, Entamoeba histolytica
VVFNKSDGLLKYFNIRDAHIMEYIK

SEQ ID NO: 2742624 - protein, 17 aa, Entamoeba histolytica
VVMKCRDSFYSIGNECS

SEQ ID NO: 2742625 - protein, 17 aa, Entamoeba histolytica
VVSPYLCLVMLLGDTQE

SEQ ID NO: 2742626 - protein, 18 aa, Entamoeba histolytica
VYDTTYLCGILNTLGYSI

SEQ ID NO: 2742627 - protein, 19 aa, Entamoeba histolytica
VYEKQGWFVPDKGVLKVWN

SEQ ID NO: 2742628 - protein, 17 aa, Entamoeba histolytica
VYRKRRRYYRRRRLLSQ

SEQ ID NO: 2742629 - protein, 18 aa, Entamoeba histolytica
WCQGEQEGPYQYNPCVWL

SEQ ID NO: 2742630 - protein, 18 aa, Entamoeba histolytica
WCSEHFNIPFFETSAKNA

SEQ ID NO: 2742631 - protein, 28 aa, Entamoeba histolytica
WDKKFELDWWMNVVIFPVFSKLNDAMTD

SEQ ID NO: 2742632 - protein, 19 aa, Entamoeba histolytica
WEFASYQMICLYSYPNRVM

SEQ ID NO: 2742633 - protein, 18 aa, Entamoeba histolytica
WEPYMGELRWYSYEEALE

SEQ ID NO: 2742634 - protein, 18 aa, Entamoeba histolytica
WIGKKIKGLMILSPEMSD

SEQ ID NO: 2742635 - protein, 19 aa, Entamoeba histolytica
WKKDKYVYKQPKQKYYALV

SEQ ID NO: 2742636 - protein, 20 aa, Entamoeba histolytica
WNWKLQILEIANAPMPKYVV

SEQ ID NO: 2742637 - protein, 26 aa, Entamoeba histolytica
WRPYYAMMRIYKKYTFPFTKNALPMT

SEQ ID NO: 2742638 - protein, 18 aa, Entamoeba histolytica
WSAKAAHKMNKDSSWFIS

SEQ ID NO: 2742639 - protein, 27 aa, Entamoeba histolytica
WSKELPNYFLRIYPKPLFISIHHSNTA

SEQ ID NO: 2742640 - protein, 18 aa, Entamoeba histolytica
WVALKNVRPLKNDCSLGY

SEQ ID NO: 2742641 - protein, 19 aa, Entamoeba histolytica
WYHDSWQHALQNRPYHISA

SEQ ID NO: 2742642 - protein, 19 aa, Entamoeba histolytica
YASAWDFYGLHASPIISGM

SEQ ID NO: 2742643 - protein, 27 aa, Entamoeba histolytica
YAVDTLWPEIPWKKITGIWRKFISHLE

SEQ ID NO: 2742644 - protein, 18 aa, Entamoeba histolytica
YAYASSTPLWYPHYDNSP

SEQ ID NO: 2742645 - protein, 25 aa, Entamoeba histolytica
YCDMYDYWKFSGVKVKWIPKVKTSV

SEQ ID NO: 2742646 - protein, 26 aa, Entamoeba histolytica
YCDQRRPVFLFNGMLGSTINANLNIP

SEQ ID NO: 2742647 - protein, 31 aa, Entamoeba histolytica
YCSGYLEAYLTHHYMYLYWTNYKANEYENGQ

SEQ ID NO: 2742648 - protein, 18 aa, Entamoeba histolytica
YCSSLKIFLISKTIKIIH

SEQ ID NO: 2742649 - protein, 22 aa, Entamoeba histolytica
YDRFYIRYQSYTNRPYLNLQII

SEQ ID NO: 2742650 - protein, 17 aa, Entamoeba histolytica
YEFIPFFVKGNTILLLK

SEQ ID NO: 2742651 - protein, 26 aa, Entamoeba histolytica
YEISTRPWLYELTQKYGKSITKLRDI

SEQ ID NO: 2742652 - protein, 19 aa, Entamoeba histolytica
YEKYNYKLPFDIKMQCMIS

SEQ ID NO: 2742653 - protein, 24 aa, Entamoeba histolytica
YEKYNYKLPFDIKMQCMISSGYES

SEQ ID NO: 2742654 - protein, 18 aa, Entamoeba histolytica
YEYSVISYFSGYEKQYIA

SEQ ID NO: 2742655 - protein, 18 aa, Entamoeba histolytica
YFPKIDHIFIIDSRRRID

SEQ ID NO: 2742656 - protein, 17 aa, Entamoeba histolytica
YGLIYWFRVWDHKYRLK

SEQ ID NO: 2742657 - protein, 17 aa, Entamoeba histolytica
YGMMKRKENSDLYSNVG

SEQ ID NO: 2742658 - protein, 22 aa, Entamoeba histolytica
YGMPLHYKGTKFHRVIPGFIIQ

SEQ ID NO: 2742659 - protein, 22 aa, Entamoeba histolytica
YGNRIVFIDSLFLPNELQISKE

SEQ ID NO: 2742660 - protein, 17 aa, Entamoeba histolytica
YGVQGFPTVKLFDAQQG

SEQ ID NO: 2742661 - protein, 21 aa, Entamoeba histolytica
YGYELNMYLLPHVLPEWKTDQ

SEQ ID NO: 2742662 - protein, 28 aa, Entamoeba histolytica
YHDESKSLLFRYAAKKYSRWLPQSALET

SEQ ID NO: 2742663 - protein, 21 aa, Entamoeba histolytica
YIDNWVAMSTPFLGSVKSIAA

SEQ ID NO: 2742664 - protein, 25 aa, Entamoeba histolytica
YIKSSTNAEFWFWASGKTDASAKTI

SEQ ID NO: 2742665 - protein, 23 aa, Entamoeba histolytica
YIVGGVCFNKKIYVQTQFGVGEH

SEQ ID NO: 2742666 - protein, 24 aa, Entamoeba histolytica
YIVKNSWGTSWGDKGYILMSRNKN

SEQ ID NO: 2742667 - protein, 20 aa, Entamoeba histolytica
YIVRNSWGTSWGMDGYILMS

SEQ ID NO: 2742668 - protein, 23 aa, Entamoeba histolytica
YKKYTKKGLVFPPLVYPEYDDDS

SEQ ID NO: 2742669 - protein, 27 aa, Entamoeba histolytica
YKRNEKEWLAQKKLLKFLKNEVKKATL

SEQ ID NO: 2742670 - protein, 24 aa, Entamoeba histolytica
YKVYDMTKPFKFYVKPYLEDKVDE

SEQ ID NO: 2742671 - protein, 19 aa, Entamoeba histolytica
YLDMGFLPVEYDPRKIYIR

SEQ ID NO: 2742672 - protein, 23 aa, Entamoeba histolytica
YLDYLDEFVDMEEDWSLGGIQEG

SEQ ID NO: 2742673 - protein, 27 aa, Entamoeba histolytica
YLEGDLELVLYFLSRYTNYGREKFIKI

SEQ ID NO: 2742674 - protein, 17 aa, Entamoeba histolytica
YLLILVNAQNTCTNSQC

SEQ ID NO: 2742675 - protein, 17 aa, Entamoeba histolytica
YLPYRLDVDLCYQARKA

SEQ ID NO: 2742676 - protein, 25 aa, Entamoeba histolytica
YLSCIISCVTAELYTFDDFELFSEI

SEQ ID NO: 2742677 - protein, 22 aa, Entamoeba histolytica
YLSPFIQYFKEITFLCKDIYCS

SEQ ID NO: 2742678 - protein, 18 aa, Entamoeba histolytica
YNGVFPKHVPLLTVNEFL

SEQ ID NO: 2742679 - protein, 22 aa, Entamoeba histolytica
YNKTYFDIIDYTFKKLGVSVTL

SEQ ID NO: 2742680 - protein, 22 aa, Entamoeba histolytica
YNNELLLPFFEGIIEKDVFNLR

SEQ ID NO: 2742681 - protein, 23 aa, Entamoeba histolytica
YNPCVWLDQTTWFNKKNNNNENK

SEQ ID NO: 2742682 - protein, 22 aa, Entamoeba histolytica
YNQFPIVNLYREGILFSSFDGQ

SEQ ID NO: 2742683 - protein, 26 aa, Entamoeba histolytica
YPFYNYKGMEMASLFDLKIFVETDDD

SEQ ID NO: 2742684 - protein, 32 aa, Entamoeba histolytica
YPSEYGRFFQEWYFDLLLSHTDKVLSAARNVF

SEQ ID NO: 2742685 - protein, 26 aa, Entamoeba histolytica
YPTIEKPFIDPPYLVPLNVVVLYDIS

SEQ ID NO: 2742686 - protein, 17 aa, Entamoeba histolytica
YPTKVYNLFAFPGTENF

SEQ ID NO: 2742687 - protein, 19 aa, Entamoeba histolytica
YQSIIYWESISIDKTYYQK

SEQ ID NO: 2742688 - protein, 20 aa, Entamoeba histolytica
YRETQGALIVYDITSRDSFE

SEQ ID NO: 2742689 - protein, 17 aa, Entamoeba histolytica
YRMYTSYAIPKRVHDIR

SEQ ID NO: 2742690 - protein, 19 aa, Entamoeba histolytica
YRNGETIIIPFYNSINNSV

SEQ ID NO: 2742691 - protein, 27 aa, Entamoeba histolytica
YRQHHQLLPTYFDPSIVKIRASAKVRT

SEQ ID NO: 2742692 - protein, 28 aa, Entamoeba histolytica
YSDIDQKFWIWYYLPNARQPVQLFINGV

SEQ ID NO: 2742693 - protein, 32 aa, Entamoeba histolytica
YSDYPTILYLKTQCLFLFFSLNIITDNFIVPQ

SEQ ID NO: 2742694 - protein, 23 aa, Entamoeba histolytica
YSFFSSLLNIVYIKSSVFNELLE

SEQ ID NO: 2742695 - protein, 17 aa, Entamoeba histolytica
YSGLWLNYCPHKNYLFN

SEQ ID NO: 2742696 - protein, 24 aa, Entamoeba histolytica
YTCNKCQEGYYWNEKECTSCPAIP

SEQ ID NO: 2742697 - protein, 18 aa, Entamoeba histolytica
YTFDDFELFSEIEYQVDL

SEQ ID NO: 2742698 - protein, 18 aa, Entamoeba histolytica
YTKALLSEDIKIPPENRT

SEQ ID NO: 2742699 - protein, 20 aa, Entamoeba histolytica
YTQPRRINFISKPTIVEPVL

SEQ ID NO: 2742700 - protein, 24 aa, Entamoeba histolytica
YVCSDCFYDCILINGSCIIPERGN

SEQ ID NO: 2742701 - protein, 20 aa, Entamoeba histolytica
YVDQWIAISMPVMGSGVAVK

SEQ ID NO: 2742702 - protein, 18 aa, Entamoeba histolytica
YVLEKKLLRICPSNDIDS

SEQ ID NO: 2742703 - protein, 25 aa, Entamoeba histolytica
YVSQVAWFMYGAMNRVMKHFDINLN

SEQ ID NO: 2742704 - protein, 17 aa, Entamoeba histolytica
YVVLPLIEVDLLNPTAA

SEQ ID NO: 2742705 - protein, 29 aa, Entamoeba histolytica
YVVNNFKIGPILFEIGFQNPYKFEAQING

SEQ ID NO: 2742706 - protein, 23 aa, Entamoeba histolytica
YVYDPELYKYDSFAYIGIDVWQV

SEQ ID NO: 2742707 - protein, 29 aa, Entamoeba histolytica
YYDPLAFNIPKYFPFPAGYLSIFSQDIIK

SEQ ID NO: 2742708 - protein, 18 aa, Entamoeba histolytica
YYKSFIHLNYLEGDLELV

SEQ ID NO: 2742709 - protein, 23 aa, Entamoeba histolytica
YYSYSYIQLFNKFNIVRIAYSNE

SEQ ID NO: 2742710 - protein, 25 aa, Entamoeba histolytica
QSEYGRFFQEWYFDLLLSHTDKVLS

SEQ ID NO: 2742711 - protein, 22 aa, Entamoeba histolytica
FALLLTVHAEEDSFDLDENVEM

SEQ ID NO: 2742712 - protein, 21 aa, Entamoeba histolytica
GFTLHGWWPNFVSGYPSCCKS

SEQ ID NO: 2742713 - protein, 23 aa, Entamoeba histolytica
HRHFWHYRNWWLRRHWMRNWKRQ

SEQ ID NO: 2742714 - protein, 17 aa, Entamoeba histolytica
ILFFSLSSAYIWEFDPN

SEQ ID NO: 2742715 - protein, 23 aa, Entamoeba histolytica
AEYLYRFAVFLDNKKFVEANANT

SEQ ID NO: 2742716 - protein, 17 aa, Entamoeba histolytica
AFMTLFETNDFLLSDTL

SEQ ID NO: 2742717 - protein, 17 aa, Entamoeba histolytica
AFTSATNIILDLDQEVK

SEQ ID NO: 2742718 - protein, 17 aa, Entamoeba histolytica
ALFLVYSEAVITFPHVI

SEQ ID NO: 2742719 - protein, 17 aa, Entamoeba histolytica
ATINPLPRWGNYQRFGA

SEQ ID NO: 2742720 - protein, 17 aa, Entamoeba histolytica
CCFVNVTSYDLFDELSD

SEQ ID NO: 2742721 - protein, 17 aa, Entamoeba histolytica
CCPLPSFDIIFTDSFHS

SEQ ID NO: 2742722 - protein, 19 aa, Entamoeba histolytica
CEYVLVLQTPCACNKKLLK

SEQ ID NO: 2742723 - protein, 17 aa, Entamoeba histolytica
CILFVYTTAHSLEEDFE

SEQ ID NO: 2742724 - protein, 19 aa, Entamoeba histolytica
CILLVLDSFALSFNDDYSD

SEQ ID NO: 2742725 - protein, 19 aa, Entamoeba histolytica
CLLELTLAVYPTGCKKKGY

SEQ ID NO: 2742726 - protein, 18 aa, Entamoeba histolytica
DFLFLARGVRRIPFYSIN

SEQ ID NO: 2742727 - protein, 19 aa, Entamoeba histolytica
DFNHQLPIFWYFSAKHNQT

SEQ ID NO: 2742728 - protein, 18 aa, Entamoeba histolytica
DKWIPLSAPFLGSGLAIK

SEQ ID NO: 2742729 - protein, 21 aa, Entamoeba histolytica
DKYIQKWIAISAPFIGTGVVP

SEQ ID NO: 2742730 - protein, 19 aa, Entamoeba histolytica
DLISDPLWKRIGLPDPSIN

SEQ ID NO: 2742731 - protein, 17 aa, Entamoeba histolytica
DNILLKVEEAKPTPQEK

SEQ ID NO: 2742732 - protein, 25 aa, Entamoeba histolytica
DPNLKFQWWFPLVERLDAKDLQNLQ

SEQ ID NO: 2742733 - protein, 20 aa, Entamoeba histolytica
DQEHFFILILKNLKKELKRA

SEQ ID NO: 2742734 - protein, 17 aa, Entamoeba histolytica
DTYIDKWIPLSAPFLGS

SEQ ID NO: 2742735 - protein, 20 aa, Entamoeba histolytica
EDLLAFDDYLDYLDEFVDME

SEQ ID NO: 2742736 - protein, 23 aa, Entamoeba histolytica
EGFTMHGWWPNFVSGYPSCCKSP

SEQ ID NO: 2742737 - protein, 32 aa, Entamoeba histolytica
EIIHTQIYSNKHKRIYNRYGIYLKGEAEVTEP

SEQ ID NO: 2742738 - protein, 24 aa, Entamoeba histolytica
EKKFIKKEKKLIKLQKRFAKASKS

SEQ ID NO: 2742739 - protein, 17 aa, Entamoeba histolytica
ELDWWMNVVIFPVFSKL

SEQ ID NO: 2742740 - protein, 21 aa, Entamoeba histolytica
ELQFFEFAPYRMYTYAPGTRN

SEQ ID NO: 2742741 - protein, 23 aa, Entamoeba histolytica
EMKYLLIDYWYKEYFMSVRNKEP

SEQ ID NO: 2742742 - protein, 20 aa, Entamoeba histolytica
ESKSLLFRYAAKKYSRWLPQ

SEQ ID NO: 2742743 - protein, 23 aa, Entamoeba histolytica
ESYNNLYVIYKSSLSQSLFVNQT

SEQ ID NO: 2742744 - protein, 17 aa, Entamoeba histolytica
ETNIFYKGCSGLLIPKI

SEQ ID NO: 2742745 - protein, 23 aa, Entamoeba histolytica
ETSRFNFFILYHPLISFMSRNYQ

SEQ ID NO: 2742746 - protein, 17 aa, Entamoeba histolytica
FALFLTVHAEEEFELDD

SEQ ID NO: 2742747 - protein, 36 aa, Entamoeba histolytica
FALFLTVHAEEEFELDDDFEINNEDFDFNDDEYELE

SEQ ID NO: 2742748 - protein, 19 aa, Entamoeba histolytica
FFQYNPYRLFRYTSQDLYT

SEQ ID NO: 2742749 - protein, 18 aa, Entamoeba histolytica
FFRPKIAIGLLPQGKKMK

SEQ ID NO: 2742750 - protein, 19 aa, Entamoeba histolytica
FIFYSFALDYYKVLGVPRN

SEQ ID NO: 2742751 - protein, 17 aa, Entamoeba histolytica
FILLVYGKLPNKWAYNY

SEQ ID NO: 2742752 - protein, 19 aa, Entamoeba histolytica
FLIYLYYDQGCKNLQYILN

SEQ ID NO: 2742753 - protein, 17 aa, Entamoeba histolytica
FLLVVINAETCPESLST

SEQ ID NO: 2742754 - protein, 19 aa, Entamoeba histolytica
FRNRHCILFTYDITKRETL

SEQ ID NO: 2742755 - protein, 21 aa, Entamoeba histolytica
FSLFLAAYAEENFDLDNNVEV

SEQ ID NO: 2742756 - protein, 17 aa, Entamoeba histolytica
FTITLSLSASIDYVFTD

SEQ ID NO: 2742757 - protein, 17 aa, Entamoeba histolytica
FWTWSYKVYQYPKKVIL

SEQ ID NO: 2742758 - protein, 28 aa, Entamoeba histolytica
FYLEIKLFLRYFLSPLLFFNLIKNDPYQ

SEQ ID NO: 2742759 - protein, 26 aa, Entamoeba histolytica
FYLEIKLFLRYFLSPLLLFNLIKNDP

SEQ ID NO: 2742760 - protein, 22 aa, Entamoeba histolytica
GDTKRQYASDNILLKVEEAKPT

SEQ ID NO: 2742761 - protein, 18 aa, Entamoeba histolytica
GIHGYPTITFFPKDFKYG

SEQ ID NO: 2742762 - protein, 19 aa, Entamoeba histolytica
GKKYWKKQAPKKCYDFIGG

SEQ ID NO: 2742763 - protein, 22 aa, Entamoeba histolytica
GKRLRPLSLLLFFIGGGGKIEE

SEQ ID NO: 2742764 - protein, 17 aa, Entamoeba histolytica
GTMFFFSDYLIFAKSEK

SEQ ID NO: 2742765 - protein, 30 aa, Entamoeba histolytica
HTQIQSKQHKRMFNLHKVQLKGEVTKEPEE

SEQ ID NO: 2742766 - protein, 23 aa, Entamoeba histolytica
IAMFLTLAFAVEEDATLDNKETE

SEQ ID NO: 2742767 - protein, 26 aa, Entamoeba histolytica
IEQELKDVGLYDLFSKKESIHENDIE

SEQ ID NO: 2742768 - protein, 18 aa, Entamoeba histolytica
IFIFYLLVGYCFSSEIKI

SEQ ID NO: 2742769 - protein, 20 aa, Entamoeba histolytica
IIFLMFNFSYAKNHVAVSIS

SEQ ID NO: 2742770 - protein, 29 aa, Entamoeba histolytica
IKSKEYKRMYKLYKVHFKSVNEIAEEKGQ

SEQ ID NO: 2742771 - protein, 18 aa, Entamoeba histolytica
ILILKHLSTILPTYKQLI

SEQ ID NO: 2742772 - protein, 20 aa, Entamoeba histolytica
ILMPAISFFPWLIKDKWDNL

SEQ ID NO: 2742773 - protein, 18 aa, Entamoeba histolytica
ILQVIFKTPLEGAQTCLH

SEQ ID NO: 2742774 - protein, 22 aa, Entamoeba histolytica
INWFYSFPFLYDKILPSAVCPY

SEQ ID NO: 2742775 - protein, 17 aa, Entamoeba histolytica
IPKSLAFGVIKESQGFV

SEQ ID NO: 2742776 - protein, 19 aa, Entamoeba histolytica
ISILAYLGYLIYKKELTWP

SEQ ID NO: 2742777 - protein, 21 aa, Entamoeba histolytica
IYKVYDLFYGGRRLKMSFSSS

SEQ ID NO: 2742778 - protein, 23 aa, Entamoeba histolytica
KELPNYFLRIYPKPLFISIHHSN

SEQ ID NO: 2742779 - protein, 18 aa, Entamoeba histolytica
KEPLLKPLFLMYPEDEMT

SEQ ID NO: 2742780 - protein, 18 aa, Entamoeba histolytica
KIMYNGYNIQLKGGDISE

SEQ ID NO: 2742781 - protein, 20 aa, Entamoeba histolytica
KKLEWPTYKRHFYLPYRLDV

SEQ ID NO: 2742782 - protein, 23 aa, Entamoeba histolytica
KKLLKYLSKIKLPKKRREFYKLM

SEQ ID NO: 2742783 - protein, 23 aa, Entamoeba histolytica
KNKKLIQSIIFKSGAKMATKMAA

SEQ ID NO: 2742784 - protein, 21 aa, Entamoeba histolytica
KRLIVQLRRLYRHKKVLLRDI

SEQ ID NO: 2742785 - protein, 23 aa, Entamoeba histolytica
KRREFYKLMKRRYWKECCNCSCC

SEQ ID NO: 2742786 - protein, 24 aa, Entamoeba histolytica
KSEYGKFFLGWYHQLLLDHTNKVL

SEQ ID NO: 2742787 - protein, 24 aa, Entamoeba histolytica
KSEYGKFFLGWYQQLLLDHANNVL

SEQ ID NO: 2742788 - protein, 21 aa, Entamoeba histolytica
KTLEWPTYKRHFYLPYRLDVD

SEQ ID NO: 2742789 - protein, 20 aa, Entamoeba histolytica
KTLKWPTYKRHFYLPYRLDV

SEQ ID NO: 2742790 - protein, 20 aa, Entamoeba histolytica
KYNYKLPFPIKMHCLISSGH

SEQ ID NO: 2742791 - protein, 22 aa, Entamoeba histolytica
LAFLVFLCLYISFPLTITETPR

SEQ ID NO: 2742792 - protein, 20 aa, Entamoeba histolytica
LEAYLTHHYMYLYWTNYKAN

SEQ ID NO: 2742793 - protein, 17 aa, Entamoeba histolytica
LFICFCLSKECSIDSND

SEQ ID NO: 2742794 - protein, 19 aa, Entamoeba histolytica
LFIITFYFRIVSGDWCEFS

SEQ ID NO: 2742795 - protein, 18 aa, Entamoeba histolytica
LIAFAFAEENELDNTFDI

SEQ ID NO: 2742796 - protein, 17 aa, Entamoeba histolytica
LIILLVTVDARRSTKKS

SEQ ID NO: 2742797 - protein, 17 aa, Entamoeba histolytica
LIIVNFSFAINFDQWKI

SEQ ID NO: 2742798 - protein, 18 aa, Entamoeba histolytica
LISEAIETKLFKEQRVKD

SEQ ID NO: 2742799 - protein, 17 aa, Entamoeba histolytica
LKNILTIILGKIPFEFD

SEQ ID NO: 2742800 - protein, 19 aa, Entamoeba histolytica
LLFVTLVLSSPLLDMKIKT

SEQ ID NO: 2742801 - protein, 23 aa, Entamoeba histolytica
LLLLFIILSTGKYIGFFPSNHEC

SEQ ID NO: 2742802 - protein, 20 aa, Entamoeba histolytica
LPVIIKEHLYFVSPIFFGMT

SEQ ID NO: 2742803 - protein, 17 aa, Entamoeba histolytica
LRKIAMLKVKLNAQMRK

SEQ ID NO: 2742804 - protein, 21 aa, Entamoeba histolytica
LSFLFIFCHALICNETNCSTI

SEQ ID NO: 2742805 - protein, 17 aa, Entamoeba histolytica
LVFFSLLAVSFAAIVGM

SEQ ID NO: 2742806 - protein, 19 aa, Entamoeba histolytica
LYLRWLQIQTFFPLFRGNG

SEQ ID NO: 2742807 - protein, 18 aa, Entamoeba histolytica
MFFFSDYLIFAKSEKDGY

SEQ ID NO: 2742808 - protein, 23 aa, Entamoeba histolytica
NDGYLALIERLFRLLHLIEMKKE

SEQ ID NO: 2742809 - protein, 25 aa, Entamoeba histolytica
NEVFIDLWEGYLYFRGFKCNTAQQD

SEQ ID NO: 2742810 - protein, 18 aa, Entamoeba histolytica
NGIPYWILKNCWGSSWGS

SEQ ID NO: 2742811 - protein, 23 aa, Entamoeba histolytica
NGLWYLFEELGFTAGKYIERDFG

SEQ ID NO: 2742812 - protein, 17 aa, Entamoeba histolytica
NIKLVFTALPFIRTFLL

SEQ ID NO: 2742813 - protein, 29 aa, Entamoeba histolytica
NLHTFHSMFIFLLIIVITNATESIVNKEE

SEQ ID NO: 2742814 - protein, 22 aa, Entamoeba histolytica
NLNDSLYYLYRDLKYATVAEDR

SEQ ID NO: 2742815 - protein, 17 aa, Entamoeba histolytica
NLRYYWPGLKQCSFFNY

SEQ ID NO: 2742816 - protein, 17 aa, Entamoeba histolytica
NPLPRWGNYQRFGAYMR

SEQ ID NO: 2742817 - protein, 26 aa, Entamoeba histolytica
NPPSPILQWKFANPAIKGWGCCFLAA

SEQ ID NO: 2742818 - protein, 23 aa, Entamoeba histolytica
NQNIIVMFIFLLSVVLLCHADSD

SEQ ID NO: 2742819 - protein, 19 aa, Entamoeba histolytica
NYKLRILRLKMADAKIRIS

SEQ ID NO: 2742820 - protein, 32 aa, Entamoeba histolytica
PEVMHTHMYSNKHKIIYNKYNIHLKSEAEVVN

SEQ ID NO: 2742821 - protein, 17 aa, Entamoeba histolytica
PFTNGFWYLMEKAGITF

SEQ ID NO: 2742822 - protein, 20 aa, Entamoeba histolytica
PLEEYILPPRLYPYVEYGKT

SEQ ID NO: 2742823 - protein, 25 aa, Entamoeba histolytica
PQDNLLNPWYWIYQPVAYKLNSRMG

SEQ ID NO: 2742824 - protein, 24 aa, Entamoeba histolytica
PQDNLLNPWYWIYQPVSYSLNSRM

SEQ ID NO: 2742825 - protein, 25 aa, Entamoeba histolytica
PSEYGRFFQEWYFDLLLSHTDKVLS

SEQ ID NO: 2742826 - protein, 23 aa, Entamoeba histolytica
PYLKPYTLPFWISGGILQTIIGG

SEQ ID NO: 2742827 - protein, 24 aa, Entamoeba histolytica
QCENKKLFLIEKLHDFIPIENKEI

SEQ ID NO: 2742828 - protein, 28 aa, Entamoeba histolytica
QIQSNKHKIMYKIYKLQLKGEEGITKTP

SEQ ID NO: 2742829 - protein, 17 aa, Entamoeba histolytica
QIWLHAWKYSFNSHDWI

SEQ ID NO: 2742830 - protein, 17 aa, Entamoeba histolytica
QLLLVPYPQNIQFNKGS

SEQ ID NO: 2742831 - protein, 24 aa, Entamoeba histolytica
QSIDILFNALWLRSFIKNNQRIIN

SEQ ID NO: 2742832 - protein, 22 aa, Entamoeba histolytica
RIRSLVQLYFKVIFNYLRSEKS

SEQ ID NO: 2742833 - protein, 19 aa, Entamoeba histolytica
RITIHSLLKKYKSKLLKKQ

SEQ ID NO: 2742834 - protein, 27 aa, Entamoeba histolytica
RKAINTLLFMRFLYTPLIQSPSLFKKV

SEQ ID NO: 2742835 - protein, 18 aa, Entamoeba histolytica
RKNLRKIAMLKVKLNAQM

SEQ ID NO: 2742836 - protein, 18 aa, Entamoeba histolytica
RMRRKRILALKKNLRKMY

SEQ ID NO: 2742837 - protein, 19 aa, Entamoeba histolytica
RMYTRYNIHLKEETYVTGE

SEQ ID NO: 2742838 - protein, 22 aa, Entamoeba histolytica
RNEQQWLFPKILHKIFGQCEKV

SEQ ID NO: 2742839 - protein, 26 aa, Entamoeba histolytica
RQGKDFLFFILLFVSLVTLVVASLCV

SEQ ID NO: 2742840 - protein, 22 aa, Entamoeba histolytica
RSVQLCFLIGILSRFCSLTFQR

SEQ ID NO: 2742841 - protein, 21 aa, Entamoeba histolytica
RTKRMVLAKMYKILRVLAPVE

SEQ ID NO: 2742842 - protein, 25 aa, Entamoeba histolytica
RYQMLPYWYSLWYYHRVDYKPVIRA

SEQ ID NO: 2742843 - protein, 25 aa, Entamoeba histolytica
SDIDQKFWIWYYLPNARQPVQLFIN

SEQ ID NO: 2742844 - protein, 18 aa, Entamoeba histolytica
SFGFALPYSGQEEKVIVD

SEQ ID NO: 2742845 - protein, 21 aa, Entamoeba histolytica
SKDWFTLWLNLLDGIPYVNDC

SEQ ID NO: 2742846 - protein, 24 aa, Entamoeba histolytica
SLYYRLLLIMLFLFFTVKQTNIVV

SEQ ID NO: 2742847 - protein, 20 aa, Entamoeba histolytica
SYHPLYYYKVWSRDATFASI

SEQ ID NO: 2742848 - protein, 24 aa, Entamoeba histolytica
TEEELLIRWYQVGTFYPFFRAHAH

SEQ ID NO: 2742849 - protein, 21 aa, Entamoeba histolytica
TFYSILYRSLLFPHNITENGY

SEQ ID NO: 2742850 - protein, 29 aa, Entamoeba histolytica
THMYSKQHKIMYNLYKAELKGEVTTQITD

SEQ ID NO: 2742851 - protein, 20 aa, Entamoeba histolytica
TIIITPVELVFPFSTNPRIR

SEQ ID NO: 2742852 - protein, 18 aa, Entamoeba histolytica
TIYNPCMWPFQGNTPDCD

SEQ ID NO: 2742853 - protein, 19 aa, Entamoeba histolytica
TLHFKYYCPYKPGSELKYF

SEQ ID NO: 2742854 - protein, 20 aa, Entamoeba histolytica
TLWPEIPWKKITGIWRKFIS

SEQ ID NO: 2742855 - protein, 27 aa, Entamoeba histolytica
TNTIQNIYINIHLIAEAPSESVPQALK

SEQ ID NO: 2742856 - protein, 17 aa, Entamoeba histolytica
TQETNIFYKGCSGLLIP

SEQ ID NO: 2742857 - protein, 24 aa, Entamoeba histolytica
VCAPYLQIKLLRLLRIMNPSTKYY

SEQ ID NO: 2742858 - protein, 17 aa, Entamoeba histolytica
VFTALPFIRTFLLNETK

SEQ ID NO: 2742859 - protein, 32 aa, Entamoeba histolytica
VIHTQIQSKQHKRMFNLYDIQLKGENEEAKEI

SEQ ID NO: 2742860 - protein, 22 aa, Entamoeba histolytica
VKNQLLLMPYPTTVNAQFGSND

SEQ ID NO: 2742861 - protein, 25 aa, Entamoeba histolytica
VLNKPFIIQLLRYAALRGILIYPEI

SEQ ID NO: 2742862 - protein, 17 aa, Entamoeba histolytica
VLSFLFFCTFAQKFSII

SEQ ID NO: 2742863 - protein, 33 aa, Entamoeba histolytica
VNTALWQFFPIWLQYLCWPILQVIFKTPLEGAQ

SEQ ID NO: 2742864 - protein, 19 aa, Entamoeba histolytica
VRNIIYFRIEAIRKEIKAL

SEQ ID NO: 2742865 - protein, 18 aa, Entamoeba histolytica
VTLCLIFTQVNALDFHDF

SEQ ID NO: 2742866 - protein, 19 aa, Entamoeba histolytica
WASFMDKKLLKYLSKIKLP

SEQ ID NO: 2742867 - protein, 23 aa, Entamoeba histolytica
WIFLTFCLFLGASSSSNSYSYSS

SEQ ID NO: 2742868 - protein, 18 aa, Entamoeba histolytica
WLHAWKYSFNSHDWIAEI

SEQ ID NO: 2742869 - protein, 17 aa, Entamoeba histolytica
WMSWMDMIWVTTVSPEI

SEQ ID NO: 2742870 - protein, 19 aa, Entamoeba histolytica
WYGLHSFTYLRMTRALLDD

SEQ ID NO: 2742871 - protein, 17 aa, Entamoeba histolytica
YECATTFKGFRPCASGT

SEQ ID NO: 2742872 - protein, 17 aa, Entamoeba histolytica
YEKYNYKLPFPIKMHCL

SEQ ID NO: 2742873 - protein, 20 aa, Entamoeba histolytica
YFRNRHVMLFCYDITKKESF

SEQ ID NO: 2742874 - protein, 22 aa, Entamoeba histolytica
YGTSFLEFEAYTKALLSEDIKI

SEQ ID NO: 2742875 - protein, 20 aa, Entamoeba histolytica
YLTHQWIWIYWQNYKKNEYK

SEQ ID NO: 2742876 - protein, 7 aa, Entamoeba invadens
GIGTPKY

SEQ ID NO: 2742877 - protein, 7 aa, Entamoeba invadens
KKLGEGS

SEQ ID NO: 2742878 - protein, 7 aa, Entamoeba invadens
TDFGSSR

SEQ ID NO: 2742879 - protein, 4 aa, Entamoeba invadens
EKVN

SEQ ID NO: 2742880 - protein, 8 aa, Entamoeba invadens
KGVGTPKY

SEQ ID NO: 2742881 - protein, 8 aa, Entamoeba invadens
LTDFGSSR

SEQ ID NO: 2742882 - protein, 8 aa, Entamoeba invadens
TDFGSSRN

SEQ ID NO: 2742883 - protein, 4 aa, Entamoeba invadens
GEAC

SEQ ID NO: 2742884 - protein, 7 aa, Entamoeba invadens
GIGTPTY

SEQ ID NO: 2742885 - protein, 9 aa, Entamoeba invadens
LTDFGSSRN

SEQ ID NO: 2742886 - protein, 6 aa, Entamoeba invadens
LPTGGG

SEQ ID NO: 2742887 - protein, 7 aa, Entamoeba invadens
TTRGGCD

SEQ ID NO: 2742888 - protein, 4 aa, Entamoeba invadens
GEGS

SEQ ID NO: 2742889 - protein, 9 aa, Entamoeba invadens
KLTDFGSAR

SEQ ID NO: 2742890 - protein, 5 aa, Entamoeba invadens
EKESR

SEQ ID NO: 2742891 - protein, 8 aa, Entamoeba invadens
LTDFGSAR

SEQ ID NO: 2742892 - protein, 4 aa, Entamoeba invadens
NYRG

SEQ ID NO: 2742893 - protein, 4 aa, Entamoeba invadens
TYRG

SEQ ID NO: 2742894 - protein, 4 aa, Entamoeba invadens
PNNP

SEQ ID NO: 2742895 - protein, 5 aa, Entamoeba invadens
TSKHN

SEQ ID NO: 2742896 - protein, 23 aa, Entamoeba invadens
TTENSTKLDYDELKEDKKLGEGS

SEQ ID NO: 2742897 - protein, 10 aa, Entamoeba invadens
YSYANSNGVC

SEQ ID NO: 2742898 - protein, 8 aa, Entamoeba invadens
ETEQTTKL

SEQ ID NO: 2742899 - protein, 4 aa, Entamoeba invadens
FRGN

SEQ ID NO: 2742900 - protein, 6 aa, Entamoeba invadens
RTSSNV

SEQ ID NO: 2742901 - protein, 7 aa, Entamoeba invadens
TDETSDG

SEQ ID NO: 2742902 - protein, 6 aa, Entamoeba invadens
TDFGSA

SEQ ID NO: 2742903 - protein, 5 aa, Entamoeba invadens
GVGTP

SEQ ID NO: 2742904 - protein, 7 aa, Entamoeba invadens
KKIGEGS

SEQ ID NO: 2742905 - protein, 6 aa, Entamoeba invadens
NKGKGI

SEQ ID NO: 2742906 - protein, 7 aa, Entamoeba invadens
YSIRTEP

SEQ ID NO: 2742907 - protein, 6 aa, Entamoeba invadens
DFGSSR

SEQ ID NO: 2742908 - protein, 6 aa, Entamoeba invadens
GIGTPK

SEQ ID NO: 2742909 - protein, 6 aa, Entamoeba invadens
NECEKC

SEQ ID NO: 2742910 - protein, 5 aa, Entamoeba invadens
NSKCS

SEQ ID NO: 2742911 - protein, 7 aa, Entamoeba invadens
RKETKKM

SEQ ID NO: 2742912 - protein, 9 aa, Entamoeba invadens
SEKPIAEGA

SEQ ID NO: 2742913 - protein, 4 aa, Entamoeba invadens
SGEA

SEQ ID NO: 2742914 - protein, 7 aa, Entamoeba invadens
TDFGSAR

SEQ ID NO: 2742915 - protein, 11 aa, Entamoeba invadens
YSYDSSNKNCS

SEQ ID NO: 2742916 - protein, 8 aa, Entamoeba invadens
CKSCTNEG

SEQ ID NO: 2742917 - protein, 7 aa, Entamoeba invadens
DFGSSRN

SEQ ID NO: 2742918 - protein, 5 aa, Entamoeba invadens
ETTCD

SEQ ID NO: 2742919 - protein, 6 aa, Entamoeba invadens
GNTTNH

SEQ ID NO: 2742920 - protein, 7 aa, Entamoeba invadens
GVGTPTY

SEQ ID NO: 2742921 - protein, 11 aa, Entamoeba invadens
KRKQKKKEQNI

SEQ ID NO: 2742922 - protein, 7 aa, Entamoeba invadens
LDPNSAC

SEQ ID NO: 2742923 - protein, 6 aa, Entamoeba invadens
PPIGGG

SEQ ID NO: 2742924 - protein, 9 aa, Entamoeba invadens
QEKYTKSAD

SEQ ID NO: 2742925 - protein, 9 aa, Entamoeba invadens
YYSSGGTSL

SEQ ID NO: 2742926 - protein, 8 aa, Entamoeba invadens
EKKLGEGS

SEQ ID NO: 2742927 - protein, 6 aa, Entamoeba invadens
EKYKMP

SEQ ID NO: 2742928 - protein, 17 aa, Entamoeba invadens
ESANNKCSKCDDNYKLS

SEQ ID NO: 2742929 - protein, 7 aa, Entamoeba invadens
GIGTPSY

SEQ ID NO: 2742930 - protein, 5 aa, Entamoeba invadens
ISTGT

SEQ ID NO: 2742931 - protein, 11 aa, Entamoeba invadens
KCTKTKDSKCS

SEQ ID NO: 2742932 - protein, 9 aa, Entamoeba invadens
KEKYKKAAD

SEQ ID NO: 2742933 - protein, 10 aa, Entamoeba invadens
KEKYKKSADI

SEQ ID NO: 2742934 - protein, 8 aa, Entamoeba invadens
KKLGEGSF

SEQ ID NO: 2742935 - protein, 6 aa, Entamoeba invadens
KLGEGS

SEQ ID NO: 2742936 - protein, 9 aa, Entamoeba invadens
KLTDFGSSR

SEQ ID NO: 2742937 - protein, 7 aa, Entamoeba invadens
NKTTSGC

SEQ ID NO: 2742938 - protein, 6 aa, Entamoeba invadens
NTSKHN

SEQ ID NO: 2742939 - protein, 7 aa, Entamoeba invadens
SALSTKL

SEQ ID NO: 2742940 - protein, 4 aa, Entamoeba invadens
SYRG

SEQ ID NO: 2742941 - protein, 5 aa, Entamoeba invadens
TQNGC

SEQ ID NO: 2742942 - protein, 6 aa, Entamoeba invadens
YKLSDD

SEQ ID NO: 2742943 - protein, 6 aa, Entamoeba invadens
DFGSAR

SEQ ID NO: 2742944 - protein, 5 aa, Entamoeba invadens
DKETR

SEQ ID NO: 2742945 - protein, 14 aa, Entamoeba invadens
DKVNAKLTDFGSAR

SEQ ID NO: 2742946 - protein, 8 aa, Entamoeba invadens
GIGTPKYM

SEQ ID NO: 2742947 - protein, 9 aa, Entamoeba invadens
GSYPQTAGD

SEQ ID NO: 2742948 - protein, 5 aa, Entamoeba invadens
GTSRF

SEQ ID NO: 2742949 - protein, 18 aa, Entamoeba invadens
GYKRSTDGKSCDKCDESC

SEQ ID NO: 2742950 - protein, 7 aa, Entamoeba invadens
HYKKPAD

SEQ ID NO: 2742951 - protein, 5 aa, Entamoeba invadens
IGEGS

SEQ ID NO: 2742952 - protein, 8 aa, Entamoeba invadens
INRESGTE

SEQ ID NO: 2742953 - protein, 6 aa, Entamoeba invadens
KCATEN

SEQ ID NO: 2742954 - protein, 7 aa, Entamoeba invadens
KDNKHTE

SEQ ID NO: 2742955 - protein, 10 aa, Entamoeba invadens
LSTRLDPDEL

SEQ ID NO: 2742956 - protein, 9 aa, Entamoeba invadens
MKQSNDTDK

SEQ ID NO: 2742957 - protein, 5 aa, Entamoeba invadens
NKETR

SEQ ID NO: 2742958 - protein, 8 aa, Entamoeba invadens
NNSKCTEC

SEQ ID NO: 2742959 - protein, 9 aa, Entamoeba invadens
QEKYKKSAD

SEQ ID NO: 2742960 - protein, 10 aa, Entamoeba invadens
QQKYKKSADV

SEQ ID NO: 2742961 - protein, 10 aa, Entamoeba invadens
REKYKKPADV

SEQ ID NO: 2742962 - protein, 5 aa, Entamoeba invadens
SKSNL

SEQ ID NO: 2742963 - protein, 5 aa, Entamoeba invadens
SSYQR

SEQ ID NO: 2742964 - protein, 6 aa, Entamoeba invadens
TDFGTS

SEQ ID NO: 2742965 - protein, 5 aa, Entamoeba invadens
TTKHN

SEQ ID NO: 2742966 - protein, 5 aa, Entamoeba invadens
TTVTN

SEQ ID NO: 2742967 - protein, 6 aa, Entamoeba invadens
TYSEGG

SEQ ID NO: 2742968 - protein, 10 aa, Entamoeba invadens
VDGCKEKTGV

SEQ ID NO: 2742969 - protein, 7 aa, Entamoeba invadens
VGSGKSS

SEQ ID NO: 2742970 - protein, 5 aa, Entamoeba invadens
YRGRD

SEQ ID NO: 2742971 - protein, 4 aa, Entamoeba invadens
AAKG

SEQ ID NO: 2742972 - protein, 10 aa, Entamoeba invadens
CGTASVGNAK

SEQ ID NO: 2742973 - protein, 4 aa, Entamoeba invadens
CGTC

SEQ ID NO: 2742974 - protein, 4 aa, Entamoeba invadens
CKRC

SEQ ID NO: 2742975 - protein, 6 aa, Entamoeba invadens
CKTCNN

SEQ ID NO: 2742976 - protein, 13 aa, Entamoeba invadens
EAGTYKKTETTCD

SEQ ID NO: 2742977 - protein, 4 aa, Entamoeba invadens
EDGS

SEQ ID NO: 2742978 - protein, 9 aa, Entamoeba invadens
EGGKCNGAN

SEQ ID NO: 2742979 - protein, 7 aa, Entamoeba invadens
ENGETVS

SEQ ID NO: 2742980 - protein, 7 aa, Entamoeba invadens
EQSTRLD

SEQ ID NO: 2742981 - protein, 12 aa, Entamoeba invadens
IDTTTQQTTKLN

SEQ ID NO: 2742982 - protein, 7 aa, Entamoeba invadens
IKSDNTL

SEQ ID NO: 2742983 - protein, 10 aa, Entamoeba invadens
KEEKKLGEGS

SEQ ID NO: 2742984 - protein, 6 aa, Entamoeba invadens
KEGNDV

SEQ ID NO: 2742985 - protein, 6 aa, Entamoeba invadens
KEKKKM

SEQ ID NO: 2742986 - protein, 9 aa, Entamoeba invadens
KEKYKKSAD

SEQ ID NO: 2742987 - protein, 5 aa, Entamoeba invadens
KGEAC

SEQ ID NO: 2742988 - protein, 6 aa, Entamoeba invadens
KGKISE

SEQ ID NO: 2742989 - protein, 8 aa, Entamoeba invadens
KNKTSHGC

SEQ ID NO: 2742990 - protein, 6 aa, Entamoeba invadens
KPDNDK

SEQ ID NO: 2742991 - protein, 8 aa, Entamoeba invadens
KRKETKKM

SEQ ID NO: 2742992 - protein, 4 aa, Entamoeba invadens
KTNS

SEQ ID NO: 2742993 - protein, 6 aa, Entamoeba invadens
KTNSQY

SEQ ID NO: 2742994 - protein, 5 aa, Entamoeba invadens
KYRGN

SEQ ID NO: 2742995 - protein, 7 aa, Entamoeba invadens
KYRGNDV

SEQ ID NO: 2742996 - protein, 7 aa, Entamoeba invadens
KYSIRTE

SEQ ID NO: 2742997 - protein, 8 aa, Entamoeba invadens
LKKGETSQ

SEQ ID NO: 2742998 - protein, 6 aa, Entamoeba invadens
LPGGGG

SEQ ID NO: 2742999 - protein, 4 aa, Entamoeba invadens
MDEF

SEQ ID NO: 2743000 - protein, 8 aa, Entamoeba invadens
NCTSCESE

SEQ ID NO: 2743001 - protein, 8 aa, Entamoeba invadens
NTNKTATK

SEQ ID NO: 2743002 - protein, 4 aa, Entamoeba invadens
PNSP

SEQ ID NO: 2743003 - protein, 8 aa, Entamoeba invadens
PSDDGTFC

SEQ ID NO: 2743004 - protein, 6 aa, Entamoeba invadens
PTLTSN

SEQ ID NO: 2743005 - protein, 4 aa, Entamoeba invadens
PYGS

SEQ ID NO: 2743006 - protein, 10 aa, Entamoeba invadens
QKSGGCESCP

SEQ ID NO: 2743007 - protein, 4 aa, Entamoeba invadens
SDKR

SEQ ID NO: 2743008 - protein, 5 aa, Entamoeba invadens
SGEAC

SEQ ID NO: 2743009 - protein, 10 aa, Entamoeba invadens
SGYVPTSPIT

SEQ ID NO: 2743010 - protein, 7 aa, Entamoeba invadens
SKLGEGS

SEQ ID NO: 2743011 - protein, 9 aa, Entamoeba invadens
SNDALNDTC

SEQ ID NO: 2743012 - protein, 4 aa, Entamoeba invadens
SNTR

SEQ ID NO: 2743013 - protein, 11 aa, Entamoeba invadens
STKTDQCESCS

SEQ ID NO: 2743014 - protein, 6 aa, Entamoeba invadens
STVNNT

SEQ ID NO: 2743015 - protein, 11 aa, Entamoeba invadens
SYVPTTSDPFK

SEQ ID NO: 2743016 - protein, 9 aa, Entamoeba invadens
TDAASSTHI

SEQ ID NO: 2743017 - protein, 10 aa, Entamoeba invadens
TDFGSSRNVN

SEQ ID NO: 2743018 - protein, 4 aa, Entamoeba invadens
TDTQ

SEQ ID NO: 2743019 - protein, 7 aa, Entamoeba invadens
TKNIEGK

SEQ ID NO: 2743020 - protein, 5 aa, Entamoeba invadens
TNSKC

SEQ ID NO: 2743021 - protein, 5 aa, Entamoeba invadens
TSCDT

SEQ ID NO: 2743022 - protein, 5 aa, Entamoeba invadens
TTNTN

SEQ ID NO: 2743023 - protein, 19 aa, Entamoeba invadens
VNQKNTLKANQKKSHQLKR

SEQ ID NO: 2743024 - protein, 4 aa, Entamoeba invadens
YGSL

SEQ ID NO: 2743025 - protein, 8 aa, Entamoeba invadens
YTVNGNEC

SEQ ID NO: 2743026 - protein, 4 aa, Entamoeba invadens
YYTT

SEQ ID NO: 2743027 - protein, 6 aa, Entamoeba invadens
ADCQPC

SEQ ID NO: 2743028 - protein, 11 aa, Entamoeba invadens
AGSTTCKSCSS

SEQ ID NO: 2743029 - protein, 8 aa, Entamoeba invadens
ANGENGEI

SEQ ID NO: 2743030 - protein, 9 aa, Entamoeba invadens
ARKVPNGNG

SEQ ID NO: 2743031 - protein, 13 aa, Entamoeba invadens
ARNLTQEQEKEFN

SEQ ID NO: 2743032 - protein, 4 aa, Entamoeba invadens
ASID

SEQ ID NO: 2743033 - protein, 7 aa, Entamoeba invadens
ASNGERK

SEQ ID NO: 2743034 - protein, 7 aa, Entamoeba invadens
ATCSNDG

SEQ ID NO: 2743035 - protein, 9 aa, Entamoeba invadens
ATKKSCTKC

SEQ ID NO: 2743036 - protein, 5 aa, Entamoeba invadens
AYPKE

SEQ ID NO: 2743037 - protein, 5 aa, Entamoeba invadens
AYQND

SEQ ID NO: 2743038 - protein, 6 aa, Entamoeba invadens
CDACDE

SEQ ID NO: 2743039 - protein, 8 aa, Entamoeba invadens
CDSQSGQC

SEQ ID NO: 2743040 - protein, 9 aa, Entamoeba invadens
CEENNKDYL

SEQ ID NO: 2743041 - protein, 5 aa, Entamoeba invadens
CGTTG

SEQ ID NO: 2743042 - protein, 8 aa, Entamoeba invadens
CKTCSNDG

SEQ ID NO: 2743043 - protein, 11 aa, Entamoeba invadens
CNGQCNTSTGV

SEQ ID NO: 2743044 - protein, 12 aa, Entamoeba invadens
CSAGTYQSGGSC

SEQ ID NO: 2743045 - protein, 16 aa, Entamoeba invadens
CSPQSELTSCANKTTA

SEQ ID NO: 2743046 - protein, 7 aa, Entamoeba invadens
DAADNER

SEQ ID NO: 2743047 - protein, 5 aa, Entamoeba invadens
DAKSH

SEQ ID NO: 2743048 - protein, 9 aa, Entamoeba invadens
DDQNKETAK

SEQ ID NO: 2743049 - protein, 5 aa, Entamoeba invadens
DFGSA

SEQ ID NO: 2743050 - protein, 6 aa, Entamoeba invadens
DGKYTR

SEQ ID NO: 2743051 - protein, 4 aa, Entamoeba invadens
DGYY

SEQ ID NO: 2743052 - protein, 7 aa, Entamoeba invadens
DISSRKC

SEQ ID NO: 2743053 - protein, 9 aa, Entamoeba invadens
DKDDKCTQC

SEQ ID NO: 2743054 - protein, 9 aa, Entamoeba invadens
DKTNGNCTS

SEQ ID NO: 2743055 - protein, 13 aa, Entamoeba invadens
DKVNAKLTDFGSA

SEQ ID NO: 2743056 - protein, 4 aa, Entamoeba invadens
DNGY

SEQ ID NO: 2743057 - protein, 7 aa, Entamoeba invadens
DNTKTKC

SEQ ID NO: 2743058 - protein, 4 aa, Entamoeba invadens
DNVN

SEQ ID NO: 2743059 - protein, 5 aa, Entamoeba invadens
DSAKG

SEQ ID NO: 2743060 - protein, 7 aa, Entamoeba invadens
DVEGQTT

SEQ ID NO: 2743061 - protein, 8 aa, Entamoeba invadens
EGEDNTTT

SEQ ID NO: 2743062 - protein, 14 aa, Entamoeba invadens
EGINNEENGKCAPQ

SEQ ID NO: 2743063 - protein, 4 aa, Entamoeba invadens
EGYY

SEQ ID NO: 2743064 - protein, 8 aa, Entamoeba invadens
EHYKKPAD

SEQ ID NO: 2743065 - protein, 12 aa, Entamoeba invadens
EIKTEKKLGEGS

SEQ ID NO: 2743066 - protein, 5 aa, Entamoeba invadens
EKKRK

SEQ ID NO: 2743067 - protein, 14 aa, Entamoeba invadens
EKVNGKLTDFGSSR

SEQ ID NO: 2743068 - protein, 9 aa, Entamoeba invadens
EKYKKSADV

SEQ ID NO: 2743069 - protein, 7 aa, Entamoeba invadens
ENSETVS

SEQ ID NO: 2743070 - protein, 7 aa, Entamoeba invadens
EPKGRSC

SEQ ID NO: 2743071 - protein, 4 aa, Entamoeba invadens
ERDT

SEQ ID NO: 2743072 - protein, 8 aa, Entamoeba invadens
ESKLGEGS

SEQ ID NO: 2743073 - protein, 5 aa, Entamoeba invadens
ETEHY

SEQ ID NO: 2743074 - protein, 4 aa, Entamoeba invadens
FKPS

SEQ ID NO: 2743075 - protein, 5 aa, Entamoeba invadens
FRGNE

SEQ ID NO: 2743076 - protein, 12 aa, Entamoeba invadens
GNDDRNSVNSTN

SEQ ID NO: 2743077 - protein, 4 aa, Entamoeba invadens
GRAV

SEQ ID NO: 2743078 - protein, 7 aa, Entamoeba invadens
GTCNNRE

SEQ ID NO: 2743079 - protein, 4 aa, Entamoeba invadens
GVEM

SEQ ID NO: 2743080 - protein, 5 aa, Entamoeba invadens
GVGSP

SEQ ID NO: 2743081 - protein, 12 aa, Entamoeba invadens
GYNKPSESGDSC

SEQ ID NO: 2743082 - protein, 9 aa, Entamoeba invadens
HKPSDAGDY

SEQ ID NO: 2743083 - protein, 9 aa, Entamoeba invadens
HSLTTKSIT

SEQ ID NO: 2743084 - protein, 8 aa, Entamoeba invadens
HYKKPADV

SEQ ID NO: 2743085 - protein, 11 aa, Entamoeba invadens
INNSGAIAAAT

SEQ ID NO: 2743086 - protein, 6 aa, Entamoeba invadens
IPVESE

SEQ ID NO: 2743087 - protein, 5 aa, Entamoeba invadens
IRTEP

SEQ ID NO: 2743088 - protein, 4 aa, Entamoeba invadens
ISTI

SEQ ID NO: 2743089 - protein, 16 aa, Entamoeba invadens
KCDDTCNNQCDSSTGF

SEQ ID NO: 2743090 - protein, 9 aa, Entamoeba invadens
KCDGNTGYC

SEQ ID NO: 2743091 - protein, 18 aa, Entamoeba invadens
KEDAVNGKLTDFGASRNI

SEQ ID NO: 2743092 - protein, 8 aa, Entamoeba invadens
KEISTNKT

SEQ ID NO: 2743093 - protein, 6 aa, Entamoeba invadens
KESFED

SEQ ID NO: 2743094 - protein, 4 aa, Entamoeba invadens
KGEA

SEQ ID NO: 2743095 - protein, 5 aa, Entamoeba invadens
KGRAV

SEQ ID NO: 2743096 - protein, 7 aa, Entamoeba invadens
KKSDEVD

SEQ ID NO: 2743097 - protein, 16 aa, Entamoeba invadens
KKSITNSEDKGLGTPI

SEQ ID NO: 2743098 - protein, 6 aa, Entamoeba invadens
KKTVGG

SEQ ID NO: 2743099 - protein, 9 aa, Entamoeba invadens
KLENKRKEL

SEQ ID NO: 2743100 - protein, 10 aa, Entamoeba invadens
KLTDFGSSRN

SEQ ID NO: 2743101 - protein, 8 aa, Entamoeba invadens
KNPHDPIT

SEQ ID NO: 2743102 - protein, 6 aa, Entamoeba invadens
KPMKCS

SEQ ID NO: 2743103 - protein, 7 aa, Entamoeba invadens
KQLGEGS

SEQ ID NO: 2743104 - protein, 5 aa, Entamoeba invadens
KSQSG

SEQ ID NO: 2743105 - protein, 8 aa, Entamoeba invadens
KTNGYCTS

SEQ ID NO: 2743106 - protein, 6 aa, Entamoeba invadens
KTQMTT

SEQ ID NO: 2743107 - protein, 8 aa, Entamoeba invadens
KVTQNGCA

SEQ ID NO: 2743108 - protein, 6 aa, Entamoeba invadens
KYRGNT

SEQ ID NO: 2743109 - protein, 5 aa, Entamoeba invadens
LNQPS

SEQ ID NO: 2743110 - protein, 7 aa, Entamoeba invadens
LPTDSTA

SEQ ID NO: 2743111 - protein, 9 aa, Entamoeba invadens
LSSSSGCER

SEQ ID NO: 2743112 - protein, 11 aa, Entamoeba invadens
MDSKSKVEVPT

SEQ ID NO: 2743113 - protein, 13 aa, Entamoeba invadens
MKQSDNKEETISE

SEQ ID NO: 2743114 - protein, 8 aa, Entamoeba invadens
NCDGTSGI

SEQ ID NO: 2743115 - protein, 8 aa, Entamoeba invadens
NEKFPLKT

SEQ ID NO: 2743116 - protein, 19 aa, Entamoeba invadens
NENAQFKAADNEAANTNFN

SEQ ID NO: 2743117 - protein, 7 aa, Entamoeba invadens
NFTAENG

SEQ ID NO: 2743118 - protein, 8 aa, Entamoeba invadens
NKSKNPMK

SEQ ID NO: 2743119 - protein, 14 aa, Entamoeba invadens
NKVNAKLTDFGSSR

SEQ ID NO: 2743120 - protein, 5 aa, Entamoeba invadens
NKYSV

SEQ ID NO: 2743121 - protein, 7 aa, Entamoeba invadens
NQKKEKL

SEQ ID NO: 2743122 - protein, 4 aa, Entamoeba invadens
NQSS

SEQ ID NO: 2743123 - protein, 6 aa, Entamoeba invadens
NRCQTL

SEQ ID NO: 2743124 - protein, 8 aa, Entamoeba invadens
NSSKGNVK

SEQ ID NO: 2743125 - protein, 7 aa, Entamoeba invadens
NSTNGYC

SEQ ID NO: 2743126 - protein, 22 aa, Entamoeba invadens
NYGETTNKQWNEELRNAPGNVA

SEQ ID NO: 2743127 - protein, 6 aa, Entamoeba invadens
PETFKD

SEQ ID NO: 2743128 - protein, 4 aa, Entamoeba invadens
PNTP

SEQ ID NO: 2743129 - protein, 9 aa, Entamoeba invadens
PSDDGTYCS

SEQ ID NO: 2743130 - protein, 5 aa, Entamoeba invadens
PSLPK

SEQ ID NO: 2743131 - protein, 10 aa, Entamoeba invadens
QEKYKKSADI

SEQ ID NO: 2743132 - protein, 6 aa, Entamoeba invadens
QNQTRN

SEQ ID NO: 2743133 - protein, 11 aa, Entamoeba invadens
QTCATDGTRSC

SEQ ID NO: 2743134 - protein, 4 aa, Entamoeba invadens
QYGS

SEQ ID NO: 2743135 - protein, 9 aa, Entamoeba invadens
REKYKKSAD

SEQ ID NO: 2743136 - protein, 6 aa, Entamoeba invadens
RHSTTT

SEQ ID NO: 2743137 - protein, 8 aa, Entamoeba invadens
RKGESTEI

SEQ ID NO: 2743138 - protein, 7 aa, Entamoeba invadens
RKVPNGN

SEQ ID NO: 2743139 - protein, 10 aa, Entamoeba invadens
RNNKGCQRCP

SEQ ID NO: 2743140 - protein, 8 aa, Entamoeba invadens
RSSSLSNN

SEQ ID NO: 2743141 - protein, 7 aa, Entamoeba invadens
SASTNIT

SEQ ID NO: 2743142 - protein, 5 aa, Entamoeba invadens
SCVNS

SEQ ID NO: 2743143 - protein, 6 aa, Entamoeba invadens
SDATRN

SEQ ID NO: 2743144 - protein, 12 aa, Entamoeba invadens
SGLRPNTTSGKC

SEQ ID NO: 2743145 - protein, 4 aa, Entamoeba invadens
SIEN

SEQ ID NO: 2743146 - protein, 7 aa, Entamoeba invadens
SNATDCQ

SEQ ID NO: 2743147 - protein, 7 aa, Entamoeba invadens
SNENVNA

SEQ ID NO: 2743148 - protein, 6 aa, Entamoeba invadens
SNQCTK

SEQ ID NO: 2743149 - protein, 12 aa, Entamoeba invadens
SQNNPNCDNQNG

SEQ ID NO: 2743150 - protein, 11 aa, Entamoeba invadens
SQTNKNQCTSC

SEQ ID NO: 2743151 - protein, 4 aa, Entamoeba invadens
SSID

SEQ ID NO: 2743152 - protein, 8 aa, Entamoeba invadens
SSTNKCEK

SEQ ID NO: 2743153 - protein, 27 aa, Entamoeba invadens
STECKKCDRKSGACTSCEVGNKRVDNS

SEQ ID NO: 2743154 - protein, 7 aa, Entamoeba invadens
SVSWPEG

SEQ ID NO: 2743155 - protein, 16 aa, Entamoeba invadens
TCGGKCDTTNGHCTGC

SEQ ID NO: 2743156 - protein, 14 aa, Entamoeba invadens
TCNGNCDQTTGKCT

SEQ ID NO: 2743157 - protein, 6 aa, Entamoeba invadens
TCSPDF

SEQ ID NO: 2743158 - protein, 6 aa, Entamoeba invadens
TDPPGK

SEQ ID NO: 2743159 - protein, 10 aa, Entamoeba invadens
TENKARRGYG

SEQ ID NO: 2743160 - protein, 6 aa, Entamoeba invadens
TGECTS

SEQ ID NO: 2743161 - protein, 8 aa, Entamoeba invadens
TKELEKTT

SEQ ID NO: 2743162 - protein, 5 aa, Entamoeba invadens
TKNYP

SEQ ID NO: 2743163 - protein, 9 aa, Entamoeba invadens
TKTQTCDPC

SEQ ID NO: 2743164 - protein, 7 aa, Entamoeba invadens
TNECKTK

SEQ ID NO: 2743165 - protein, 16 aa, Entamoeba invadens
TNYKTSNGDCLPRSSI

SEQ ID NO: 2743166 - protein, 4 aa, Entamoeba invadens
TPFG

SEQ ID NO: 2743167 - protein, 5 aa, Entamoeba invadens
TQQPN

SEQ ID NO: 2743168 - protein, 8 aa, Entamoeba invadens
TQQSTRID

SEQ ID NO: 2743169 - protein, 12 aa, Entamoeba invadens
TSALDTQSEKVV

SEQ ID NO: 2743170 - protein, 4 aa, Entamoeba invadens
TSNG

SEQ ID NO: 2743171 - protein, 4 aa, Entamoeba invadens
TSSD

SEQ ID NO: 2743172 - protein, 8 aa, Entamoeba invadens
TTDTQCNS

SEQ ID NO: 2743173 - protein, 4 aa, Entamoeba invadens
TTGN

SEQ ID NO: 2743174 - protein, 16 aa, Entamoeba invadens
TTKDKCDKYKIRTEPK

SEQ ID NO: 2743175 - protein, 5 aa, Entamoeba invadens
TTNNH

SEQ ID NO: 2743176 - protein, 11 aa, Entamoeba invadens
TYNGNKYGRTY

SEQ ID NO: 2743177 - protein, 4 aa, Entamoeba invadens
VDAG

SEQ ID NO: 2743178 - protein, 6 aa, Entamoeba invadens
VEEGKR

SEQ ID NO: 2743179 - protein, 5 aa, Entamoeba invadens
VEPST

SEQ ID NO: 2743180 - protein, 11 aa, Entamoeba invadens
VGRTGSGKSTL

SEQ ID NO: 2743181 - protein, 6 aa, Entamoeba invadens
VKPDNT

SEQ ID NO: 2743182 - protein, 5 aa, Entamoeba invadens
VREVE

SEQ ID NO: 2743183 - protein, 5 aa, Entamoeba invadens
VSDNI

SEQ ID NO: 2743184 - protein, 4 aa, Entamoeba invadens
VSDS

SEQ ID NO: 2743185 - protein, 6 aa, Entamoeba invadens
VSNKTT

SEQ ID NO: 2743186 - protein, 5 aa, Entamoeba invadens
VTNKT

SEQ ID NO: 2743187 - protein, 4 aa, Entamoeba invadens
VVTG

SEQ ID NO: 2743188 - protein, 4 aa, Entamoeba invadens
YATN

SEQ ID NO: 2743189 - protein, 4 aa, Entamoeba invadens
YGTS

SEQ ID NO: 2743190 - protein, 4 aa, Entamoeba invadens
YKQK

SEQ ID NO: 2743191 - protein, 10 aa, Entamoeba invadens
YMRSSDGTTC

SEQ ID NO: 2743192 - protein, 4 aa, Entamoeba invadens
YSKD

SEQ ID NO: 2743193 - protein, 6 aa, Entamoeba invadens
YSKSSI

SEQ ID NO: 2743194 - protein, 7 aa, Entamoeba invadens
YSYTKNG

SEQ ID NO: 2743195 - protein, 6 aa, Entamoeba invadens
YYKQKT

SEQ ID NO: 2743196 - protein, 7 aa, Entamoeba invadens
AADKYKT

SEQ ID NO: 2743197 - protein, 5 aa, Entamoeba invadens
ADKEA

SEQ ID NO: 2743198 - protein, 7 aa, Entamoeba invadens
AGIAEPG

SEQ ID NO: 2743199 - protein, 7 aa, Entamoeba invadens
AGSGYPA

SEQ ID NO: 2743200 - protein, 4 aa, Entamoeba invadens
AIPE

SEQ ID NO: 2743201 - protein, 8 aa, Entamoeba invadens
AKCEGGCV

SEQ ID NO: 2743202 - protein, 9 aa, Entamoeba invadens
AKLTDFGSA

SEQ ID NO: 2743203 - protein, 6 aa, Entamoeba invadens
AKTQMT

SEQ ID NO: 2743204 - protein, 7 aa, Entamoeba invadens
ANSSSQC

SEQ ID NO: 2743205 - protein, 5 aa, Entamoeba invadens
ANVGQ

SEQ ID NO: 2743206 - protein, 9 aa, Entamoeba invadens
ASCNATDGK

SEQ ID NO: 2743207 - protein, 9 aa, Entamoeba invadens
ASCNATNGK

SEQ ID NO: 2743208 - protein, 4 aa, Entamoeba invadens
ASDF

SEQ ID NO: 2743209 - protein, 8 aa, Entamoeba invadens
ASDNTRRC

SEQ ID NO: 2743210 - protein, 10 aa, Entamoeba invadens
ASDSTRKCKQ

SEQ ID NO: 2743211 - protein, 9 aa, Entamoeba invadens
ASGCGKSTT

SEQ ID NO: 2743212 - protein, 4 aa, Entamoeba invadens
ASRN

SEQ ID NO: 2743213 - protein, 7 aa, Entamoeba invadens
ATNDRCT

SEQ ID NO: 2743214 - protein, 35 aa, Entamoeba invadens
AWSDPTEKAPEVPSDKPSGDHSETDDENNNQENSA

SEQ ID NO: 2743215 - protein, 5 aa, Entamoeba invadens
AYASI

SEQ ID NO: 2743216 - protein, 4 aa, Entamoeba invadens
AYQN

SEQ ID NO: 2743217 - protein, 10 aa, Entamoeba invadens
CATCQDKETC

SEQ ID NO: 2743218 - protein, 6 aa, Entamoeba invadens
CDAASG

SEQ ID NO: 2743219 - protein, 5 aa, Entamoeba invadens
CDKTT

SEQ ID NO: 2743220 - protein, 13 aa, Entamoeba invadens
CDSGYKTDSTAGA

SEQ ID NO: 2743221 - protein, 4 aa, Entamoeba invadens
CDSS

SEQ ID NO: 2743222 - protein, 5 aa, Entamoeba invadens
CDSTC

SEQ ID NO: 2743223 - protein, 5 aa, Entamoeba invadens
CEDQT

SEQ ID NO: 2743224 - protein, 5 aa, Entamoeba invadens
CEKCD

SEQ ID NO: 2743225 - protein, 4 aa, Entamoeba invadens
CENG

SEQ ID NO: 2743226 - protein, 10 aa, Entamoeba invadens
CENNTCDAVN

SEQ ID NO: 2743227 - protein, 7 aa, Entamoeba invadens
CEPGTTL

SEQ ID NO: 2743228 - protein, 5 aa, Entamoeba invadens
CESDT

SEQ ID NO: 2743229 - protein, 6 aa, Entamoeba invadens
CGDNNI

SEQ ID NO: 2743230 - protein, 11 aa, Entamoeba invadens
CGSSGCSNKTN

SEQ ID NO: 2743231 - protein, 6 aa, Entamoeba invadens
CGTATP

SEQ ID NO: 2743232 - protein, 5 aa, Entamoeba invadens
CGTCV

SEQ ID NO: 2743233 - protein, 14 aa, Entamoeba invadens
CKDKSEYKTPCTDK

SEQ ID NO: 2743234 - protein, 15 aa, Entamoeba invadens
CKKCTEAGKCTECPD

SEQ ID NO: 2743235 - protein, 9 aa, Entamoeba invadens
CKKTGTGSV

SEQ ID NO: 2743236 - protein, 24 aa, Entamoeba invadens
CKTNSKNTCEDCENGITTTGNCEE

SEQ ID NO: 2743237 - protein, 10 aa, Entamoeba invadens
CNEKTGQCEN

SEQ ID NO: 2743238 - protein, 9 aa, Entamoeba invadens
CNGNSSSNC

SEQ ID NO: 2743239 - protein, 8 aa, Entamoeba invadens
CNNSPNRI

SEQ ID NO: 2743240 - protein, 9 aa, Entamoeba invadens
CNVTSSSGC

SEQ ID NO: 2743241 - protein, 9 aa, Entamoeba invadens
CPGGAERKC

SEQ ID NO: 2743242 - protein, 7 aa, Entamoeba invadens
CPKEQNG

SEQ ID NO: 2743243 - protein, 7 aa, Entamoeba invadens
CQQTSKI

SEQ ID NO: 2743244 - protein, 5 aa, Entamoeba invadens
CSSAF

SEQ ID NO: 2743245 - protein, 4 aa, Entamoeba invadens
CSSC

SEQ ID NO: 2743246 - protein, 4 aa, Entamoeba invadens
CSTC

SEQ ID NO: 2743247 - protein, 4 aa, Entamoeba invadens
CTDG

SEQ ID NO: 2743248 - protein, 4 aa, Entamoeba invadens
CTQC

SEQ ID NO: 2743249 - protein, 10 aa, Entamoeba invadens
CYSDTSKCKE

SEQ ID NO: 2743250 - protein, 8 aa, Entamoeba invadens
DAASSTHI

SEQ ID NO: 2743251 - protein, 4 aa, Entamoeba invadens
DAYD

SEQ ID NO: 2743252 - protein, 7 aa, Entamoeba invadens
DDALGDT

SEQ ID NO: 2743253 - protein, 7 aa, Entamoeba invadens
DDNDPLK

SEQ ID NO: 2743254 - protein, 7 aa, Entamoeba invadens
DEDEVAE

SEQ ID NO: 2743255 - protein, 7 aa, Entamoeba invadens
DEKGTLQ

SEQ ID NO: 2743256 - protein, 8 aa, Entamoeba invadens
DGCDATNG

SEQ ID NO: 2743257 - protein, 7 aa, Entamoeba invadens
DGQGNCK

SEQ ID NO: 2743258 - protein, 7 aa, Entamoeba invadens
DGYGGDD

SEQ ID NO: 2743259 - protein, 5 aa, Entamoeba invadens
DKSVR

SEQ ID NO: 2743260 - protein, 9 aa, Entamoeba invadens
DKTGTLTEN

SEQ ID NO: 2743261 - protein, 4 aa, Entamoeba invadens
DKVN

SEQ ID NO: 2743262 - protein, 7 aa, Entamoeba invadens
DKYCRPQ

SEQ ID NO: 2743263 - protein, 6 aa, Entamoeba invadens
DLTQQL

SEQ ID NO: 2743264 - protein, 11 aa, Entamoeba invadens
DNKKCSKCDAS

SEQ ID NO: 2743265 - protein, 5 aa, Entamoeba invadens
DPNTN

SEQ ID NO: 2743266 - protein, 12 aa, Entamoeba invadens
DPYDPAKFPDSE

SEQ ID NO: 2743267 - protein, 4 aa, Entamoeba invadens
DPYP

SEQ ID NO: 2743268 - protein, 7 aa, Entamoeba invadens
DQKCTTC

SEQ ID NO: 2743269 - protein, 6 aa, Entamoeba invadens
DTKSGY

SEQ ID NO: 2743270 - protein, 6 aa, Entamoeba invadens
EAGQPA

SEQ ID NO: 2743271 - protein, 6 aa, Entamoeba invadens
EASTYP

SEQ ID NO: 2743272 - protein, 6 aa, Entamoeba invadens
EAYDKE

SEQ ID NO: 2743273 - protein, 6 aa, Entamoeba invadens
ECNTEK

SEQ ID NO: 2743274 - protein, 16 aa, Entamoeba invadens
ECPTDPTDASEQNNLE

SEQ ID NO: 2743275 - protein, 7 aa, Entamoeba invadens
EDGKNKL

SEQ ID NO: 2743276 - protein, 4 aa, Entamoeba invadens
EDQF

SEQ ID NO: 2743277 - protein, 6 aa, Entamoeba invadens
EEKLRK

SEQ ID NO: 2743278 - protein, 9 aa, Entamoeba invadens
EEKRLGEGS

SEQ ID NO: 2743279 - protein, 7 aa, Entamoeba invadens
EENRPNN

SEQ ID NO: 2743280 - protein, 6 aa, Entamoeba invadens
EEPYKE

SEQ ID NO: 2743281 - protein, 7 aa, Entamoeba invadens
EGKCSAC

SEQ ID NO: 2743282 - protein, 9 aa, Entamoeba invadens
EGVPTTNKD

SEQ ID NO: 2743283 - protein, 7 aa, Entamoeba invadens
EGYYPSN

SEQ ID NO: 2743284 - protein, 7 aa, Entamoeba invadens
EHNPKKR

SEQ ID NO: 2743285 - protein, 10 aa, Entamoeba invadens
EIPEDEKKSF

SEQ ID NO: 2743286 - protein, 5 aa, Entamoeba invadens
EIRTP

SEQ ID NO: 2743287 - protein, 5 aa, Entamoeba invadens
EISTC

SEQ ID NO: 2743288 - protein, 12 aa, Entamoeba invadens
EITEDEKLGEGS

SEQ ID NO: 2743289 - protein, 6 aa, Entamoeba invadens
EKCDKC

SEQ ID NO: 2743290 - protein, 24 aa, Entamoeba invadens
EKEGKCEKCKDKYDTPCKEGDKEC

SEQ ID NO: 2743291 - protein, 8 aa, Entamoeba invadens
EKKIGEGS

SEQ ID NO: 2743292 - protein, 7 aa, Entamoeba invadens
EKLGEGS

SEQ ID NO: 2743293 - protein, 8 aa, Entamoeba invadens
EKNLNNMS

SEQ ID NO: 2743294 - protein, 8 aa, Entamoeba invadens
EKRCSPCD

SEQ ID NO: 2743295 - protein, 6 aa, Entamoeba invadens
EKTTRL

SEQ ID NO: 2743296 - protein, 6 aa, Entamoeba invadens
EKYKMS

SEQ ID NO: 2743297 - protein, 12 aa, Entamoeba invadens
ELEETKQIGEGS

SEQ ID NO: 2743298 - protein, 12 aa, Entamoeba invadens
ELKEDKKLGEGS

SEQ ID NO: 2743299 - protein, 4 aa, Entamoeba invadens
ENET

SEQ ID NO: 2743300 - protein, 7 aa, Entamoeba invadens
ENFPGAD

SEQ ID NO: 2743301 - protein, 5 aa, Entamoeba invadens
ENSKC

SEQ ID NO: 2743302 - protein, 7 aa, Entamoeba invadens
EPAKGKV

SEQ ID NO: 2743303 - protein, 4 aa, Entamoeba invadens
EPYK

SEQ ID NO: 2743304 - protein, 5 aa, Entamoeba invadens
EPYKD

SEQ ID NO: 2743305 - protein, 7 aa, Entamoeba invadens
EPYPKSE

SEQ ID NO: 2743306 - protein, 7 aa, Entamoeba invadens
EPYSKDQ

SEQ ID NO: 2743307 - protein, 5 aa, Entamoeba invadens
EQQPT

SEQ ID NO: 2743308 - protein, 6 aa, Entamoeba invadens
EQSKRL

SEQ ID NO: 2743309 - protein, 6 aa, Entamoeba invadens
ESANGK

SEQ ID NO: 2743310 - protein, 6 aa, Entamoeba invadens
ESGTFC

SEQ ID NO: 2743311 - protein, 5 aa, Entamoeba invadens
ESPGN

SEQ ID NO: 2743312 - protein, 4 aa, Entamoeba invadens
ESTR

SEQ ID NO: 2743313 - protein, 10 aa, Entamoeba invadens
ETAAPDAPSI

SEQ ID NO: 2743314 - protein, 9 aa, Entamoeba invadens
ETGKQIDEK

SEQ ID NO: 2743315 - protein, 17 aa, Entamoeba invadens
ETVADNAKIYNRSGCPC

SEQ ID NO: 2743316 - protein, 4 aa, Entamoeba invadens
ETVN

SEQ ID NO: 2743317 - protein, 6 aa, Entamoeba invadens
EVEKTT

SEQ ID NO: 2743318 - protein, 8 aa, Entamoeba invadens
FIESSGKI

SEQ ID NO: 2743319 - protein, 5 aa, Entamoeba invadens
FLPSG

SEQ ID NO: 2743320 - protein, 4 aa, Entamoeba invadens
FNSE

SEQ ID NO: 2743321 - protein, 10 aa, Entamoeba invadens
FRNEDGKCEN

SEQ ID NO: 2743322 - protein, 5 aa, Entamoeba invadens
FRSEP

SEQ ID NO: 2743323 - protein, 4 aa, Entamoeba invadens
FTGN

SEQ ID NO: 2743324 - protein, 16 aa, Entamoeba invadens
FTSSGKRLQIPTSVPE

SEQ ID NO: 2743325 - protein, 4 aa, Entamoeba invadens
FYQG

SEQ ID NO: 2743326 - protein, 8 aa, Entamoeba invadens
FYSTSGSS

SEQ ID NO: 2743327 - protein, 9 aa, Entamoeba invadens
GAKYTSEGK

SEQ ID NO: 2743328 - protein, 4 aa, Entamoeba invadens
GCTQ

SEQ ID NO: 2743329 - protein, 7 aa, Entamoeba invadens
GDEVNVN

SEQ ID NO: 2743330 - protein, 4 aa, Entamoeba invadens
GDTL

SEQ ID NO: 2743331 - protein, 11 aa, Entamoeba invadens
GEDQKDRDADN

SEQ ID NO: 2743332 - protein, 11 aa, Entamoeba invadens
GEEVEVNEKQR

SEQ ID NO: 2743333 - protein, 12 aa, Entamoeba invadens
GGSNLSGGQKQR

SEQ ID NO: 2743334 - protein, 7 aa, Entamoeba invadens
GIGTPAY

SEQ ID NO: 2743335 - protein, 6 aa, Entamoeba invadens
GKCTSC

SEQ ID NO: 2743336 - protein, 7 aa, Entamoeba invadens
GLGPRDL

SEQ ID NO: 2743337 - protein, 8 aa, Entamoeba invadens
GNECKKCN

SEQ ID NO: 2743338 - protein, 4 aa, Entamoeba invadens
GNYL

SEQ ID NO: 2743339 - protein, 8 aa, Entamoeba invadens
GSDKGKRT

SEQ ID NO: 2743340 - protein, 4 aa, Entamoeba invadens
GSLT

SEQ ID NO: 2743341 - protein, 5 aa, Entamoeba invadens
GSYRG

SEQ ID NO: 2743342 - protein, 7 aa, Entamoeba invadens
GTFEKTG

SEQ ID NO: 2743343 - protein, 6 aa, Entamoeba invadens
GTTSTD

SEQ ID NO: 2743344 - protein, 4 aa, Entamoeba invadens
GVQY

SEQ ID NO: 2743345 - protein, 11 aa, Entamoeba invadens
GYMRSSDGKQC

SEQ ID NO: 2743346 - protein, 8 aa, Entamoeba invadens
GYSSTTNG

SEQ ID NO: 2743347 - protein, 4 aa, Entamoeba invadens
GYYR

SEQ ID NO: 2743348 - protein, 8 aa, Entamoeba invadens
HDTRKKEV

SEQ ID NO: 2743349 - protein, 10 aa, Entamoeba invadens
HETTEPSKIP

SEQ ID NO: 2743350 - protein, 4 aa, Entamoeba invadens
HGSL

SEQ ID NO: 2743351 - protein, 7 aa, Entamoeba invadens
HKTSDEI

SEQ ID NO: 2743352 - protein, 8 aa, Entamoeba invadens
HKTSDEVD

SEQ ID NO: 2743353 - protein, 8 aa, Entamoeba invadens
HKTSEEVD

SEQ ID NO: 2743354 - protein, 4 aa, Entamoeba invadens
HSTI

SEQ ID NO: 2743355 - protein, 4 aa, Entamoeba invadens
IAEG

SEQ ID NO: 2743356 - protein, 7 aa, Entamoeba invadens
IEDSKCT

SEQ ID NO: 2743357 - protein, 17 aa, Entamoeba invadens
IKANGKLTDFGSSRNVN

SEQ ID NO: 2743358 - protein, 5 aa, Entamoeba invadens
IKPDN

SEQ ID NO: 2743359 - protein, 6 aa, Entamoeba invadens
IKPDNT

SEQ ID NO: 2743360 - protein, 6 aa, Entamoeba invadens
IRTEPS

SEQ ID NO: 2743361 - protein, 4 aa, Entamoeba invadens
IRTN

SEQ ID NO: 2743362 - protein, 9 aa, Entamoeba invadens
ISAKRGAGF

SEQ ID NO: 2743363 - protein, 4 aa, Entamoeba invadens
ISNS

SEQ ID NO: 2743364 - protein, 4 aa, Entamoeba invadens
ISQI

SEQ ID NO: 2743365 - protein, 4 aa, Entamoeba invadens
ISQN

SEQ ID NO: 2743366 - protein, 8 aa, Entamoeba invadens
ISRKDQMT

SEQ ID NO: 2743367 - protein, 6 aa, Entamoeba invadens
ITNSKC

SEQ ID NO: 2743368 - protein, 9 aa, Entamoeba invadens
ITSKGNYTF

SEQ ID NO: 2743369 - protein, 4 aa, Entamoeba invadens
KAVE

SEQ ID NO: 2743370 - protein, 6 aa, Entamoeba invadens
KCENCG

SEQ ID NO: 2743371 - protein, 12 aa, Entamoeba invadens
KCNPLTGEVEYR

SEQ ID NO: 2743372 - protein, 8 aa, Entamoeba invadens
KCSTTSKT

SEQ ID NO: 2743373 - protein, 6 aa, Entamoeba invadens
KCTQCN

SEQ ID NO: 2743374 - protein, 6 aa, Entamoeba invadens
KCVKGN

SEQ ID NO: 2743375 - protein, 13 aa, Entamoeba invadens
KCVSSGSCESPTL

SEQ ID NO: 2743376 - protein, 9 aa, Entamoeba invadens
KDGITNNNQ

SEQ ID NO: 2743377 - protein, 8 aa, Entamoeba invadens
KDKTSTKC

SEQ ID NO: 2743378 - protein, 5 aa, Entamoeba invadens
KDNTN

SEQ ID NO: 2743379 - protein, 8 aa, Entamoeba invadens
KEDAGCDE

SEQ ID NO: 2743380 - protein, 7 aa, Entamoeba invadens
KEKCDKC

SEQ ID NO: 2743381 - protein, 10 aa, Entamoeba invadens
KEKYKKPADV

SEQ ID NO: 2743382 - protein, 8 aa, Entamoeba invadens
KEKYTKGA

SEQ ID NO: 2743383 - protein, 8 aa, Entamoeba invadens
KEKYTKSA

SEQ ID NO: 2743384 - protein, 13 aa, Entamoeba invadens
KEVGDNKGSMEEF

SEQ ID NO: 2743385 - protein, 5 aa, Entamoeba invadens
KGCQH

SEQ ID NO: 2743386 - protein, 5 aa, Entamoeba invadens
KGENF

SEQ ID NO: 2743387 - protein, 6 aa, Entamoeba invadens
KGVGTP

SEQ ID NO: 2743388 - protein, 4 aa, Entamoeba invadens
KGVS

SEQ ID NO: 2743389 - protein, 7 aa, Entamoeba invadens
KHNNDVY

SEQ ID NO: 2743390 - protein, 10 aa, Entamoeba invadens
KKGEQTTNKI

SEQ ID NO: 2743391 - protein, 4 aa, Entamoeba invadens
KKGV

SEQ ID NO: 2743392 - protein, 4 aa, Entamoeba invadens
KKKM

SEQ ID NO: 2743393 - protein, 8 aa, Entamoeba invadens
KKKSNEVE

SEQ ID NO: 2743394 - protein, 8 aa, Entamoeba invadens
KKREQSPC

SEQ ID NO: 2743395 - protein, 5 aa, Entamoeba invadens
KKSDE

SEQ ID NO: 2743396 - protein, 7 aa, Entamoeba invadens
KKSDEID

SEQ ID NO: 2743397 - protein, 7 aa, Entamoeba invadens
KKSEEIE

SEQ ID NO: 2743398 - protein, 7 aa, Entamoeba invadens
KLNKQQK

SEQ ID NO: 2743399 - protein, 8 aa, Entamoeba invadens
KLTDFGSA

SEQ ID NO: 2743400 - protein, 8 aa, Entamoeba invadens
KMTDFGSA

SEQ ID NO: 2743401 - protein, 10 aa, Entamoeba invadens
KNAYENDERF

SEQ ID NO: 2743402 - protein, 9 aa, Entamoeba invadens
KNDPLEDTE

SEQ ID NO: 2743403 - protein, 7 aa, Entamoeba invadens
KNEQIPP

SEQ ID NO: 2743404 - protein, 6 aa, Entamoeba invadens
KNRSRN

SEQ ID NO: 2743405 - protein, 4 aa, Entamoeba invadens
KPLA

SEQ ID NO: 2743406 - protein, 11 aa, Entamoeba invadens
KPSGGEVEEKE

SEQ ID NO: 2743407 - protein, 9 aa, Entamoeba invadens
KQCSTSATS

SEQ ID NO: 2743408 - protein, 10 aa, Entamoeba invadens
KQKKSTEVET

SEQ ID NO: 2743409 - protein, 10 aa, Entamoeba invadens
KQNPEERPTF

SEQ ID NO: 2743410 - protein, 6 aa, Entamoeba invadens
KQNPID

SEQ ID NO: 2743411 - protein, 6 aa, Entamoeba invadens
KQPTKL

SEQ ID NO: 2743412 - protein, 10 aa, Entamoeba invadens
KRKDPIEEEQ

SEQ ID NO: 2743413 - protein, 4 aa, Entamoeba invadens
KRLE

SEQ ID NO: 2743414 - protein, 8 aa, Entamoeba invadens
KSANNSKC

SEQ ID NO: 2743415 - protein, 7 aa, Entamoeba invadens
KSAQENV

SEQ ID NO: 2743416 - protein, 17 aa, Entamoeba invadens
KSCATDCASGYKDTTNM

SEQ ID NO: 2743417 - protein, 7 aa, Entamoeba invadens
KSCTNEG

SEQ ID NO: 2743418 - protein, 6 aa, Entamoeba invadens
KSGSFG

SEQ ID NO: 2743419 - protein, 4 aa, Entamoeba invadens
KSGT

SEQ ID NO: 2743420 - protein, 10 aa, Entamoeba invadens
KSNDELNDTC

SEQ ID NO: 2743421 - protein, 13 aa, Entamoeba invadens
KTANEDVETESVG

SEQ ID NO: 2743422 - protein, 8 aa, Entamoeba invadens
KTCNDCDP

SEQ ID NO: 2743423 - protein, 7 aa, Entamoeba invadens
KTCTEET

SEQ ID NO: 2743424 - protein, 7 aa, Entamoeba invadens
KTCTNDG

SEQ ID NO: 2743425 - protein, 6 aa, Entamoeba invadens
KTFSSS

SEQ ID NO: 2743426 - protein, 5 aa, Entamoeba invadens
KTNVE

SEQ ID NO: 2743427 - protein, 8 aa, Entamoeba invadens
KTNVENTN

SEQ ID NO: 2743428 - protein, 6 aa, Entamoeba invadens
KTSNEI

SEQ ID NO: 2743429 - protein, 7 aa, Entamoeba invadens
KTTNKTV

SEQ ID NO: 2743430 - protein, 7 aa, Entamoeba invadens
KTTNLVD

SEQ ID NO: 2743431 - protein, 6 aa, Entamoeba invadens
KTTQEM

SEQ ID NO: 2743432 - protein, 12 aa, Entamoeba invadens
KVETSTANSTKL

SEQ ID NO: 2743433 - protein, 4 aa, Entamoeba invadens
KYGS

SEQ ID NO: 2743434 - protein, 4 aa, Entamoeba invadens
LDTE

SEQ ID NO: 2743435 - protein, 10 aa, Entamoeba invadens
LEETRQKIYD

SEQ ID NO: 2743436 - protein, 11 aa, Entamoeba invadens
LEGDNNGPLIN

SEQ ID NO: 2743437 - protein, 8 aa, Entamoeba invadens
LEGTSANI

SEQ ID NO: 2743438 - protein, 9 aa, Entamoeba invadens
LKKSNIPAS

SEQ ID NO: 2743439 - protein, 4 aa, Entamoeba invadens
LLTG

SEQ ID NO: 2743440 - protein, 6 aa, Entamoeba invadens
LNASQS

SEQ ID NO: 2743441 - protein, 4 aa, Entamoeba invadens
LNTN

SEQ ID NO: 2743442 - protein, 9 aa, Entamoeba invadens
LPKPDEMSQ

SEQ ID NO: 2743443 - protein, 8 aa, Entamoeba invadens
LSDFGSAR

SEQ ID NO: 2743444 - protein, 6 aa, Entamoeba invadens
LSGREN

SEQ ID NO: 2743445 - protein, 4 aa, Entamoeba invadens
LSGT

SEQ ID NO: 2743446 - protein, 5 aa, Entamoeba invadens
LSSNK

SEQ ID NO: 2743447 - protein, 13 aa, Entamoeba invadens
LTYNTKSNTCEEY

SEQ ID NO: 2743448 - protein, 20 aa, Entamoeba invadens
MKQSGENNTLNNDKNDEEFE

SEQ ID NO: 2743449 - protein, 20 aa, Entamoeba invadens
MSTALDPDELKKERKLGEGS

SEQ ID NO: 2743450 - protein, 10 aa, Entamoeba invadens
NAIPGTSSSG

SEQ ID NO: 2743451 - protein, 4 aa, Entamoeba invadens
NCES

SEQ ID NO: 2743452 - protein, 17 aa, Entamoeba invadens
NDMEISKGKCSKCETEN

SEQ ID NO: 2743453 - protein, 4 aa, Entamoeba invadens
NDVV

SEQ ID NO: 2743454 - protein, 15 aa, Entamoeba invadens
NEDITTERNECNKCT

SEQ ID NO: 2743455 - protein, 13 aa, Entamoeba invadens
NEDKMSQSLKTDI

SEQ ID NO: 2743456 - protein, 5 aa, Entamoeba invadens
NEETR

SEQ ID NO: 2743457 - protein, 9 aa, Entamoeba invadens
NEKTGQCEN

SEQ ID NO: 2743458 - protein, 6 aa, Entamoeba invadens
NENSNK

SEQ ID NO: 2743459 - protein, 10 aa, Entamoeba invadens
NEPKKRSLTE

SEQ ID NO: 2743460 - protein, 6 aa, Entamoeba invadens
NGGNRL

SEQ ID NO: 2743461 - protein, 8 aa, Entamoeba invadens
NGIGTPKY

SEQ ID NO: 2743462 - protein, 8 aa, Entamoeba invadens
NGKIDTNP

SEQ ID NO: 2743463 - protein, 10 aa, Entamoeba invadens
NGYYPDSNGK

SEQ ID NO: 2743464 - protein, 8 aa, Entamoeba invadens
NGYYPNDS

SEQ ID NO: 2743465 - protein, 7 aa, Entamoeba invadens
NKCATDF

SEQ ID NO: 2743466 - protein, 5 aa, Entamoeba invadens
NKCTN

SEQ ID NO: 2743467 - protein, 6 aa, Entamoeba invadens
NKEKKK

SEQ ID NO: 2743468 - protein, 8 aa, Entamoeba invadens
NKKDQMTL

SEQ ID NO: 2743469 - protein, 6 aa, Entamoeba invadens
NKKSEI

SEQ ID NO: 2743470 - protein, 8 aa, Entamoeba invadens
NKNESNVR

SEQ ID NO: 2743471 - protein, 8 aa, Entamoeba invadens
NKRDTSGL

SEQ ID NO: 2743472 - protein, 8 aa, Entamoeba invadens
NNCDPSTG

SEQ ID NO: 2743473 - protein, 12 aa, Entamoeba invadens
NNDPLKVDKETR

SEQ ID NO: 2743474 - protein, 6 aa, Entamoeba invadens
NNERVN

SEQ ID NO: 2743475 - protein, 8 aa, Entamoeba invadens
NNGNPNGV

SEQ ID NO: 2743476 - protein, 7 aa, Entamoeba invadens
NNSKNNL

SEQ ID NO: 2743477 - protein, 4 aa, Entamoeba invadens
NNST

SEQ ID NO: 2743478 - protein, 9 aa, Entamoeba invadens
NQPQDSNKS

SEQ ID NO: 2743479 - protein, 5 aa, Entamoeba invadens
NSCEK

SEQ ID NO: 2743480 - protein, 21 aa, Entamoeba invadens
NSDCKSKVSNCKYQRNYKTQS

SEQ ID NO: 2743481 - protein, 4 aa, Entamoeba invadens
NSKC

SEQ ID NO: 2743482 - protein, 8 aa, Entamoeba invadens
NSSHQMEE

SEQ ID NO: 2743483 - protein, 7 aa, Entamoeba invadens
NSSKGNM

SEQ ID NO: 2743484 - protein, 6 aa, Entamoeba invadens
NSSKNV

SEQ ID NO: 2743485 - protein, 6 aa, Entamoeba invadens
NSSKQH

SEQ ID NO: 2743486 - protein, 6 aa, Entamoeba invadens
NTCNTN

SEQ ID NO: 2743487 - protein, 4 aa, Entamoeba invadens
NTNS

SEQ ID NO: 2743488 - protein, 4 aa, Entamoeba invadens
NTTH

SEQ ID NO: 2743489 - protein, 7 aa, Entamoeba invadens
NTTKSDT

SEQ ID NO: 2743490 - protein, 6 aa, Entamoeba invadens
NVIDDQ

SEQ ID NO: 2743491 - protein, 15 aa, Entamoeba invadens
NVKANGKLTDFGSSR

SEQ ID NO: 2743492 - protein, 5 aa, Entamoeba invadens
NVPSV

SEQ ID NO: 2743493 - protein, 15 aa, Entamoeba invadens
NYKTSSGDCKSQSSL

SEQ ID NO: 2743494 - protein, 12 aa, Entamoeba invadens
NYKTTSGKCLPQ

SEQ ID NO: 2743495 - protein, 7 aa, Entamoeba invadens
NYSNTSC

SEQ ID NO: 2743496 - protein, 7 aa, Entamoeba invadens
PCERTSG

SEQ ID NO: 2743497 - protein, 7 aa, Entamoeba invadens
PDETSGK

SEQ ID NO: 2743498 - protein, 4 aa, Entamoeba invadens
PDFS

SEQ ID NO: 2743499 - protein, 8 aa, Entamoeba invadens
PNDNGTFC

SEQ ID NO: 2743500 - protein, 9 aa, Entamoeba invadens
PNEQITCPE

SEQ ID NO: 2743501 - protein, 7 aa, Entamoeba invadens
PNFTSKI

SEQ ID NO: 2743502 - protein, 7 aa, Entamoeba invadens
PPQNTPI

SEQ ID NO: 2743503 - protein, 4 aa, Entamoeba invadens
PSHR

SEQ ID NO: 2743504 - protein, 9 aa, Entamoeba invadens
PSKCEQCST

SEQ ID NO: 2743505 - protein, 8 aa, Entamoeba invadens
PVNEETKQ

SEQ ID NO: 2743506 - protein, 13 aa, Entamoeba invadens
QCPEGTVKNDEKM

SEQ ID NO: 2743507 - protein, 16 aa, Entamoeba invadens
QCVSQSDKNCDKSSVS

SEQ ID NO: 2743508 - protein, 9 aa, Entamoeba invadens
QDKYKKSAD

SEQ ID NO: 2743509 - protein, 7 aa, Entamoeba invadens
QDYNGNL

SEQ ID NO: 2743510 - protein, 9 aa, Entamoeba invadens
QEKYKKEAD

SEQ ID NO: 2743511 - protein, 13 aa, Entamoeba invadens
QGPTTKDQITNKF

SEQ ID NO: 2743512 - protein, 4 aa, Entamoeba invadens
QGTS

SEQ ID NO: 2743513 - protein, 10 aa, Entamoeba invadens
QKQKKKEQNI

SEQ ID NO: 2743514 - protein, 9 aa, Entamoeba invadens
QKYKKSADV

SEQ ID NO: 2743515 - protein, 10 aa, Entamoeba invadens
QLDDQPAADG

SEQ ID NO: 2743516 - protein, 9 aa, Entamoeba invadens
QLDNNESGL

SEQ ID NO: 2743517 - protein, 5 aa, Entamoeba invadens
QPMGN

SEQ ID NO: 2743518 - protein, 4 aa, Entamoeba invadens
QQPT

SEQ ID NO: 2743519 - protein, 6 aa, Entamoeba invadens
QQTTRI

SEQ ID NO: 2743520 - protein, 7 aa, Entamoeba invadens
QTCSPDF

SEQ ID NO: 2743521 - protein, 8 aa, Entamoeba invadens
QTCSTQSV

SEQ ID NO: 2743522 - protein, 13 aa, Entamoeba invadens
QVDPNSDANSVTS

SEQ ID NO: 2743523 - protein, 4 aa, Entamoeba invadens
RDMS

SEQ ID NO: 2743524 - protein, 13 aa, Entamoeba invadens
RELEEDKKLGEGS

SEQ ID NO: 2743525 - protein, 4 aa, Entamoeba invadens
RGNK

SEQ ID NO: 2743526 - protein, 9 aa, Entamoeba invadens
RLPKKEMMS

SEQ ID NO: 2743527 - protein, 6 aa, Entamoeba invadens
RNPKTS

SEQ ID NO: 2743528 - protein, 7 aa, Entamoeba invadens
RQEKEDY

SEQ ID NO: 2743529 - protein, 6 aa, Entamoeba invadens
RRNDPI

SEQ ID NO: 2743530 - protein, 16 aa, Entamoeba invadens
SANNKCSKCDDNYKLS

SEQ ID NO: 2743531 - protein, 9 aa, Entamoeba invadens
SCGGSCNGV

SEQ ID NO: 2743532 - protein, 6 aa, Entamoeba invadens
SCQKST

SEQ ID NO: 2743533 - protein, 7 aa, Entamoeba invadens
SDASRKC

SEQ ID NO: 2743534 - protein, 7 aa, Entamoeba invadens
SDEEMKE

SEQ ID NO: 2743535 - protein, 10 aa, Entamoeba invadens
SDGTCKSNDN

SEQ ID NO: 2743536 - protein, 21 aa, Entamoeba invadens
SEFSGKVSSETKWKRSQCPCN

SEQ ID NO: 2743537 - protein, 5 aa, Entamoeba invadens
SESTC

SEQ ID NO: 2743538 - protein, 8 aa, Entamoeba invadens
SETPIAEG

SEQ ID NO: 2743539 - protein, 5 aa, Entamoeba invadens
SETTC

SEQ ID NO: 2743540 - protein, 8 aa, Entamoeba invadens
SEVKIDTQ

SEQ ID NO: 2743541 - protein, 16 aa, Entamoeba invadens
SGCDNCNGKTGECTNC

SEQ ID NO: 2743542 - protein, 8 aa, Entamoeba invadens
SGCGKSTT

SEQ ID NO: 2743543 - protein, 11 aa, Entamoeba invadens
SGMYPDESTKK

SEQ ID NO: 2743544 - protein, 6 aa, Entamoeba invadens
SGSENK

SEQ ID NO: 2743545 - protein, 16 aa, Entamoeba invadens
SGTFDTNTQTCGESQT

SEQ ID NO: 2743546 - protein, 7 aa, Entamoeba invadens
SIPKGKA

SEQ ID NO: 2743547 - protein, 9 aa, Entamoeba invadens
SKCKEDTIL

SEQ ID NO: 2743548 - protein, 9 aa, Entamoeba invadens
SKRENCSYD

SEQ ID NO: 2743549 - protein, 7 aa, Entamoeba invadens
SKTTKTC

SEQ ID NO: 2743550 - protein, 6 aa, Entamoeba invadens
SLDGTY

SEQ ID NO: 2743551 - protein, 7 aa, Entamoeba invadens
SLTFDDT

SEQ ID NO: 2743552 - protein, 12 aa, Entamoeba invadens
SNCKTCKSDYTR

SEQ ID NO: 2743553 - protein, 6 aa, Entamoeba invadens
SNSKCS

SEQ ID NO: 2743554 - protein, 7 aa, Entamoeba invadens
SQSTRID

SEQ ID NO: 2743555 - protein, 4 aa, Entamoeba invadens
SQTT

SEQ ID NO: 2743556 - protein, 5 aa, Entamoeba invadens
SSCDG

SEQ ID NO: 2743557 - protein, 4 aa, Entamoeba invadens
SSEC

SEQ ID NO: 2743558 - protein, 11 aa, Entamoeba invadens
SSECVSKSQVD

SEQ ID NO: 2743559 - protein, 4 aa, Entamoeba invadens
SSKG

SEQ ID NO: 2743560 - protein, 7 aa, Entamoeba invadens
SSNGETQ

SEQ ID NO: 2743561 - protein, 6 aa, Entamoeba invadens
SSTPLN

SEQ ID NO: 2743562 - protein, 8 aa, Entamoeba invadens
STNGDRKC

SEQ ID NO: 2743563 - protein, 4 aa, Entamoeba invadens
STQT

SEQ ID NO: 2743564 - protein, 6 aa, Entamoeba invadens
STSNPN

SEQ ID NO: 2743565 - protein, 10 aa, Entamoeba invadens
SVFTEPKSTK

SEQ ID NO: 2743566 - protein, 8 aa, Entamoeba invadens
SVSSQISN

SEQ ID NO: 2743567 - protein, 4 aa, Entamoeba invadens
SWTG

SEQ ID NO: 2743568 - protein, 6 aa, Entamoeba invadens
SYTQQK

SEQ ID NO: 2743569 - protein, 7 aa, Entamoeba invadens
SYYPNDG

SEQ ID NO: 2743570 - protein, 5 aa, Entamoeba invadens
TAKKG

SEQ ID NO: 2743571 - protein, 11 aa, Entamoeba invadens
TCGEISEVTNN

SEQ ID NO: 2743572 - protein, 6 aa, Entamoeba invadens
TCNTKD

SEQ ID NO: 2743573 - protein, 7 aa, Entamoeba invadens
TDFGTSR

SEQ ID NO: 2743574 - protein, 6 aa, Entamoeba invadens
TEASDI

SEQ ID NO: 2743575 - protein, 11 aa, Entamoeba invadens
TESGCSTCKNG

SEQ ID NO: 2743576 - protein, 5 aa, Entamoeba invadens
TETEV

SEQ ID NO: 2743577 - protein, 30 aa, Entamoeba invadens
TFDEDDKLKTNTKTATETSCQIRNNKGCQH

SEQ ID NO: 2743578 - protein, 5 aa, Entamoeba invadens
TFSSG

SEQ ID NO: 2743579 - protein, 4 aa, Entamoeba invadens
TGTY

SEQ ID NO: 2743580 - protein, 4 aa, Entamoeba invadens
TGVT

SEQ ID NO: 2743581 - protein, 16 aa, Entamoeba invadens
TINPSNPKQCQSCSSF

SEQ ID NO: 2743582 - protein, 9 aa, Entamoeba invadens
TIPSGSSGK

SEQ ID NO: 2743583 - protein, 8 aa, Entamoeba invadens
TISTSENA

SEQ ID NO: 2743584 - protein, 9 aa, Entamoeba invadens
TKGNIKKIE

SEQ ID NO: 2743585 - protein, 6 aa, Entamoeba invadens
TKGTED

SEQ ID NO: 2743586 - protein, 15 aa, Entamoeba invadens
TKKCTTDANCPAGYY

SEQ ID NO: 2743587 - protein, 4 aa, Entamoeba invadens
TKMD

SEQ ID NO: 2743588 - protein, 6 aa, Entamoeba invadens
TLPQGT

SEQ ID NO: 2743589 - protein, 4 aa, Entamoeba invadens
TNEC

SEQ ID NO: 2743590 - protein, 5 aa, Entamoeba invadens
TNECD

SEQ ID NO: 2743591 - protein, 4 aa, Entamoeba invadens
TNND

SEQ ID NO: 2743592 - protein, 27 aa, Entamoeba invadens
TNRSPSEYYPNQNKYSKSDCTGTPSTM

SEQ ID NO: 2743593 - protein, 5 aa, Entamoeba invadens
TNSLQ

SEQ ID NO: 2743594 - protein, 4 aa, Entamoeba invadens
TNVT

SEQ ID NO: 2743595 - protein, 5 aa, Entamoeba invadens
TPPDF

SEQ ID NO: 2743596 - protein, 4 aa, Entamoeba invadens
TPVD

SEQ ID NO: 2743597 - protein, 4 aa, Entamoeba invadens
TQIE

SEQ ID NO: 2743598 - protein, 5 aa, Entamoeba invadens
TQNIS

SEQ ID NO: 2743599 - protein, 11 aa, Entamoeba invadens
TQRCDKNKCNG

SEQ ID NO: 2743600 - protein, 12 aa, Entamoeba invadens
TQSGCSKCQDGY

SEQ ID NO: 2743601 - protein, 10 aa, Entamoeba invadens
TSADDETRPP

SEQ ID NO: 2743602 - protein, 11 aa, Entamoeba invadens
TSALDTQSEKI

SEQ ID NO: 2743603 - protein, 4 aa, Entamoeba invadens
TSGK

SEQ ID NO: 2743604 - protein, 6 aa, Entamoeba invadens
TSKHSL

SEQ ID NO: 2743605 - protein, 10 aa, Entamoeba invadens
TSNANCPAGN

SEQ ID NO: 2743606 - protein, 4 aa, Entamoeba invadens
TSTT

SEQ ID NO: 2743607 - protein, 4 aa, Entamoeba invadens
TTAN

SEQ ID NO: 2743608 - protein, 12 aa, Entamoeba invadens
TTCGGSCDATNG

SEQ ID NO: 2743609 - protein, 12 aa, Entamoeba invadens
TTCNGNCNQTSG

SEQ ID NO: 2743610 - protein, 10 aa, Entamoeba invadens
TTDAASSTHI

SEQ ID NO: 2743611 - protein, 9 aa, Entamoeba invadens
TTQNDEEKF

SEQ ID NO: 2743612 - protein, 8 aa, Entamoeba invadens
TTTEFSTK

SEQ ID NO: 2743613 - protein, 4 aa, Entamoeba invadens
TTTQ

SEQ ID NO: 2743614 - protein, 9 aa, Entamoeba invadens
TVEDNNTLN

SEQ ID NO: 2743615 - protein, 11 aa, Entamoeba invadens
TWEDNDSTALS

SEQ ID NO: 2743616 - protein, 10 aa, Entamoeba invadens
TYDNSEPIPR

SEQ ID NO: 2743617 - protein, 8 aa, Entamoeba invadens
TYYPGSDG

SEQ ID NO: 2743618 - protein, 6 aa, Entamoeba invadens
VDTETR

SEQ ID NO: 2743619 - protein, 7 aa, Entamoeba invadens
VEKSEEF

SEQ ID NO: 2743620 - protein, 21 aa, Entamoeba invadens
VKDQKGKEKCPIKTSKCQQYK

SEQ ID NO: 2743621 - protein, 8 aa, Entamoeba invadens
VKEAPSGV

SEQ ID NO: 2743622 - protein, 4 aa, Entamoeba invadens
VKPD

SEQ ID NO: 2743623 - protein, 13 aa, Entamoeba invadens
VNCKRTSQSGCAQ

SEQ ID NO: 2743624 - protein, 4 aa, Entamoeba invadens
VNGD

SEQ ID NO: 2743625 - protein, 6 aa, Entamoeba invadens
VNKETR

SEQ ID NO: 2743626 - protein, 13 aa, Entamoeba invadens
VPEEPDTPDVTPT

SEQ ID NO: 2743627 - protein, 4 aa, Entamoeba invadens
VSAT

SEQ ID NO: 2743628 - protein, 11 aa, Entamoeba invadens
VSRQRNGTTTY

SEQ ID NO: 2743629 - protein, 4 aa, Entamoeba invadens
VSST

SEQ ID NO: 2743630 - protein, 6 aa, Entamoeba invadens
VTDGTS

SEQ ID NO: 2743631 - protein, 11 aa, Entamoeba invadens
VTLPTSQSGFE

SEQ ID NO: 2743632 - protein, 10 aa, Entamoeba invadens
WHAPDDSGSF

SEQ ID NO: 2743633 - protein, 9 aa, Entamoeba invadens
YAGDGKRCT

SEQ ID NO: 2743634 - protein, 14 aa, Entamoeba invadens
YEELNEDKKLGEGG

SEQ ID NO: 2743635 - protein, 5 aa, Entamoeba invadens
YHEKT

SEQ ID NO: 2743636 - protein, 4 aa, Entamoeba invadens
YHPV

SEQ ID NO: 2743637 - protein, 15 aa, Entamoeba invadens
YKSSEVCENGRPTKC

SEQ ID NO: 2743638 - protein, 7 aa, Entamoeba invadens
YKTQTNK

SEQ ID NO: 2743639 - protein, 10 aa, Entamoeba invadens
YMRSSDGKQC

SEQ ID NO: 2743640 - protein, 12 aa, Entamoeba invadens
YNETTNPGSKCN

SEQ ID NO: 2743641 - protein, 23 aa, Entamoeba invadens
YNKNTKECDNYETNCTTQNDNKK

SEQ ID NO: 2743642 - protein, 8 aa, Entamoeba invadens
YNVPPPQY

SEQ ID NO: 2743643 - protein, 6 aa, Entamoeba invadens
YPNTNK

SEQ ID NO: 2743644 - protein, 6 aa, Entamoeba invadens
YPQSEE

SEQ ID NO: 2743645 - protein, 12 aa, Entamoeba invadens
YPTDSINNEGKY

SEQ ID NO: 2743646 - protein, 12 aa, Entamoeba invadens
YQKKKARLRVES

SEQ ID NO: 2743647 - protein, 8 aa, Entamoeba invadens
YQSEEGQS

SEQ ID NO: 2743648 - protein, 6 aa, Entamoeba invadens
YRTPNN

SEQ ID NO: 2743649 - protein, 6 aa, Entamoeba invadens
YSLESG

SEQ ID NO: 2743650 - protein, 4 aa, Entamoeba invadens
YSSD

SEQ ID NO: 2743651 - protein, 12 aa, Entamoeba invadens
YSYPNTNGNCTT

SEQ ID NO: 2743652 - protein, 10 aa, Entamoeba invadens
YSYTNNKGDC

SEQ ID NO: 2743653 - protein, 5 aa, Entamoeba invadens
YTNEY

SEQ ID NO: 2743654 - protein, 6 aa, Entamoeba invadens
YTTDNP

SEQ ID NO: 2743655 - protein, 5 aa, Entamoeba invadens
YTYDV

SEQ ID NO: 2743656 - protein, 4 aa, Entamoeba invadens
YVNP

SEQ ID NO: 2743657 - protein, 4 aa, Entamoeba invadens
YYPD

SEQ ID NO: 2743658 - protein, 15 aa, Entamoeba invadens
AAASSAIIPNSTHNT

SEQ ID NO: 2743659 - protein, 5 aa, Entamoeba invadens
ACPSN

SEQ ID NO: 2743660 - protein, 5 aa, Entamoeba invadens
ACSGE

SEQ ID NO: 2743661 - protein, 8 aa, Entamoeba invadens
ACSSDAKK

SEQ ID NO: 2743662 - protein, 15 aa, Entamoeba invadens
ADCDTTNGNCKKCST

SEQ ID NO: 2743663 - protein, 7 aa, Entamoeba invadens
ADGKCES

SEQ ID NO: 2743664 - protein, 17 aa, Entamoeba invadens
ADGTTCKNCDSTKNCAT

SEQ ID NO: 2743665 - protein, 13 aa, Entamoeba invadens
ADVTGTENVATVQ

SEQ ID NO: 2743666 - protein, 5 aa, Entamoeba invadens
AEDMT

SEQ ID NO: 2743667 - protein, 6 aa, Entamoeba invadens
AEMNEK

SEQ ID NO: 2743668 - protein, 7 aa, Entamoeba invadens
AETKKQL

SEQ ID NO: 2743669 - protein, 5 aa, Entamoeba invadens
AEYGS

SEQ ID NO: 2743670 - protein, 6 aa, Entamoeba invadens
AFKGAT

SEQ ID NO: 2743671 - protein, 8 aa, Entamoeba invadens
AGGISCSK

SEQ ID NO: 2743672 - protein, 14 aa, Entamoeba invadens
AGKSSNGSDENFPT

SEQ ID NO: 2743673 - protein, 6 aa, Entamoeba invadens
AGQPAL

SEQ ID NO: 2743674 - protein, 11 aa, Entamoeba invadens
AGSTTCKSCSP

SEQ ID NO: 2743675 - protein, 12 aa, Entamoeba invadens
AGTAANQETNTC

SEQ ID NO: 2743676 - protein, 9 aa, Entamoeba invadens
AGTCSSNNK

SEQ ID NO: 2743677 - protein, 16 aa, Entamoeba invadens
AGTYADEQASSSCKTC

SEQ ID NO: 2743678 - protein, 6 aa, Entamoeba invadens
AGTYSV

SEQ ID NO: 2743679 - protein, 51 aa, Entamoeba invadens
AKGFTKNSTVESSSRNLAKNTTKSTTKNNTTNNSSMTTRDKTAAEKQMDKK

SEQ ID NO: 2743680 - protein, 7 aa, Entamoeba invadens
AKIGEGS

SEQ ID NO: 2743681 - protein, 10 aa, Entamoeba invadens
AKINSNSSVT

SEQ ID NO: 2743682 - protein, 9 aa, Entamoeba invadens
AKQNCETSH

SEQ ID NO: 2743683 - protein, 10 aa, Entamoeba invadens
AKSQSTTPHG

SEQ ID NO: 2743684 - protein, 4 aa, Entamoeba invadens
AKSV

SEQ ID NO: 2743685 - protein, 7 aa, Entamoeba invadens
AKTEMTT

SEQ ID NO: 2743686 - protein, 9 aa, Entamoeba invadens
AKTENSTHL

SEQ ID NO: 2743687 - protein, 7 aa, Entamoeba invadens
AKTQMTT

SEQ ID NO: 2743688 - protein, 8 aa, Entamoeba invadens
AKTSFDDA

SEQ ID NO: 2743689 - protein, 4 aa, Entamoeba invadens
ALTT

SEQ ID NO: 2743690 - protein, 4 aa, Entamoeba invadens
AMYP

SEQ ID NO: 2743691 - protein, 5 aa, Entamoeba invadens
ANATN

SEQ ID NO: 2743692 - protein, 10 aa, Entamoeba invadens
ANEDDKKRTQ

SEQ ID NO: 2743693 - protein, 4 aa, Entamoeba invadens
ANFD

SEQ ID NO: 2743694 - protein, 11 aa, Entamoeba invadens
ANIDIQTDKNI

SEQ ID NO: 2743695 - protein, 5 aa, Entamoeba invadens
ANIED

SEQ ID NO: 2743696 - protein, 20 aa, Entamoeba invadens
ANNNSYHYNSTTNNGSPNQV

SEQ ID NO: 2743697 - protein, 5 aa, Entamoeba invadens
ANPPL

SEQ ID NO: 2743698 - protein, 10 aa, Entamoeba invadens
ANRCNSSTGY

SEQ ID NO: 2743699 - protein, 14 aa, Entamoeba invadens
ANRVSIDEIVNMLI

SEQ ID NO: 2743700 - protein, 9 aa, Entamoeba invadens
ANSCDGSTG

SEQ ID NO: 2743701 - protein, 4 aa, Entamoeba invadens
ANTI

SEQ ID NO: 2743702 - protein, 5 aa, Entamoeba invadens
ANYTC

SEQ ID NO: 2743703 - protein, 5 aa, Entamoeba invadens
APDKR

SEQ ID NO: 2743704 - protein, 4 aa, Entamoeba invadens
APEN

SEQ ID NO: 2743705 - protein, 4 aa, Entamoeba invadens
APET

SEQ ID NO: 2743706 - protein, 7 aa, Entamoeba invadens
APETFKD

SEQ ID NO: 2743707 - protein, 9 aa, Entamoeba invadens
APETYKDEY

SEQ ID NO: 2743708 - protein, 11 aa, Entamoeba invadens
APNEEGTACDT

SEQ ID NO: 2743709 - protein, 11 aa, Entamoeba invadens
APPKENNTTKY

SEQ ID NO: 2743710 - protein, 12 aa, Entamoeba invadens
APTTLPTETPLN

SEQ ID NO: 2743711 - protein, 8 aa, Entamoeba invadens
AQCADDGV

SEQ ID NO: 2743712 - protein, 4 aa, Entamoeba invadens
AQNG

SEQ ID NO: 2743713 - protein, 13 aa, Entamoeba invadens
AQTTQPQNDSAQS

SEQ ID NO: 2743714 - protein, 11 aa, Entamoeba invadens
ARISESSEKVL

SEQ ID NO: 2743715 - protein, 13 aa, Entamoeba invadens
ARNLTEEQEKEFK

SEQ ID NO: 2743716 - protein, 10 aa, Entamoeba invadens
ASASEFSDKT

SEQ ID NO: 2743717 - protein, 9 aa, Entamoeba invadens
ASESEKGKY

SEQ ID NO: 2743718 - protein, 7 aa, Entamoeba invadens
ASESGEY

SEQ ID NO: 2743719 - protein, 6 aa, Entamoeba invadens
ASFSSY

SEQ ID NO: 2743720 - protein, 12 aa, Entamoeba invadens
ASGSYKNTETSC

SEQ ID NO: 2743721 - protein, 6 aa, Entamoeba invadens
ASNNNA

SEQ ID NO: 2743722 - protein, 4 aa, Entamoeba invadens
ASPH

SEQ ID NO: 2743723 - protein, 6 aa, Entamoeba invadens
ASPSQH

SEQ ID NO: 2743724 - protein, 4 aa, Entamoeba invadens
ASTF

SEQ ID NO: 2743725 - protein, 9 aa, Entamoeba invadens
ASTKPSTRL

SEQ ID NO: 2743726 - protein, 20 aa, Entamoeba invadens
ATADTPVKSSVKTLTPNYED

SEQ ID NO: 2743727 - protein, 12 aa, Entamoeba invadens
ATCGGKCDTTTG

SEQ ID NO: 2743728 - protein, 9 aa, Entamoeba invadens
ATCNQSKAE

SEQ ID NO: 2743729 - protein, 5 aa, Entamoeba invadens
ATDPV

SEQ ID NO: 2743730 - protein, 7 aa, Entamoeba invadens
ATEEGKS

SEQ ID NO: 2743731 - protein, 14 aa, Entamoeba invadens
ATEETTKIPVATES

SEQ ID NO: 2743732 - protein, 4 aa, Entamoeba invadens
ATKI

SEQ ID NO: 2743733 - protein, 5 aa, Entamoeba invadens
ATLSC

SEQ ID NO: 2743734 - protein, 6 aa, Entamoeba invadens
ATLTLT

SEQ ID NO: 2743735 - protein, 4 aa, Entamoeba invadens
ATPV

SEQ ID NO: 2743736 - protein, 7 aa, Entamoeba invadens
ATVNDNA

SEQ ID NO: 2743737 - protein, 9 aa, Entamoeba invadens
AYKTDPTKV

SEQ ID NO: 2743738 - protein, 6 aa, Entamoeba invadens
AYPKED

SEQ ID NO: 2743739 - protein, 6 aa, Entamoeba invadens
AYPKSE

SEQ ID NO: 2743740 - protein, 6 aa, Entamoeba invadens
AYSGKI

SEQ ID NO: 2743741 - protein, 12 aa, Entamoeba invadens
AYSNNKDGTCEE

SEQ ID NO: 2743742 - protein, 6 aa, Entamoeba invadens
AYTYSS

SEQ ID NO: 2743743 - protein, 8 aa, Entamoeba invadens
CADCDEGY

SEQ ID NO: 2743744 - protein, 9 aa, Entamoeba invadens
CAKKGYGCY

SEQ ID NO: 2743745 - protein, 12 aa, Entamoeba invadens
CANGCNSSTGYC

SEQ ID NO: 2743746 - protein, 20 aa, Entamoeba invadens
CAPNTCNTSNGNCDKCTENK

SEQ ID NO: 2743747 - protein, 10 aa, Entamoeba invadens
CAQTAENVDY

SEQ ID NO: 2743748 - protein, 13 aa, Entamoeba invadens
CASCGANEFESEK

SEQ ID NO: 2743749 - protein, 6 aa, Entamoeba invadens
CASDYT

SEQ ID NO: 2743750 - protein, 11 aa, Entamoeba invadens
CASNDELKEKC

SEQ ID NO: 2743751 - protein, 16 aa, Entamoeba invadens
CATNNNNCEIQNGQNE

SEQ ID NO: 2743752 - protein, 4 aa, Entamoeba invadens
CDAT

SEQ ID NO: 2743753 - protein, 6 aa, Entamoeba invadens
CDDDDK

SEQ ID NO: 2743754 - protein, 7 aa, Entamoeba invadens
CDDNNCK

SEQ ID NO: 2743755 - protein, 10 aa, Entamoeba invadens
CDNGSSSGCL

SEQ ID NO: 2743756 - protein, 6 aa, Entamoeba invadens
CDQTNG

SEQ ID NO: 2743757 - protein, 7 aa, Entamoeba invadens
CDSCPTS

SEQ ID NO: 2743758 - protein, 5 aa, Entamoeba invadens
CDSFD

SEQ ID NO: 2743759 - protein, 14 aa, Entamoeba invadens
CDSFNNDTDNTRNY

SEQ ID NO: 2743760 - protein, 8 aa, Entamoeba invadens
CDSKTTNC

SEQ ID NO: 2743761 - protein, 7 aa, Entamoeba invadens
CDSTNGN

SEQ ID NO: 2743762 - protein, 7 aa, Entamoeba invadens
CDSTYPN

SEQ ID NO: 2743763 - protein, 16 aa, Entamoeba invadens
CDTDSTKCDKCSGTNV

SEQ ID NO: 2743764 - protein, 6 aa, Entamoeba invadens
CDTTTG

SEQ ID NO: 2743765 - protein, 5 aa, Entamoeba invadens
CDYGN

SEQ ID NO: 2743766 - protein, 7 aa, Entamoeba invadens
CEDGYYK

SEQ ID NO: 2743767 - protein, 14 aa, Entamoeba invadens
CEEYETNTNTCSKC

SEQ ID NO: 2743768 - protein, 11 aa, Entamoeba invadens
CEGGKCKKCND

SEQ ID NO: 2743769 - protein, 13 aa, Entamoeba invadens
CEGGQYANTATNS

SEQ ID NO: 2743770 - protein, 4 aa, Entamoeba invadens
CELQ

SEQ ID NO: 2743771 - protein, 8 aa, Entamoeba invadens
CENGYGNS

SEQ ID NO: 2743772 - protein, 13 aa, Entamoeba invadens
CENNKKLSEDGLS

SEQ ID NO: 2743773 - protein, 5 aa, Entamoeba invadens
CESDS

SEQ ID NO: 2743774 - protein, 12 aa, Entamoeba invadens
CETCQNGGNRSC

SEQ ID NO: 2743775 - protein, 6 aa, Entamoeba invadens
CETDQR

SEQ ID NO: 2743776 - protein, 8 aa, Entamoeba invadens
CETGSEVD

SEQ ID NO: 2743777 - protein, 6 aa, Entamoeba invadens
CETNDN

SEQ ID NO: 2743778 - protein, 10 aa, Entamoeba invadens
CFQTKTESNY

SEQ ID NO: 2743779 - protein, 7 aa, Entamoeba invadens
CGECTSK

SEQ ID NO: 2743780 - protein, 5 aa, Entamoeba invadens
CGFGG

SEQ ID NO: 2743781 - protein, 11 aa, Entamoeba invadens
CGGKCDTTTGV

SEQ ID NO: 2743782 - protein, 5 aa, Entamoeba invadens
CGGNC

SEQ ID NO: 2743783 - protein, 10 aa, Entamoeba invadens
CGGNCDTTNG

SEQ ID NO: 2743784 - protein, 5 aa, Entamoeba invadens
CGNNK

SEQ ID NO: 2743785 - protein, 10 aa, Entamoeba invadens
CGQDDSAYTY

SEQ ID NO: 2743786 - protein, 5 aa, Entamoeba invadens
CGSNC

SEQ ID NO: 2743787 - protein, 11 aa, Entamoeba invadens
CGSNGCSNKTN

SEQ ID NO: 2743788 - protein, 8 aa, Entamoeba invadens
CGTSPSNC

SEQ ID NO: 2743789 - protein, 4 aa, Entamoeba invadens
CIES

SEQ ID NO: 2743790 - protein, 9 aa, Entamoeba invadens
CKACSESIT

SEQ ID NO: 2743791 - protein, 16 aa, Entamoeba invadens
CKAGYYPKTSGDYKCQ

SEQ ID NO: 2743792 - protein, 17 aa, Entamoeba invadens
CKGCSTVSGQSGKTQCN

SEQ ID NO: 2743793 - protein, 15 aa, Entamoeba invadens
CKGERPKNKNLTEKE

SEQ ID NO: 2743794 - protein, 17 aa, Entamoeba invadens
CKKTCETGKITTETPTT

SEQ ID NO: 2743795 - protein, 23 aa, Entamoeba invadens
CKPCENGTHSSTGGSTECKPCQG

SEQ ID NO: 2743796 - protein, 10 aa, Entamoeba invadens
CKTCASESTR

SEQ ID NO: 2743797 - protein, 7 aa, Entamoeba invadens
CKTCATD

SEQ ID NO: 2743798 - protein, 12 aa, Entamoeba invadens
CKTCTDENTCSV

SEQ ID NO: 2743799 - protein, 5 aa, Entamoeba invadens
CLNST

SEQ ID NO: 2743800 - protein, 4 aa, Entamoeba invadens
CNDG

SEQ ID NO: 2743801 - protein, 11 aa, Entamoeba invadens
CNEERGGGKCS

SEQ ID NO: 2743802 - protein, 7 aa, Entamoeba invadens
CNEESGF

SEQ ID NO: 2743803 - protein, 7 aa, Entamoeba invadens
CNFTGND

SEQ ID NO: 2743804 - protein, 11 aa, Entamoeba invadens
CNGQCNASTGV

SEQ ID NO: 2743805 - protein, 5 aa, Entamoeba invadens
CNNNC

SEQ ID NO: 2743806 - protein, 6 aa, Entamoeba invadens
CNQCKN

SEQ ID NO: 2743807 - protein, 6 aa, Entamoeba invadens
CNRCSN

SEQ ID NO: 2743808 - protein, 8 aa, Entamoeba invadens
CNSASEYD

SEQ ID NO: 2743809 - protein, 8 aa, Entamoeba invadens
CNSTNGNC

SEQ ID NO: 2743810 - protein, 12 aa, Entamoeba invadens
CNTCNGGTSSSC

SEQ ID NO: 2743811 - protein, 6 aa, Entamoeba invadens
CNTNED

SEQ ID NO: 2743812 - protein, 11 aa, Entamoeba invadens
CNTNGTCNGCS

SEQ ID NO: 2743813 - protein, 6 aa, Entamoeba invadens
CNTNND

SEQ ID NO: 2743814 - protein, 6 aa, Entamoeba invadens
CNTQTG

SEQ ID NO: 2743815 - protein, 26 aa, Entamoeba invadens
CPEGTTLNEETKECVANTPQTCTAEN

SEQ ID NO: 2743816 - protein, 13 aa, Entamoeba invadens
CPEGYEANKETKK

SEQ ID NO: 2743817 - protein, 26 aa, Entamoeba invadens
CPNGEYAKGANKQCTKCSTKNCATCD

SEQ ID NO: 2743818 - protein, 12 aa, Entamoeba invadens
CPPSKNNEGVKS

SEQ ID NO: 2743819 - protein, 10 aa, Entamoeba invadens
CPSDGYTAVG

SEQ ID NO: 2743820 - protein, 6 aa, Entamoeba invadens
CQDASK

SEQ ID NO: 2743821 - protein, 6 aa, Entamoeba invadens
CQDCDS

SEQ ID NO: 2743822 - protein, 12 aa, Entamoeba invadens
CQSCTSQQCTKC

SEQ ID NO: 2743823 - protein, 4 aa, Entamoeba invadens
CQTP

SEQ ID NO: 2743824 - protein, 6 aa, Entamoeba invadens
CRPCDT

SEQ ID NO: 2743825 - protein, 11 aa, Entamoeba invadens
CSAGTYSQSGA

SEQ ID NO: 2743826 - protein, 7 aa, Entamoeba invadens
CSAKSEV

SEQ ID NO: 2743827 - protein, 6 aa, Entamoeba invadens
CSDECT

SEQ ID NO: 2743828 - protein, 4 aa, Entamoeba invadens
CSDT

SEQ ID NO: 2743829 - protein, 5 aa, Entamoeba invadens
CSDTN

SEQ ID NO: 2743830 - protein, 16 aa, Entamoeba invadens
CSECGGSNKVGPNGDE

SEQ ID NO: 2743831 - protein, 5 aa, Entamoeba invadens
CSECT

SEQ ID NO: 2743832 - protein, 12 aa, Entamoeba invadens
CSEGGKTTDGRC

SEQ ID NO: 2743833 - protein, 8 aa, Entamoeba invadens
CSGSQGEF

SEQ ID NO: 2743834 - protein, 7 aa, Entamoeba invadens
CSKTTGN

SEQ ID NO: 2743835 - protein, 7 aa, Entamoeba invadens
CSKTTGQ

SEQ ID NO: 2743836 - protein, 8 aa, Entamoeba invadens
CSPKSNDC

SEQ ID NO: 2743837 - protein, 15 aa, Entamoeba invadens
CSPQSELTSCANKTT

SEQ ID NO: 2743838 - protein, 16 aa, Entamoeba invadens
CSPQSELTSCANRTTA

SEQ ID NO: 2743839 - protein, 17 aa, Entamoeba invadens
CSPQSELTSCANRTTAG

SEQ ID NO: 2743840 - protein, 5 aa, Entamoeba invadens
CSPTF

SEQ ID NO: 2743841 - protein, 15 aa, Entamoeba invadens
CSQCNGNCKTCSSQS

SEQ ID NO: 2743842 - protein, 6 aa, Entamoeba invadens
CSQTQK

SEQ ID NO: 2743843 - protein, 5 aa, Entamoeba invadens
CSRTE

SEQ ID NO: 2743844 - protein, 4 aa, Entamoeba invadens
CSSN

SEQ ID NO: 2743845 - protein, 8 aa, Entamoeba invadens
CSSSIQNC

SEQ ID NO: 2743846 - protein, 14 aa, Entamoeba invadens
CSSYTDSGCSSSTD

SEQ ID NO: 2743847 - protein, 30 aa, Entamoeba invadens
CSTGKYPQASGKCGECDSTCGGQCNPTNGY

SEQ ID NO: 2743848 - protein, 5 aa, Entamoeba invadens
CSTQT

SEQ ID NO: 2743849 - protein, 6 aa, Entamoeba invadens
CSTTER

SEQ ID NO: 2743850 - protein, 4 aa, Entamoeba invadens
CTAK

SEQ ID NO: 2743851 - protein, 14 aa, Entamoeba invadens
CTDATSCTTPEDNY

SEQ ID NO: 2743852 - protein, 6 aa, Entamoeba invadens
CTDSQS

SEQ ID NO: 2743853 - protein, 5 aa, Entamoeba invadens
CTDTQ

SEQ ID NO: 2743854 - protein, 6 aa, Entamoeba invadens
CTDTYS

SEQ ID NO: 2743855 - protein, 6 aa, Entamoeba invadens
CTKCGD

SEQ ID NO: 2743856 - protein, 4 aa, Entamoeba invadens
CTKD

SEQ ID NO: 2743857 - protein, 21 aa, Entamoeba invadens
CTPNGTDTDDGFTPSNCSVTT

SEQ ID NO: 2743858 - protein, 5 aa, Entamoeba invadens
CTQNT

SEQ ID NO: 2743859 - protein, 4 aa, Entamoeba invadens
CTSC

SEQ ID NO: 2743860 - protein, 7 aa, Entamoeba invadens
CTSCESE

SEQ ID NO: 2743861 - protein, 7 aa, Entamoeba invadens
CTSCGDT

SEQ ID NO: 2743862 - protein, 5 aa, Entamoeba invadens
CTSCS

SEQ ID NO: 2743863 - protein, 4 aa, Entamoeba invadens
CTSG

SEQ ID NO: 2743864 - protein, 12 aa, Entamoeba invadens
CTSQNSDCVSPQ

SEQ ID NO: 2743865 - protein, 4 aa, Entamoeba invadens
CTSS

SEQ ID NO: 2743866 - protein, 8 aa, Entamoeba invadens
CTTCNSAT

SEQ ID NO: 2743867 - protein, 16 aa, Entamoeba invadens
CVDSSTHCDTSTGCSK

SEQ ID NO: 2743868 - protein, 4 aa, Entamoeba invadens
CVEK

SEQ ID NO: 2743869 - protein, 4 aa, Entamoeba invadens
CVKG

SEQ ID NO: 2743870 - protein, 15 aa, Entamoeba invadens
CVSQNEQNCDKSSVS

SEQ ID NO: 2743871 - protein, 4 aa, Entamoeba invadens
CYPP

SEQ ID NO: 2743872 - protein, 13 aa, Entamoeba invadens
DATCGGKCDTTTG

SEQ ID NO: 2743873 - protein, 13 aa, Entamoeba invadens
DCPEGSKKDETNM

SEQ ID NO: 2743874 - protein, 10 aa, Entamoeba invadens
DCQGCTNNTY

SEQ ID NO: 2743875 - protein, 5 aa, Entamoeba invadens
DCSSC

SEQ ID NO: 2743876 - protein, 4 aa, Entamoeba invadens
DDDK

SEQ ID NO: 2743877 - protein, 9 aa, Entamoeba invadens
DDDQDYEEI

SEQ ID NO: 2743878 - protein, 4 aa, Entamoeba invadens
DDEF

SEQ ID NO: 2743879 - protein, 4 aa, Entamoeba invadens
DDEN

SEQ ID NO: 2743880 - protein, 5 aa, Entamoeba invadens
DDERF

SEQ ID NO: 2743881 - protein, 7 aa, Entamoeba invadens
DDGTYCN

SEQ ID NO: 2743882 - protein, 14 aa, Entamoeba invadens
DDGYYSDDSTATSF

SEQ ID NO: 2743883 - protein, 5 aa, Entamoeba invadens
DDKYL

SEQ ID NO: 2743884 - protein, 4 aa, Entamoeba invadens
DDNC

SEQ ID NO: 2743885 - protein, 15 aa, Entamoeba invadens
DDNENSDIPVGKETR

SEQ ID NO: 2743886 - protein, 7 aa, Entamoeba invadens
DDRKKMK

SEQ ID NO: 2743887 - protein, 4 aa, Entamoeba invadens
DDRN

SEQ ID NO: 2743888 - protein, 5 aa, Entamoeba invadens
DDSQN

SEQ ID NO: 2743889 - protein, 7 aa, Entamoeba invadens
DDTCSKD

SEQ ID NO: 2743890 - protein, 5 aa, Entamoeba invadens
DDTSI

SEQ ID NO: 2743891 - protein, 7 aa, Entamoeba invadens
DDYNSYD

SEQ ID NO: 2743892 - protein, 7 aa, Entamoeba invadens
DEEEMKE

SEQ ID NO: 2743893 - protein, 5 aa, Entamoeba invadens
DEETL

SEQ ID NO: 2743894 - protein, 12 aa, Entamoeba invadens
DEFSSESVTIGN

SEQ ID NO: 2743895 - protein, 4 aa, Entamoeba invadens
DEHR

SEQ ID NO: 2743896 - protein, 9 aa, Entamoeba invadens
DEKCEKCPE

SEQ ID NO: 2743897 - protein, 10 aa, Entamoeba invadens
DEKGTVATAA

SEQ ID NO: 2743898 - protein, 9 aa, Entamoeba invadens
DEKMYTADT

SEQ ID NO: 2743899 - protein, 13 aa, Entamoeba invadens
DELTEDKKLGQGS

SEQ ID NO: 2743900 - protein, 9 aa, Entamoeba invadens
DEMNEKNFE

SEQ ID NO: 2743901 - protein, 6 aa, Entamoeba invadens
DENTKL

SEQ ID NO: 2743902 - protein, 6 aa, Entamoeba invadens
DEQSVD

SEQ ID NO: 2743903 - protein, 33 aa, Entamoeba invadens
DERKCKKCKPGMYPDEQSGACKSCDTTCDSQCE

SEQ ID NO: 2743904 - protein, 4 aa, Entamoeba invadens
DETI

SEQ ID NO: 2743905 - protein, 5 aa, Entamoeba invadens
DEVCS

SEQ ID NO: 2743906 - protein, 17 aa, Entamoeba invadens
DEVNGKLTDFGASRNVN

SEQ ID NO: 2743907 - protein, 10 aa, Entamoeba invadens
DFGNDENGHC

SEQ ID NO: 2743908 - protein, 5 aa, Entamoeba invadens
DFGTS

SEQ ID NO: 2743909 - protein, 7 aa, Entamoeba invadens
DGFYKST

SEQ ID NO: 2743910 - protein, 4 aa, Entamoeba invadens
DGIP

SEQ ID NO: 2743911 - protein, 7 aa, Entamoeba invadens
DGKGHCK

SEQ ID NO: 2743912 - protein, 5 aa, Entamoeba invadens
DGVNA

SEQ ID NO: 2743913 - protein, 27 aa, Entamoeba invadens
DGVTGKCKSCSENSVVQAGSTDTCETC

SEQ ID NO: 2743914 - protein, 7 aa, Entamoeba invadens
DGYGGSD

SEQ ID NO: 2743915 - protein, 4 aa, Entamoeba invadens
DGYT

SEQ ID NO: 2743916 - protein, 23 aa, Entamoeba invadens
DGYTLSDDTNKRCVKNGENTDSA

SEQ ID NO: 2743917 - protein, 13 aa, Entamoeba invadens
DGYYKSMDGKQCN

SEQ ID NO: 2743918 - protein, 8 aa, Entamoeba invadens
DHKEDIPK

SEQ ID NO: 2743919 - protein, 5 aa, Entamoeba invadens
DHSEI

SEQ ID NO: 2743920 - protein, 15 aa, Entamoeba invadens
DIENSESSWTNEQVA

SEQ ID NO: 2743921 - protein, 5 aa, Entamoeba invadens
DILSN

SEQ ID NO: 2743922 - protein, 6 aa, Entamoeba invadens
DIRTEP

SEQ ID NO: 2743923 - protein, 10 aa, Entamoeba invadens
DISNKNGKCV

SEQ ID NO: 2743924 - protein, 4 aa, Entamoeba invadens
DITN

SEQ ID NO: 2743925 - protein, 8 aa, Entamoeba invadens
DKASVGRT

SEQ ID NO: 2743926 - protein, 4 aa, Entamoeba invadens
DKCS

SEQ ID NO: 2743927 - protein, 12 aa, Entamoeba invadens
DKCSEGNSDTKC

SEQ ID NO: 2743928 - protein, 9 aa, Entamoeba invadens
DKDDKCTKC

SEQ ID NO: 2743929 - protein, 5 aa, Entamoeba invadens
DKESR

SEQ ID NO: 2743930 - protein, 5 aa, Entamoeba invadens
DKGNC

SEQ ID NO: 2743931 - protein, 4 aa, Entamoeba invadens
DKIN

SEQ ID NO: 2743932 - protein, 8 aa, Entamoeba invadens
DKKLGEGS

SEQ ID NO: 2743933 - protein, 8 aa, Entamoeba invadens
DKKQYQSA

SEQ ID NO: 2743934 - protein, 10 aa, Entamoeba invadens
DKKTQGAFES

SEQ ID NO: 2743935 - protein, 7 aa, Entamoeba invadens
DKLGEGS

SEQ ID NO: 2743936 - protein, 4 aa, Entamoeba invadens
DKMT

SEQ ID NO: 2743937 - protein, 8 aa, Entamoeba invadens
DKSLGNAS

SEQ ID NO: 2743938 - protein, 7 aa, Entamoeba invadens
DKSTLSK

SEQ ID NO: 2743939 - protein, 9 aa, Entamoeba invadens
DKSTYSYKI

SEQ ID NO: 2743940 - protein, 11 aa, Entamoeba invadens
DKTKSGCKSCA

SEQ ID NO: 2743941 - protein, 7 aa, Entamoeba invadens
DKTNGHC

SEQ ID NO: 2743942 - protein, 13 aa, Entamoeba invadens
DKVNAKLTDFGAS

SEQ ID NO: 2743943 - protein, 7 aa, Entamoeba invadens
DKYGGDD

SEQ ID NO: 2743944 - protein, 8 aa, Entamoeba invadens
DLKNGEEK

SEQ ID NO: 2743945 - protein, 5 aa, Entamoeba invadens
DLNTE

SEQ ID NO: 2743946 - protein, 9 aa, Entamoeba invadens
DLPNEEESV

SEQ ID NO: 2743947 - protein, 4 aa, Entamoeba invadens
DLST

SEQ ID NO: 2743948 - protein, 5 aa, Entamoeba invadens
DLVPN

SEQ ID NO: 2743949 - protein, 5 aa, Entamoeba invadens
DNFGR

SEQ ID NO: 2743950 - protein, 6 aa, Entamoeba invadens
DNKGCS

SEQ ID NO: 2743951 - protein, 8 aa, Entamoeba invadens
DNKYQSNC

SEQ ID NO: 2743952 - protein, 9 aa, Entamoeba invadens
DNLDPWNQM

SEQ ID NO: 2743953 - protein, 7 aa, Entamoeba invadens
DNNKDAA

SEQ ID NO: 2743954 - protein, 4 aa, Entamoeba invadens
DNPL

SEQ ID NO: 2743955 - protein, 6 aa, Entamoeba invadens
DNPTNC

SEQ ID NO: 2743956 - protein, 8 aa, Entamoeba invadens
DNQKVNAK

SEQ ID NO: 2743957 - protein, 5 aa, Entamoeba invadens
DNSFV

SEQ ID NO: 2743958 - protein, 7 aa, Entamoeba invadens
DNSTGSV

SEQ ID NO: 2743959 - protein, 5 aa, Entamoeba invadens
DNTEA

SEQ ID NO: 2743960 - protein, 10 aa, Entamoeba invadens
DNTTGTPKCV

SEQ ID NO: 2743961 - protein, 7 aa, Entamoeba invadens
DNVRPGK

SEQ ID NO: 2743962 - protein, 5 aa, Entamoeba invadens
DPING

SEQ ID NO: 2743963 - protein, 9 aa, Entamoeba invadens
DPKDRPSFD

SEQ ID NO: 2743964 - protein, 4 aa, Entamoeba invadens
DPNC

SEQ ID NO: 2743965 - protein, 7 aa, Entamoeba invadens
DPNDYKK

SEQ ID NO: 2743966 - protein, 5 aa, Entamoeba invadens
DQDYD

SEQ ID NO: 2743967 - protein, 4 aa, Entamoeba invadens
DQIS

SEQ ID NO: 2743968 - protein, 8 aa, Entamoeba invadens
DQNPKERL

SEQ ID NO: 2743969 - protein, 5 aa, Entamoeba invadens
DQYLD

SEQ ID NO: 2743970 - protein, 8 aa, Entamoeba invadens
DRASEGRT

SEQ ID NO: 2743971 - protein, 12 aa, Entamoeba invadens
DRNSGCKKCENG

SEQ ID NO: 2743972 - protein, 9 aa, Entamoeba invadens
DSCQTRNDA

SEQ ID NO: 2743973 - protein, 4 aa, Entamoeba invadens
DSEG

SEQ ID NO: 2743974 - protein, 5 aa, Entamoeba invadens
DSENR

SEQ ID NO: 2743975 - protein, 9 aa, Entamoeba invadens
DSIGGRDES

SEQ ID NO: 2743976 - protein, 5 aa, Entamoeba invadens
DSITT

SEQ ID NO: 2743977 - protein, 4 aa, Entamoeba invadens
DSNC

SEQ ID NO: 2743978 - protein, 13 aa, Entamoeba invadens
DSNCKTCDQTSTQ

SEQ ID NO: 2743979 - protein, 14 aa, Entamoeba invadens
DSNCNTCNNTEKSC

SEQ ID NO: 2743980 - protein, 11 aa, Entamoeba invadens
DSNCSSCSSDF

SEQ ID NO: 2743981 - protein, 15 aa, Entamoeba invadens
DSNENESQRECAECS

SEQ ID NO: 2743982 - protein, 16 aa, Entamoeba invadens
DSTCGNQCDGKNGHCT

SEQ ID NO: 2743983 - protein, 13 aa, Entamoeba invadens
DSTCNGDCNTANG

SEQ ID NO: 2743984 - protein, 14 aa, Entamoeba invadens
DSTFYDSQETGTLT

SEQ ID NO: 2743985 - protein, 7 aa, Entamoeba invadens
DSTITLS

SEQ ID NO: 2743986 - protein, 5 aa, Entamoeba invadens
DSVNA

SEQ ID NO: 2743987 - protein, 4 aa, Entamoeba invadens
DTNQ

SEQ ID NO: 2743988 - protein, 4 aa, Entamoeba invadens
DTPE

SEQ ID NO: 2743989 - protein, 9 aa, Entamoeba invadens
DTPMPGSSL

SEQ ID NO: 2743990 - protein, 5 aa, Entamoeba invadens
DTQLN

SEQ ID NO: 2743991 - protein, 6 aa, Entamoeba invadens
DTQTCT

SEQ ID NO: 2743992 - protein, 4 aa, Entamoeba invadens
DTSF

SEQ ID NO: 2743993 - protein, 9 aa, Entamoeba invadens
DTSPTPPTC

SEQ ID NO: 2743994 - protein, 16 aa, Entamoeba invadens
DTSTCEVDTKQNRQLM

SEQ ID NO: 2743995 - protein, 11 aa, Entamoeba invadens
DTTCKTCGNTK

SEQ ID NO: 2743996 - protein, 9 aa, Entamoeba invadens
DTTTRDQWN

SEQ ID NO: 2743997 - protein, 4 aa, Entamoeba invadens
DTVN

SEQ ID NO: 2743998 - protein, 4 aa, Entamoeba invadens
DTVT

SEQ ID NO: 2743999 - protein, 18 aa, Entamoeba invadens
DVKEEPMECGSKSQHTSN

SEQ ID NO: 2744000 - protein, 7 aa, Entamoeba invadens
DVNTQQR

SEQ ID NO: 2744001 - protein, 6 aa, Entamoeba invadens
DVSQSV

SEQ ID NO: 2744002 - protein, 7 aa, Entamoeba invadens
EAAKTAN

SEQ ID NO: 2744003 - protein, 6 aa, Entamoeba invadens
EATDSK

SEQ ID NO: 2744004 - protein, 5 aa, Entamoeba invadens
EATNN

SEQ ID NO: 2744005 - protein, 10 aa, Entamoeba invadens
EAVGGKCTTC

SEQ ID NO: 2744006 - protein, 5 aa, Entamoeba invadens
EAYDK

SEQ ID NO: 2744007 - protein, 7 aa, Entamoeba invadens
EAYTLKS

SEQ ID NO: 2744008 - protein, 8 aa, Entamoeba invadens
ECDGGTNC

SEQ ID NO: 2744009 - protein, 8 aa, Entamoeba invadens
ECEDSTQI

SEQ ID NO: 2744010 - protein, 4 aa, Entamoeba invadens
ECEE

SEQ ID NO: 2744011 - protein, 7 aa, Entamoeba invadens
ECKEYTT

SEQ ID NO: 2744012 - protein, 8 aa, Entamoeba invadens
ECKNGYYK

SEQ ID NO: 2744013 - protein, 6 aa, Entamoeba invadens
EDEKQS

SEQ ID NO: 2744014 - protein, 7 aa, Entamoeba invadens
EDGDHCD

SEQ ID NO: 2744015 - protein, 7 aa, Entamoeba invadens
EECDGGV

SEQ ID NO: 2744016 - protein, 10 aa, Entamoeba invadens
EECDNGTNCN

SEQ ID NO: 2744017 - protein, 6 aa, Entamoeba invadens
EECSIS

SEQ ID NO: 2744018 - protein, 10 aa, Entamoeba invadens
EEEKKLGEGS

SEQ ID NO: 2744019 - protein, 9 aa, Entamoeba invadens
EEEKTEYHT

SEQ ID NO: 2744020 - protein, 7 aa, Entamoeba invadens
EEGSTFE

SEQ ID NO: 2744021 - protein, 6 aa, Entamoeba invadens
EEKLRN

SEQ ID NO: 2744022 - protein, 5 aa, Entamoeba invadens
EENVS

SEQ ID NO: 2744023 - protein, 8 aa, Entamoeba invadens
EEQRERVR

SEQ ID NO: 2744024 - protein, 18 aa, Entamoeba invadens
EESCSKCSTTTKKCTNCE

SEQ ID NO: 2744025 - protein, 6 aa, Entamoeba invadens
EETCST

SEQ ID NO: 2744026 - protein, 5 aa, Entamoeba invadens
EETET

SEQ ID NO: 2744027 - protein, 9 aa, Entamoeba invadens
EETPQGCQD

SEQ ID NO: 2744028 - protein, 4 aa, Entamoeba invadens
EETY

SEQ ID NO: 2744029 - protein, 12 aa, Entamoeba invadens
EFSETKQSMDEF

SEQ ID NO: 2744030 - protein, 8 aa, Entamoeba invadens
EGGANFSI

SEQ ID NO: 2744031 - protein, 5 aa, Entamoeba invadens
EGKEE

SEQ ID NO: 2744032 - protein, 10 aa, Entamoeba invadens
EGKVKNGDKT

SEQ ID NO: 2744033 - protein, 5 aa, Entamoeba invadens
EGLAG

SEQ ID NO: 2744034 - protein, 10 aa, Entamoeba invadens
EGNGFDDQGN

SEQ ID NO: 2744035 - protein, 13 aa, Entamoeba invadens
EGNYLSKDSPPKC

SEQ ID NO: 2744036 - protein, 8 aa, Entamoeba invadens
EGQNITYN

SEQ ID NO: 2744037 - protein, 14 aa, Entamoeba invadens
EGRREPTDSGDSCT

SEQ ID NO: 2744038 - protein, 16 aa, Entamoeba invadens
EGRREPTDSGDSCTKS

SEQ ID NO: 2744039 - protein, 9 aa, Entamoeba invadens
EGSDTEPKK

SEQ ID NO: 2744040 - protein, 4 aa, Entamoeba invadens
EGSN

SEQ ID NO: 2744041 - protein, 4 aa, Entamoeba invadens
EGTY

SEQ ID NO: 2744042 - protein, 9 aa, Entamoeba invadens
EGYSVSADR

SEQ ID NO: 2744043 - protein, 12 aa, Entamoeba invadens
EGYYNTNSDCTS

SEQ ID NO: 2744044 - protein, 13 aa, Entamoeba invadens
EHLEKQSSMSDEQ

SEQ ID NO: 2744045 - protein, 19 aa, Entamoeba invadens
EHYEKPCKDEECEKCTGGV

SEQ ID NO: 2744046 - protein, 9 aa, Entamoeba invadens
EHYKKPADV

SEQ ID NO: 2744047 - protein, 9 aa, Entamoeba invadens
EHYKKSSDV

SEQ ID NO: 2744048 - protein, 11 aa, Entamoeba invadens
EIPNDTNGRCN

SEQ ID NO: 2744049 - protein, 6 aa, Entamoeba invadens
EIPVGK

SEQ ID NO: 2744050 - protein, 6 aa, Entamoeba invadens
EIQPEF

SEQ ID NO: 2744051 - protein, 27 aa, Entamoeba invadens
EISSDELEEEQENETTTQNVSQNGSIK

SEQ ID NO: 2744052 - protein, 4 aa, Entamoeba invadens
EIST

SEQ ID NO: 2744053 - protein, 9 aa, Entamoeba invadens
EKAANGRTT

SEQ ID NO: 2744054 - protein, 9 aa, Entamoeba invadens
EKASEGRTT

SEQ ID NO: 2744055 - protein, 5 aa, Entamoeba invadens
EKDID

SEQ ID NO: 2744056 - protein, 6 aa, Entamoeba invadens
EKEERI

SEQ ID NO: 2744057 - protein, 23 aa, Entamoeba invadens
EKEGKCEKCKDTYNTPCKQGDTE

SEQ ID NO: 2744058 - protein, 5 aa, Entamoeba invadens
EKEIS

SEQ ID NO: 2744059 - protein, 4 aa, Entamoeba invadens
EKGK

SEQ ID NO: 2744060 - protein, 12 aa, Entamoeba invadens
EKKTKQQLTTQT

SEQ ID NO: 2744061 - protein, 8 aa, Entamoeba invadens
EKRLGEGS

SEQ ID NO: 2744062 - protein, 8 aa, Entamoeba invadens
EKSIETTT

SEQ ID NO: 2744063 - protein, 4 aa, Entamoeba invadens
EKSN

SEQ ID NO: 2744064 - protein, 7 aa, Entamoeba invadens
EKTTKGC

SEQ ID NO: 2744065 - protein, 5 aa, Entamoeba invadens
EKYKM

SEQ ID NO: 2744066 - protein, 12 aa, Entamoeba invadens
ELEEDEKLGEGS

SEQ ID NO: 2744067 - protein, 12 aa, Entamoeba invadens
ELEETKKIGEGS

SEQ ID NO: 2744068 - protein, 10 aa, Entamoeba invadens
ELKEDVDEIN

SEQ ID NO: 2744069 - protein, 6 aa, Entamoeba invadens
ELPPAV

SEQ ID NO: 2744070 - protein, 5 aa, Entamoeba invadens
ELSLE

SEQ ID NO: 2744071 - protein, 12 aa, Entamoeba invadens
EMNQSDKAIQEF

SEQ ID NO: 2744072 - protein, 4 aa, Entamoeba invadens
EMST

SEQ ID NO: 2744073 - protein, 4 aa, Entamoeba invadens
ENCE

SEQ ID NO: 2744074 - protein, 9 aa, Entamoeba invadens
ENEGVNEIH

SEQ ID NO: 2744075 - protein, 5 aa, Entamoeba invadens
ENETK

SEQ ID NO: 2744076 - protein, 8 aa, Entamoeba invadens
ENGHPTKC

SEQ ID NO: 2744077 - protein, 19 aa, Entamoeba invadens
ENGKTTKCDDKSKMSLSGT

SEQ ID NO: 2744078 - protein, 6 aa, Entamoeba invadens
ENITQS

SEQ ID NO: 2744079 - protein, 8 aa, Entamoeba invadens
ENKLGEGS

SEQ ID NO: 2744080 - protein, 17 aa, Entamoeba invadens
ENNDTQNESIPVDKETR

SEQ ID NO: 2744081 - protein, 15 aa, Entamoeba invadens
ENNFASSYNDKMNKA

SEQ ID NO: 2744082 - protein, 6 aa, Entamoeba invadens
ENNGEY

SEQ ID NO: 2744083 - protein, 4 aa, Entamoeba invadens
ENNM

SEQ ID NO: 2744084 - protein, 4 aa, Entamoeba invadens
ENNN

SEQ ID NO: 2744085 - protein, 8 aa, Entamoeba invadens
ENPQLDKP

SEQ ID NO: 2744086 - protein, 4 aa, Entamoeba invadens
ENQC

SEQ ID NO: 2744087 - protein, 4 aa, Entamoeba invadens
ENQN

SEQ ID NO: 2744088 - protein, 10 aa, Entamoeba invadens
ENSNTGCAKC

SEQ ID NO: 2744089 - protein, 7 aa, Entamoeba invadens
ENSTITS

SEQ ID NO: 2744090 - protein, 6 aa, Entamoeba invadens
ENYGSG

SEQ ID NO: 2744091 - protein, 5 aa, Entamoeba invadens
EPAGG

SEQ ID NO: 2744092 - protein, 7 aa, Entamoeba invadens
EPDVDTT

SEQ ID NO: 2744093 - protein, 6 aa, Entamoeba invadens
EPESQS

SEQ ID NO: 2744094 - protein, 4 aa, Entamoeba invadens
EPLK

SEQ ID NO: 2744095 - protein, 7 aa, Entamoeba invadens
EPTKPYT

SEQ ID NO: 2744096 - protein, 5 aa, Entamoeba invadens
EPYKS

SEQ ID NO: 2744097 - protein, 5 aa, Entamoeba invadens
EPYNE

SEQ ID NO: 2744098 - protein, 7 aa, Entamoeba invadens
EQCSNTT

SEQ ID NO: 2744099 - protein, 11 aa, Entamoeba invadens
EQEPKNRPTFD

SEQ ID NO: 2744100 - protein, 15 aa, Entamoeba invadens
EQPRYDPDSVPTFTE

SEQ ID NO: 2744101 - protein, 6 aa, Entamoeba invadens
EQQIAD

SEQ ID NO: 2744102 - protein, 19 aa, Entamoeba invadens
ERALSTKELSQGIGTPTYM

SEQ ID NO: 2744103 - protein, 13 aa, Entamoeba invadens
ERGANLSGGQRQR

SEQ ID NO: 2744104 - protein, 4 aa, Entamoeba invadens
ERIT

SEQ ID NO: 2744105 - protein, 6 aa, Entamoeba invadens
ERKKNG

SEQ ID NO: 2744106 - protein, 4 aa, Entamoeba invadens
ERSN

SEQ ID NO: 2744107 - protein, 8 aa, Entamoeba invadens
ESCSTTGF

SEQ ID NO: 2744108 - protein, 35 aa, Entamoeba invadens
ESETKCTKCGNNQYVQEDGSCGDTCPEKYRKGDGI

SEQ ID NO: 2744109 - protein, 9 aa, Entamoeba invadens
ESGCGKSTT

SEQ ID NO: 2744110 - protein, 17 aa, Entamoeba invadens
ESGTCSSCKNGLKRVGD

SEQ ID NO: 2744111 - protein, 6 aa, Entamoeba invadens
ESIDGN

SEQ ID NO: 2744112 - protein, 8 aa, Entamoeba invadens
ESIGEEAF

SEQ ID NO: 2744113 - protein, 8 aa, Entamoeba invadens
ESKTNEEL

SEQ ID NO: 2744114 - protein, 11 aa, Entamoeba invadens
ESRETKKCVTT

SEQ ID NO: 2744115 - protein, 6 aa, Entamoeba invadens
ESSDID

SEQ ID NO: 2744116 - protein, 5 aa, Entamoeba invadens
ESSSH

SEQ ID NO: 2744117 - protein, 5 aa, Entamoeba invadens
ESVEG

SEQ ID NO: 2744118 - protein, 4 aa, Entamoeba invadens
ESVS

SEQ ID NO: 2744119 - protein, 10 aa, Entamoeba invadens
ETCDSNYEKK

SEQ ID NO: 2744120 - protein, 4 aa, Entamoeba invadens
ETCS

SEQ ID NO: 2744121 - protein, 4 aa, Entamoeba invadens
ETCV

SEQ ID NO: 2744122 - protein, 8 aa, Entamoeba invadens
ETEESTKL

SEQ ID NO: 2744123 - protein, 4 aa, Entamoeba invadens
ETET

SEQ ID NO: 2744124 - protein, 8 aa, Entamoeba invadens
ETFTTEEK

SEQ ID NO: 2744125 - protein, 6 aa, Entamoeba invadens
ETGELK

SEQ ID NO: 2744126 - protein, 4 aa, Entamoeba invadens
ETKS

SEQ ID NO: 2744127 - protein, 5 aa, Entamoeba invadens
ETNFY

SEQ ID NO: 2744128 - protein, 12 aa, Entamoeba invadens
ETPYTGTLPNNT

SEQ ID NO: 2744129 - protein, 8 aa, Entamoeba invadens
ETSTTRNE

SEQ ID NO: 2744130 - protein, 7 aa, Entamoeba invadens
ETTCDSS

SEQ ID NO: 2744131 - protein, 11 aa, Entamoeba invadens
ETTQNGCSKCS

SEQ ID NO: 2744132 - protein, 5 aa, Entamoeba invadens
ETVTR

SEQ ID NO: 2744133 - protein, 4 aa, Entamoeba invadens
ETYY

SEQ ID NO: 2744134 - protein, 14 aa, Entamoeba invadens
EVRDKTPSIPSRDI

SEQ ID NO: 2744135 - protein, 5 aa, Entamoeba invadens
EVSFG

SEQ ID NO: 2744136 - protein, 13 aa, Entamoeba invadens
EVSKGKCTKCKND

SEQ ID NO: 2744137 - protein, 4 aa, Entamoeba invadens
EYGQ

SEQ ID NO: 2744138 - protein, 11 aa, Entamoeba invadens
EYNQQTETELK

SEQ ID NO: 2744139 - protein, 5 aa, Entamoeba invadens
EYQPT

SEQ ID NO: 2744140 - protein, 4 aa, Entamoeba invadens
EYSA

SEQ ID NO: 2744141 - protein, 17 aa, Entamoeba invadens
EYSRLPNGKMRRNAKTN

SEQ ID NO: 2744142 - protein, 24 aa, Entamoeba invadens
FEEKRGSRESVEQIEENNKSELKE

SEQ ID NO: 2744143 - protein, 10 aa, Entamoeba invadens
FENSTFNSST

SEQ ID NO: 2744144 - protein, 8 aa, Entamoeba invadens
FETKGNHK

SEQ ID NO: 2744145 - protein, 12 aa, Entamoeba invadens
FEYNNTSCKSGY

SEQ ID NO: 2744146 - protein, 5 aa, Entamoeba invadens
FGDGS

SEQ ID NO: 2744147 - protein, 10 aa, Entamoeba invadens
FGESTKCTAC

SEQ ID NO: 2744148 - protein, 6 aa, Entamoeba invadens
FGGSEK

SEQ ID NO: 2744149 - protein, 7 aa, Entamoeba invadens
FGNDTKL

SEQ ID NO: 2744150 - protein, 9 aa, Entamoeba invadens
FGNSTSATA

SEQ ID NO: 2744151 - protein, 7 aa, Entamoeba invadens
FGTNSTN

SEQ ID NO: 2744152 - protein, 6 aa, Entamoeba invadens
FIESSS

SEQ ID NO: 2744153 - protein, 5 aa, Entamoeba invadens
FKDKN

SEQ ID NO: 2744154 - protein, 5 aa, Entamoeba invadens
FKGAT

SEQ ID NO: 2744155 - protein, 8 aa, Entamoeba invadens
FKTEQTSS

SEQ ID NO: 2744156 - protein, 5 aa, Entamoeba invadens
FNDTN

SEQ ID NO: 2744157 - protein, 4 aa, Entamoeba invadens
FNET

SEQ ID NO: 2744158 - protein, 4 aa, Entamoeba invadens
FNNN

SEQ ID NO: 2744159 - protein, 5 aa, Entamoeba invadens
FPKSE

SEQ ID NO: 2744160 - protein, 5 aa, Entamoeba invadens
FPSSV

SEQ ID NO: 2744161 - protein, 8 aa, Entamoeba invadens
FPTNQTEI

SEQ ID NO: 2744162 - protein, 4 aa, Entamoeba invadens
FQKY

SEQ ID NO: 2744163 - protein, 7 aa, Entamoeba invadens
FQNETGK

SEQ ID NO: 2744164 - protein, 5 aa, Entamoeba invadens
FRGND

SEQ ID NO: 2744165 - protein, 5 aa, Entamoeba invadens
FRGNT

SEQ ID NO: 2744166 - protein, 4 aa, Entamoeba invadens
FRNN

SEQ ID NO: 2744167 - protein, 4 aa, Entamoeba invadens
FRTQ

SEQ ID NO: 2744168 - protein, 7 aa, Entamoeba invadens
FSKGDGL

SEQ ID NO: 2744169 - protein, 9 aa, Entamoeba invadens
FSKSGNATC

SEQ ID NO: 2744170 - protein, 4 aa, Entamoeba invadens
FSNE

SEQ ID NO: 2744171 - protein, 4 aa, Entamoeba invadens
FSNI

SEQ ID NO: 2744172 - protein, 4 aa, Entamoeba invadens
FSNM

SEQ ID NO: 2744173 - protein, 8 aa, Entamoeba invadens
FSNPNKTD

SEQ ID NO: 2744174 - protein, 11 aa, Entamoeba invadens
FSNSPESARAQ

SEQ ID NO: 2744175 - protein, 9 aa, Entamoeba invadens
FSSSSGCER

SEQ ID NO: 2744176 - protein, 7 aa, Entamoeba invadens
FTDPPGK

SEQ ID NO: 2744177 - protein, 4 aa, Entamoeba invadens
FTEK

SEQ ID NO: 2744178 - protein, 10 aa, Entamoeba invadens
FTGESDTDID

SEQ ID NO: 2744179 - protein, 5 aa, Entamoeba invadens
FTGTS

SEQ ID NO: 2744180 - protein, 9 aa, Entamoeba invadens
FTKRNPNLK

SEQ ID NO: 2744181 - protein, 9 aa, Entamoeba invadens
FTPPGAKSG

SEQ ID NO: 2744182 - protein, 5 aa, Entamoeba invadens
FTSAG

SEQ ID NO: 2744183 - protein, 4 aa, Entamoeba invadens
FVNT

SEQ ID NO: 2744184 - protein, 9 aa, Entamoeba invadens
FYSTTGSST

SEQ ID NO: 2744185 - protein, 8 aa, Entamoeba invadens
GACDPTSG

SEQ ID NO: 2744186 - protein, 8 aa, Entamoeba invadens
GACNPTSG

SEQ ID NO: 2744187 - protein, 6 aa, Entamoeba invadens
GADETL

SEQ ID NO: 2744188 - protein, 4 aa, Entamoeba invadens
GADS

SEQ ID NO: 2744189 - protein, 4 aa, Entamoeba invadens
GAEK

SEQ ID NO: 2744190 - protein, 6 aa, Entamoeba invadens
GAQDLI

SEQ ID NO: 2744191 - protein, 18 aa, Entamoeba invadens
GASKAYTVTPLPTNTDGI

SEQ ID NO: 2744192 - protein, 6 aa, Entamoeba invadens
GCDQYS

SEQ ID NO: 2744193 - protein, 12 aa, Entamoeba invadens
GCDQYSIRTEPK

SEQ ID NO: 2744194 - protein, 10 aa, Entamoeba invadens
GCVSSPNTYC

SEQ ID NO: 2744195 - protein, 5 aa, Entamoeba invadens
GDAAF

SEQ ID NO: 2744196 - protein, 7 aa, Entamoeba invadens
GDAAFNN

SEQ ID NO: 2744197 - protein, 7 aa, Entamoeba invadens
GDDRPGV

SEQ ID NO: 2744198 - protein, 7 aa, Entamoeba invadens
GDDVSNE

SEQ ID NO: 2744199 - protein, 9 aa, Entamoeba invadens
GDGGMKNVT

SEQ ID NO: 2744200 - protein, 9 aa, Entamoeba invadens
GDNCKECSS

SEQ ID NO: 2744201 - protein, 6 aa, Entamoeba invadens
GDNGNC

SEQ ID NO: 2744202 - protein, 4 aa, Entamoeba invadens
GDNK

SEQ ID NO: 2744203 - protein, 9 aa, Entamoeba invadens
GDNKNRVCT

SEQ ID NO: 2744204 - protein, 5 aa, Entamoeba invadens
GDNNF

SEQ ID NO: 2744205 - protein, 8 aa, Entamoeba invadens
GDREGGGV

SEQ ID NO: 2744206 - protein, 5 aa, Entamoeba invadens
GDRTV

SEQ ID NO: 2744207 - protein, 8 aa, Entamoeba invadens
GDSTEEMP

SEQ ID NO: 2744208 - protein, 8 aa, Entamoeba invadens
GDSVTFPK

SEQ ID NO: 2744209 - protein, 20 aa, Entamoeba invadens
GDTKGTLSNSTNSSSATEND

SEQ ID NO: 2744210 - protein, 6 aa, Entamoeba invadens
GECAPC

SEQ ID NO: 2744211 - protein, 5 aa, Entamoeba invadens
GEGSF

SEQ ID NO: 2744212 - protein, 10 aa, Entamoeba invadens
GELNTNCDTC

SEQ ID NO: 2744213 - protein, 13 aa, Entamoeba invadens
GEMTYSNSGSLSC

SEQ ID NO: 2744214 - protein, 4 aa, Entamoeba invadens
GENK

SEQ ID NO: 2744215 - protein, 5 aa, Entamoeba invadens
GENSG

SEQ ID NO: 2744216 - protein, 12 aa, Entamoeba invadens
GERLERRENIPE

SEQ ID NO: 2744217 - protein, 8 aa, Entamoeba invadens
GESNFDDP

SEQ ID NO: 2744218 - protein, 9 aa, Entamoeba invadens
GESRDTSSI

SEQ ID NO: 2744219 - protein, 4 aa, Entamoeba invadens
GETF

SEQ ID NO: 2744220 - protein, 6 aa, Entamoeba invadens
GFAPKD

SEQ ID NO: 2744221 - protein, 5 aa, Entamoeba invadens
GFERG

SEQ ID NO: 2744222 - protein, 22 aa, Entamoeba invadens
GFYPESKTCSKCDSSCSDCTSL

SEQ ID NO: 2744223 - protein, 5 aa, Entamoeba invadens
GFYQG

SEQ ID NO: 2744224 - protein, 7 aa, Entamoeba invadens
GGDSQEC

SEQ ID NO: 2744225 - protein, 5 aa, Entamoeba invadens
GGFSL

SEQ ID NO: 2744226 - protein, 5 aa, Entamoeba invadens
GGNCA

SEQ ID NO: 2744227 - protein, 4 aa, Entamoeba invadens
GGSV

SEQ ID NO: 2744228 - protein, 12 aa, Entamoeba invadens
GGTTEVKVTNSN

SEQ ID NO: 2744229 - protein, 4 aa, Entamoeba invadens
GGYT

SEQ ID NO: 2744230 - protein, 13 aa, Entamoeba invadens
GIEGKEGKQASMA

SEQ ID NO: 2744231 - protein, 8 aa, Entamoeba invadens
GIGSPSYM

SEQ ID NO: 2744232 - protein, 7 aa, Entamoeba invadens
GIGSPTY

SEQ ID NO: 2744233 - protein, 4 aa, Entamoeba invadens
GIGT

SEQ ID NO: 2744234 - protein, 6 aa, Entamoeba invadens
GIGTPT

SEQ ID NO: 2744235 - protein, 4 aa, Entamoeba invadens
GINE

SEQ ID NO: 2744236 - protein, 10 aa, Entamoeba invadens
GITESSDTQI

SEQ ID NO: 2744237 - protein, 4 aa, Entamoeba invadens
GKAA

SEQ ID NO: 2744238 - protein, 4 aa, Entamoeba invadens
GKAV

SEQ ID NO: 2744239 - protein, 19 aa, Entamoeba invadens
GKCIANPKNCLTSSKSGNC

SEQ ID NO: 2744240 - protein, 4 aa, Entamoeba invadens
GKCT

SEQ ID NO: 2744241 - protein, 7 aa, Entamoeba invadens
GKCYKKR

SEQ ID NO: 2744242 - protein, 19 aa, Entamoeba invadens
GKDDDQSTITVDSDEWEEV

SEQ ID NO: 2744243 - protein, 23 aa, Entamoeba invadens
GKDSCSKCKDGYTLNKTSGKCNG

SEQ ID NO: 2744244 - protein, 4 aa, Entamoeba invadens
GKGN

SEQ ID NO: 2744245 - protein, 14 aa, Entamoeba invadens
GKHPRKRSSITKEE

SEQ ID NO: 2744246 - protein, 9 aa, Entamoeba invadens
GKKETTSVK

SEQ ID NO: 2744247 - protein, 12 aa, Entamoeba invadens
GKKPSDDGLSCS

SEQ ID NO: 2744248 - protein, 10 aa, Entamoeba invadens
GKLSSHYSNQ

SEQ ID NO: 2744249 - protein, 11 aa, Entamoeba invadens
GKLTDFGSSRN

SEQ ID NO: 2744250 - protein, 7 aa, Entamoeba invadens
GKNVEGK

SEQ ID NO: 2744251 - protein, 8 aa, Entamoeba invadens
GKPVETPI

SEQ ID NO: 2744252 - protein, 9 aa, Entamoeba invadens
GKPVETPIK

SEQ ID NO: 2744253 - protein, 13 aa, Entamoeba invadens
GKRYGAYKDIDNE

SEQ ID NO: 2744254 - protein, 10 aa, Entamoeba invadens
GKVAEQGTHD

SEQ ID NO: 2744255 - protein, 15 aa, Entamoeba invadens
GKYYNPNSKSCQSND

SEQ ID NO: 2744256 - protein, 7 aa, Entamoeba invadens
GLCEPNT

SEQ ID NO: 2744257 - protein, 11 aa, Entamoeba invadens
GMRKPSDDGLS

SEQ ID NO: 2744258 - protein, 6 aa, Entamoeba invadens
GNCEKV

SEQ ID NO: 2744259 - protein, 14 aa, Entamoeba invadens
GNCTSCNTTGDEQN

SEQ ID NO: 2744260 - protein, 11 aa, Entamoeba invadens
GNCTTCNSATG

SEQ ID NO: 2744261 - protein, 15 aa, Entamoeba invadens
GNDEYKKSESVAKKC

SEQ ID NO: 2744262 - protein, 7 aa, Entamoeba invadens
GNGNTTF

SEQ ID NO: 2744263 - protein, 4 aa, Entamoeba invadens
GNGR

SEQ ID NO: 2744264 - protein, 4 aa, Entamoeba invadens
GNGY

SEQ ID NO: 2744265 - protein, 9 aa, Entamoeba invadens
GNKNKATLI

SEQ ID NO: 2744266 - protein, 6 aa, Entamoeba invadens
GNKTEG

SEQ ID NO: 2744267 - protein, 8 aa, Entamoeba invadens
GNNSAIST

SEQ ID NO: 2744268 - protein, 5 aa, Entamoeba invadens
GNSKI

SEQ ID NO: 2744269 - protein, 4 aa, Entamoeba invadens
GNTI

SEQ ID NO: 2744270 - protein, 4 aa, Entamoeba invadens
GNTV

SEQ ID NO: 2744271 - protein, 8 aa, Entamoeba invadens
GNYLNENN

SEQ ID NO: 2744272 - protein, 9 aa, Entamoeba invadens
GPTPNDLTH

SEQ ID NO: 2744273 - protein, 4 aa, Entamoeba invadens
GQCL

SEQ ID NO: 2744274 - protein, 6 aa, Entamoeba invadens
GQIPST

SEQ ID NO: 2744275 - protein, 10 aa, Entamoeba invadens
GQKYKKPADV

SEQ ID NO: 2744276 - protein, 9 aa, Entamoeba invadens
GQPDELKKT

SEQ ID NO: 2744277 - protein, 5 aa, Entamoeba invadens
GRCKP

SEQ ID NO: 2744278 - protein, 5 aa, Entamoeba invadens
GRPRP

SEQ ID NO: 2744279 - protein, 5 aa, Entamoeba invadens
GRTCK

SEQ ID NO: 2744280 - protein, 9 aa, Entamoeba invadens
GRTGAGKSS

SEQ ID NO: 2744281 - protein, 10 aa, Entamoeba invadens
GRTGSGKSTM

SEQ ID NO: 2744282 - protein, 7 aa, Entamoeba invadens
GRYNTEN

SEQ ID NO: 2744283 - protein, 11 aa, Entamoeba invadens
GSCDEETKSKC

SEQ ID NO: 2744284 - protein, 11 aa, Entamoeba invadens
GSGELNDKQNG

SEQ ID NO: 2744285 - protein, 6 aa, Entamoeba invadens
GSNPTG

SEQ ID NO: 2744286 - protein, 8 aa, Entamoeba invadens
GSNVSDNC

SEQ ID NO: 2744287 - protein, 7 aa, Entamoeba invadens
GSRLSEG

SEQ ID NO: 2744288 - protein, 35 aa, Entamoeba invadens
GSSKKEPSKLSKYELSPTSLDFGNDEKATDIGDTR

SEQ ID NO: 2744289 - protein, 9 aa, Entamoeba invadens
GSVSDSTVN

SEQ ID NO: 2744290 - protein, 8 aa, Entamoeba invadens
GSVTSDNN

SEQ ID NO: 2744291 - protein, 20 aa, Entamoeba invadens
GSYGRMDPELGGEKQFEATG

SEQ ID NO: 2744292 - protein, 5 aa, Entamoeba invadens
GTCNN

SEQ ID NO: 2744293 - protein, 4 aa, Entamoeba invadens
GTCV

SEQ ID NO: 2744294 - protein, 4 aa, Entamoeba invadens
GTDV

SEQ ID NO: 2744295 - protein, 9 aa, Entamoeba invadens
GTDVAKQAS

SEQ ID NO: 2744296 - protein, 5 aa, Entamoeba invadens
GTDYP

SEQ ID NO: 2744297 - protein, 9 aa, Entamoeba invadens
GTIKPKEQV

SEQ ID NO: 2744298 - protein, 9 aa, Entamoeba invadens
GTKATHLKS

SEQ ID NO: 2744299 - protein, 7 aa, Entamoeba invadens
GTKSNRI

SEQ ID NO: 2744300 - protein, 8 aa, Entamoeba invadens
GTKSNSIT

SEQ ID NO: 2744301 - protein, 6 aa, Entamoeba invadens
GTQPNT

SEQ ID NO: 2744302 - protein, 22 aa, Entamoeba invadens
GTRSCVSEGTTDNCDQMSKAND

SEQ ID NO: 2744303 - protein, 4 aa, Entamoeba invadens
GTSF

SEQ ID NO: 2744304 - protein, 4 aa, Entamoeba invadens
GTSQ

SEQ ID NO: 2744305 - protein, 6 aa, Entamoeba invadens
GTSRFT

SEQ ID NO: 2744306 - protein, 22 aa, Entamoeba invadens
GTSRFTKKSINNSDDKGLGTPI

SEQ ID NO: 2744307 - protein, 23 aa, Entamoeba invadens
GTSRFTKKTLKKNNEDKGLGTPI

SEQ ID NO: 2744308 - protein, 8 aa, Entamoeba invadens
GTTNQTST

SEQ ID NO: 2744309 - protein, 5 aa, Entamoeba invadens
GTYRG

SEQ ID NO: 2744310 - protein, 13 aa, Entamoeba invadens
GTYSEQNATSCTS

SEQ ID NO: 2744311 - protein, 12 aa, Entamoeba invadens
GTYSISQSTYCT

SEQ ID NO: 2744312 - protein, 6 aa, Entamoeba invadens
GTYSYG

SEQ ID NO: 2744313 - protein, 5 aa, Entamoeba invadens
GVCEQ

SEQ ID NO: 2744314 - protein, 6 aa, Entamoeba invadens
GVCTSN

SEQ ID NO: 2744315 - protein, 9 aa, Entamoeba invadens
GVDDNGQCQ

SEQ ID NO: 2744316 - protein, 12 aa, Entamoeba invadens
GVENDKEKTVDL

SEQ ID NO: 2744317 - protein, 7 aa, Entamoeba invadens
GVGTPKY

SEQ ID NO: 2744318 - protein, 9 aa, Entamoeba invadens
GVLDENEDC

SEQ ID NO: 2744319 - protein, 10 aa, Entamoeba invadens
GVLKSAQDAF

SEQ ID NO: 2744320 - protein, 17 aa, Entamoeba invadens
GVTESKCQMRDNKGCQR

SEQ ID NO: 2744321 - protein, 6 aa, Entamoeba invadens
GVTLNK

SEQ ID NO: 2744322 - protein, 12 aa, Entamoeba invadens
GVYNKTSKMCED

SEQ ID NO: 2744323 - protein, 10 aa, Entamoeba invadens
GYELNSDKEC

SEQ ID NO: 2744324 - protein, 11 aa, Entamoeba invadens
GYKFETNKTTL

SEQ ID NO: 2744325 - protein, 4 aa, Entamoeba invadens
GYSK

SEQ ID NO: 2744326 - protein, 7 aa, Entamoeba invadens
GYYREQS

SEQ ID NO: 2744327 - protein, 8 aa, Entamoeba invadens
GYYRSGNG

SEQ ID NO: 2744328 - protein, 5 aa, Entamoeba invadens
GYYTT

SEQ ID NO: 2744329 - protein, 10 aa, Entamoeba invadens
HEKKLEKTTT

SEQ ID NO: 2744330 - protein, 9 aa, Entamoeba invadens
HEPKSIGGV

SEQ ID NO: 2744331 - protein, 12 aa, Entamoeba invadens
HFNSKDDNPNCE

SEQ ID NO: 2744332 - protein, 11 aa, Entamoeba invadens
HGGSKNTSAGT

SEQ ID NO: 2744333 - protein, 8 aa, Entamoeba invadens
HKKEQEKG

SEQ ID NO: 2744334 - protein, 8 aa, Entamoeba invadens
HKNTEEKT

SEQ ID NO: 2744335 - protein, 26 aa, Entamoeba invadens
HKQKTTKNEIQEDDEFSSESATIGNN

SEQ ID NO: 2744336 - protein, 5 aa, Entamoeba invadens
HKQQM

SEQ ID NO: 2744337 - protein, 8 aa, Entamoeba invadens
HKSSSEID

SEQ ID NO: 2744338 - protein, 7 aa, Entamoeba invadens
HKTSDEV

SEQ ID NO: 2744339 - protein, 6 aa, Entamoeba invadens
HNEGSS

SEQ ID NO: 2744340 - protein, 34 aa, Entamoeba invadens
HNEYDSHTHHGGKEECSKCEDEAGKGDIKSKEHR

SEQ ID NO: 2744341 - protein, 10 aa, Entamoeba invadens
HNSTLNSTKF

SEQ ID NO: 2744342 - protein, 11 aa, Entamoeba invadens
HPEEKRPSSVS

SEQ ID NO: 2744343 - protein, 9 aa, Entamoeba invadens
HQKVEKGNS

SEQ ID NO: 2744344 - protein, 8 aa, Entamoeba invadens
HSGKQNTT

SEQ ID NO: 2744345 - protein, 5 aa, Entamoeba invadens
HSKNT

SEQ ID NO: 2744346 - protein, 4 aa, Entamoeba invadens
HSPV

SEQ ID NO: 2744347 - protein, 5 aa, Entamoeba invadens
HTAKI

SEQ ID NO: 2744348 - protein, 9 aa, Entamoeba invadens
HVDNSNDEI

SEQ ID NO: 2744349 - protein, 9 aa, Entamoeba invadens
HYSNENQTC

SEQ ID NO: 2744350 - protein, 8 aa, Entamoeba invadens
IATSNGKC

SEQ ID NO: 2744351 - protein, 16 aa, Entamoeba invadens
IDFGDTRPEINEPVTT

SEQ ID NO: 2744352 - protein, 9 aa, Entamoeba invadens
IDRPDQGYT

SEQ ID NO: 2744353 - protein, 5 aa, Entamoeba invadens
IDTTT

SEQ ID NO: 2744354 - protein, 4 aa, Entamoeba invadens
IDVD

SEQ ID NO: 2744355 - protein, 5 aa, Entamoeba invadens
IEESE

SEQ ID NO: 2744356 - protein, 5 aa, Entamoeba invadens
IEGSS

SEQ ID NO: 2744357 - protein, 6 aa, Entamoeba invadens
IEGSTI

SEQ ID NO: 2744358 - protein, 9 aa, Entamoeba invadens
IENPTGNTN

SEQ ID NO: 2744359 - protein, 14 aa, Entamoeba invadens
IEPKSATLKPSTAI

SEQ ID NO: 2744360 - protein, 6 aa, Entamoeba invadens
IEPKTS

SEQ ID NO: 2744361 - protein, 7 aa, Entamoeba invadens
IERSSKG

SEQ ID NO: 2744362 - protein, 6 aa, Entamoeba invadens
IESGSH

SEQ ID NO: 2744363 - protein, 11 aa, Entamoeba invadens
IESQTDQQVPF

SEQ ID NO: 2744364 - protein, 9 aa, Entamoeba invadens
IETEQTTKL

SEQ ID NO: 2744365 - protein, 4 aa, Entamoeba invadens
IETP

SEQ ID NO: 2744366 - protein, 5 aa, Entamoeba invadens
IGEGA

SEQ ID NO: 2744367 - protein, 7 aa, Entamoeba invadens
IGEGSFG

SEQ ID NO: 2744368 - protein, 10 aa, Entamoeba invadens
IGGQSGKNKC

SEQ ID NO: 2744369 - protein, 9 aa, Entamoeba invadens
IGRGGNGTV

SEQ ID NO: 2744370 - protein, 8 aa, Entamoeba invadens
IGRGKNAG

SEQ ID NO: 2744371 - protein, 6 aa, Entamoeba invadens
IGSNTS

SEQ ID NO: 2744372 - protein, 11 aa, Entamoeba invadens
IKCSENNASEV

SEQ ID NO: 2744373 - protein, 7 aa, Entamoeba invadens
IKKELDD

SEQ ID NO: 2744374 - protein, 7 aa, Entamoeba invadens
IKNNTTS

SEQ ID NO: 2744375 - protein, 4 aa, Entamoeba invadens
IKTS

SEQ ID NO: 2744376 - protein, 14 aa, Entamoeba invadens
INCDNYDSTCNKCE

SEQ ID NO: 2744377 - protein, 11 aa, Entamoeba invadens
INNTGAIAAAT

SEQ ID NO: 2744378 - protein, 6 aa, Entamoeba invadens
INPNSV

SEQ ID NO: 2744379 - protein, 4 aa, Entamoeba invadens
INTA

SEQ ID NO: 2744380 - protein, 11 aa, Entamoeba invadens
INTEDDSQKIE

SEQ ID NO: 2744381 - protein, 5 aa, Entamoeba invadens
INTND

SEQ ID NO: 2744382 - protein, 6 aa, Entamoeba invadens
IPESAF

SEQ ID NO: 2744383 - protein, 8 aa, Entamoeba invadens
IPKDCKNN

SEQ ID NO: 2744384 - protein, 11 aa, Entamoeba invadens
IPNDENGRCEN

SEQ ID NO: 2744385 - protein, 15 aa, Entamoeba invadens
IPPSAGSGVYESTTD

SEQ ID NO: 2744386 - protein, 7 aa, Entamoeba invadens
IPPTSEP

SEQ ID NO: 2744387 - protein, 13 aa, Entamoeba invadens
IPSEGKLCESNTT

SEQ ID NO: 2744388 - protein, 15 aa, Entamoeba invadens
IPSEGKLCESNTTLT

SEQ ID NO: 2744389 - protein, 14 aa, Entamoeba invadens
IPSEGKLCQPNTTL

SEQ ID NO: 2744390 - protein, 4 aa, Entamoeba invadens
IPSQ

SEQ ID NO: 2744391 - protein, 5 aa, Entamoeba invadens
IPTTN

SEQ ID NO: 2744392 - protein, 8 aa, Entamoeba invadens
IPVEQSTR

SEQ ID NO: 2744393 - protein, 6 aa, Entamoeba invadens
IQLNGS

SEQ ID NO: 2744394 - protein, 7 aa, Entamoeba invadens
IQYTGSD

SEQ ID NO: 2744395 - protein, 10 aa, Entamoeba invadens
IRNTNDIYNN

SEQ ID NO: 2744396 - protein, 11 aa, Entamoeba invadens
IRSSNGQEQFK

SEQ ID NO: 2744397 - protein, 12 aa, Entamoeba invadens
IRYNTGSSSSQW

SEQ ID NO: 2744398 - protein, 4 aa, Entamoeba invadens
ISAT

SEQ ID NO: 2744399 - protein, 4 aa, Entamoeba invadens
ISEI

SEQ ID NO: 2744400 - protein, 4 aa, Entamoeba invadens
ISES

SEQ ID NO: 2744401 - protein, 7 aa, Entamoeba invadens
ISGKGGD

SEQ ID NO: 2744402 - protein, 26 aa, Entamoeba invadens
ISGKTEISTRLDPDELKEEKKLGEGS

SEQ ID NO: 2744403 - protein, 15 aa, Entamoeba invadens
ISKNPLNNDTISTQR

SEQ ID NO: 2744404 - protein, 6 aa, Entamoeba invadens
ISQNPL

SEQ ID NO: 2744405 - protein, 9 aa, Entamoeba invadens
ISRKDQMTL

SEQ ID NO: 2744406 - protein, 11 aa, Entamoeba invadens
ISRKNREIKYD

SEQ ID NO: 2744407 - protein, 11 aa, Entamoeba invadens
ISSKSDEESYQ

SEQ ID NO: 2744408 - protein, 4 aa, Entamoeba invadens
ISSN

SEQ ID NO: 2744409 - protein, 4 aa, Entamoeba invadens
ISTD

SEQ ID NO: 2744410 - protein, 6 aa, Entamoeba invadens
ISTGTS

SEQ ID NO: 2744411 - protein, 11 aa, Entamoeba invadens
ITATGNSSLTF

SEQ ID NO: 2744412 - protein, 4 aa, Entamoeba invadens
ITAV

SEQ ID NO: 2744413 - protein, 8 aa, Entamoeba invadens
ITEGNGNC

SEQ ID NO: 2744414 - protein, 14 aa, Entamoeba invadens
ITKTIDKKEEVPNP

SEQ ID NO: 2744415 - protein, 4 aa, Entamoeba invadens
ITNG

SEQ ID NO: 2744416 - protein, 9 aa, Entamoeba invadens
ITSDSQTQT

SEQ ID NO: 2744417 - protein, 11 aa, Entamoeba invadens
ITSTASKSEYA

SEQ ID NO: 2744418 - protein, 6 aa, Entamoeba invadens
ITTETS

SEQ ID NO: 2744419 - protein, 10 aa, Entamoeba invadens
ITTKSENVTK

SEQ ID NO: 2744420 - protein, 4 aa, Entamoeba invadens
ITTN

SEQ ID NO: 2744421 - protein, 21 aa, Entamoeba invadens
IVEDAKESAESGKPTNKQSPI

SEQ ID NO: 2744422 - protein, 6 aa, Entamoeba invadens
IVESQS

SEQ ID NO: 2744423 - protein, 12 aa, Entamoeba invadens
IYKGDQKVATDE

SEQ ID NO: 2744424 - protein, 6 aa, Entamoeba invadens
KAEASV

SEQ ID NO: 2744425 - protein, 15 aa, Entamoeba invadens
KAETEMSTRLDPDEL

SEQ ID NO: 2744426 - protein, 9 aa, Entamoeba invadens
KAFKGATKL

SEQ ID NO: 2744427 - protein, 11 aa, Entamoeba invadens
KAQTENSTRLD

SEQ ID NO: 2744428 - protein, 9 aa, Entamoeba invadens
KASNTPCNS

SEQ ID NO: 2744429 - protein, 8 aa, Entamoeba invadens
KATLDGDN

SEQ ID NO: 2744430 - protein, 9 aa, Entamoeba invadens
KATMNTSTQ

SEQ ID NO: 2744431 - protein, 10 aa, Entamoeba invadens
KATNCESNRQ

SEQ ID NO: 2744432 - protein, 6 aa, Entamoeba invadens
KCADSN

SEQ ID NO: 2744433 - protein, 11 aa, Entamoeba invadens
KCATPNEKTPK

SEQ ID NO: 2744434 - protein, 5 aa, Entamoeba invadens
KCDET

SEQ ID NO: 2744435 - protein, 5 aa, Entamoeba invadens
KCDTG

SEQ ID NO: 2744436 - protein, 4 aa, Entamoeba invadens
KCED

SEQ ID NO: 2744437 - protein, 4 aa, Entamoeba invadens
KCEE

SEQ ID NO: 2744438 - protein, 5 aa, Entamoeba invadens
KCEEI

SEQ ID NO: 2744439 - protein, 7 aa, Entamoeba invadens
KCKECSQ

SEQ ID NO: 2744440 - protein, 9 aa, Entamoeba invadens
KCKSGQCST

SEQ ID NO: 2744441 - protein, 5 aa, Entamoeba invadens
KCMTS

SEQ ID NO: 2744442 - protein, 8 aa, Entamoeba invadens
KCNKCTNG

SEQ ID NO: 2744443 - protein, 11 aa, Entamoeba invadens
KCNKNGESNCI

SEQ ID NO: 2744444 - protein, 6 aa, Entamoeba invadens
KCPEGY

SEQ ID NO: 2744445 - protein, 14 aa, Entamoeba invadens
KCPEGYMTDKTNNK

SEQ ID NO: 2744446 - protein, 7 aa, Entamoeba invadens
KCQQTAP

SEQ ID NO: 2744447 - protein, 11 aa, Entamoeba invadens
KCSESTRCTSC

SEQ ID NO: 2744448 - protein, 17 aa, Entamoeba invadens
KCSQGKEKCDKCESPKL

SEQ ID NO: 2744449 - protein, 8 aa, Entamoeba invadens
KCSSCEED

SEQ ID NO: 2744450 - protein, 7 aa, Entamoeba invadens
KCSSSSL

SEQ ID NO: 2744451 - protein, 5 aa, Entamoeba invadens
KCTAC

SEQ ID NO: 2744452 - protein, 7 aa, Entamoeba invadens
KCTECPD

SEQ ID NO: 2744453 - protein, 11 aa, Entamoeba invadens
KCTENTKCTEC

SEQ ID NO: 2744454 - protein, 7 aa, Entamoeba invadens
KCTSNNT

SEQ ID NO: 2744455 - protein, 5 aa, Entamoeba invadens
KCVDT

SEQ ID NO: 2744456 - protein, 7 aa, Entamoeba invadens
KCVKGNC

SEQ ID NO: 2744457 - protein, 8 aa, Entamoeba invadens
KDADGNLS

SEQ ID NO: 2744458 - protein, 8 aa, Entamoeba invadens
KDAKDGEI

SEQ ID NO: 2744459 - protein, 8 aa, Entamoeba invadens
KDDQTNSI

SEQ ID NO: 2744460 - protein, 13 aa, Entamoeba invadens
KDDSSGEIPPSPK

SEQ ID NO: 2744461 - protein, 8 aa, Entamoeba invadens
KDDTQNLI

SEQ ID NO: 2744462 - protein, 9 aa, Entamoeba invadens
KDEKCKTCG

SEQ ID NO: 2744463 - protein, 15 aa, Entamoeba invadens
KDENGDEQCSISESS

SEQ ID NO: 2744464 - protein, 4 aa, Entamoeba invadens
KDIK

SEQ ID NO: 2744465 - protein, 9 aa, Entamoeba invadens
KDKDPSNKN

SEQ ID NO: 2744466 - protein, 32 aa, Entamoeba invadens
KDKECKTPDTENYEEDTFRECSGSGSYRTKYY

SEQ ID NO: 2744467 - protein, 5 aa, Entamoeba invadens
KDKRD

SEQ ID NO: 2744468 - protein, 10 aa, Entamoeba invadens
KDKYKKPADI

SEQ ID NO: 2744469 - protein, 8 aa, Entamoeba invadens
KDLEKTTT

SEQ ID NO: 2744470 - protein, 9 aa, Entamoeba invadens
KDLGGHTTC

SEQ ID NO: 2744471 - protein, 7 aa, Entamoeba invadens
KDNAPVT

SEQ ID NO: 2744472 - protein, 9 aa, Entamoeba invadens
KDPNHSNMS

SEQ ID NO: 2744473 - protein, 6 aa, Entamoeba invadens
KDQTDQ

SEQ ID NO: 2744474 - protein, 20 aa, Entamoeba invadens
KDSDPTAGSAVASQTEVSTM

SEQ ID NO: 2744475 - protein, 9 aa, Entamoeba invadens
KDTPQITTN

SEQ ID NO: 2744476 - protein, 19 aa, Entamoeba invadens
KDTYQTPCKEGDKECETCS

SEQ ID NO: 2744477 - protein, 12 aa, Entamoeba invadens
KEANNTTSSIAE

SEQ ID NO: 2744478 - protein, 9 aa, Entamoeba invadens
KEDAPKSTG

SEQ ID NO: 2744479 - protein, 11 aa, Entamoeba invadens
KEEALSKCPQL

SEQ ID NO: 2744480 - protein, 5 aa, Entamoeba invadens
KEEKK

SEQ ID NO: 2744481 - protein, 6 aa, Entamoeba invadens
KEEKKM

SEQ ID NO: 2744482 - protein, 6 aa, Entamoeba invadens
KEGCDD

SEQ ID NO: 2744483 - protein, 7 aa, Entamoeba invadens
KEGCNDE

SEQ ID NO: 2744484 - protein, 9 aa, Entamoeba invadens
KEIKNSKCN

SEQ ID NO: 2744485 - protein, 6 aa, Entamoeba invadens
KEKDRN

SEQ ID NO: 2744486 - protein, 7 aa, Entamoeba invadens
KEKKYNL

SEQ ID NO: 2744487 - protein, 12 aa, Entamoeba invadens
KEKSDKYTIRTT

SEQ ID NO: 2744488 - protein, 8 aa, Entamoeba invadens
KEKYKKAA

SEQ ID NO: 2744489 - protein, 5 aa, Entamoeba invadens
KEKYP

SEQ ID NO: 2744490 - protein, 4 aa, Entamoeba invadens
KEMP

SEQ ID NO: 2744491 - protein, 8 aa, Entamoeba invadens
KEQEKTTT

SEQ ID NO: 2744492 - protein, 7 aa, Entamoeba invadens
KERIKEK

SEQ ID NO: 2744493 - protein, 4 aa, Entamoeba invadens
KESY

SEQ ID NO: 2744494 - protein, 7 aa, Entamoeba invadens
KETSEKE

SEQ ID NO: 2744495 - protein, 10 aa, Entamoeba invadens
KETTGNFNGR

SEQ ID NO: 2744496 - protein, 17 aa, Entamoeba invadens
KEYTKNFPDKHSTQHDN

SEQ ID NO: 2744497 - protein, 5 aa, Entamoeba invadens
KGAAN

SEQ ID NO: 2744498 - protein, 4 aa, Entamoeba invadens
KGAF

SEQ ID NO: 2744499 - protein, 13 aa, Entamoeba invadens
KGANLSGGQRQRV

SEQ ID NO: 2744500 - protein, 7 aa, Entamoeba invadens
KGAVSRT

SEQ ID NO: 2744501 - protein, 7 aa, Entamoeba invadens
KGCERCN

SEQ ID NO: 2744502 - protein, 20 aa, Entamoeba invadens
KGCSDGCSTCSGAATCTSCN

SEQ ID NO: 2744503 - protein, 5 aa, Entamoeba invadens
KGDHK

SEQ ID NO: 2744504 - protein, 9 aa, Entamoeba invadens
KGDNSQADF

SEQ ID NO: 2744505 - protein, 9 aa, Entamoeba invadens
KGGKQNTTL

SEQ ID NO: 2744506 - protein, 13 aa, Entamoeba invadens
KGITVSSSGTNAI

SEQ ID NO: 2744507 - protein, 5 aa, Entamoeba invadens
KGKGI

SEQ ID NO: 2744508 - protein, 6 aa, Entamoeba invadens
KGKTAA

SEQ ID NO: 2744509 - protein, 5 aa, Entamoeba invadens
KGKTK

SEQ ID NO: 2744510 - protein, 7 aa, Entamoeba invadens
KGKTPIK

SEQ ID NO: 2744511 - protein, 7 aa, Entamoeba invadens
KGNCDYG

SEQ ID NO: 2744512 - protein, 15 aa, Entamoeba invadens
KGNLIKGGSKCEANC

SEQ ID NO: 2744513 - protein, 7 aa, Entamoeba invadens
KGSGPYP

SEQ ID NO: 2744514 - protein, 9 aa, Entamoeba invadens
KGSSSCQTC

SEQ ID NO: 2744515 - protein, 11 aa, Entamoeba invadens
KGTWNEDSNGK

SEQ ID NO: 2744516 - protein, 9 aa, Entamoeba invadens
KGVGTPKYM

SEQ ID NO: 2744517 - protein, 9 aa, Entamoeba invadens
KGVGTPSYM

SEQ ID NO: 2744518 - protein, 8 aa, Entamoeba invadens
KGYYSKSG

SEQ ID NO: 2744519 - protein, 6 aa, Entamoeba invadens
KHTDEE

SEQ ID NO: 2744520 - protein, 8 aa, Entamoeba invadens
KIDEAKDN

SEQ ID NO: 2744521 - protein, 19 aa, Entamoeba invadens
KIDNDTFTDDTTYSGVGSL

SEQ ID NO: 2744522 - protein, 6 aa, Entamoeba invadens
KIEKTR

SEQ ID NO: 2744523 - protein, 6 aa, Entamoeba invadens
KIGEGS

SEQ ID NO: 2744524 - protein, 16 aa, Entamoeba invadens
KISQNNQPTPSQHKTS

SEQ ID NO: 2744525 - protein, 6 aa, Entamoeba invadens
KITQKG

SEQ ID NO: 2744526 - protein, 5 aa, Entamoeba invadens
KKAEE

SEQ ID NO: 2744527 - protein, 21 aa, Entamoeba invadens
KKCTTNSECPAGYTKDTANKK

SEQ ID NO: 2744528 - protein, 11 aa, Entamoeba invadens
KKCVKDKCPEN

SEQ ID NO: 2744529 - protein, 4 aa, Entamoeba invadens
KKDF

SEQ ID NO: 2744530 - protein, 7 aa, Entamoeba invadens
KKDNKQF

SEQ ID NO: 2744531 - protein, 9 aa, Entamoeba invadens
KKEHNSKCS

SEQ ID NO: 2744532 - protein, 14 aa, Entamoeba invadens
KKEIKNDDDDEFTK

SEQ ID NO: 2744533 - protein, 7 aa, Entamoeba invadens
KKENPDL

SEQ ID NO: 2744534 - protein, 7 aa, Entamoeba invadens
KKENPNL

SEQ ID NO: 2744535 - protein, 7 aa, Entamoeba invadens
KKEQEKT

SEQ ID NO: 2744536 - protein, 9 aa, Entamoeba invadens
KKEVEKTTT

SEQ ID NO: 2744537 - protein, 6 aa, Entamoeba invadens
KKEVTA

SEQ ID NO: 2744538 - protein, 8 aa, Entamoeba invadens
KKGADCAQ

SEQ ID NO: 2744539 - protein, 8 aa, Entamoeba invadens
KKGTPEMN

SEQ ID NO: 2744540 - protein, 7 aa, Entamoeba invadens
KKIGEGT

SEQ ID NO: 2744541 - protein, 8 aa, Entamoeba invadens
KKIGEGTF

SEQ ID NO: 2744542 - protein, 13 aa, Entamoeba invadens
KKIQKEEEQEEEI

SEQ ID NO: 2744543 - protein, 9 aa, Entamoeba invadens
KKKEEELNN

SEQ ID NO: 2744544 - protein, 5 aa, Entamoeba invadens
KKKGV

SEQ ID NO: 2744545 - protein, 7 aa, Entamoeba invadens
KKKTIEG

SEQ ID NO: 2744546 - protein, 9 aa, Entamoeba invadens
KKKYKKPAD

SEQ ID NO: 2744547 - protein, 5 aa, Entamoeba invadens
KKLDK

SEQ ID NO: 2744548 - protein, 8 aa, Entamoeba invadens
KKNEQIPP

SEQ ID NO: 2744549 - protein, 4 aa, Entamoeba invadens
KKNY

SEQ ID NO: 2744550 - protein, 5 aa, Entamoeba invadens
KKPAD

SEQ ID NO: 2744551 - protein, 6 aa, Entamoeba invadens
KKPADI

SEQ ID NO: 2744552 - protein, 7 aa, Entamoeba invadens
KKPYNPV

SEQ ID NO: 2744553 - protein, 4 aa, Entamoeba invadens
KKQN

SEQ ID NO: 2744554 - protein, 9 aa, Entamoeba invadens
KKREQSPRM

SEQ ID NO: 2744555 - protein, 5 aa, Entamoeba invadens
KKSAD

SEQ ID NO: 2744556 - protein, 7 aa, Entamoeba invadens
KKSDDID

SEQ ID NO: 2744557 - protein, 9 aa, Entamoeba invadens
KKSDEISNK

SEQ ID NO: 2744558 - protein, 9 aa, Entamoeba invadens
KKSEEVETK

SEQ ID NO: 2744559 - protein, 6 aa, Entamoeba invadens
KKSKCT

SEQ ID NO: 2744560 - protein, 6 aa, Entamoeba invadens
KKSKSG

SEQ ID NO: 2744561 - protein, 5 aa, Entamoeba invadens
KKTNF

SEQ ID NO: 2744562 - protein, 4 aa, Entamoeba invadens
KKVD

SEQ ID NO: 2744563 - protein, 9 aa, Entamoeba invadens
KKYKKPADV

SEQ ID NO: 2744564 - protein, 6 aa, Entamoeba invadens
KKYSRE

SEQ ID NO: 2744565 - protein, 8 aa, Entamoeba invadens
KKYTKSAD

SEQ ID NO: 2744566 - protein, 12 aa, Entamoeba invadens
KLQNSKEGKGFT

SEQ ID NO: 2744567 - protein, 7 aa, Entamoeba invadens
KMTQTSN

SEQ ID NO: 2744568 - protein, 4 aa, Entamoeba invadens
KNAE

SEQ ID NO: 2744569 - protein, 13 aa, Entamoeba invadens
KNAQATKSAIEEF

SEQ ID NO: 2744570 - protein, 12 aa, Entamoeba invadens
KNCEKCDTNATT

SEQ ID NO: 2744571 - protein, 5 aa, Entamoeba invadens
KNESP

SEQ ID NO: 2744572 - protein, 4 aa, Entamoeba invadens
KNGI

SEQ ID NO: 2744573 - protein, 4 aa, Entamoeba invadens
KNGM

SEQ ID NO: 2744574 - protein, 7 aa, Entamoeba invadens
KNMRNDI

SEQ ID NO: 2744575 - protein, 4 aa, Entamoeba invadens
KNNT

SEQ ID NO: 2744576 - protein, 5 aa, Entamoeba invadens
KNNVD

SEQ ID NO: 2744577 - protein, 5 aa, Entamoeba invadens
KNNVN

SEQ ID NO: 2744578 - protein, 8 aa, Entamoeba invadens
KNPDEGTF

SEQ ID NO: 2744579 - protein, 17 aa, Entamoeba invadens
KNPHDPTTTKISDFGTS

SEQ ID NO: 2744580 - protein, 5 aa, Entamoeba invadens
KNPNC

SEQ ID NO: 2744581 - protein, 9 aa, Entamoeba invadens
KNPSNGTVS

SEQ ID NO: 2744582 - protein, 8 aa, Entamoeba invadens
KNSGNATA

SEQ ID NO: 2744583 - protein, 16 aa, Entamoeba invadens
KNSKVNAKLTDFGSAR

SEQ ID NO: 2744584 - protein, 6 aa, Entamoeba invadens
KNSQIT

SEQ ID NO: 2744585 - protein, 14 aa, Entamoeba invadens
KNTCKKCKSECTKC

SEQ ID NO: 2744586 - protein, 4 aa, Entamoeba invadens
KNTF

SEQ ID NO: 2744587 - protein, 8 aa, Entamoeba invadens
KNTKRSIR

SEQ ID NO: 2744588 - protein, 12 aa, Entamoeba invadens
KNTNCADGDTID

SEQ ID NO: 2744589 - protein, 5 aa, Entamoeba invadens
KNYSK

SEQ ID NO: 2744590 - protein, 4 aa, Entamoeba invadens
KPEF

SEQ ID NO: 2744591 - protein, 6 aa, Entamoeba invadens
KPHNKK

SEQ ID NO: 2744592 - protein, 5 aa, Entamoeba invadens
KPIQC

SEQ ID NO: 2744593 - protein, 6 aa, Entamoeba invadens
KPKNCS

SEQ ID NO: 2744594 - protein, 10 aa, Entamoeba invadens
KPLEDKVNKY

SEQ ID NO: 2744595 - protein, 6 aa, Entamoeba invadens
KPSNGF

SEQ ID NO: 2744596 - protein, 5 aa, Entamoeba invadens
KQDQT

SEQ ID NO: 2744597 - protein, 15 aa, Entamoeba invadens
KQEEGKSKPVGYGTS

SEQ ID NO: 2744598 - protein, 5 aa, Entamoeba invadens
KQFNS

SEQ ID NO: 2744599 - protein, 8 aa, Entamoeba invadens
KQKKDRER

SEQ ID NO: 2744600 - protein, 9 aa, Entamoeba invadens
KQNPKERTT

SEQ ID NO: 2744601 - protein, 7 aa, Entamoeba invadens
KQNPNER

SEQ ID NO: 2744602 - protein, 10 aa, Entamoeba invadens
KQQEEKEAQL

SEQ ID NO: 2744603 - protein, 7 aa, Entamoeba invadens
KQSTRLD

SEQ ID NO: 2744604 - protein, 9 aa, Entamoeba invadens
KQTDSNDLT

SEQ ID NO: 2744605 - protein, 13 aa, Entamoeba invadens
KQTNTFKENDVNC

SEQ ID NO: 2744606 - protein, 4 aa, Entamoeba invadens
KQYG

SEQ ID NO: 2744607 - protein, 8 aa, Entamoeba invadens
KRFARPNN

SEQ ID NO: 2744608 - protein, 6 aa, Entamoeba invadens
KRGESH

SEQ ID NO: 2744609 - protein, 7 aa, Entamoeba invadens
KRNSVLN

SEQ ID NO: 2744610 - protein, 7 aa, Entamoeba invadens
KRSDEVN

SEQ ID NO: 2744611 - protein, 7 aa, Entamoeba invadens
KRSEYGC

SEQ ID NO: 2744612 - protein, 16 aa, Entamoeba invadens
KRTIGKGQDKGLGTPI

SEQ ID NO: 2744613 - protein, 10 aa, Entamoeba invadens
KRVSEEFRSN

SEQ ID NO: 2744614 - protein, 9 aa, Entamoeba invadens
KRYSAKNNK

SEQ ID NO: 2744615 - protein, 18 aa, Entamoeba invadens
KSAQNCNGPSNLSPASCD

SEQ ID NO: 2744616 - protein, 19 aa, Entamoeba invadens
KSDLETQRSVSKEEGENIA

SEQ ID NO: 2744617 - protein, 7 aa, Entamoeba invadens
KSDQTKF

SEQ ID NO: 2744618 - protein, 9 aa, Entamoeba invadens
KSDTNPKTC

SEQ ID NO: 2744619 - protein, 8 aa, Entamoeba invadens
KSETTTDN

SEQ ID NO: 2744620 - protein, 10 aa, Entamoeba invadens
KSGSCTKCSK

SEQ ID NO: 2744621 - protein, 8 aa, Entamoeba invadens
KSGYGGDD

SEQ ID NO: 2744622 - protein, 7 aa, Entamoeba invadens
KSIGGGA

SEQ ID NO: 2744623 - protein, 5 aa, Entamoeba invadens
KSKGI

SEQ ID NO: 2744624 - protein, 5 aa, Entamoeba invadens
KSKHH

SEQ ID NO: 2744625 - protein, 8 aa, Entamoeba invadens
KSLTEAAN

SEQ ID NO: 2744626 - protein, 11 aa, Entamoeba invadens
KSMEPSLAGTA

SEQ ID NO: 2744627 - protein, 4 aa, Entamoeba invadens
KSPN

SEQ ID NO: 2744628 - protein, 6 aa, Entamoeba invadens
KSTLSS

SEQ ID NO: 2744629 - protein, 4 aa, Entamoeba invadens
KSVK

SEQ ID NO: 2744630 - protein, 9 aa, Entamoeba invadens
KSVKAETAA

SEQ ID NO: 2744631 - protein, 12 aa, Entamoeba invadens
KTCKDSNTCETC

SEQ ID NO: 2744632 - protein, 17 aa, Entamoeba invadens
KTCSGGTQSSCTSCDSG

SEQ ID NO: 2744633 - protein, 7 aa, Entamoeba invadens
KTCSNDG

SEQ ID NO: 2744634 - protein, 6 aa, Entamoeba invadens
KTCSPS

SEQ ID NO: 2744635 - protein, 14 aa, Entamoeba invadens
KTCTEETKCTACKD

SEQ ID NO: 2744636 - protein, 4 aa, Entamoeba invadens
KTDI

SEQ ID NO: 2744637 - protein, 43 aa, Entamoeba invadens
KTDTKQTPSPTQPLADTKDTDNKDIQTNENGVHKDDEIDEEEI

SEQ ID NO: 2744638 - protein, 13 aa, Entamoeba invadens
KTEISTKLDPDEL

SEQ ID NO: 2744639 - protein, 6 aa, Entamoeba invadens
KTEMTT

SEQ ID NO: 2744640 - protein, 4 aa, Entamoeba invadens
KTET

SEQ ID NO: 2744641 - protein, 8 aa, Entamoeba invadens
KTGDQNSM

SEQ ID NO: 2744642 - protein, 35 aa, Entamoeba invadens
KTGLGGEHSDEQEDHKEEKDVKPKDEVKQETKEEK

SEQ ID NO: 2744643 - protein, 5 aa, Entamoeba invadens
KTKEL

SEQ ID NO: 2744644 - protein, 6 aa, Entamoeba invadens
KTKGTE

SEQ ID NO: 2744645 - protein, 7 aa, Entamoeba invadens
KTKNKAV

SEQ ID NO: 2744646 - protein, 9 aa, Entamoeba invadens
KTKTSGSNV

SEQ ID NO: 2744647 - protein, 4 aa, Entamoeba invadens
KTNF

SEQ ID NO: 2744648 - protein, 4 aa, Entamoeba invadens
KTNG

SEQ ID NO: 2744649 - protein, 5 aa, Entamoeba invadens
KTQFG

SEQ ID NO: 2744650 - protein, 7 aa, Entamoeba invadens
KTQQNIT

SEQ ID NO: 2744651 - protein, 8 aa, Entamoeba invadens
KTRKSPIQ

SEQ ID NO: 2744652 - protein, 7 aa, Entamoeba invadens
KTSDEVN

SEQ ID NO: 2744653 - protein, 11 aa, Entamoeba invadens
KTSDTCEKCTS

SEQ ID NO: 2744654 - protein, 6 aa, Entamoeba invadens
KTSEEI

SEQ ID NO: 2744655 - protein, 25 aa, Entamoeba invadens
KTSGDYKCQSCSSTCGGACDGSNGI

SEQ ID NO: 2744656 - protein, 12 aa, Entamoeba invadens
KTTEKAEDGVTD

SEQ ID NO: 2744657 - protein, 9 aa, Entamoeba invadens
KTTQKCGDF

SEQ ID NO: 2744658 - protein, 13 aa, Entamoeba invadens
KTTQNGCSKCSDG

SEQ ID NO: 2744659 - protein, 7 aa, Entamoeba invadens
KTTSGDF

SEQ ID NO: 2744660 - protein, 6 aa, Entamoeba invadens
KTYTSG

SEQ ID NO: 2744661 - protein, 13 aa, Entamoeba invadens
KVNAKLTDFGSAR

SEQ ID NO: 2744662 - protein, 10 aa, Entamoeba invadens
KVNETKTSVY

SEQ ID NO: 2744663 - protein, 7 aa, Entamoeba invadens
KVSLKNN

SEQ ID NO: 2744664 - protein, 6 aa, Entamoeba invadens
KVSSNG

SEQ ID NO: 2744665 - protein, 10 aa, Entamoeba invadens
KWQGGTAQIG

SEQ ID NO: 2744666 - protein, 4 aa, Entamoeba invadens
KYEG

SEQ ID NO: 2744667 - protein, 4 aa, Entamoeba invadens
KYFD

SEQ ID NO: 2744668 - protein, 6 aa, Entamoeba invadens
KYIDES

SEQ ID NO: 2744669 - protein, 4 aa, Entamoeba invadens
KYIS

SEQ ID NO: 2744670 - protein, 4 aa, Entamoeba invadens
KYKM

SEQ ID NO: 2744671 - protein, 6 aa, Entamoeba invadens
KYKMPS

SEQ ID NO: 2744672 - protein, 7 aa, Entamoeba invadens
KYLNENN

SEQ ID NO: 2744673 - protein, 12 aa, Entamoeba invadens
KYNATGKECSSC

SEQ ID NO: 2744674 - protein, 8 aa, Entamoeba invadens
KYNESTGR

SEQ ID NO: 2744675 - protein, 10 aa, Entamoeba invadens
KYQKSEKGVS

SEQ ID NO: 2744676 - protein, 7 aa, Entamoeba invadens
KYQKTMN

SEQ ID NO: 2744677 - protein, 4 aa, Entamoeba invadens
KYRG

SEQ ID NO: 2744678 - protein, 7 aa, Entamoeba invadens
KYRGNEV

SEQ ID NO: 2744679 - protein, 7 aa, Entamoeba invadens
KYRGNTV

SEQ ID NO: 2744680 - protein, 10 aa, Entamoeba invadens
KYRPASNGTC

SEQ ID NO: 2744681 - protein, 5 aa, Entamoeba invadens
KYSND

SEQ ID NO: 2744682 - protein, 7 aa, Entamoeba invadens
KYSYDGD

SEQ ID NO: 2744683 - protein, 12 aa, Entamoeba invadens
KYTRNNQDDHCV

SEQ ID NO: 2744684 - protein, 8 aa, Entamoeba invadens
KYYPNEYN

SEQ ID NO: 2744685 - protein, 4 aa, Entamoeba invadens
LASQ

SEQ ID NO: 2744686 - protein, 14 aa, Entamoeba invadens
LCSDDTNCASIKNN

SEQ ID NO: 2744687 - protein, 4 aa, Entamoeba invadens
LDGK

SEQ ID NO: 2744688 - protein, 15 aa, Entamoeba invadens
LDNNRQYKLGSPFGG

SEQ ID NO: 2744689 - protein, 9 aa, Entamoeba invadens
LDNYESGLA

SEQ ID NO: 2744690 - protein, 6 aa, Entamoeba invadens
LDSTNH

SEQ ID NO: 2744691 - protein, 9 aa, Entamoeba invadens
LEENNRPDN

SEQ ID NO: 2744692 - protein, 4 aa, Entamoeba invadens
LEGN

SEQ ID NO: 2744693 - protein, 10 aa, Entamoeba invadens
LEKAGKGRTT

SEQ ID NO: 2744694 - protein, 5 aa, Entamoeba invadens
LEKPM

SEQ ID NO: 2744695 - protein, 10 aa, Entamoeba invadens
LEKTQGDTVI

SEQ ID NO: 2744696 - protein, 12 aa, Entamoeba invadens
LEMSSGSPTCKA

SEQ ID NO: 2744697 - protein, 4 aa, Entamoeba invadens
LENG

SEQ ID NO: 2744698 - protein, 6 aa, Entamoeba invadens
LGASND

SEQ ID NO: 2744699 - protein, 5 aa, Entamoeba invadens
LGDLK

SEQ ID NO: 2744700 - protein, 5 aa, Entamoeba invadens
LGDNK

SEQ ID NO: 2744701 - protein, 6 aa, Entamoeba invadens
LGEGSF

SEQ ID NO: 2744702 - protein, 9 aa, Entamoeba invadens
LGTKSSETA

SEQ ID NO: 2744703 - protein, 6 aa, Entamoeba invadens
LKEMDT

SEQ ID NO: 2744704 - protein, 10 aa, Entamoeba invadens
LKKGETSEVS

SEQ ID NO: 2744705 - protein, 10 aa, Entamoeba invadens
LKKRQETPTE

SEQ ID NO: 2744706 - protein, 21 aa, Entamoeba invadens
LKQRKNKKSQKKGCDSKSITV

SEQ ID NO: 2744707 - protein, 6 aa, Entamoeba invadens
LKQTES

SEQ ID NO: 2744708 - protein, 8 aa, Entamoeba invadens
LKTNDEKF

SEQ ID NO: 2744709 - protein, 4 aa, Entamoeba invadens
LKTQ

SEQ ID NO: 2744710 - protein, 6 aa, Entamoeba invadens
LKTQEE

SEQ ID NO: 2744711 - protein, 4 aa, Entamoeba invadens
LLND

SEQ ID NO: 2744712 - protein, 10 aa, Entamoeba invadens
LLPAEGTKRV

SEQ ID NO: 2744713 - protein, 9 aa, Entamoeba invadens
LLSGGQKQR

SEQ ID NO: 2744714 - protein, 7 aa, Entamoeba invadens
LLSQESK

SEQ ID NO: 2744715 - protein, 4 aa, Entamoeba invadens
LNAG

SEQ ID NO: 2744716 - protein, 6 aa, Entamoeba invadens
LNKNDT

SEQ ID NO: 2744717 - protein, 18 aa, Entamoeba invadens
LNQKTQEAIQQPIQQHSE

SEQ ID NO: 2744718 - protein, 4 aa, Entamoeba invadens
LNQP

SEQ ID NO: 2744719 - protein, 10 aa, Entamoeba invadens
LNSASIEETG

SEQ ID NO: 2744720 - protein, 4 aa, Entamoeba invadens
LNST

SEQ ID NO: 2744721 - protein, 6 aa, Entamoeba invadens
LNVEDE

SEQ ID NO: 2744722 - protein, 6 aa, Entamoeba invadens
LPGGSG

SEQ ID NO: 2744723 - protein, 6 aa, Entamoeba invadens
LPKSVT

SEQ ID NO: 2744724 - protein, 27 aa, Entamoeba invadens
LPNETTKQTTKNEDTQTDSHCEVSTTK

SEQ ID NO: 2744725 - protein, 5 aa, Entamoeba invadens
LPRAE

SEQ ID NO: 2744726 - protein, 5 aa, Entamoeba invadens
LPTNN

SEQ ID NO: 2744727 - protein, 5 aa, Entamoeba invadens
LQTNG

SEQ ID NO: 2744728 - protein, 12 aa, Entamoeba invadens
LREPTTNCTTCK

SEQ ID NO: 2744729 - protein, 9 aa, Entamoeba invadens
LSDDEMKEL

SEQ ID NO: 2744730 - protein, 10 aa, Entamoeba invadens
LSEDSTKCEL

SEQ ID NO: 2744731 - protein, 4 aa, Entamoeba invadens
LSEG

SEQ ID NO: 2744732 - protein, 6 aa, Entamoeba invadens
LSFNEN

SEQ ID NO: 2744733 - protein, 4 aa, Entamoeba invadens
LSKN

SEQ ID NO: 2744734 - protein, 8 aa, Entamoeba invadens
LSNPDKAC

SEQ ID NO: 2744735 - protein, 6 aa, Entamoeba invadens
LSQDSY

SEQ ID NO: 2744736 - protein, 8 aa, Entamoeba invadens
LSSGVDTY

SEQ ID NO: 2744737 - protein, 4 aa, Entamoeba invadens
LSTK

SEQ ID NO: 2744738 - protein, 4 aa, Entamoeba invadens
LSTP

SEQ ID NO: 2744739 - protein, 6 aa, Entamoeba invadens
LSTSNE

SEQ ID NO: 2744740 - protein, 5 aa, Entamoeba invadens
LSYEN

SEQ ID NO: 2744741 - protein, 7 aa, Entamoeba invadens
LTDFGSA

SEQ ID NO: 2744742 - protein, 11 aa, Entamoeba invadens
LTDFGSSRNVN

SEQ ID NO: 2744743 - protein, 8 aa, Entamoeba invadens
LTDFGTSR

SEQ ID NO: 2744744 - protein, 7 aa, Entamoeba invadens
LTDSNCK

SEQ ID NO: 2744745 - protein, 6 aa, Entamoeba invadens
LTMNDK

SEQ ID NO: 2744746 - protein, 13 aa, Entamoeba invadens
LTNKTEINYNDSN

SEQ ID NO: 2744747 - protein, 7 aa, Entamoeba invadens
LTQNENK

SEQ ID NO: 2744748 - protein, 7 aa, Entamoeba invadens
LTQTSAD

SEQ ID NO: 2744749 - protein, 12 aa, Entamoeba invadens
LTSGGCESCDSF

SEQ ID NO: 2744750 - protein, 8 aa, Entamoeba invadens
LTSTSTQE

SEQ ID NO: 2744751 - protein, 7 aa, Entamoeba invadens
LTTSNSK

SEQ ID NO: 2744752 - protein, 4 aa, Entamoeba invadens
LTTT

SEQ ID NO: 2744753 - protein, 5 aa, Entamoeba invadens
LTTTQ

SEQ ID NO: 2744754 - protein, 4 aa, Entamoeba invadens
LTVT

SEQ ID NO: 2744755 - protein, 6 aa, Entamoeba invadens
LVTTGD

SEQ ID NO: 2744756 - protein, 9 aa, Entamoeba invadens
MDNPSNNKI

SEQ ID NO: 2744757 - protein, 9 aa, Entamoeba invadens
MEKGAERFT

SEQ ID NO: 2744758 - protein, 5 aa, Entamoeba invadens
MERTQ

SEQ ID NO: 2744759 - protein, 17 aa, Entamoeba invadens
MKQSSDDKSSKKEFEDE

SEQ ID NO: 2744760 - protein, 6 aa, Entamoeba invadens
MNPVSK

SEQ ID NO: 2744761 - protein, 4 aa, Entamoeba invadens
MNSN

SEQ ID NO: 2744762 - protein, 10 aa, Entamoeba invadens
MNSNTDDDYE

SEQ ID NO: 2744763 - protein, 8 aa, Entamoeba invadens
MPLPTGGG

SEQ ID NO: 2744764 - protein, 9 aa, Entamoeba invadens
MRSSDGSTC

SEQ ID NO: 2744765 - protein, 24 aa, Entamoeba invadens
MSDSSRKCSECNSNYYPKTTGDYK

SEQ ID NO: 2744766 - protein, 20 aa, Entamoeba invadens
MSTALDPDELKKKRKLGEGS

SEQ ID NO: 2744767 - protein, 5 aa, Entamoeba invadens
MSTKG

SEQ ID NO: 2744768 - protein, 7 aa, Entamoeba invadens
MSTPDEK

SEQ ID NO: 2744769 - protein, 8 aa, Entamoeba invadens
MVPPPTYV

SEQ ID NO: 2744770 - protein, 8 aa, Entamoeba invadens
MYPDTTYT

SEQ ID NO: 2744771 - protein, 6 aa, Entamoeba invadens
MYPNTN

SEQ ID NO: 2744772 - protein, 8 aa, Entamoeba invadens
MYPNTNGT

SEQ ID NO: 2744773 - protein, 6 aa, Entamoeba invadens
NACNKN

SEQ ID NO: 2744774 - protein, 7 aa, Entamoeba invadens
NAFSGTK

SEQ ID NO: 2744775 - protein, 8 aa, Entamoeba invadens
NAGAQGGM

SEQ ID NO: 2744776 - protein, 6 aa, Entamoeba invadens
NAPSKK

SEQ ID NO: 2744777 - protein, 7 aa, Entamoeba invadens
NATNTTV

SEQ ID NO: 2744778 - protein, 4 aa, Entamoeba invadens
NATT

SEQ ID NO: 2744779 - protein, 13 aa, Entamoeba invadens
NCDAQSSNGETQM

SEQ ID NO: 2744780 - protein, 7 aa, Entamoeba invadens
NCDGYRK

SEQ ID NO: 2744781 - protein, 16 aa, Entamoeba invadens
NCETKTQNGCSQCSTG

SEQ ID NO: 2744782 - protein, 11 aa, Entamoeba invadens
NCNEVTKSKCS

SEQ ID NO: 2744783 - protein, 5 aa, Entamoeba invadens
NCNVT

SEQ ID NO: 2744784 - protein, 6 aa, Entamoeba invadens
NCTAAN

SEQ ID NO: 2744785 - protein, 10 aa, Entamoeba invadens
NCTSCKQGTY

SEQ ID NO: 2744786 - protein, 4 aa, Entamoeba invadens
NCTT

SEQ ID NO: 2744787 - protein, 11 aa, Entamoeba invadens
NCTTCSQSEGN

SEQ ID NO: 2744788 - protein, 9 aa, Entamoeba invadens
NCTTNGKCT

SEQ ID NO: 2744789 - protein, 9 aa, Entamoeba invadens
NCTTNTRSN

SEQ ID NO: 2744790 - protein, 7 aa, Entamoeba invadens
NDEDNSC

SEQ ID NO: 2744791 - protein, 4 aa, Entamoeba invadens
NDEI

SEQ ID NO: 2744792 - protein, 14 aa, Entamoeba invadens
NDPKDKKCATCSSF

SEQ ID NO: 2744793 - protein, 4 aa, Entamoeba invadens
NDRL

SEQ ID NO: 2744794 - protein, 7 aa, Entamoeba invadens
NDSCRPP

SEQ ID NO: 2744795 - protein, 6 aa, Entamoeba invadens
NDSSTF

SEQ ID NO: 2744796 - protein, 9 aa, Entamoeba invadens
NDSTRASPI

SEQ ID NO: 2744797 - protein, 13 aa, Entamoeba invadens
NDTNCDKCSENCE

SEQ ID NO: 2744798 - protein, 5 aa, Entamoeba invadens
NDTNR

SEQ ID NO: 2744799 - protein, 9 aa, Entamoeba invadens
NDTQRCEKC

SEQ ID NO: 2744800 - protein, 12 aa, Entamoeba invadens
NDTSTSFKITAS

SEQ ID NO: 2744801 - protein, 5 aa, Entamoeba invadens
NECEK

SEQ ID NO: 2744802 - protein, 7 aa, Entamoeba invadens
NECQKCD

SEQ ID NO: 2744803 - protein, 6 aa, Entamoeba invadens
NEGKEE

SEQ ID NO: 2744804 - protein, 8 aa, Entamoeba invadens
NEITDSKC

SEQ ID NO: 2744805 - protein, 9 aa, Entamoeba invadens
NEKCNECKS

SEQ ID NO: 2744806 - protein, 7 aa, Entamoeba invadens
NEKFPLK

SEQ ID NO: 2744807 - protein, 6 aa, Entamoeba invadens
NEKQER

SEQ ID NO: 2744808 - protein, 16 aa, Entamoeba invadens
NEKVNYDYNSNSPSIR

SEQ ID NO: 2744809 - protein, 4 aa, Entamoeba invadens
NELE

SEQ ID NO: 2744810 - protein, 16 aa, Entamoeba invadens
NENCTKCTSQNQCTSC

SEQ ID NO: 2744811 - protein, 8 aa, Entamoeba invadens
NERKKKGV

SEQ ID NO: 2744812 - protein, 5 aa, Entamoeba invadens
NERSK

SEQ ID NO: 2744813 - protein, 17 aa, Entamoeba invadens
NETLGCSGNIDSEYGCS

SEQ ID NO: 2744814 - protein, 12 aa, Entamoeba invadens
NETNCDKCSEKC

SEQ ID NO: 2744815 - protein, 5 aa, Entamoeba invadens
NETNE

SEQ ID NO: 2744816 - protein, 7 aa, Entamoeba invadens
NETQPYA

SEQ ID NO: 2744817 - protein, 4 aa, Entamoeba invadens
NEVE

SEQ ID NO: 2744818 - protein, 7 aa, Entamoeba invadens
NGDKTAI

SEQ ID NO: 2744819 - protein, 7 aa, Entamoeba invadens
NGETGCT

SEQ ID NO: 2744820 - protein, 5 aa, Entamoeba invadens
NGGGF

SEQ ID NO: 2744821 - protein, 7 aa, Entamoeba invadens
NGHPTKC

SEQ ID NO: 2744822 - protein, 7 aa, Entamoeba invadens
NGKYDNT

SEQ ID NO: 2744823 - protein, 28 aa, Entamoeba invadens
NGKYPDETTKTCKDCDSTCNTQCNTTNG

SEQ ID NO: 2744824 - protein, 10 aa, Entamoeba invadens
NGLYNKSSQQ

SEQ ID NO: 2744825 - protein, 14 aa, Entamoeba invadens
NGNKNNEPEPFRPE

SEQ ID NO: 2744826 - protein, 7 aa, Entamoeba invadens
NGNNTYT

SEQ ID NO: 2744827 - protein, 4 aa, Entamoeba invadens
NGQC

SEQ ID NO: 2744828 - protein, 18 aa, Entamoeba invadens
NGRTTKCQSTSEMTPNGK

SEQ ID NO: 2744829 - protein, 8 aa, Entamoeba invadens
NGSYSGGF

SEQ ID NO: 2744830 - protein, 7 aa, Entamoeba invadens
NGTFYPG

SEQ ID NO: 2744831 - protein, 6 aa, Entamoeba invadens
NGTPLD

SEQ ID NO: 2744832 - protein, 4 aa, Entamoeba invadens
NGYY

SEQ ID NO: 2744833 - protein, 6 aa, Entamoeba invadens
NGYYDN

SEQ ID NO: 2744834 - protein, 4 aa, Entamoeba invadens
NHSC

SEQ ID NO: 2744835 - protein, 5 aa, Entamoeba invadens
NIDTT

SEQ ID NO: 2744836 - protein, 8 aa, Entamoeba invadens
NIKEGHRA

SEQ ID NO: 2744837 - protein, 8 aa, Entamoeba invadens
NIKNGKEC

SEQ ID NO: 2744838 - protein, 4 aa, Entamoeba invadens
NINQ

SEQ ID NO: 2744839 - protein, 4 aa, Entamoeba invadens
NIPT

SEQ ID NO: 2744840 - protein, 5 aa, Entamoeba invadens
NITMN

SEQ ID NO: 2744841 - protein, 11 aa, Entamoeba invadens
NITNASQTTSL

SEQ ID NO: 2744842 - protein, 4 aa, Entamoeba invadens
NKAV

SEQ ID NO: 2744843 - protein, 5 aa, Entamoeba invadens
NKCDS

SEQ ID NO: 2744844 - protein, 10 aa, Entamoeba invadens
NKCELSSELS

SEQ ID NO: 2744845 - protein, 6 aa, Entamoeba invadens
NKCISN

SEQ ID NO: 2744846 - protein, 9 aa, Entamoeba invadens
NKCQQNSNK

SEQ ID NO: 2744847 - protein, 12 aa, Entamoeba invadens
NKCSSCSEEYKL

SEQ ID NO: 2744848 - protein, 8 aa, Entamoeba invadens
NKDAKDVD

SEQ ID NO: 2744849 - protein, 4 aa, Entamoeba invadens
NKDD

SEQ ID NO: 2744850 - protein, 7 aa, Entamoeba invadens
NKDGTMC

SEQ ID NO: 2744851 - protein, 4 aa, Entamoeba invadens
NKET

SEQ ID NO: 2744852 - protein, 6 aa, Entamoeba invadens
NKGKGV

SEQ ID NO: 2744853 - protein, 6 aa, Entamoeba invadens
NKKGEV

SEQ ID NO: 2744854 - protein, 4 aa, Entamoeba invadens
NKKT

SEQ ID NO: 2744855 - protein, 7 aa, Entamoeba invadens
NKNFPLK

SEQ ID NO: 2744856 - protein, 5 aa, Entamoeba invadens
NKRTI

SEQ ID NO: 2744857 - protein, 7 aa, Entamoeba invadens
NKSKNRM

SEQ ID NO: 2744858 - protein, 7 aa, Entamoeba invadens
NKSKNTI

SEQ ID NO: 2744859 - protein, 4 aa, Entamoeba invadens
NKTG

SEQ ID NO: 2744860 - protein, 6 aa, Entamoeba invadens
NKTNGN

SEQ ID NO: 2744861 - protein, 4 aa, Entamoeba invadens
NKTT

SEQ ID NO: 2744862 - protein, 5 aa, Entamoeba invadens
NKTTT

SEQ ID NO: 2744863 - protein, 9 aa, Entamoeba invadens
NKVSSGPKL

SEQ ID NO: 2744864 - protein, 5 aa, Entamoeba invadens
NLAQT

SEQ ID NO: 2744865 - protein, 10 aa, Entamoeba invadens
NLKTNEEKYN

SEQ ID NO: 2744866 - protein, 4 aa, Entamoeba invadens
NLSK

SEQ ID NO: 2744867 - protein, 5 aa, Entamoeba invadens
NLSST

SEQ ID NO: 2744868 - protein, 8 aa, Entamoeba invadens
NLSTQDLN

SEQ ID NO: 2744869 - protein, 4 aa, Entamoeba invadens
NLTM

SEQ ID NO: 2744870 - protein, 6 aa, Entamoeba invadens
NMQSTE

SEQ ID NO: 2744871 - protein, 14 aa, Entamoeba invadens
NNANNEIPVNKETR

SEQ ID NO: 2744872 - protein, 12 aa, Entamoeba invadens
NNCKTCKSDYTR

SEQ ID NO: 2744873 - protein, 5 aa, Entamoeba invadens
NNCSS

SEQ ID NO: 2744874 - protein, 9 aa, Entamoeba invadens
NNDCDTQNR

SEQ ID NO: 2744875 - protein, 7 aa, Entamoeba invadens
NNDGGVN

SEQ ID NO: 2744876 - protein, 7 aa, Entamoeba invadens
NNESSCK

SEQ ID NO: 2744877 - protein, 7 aa, Entamoeba invadens
NNETLMS

SEQ ID NO: 2744878 - protein, 9 aa, Entamoeba invadens
NNGLTANCD

SEQ ID NO: 2744879 - protein, 5 aa, Entamoeba invadens
NNGNK

SEQ ID NO: 2744880 - protein, 6 aa, Entamoeba invadens
NNGNRL

SEQ ID NO: 2744881 - protein, 20 aa, Entamoeba invadens
NNKCEKCGTGCASCNENNLE

SEQ ID NO: 2744882 - protein, 11 aa, Entamoeba invadens
NNKCEQTTELS

SEQ ID NO: 2744883 - protein, 7 aa, Entamoeba invadens
NNKGCQR

SEQ ID NO: 2744884 - protein, 7 aa, Entamoeba invadens
NNKKSYD

SEQ ID NO: 2744885 - protein, 4 aa, Entamoeba invadens
NNKN

SEQ ID NO: 2744886 - protein, 7 aa, Entamoeba invadens
NNKNSVS

SEQ ID NO: 2744887 - protein, 4 aa, Entamoeba invadens
NNLS

SEQ ID NO: 2744888 - protein, 4 aa, Entamoeba invadens
NNNM

SEQ ID NO: 2744889 - protein, 4 aa, Entamoeba invadens
NNQV

SEQ ID NO: 2744890 - protein, 4 aa, Entamoeba invadens
NNSE

SEQ ID NO: 2744891 - protein, 9 aa, Entamoeba invadens
NNSGTSCQT

SEQ ID NO: 2744892 - protein, 7 aa, Entamoeba invadens
NNSKCTE

SEQ ID NO: 2744893 - protein, 7 aa, Entamoeba invadens
NNSKHTV

SEQ ID NO: 2744894 - protein, 7 aa, Entamoeba invadens
NNSKNTI

SEQ ID NO: 2744895 - protein, 4 aa, Entamoeba invadens
NNSN

SEQ ID NO: 2744896 - protein, 5 aa, Entamoeba invadens
NNSYD

SEQ ID NO: 2744897 - protein, 8 aa, Entamoeba invadens
NNTKCTDN

SEQ ID NO: 2744898 - protein, 4 aa, Entamoeba invadens
NNTY

SEQ ID NO: 2744899 - protein, 10 aa, Entamoeba invadens
NNYTTTTSKT

SEQ ID NO: 2744900 - protein, 8 aa, Entamoeba invadens
NPGYGGDD

SEQ ID NO: 2744901 - protein, 4 aa, Entamoeba invadens
NPKS

SEQ ID NO: 2744902 - protein, 7 aa, Entamoeba invadens
NPKTPEC

SEQ ID NO: 2744903 - protein, 5 aa, Entamoeba invadens
NPPTC

SEQ ID NO: 2744904 - protein, 4 aa, Entamoeba invadens
NPSI

SEQ ID NO: 2744905 - protein, 4 aa, Entamoeba invadens
NPSL

SEQ ID NO: 2744906 - protein, 6 aa, Entamoeba invadens
NQADCT

SEQ ID NO: 2744907 - protein, 10 aa, Entamoeba invadens
NQCNGQTGAC

SEQ ID NO: 2744908 - protein, 22 aa, Entamoeba invadens
NQGCGIGDNVKRPANVSDIGDS

SEQ ID NO: 2744909 - protein, 4 aa, Entamoeba invadens
NQGT

SEQ ID NO: 2744910 - protein, 9 aa, Entamoeba invadens
NQTTGNEEC

SEQ ID NO: 2744911 - protein, 4 aa, Entamoeba invadens
NQTY

SEQ ID NO: 2744912 - protein, 8 aa, Entamoeba invadens
NRDDPSQY

SEQ ID NO: 2744913 - protein, 8 aa, Entamoeba invadens
NREPSETP

SEQ ID NO: 2744914 - protein, 6 aa, Entamoeba invadens
NRGCNT

SEQ ID NO: 2744915 - protein, 10 aa, Entamoeba invadens
NRGCNTCTNR

SEQ ID NO: 2744916 - protein, 9 aa, Entamoeba invadens
NSCYSPTNN

SEQ ID NO: 2744917 - protein, 6 aa, Entamoeba invadens
NSDCQD

SEQ ID NO: 2744918 - protein, 9 aa, Entamoeba invadens
NSDCSTSQK

SEQ ID NO: 2744919 - protein, 15 aa, Entamoeba invadens
NSDTEQIEVNKETSQ

SEQ ID NO: 2744920 - protein, 19 aa, Entamoeba invadens
NSEQSSPAIKAYEKSGNTL

SEQ ID NO: 2744921 - protein, 5 aa, Entamoeba invadens
NSETL

SEQ ID NO: 2744922 - protein, 9 aa, Entamoeba invadens
NSGNNNCGS

SEQ ID NO: 2744923 - protein, 7 aa, Entamoeba invadens
NSGNNTI

SEQ ID NO: 2744924 - protein, 4 aa, Entamoeba invadens
NSKI

SEQ ID NO: 2744925 - protein, 5 aa, Entamoeba invadens
NSNYS

SEQ ID NO: 2744926 - protein, 11 aa, Entamoeba invadens
NSPKTSSKTRF

SEQ ID NO: 2744927 - protein, 4 aa, Entamoeba invadens
NSQC

SEQ ID NO: 2744928 - protein, 4 aa, Entamoeba invadens
NSRS

SEQ ID NO: 2744929 - protein, 6 aa, Entamoeba invadens
NSSDKR

SEQ ID NO: 2744930 - protein, 8 aa, Entamoeba invadens
NSSEYSYP

SEQ ID NO: 2744931 - protein, 8 aa, Entamoeba invadens
NSSIPNAD

SEQ ID NO: 2744932 - protein, 7 aa, Entamoeba invadens
NSSKSNM

SEQ ID NO: 2744933 - protein, 4 aa, Entamoeba invadens
NSSQ

SEQ ID NO: 2744934 - protein, 10 aa, Entamoeba invadens
NSSSNRCERC

SEQ ID NO: 2744935 - protein, 7 aa, Entamoeba invadens
NSTDGNV

SEQ ID NO: 2744936 - protein, 5 aa, Entamoeba invadens
NSTFE

SEQ ID NO: 2744937 - protein, 11 aa, Entamoeba invadens
NSTKSNCDKCN

SEQ ID NO: 2744938 - protein, 15 aa, Entamoeba invadens
NSTNYKTQDGDCIPQ

SEQ ID NO: 2744939 - protein, 18 aa, Entamoeba invadens
NSTSVAITAEQKSEDKEV

SEQ ID NO: 2744940 - protein, 5 aa, Entamoeba invadens
NSTTC

SEQ ID NO: 2744941 - protein, 6 aa, Entamoeba invadens
NSTTGA

SEQ ID NO: 2744942 - protein, 4 aa, Entamoeba invadens
NSTV

SEQ ID NO: 2744943 - protein, 5 aa, Entamoeba invadens
NSYDG

SEQ ID NO: 2744944 - protein, 15 aa, Entamoeba invadens
NTCEQKEQALTSSNS

SEQ ID NO: 2744945 - protein, 5 aa, Entamoeba invadens
NTCKP

SEQ ID NO: 2744946 - protein, 7 aa, Entamoeba invadens
NTCSQCD

SEQ ID NO: 2744947 - protein, 10 aa, Entamoeba invadens
NTCSSDAKKC

SEQ ID NO: 2744948 - protein, 9 aa, Entamoeba invadens
NTCSSTERK

SEQ ID NO: 2744949 - protein, 9 aa, Entamoeba invadens
NTEDGKGQI

SEQ ID NO: 2744950 - protein, 4 aa, Entamoeba invadens
NTEL

SEQ ID NO: 2744951 - protein, 4 aa, Entamoeba invadens
NTIE

SEQ ID NO: 2744952 - protein, 9 aa, Entamoeba invadens
NTKIPGTLS

SEQ ID NO: 2744953 - protein, 4 aa, Entamoeba invadens
NTLE

SEQ ID NO: 2744954 - protein, 4 aa, Entamoeba invadens
NTNC

SEQ ID NO: 2744955 - protein, 9 aa, Entamoeba invadens
NTNECGKCD

SEQ ID NO: 2744956 - protein, 25 aa, Entamoeba invadens
NTNECQKCNDNCNTCTTTRNKCTSC

SEQ ID NO: 2744957 - protein, 5 aa, Entamoeba invadens
NTNHT

SEQ ID NO: 2744958 - protein, 6 aa, Entamoeba invadens
NTNKNA

SEQ ID NO: 2744959 - protein, 14 aa, Entamoeba invadens
NTNKNSTKKQFTIS

SEQ ID NO: 2744960 - protein, 9 aa, Entamoeba invadens
NTNTGCSKC

SEQ ID NO: 2744961 - protein, 7 aa, Entamoeba invadens
NTNTNNI

SEQ ID NO: 2744962 - protein, 5 aa, Entamoeba invadens
NTNYT

SEQ ID NO: 2744963 - protein, 8 aa, Entamoeba invadens
NTQEENFT

SEQ ID NO: 2744964 - protein, 4 aa, Entamoeba invadens
NTSD

SEQ ID NO: 2744965 - protein, 5 aa, Entamoeba invadens
NTSFL

SEQ ID NO: 2744966 - protein, 6 aa, Entamoeba invadens
NTSKIP

SEQ ID NO: 2744967 - protein, 14 aa, Entamoeba invadens
NTSNGNCDKCTENK

SEQ ID NO: 2744968 - protein, 5 aa, Entamoeba invadens
NTSTL

SEQ ID NO: 2744969 - protein, 14 aa, Entamoeba invadens
NTTCSDTFDDDHTC

SEQ ID NO: 2744970 - protein, 8 aa, Entamoeba invadens
NTTHNPLR

SEQ ID NO: 2744971 - protein, 5 aa, Entamoeba invadens
NTTKH

SEQ ID NO: 2744972 - protein, 4 aa, Entamoeba invadens
NTTL

SEQ ID NO: 2744973 - protein, 7 aa, Entamoeba invadens
NTTQSDK

SEQ ID NO: 2744974 - protein, 7 aa, Entamoeba invadens
NTTSEEM

SEQ ID NO: 2744975 - protein, 7 aa, Entamoeba invadens
NTTSKTL

SEQ ID NO: 2744976 - protein, 8 aa, Entamoeba invadens
NVFEDPPS

SEQ ID NO: 2744977 - protein, 7 aa, Entamoeba invadens
NVGTPTY

SEQ ID NO: 2744978 - protein, 10 aa, Entamoeba invadens
NVKSAENEEN

SEQ ID NO: 2744979 - protein, 5 aa, Entamoeba invadens
NVRNP

SEQ ID NO: 2744980 - protein, 4 aa, Entamoeba invadens
NVTF

SEQ ID NO: 2744981 - protein, 4 aa, Entamoeba invadens
NVTS

SEQ ID NO: 2744982 - protein, 6 aa, Entamoeba invadens
NVTSDG

SEQ ID NO: 2744983 - protein, 5 aa, Entamoeba invadens
NYIKE

SEQ ID NO: 2744984 - protein, 9 aa, Entamoeba invadens
NYKPSEIGD

SEQ ID NO: 2744985 - protein, 11 aa, Entamoeba invadens
NYKTNSGDCLP

SEQ ID NO: 2744986 - protein, 12 aa, Entamoeba invadens
NYKTQSGKCLPQ

SEQ ID NO: 2744987 - protein, 6 aa, Entamoeba invadens
NYRGNT

SEQ ID NO: 2744988 - protein, 5 aa, Entamoeba invadens
NYSKN

SEQ ID NO: 2744989 - protein, 8 aa, Entamoeba invadens
NYSSNITS

SEQ ID NO: 2744990 - protein, 9 aa, Entamoeba invadens
NYYDSTTRE

SEQ ID NO: 2744991 - protein, 7 aa, Entamoeba invadens
NYYQSNS

SEQ ID NO: 2744992 - protein, 8 aa, Entamoeba invadens
PCEKTSGK

SEQ ID NO: 2744993 - protein, 13 aa, Entamoeba invadens
PCNGKCDPTNGNC

SEQ ID NO: 2744994 - protein, 14 aa, Entamoeba invadens
PDCKGEPSKTVTKP

SEQ ID NO: 2744995 - protein, 7 aa, Entamoeba invadens
PDDASGK

SEQ ID NO: 2744996 - protein, 4 aa, Entamoeba invadens
PDGG

SEQ ID NO: 2744997 - protein, 5 aa, Entamoeba invadens
PDGTH

SEQ ID NO: 2744998 - protein, 7 aa, Entamoeba invadens
PDGYDTV

SEQ ID NO: 2744999 - protein, 4 aa, Entamoeba invadens
PEEC

SEQ ID NO: 2745000 - protein, 4 aa, Entamoeba invadens
PEGV

SEQ ID NO: 2745001 - protein, 4 aa, Entamoeba invadens
PEGY

SEQ ID NO: 2745002 - protein, 5 aa, Entamoeba invadens
PEGYN

SEQ ID NO: 2745003 - protein, 4 aa, Entamoeba invadens
PELN

SEQ ID NO: 2745004 - protein, 4 aa, Entamoeba invadens
PESI

SEQ ID NO: 2745005 - protein, 11 aa, Entamoeba invadens
PEVANSDISLS

SEQ ID NO: 2745006 - protein, 5 aa, Entamoeba invadens
PFEVS

SEQ ID NO: 2745007 - protein, 4 aa, Entamoeba invadens
PFSS

SEQ ID NO: 2745008 - protein, 9 aa, Entamoeba invadens
PGSSPSIGE

SEQ ID NO: 2745009 - protein, 5 aa, Entamoeba invadens
PIETE

SEQ ID NO: 2745010 - protein, 4 aa, Entamoeba invadens
PINT

SEQ ID NO: 2745011 - protein, 6 aa, Entamoeba invadens
PISTNC

SEQ ID NO: 2745012 - protein, 4 aa, Entamoeba invadens
PITT

SEQ ID NO: 2745013 - protein, 5 aa, Entamoeba invadens
PKAER

SEQ ID NO: 2745014 - protein, 4 aa, Entamoeba invadens
PKSE

SEQ ID NO: 2745015 - protein, 7 aa, Entamoeba invadens
PKTSGDY

SEQ ID NO: 2745016 - protein, 5 aa, Entamoeba invadens
PLESQ

SEQ ID NO: 2745017 - protein, 5 aa, Entamoeba invadens
PLTDQ

SEQ ID NO: 2745018 - protein, 9 aa, Entamoeba invadens
PNDQNGKCT

SEQ ID NO: 2745019 - protein, 7 aa, Entamoeba invadens
PNFTSNI

SEQ ID NO: 2745020 - protein, 5 aa, Entamoeba invadens
PNGYY

SEQ ID NO: 2745021 - protein, 5 aa, Entamoeba invadens
PNNIG

SEQ ID NO: 2745022 - protein, 6 aa, Entamoeba invadens
PNNPEY

SEQ ID NO: 2745023 - protein, 7 aa, Entamoeba invadens
PNPSTGI

SEQ ID NO: 2745024 - protein, 4 aa, Entamoeba invadens
PNSM

SEQ ID NO: 2745025 - protein, 14 aa, Entamoeba invadens
PPAKPKAKTSCPAD

SEQ ID NO: 2745026 - protein, 7 aa, Entamoeba invadens
PPEQQMQ

SEQ ID NO: 2745027 - protein, 4 aa, Entamoeba invadens
PPTI

SEQ ID NO: 2745028 - protein, 4 aa, Entamoeba invadens
PQAS

SEQ ID NO: 2745029 - protein, 7 aa, Entamoeba invadens
PQQYSEQ

SEQ ID NO: 2745030 - protein, 4 aa, Entamoeba invadens
PQSS

SEQ ID NO: 2745031 - protein, 12 aa, Entamoeba invadens
PRKSFFDQVDSR

SEQ ID NO: 2745032 - protein, 10 aa, Entamoeba invadens
PRSNSYYDGD

SEQ ID NO: 2745033 - protein, 13 aa, Entamoeba invadens
PSGQYSASSGSSI

SEQ ID NO: 2745034 - protein, 9 aa, Entamoeba invadens
PSKCEPCST

SEQ ID NO: 2745035 - protein, 10 aa, Entamoeba invadens
PSSDGTSCAK

SEQ ID NO: 2745036 - protein, 9 aa, Entamoeba invadens
PSTNYEKAN

SEQ ID NO: 2745037 - protein, 5 aa, Entamoeba invadens
PTFGY

SEQ ID NO: 2745038 - protein, 4 aa, Entamoeba invadens
PTFT

SEQ ID NO: 2745039 - protein, 4 aa, Entamoeba invadens
PTKV

SEQ ID NO: 2745040 - protein, 4 aa, Entamoeba invadens
PTNN

SEQ ID NO: 2745041 - protein, 9 aa, Entamoeba invadens
PTNSGTSCN

SEQ ID NO: 2745042 - protein, 10 aa, Entamoeba invadens
PTYSGDFKSS

SEQ ID NO: 2745043 - protein, 7 aa, Entamoeba invadens
PVDEESR

SEQ ID NO: 2745044 - protein, 6 aa, Entamoeba invadens
PVKKPT

SEQ ID NO: 2745045 - protein, 4 aa, Entamoeba invadens
PVNT

SEQ ID NO: 2745046 - protein, 5 aa, Entamoeba invadens
PVQGK

SEQ ID NO: 2745047 - protein, 6 aa, Entamoeba invadens
PVTEES

SEQ ID NO: 2745048 - protein, 11 aa, Entamoeba invadens
PYNPTQTTCQE

SEQ ID NO: 2745049 - protein, 7 aa, Entamoeba invadens
QAKEYKN

SEQ ID NO: 2745050 - protein, 8 aa, Entamoeba invadens
QASGKTKC

SEQ ID NO: 2745051 - protein, 4 aa, Entamoeba invadens
QDGY

SEQ ID NO: 2745052 - protein, 9 aa, Entamoeba invadens
QDKYTKSAD

SEQ ID NO: 2745053 - protein, 8 aa, Entamoeba invadens
QDPRERPD

SEQ ID NO: 2745054 - protein, 9 aa, Entamoeba invadens
QDPRERPDM

SEQ ID NO: 2745055 - protein, 4 aa, Entamoeba invadens
QEIT

SEQ ID NO: 2745056 - protein, 8 aa, Entamoeba invadens
QEKYKKEA

SEQ ID NO: 2745057 - protein, 10 aa, Entamoeba invadens
QEKYKKPADI

SEQ ID NO: 2745058 - protein, 10 aa, Entamoeba invadens
QEKYKKPADV

SEQ ID NO: 2745059 - protein, 10 aa, Entamoeba invadens
QEKYKKSADV

SEQ ID NO: 2745060 - protein, 8 aa, Entamoeba invadens
QEKYTKGA

SEQ ID NO: 2745061 - protein, 9 aa, Entamoeba invadens
QERYTKSAD

SEQ ID NO: 2745062 - protein, 10 aa, Entamoeba invadens
QESQENEFEK

SEQ ID NO: 2745063 - protein, 10 aa, Entamoeba invadens
QETDENGAIR

SEQ ID NO: 2745064 - protein, 7 aa, Entamoeba invadens
QGDGKKR

SEQ ID NO: 2745065 - protein, 7 aa, Entamoeba invadens
QGFCGNE

SEQ ID NO: 2745066 - protein, 8 aa, Entamoeba invadens
QGQPIPQP

SEQ ID NO: 2745067 - protein, 14 aa, Entamoeba invadens
QIDNSLDDNSIDEF

SEQ ID NO: 2745068 - protein, 4 aa, Entamoeba invadens
QKCE

SEQ ID NO: 2745069 - protein, 6 aa, Entamoeba invadens
QKGISQ

SEQ ID NO: 2745070 - protein, 4 aa, Entamoeba invadens
QKKI

SEQ ID NO: 2745071 - protein, 8 aa, Entamoeba invadens
QKNLEGSY

SEQ ID NO: 2745072 - protein, 7 aa, Entamoeba invadens
QKQKERY

SEQ ID NO: 2745073 - protein, 14 aa, Entamoeba invadens
QKQTELYSDESATI

SEQ ID NO: 2745074 - protein, 8 aa, Entamoeba invadens
QKSSQTSS

SEQ ID NO: 2745075 - protein, 7 aa, Entamoeba invadens
QKTQSGC

SEQ ID NO: 2745076 - protein, 5 aa, Entamoeba invadens
QKYSI

SEQ ID NO: 2745077 - protein, 8 aa, Entamoeba invadens
QLDNNENG

SEQ ID NO: 2745078 - protein, 8 aa, Entamoeba invadens
QLDQSNMS

SEQ ID NO: 2745079 - protein, 12 aa, Entamoeba invadens
QLDSNESGLDEF

SEQ ID NO: 2745080 - protein, 9 aa, Entamoeba invadens
QMSESDTAQ

SEQ ID NO: 2745081 - protein, 10 aa, Entamoeba invadens
QMSKDSMEEF

SEQ ID NO: 2745082 - protein, 8 aa, Entamoeba invadens
QNAELGGD

SEQ ID NO: 2745083 - protein, 6 aa, Entamoeba invadens
QNETRN

SEQ ID NO: 2745084 - protein, 5 aa, Entamoeba invadens
QNGDN

SEQ ID NO: 2745085 - protein, 5 aa, Entamoeba invadens
QNGEN

SEQ ID NO: 2745086 - protein, 7 aa, Entamoeba invadens
QNKEDEC

SEQ ID NO: 2745087 - protein, 8 aa, Entamoeba invadens
QNKEFENE

SEQ ID NO: 2745088 - protein, 9 aa, Entamoeba invadens
QNPKERETT

SEQ ID NO: 2745089 - protein, 7 aa, Entamoeba invadens
QNSESEC

SEQ ID NO: 2745090 - protein, 9 aa, Entamoeba invadens
QNSSEYSYP

SEQ ID NO: 2745091 - protein, 9 aa, Entamoeba invadens
QNSSQEDTH

SEQ ID NO: 2745092 - protein, 6 aa, Entamoeba invadens
QNVKSA

SEQ ID NO: 2745093 - protein, 4 aa, Entamoeba invadens
QPPQ

SEQ ID NO: 2745094 - protein, 4 aa, Entamoeba invadens
QPTT

SEQ ID NO: 2745095 - protein, 18 aa, Entamoeba invadens
QQPADRPPIEDVVEKLEK

SEQ ID NO: 2745096 - protein, 15 aa, Entamoeba invadens
QQTTRCQSPSNTTMS

SEQ ID NO: 2745097 - protein, 17 aa, Entamoeba invadens
QRNNQISDVNDNSTKTP

SEQ ID NO: 2745098 - protein, 18 aa, Entamoeba invadens
QRPEDRPHIDEVIKSVET

SEQ ID NO: 2745099 - protein, 6 aa, Entamoeba invadens
QRPTDI

SEQ ID NO: 2745100 - protein, 11 aa, Entamoeba invadens
QRSSPMQTGGQ

SEQ ID NO: 2745101 - protein, 4 aa, Entamoeba invadens
QSEI

SEQ ID NO: 2745102 - protein, 14 aa, Entamoeba invadens
QSESNKLCSSNTTL

SEQ ID NO: 2745103 - protein, 4 aa, Entamoeba invadens
QSSS

SEQ ID NO: 2745104 - protein, 9 aa, Entamoeba invadens
QTDKNHIKG

SEQ ID NO: 2745105 - protein, 4 aa, Entamoeba invadens
QTNS

SEQ ID NO: 2745106 - protein, 9 aa, Entamoeba invadens
QTPPQQYQQ

SEQ ID NO: 2745107 - protein, 4 aa, Entamoeba invadens
QTQD

SEQ ID NO: 2745108 - protein, 6 aa, Entamoeba invadens
QTTKEC

SEQ ID NO: 2745109 - protein, 7 aa, Entamoeba invadens
QTTLPQN

SEQ ID NO: 2745110 - protein, 4 aa, Entamoeba invadens
QTTN

SEQ ID NO: 2745111 - protein, 8 aa, Entamoeba invadens
QVENSTHL

SEQ ID NO: 2745112 - protein, 6 aa, Entamoeba invadens
QYSDCQ

SEQ ID NO: 2745113 - protein, 4 aa, Entamoeba invadens
QYSQ

SEQ ID NO: 2745114 - protein, 9 aa, Entamoeba invadens
QYSYPNTNG

SEQ ID NO: 2745115 - protein, 11 aa, Entamoeba invadens
QYTPAITQPSK

SEQ ID NO: 2745116 - protein, 7 aa, Entamoeba invadens
RCDPPEA

SEQ ID NO: 2745117 - protein, 6 aa, Entamoeba invadens
RCTKCN

SEQ ID NO: 2745118 - protein, 15 aa, Entamoeba invadens
RCTTNENCKATNGAN

SEQ ID NO: 2745119 - protein, 14 aa, Entamoeba invadens
RDLASKVKSGTIQR

SEQ ID NO: 2745120 - protein, 5 aa, Entamoeba invadens
RDTKE

SEQ ID NO: 2745121 - protein, 9 aa, Entamoeba invadens
REGCDDEAK

SEQ ID NO: 2745122 - protein, 8 aa, Entamoeba invadens
REGCNDEA

SEQ ID NO: 2745123 - protein, 5 aa, Entamoeba invadens
REGNC

SEQ ID NO: 2745124 - protein, 5 aa, Entamoeba invadens
REQSN

SEQ ID NO: 2745125 - protein, 4 aa, Entamoeba invadens
RGEA

SEQ ID NO: 2745126 - protein, 11 aa, Entamoeba invadens
RGGKYPKDGVN

SEQ ID NO: 2745127 - protein, 4 aa, Entamoeba invadens
RGGS

SEQ ID NO: 2745128 - protein, 4 aa, Entamoeba invadens
RGQK

SEQ ID NO: 2745129 - protein, 4 aa, Entamoeba invadens
RGSA

SEQ ID NO: 2745130 - protein, 6 aa, Entamoeba invadens
RKEKED

SEQ ID NO: 2745131 - protein, 8 aa, Entamoeba invadens
RKENSLGS

SEQ ID NO: 2745132 - protein, 10 aa, Entamoeba invadens
RKKYKKASDV

SEQ ID NO: 2745133 - protein, 7 aa, Entamoeba invadens
RKPVPGK

SEQ ID NO: 2745134 - protein, 13 aa, Entamoeba invadens
RKSRNQSTRNLGT

SEQ ID NO: 2745135 - protein, 10 aa, Entamoeba invadens
RKSTDAQARS

SEQ ID NO: 2745136 - protein, 7 aa, Entamoeba invadens
RKTEKLR

SEQ ID NO: 2745137 - protein, 10 aa, Entamoeba invadens
RLDKEENMNE

SEQ ID NO: 2745138 - protein, 10 aa, Entamoeba invadens
RLDKPTGIPE

SEQ ID NO: 2745139 - protein, 7 aa, Entamoeba invadens
RLDPDEL

SEQ ID NO: 2745140 - protein, 7 aa, Entamoeba invadens
RLEKPDY

SEQ ID NO: 2745141 - protein, 10 aa, Entamoeba invadens
RLEKPNGIPE

SEQ ID NO: 2745142 - protein, 13 aa, Entamoeba invadens
RLERNENMSDSQY

SEQ ID NO: 2745143 - protein, 5 aa, Entamoeba invadens
RNGDY

SEQ ID NO: 2745144 - protein, 6 aa, Entamoeba invadens
RNGNSK

SEQ ID NO: 2745145 - protein, 5 aa, Entamoeba invadens
RNIEQ

SEQ ID NO: 2745146 - protein, 10 aa, Entamoeba invadens
RNLGESPTAV

SEQ ID NO: 2745147 - protein, 11 aa, Entamoeba invadens
RNNKGCERCNS

SEQ ID NO: 2745148 - protein, 4 aa, Entamoeba invadens
RPGM

SEQ ID NO: 2745149 - protein, 4 aa, Entamoeba invadens
RQCE

SEQ ID NO: 2745150 - protein, 6 aa, Entamoeba invadens
RQEKED

SEQ ID NO: 2745151 - protein, 7 aa, Entamoeba invadens
RQGPAMT

SEQ ID NO: 2745152 - protein, 6 aa, Entamoeba invadens
RQPEEI

SEQ ID NO: 2745153 - protein, 6 aa, Entamoeba invadens
RSDGTC

SEQ ID NO: 2745154 - protein, 8 aa, Entamoeba invadens
RSSCPDGY

SEQ ID NO: 2745155 - protein, 4 aa, Entamoeba invadens
RTDI

SEQ ID NO: 2745156 - protein, 13 aa, Entamoeba invadens
RTDRIQKQINSIS

SEQ ID NO: 2745157 - protein, 17 aa, Entamoeba invadens
RTEQEYVNDGKCKACSE

SEQ ID NO: 2745158 - protein, 4 aa, Entamoeba invadens
RTNG

SEQ ID NO: 2745159 - protein, 5 aa, Entamoeba invadens
RTNVT

SEQ ID NO: 2745160 - protein, 5 aa, Entamoeba invadens
RTRYN

SEQ ID NO: 2745161 - protein, 7 aa, Entamoeba invadens
RTTKTVT

SEQ ID NO: 2745162 - protein, 8 aa, Entamoeba invadens
RTTSSSTE

SEQ ID NO: 2745163 - protein, 6 aa, Entamoeba invadens
RVEYET

SEQ ID NO: 2745164 - protein, 5 aa, Entamoeba invadens
RYGSS

SEQ ID NO: 2745165 - protein, 5 aa, Entamoeba invadens
RYHKT

SEQ ID NO: 2745166 - protein, 8 aa, Entamoeba invadens
RYNAKNNK

SEQ ID NO: 2745167 - protein, 6 aa, Entamoeba invadens
SAIPYG

SEQ ID NO: 2745168 - protein, 8 aa, Entamoeba invadens
SAKTGCEK

SEQ ID NO: 2745169 - protein, 7 aa, Entamoeba invadens
SAQKSKC

SEQ ID NO: 2745170 - protein, 19 aa, Entamoeba invadens
SAQVYQGSLPTQIKNKCSQ

SEQ ID NO: 2745171 - protein, 7 aa, Entamoeba invadens
SASDNKC

SEQ ID NO: 2745172 - protein, 14 aa, Entamoeba invadens
SASDSTKCESCSTF

SEQ ID NO: 2745173 - protein, 4 aa, Entamoeba invadens
SASL

SEQ ID NO: 2745174 - protein, 6 aa, Entamoeba invadens
SCDSNN

SEQ ID NO: 2745175 - protein, 6 aa, Entamoeba invadens
SCDSQC

SEQ ID NO: 2745176 - protein, 12 aa, Entamoeba invadens
SCEEGKYSLGGN

SEQ ID NO: 2745177 - protein, 12 aa, Entamoeba invadens
SCGDCATSIPGC

SEQ ID NO: 2745178 - protein, 9 aa, Entamoeba invadens
SCGGSCSGV

SEQ ID NO: 2745179 - protein, 14 aa, Entamoeba invadens
SCGKAKQNCETSHN

SEQ ID NO: 2745180 - protein, 6 aa, Entamoeba invadens
SCGSNC

SEQ ID NO: 2745181 - protein, 8 aa, Entamoeba invadens
SCSDTGKC

SEQ ID NO: 2745182 - protein, 5 aa, Entamoeba invadens
SCSEC

SEQ ID NO: 2745183 - protein, 6 aa, Entamoeba invadens
SCSQNH

SEQ ID NO: 2745184 - protein, 15 aa, Entamoeba invadens
SCSSGSYKNTETSCG

SEQ ID NO: 2745185 - protein, 8 aa, Entamoeba invadens
SCVESDTK

SEQ ID NO: 2745186 - protein, 11 aa, Entamoeba invadens
SDARTKTDITR

SEQ ID NO: 2745187 - protein, 7 aa, Entamoeba invadens
SDEDMKE

SEQ ID NO: 2745188 - protein, 6 aa, Entamoeba invadens
SDFDPN

SEQ ID NO: 2745189 - protein, 7 aa, Entamoeba invadens
SDFGSSR

SEQ ID NO: 2745190 - protein, 6 aa, Entamoeba invadens
SDGKCG

SEQ ID NO: 2745191 - protein, 6 aa, Entamoeba invadens
SDKQVD

SEQ ID NO: 2745192 - protein, 10 aa, Entamoeba invadens
SDKTGTLTEN

SEQ ID NO: 2745193 - protein, 8 aa, Entamoeba invadens
SDKYCRPQ

SEQ ID NO: 2745194 - protein, 10 aa, Entamoeba invadens
SDNECESRSN

SEQ ID NO: 2745195 - protein, 4 aa, Entamoeba invadens
SDNN

SEQ ID NO: 2745196 - protein, 5 aa, Entamoeba invadens
SDPTW

SEQ ID NO: 2745197 - protein, 6 aa, Entamoeba invadens
SDSKCT

SEQ ID NO: 2745198 - protein, 6 aa, Entamoeba invadens
SDTLTS

SEQ ID NO: 2745199 - protein, 6 aa, Entamoeba invadens
SEADKM

SEQ ID NO: 2745200 - protein, 22 aa, Entamoeba invadens
SEASTALDPDELHKENKLGEGG

SEQ ID NO: 2745201 - protein, 4 aa, Entamoeba invadens
SEEN

SEQ ID NO: 2745202 - protein, 9 aa, Entamoeba invadens
SEGTYPNGV

SEQ ID NO: 2745203 - protein, 4 aa, Entamoeba invadens
SEID

SEQ ID NO: 2745204 - protein, 6 aa, Entamoeba invadens
SEISTC

SEQ ID NO: 2745205 - protein, 5 aa, Entamoeba invadens
SEITS

SEQ ID NO: 2745206 - protein, 7 aa, Entamoeba invadens
SEKCEAG

SEQ ID NO: 2745207 - protein, 9 aa, Entamoeba invadens
SEKRNKRLR

SEQ ID NO: 2745208 - protein, 9 aa, Entamoeba invadens
SENGSSCET

SEQ ID NO: 2745209 - protein, 9 aa, Entamoeba invadens
SENPIAEGA

SEQ ID NO: 2745210 - protein, 6 aa, Entamoeba invadens
SEPNPM

SEQ ID NO: 2745211 - protein, 4 aa, Entamoeba invadens
SEQY

SEQ ID NO: 2745212 - protein, 25 aa, Entamoeba invadens
SERGITEDDPTVTGRVGPNWPEQGD

SEQ ID NO: 2745213 - protein, 19 aa, Entamoeba invadens
SERNLQSKALSQGIGTPTY

SEQ ID NO: 2745214 - protein, 6 aa, Entamoeba invadens
SESSSK

SEQ ID NO: 2745215 - protein, 6 aa, Entamoeba invadens
SETKCG

SEQ ID NO: 2745216 - protein, 9 aa, Entamoeba invadens
SETLSKTVE

SEQ ID NO: 2745217 - protein, 5 aa, Entamoeba invadens
SETPL

SEQ ID NO: 2745218 - protein, 6 aa, Entamoeba invadens
SETTTL

SEQ ID NO: 2745219 - protein, 18 aa, Entamoeba invadens
SFDEDDKLKTSSKTATET

SEQ ID NO: 2745220 - protein, 12 aa, Entamoeba invadens
SFDNWTEDDKKK

SEQ ID NO: 2745221 - protein, 12 aa, Entamoeba invadens
SFGESSFAKTAM

SEQ ID NO: 2745222 - protein, 10 aa, Entamoeba invadens
SFGESSFDNT

SEQ ID NO: 2745223 - protein, 11 aa, Entamoeba invadens
SFGESSFDNTA

SEQ ID NO: 2745224 - protein, 5 aa, Entamoeba invadens
SFGST

SEQ ID NO: 2745225 - protein, 6 aa, Entamoeba invadens
SFNQEK

SEQ ID NO: 2745226 - protein, 7 aa, Entamoeba invadens
SFPNNET

SEQ ID NO: 2745227 - protein, 12 aa, Entamoeba invadens
SFSGTFDQQETV

SEQ ID NO: 2745228 - protein, 6 aa, Entamoeba invadens
SFSKDG

SEQ ID NO: 2745229 - protein, 10 aa, Entamoeba invadens
SGATEIPANT

SEQ ID NO: 2745230 - protein, 6 aa, Entamoeba invadens
SGESSI

SEQ ID NO: 2745231 - protein, 7 aa, Entamoeba invadens
SGFEPYK

SEQ ID NO: 2745232 - protein, 8 aa, Entamoeba invadens
SGITAETP

SEQ ID NO: 2745233 - protein, 8 aa, Entamoeba invadens
SGKGISGN

SEQ ID NO: 2745234 - protein, 4 aa, Entamoeba invadens
SGKR

SEQ ID NO: 2745235 - protein, 13 aa, Entamoeba invadens
SGKRLEKQDNMPT

SEQ ID NO: 2745236 - protein, 6 aa, Entamoeba invadens
SGMGIT

SEQ ID NO: 2745237 - protein, 28 aa, Entamoeba invadens
SGMYPDESTKKCKSCSSTCNGNCNQTSG

SEQ ID NO: 2745238 - protein, 10 aa, Entamoeba invadens
SGMYPSDSTY

SEQ ID NO: 2745239 - protein, 7 aa, Entamoeba invadens
SGPAYNQ

SEQ ID NO: 2745240 - protein, 5 aa, Entamoeba invadens
SGRYL

SEQ ID NO: 2745241 - protein, 4 aa, Entamoeba invadens
SGSD

SEQ ID NO: 2745242 - protein, 4 aa, Entamoeba invadens
SGSF

SEQ ID NO: 2745243 - protein, 6 aa, Entamoeba invadens
SGSKSK

SEQ ID NO: 2745244 - protein, 6 aa, Entamoeba invadens
SGSTTK

SEQ ID NO: 2745245 - protein, 8 aa, Entamoeba invadens
SGSVTSDT

SEQ ID NO: 2745246 - protein, 5 aa, Entamoeba invadens
SGTEN

SEQ ID NO: 2745247 - protein, 30 aa, Entamoeba invadens
SGTMANQTTNNCDTCKAGTYAGEGYSECKS

SEQ ID NO: 2745248 - protein, 4 aa, Entamoeba invadens
SGTQ

SEQ ID NO: 2745249 - protein, 16 aa, Entamoeba invadens
SGTQKVTSVANDAFSG

SEQ ID NO: 2745250 - protein, 6 aa, Entamoeba invadens
SGTYRN

SEQ ID NO: 2745251 - protein, 12 aa, Entamoeba invadens
SGYKQESLVGGG

SEQ ID NO: 2745252 - protein, 4 aa, Entamoeba invadens
SGYT

SEQ ID NO: 2745253 - protein, 8 aa, Entamoeba invadens
SGYYPNQS

SEQ ID NO: 2745254 - protein, 11 aa, Entamoeba invadens
SHAKGKGIDTP

SEQ ID NO: 2745255 - protein, 5 aa, Entamoeba invadens
SHHPP

SEQ ID NO: 2745256 - protein, 9 aa, Entamoeba invadens
SHQDEHGKR

SEQ ID NO: 2745257 - protein, 6 aa, Entamoeba invadens
SIDNSN

SEQ ID NO: 2745258 - protein, 5 aa, Entamoeba invadens
SIEEF

SEQ ID NO: 2745259 - protein, 5 aa, Entamoeba invadens
SINST

SEQ ID NO: 2745260 - protein, 4 aa, Entamoeba invadens
SIPN

SEQ ID NO: 2745261 - protein, 5 aa, Entamoeba invadens
SIRGA

SEQ ID NO: 2745262 - protein, 14 aa, Entamoeba invadens
SIRPLKGAPQGDKG

SEQ ID NO: 2745263 - protein, 6 aa, Entamoeba invadens
SIRTEP

SEQ ID NO: 2745264 - protein, 5 aa, Entamoeba invadens
SISPS

SEQ ID NO: 2745265 - protein, 10 aa, Entamoeba invadens
SKCKQDKTTC

SEQ ID NO: 2745266 - protein, 5 aa, Entamoeba invadens
SKCTE

SEQ ID NO: 2745267 - protein, 12 aa, Entamoeba invadens
SKCTQNSDSEMW

SEQ ID NO: 2745268 - protein, 5 aa, Entamoeba invadens
SKDKR

SEQ ID NO: 2745269 - protein, 16 aa, Entamoeba invadens
SKELDIKNSKIQSDSD

SEQ ID NO: 2745270 - protein, 9 aa, Entamoeba invadens
SKETTENCK

SEQ ID NO: 2745271 - protein, 5 aa, Entamoeba invadens
SKGDG

SEQ ID NO: 2745272 - protein, 9 aa, Entamoeba invadens
SKKMSVDGN

SEQ ID NO: 2745273 - protein, 6 aa, Entamoeba invadens
SKNGMY

SEQ ID NO: 2745274 - protein, 4 aa, Entamoeba invadens
SKNN

SEQ ID NO: 2745275 - protein, 4 aa, Entamoeba invadens
SKNT

SEQ ID NO: 2745276 - protein, 4 aa, Entamoeba invadens
SKPS

SEQ ID NO: 2745277 - protein, 11 aa, Entamoeba invadens
SKQTETEKYTT

SEQ ID NO: 2745278 - protein, 9 aa, Entamoeba invadens
SKRKSNEVN

SEQ ID NO: 2745279 - protein, 5 aa, Entamoeba invadens
SKSQT

SEQ ID NO: 2745280 - protein, 8 aa, Entamoeba invadens
SKTSITEY

SEQ ID NO: 2745281 - protein, 5 aa, Entamoeba invadens
SLATT

SEQ ID NO: 2745282 - protein, 7 aa, Entamoeba invadens
SLDGTYC

SEQ ID NO: 2745283 - protein, 4 aa, Entamoeba invadens
SLEE

SEQ ID NO: 2745284 - protein, 13 aa, Entamoeba invadens
SLEGGDAEEQMKQ

SEQ ID NO: 2745285 - protein, 4 aa, Entamoeba invadens
SLGG

SEQ ID NO: 2745286 - protein, 12 aa, Entamoeba invadens
SLGTSNEGESIC

SEQ ID NO: 2745287 - protein, 11 aa, Entamoeba invadens
SLKDGKENYNE

SEQ ID NO: 2745288 - protein, 9 aa, Entamoeba invadens
SLNDNTNTL

SEQ ID NO: 2745289 - protein, 10 aa, Entamoeba invadens
SLQSGKESFD

SEQ ID NO: 2745290 - protein, 4 aa, Entamoeba invadens
SMID

SEQ ID NO: 2745291 - protein, 4 aa, Entamoeba invadens
SMPA

SEQ ID NO: 2745292 - protein, 8 aa, Entamoeba invadens
SNANDCQE

SEQ ID NO: 2745293 - protein, 11 aa, Entamoeba invadens
SNCESDSSLSL

SEQ ID NO: 2745294 - protein, 12 aa, Entamoeba invadens
SNCKKSNKNFGC

SEQ ID NO: 2745295 - protein, 6 aa, Entamoeba invadens
SNEMTK

SEQ ID NO: 2745296 - protein, 5 aa, Entamoeba invadens
SNETT

SEQ ID NO: 2745297 - protein, 8 aa, Entamoeba invadens
SNKCTSCN

SEQ ID NO: 2745298 - protein, 8 aa, Entamoeba invadens
SNKYPSNK

SEQ ID NO: 2745299 - protein, 5 aa, Entamoeba invadens
SNLTM

SEQ ID NO: 2745300 - protein, 7 aa, Entamoeba invadens
SNNVDTT

SEQ ID NO: 2745301 - protein, 7 aa, Entamoeba invadens
SNRAQGW

SEQ ID NO: 2745302 - protein, 7 aa, Entamoeba invadens
SNSKCNK

SEQ ID NO: 2745303 - protein, 6 aa, Entamoeba invadens
SNSKCT

SEQ ID NO: 2745304 - protein, 5 aa, Entamoeba invadens
SNSNL

SEQ ID NO: 2745305 - protein, 5 aa, Entamoeba invadens
SNSSC

SEQ ID NO: 2745306 - protein, 4 aa, Entamoeba invadens
SNSY

SEQ ID NO: 2745307 - protein, 21 aa, Entamoeba invadens
SNSYVNTRDCPCSKSTGSVFT

SEQ ID NO: 2745308 - protein, 4 aa, Entamoeba invadens
SNTE

SEQ ID NO: 2745309 - protein, 4 aa, Entamoeba invadens
SNVT

SEQ ID NO: 2745310 - protein, 20 aa, Entamoeba invadens
SNYERKCTTCNTGYYPNADG

SEQ ID NO: 2745311 - protein, 8 aa, Entamoeba invadens
SNYERTCT

SEQ ID NO: 2745312 - protein, 12 aa, Entamoeba invadens
SNYIKDDNTTFN

SEQ ID NO: 2745313 - protein, 5 aa, Entamoeba invadens
SPDVN

SEQ ID NO: 2745314 - protein, 6 aa, Entamoeba invadens
SPGCPD

SEQ ID NO: 2745315 - protein, 4 aa, Entamoeba invadens
SPKL

SEQ ID NO: 2745316 - protein, 6 aa, Entamoeba invadens
SPTRPY

SEQ ID NO: 2745317 - protein, 4 aa, Entamoeba invadens
SQAS

SEQ ID NO: 2745318 - protein, 4 aa, Entamoeba invadens
SQCI

SEQ ID NO: 2745319 - protein, 15 aa, Entamoeba invadens
SQCTDGYYKDTTNSV

SEQ ID NO: 2745320 - protein, 6 aa, Entamoeba invadens
SQIDDS

SEQ ID NO: 2745321 - protein, 4 aa, Entamoeba invadens
SQMQ

SEQ ID NO: 2745322 - protein, 4 aa, Entamoeba invadens
SQNE

SEQ ID NO: 2745323 - protein, 4 aa, Entamoeba invadens
SQTE

SEQ ID NO: 2745324 - protein, 21 aa, Entamoeba invadens
SQYLDNNNSCHECQDDQTSGV

SEQ ID NO: 2745325 - protein, 10 aa, Entamoeba invadens
SRCQNSMPND

SEQ ID NO: 2745326 - protein, 5 aa, Entamoeba invadens
SRCTK

SEQ ID NO: 2745327 - protein, 15 aa, Entamoeba invadens
SRDKVNAKLTDFGSA

SEQ ID NO: 2745328 - protein, 9 aa, Entamoeba invadens
SRGSNNDTI

SEQ ID NO: 2745329 - protein, 12 aa, Entamoeba invadens
SRGTYSSSGSAY

SEQ ID NO: 2745330 - protein, 10 aa, Entamoeba invadens
SRLPKPDEMN

SEQ ID NO: 2745331 - protein, 4 aa, Entamoeba invadens
SRSA

SEQ ID NO: 2745332 - protein, 4 aa, Entamoeba invadens
SSAF

SEQ ID NO: 2745333 - protein, 5 aa, Entamoeba invadens
SSAIP

SEQ ID NO: 2745334 - protein, 4 aa, Entamoeba invadens
SSDC

SEQ ID NO: 2745335 - protein, 5 aa, Entamoeba invadens
SSDEL

SEQ ID NO: 2745336 - protein, 7 aa, Entamoeba invadens
SSDGMSC

SEQ ID NO: 2745337 - protein, 5 aa, Entamoeba invadens
SSDSI

SEQ ID NO: 2745338 - protein, 4 aa, Entamoeba invadens
SSDY

SEQ ID NO: 2745339 - protein, 5 aa, Entamoeba invadens
SSDYN

SEQ ID NO: 2745340 - protein, 10 aa, Entamoeba invadens
SSECVSKSQV

SEQ ID NO: 2745341 - protein, 4 aa, Entamoeba invadens
SSEF

SEQ ID NO: 2745342 - protein, 8 aa, Entamoeba invadens
SSEPDASR

SEQ ID NO: 2745343 - protein, 5 aa, Entamoeba invadens
SSEYG

SEQ ID NO: 2745344 - protein, 7 aa, Entamoeba invadens
SSFESTA

SEQ ID NO: 2745345 - protein, 4 aa, Entamoeba invadens
SSFT

SEQ ID NO: 2745346 - protein, 10 aa, Entamoeba invadens
SSGKRPDISD

SEQ ID NO: 2745347 - protein, 12 aa, Entamoeba invadens
SSGKRPDKSETI

SEQ ID NO: 2745348 - protein, 14 aa, Entamoeba invadens
SSGKYPKPSENYKC

SEQ ID NO: 2745349 - protein, 5 aa, Entamoeba invadens
SSGPF

SEQ ID NO: 2745350 - protein, 5 aa, Entamoeba invadens
SSGSC

SEQ ID NO: 2745351 - protein, 9 aa, Entamoeba invadens
SSHSGCTQC

SEQ ID NO: 2745352 - protein, 6 aa, Entamoeba invadens
SSIKRA

SEQ ID NO: 2745353 - protein, 7 aa, Entamoeba invadens
SSINQTT

SEQ ID NO: 2745354 - protein, 6 aa, Entamoeba invadens
SSIPHA

SEQ ID NO: 2745355 - protein, 5 aa, Entamoeba invadens
SSKCT

SEQ ID NO: 2745356 - protein, 13 aa, Entamoeba invadens
SSKEDTEKYSIRT

SEQ ID NO: 2745357 - protein, 7 aa, Entamoeba invadens
SSKTTDI

SEQ ID NO: 2745358 - protein, 9 aa, Entamoeba invadens
SSKYPDEIT

SEQ ID NO: 2745359 - protein, 6 aa, Entamoeba invadens
SSLEMN

SEQ ID NO: 2745360 - protein, 7 aa, Entamoeba invadens
SSNAEST

SEQ ID NO: 2745361 - protein, 7 aa, Entamoeba invadens
SSNEGGE

SEQ ID NO: 2745362 - protein, 8 aa, Entamoeba invadens
SSNQTENC

SEQ ID NO: 2745363 - protein, 7 aa, Entamoeba invadens
SSPSCSF

SEQ ID NO: 2745364 - protein, 8 aa, Entamoeba invadens
SSQISTNS

SEQ ID NO: 2745365 - protein, 9 aa, Entamoeba invadens
SSQRSCESC

SEQ ID NO: 2745366 - protein, 5 aa, Entamoeba invadens
SSQTQ

SEQ ID NO: 2745367 - protein, 9 aa, Entamoeba invadens
SSSCKDGEI

SEQ ID NO: 2745368 - protein, 7 aa, Entamoeba invadens
SSSFTTS

SEQ ID NO: 2745369 - protein, 5 aa, Entamoeba invadens
SSSKC

SEQ ID NO: 2745370 - protein, 9 aa, Entamoeba invadens
SSSSCNKCN

SEQ ID NO: 2745371 - protein, 7 aa, Entamoeba invadens
SSSYSDV

SEQ ID NO: 2745372 - protein, 4 aa, Entamoeba invadens
SSTL

SEQ ID NO: 2745373 - protein, 4 aa, Entamoeba invadens
SSTQ

SEQ ID NO: 2745374 - protein, 5 aa, Entamoeba invadens
SSTSK

SEQ ID NO: 2745375 - protein, 4 aa, Entamoeba invadens
SSTV

SEQ ID NO: 2745376 - protein, 5 aa, Entamoeba invadens
SSVTS

SEQ ID NO: 2745377 - protein, 17 aa, Entamoeba invadens
STCGGKCDPTDGHCTGC

SEQ ID NO: 2745378 - protein, 6 aa, Entamoeba invadens
STCNTK

SEQ ID NO: 2745379 - protein, 7 aa, Entamoeba invadens
STCNTKD

SEQ ID NO: 2745380 - protein, 7 aa, Entamoeba invadens
STCNTNS

SEQ ID NO: 2745381 - protein, 6 aa, Entamoeba invadens
STESTK

SEQ ID NO: 2745382 - protein, 8 aa, Entamoeba invadens
STGGKSVC

SEQ ID NO: 2745383 - protein, 4 aa, Entamoeba invadens
STGY

SEQ ID NO: 2745384 - protein, 8 aa, Entamoeba invadens
STIEATNN

SEQ ID NO: 2745385 - protein, 17 aa, Entamoeba invadens
STKENTAKYTIKTEPKV

SEQ ID NO: 2745386 - protein, 4 aa, Entamoeba invadens
STKG

SEQ ID NO: 2745387 - protein, 4 aa, Entamoeba invadens
STKL

SEQ ID NO: 2745388 - protein, 6 aa, Entamoeba invadens
STKLNH

SEQ ID NO: 2745389 - protein, 7 aa, Entamoeba invadens
STKSRVC

SEQ ID NO: 2745390 - protein, 25 aa, Entamoeba invadens
STKVTRSKGDVYDSKAGAIAEETLG

SEQ ID NO: 2745391 - protein, 16 aa, Entamoeba invadens
STLKTNSGTSMSSKAT

SEQ ID NO: 2745392 - protein, 6 aa, Entamoeba invadens
STNENG

SEQ ID NO: 2745393 - protein, 5 aa, Entamoeba invadens
STNKF

SEQ ID NO: 2745394 - protein, 6 aa, Entamoeba invadens
STNSKS

SEQ ID NO: 2745395 - protein, 13 aa, Entamoeba invadens
STNYKTNGGDCLP

SEQ ID NO: 2745396 - protein, 14 aa, Entamoeba invadens
STNYKTNGGDCLPQ

SEQ ID NO: 2745397 - protein, 17 aa, Entamoeba invadens
STNYKTWSGDCKSQSSL

SEQ ID NO: 2745398 - protein, 4 aa, Entamoeba invadens
STPL

SEQ ID NO: 2745399 - protein, 6 aa, Entamoeba invadens
STPSGC

SEQ ID NO: 2745400 - protein, 12 aa, Entamoeba invadens
STQQKKVGNSRG

SEQ ID NO: 2745401 - protein, 19 aa, Entamoeba invadens
STRLDPDELKEDKKLGEGS

SEQ ID NO: 2745402 - protein, 7 aa, Entamoeba invadens
STSNSDV

SEQ ID NO: 2745403 - protein, 5 aa, Entamoeba invadens
STTHT

SEQ ID NO: 2745404 - protein, 4 aa, Entamoeba invadens
STTS

SEQ ID NO: 2745405 - protein, 5 aa, Entamoeba invadens
STYQR

SEQ ID NO: 2745406 - protein, 8 aa, Entamoeba invadens
SVDNNNNV

SEQ ID NO: 2745407 - protein, 5 aa, Entamoeba invadens
SVGTP

SEQ ID NO: 2745408 - protein, 8 aa, Entamoeba invadens
SVKAETAA

SEQ ID NO: 2745409 - protein, 9 aa, Entamoeba invadens
SVNSPEIIK

SEQ ID NO: 2745410 - protein, 4 aa, Entamoeba invadens
SVSD

SEQ ID NO: 2745411 - protein, 8 aa, Entamoeba invadens
SVSGSNQH

SEQ ID NO: 2745412 - protein, 10 aa, Entamoeba invadens
SVSPDKTTTR

SEQ ID NO: 2745413 - protein, 8 aa, Entamoeba invadens
SVSSTRSF

SEQ ID NO: 2745414 - protein, 6 aa, Entamoeba invadens
SWLPPE

SEQ ID NO: 2745415 - protein, 7 aa, Entamoeba invadens
SYLSSGN

SEQ ID NO: 2745416 - protein, 10 aa, Entamoeba invadens
SYPSRPEKTI

SEQ ID NO: 2745417 - protein, 4 aa, Entamoeba invadens
SYRK

SEQ ID NO: 2745418 - protein, 8 aa, Entamoeba invadens
SYSSSGDC

SEQ ID NO: 2745419 - protein, 7 aa, Entamoeba invadens
SYVQSNT

SEQ ID NO: 2745420 - protein, 9 aa, Entamoeba invadens
TACTQCKDG

SEQ ID NO: 2745421 - protein, 20 aa, Entamoeba invadens
TADIKNSTLKMSGNSRITSE

SEQ ID NO: 2745422 - protein, 5 aa, Entamoeba invadens
TADVS

SEQ ID NO: 2745423 - protein, 6 aa, Entamoeba invadens
TAFSKE

SEQ ID NO: 2745424 - protein, 15 aa, Entamoeba invadens
TAGTDIELQKNSTTN

SEQ ID NO: 2745425 - protein, 18 aa, Entamoeba invadens
TAHENCSSCSVDGNCTEC

SEQ ID NO: 2745426 - protein, 9 aa, Entamoeba invadens
TAKNEYTIP

SEQ ID NO: 2745427 - protein, 10 aa, Entamoeba invadens
TAKYPDETSH

SEQ ID NO: 2745428 - protein, 9 aa, Entamoeba invadens
TAMDKATKN

SEQ ID NO: 2745429 - protein, 11 aa, Entamoeba invadens
TAQTKNSTRLD

SEQ ID NO: 2745430 - protein, 15 aa, Entamoeba invadens
TATSKLTTRLDPDEL

SEQ ID NO: 2745431 - protein, 9 aa, Entamoeba invadens
TCAAGERQC

SEQ ID NO: 2745432 - protein, 9 aa, Entamoeba invadens
TCAEGKTDV

SEQ ID NO: 2745433 - protein, 8 aa, Entamoeba invadens
TCAENNNE

SEQ ID NO: 2745434 - protein, 14 aa, Entamoeba invadens
TCASTGCNTQTGAC

SEQ ID NO: 2745435 - protein, 9 aa, Entamoeba invadens
TCDGDGKPD

SEQ ID NO: 2745436 - protein, 15 aa, Entamoeba invadens
TCDKTKYSCKTCNSK

SEQ ID NO: 2745437 - protein, 17 aa, Entamoeba invadens
TCEGGSPTYKESLEAGT

SEQ ID NO: 2745438 - protein, 12 aa, Entamoeba invadens
TCGGKCGGTTGM

SEQ ID NO: 2745439 - protein, 16 aa, Entamoeba invadens
TCGGNCDPTDGHCTGC

SEQ ID NO: 2745440 - protein, 6 aa, Entamoeba invadens
TCNNRE

SEQ ID NO: 2745441 - protein, 6 aa, Entamoeba invadens
TCNNYT

SEQ ID NO: 2745442 - protein, 4 aa, Entamoeba invadens
TCNQ

SEQ ID NO: 2745443 - protein, 10 aa, Entamoeba invadens
TCQSCSNTLT

SEQ ID NO: 2745444 - protein, 4 aa, Entamoeba invadens
TCSN

SEQ ID NO: 2745445 - protein, 19 aa, Entamoeba invadens
TCSPTCGGKCDGVSGQCTG

SEQ ID NO: 2745446 - protein, 11 aa, Entamoeba invadens
TCSSATGKCSA

SEQ ID NO: 2745447 - protein, 8 aa, Entamoeba invadens
TCSTDSTR

SEQ ID NO: 2745448 - protein, 7 aa, Entamoeba invadens
TCSTKTV

SEQ ID NO: 2745449 - protein, 7 aa, Entamoeba invadens
TCTKAND

SEQ ID NO: 2745450 - protein, 6 aa, Entamoeba invadens
TCTKCS

SEQ ID NO: 2745451 - protein, 7 aa, Entamoeba invadens
TCTNDGT

SEQ ID NO: 2745452 - protein, 7 aa, Entamoeba invadens
TCTPQVE

SEQ ID NO: 2745453 - protein, 4 aa, Entamoeba invadens
TCTQ

SEQ ID NO: 2745454 - protein, 4 aa, Entamoeba invadens
TCTS

SEQ ID NO: 2745455 - protein, 9 aa, Entamoeba invadens
TCVEGKTDI

SEQ ID NO: 2745456 - protein, 6 aa, Entamoeba invadens
TDFGAS

SEQ ID NO: 2745457 - protein, 8 aa, Entamoeba invadens
TDFGASRN

SEQ ID NO: 2745458 - protein, 5 aa, Entamoeba invadens
TDGGV

SEQ ID NO: 2745459 - protein, 4 aa, Entamoeba invadens
TDGK

SEQ ID NO: 2745460 - protein, 4 aa, Entamoeba invadens
TDSN

SEQ ID NO: 2745461 - protein, 4 aa, Entamoeba invadens
TDSQ

SEQ ID NO: 2745462 - protein, 6 aa, Entamoeba invadens
TDVTSF

SEQ ID NO: 2745463 - protein, 4 aa, Entamoeba invadens
TECE

SEQ ID NO: 2745464 - protein, 5 aa, Entamoeba invadens
TEDKT

SEQ ID NO: 2745465 - protein, 20 aa, Entamoeba invadens
TEDSTTPGGSVKTQLKSGTF

SEQ ID NO: 2745466 - protein, 10 aa, Entamoeba invadens
TEERGTEKGD

SEQ ID NO: 2745467 - protein, 8 aa, Entamoeba invadens
TEGSQPIV

SEQ ID NO: 2745468 - protein, 4 aa, Entamoeba invadens
TEIP

SEQ ID NO: 2745469 - protein, 22 aa, Entamoeba invadens
TENSTKLDYDELKEDKKLGEGS

SEQ ID NO: 2745470 - protein, 5 aa, Entamoeba invadens
TEPEK

SEQ ID NO: 2745471 - protein, 5 aa, Entamoeba invadens
TESGC

SEQ ID NO: 2745472 - protein, 20 aa, Entamoeba invadens
TESGCSTCKDGYYTVNGNEC

SEQ ID NO: 2745473 - protein, 4 aa, Entamoeba invadens
TETN

SEQ ID NO: 2745474 - protein, 18 aa, Entamoeba invadens
TFDEDDKLKTSSKTVTET

SEQ ID NO: 2745475 - protein, 6 aa, Entamoeba invadens
TFGGTE

SEQ ID NO: 2745476 - protein, 10 aa, Entamoeba invadens
TGDGTNDVPA

SEQ ID NO: 2745477 - protein, 6 aa, Entamoeba invadens
TGEKTQ

SEQ ID NO: 2745478 - protein, 4 aa, Entamoeba invadens
TGEM

SEQ ID NO: 2745479 - protein, 10 aa, Entamoeba invadens
TGGNRLNKSE

SEQ ID NO: 2745480 - protein, 9 aa, Entamoeba invadens
TGGNTYTKY

SEQ ID NO: 2745481 - protein, 8 aa, Entamoeba invadens
TGGSTGNW

SEQ ID NO: 2745482 - protein, 20 aa, Entamoeba invadens
TGKITSNGKCDTSENACGSG

SEQ ID NO: 2745483 - protein, 9 aa, Entamoeba invadens
TGTEAVTSV

SEQ ID NO: 2745484 - protein, 13 aa, Entamoeba invadens
TGTYANSTNNKCQ

SEQ ID NO: 2745485 - protein, 5 aa, Entamoeba invadens
TGVQY

SEQ ID NO: 2745486 - protein, 9 aa, Entamoeba invadens
TGYSSTTNG

SEQ ID NO: 2745487 - protein, 6 aa, Entamoeba invadens
THNKST

SEQ ID NO: 2745488 - protein, 7 aa, Entamoeba invadens
THSGQCT

SEQ ID NO: 2745489 - protein, 6 aa, Entamoeba invadens
TIENSM

SEQ ID NO: 2745490 - protein, 10 aa, Entamoeba invadens
TIGKDDPTIT

SEQ ID NO: 2745491 - protein, 30 aa, Entamoeba invadens
TINENNHTCGKCQPDCKTCTDGTKCTSCPE

SEQ ID NO: 2745492 - protein, 6 aa, Entamoeba invadens
TINNSN

SEQ ID NO: 2745493 - protein, 6 aa, Entamoeba invadens
TINTPV

SEQ ID NO: 2745494 - protein, 6 aa, Entamoeba invadens
TIPKST

SEQ ID NO: 2745495 - protein, 5 aa, Entamoeba invadens
TIQGA

SEQ ID NO: 2745496 - protein, 5 aa, Entamoeba invadens
TISPT

SEQ ID NO: 2745497 - protein, 5 aa, Entamoeba invadens
TKCED

SEQ ID NO: 2745498 - protein, 4 aa, Entamoeba invadens
TKCN

SEQ ID NO: 2745499 - protein, 11 aa, Entamoeba invadens
TKCSPNNRNAN

SEQ ID NO: 2745500 - protein, 15 aa, Entamoeba invadens
TKCTSGMYPSTTSPF

SEQ ID NO: 2745501 - protein, 9 aa, Entamoeba invadens
TKDHEGKYE

SEQ ID NO: 2745502 - protein, 55 aa, Entamoeba invadens
TKEENETKEISTPNSTSPLSKENKSDQNSSESSEVEMPEDVQTTRKNKGKNVGHS

SEQ ID NO: 2745503 - protein, 5 aa, Entamoeba invadens
TKERT

SEQ ID NO: 2745504 - protein, 6 aa, Entamoeba invadens
TKGATI

SEQ ID NO: 2745505 - protein, 6 aa, Entamoeba invadens
TKGDGK

SEQ ID NO: 2745506 - protein, 6 aa, Entamoeba invadens
TKGGYY

SEQ ID NO: 2745507 - protein, 8 aa, Entamoeba invadens
TKGMSKKT

SEQ ID NO: 2745508 - protein, 7 aa, Entamoeba invadens
TKIGEGG

SEQ ID NO: 2745509 - protein, 9 aa, Entamoeba invadens
TKKCSKTNC

SEQ ID NO: 2745510 - protein, 4 aa, Entamoeba invadens
TKKQ

SEQ ID NO: 2745511 - protein, 8 aa, Entamoeba invadens
TKKQNRVT

SEQ ID NO: 2745512 - protein, 7 aa, Entamoeba invadens
TKKYAKA

SEQ ID NO: 2745513 - protein, 5 aa, Entamoeba invadens
TKNGC

SEQ ID NO: 2745514 - protein, 6 aa, Entamoeba invadens
TKNGCV

SEQ ID NO: 2745515 - protein, 4 aa, Entamoeba invadens
TKQC

SEQ ID NO: 2745516 - protein, 9 aa, Entamoeba invadens
TKRVEQSKR

SEQ ID NO: 2745517 - protein, 7 aa, Entamoeba invadens
TKSATIE

SEQ ID NO: 2745518 - protein, 16 aa, Entamoeba invadens
TKTETEMSTRLDPDEL

SEQ ID NO: 2745519 - protein, 4 aa, Entamoeba invadens
TLKI

SEQ ID NO: 2745520 - protein, 8 aa, Entamoeba invadens
TLKRETCS

SEQ ID NO: 2745521 - protein, 5 aa, Entamoeba invadens
TLNGN

SEQ ID NO: 2745522 - protein, 12 aa, Entamoeba invadens
TLNNCTKSTSEG

SEQ ID NO: 2745523 - protein, 7 aa, Entamoeba invadens
TLNNEGK

SEQ ID NO: 2745524 - protein, 7 aa, Entamoeba invadens
TLPAGGG

SEQ ID NO: 2745525 - protein, 28 aa, Entamoeba invadens
TLPNETTKQTTKNVDTQTDSHCEVSTTK

SEQ ID NO: 2745526 - protein, 9 aa, Entamoeba invadens
TLPSPLTTS

SEQ ID NO: 2745527 - protein, 4 aa, Entamoeba invadens
TLPT

SEQ ID NO: 2745528 - protein, 4 aa, Entamoeba invadens
TNAE

SEQ ID NO: 2745529 - protein, 5 aa, Entamoeba invadens
TNAGD

SEQ ID NO: 2745530 - protein, 9 aa, Entamoeba invadens
TNCDTKTPI

SEQ ID NO: 2745531 - protein, 16 aa, Entamoeba invadens
TNCDTSCKSCDNTNGN

SEQ ID NO: 2745532 - protein, 4 aa, Entamoeba invadens
TNCE

SEQ ID NO: 2745533 - protein, 9 aa, Entamoeba invadens
TNCEDKSVR

SEQ ID NO: 2745534 - protein, 9 aa, Entamoeba invadens
TNCETKTPI

SEQ ID NO: 2745535 - protein, 10 aa, Entamoeba invadens
TNDHQSHTNM

SEQ ID NO: 2745536 - protein, 6 aa, Entamoeba invadens
TNECPD

SEQ ID NO: 2745537 - protein, 8 aa, Entamoeba invadens
TNHKPSSD

SEQ ID NO: 2745538 - protein, 8 aa, Entamoeba invadens
TNINNDNN

SEQ ID NO: 2745539 - protein, 6 aa, Entamoeba invadens
TNKGCQ

SEQ ID NO: 2745540 - protein, 4 aa, Entamoeba invadens
TNKN

SEQ ID NO: 2745541 - protein, 6 aa, Entamoeba invadens
TNKPNL

SEQ ID NO: 2745542 - protein, 4 aa, Entamoeba invadens
TNKT

SEQ ID NO: 2745543 - protein, 11 aa, Entamoeba invadens
TNNCNTPSTIS

SEQ ID NO: 2745544 - protein, 8 aa, Entamoeba invadens
TNNSNYYY

SEQ ID NO: 2745545 - protein, 5 aa, Entamoeba invadens
TNNTR

SEQ ID NO: 2745546 - protein, 9 aa, Entamoeba invadens
TNPEETTSC

SEQ ID NO: 2745547 - protein, 21 aa, Entamoeba invadens
TNQCNVEKRTRVKIGTDAARG

SEQ ID NO: 2745548 - protein, 10 aa, Entamoeba invadens
TNQISAKGTP

SEQ ID NO: 2745549 - protein, 5 aa, Entamoeba invadens
TNQLD

SEQ ID NO: 2745550 - protein, 8 aa, Entamoeba invadens
TNSDNTSC

SEQ ID NO: 2745551 - protein, 6 aa, Entamoeba invadens
TNSKCS

SEQ ID NO: 2745552 - protein, 8 aa, Entamoeba invadens
TNSYSNKT

SEQ ID NO: 2745553 - protein, 4 aa, Entamoeba invadens
TNTN

SEQ ID NO: 2745554 - protein, 10 aa, Entamoeba invadens
TNVPDSTFKG

SEQ ID NO: 2745555 - protein, 10 aa, Entamoeba invadens
TNVTGQDATR

SEQ ID NO: 2745556 - protein, 13 aa, Entamoeba invadens
TNYKTTSGKCLPQ

SEQ ID NO: 2745557 - protein, 5 aa, Entamoeba invadens
TNYSR

SEQ ID NO: 2745558 - protein, 10 aa, Entamoeba invadens
TPEIDSTMPS

SEQ ID NO: 2745559 - protein, 4 aa, Entamoeba invadens
TPHT

SEQ ID NO: 2745560 - protein, 6 aa, Entamoeba invadens
TPNSKL

SEQ ID NO: 2745561 - protein, 4 aa, Entamoeba invadens
TPPT

SEQ ID NO: 2745562 - protein, 5 aa, Entamoeba invadens
TPQDP

SEQ ID NO: 2745563 - protein, 7 aa, Entamoeba invadens
TPQTVND

SEQ ID NO: 2745564 - protein, 5 aa, Entamoeba invadens
TPRPD

SEQ ID NO: 2745565 - protein, 10 aa, Entamoeba invadens
TQCKEGYSLT

SEQ ID NO: 2745566 - protein, 6 aa, Entamoeba invadens
TQETTF

SEQ ID NO: 2745567 - protein, 7 aa, Entamoeba invadens
TQGKGNM

SEQ ID NO: 2745568 - protein, 12 aa, Entamoeba invadens
TQNGCSKCQDGY

SEQ ID NO: 2745569 - protein, 10 aa, Entamoeba invadens
TQNGCSKCQN

SEQ ID NO: 2745570 - protein, 4 aa, Entamoeba invadens
TQNT

SEQ ID NO: 2745571 - protein, 8 aa, Entamoeba invadens
TQNTKCQS

SEQ ID NO: 2745572 - protein, 5 aa, Entamoeba invadens
TQQPS

SEQ ID NO: 2745573 - protein, 7 aa, Entamoeba invadens
TQSCERC

SEQ ID NO: 2745574 - protein, 6 aa, Entamoeba invadens
TQSGCS

SEQ ID NO: 2745575 - protein, 11 aa, Entamoeba invadens
TQSGCSKCGDG

SEQ ID NO: 2745576 - protein, 9 aa, Entamoeba invadens
TQSGCSKCQ

SEQ ID NO: 2745577 - protein, 10 aa, Entamoeba invadens
TQSGCSKCQD

SEQ ID NO: 2745578 - protein, 19 aa, Entamoeba invadens
TQSQNYIPQNSYPIPPQNA

SEQ ID NO: 2745579 - protein, 4 aa, Entamoeba invadens
TQSS

SEQ ID NO: 2745580 - protein, 15 aa, Entamoeba invadens
TQTLTNQKYQIESNP

SEQ ID NO: 2745581 - protein, 15 aa, Entamoeba invadens
TRALSGKQSRYSITP

SEQ ID NO: 2745582 - protein, 5 aa, Entamoeba invadens
TRDDN

SEQ ID NO: 2745583 - protein, 9 aa, Entamoeba invadens
TRDYEGKYE

SEQ ID NO: 2745584 - protein, 6 aa, Entamoeba invadens
TRENCD

SEQ ID NO: 2745585 - protein, 8 aa, Entamoeba invadens
TRLDPDEL

SEQ ID NO: 2745586 - protein, 8 aa, Entamoeba invadens
TRLDPDSL

SEQ ID NO: 2745587 - protein, 6 aa, Entamoeba invadens
TRMGSS

SEQ ID NO: 2745588 - protein, 4 aa, Entamoeba invadens
TRPE

SEQ ID NO: 2745589 - protein, 12 aa, Entamoeba invadens
TSALDSESEKIV

SEQ ID NO: 2745590 - protein, 11 aa, Entamoeba invadens
TSALDTASEEI

SEQ ID NO: 2745591 - protein, 11 aa, Entamoeba invadens
TSALDTESERV

SEQ ID NO: 2745592 - protein, 25 aa, Entamoeba invadens
TSALDTQSEKEVQNALENAAKGRTT

SEQ ID NO: 2745593 - protein, 6 aa, Entamoeba invadens
TSATPV

SEQ ID NO: 2745594 - protein, 7 aa, Entamoeba invadens
TSCNEGT

SEQ ID NO: 2745595 - protein, 16 aa, Entamoeba invadens
TSDASGTKTREETREI

SEQ ID NO: 2745596 - protein, 7 aa, Entamoeba invadens
TSDGTSC

SEQ ID NO: 2745597 - protein, 7 aa, Entamoeba invadens
TSDSTTC

SEQ ID NO: 2745598 - protein, 8 aa, Entamoeba invadens
TSFDETDA

SEQ ID NO: 2745599 - protein, 6 aa, Entamoeba invadens
TSGKCV

SEQ ID NO: 2745600 - protein, 18 aa, Entamoeba invadens
TSHLSKNKINKKYNVSKD

SEQ ID NO: 2745601 - protein, 6 aa, Entamoeba invadens
TSIGDT

SEQ ID NO: 2745602 - protein, 9 aa, Entamoeba invadens
TSIGSSGQI

SEQ ID NO: 2745603 - protein, 9 aa, Entamoeba invadens
TSITTSGTS

SEQ ID NO: 2745604 - protein, 7 aa, Entamoeba invadens
TSKNDIE

SEQ ID NO: 2745605 - protein, 20 aa, Entamoeba invadens
TSKNPRKKFGKAEDEVSAAK

SEQ ID NO: 2745606 - protein, 8 aa, Entamoeba invadens
TSKSDIEK

SEQ ID NO: 2745607 - protein, 22 aa, Entamoeba invadens
TSLSNGKCTSCSEGTYQDKTGQ

SEQ ID NO: 2745608 - protein, 5 aa, Entamoeba invadens
TSNFE

SEQ ID NO: 2745609 - protein, 23 aa, Entamoeba invadens
TSNFNTNGKPKVTLNGSSKLIAS

SEQ ID NO: 2745610 - protein, 11 aa, Entamoeba invadens
TSNGNCANTTN

SEQ ID NO: 2745611 - protein, 4 aa, Entamoeba invadens
TSNN

SEQ ID NO: 2745612 - protein, 7 aa, Entamoeba invadens
TSPDDPF

SEQ ID NO: 2745613 - protein, 6 aa, Entamoeba invadens
TSPICT

SEQ ID NO: 2745614 - protein, 7 aa, Entamoeba invadens
TSPLGES

SEQ ID NO: 2745615 - protein, 10 aa, Entamoeba invadens
TSPTSKTCQR

SEQ ID NO: 2745616 - protein, 5 aa, Entamoeba invadens
TSPYT

SEQ ID NO: 2745617 - protein, 6 aa, Entamoeba invadens
TSQCTK

SEQ ID NO: 2745618 - protein, 5 aa, Entamoeba invadens
TSSIG

SEQ ID NO: 2745619 - protein, 4 aa, Entamoeba invadens
TSSN

SEQ ID NO: 2745620 - protein, 4 aa, Entamoeba invadens
TSSV

SEQ ID NO: 2745621 - protein, 4 aa, Entamoeba invadens
TSTG

SEQ ID NO: 2745622 - protein, 8 aa, Entamoeba invadens
TTATTATI

SEQ ID NO: 2745623 - protein, 17 aa, Entamoeba invadens
TTCGGSCDQTDGHCTSC

SEQ ID NO: 2745624 - protein, 14 aa, Entamoeba invadens
TTCGTGKYGTPPDC

SEQ ID NO: 2745625 - protein, 13 aa, Entamoeba invadens
TTCNNKCNTSNGM

SEQ ID NO: 2745626 - protein, 11 aa, Entamoeba invadens
TTCPQSCGENG

SEQ ID NO: 2745627 - protein, 18 aa, Entamoeba invadens
TTCSSDNLQPDKTGCKAT

SEQ ID NO: 2745628 - protein, 15 aa, Entamoeba invadens
TTCTTGKYPNPSSPF

SEQ ID NO: 2745629 - protein, 8 aa, Entamoeba invadens
TTEKCDKT

SEQ ID NO: 2745630 - protein, 28 aa, Entamoeba invadens
TTEMNSNKSCENKNCSIPNDQNGRCSSP

SEQ ID NO: 2745631 - protein, 9 aa, Entamoeba invadens
TTENSTKLD

SEQ ID NO: 2745632 - protein, 6 aa, Entamoeba invadens
TTESGC

SEQ ID NO: 2745633 - protein, 7 aa, Entamoeba invadens
TTESTKC

SEQ ID NO: 2745634 - protein, 6 aa, Entamoeba invadens
TTGCTQ

SEQ ID NO: 2745635 - protein, 10 aa, Entamoeba invadens
TTGKQNTTSI

SEQ ID NO: 2745636 - protein, 4 aa, Entamoeba invadens
TTGT

SEQ ID NO: 2745637 - protein, 15 aa, Entamoeba invadens
TTHYNYEESKEDVND

SEQ ID NO: 2745638 - protein, 6 aa, Entamoeba invadens
TTIPSG

SEQ ID NO: 2745639 - protein, 14 aa, Entamoeba invadens
TTITSDGKCYSTGS

SEQ ID NO: 2745640 - protein, 13 aa, Entamoeba invadens
TTITSNGKCYSTD

SEQ ID NO: 2745641 - protein, 16 aa, Entamoeba invadens
TTKDKCDKYKIRTEPQ

SEQ ID NO: 2745642 - protein, 15 aa, Entamoeba invadens
TTKDKCDKYTIRTEP

SEQ ID NO: 2745643 - protein, 4 aa, Entamoeba invadens
TTKE

SEQ ID NO: 2745644 - protein, 4 aa, Entamoeba invadens
TTKI

SEQ ID NO: 2745645 - protein, 6 aa, Entamoeba invadens
TTKMST

SEQ ID NO: 2745646 - protein, 6 aa, Entamoeba invadens
TTKMTT

SEQ ID NO: 2745647 - protein, 18 aa, Entamoeba invadens
TTKNTKIIKTNSENEDVS

SEQ ID NO: 2745648 - protein, 9 aa, Entamoeba invadens
TTKTNTTIN

SEQ ID NO: 2745649 - protein, 7 aa, Entamoeba invadens
TTKYNTK

SEQ ID NO: 2745650 - protein, 6 aa, Entamoeba invadens
TTNDYK

SEQ ID NO: 2745651 - protein, 5 aa, Entamoeba invadens
TTNKN

SEQ ID NO: 2745652 - protein, 4 aa, Entamoeba invadens
TTNN

SEQ ID NO: 2745653 - protein, 4 aa, Entamoeba invadens
TTNS

SEQ ID NO: 2745654 - protein, 7 aa, Entamoeba invadens
TTNTRRN

SEQ ID NO: 2745655 - protein, 4 aa, Entamoeba invadens
TTPF

SEQ ID NO: 2745656 - protein, 5 aa, Entamoeba invadens
TTPIE

SEQ ID NO: 2745657 - protein, 5 aa, Entamoeba invadens
TTPTT

SEQ ID NO: 2745658 - protein, 8 aa, Entamoeba invadens
TTRCHSPS

SEQ ID NO: 2745659 - protein, 4 aa, Entamoeba invadens
TTSL

SEQ ID NO: 2745660 - protein, 15 aa, Entamoeba invadens
TTSNQCVTDENCQTA

SEQ ID NO: 2745661 - protein, 4 aa, Entamoeba invadens
TTSQ

SEQ ID NO: 2745662 - protein, 4 aa, Entamoeba invadens
TTSS

SEQ ID NO: 2745663 - protein, 4 aa, Entamoeba invadens
TTTV

SEQ ID NO: 2745664 - protein, 7 aa, Entamoeba invadens
TVNGNEC

SEQ ID NO: 2745665 - protein, 4 aa, Entamoeba invadens
TVRN

SEQ ID NO: 2745666 - protein, 8 aa, Entamoeba invadens
TYQKDEKE

SEQ ID NO: 2745667 - protein, 4 aa, Entamoeba invadens
TYRE

SEQ ID NO: 2745668 - protein, 6 aa, Entamoeba invadens
TYTSQT

SEQ ID NO: 2745669 - protein, 9 aa, Entamoeba invadens
TYYTSTADN

SEQ ID NO: 2745670 - protein, 8 aa, Entamoeba invadens
VAKTTSMS

SEQ ID NO: 2745671 - protein, 6 aa, Entamoeba invadens
VDEESR

SEQ ID NO: 2745672 - protein, 17 aa, Entamoeba invadens
VDFNSENDEIPVNTESR

SEQ ID NO: 2745673 - protein, 4 aa, Entamoeba invadens
VDGN

SEQ ID NO: 2745674 - protein, 10 aa, Entamoeba invadens
VDTEQSTKLN

SEQ ID NO: 2745675 - protein, 7 aa, Entamoeba invadens
VDTTTCS

SEQ ID NO: 2745676 - protein, 20 aa, Entamoeba invadens
VDVSDDSSANEKESKEAAPS

SEQ ID NO: 2745677 - protein, 8 aa, Entamoeba invadens
VEKGTHNE

SEQ ID NO: 2745678 - protein, 8 aa, Entamoeba invadens
VENVEGTS

SEQ ID NO: 2745679 - protein, 15 aa, Entamoeba invadens
VEPSTPVSIKKGRAV

SEQ ID NO: 2745680 - protein, 10 aa, Entamoeba invadens
VEPTEESTAV

SEQ ID NO: 2745681 - protein, 8 aa, Entamoeba invadens
VEQDNKST

SEQ ID NO: 2745682 - protein, 6 aa, Entamoeba invadens
VESGKR

SEQ ID NO: 2745683 - protein, 9 aa, Entamoeba invadens
VESRSSKCT

SEQ ID NO: 2745684 - protein, 7 aa, Entamoeba invadens
VFEDSPS

SEQ ID NO: 2745685 - protein, 15 aa, Entamoeba invadens
VGDRGSQLSGGQKQR

SEQ ID NO: 2745686 - protein, 15 aa, Entamoeba invadens
VGERGAQLSGGQKQR

SEQ ID NO: 2745687 - protein, 7 aa, Entamoeba invadens
VGGGKSS

SEQ ID NO: 2745688 - protein, 6 aa, Entamoeba invadens
VGHSKC

SEQ ID NO: 2745689 - protein, 4 aa, Entamoeba invadens
VGNI

SEQ ID NO: 2745690 - protein, 11 aa, Entamoeba invadens
VGTYKKTETTC

SEQ ID NO: 2745691 - protein, 7 aa, Entamoeba invadens
VIPPGTL

SEQ ID NO: 2745692 - protein, 7 aa, Entamoeba invadens
VKQSGAA

SEQ ID NO: 2745693 - protein, 11 aa, Entamoeba invadens
VKRTTKNTRDG

SEQ ID NO: 2745694 - protein, 4 aa, Entamoeba invadens
VKTI

SEQ ID NO: 2745695 - protein, 5 aa, Entamoeba invadens
VLSSN

SEQ ID NO: 2745696 - protein, 5 aa, Entamoeba invadens
VMTNK

SEQ ID NO: 2745697 - protein, 5 aa, Entamoeba invadens
VNEKQ

SEQ ID NO: 2745698 - protein, 6 aa, Entamoeba invadens
VNETER

SEQ ID NO: 2745699 - protein, 11 aa, Entamoeba invadens
VNETNGTPYET

SEQ ID NO: 2745700 - protein, 7 aa, Entamoeba invadens
VNNNTVD

SEQ ID NO: 2745701 - protein, 9 aa, Entamoeba invadens
VNNTGCTEC

SEQ ID NO: 2745702 - protein, 7 aa, Entamoeba invadens
VNPGESV

SEQ ID NO: 2745703 - protein, 27 aa, Entamoeba invadens
VNQKNTLKANQRNTLKANQKKSHQLKR

SEQ ID NO: 2745704 - protein, 14 aa, Entamoeba invadens
VNTEGTQCDKKTNY

SEQ ID NO: 2745705 - protein, 9 aa, Entamoeba invadens
VPSASDTKL

SEQ ID NO: 2745706 - protein, 9 aa, Entamoeba invadens
VPSETEPEL

SEQ ID NO: 2745707 - protein, 4 aa, Entamoeba invadens
VPTK

SEQ ID NO: 2745708 - protein, 8 aa, Entamoeba invadens
VQDPPTAT

SEQ ID NO: 2745709 - protein, 12 aa, Entamoeba invadens
VQFESENKSTKT

SEQ ID NO: 2745710 - protein, 5 aa, Entamoeba invadens
VQKDS

SEQ ID NO: 2745711 - protein, 8 aa, Entamoeba invadens
VQNGELPL

SEQ ID NO: 2745712 - protein, 9 aa, Entamoeba invadens
VQNSSSTPL

SEQ ID NO: 2745713 - protein, 5 aa, Entamoeba invadens
VQSLG

SEQ ID NO: 2745714 - protein, 17 aa, Entamoeba invadens
VQYTESCSSSKSSCGSF

SEQ ID NO: 2745715 - protein, 7 aa, Entamoeba invadens
VSDSKCS

SEQ ID NO: 2745716 - protein, 4 aa, Entamoeba invadens
VSDV

SEQ ID NO: 2745717 - protein, 4 aa, Entamoeba invadens
VSNK

SEQ ID NO: 2745718 - protein, 5 aa, Entamoeba invadens
VSNTT

SEQ ID NO: 2745719 - protein, 7 aa, Entamoeba invadens
VSTNSKS

SEQ ID NO: 2745720 - protein, 4 aa, Entamoeba invadens
VSTT

SEQ ID NO: 2745721 - protein, 8 aa, Entamoeba invadens
VSVNTTSK

SEQ ID NO: 2745722 - protein, 14 aa, Entamoeba invadens
VTAEGATESTEECT

SEQ ID NO: 2745723 - protein, 12 aa, Entamoeba invadens
VTAQSTRIDPDE

SEQ ID NO: 2745724 - protein, 5 aa, Entamoeba invadens
VTDGN

SEQ ID NO: 2745725 - protein, 5 aa, Entamoeba invadens
VTDTE

SEQ ID NO: 2745726 - protein, 10 aa, Entamoeba invadens
VTEKSTRIDY

SEQ ID NO: 2745727 - protein, 6 aa, Entamoeba invadens
VTGERK

SEQ ID NO: 2745728 - protein, 4 aa, Entamoeba invadens
VTIN

SEQ ID NO: 2745729 - protein, 18 aa, Entamoeba invadens
VTNPTDKRNCYKPSITTS

SEQ ID NO: 2745730 - protein, 12 aa, Entamoeba invadens
VTPTWTSESGVS

SEQ ID NO: 2745731 - protein, 7 aa, Entamoeba invadens
VTQTSCD

SEQ ID NO: 2745732 - protein, 9 aa, Entamoeba invadens
VTSQSTRID

SEQ ID NO: 2745733 - protein, 11 aa, Entamoeba invadens
VTSSDSKACNL

SEQ ID NO: 2745734 - protein, 10 aa, Entamoeba invadens
VTTEQSTKLN

SEQ ID NO: 2745735 - protein, 8 aa, Entamoeba invadens
VVDTEYTE

SEQ ID NO: 2745736 - protein, 18 aa, Entamoeba invadens
VVSPNELNNEVPNYSVPL

SEQ ID NO: 2745737 - protein, 12 aa, Entamoeba invadens
VVTEGGDNFSLG

SEQ ID NO: 2745738 - protein, 9 aa, Entamoeba invadens
VYNPSNTKT

SEQ ID NO: 2745739 - protein, 8 aa, Entamoeba invadens
WAGSTVNK

SEQ ID NO: 2745740 - protein, 11 aa, Entamoeba invadens
WEDDPKERADV

SEQ ID NO: 2745741 - protein, 13 aa, Entamoeba invadens
WKKQSLNKNPSIG

SEQ ID NO: 2745742 - protein, 29 aa, Entamoeba invadens
WSTTTSSSCTKCDSSCKTCNNENGKCTSC

SEQ ID NO: 2745743 - protein, 4 aa, Entamoeba invadens
WTNN

SEQ ID NO: 2745744 - protein, 6 aa, Entamoeba invadens
WTPENG

SEQ ID NO: 2745745 - protein, 5 aa, Entamoeba invadens
YAAGS

SEQ ID NO: 2745746 - protein, 21 aa, Entamoeba invadens
YAGVTDNTECTCKPTTTSVTN

SEQ ID NO: 2745747 - protein, 8 aa, Entamoeba invadens
YCPSDTRS

SEQ ID NO: 2745748 - protein, 14 aa, Entamoeba invadens
YCQTPSGVDEKRAT

SEQ ID NO: 2745749 - protein, 7 aa, Entamoeba invadens
YEANRNN

SEQ ID NO: 2745750 - protein, 11 aa, Entamoeba invadens
YEEEDEGIDDD

SEQ ID NO: 2745751 - protein, 7 aa, Entamoeba invadens
YEGKTAG

SEQ ID NO: 2745752 - protein, 12 aa, Entamoeba invadens
YETTFGKTRTDS

SEQ ID NO: 2745753 - protein, 4 aa, Entamoeba invadens
YFPK

SEQ ID NO: 2745754 - protein, 11 aa, Entamoeba invadens
YGDASEKGSVE

SEQ ID NO: 2745755 - protein, 4 aa, Entamoeba invadens
YGDE

SEQ ID NO: 2745756 - protein, 9 aa, Entamoeba invadens
YGKPQQTAG

SEQ ID NO: 2745757 - protein, 7 aa, Entamoeba invadens
YGPNTKR

SEQ ID NO: 2745758 - protein, 4 aa, Entamoeba invadens
YGTT

SEQ ID NO: 2745759 - protein, 13 aa, Entamoeba invadens
YGYKKDGDNCTNV

SEQ ID NO: 2745760 - protein, 12 aa, Entamoeba invadens
YHTTNDNTIEQC

SEQ ID NO: 2745761 - protein, 8 aa, Entamoeba invadens
YIGEENKN

SEQ ID NO: 2745762 - protein, 5 aa, Entamoeba invadens
YINSN

SEQ ID NO: 2745763 - protein, 5 aa, Entamoeba invadens
YKGRF

SEQ ID NO: 2745764 - protein, 6 aa, Entamoeba invadens
YKGRTV

SEQ ID NO: 2745765 - protein, 9 aa, Entamoeba invadens
YKKDDSNCY

SEQ ID NO: 2745766 - protein, 7 aa, Entamoeba invadens
YKKGADC

SEQ ID NO: 2745767 - protein, 7 aa, Entamoeba invadens
YKKPADI

SEQ ID NO: 2745768 - protein, 6 aa, Entamoeba invadens
YKKSAD

SEQ ID NO: 2745769 - protein, 7 aa, Entamoeba invadens
YKLNDDQ

SEQ ID NO: 2745770 - protein, 5 aa, Entamoeba invadens
YKLRD

SEQ ID NO: 2745771 - protein, 9 aa, Entamoeba invadens
YKPASNGTC

SEQ ID NO: 2745772 - protein, 9 aa, Entamoeba invadens
YKSGQTCTK

SEQ ID NO: 2745773 - protein, 12 aa, Entamoeba invadens
YMRSSDGKACEK

SEQ ID NO: 2745774 - protein, 12 aa, Entamoeba invadens
YMRSSDGKKCDK

SEQ ID NO: 2745775 - protein, 10 aa, Entamoeba invadens
YMRSSDGSTC

SEQ ID NO: 2745776 - protein, 14 aa, Entamoeba invadens
YNDKVNDVDTPTFN

SEQ ID NO: 2745777 - protein, 9 aa, Entamoeba invadens
YNDSNGDCV

SEQ ID NO: 2745778 - protein, 12 aa, Entamoeba invadens
YNGDSKKCESGC

SEQ ID NO: 2745779 - protein, 13 aa, Entamoeba invadens
YNKTSQKCEDPTI

SEQ ID NO: 2745780 - protein, 7 aa, Entamoeba invadens
YNSSNKC

SEQ ID NO: 2745781 - protein, 4 aa, Entamoeba invadens
YNTE

SEQ ID NO: 2745782 - protein, 6 aa, Entamoeba invadens
YPDITS

SEQ ID NO: 2745783 - protein, 11 aa, Entamoeba invadens
YPDSEGECNKC

SEQ ID NO: 2745784 - protein, 6 aa, Entamoeba invadens
YPDSNG

SEQ ID NO: 2745785 - protein, 5 aa, Entamoeba invadens
YPGDR

SEQ ID NO: 2745786 - protein, 9 aa, Entamoeba invadens
YPGTWASAN

SEQ ID NO: 2745787 - protein, 4 aa, Entamoeba invadens
YPKD

SEQ ID NO: 2745788 - protein, 4 aa, Entamoeba invadens
YPKQ

SEQ ID NO: 2745789 - protein, 8 aa, Entamoeba invadens
YPNDSGKC

SEQ ID NO: 2745790 - protein, 10 aa, Entamoeba invadens
YPRNCQSGYV

SEQ ID NO: 2745791 - protein, 9 aa, Entamoeba invadens
YPSQSGQNI

SEQ ID NO: 2745792 - protein, 9 aa, Entamoeba invadens
YPTRPTKQI

SEQ ID NO: 2745793 - protein, 10 aa, Entamoeba invadens
YQKSKKGVST

SEQ ID NO: 2745794 - protein, 7 aa, Entamoeba invadens
YQPNNKR

SEQ ID NO: 2745795 - protein, 17 aa, Entamoeba invadens
YQPQQKVNTTNQNDSMT

SEQ ID NO: 2745796 - protein, 9 aa, Entamoeba invadens
YQTEYNGNK

SEQ ID NO: 2745797 - protein, 8 aa, Entamoeba invadens
YRKQSDCD

SEQ ID NO: 2745798 - protein, 10 aa, Entamoeba invadens
YRTATNNTKY

SEQ ID NO: 2745799 - protein, 16 aa, Entamoeba invadens
YRTPNNNTKLCNTQTD

SEQ ID NO: 2745800 - protein, 13 aa, Entamoeba invadens
YRTSNNECKPQSD

SEQ ID NO: 2745801 - protein, 7 aa, Entamoeba invadens
YRTSSNV

SEQ ID NO: 2745802 - protein, 19 aa, Entamoeba invadens
YSCGDGEYLNGNECESCSI

SEQ ID NO: 2745803 - protein, 5 aa, Entamoeba invadens
YSEGG

SEQ ID NO: 2745804 - protein, 25 aa, Entamoeba invadens
YSLGGSSGCTKCSTSCKTCDQTNGN

SEQ ID NO: 2745805 - protein, 4 aa, Entamoeba invadens
YSNT

SEQ ID NO: 2745806 - protein, 4 aa, Entamoeba invadens
YSPN

SEQ ID NO: 2745807 - protein, 9 aa, Entamoeba invadens
YSSGGTSSC

SEQ ID NO: 2745808 - protein, 8 aa, Entamoeba invadens
YSYATNGK

SEQ ID NO: 2745809 - protein, 4 aa, Entamoeba invadens
YTGD

SEQ ID NO: 2745810 - protein, 7 aa, Entamoeba invadens
YTLTTEN

SEQ ID NO: 2745811 - protein, 11 aa, Entamoeba invadens
YTNKGGDDTKC

SEQ ID NO: 2745812 - protein, 12 aa, Entamoeba invadens
YTPTNNPSDGDT

SEQ ID NO: 2745813 - protein, 11 aa, Entamoeba invadens
YTSKSPTTMEG

SEQ ID NO: 2745814 - protein, 4 aa, Entamoeba invadens
YTSN

SEQ ID NO: 2745815 - protein, 12 aa, Entamoeba invadens
YTTKEGSYTNKN

SEQ ID NO: 2745816 - protein, 8 aa, Entamoeba invadens
YTVSSNGS

SEQ ID NO: 2745817 - protein, 5 aa, Entamoeba invadens
YVPDG

SEQ ID NO: 2745818 - protein, 12 aa, Entamoeba invadens
YYDKTTKNCVSN

SEQ ID NO: 2745819 - protein, 11 aa, Entamoeba invadens
YYDNNTKSCLP

SEQ ID NO: 2745820 - protein, 7 aa, Entamoeba invadens
YYKSQSS

SEQ ID NO: 2745821 - protein, 8 aa, Entamoeba invadens
YYPDDGKC

SEQ ID NO: 2745822 - protein, 7 aa, Entamoeba invadens
YYPDSTG

SEQ ID NO: 2745823 - protein, 6 aa, Entamoeba invadens
YYPGDN

SEQ ID NO: 2745824 - protein, 5 aa, Entamoeba invadens
YYPGS

SEQ ID NO: 2745825 - protein, 6 aa, Entamoeba invadens
YYPHQN

SEQ ID NO: 2745826 - protein, 7 aa, Entamoeba invadens
YYPKQGR

SEQ ID NO: 2745827 - protein, 12 aa, Entamoeba invadens
YYPKTSGDYKCQ

SEQ ID NO: 2745828 - protein, 6 aa, Entamoeba invadens
YYPKTV

SEQ ID NO: 2745829 - protein, 4 aa, Entamoeba invadens
YYQT

SEQ ID NO: 2745830 - protein, 12 aa, Entamoeba invadens
YYQTDSKNVENK

SEQ ID NO: 2745831 - protein, 11 aa, Entamoeba invadens
YYQTNASTFTD

SEQ ID NO: 2745832 - protein, 10 aa, Entamoeba invadens
YYRNGTDCNK

SEQ ID NO: 2745833 - protein, 17 aa, Entamoeba invadens
YYRTPNNNTKLCNPQKE

SEQ ID NO: 2745834 - protein, 29 aa, Entamoeba invadens
YYSKGGQNSCSQCEEGTYSSHSGSSTCTN

SEQ ID NO: 2745835 - protein, 5 aa, Entamoeba invadens
AAAGT

SEQ ID NO: 2745836 - protein, 6 aa, Entamoeba invadens
AAALNN

SEQ ID NO: 2745837 - protein, 5 aa, Entamoeba invadens
AAAPL

SEQ ID NO: 2745838 - protein, 5 aa, Entamoeba invadens
AAAPM

SEQ ID NO: 2745839 - protein, 11 aa, Entamoeba invadens
AAASAQKERVA

SEQ ID NO: 2745840 - protein, 8 aa, Entamoeba invadens
AAASTDID

SEQ ID NO: 2745841 - protein, 5 aa, Entamoeba invadens
AADGF

SEQ ID NO: 2745842 - protein, 9 aa, Entamoeba invadens
AADKRKCVE

SEQ ID NO: 2745843 - protein, 8 aa, Entamoeba invadens
AADSSGSC

SEQ ID NO: 2745844 - protein, 7 aa, Entamoeba invadens
AAEETKC

SEQ ID NO: 2745845 - protein, 6 aa, Entamoeba invadens
AAEEVG

SEQ ID NO: 2745846 - protein, 9 aa, Entamoeba invadens
AAEKPDCPM

SEQ ID NO: 2745847 - protein, 28 aa, Entamoeba invadens
AAELQKDKQDKKETKVKPPKSAQPKTGK

SEQ ID NO: 2745848 - protein, 15 aa, Entamoeba invadens
AAEPEQQKKKSYTGT

SEQ ID NO: 2745849 - protein, 5 aa, Entamoeba invadens
AAEQI

SEQ ID NO: 2745850 - protein, 6 aa, Entamoeba invadens
AAERYD

SEQ ID NO: 2745851 - protein, 8 aa, Entamoeba invadens
AAESEGIS

SEQ ID NO: 2745852 - protein, 11 aa, Entamoeba invadens
AAETNEKASLT

SEQ ID NO: 2745853 - protein, 6 aa, Entamoeba invadens
AAGDLN

SEQ ID NO: 2745854 - protein, 7 aa, Entamoeba invadens
AAGDLTI

SEQ ID NO: 2745855 - protein, 4 aa, Entamoeba invadens
AAGG

SEQ ID NO: 2745856 - protein, 6 aa, Entamoeba invadens
AAGKPT

SEQ ID NO: 2745857 - protein, 9 aa, Entamoeba invadens
AAGKSCHSD

SEQ ID NO: 2745858 - protein, 15 aa, Entamoeba invadens
AAGNISSAAKPHSFP

SEQ ID NO: 2745859 - protein, 7 aa, Entamoeba invadens
AAGNTIR

SEQ ID NO: 2745860 - protein, 6 aa, Entamoeba invadens
AAGPGL

SEQ ID NO: 2745861 - protein, 6 aa, Entamoeba invadens
AAGSLD

SEQ ID NO: 2745862 - protein, 6 aa, Entamoeba invadens
AAGTGI

SEQ ID NO: 2745863 - protein, 7 aa, Entamoeba invadens
AAGTYSV

SEQ ID NO: 2745864 - protein, 6 aa, Entamoeba invadens
AAIPNV

SEQ ID NO: 2745865 - protein, 11 aa, Entamoeba invadens
AAKAENVEGHD

SEQ ID NO: 2745866 - protein, 8 aa, Entamoeba invadens
AAKDDEAK

SEQ ID NO: 2745867 - protein, 9 aa, Entamoeba invadens
AAKDSDGKN

SEQ ID NO: 2745868 - protein, 16 aa, Entamoeba invadens
AAKKNEKSVREKTKKF

SEQ ID NO: 2745869 - protein, 7 aa, Entamoeba invadens
AAKKNGV

SEQ ID NO: 2745870 - protein, 15 aa, Entamoeba invadens
AAKKQPDINLAPNET

SEQ ID NO: 2745871 - protein, 8 aa, Entamoeba invadens
AAKLSASK

SEQ ID NO: 2745872 - protein, 6 aa, Entamoeba invadens
AAKPGR

SEQ ID NO: 2745873 - protein, 9 aa, Entamoeba invadens
AAKRNKGLT

SEQ ID NO: 2745874 - protein, 8 aa, Entamoeba invadens
AALDGETS

SEQ ID NO: 2745875 - protein, 5 aa, Entamoeba invadens
AALKN

SEQ ID NO: 2745876 - protein, 9 aa, Entamoeba invadens
AALKSVQSA

SEQ ID NO: 2745877 - protein, 8 aa, Entamoeba invadens
AALNTKDE

SEQ ID NO: 2745878 - protein, 8 aa, Entamoeba invadens
AALNTKNG

SEQ ID NO: 2745879 - protein, 9 aa, Entamoeba invadens
AANEDDPYK

SEQ ID NO: 2745880 - protein, 9 aa, Entamoeba invadens
AANEYRKNN

SEQ ID NO: 2745881 - protein, 6 aa, Entamoeba invadens
AANLGS

SEQ ID NO: 2745882 - protein, 9 aa, Entamoeba invadens
AANNSCTKC

SEQ ID NO: 2745883 - protein, 9 aa, Entamoeba invadens
AANRGHGDS

SEQ ID NO: 2745884 - protein, 6 aa, Entamoeba invadens
AANSPD

SEQ ID NO: 2745885 - protein, 12 aa, Entamoeba invadens
AANTTEIPELTS

SEQ ID NO: 2745886 - protein, 11 aa, Entamoeba invadens
AAPAALPTDLN

SEQ ID NO: 2745887 - protein, 11 aa, Entamoeba invadens
AAPATLPNDLN

SEQ ID NO: 2745888 - protein, 9 aa, Entamoeba invadens
AAPDGGEFA

SEQ ID NO: 2745889 - protein, 10 aa, Entamoeba invadens
AAPDSNNCTI

SEQ ID NO: 2745890 - protein, 11 aa, Entamoeba invadens
AAPETTRDEYT

SEQ ID NO: 2745891 - protein, 6 aa, Entamoeba invadens
AAPETY

SEQ ID NO: 2745892 - protein, 7 aa, Entamoeba invadens
AAPETYN

SEQ ID NO: 2745893 - protein, 9 aa, Entamoeba invadens
AAPISQKSE

SEQ ID NO: 2745894 - protein, 12 aa, Entamoeba invadens
AAPNFAQPLPKN

SEQ ID NO: 2745895 - protein, 18 aa, Entamoeba invadens
AAPNGGNCEVTRSGETYV

SEQ ID NO: 2745896 - protein, 10 aa, Entamoeba invadens
AAPNTQCGAD

SEQ ID NO: 2745897 - protein, 12 aa, Entamoeba invadens
AAPTIPTGTELN

SEQ ID NO: 2745898 - protein, 13 aa, Entamoeba invadens
AAPTIPTGTKLNS

SEQ ID NO: 2745899 - protein, 13 aa, Entamoeba invadens
AAQEAQRKSQLLE

SEQ ID NO: 2745900 - protein, 15 aa, Entamoeba invadens
AAQPCSPVKDVKIEV

SEQ ID NO: 2745901 - protein, 5 aa, Entamoeba invadens
AARAG

SEQ ID NO: 2745902 - protein, 8 aa, Entamoeba invadens
AARNSECT

SEQ ID NO: 2745903 - protein, 20 aa, Entamoeba invadens
AASAGFEDEAKQSKFSRGVG

SEQ ID NO: 2745904 - protein, 5 aa, Entamoeba invadens
AASAI

SEQ ID NO: 2745905 - protein, 7 aa, Entamoeba invadens
AASEAGV

SEQ ID NO: 2745906 - protein, 7 aa, Entamoeba invadens
AASGDLK

SEQ ID NO: 2745907 - protein, 5 aa, Entamoeba invadens
AASGK

SEQ ID NO: 2745908 - protein, 7 aa, Entamoeba invadens
AASGSGF

SEQ ID NO: 2745909 - protein, 10 aa, Entamoeba invadens
AASGVERKAK

SEQ ID NO: 2745910 - protein, 5 aa, Entamoeba invadens
AASKS

SEQ ID NO: 2745911 - protein, 25 aa, Entamoeba invadens
AASNNTCTKCKNNKKVSKDKLSCDK

SEQ ID NO: 2745912 - protein, 9 aa, Entamoeba invadens
AASSAEEGL

SEQ ID NO: 2745913 - protein, 9 aa, Entamoeba invadens
AASSSIEDG

SEQ ID NO: 2745914 - protein, 7 aa, Entamoeba invadens
AASSTHI

SEQ ID NO: 2745915 - protein, 7 aa, Entamoeba invadens
AASSTHL

SEQ ID NO: 2745916 - protein, 7 aa, Entamoeba invadens
AASTPDI

SEQ ID NO: 2745917 - protein, 7 aa, Entamoeba invadens
AASTPPL

SEQ ID NO: 2745918 - protein, 10 aa, Entamoeba invadens
AASTSRIPTL

SEQ ID NO: 2745919 - protein, 7 aa, Entamoeba invadens
AASTVNK

SEQ ID NO: 2745920 - protein, 8 aa, Entamoeba invadens
AASTVNKR

SEQ ID NO: 2745921 - protein, 5 aa, Entamoeba invadens
AASVD

SEQ ID NO: 2745922 - protein, 11 aa, Entamoeba invadens
AATAEECSVSG

SEQ ID NO: 2745923 - protein, 8 aa, Entamoeba invadens
AATSVKSR

SEQ ID NO: 2745924 - protein, 67 aa, Entamoeba invadens
AAVDPVDPPKPVEPSQPETPEKPSEPEKPVDPPVTPVDPSKPSEPTDPEKPVNSETTENSEISNLDG

SEQ ID NO: 2745925 - protein, 68 aa, Entamoeba invadens
AAVDPVDPPKTVEPSQPETPEKPSEPEKPVDPPVTPVDPSKPSEPTEPEKPVNSEESTENSEIANLDG

SEQ ID NO: 2745926 - protein, 10 aa, Entamoeba invadens
AAVKAKQERQ

SEQ ID NO: 2745927 - protein, 6 aa, Entamoeba invadens
AAYPND

SEQ ID NO: 2745928 - protein, 6 aa, Entamoeba invadens
AAYRND

SEQ ID NO: 2745929 - protein, 8 aa, Entamoeba invadens
ACDASKCG

SEQ ID NO: 2745930 - protein, 6 aa, Entamoeba invadens
ACDDQN

SEQ ID NO: 2745931 - protein, 5 aa, Entamoeba invadens
ACDGD

SEQ ID NO: 2745932 - protein, 18 aa, Entamoeba invadens
ACDKEQSSSVSSEDSGLE

SEQ ID NO: 2745933 - protein, 10 aa, Entamoeba invadens
ACDPDNTLQP

SEQ ID NO: 2745934 - protein, 7 aa, Entamoeba invadens
ACDPTSG

SEQ ID NO: 2745935 - protein, 27 aa, Entamoeba invadens
ACDTSSCEVAENTIKDANGKCEKPTQN

SEQ ID NO: 2745936 - protein, 14 aa, Entamoeba invadens
ACDTTDRKACGSGK

SEQ ID NO: 2745937 - protein, 6 aa, Entamoeba invadens
ACENGC

SEQ ID NO: 2745938 - protein, 5 aa, Entamoeba invadens
ACETQ

SEQ ID NO: 2745939 - protein, 6 aa, Entamoeba invadens
ACGGDG

SEQ ID NO: 2745940 - protein, 8 aa, Entamoeba invadens
ACGGNKKC

SEQ ID NO: 2745941 - protein, 10 aa, Entamoeba invadens
ACKDETGCST

SEQ ID NO: 2745942 - protein, 8 aa, Entamoeba invadens
ACKKEDQN

SEQ ID NO: 2745943 - protein, 8 aa, Entamoeba invadens
ACKSGGGC

SEQ ID NO: 2745944 - protein, 5 aa, Entamoeba invadens
ACNDN

SEQ ID NO: 2745945 - protein, 7 aa, Entamoeba invadens
ACNPTSG

SEQ ID NO: 2745946 - protein, 6 aa, Entamoeba invadens
ACNSCS

SEQ ID NO: 2745947 - protein, 6 aa, Entamoeba invadens
ACPEGT

SEQ ID NO: 2745948 - protein, 24 aa, Entamoeba invadens
ACPESTTLNDDKTECVANTPQTCT

SEQ ID NO: 2745949 - protein, 10 aa, Entamoeba invadens
ACPYNTNENE

SEQ ID NO: 2745950 - protein, 5 aa, Entamoeba invadens
ACQDN

SEQ ID NO: 2745951 - protein, 5 aa, Entamoeba invadens
ACQTE

SEQ ID NO: 2745952 - protein, 14 aa, Entamoeba invadens
ACSDASTCSSCSTG

SEQ ID NO: 2745953 - protein, 4 aa, Entamoeba invadens
ACSS

SEQ ID NO: 2745954 - protein, 9 aa, Entamoeba invadens
ACSSPSKCD

SEQ ID NO: 2745955 - protein, 13 aa, Entamoeba invadens
ACTDQTSTPSKVE

SEQ ID NO: 2745956 - protein, 22 aa, Entamoeba invadens
ACTQCKDGNAILGPTSNPTKYC

SEQ ID NO: 2745957 - protein, 9 aa, Entamoeba invadens
ACTSAEEFN

SEQ ID NO: 2745958 - protein, 9 aa, Entamoeba invadens
ACTSCKNDS

SEQ ID NO: 2745959 - protein, 7 aa, Entamoeba invadens
ACTSDHE

SEQ ID NO: 2745960 - protein, 6 aa, Entamoeba invadens
ACTSGT

SEQ ID NO: 2745961 - protein, 6 aa, Entamoeba invadens
ADADET

SEQ ID NO: 2745962 - protein, 5 aa, Entamoeba invadens
ADAGY

SEQ ID NO: 2745963 - protein, 13 aa, Entamoeba invadens
ADAQDLPSFSQTP

SEQ ID NO: 2745964 - protein, 7 aa, Entamoeba invadens
ADARGEV

SEQ ID NO: 2745965 - protein, 4 aa, Entamoeba invadens
ADAS

SEQ ID NO: 2745966 - protein, 17 aa, Entamoeba invadens
ADASGTKTREETKEVGR

SEQ ID NO: 2745967 - protein, 6 aa, Entamoeba invadens
ADASHG

SEQ ID NO: 2745968 - protein, 8 aa, Entamoeba invadens
ADASTCEK

SEQ ID NO: 2745969 - protein, 6 aa, Entamoeba invadens
ADASTP

SEQ ID NO: 2745970 - protein, 15 aa, Entamoeba invadens
ADCDTTNGGCKKCST

SEQ ID NO: 2745971 - protein, 7 aa, Entamoeba invadens
ADCQPCG

SEQ ID NO: 2745972 - protein, 7 aa, Entamoeba invadens
ADCQPCS

SEQ ID NO: 2745973 - protein, 6 aa, Entamoeba invadens
ADCQRC

SEQ ID NO: 2745974 - protein, 5 aa, Entamoeba invadens
ADCSV

SEQ ID NO: 2745975 - protein, 6 aa, Entamoeba invadens
ADDANG

SEQ ID NO: 2745976 - protein, 9 aa, Entamoeba invadens
ADDAPEPKF

SEQ ID NO: 2745977 - protein, 10 aa, Entamoeba invadens
ADDDSKDKTV

SEQ ID NO: 2745978 - protein, 9 aa, Entamoeba invadens
ADDEKHINE

SEQ ID NO: 2745979 - protein, 9 aa, Entamoeba invadens
ADDHYGSND

SEQ ID NO: 2745980 - protein, 4 aa, Entamoeba invadens
ADDK

SEQ ID NO: 2745981 - protein, 41 aa, Entamoeba invadens
ADDKQTKQTVTETDETLQTDEVEKTQEEKVEETNEEQLNKM

SEQ ID NO: 2745982 - protein, 7 aa, Entamoeba invadens
ADDNNTR

SEQ ID NO: 2745983 - protein, 5 aa, Entamoeba invadens
ADDNS

SEQ ID NO: 2745984 - protein, 11 aa, Entamoeba invadens
ADDNTKYTNQN

SEQ ID NO: 2745985 - protein, 9 aa, Entamoeba invadens
ADDTTQCET

SEQ ID NO: 2745986 - protein, 5 aa, Entamoeba invadens
ADDTY

SEQ ID NO: 2745987 - protein, 11 aa, Entamoeba invadens
ADEAEDNDGAM

SEQ ID NO: 2745988 - protein, 5 aa, Entamoeba invadens
ADEEA

SEQ ID NO: 2745989 - protein, 10 aa, Entamoeba invadens
ADEEKSSPLP

SEQ ID NO: 2745990 - protein, 5 aa, Entamoeba invadens
ADEGY

SEQ ID NO: 2745991 - protein, 29 aa, Entamoeba invadens
ADEIEEYEKKEKKPNTLVPPRKKKKLSTF

SEQ ID NO: 2745992 - protein, 5 aa, Entamoeba invadens
ADEIP

SEQ ID NO: 2745993 - protein, 23 aa, Entamoeba invadens
ADEISDEKDTTIATEEIKTTRTY

SEQ ID NO: 2745994 - protein, 10 aa, Entamoeba invadens
ADEKESRSAT

SEQ ID NO: 2745995 - protein, 7 aa, Entamoeba invadens
ADENKDN

SEQ ID NO: 2745996 - protein, 6 aa, Entamoeba invadens
ADETAK

SEQ ID NO: 2745997 - protein, 11 aa, Entamoeba invadens
ADETGCTNRIS

SEQ ID NO: 2745998 - protein, 5 aa, Entamoeba invadens
ADETL

SEQ ID NO: 2745999 - protein, 5 aa, Entamoeba invadens
ADETM

SEQ ID NO: 2746000 - protein, 4 aa, Entamoeba invadens
ADEV

SEQ ID NO: 2746001 - protein, 6 aa, Entamoeba invadens
ADEVKN

SEQ ID NO: 2746002 - protein, 9 aa, Entamoeba invadens
ADEVSPVQS

SEQ ID NO: 2746003 - protein, 8 aa, Entamoeba invadens
ADFDSSHS

SEQ ID NO: 2746004 - protein, 15 aa, Entamoeba invadens
ADFEKDVEKTQKEIN

SEQ ID NO: 2746005 - protein, 7 aa, Entamoeba invadens
ADFGSSR

SEQ ID NO: 2746006 - protein, 7 aa, Entamoeba invadens
ADFSTSQ

SEQ ID NO: 2746007 - protein, 17 aa, Entamoeba invadens
ADGFEPAGVTNINKGDC

SEQ ID NO: 2746008 - protein, 15 aa, Entamoeba invadens
ADGGSCNYGPRTDPI

SEQ ID NO: 2746009 - protein, 10 aa, Entamoeba invadens
ADGKDTEEVA

SEQ ID NO: 2746010 - protein, 11 aa, Entamoeba invadens
ADGKKDDTNVI

SEQ ID NO: 2746011 - protein, 10 aa, Entamoeba invadens
ADGKKSEVSF

SEQ ID NO: 2746012 - protein, 16 aa, Entamoeba invadens
ADGKMWSSRSQPSVGV

SEQ ID NO: 2746013 - protein, 12 aa, Entamoeba invadens
ADGNKTNNGEES

SEQ ID NO: 2746014 - protein, 5 aa, Entamoeba invadens
ADGNT

SEQ ID NO: 2746015 - protein, 9 aa, Entamoeba invadens
ADGSVKKES

SEQ ID NO: 2746016 - protein, 4 aa, Entamoeba invadens
ADGT

SEQ ID NO: 2746017 - protein, 13 aa, Entamoeba invadens
ADGTYADTTGLPS

SEQ ID NO: 2746018 - protein, 6 aa, Entamoeba invadens
ADGVEG

SEQ ID NO: 2746019 - protein, 17 aa, Entamoeba invadens
ADGYNDYPACTKKSNTG

SEQ ID NO: 2746020 - protein, 13 aa, Entamoeba invadens
ADGYTKTTPPGIT

SEQ ID NO: 2746021 - protein, 6 aa, Entamoeba invadens
ADHTSL

SEQ ID NO: 2746022 - protein, 6 aa, Entamoeba invadens
ADIDEN

SEQ ID NO: 2746023 - protein, 6 aa, Entamoeba invadens
ADIDKP

SEQ ID NO: 2746024 - protein, 12 aa, Entamoeba invadens
ADIGSATSTKTP

SEQ ID NO: 2746025 - protein, 8 aa, Entamoeba invadens
ADIGSEQC

SEQ ID NO: 2746026 - protein, 4 aa, Entamoeba invadens
ADIH

SEQ ID NO: 2746027 - protein, 9 aa, Entamoeba invadens
ADISTEGST

SEQ ID NO: 2746028 - protein, 15 aa, Entamoeba invadens
ADKDSLGSANGVAQS

SEQ ID NO: 2746029 - protein, 4 aa, Entamoeba invadens
ADKE

SEQ ID NO: 2746030 - protein, 6 aa, Entamoeba invadens
ADKFGD

SEQ ID NO: 2746031 - protein, 5 aa, Entamoeba invadens
ADKND

SEQ ID NO: 2746032 - protein, 10 aa, Entamoeba invadens
ADKNNYGGCK

SEQ ID NO: 2746033 - protein, 14 aa, Entamoeba invadens
ADKPYRKPPCSPGD

SEQ ID NO: 2746034 - protein, 9 aa, Entamoeba invadens
ADKSEPCTF

SEQ ID NO: 2746035 - protein, 31 aa, Entamoeba invadens
ADKTGSVNCESSTEAKCIKSRSDGCGADSKL

SEQ ID NO: 2746036 - protein, 11 aa, Entamoeba invadens
ADKTGTAINGE

SEQ ID NO: 2746037 - protein, 8 aa, Entamoeba invadens
ADLNNKGI

SEQ ID NO: 2746038 - protein, 5 aa, Entamoeba invadens
ADLNT

SEQ ID NO: 2746039 - protein, 6 aa, Entamoeba invadens
ADLQTK

SEQ ID NO: 2746040 - protein, 6 aa, Entamoeba invadens
ADLRTK

SEQ ID NO: 2746041 - protein, 5 aa, Entamoeba invadens
ADNEN

SEQ ID NO: 2746042 - protein, 9 aa, Entamoeba invadens
ADNERDPDG

SEQ ID NO: 2746043 - protein, 10 aa, Entamoeba invadens
ADNGTFKGNI

SEQ ID NO: 2746044 - protein, 5 aa, Entamoeba invadens
ADNGV

SEQ ID NO: 2746045 - protein, 5 aa, Entamoeba invadens
ADNNN

SEQ ID NO: 2746046 - protein, 6 aa, Entamoeba invadens
ADNNTC

SEQ ID NO: 2746047 - protein, 6 aa, Entamoeba invadens
ADNSSL

SEQ ID NO: 2746048 - protein, 8 aa, Entamoeba invadens
ADNTTKTY

SEQ ID NO: 2746049 - protein, 8 aa, Entamoeba invadens
ADNVTGDL

SEQ ID NO: 2746050 - protein, 5 aa, Entamoeba invadens
ADPES

SEQ ID NO: 2746051 - protein, 4 aa, Entamoeba invadens
ADPF

SEQ ID NO: 2746052 - protein, 11 aa, Entamoeba invadens
ADPKDRPNFDK

SEQ ID NO: 2746053 - protein, 20 aa, Entamoeba invadens
ADPNTSISLEATKSGETYTT

SEQ ID NO: 2746054 - protein, 5 aa, Entamoeba invadens
ADPPI

SEQ ID NO: 2746055 - protein, 7 aa, Entamoeba invadens
ADPSGRA

SEQ ID NO: 2746056 - protein, 9 aa, Entamoeba invadens
ADPSNAALY

SEQ ID NO: 2746057 - protein, 7 aa, Entamoeba invadens
ADPSQIE

SEQ ID NO: 2746058 - protein, 9 aa, Entamoeba invadens
ADPTGMDRG

SEQ ID NO: 2746059 - protein, 9 aa, Entamoeba invadens
ADQADGKDH

SEQ ID NO: 2746060 - protein, 6 aa, Entamoeba invadens
ADQIHA

SEQ ID NO: 2746061 - protein, 11 aa, Entamoeba invadens
ADQKAQTDSIT

SEQ ID NO: 2746062 - protein, 14 aa, Entamoeba invadens
ADQSKGDDKEENVP

SEQ ID NO: 2746063 - protein, 5 aa, Entamoeba invadens
ADQTT

SEQ ID NO: 2746064 - protein, 6 aa, Entamoeba invadens
ADQTTC

SEQ ID NO: 2746065 - protein, 9 aa, Entamoeba invadens
ADQTTQKWQ

SEQ ID NO: 2746066 - protein, 5 aa, Entamoeba invadens
ADRAT

SEQ ID NO: 2746067 - protein, 7 aa, Entamoeba invadens
ADRGPSL

SEQ ID NO: 2746068 - protein, 31 aa, Entamoeba invadens
ADRGSETPKRKSVSLSKSTIVSSSKSTSSLG

SEQ ID NO: 2746069 - protein, 11 aa, Entamoeba invadens
ADRLPTQEEIS

SEQ ID NO: 2746070 - protein, 4 aa, Entamoeba invadens
ADRM

SEQ ID NO: 2746071 - protein, 5 aa, Entamoeba invadens
ADRPV

SEQ ID NO: 2746072 - protein, 12 aa, Entamoeba invadens
ADRTSDKGLGTP

SEQ ID NO: 2746073 - protein, 17 aa, Entamoeba invadens
ADSDALPAKEKEEKAMS

SEQ ID NO: 2746074 - protein, 5 aa, Entamoeba invadens
ADSEI

SEQ ID NO: 2746075 - protein, 8 aa, Entamoeba invadens
ADSFPKDK

SEQ ID NO: 2746076 - protein, 22 aa, Entamoeba invadens
ADSKEGTQSIKITGTTKIESVD

SEQ ID NO: 2746077 - protein, 12 aa, Entamoeba invadens
ADSKKLSSVKTE

SEQ ID NO: 2746078 - protein, 5 aa, Entamoeba invadens
ADSKS

SEQ ID NO: 2746079 - protein, 8 aa, Entamoeba invadens
ADSKTGLT

SEQ ID NO: 2746080 - protein, 9 aa, Entamoeba invadens
ADSNNTESN

SEQ ID NO: 2746081 - protein, 8 aa, Entamoeba invadens
ADSPGCTY

SEQ ID NO: 2746082 - protein, 6 aa, Entamoeba invadens
ADSQKS

SEQ ID NO: 2746083 - protein, 5 aa, Entamoeba invadens
ADSRT

SEQ ID NO: 2746084 - protein, 10 aa, Entamoeba invadens
ADSSTPGQFV

SEQ ID NO: 2746085 - protein, 9 aa, Entamoeba invadens
ADSTEKDFS

SEQ ID NO: 2746086 - protein, 12 aa, Entamoeba invadens
ADSTKCEKCSAT

SEQ ID NO: 2746087 - protein, 9 aa, Entamoeba invadens
ADSTSETFQ

SEQ ID NO: 2746088 - protein, 8 aa, Entamoeba invadens
ADSTTQYT

SEQ ID NO: 2746089 - protein, 5 aa, Entamoeba invadens
ADSTV

SEQ ID NO: 2746090 - protein, 14 aa, Entamoeba invadens
ADSTYVDKSGATVT

SEQ ID NO: 2746091 - protein, 16 aa, Entamoeba invadens
ADSVSYDYTKSTHTTC

SEQ ID NO: 2746092 - protein, 6 aa, Entamoeba invadens
ADSYGK

SEQ ID NO: 2746093 - protein, 12 aa, Entamoeba invadens
ADTDLTSASSAV

SEQ ID NO: 2746094 - protein, 13 aa, Entamoeba invadens
ADTDLTSATSAAD

SEQ ID NO: 2746095 - protein, 9 aa, Entamoeba invadens
ADTKHKPVE

SEQ ID NO: 2746096 - protein, 24 aa, Entamoeba invadens
ADTKVAEGVEEVGKAQTYQKKASR

SEQ ID NO: 2746097 - protein, 4 aa, Entamoeba invadens
ADTL

SEQ ID NO: 2746098 - protein, 8 aa, Entamoeba invadens
ADTRTKPY

SEQ ID NO: 2746099 - protein, 10 aa, Entamoeba invadens
ADTSGDNVGI

SEQ ID NO: 2746100 - protein, 9 aa, Entamoeba invadens
ADTSKNGNE

SEQ ID NO: 2746101 - protein, 6 aa, Entamoeba invadens
ADVEQP

SEQ ID NO: 2746102 - protein, 4 aa, Entamoeba invadens
ADVH

SEQ ID NO: 2746103 - protein, 8 aa, Entamoeba invadens
ADVNSEKI

SEQ ID NO: 2746104 - protein, 13 aa, Entamoeba invadens
ADYGDLKVGEESR

SEQ ID NO: 2746105 - protein, 4 aa, Entamoeba invadens
ADYN

SEQ ID NO: 2746106 - protein, 5 aa, Entamoeba invadens
ADYNK

SEQ ID NO: 2746107 - protein, 6 aa, Entamoeba invadens
AEAEYH

SEQ ID NO: 2746108 - protein, 6 aa, Entamoeba invadens
AEAEYQ

SEQ ID NO: 2746109 - protein, 17 aa, Entamoeba invadens
AEAKTACPNKDKKIAGV

SEQ ID NO: 2746110 - protein, 4 aa, Entamoeba invadens
AEAN

SEQ ID NO: 2746111 - protein, 11 aa, Entamoeba invadens
AEARTSNLNEQ

SEQ ID NO: 2746112 - protein, 8 aa, Entamoeba invadens
AEAYSKKN

SEQ ID NO: 2746113 - protein, 11 aa, Entamoeba invadens
AECDKNGNFDI

SEQ ID NO: 2746114 - protein, 13 aa, Entamoeba invadens
AECNTNTTISTTA

SEQ ID NO: 2746115 - protein, 15 aa, Entamoeba invadens
AECSGSNKVGPNGDE

SEQ ID NO: 2746116 - protein, 5 aa, Entamoeba invadens
AECSP

SEQ ID NO: 2746117 - protein, 16 aa, Entamoeba invadens
AECTETQYYDQTENQC

SEQ ID NO: 2746118 - protein, 8 aa, Entamoeba invadens
AEDATLEA

SEQ ID NO: 2746119 - protein, 4 aa, Entamoeba invadens
AEDD

SEQ ID NO: 2746120 - protein, 6 aa, Entamoeba invadens
AEDDPV

SEQ ID NO: 2746121 - protein, 9 aa, Entamoeba invadens
AEDLSTPKL

SEQ ID NO: 2746122 - protein, 11 aa, Entamoeba invadens
AEDPKPTTTQN

SEQ ID NO: 2746123 - protein, 7 aa, Entamoeba invadens
AEDSGKL

SEQ ID NO: 2746124 - protein, 5 aa, Entamoeba invadens
AEDTR

SEQ ID NO: 2746125 - protein, 7 aa, Entamoeba invadens
AEEEGVK

SEQ ID NO: 2746126 - protein, 83 aa, Entamoeba invadens
AEEENLQQPTPKIDPTYSSRISDPDAPVSKSFQTEDEAQKAIPPTCNGKDDTQNLNSQEADINKLNNKEEPKNRDNPQPTATD

SEQ ID NO: 2746127 - protein, 11 aa, Entamoeba invadens
AEEKCKHKDVK

SEQ ID NO: 2746128 - protein, 5 aa, Entamoeba invadens
AEEKY

SEQ ID NO: 2746129 - protein, 7 aa, Entamoeba invadens
AEELRKA

SEQ ID NO: 2746130 - protein, 12 aa, Entamoeba invadens
AEENIKSKNAKV

SEQ ID NO: 2746131 - protein, 5 aa, Entamoeba invadens
AEENM

SEQ ID NO: 2746132 - protein, 5 aa, Entamoeba invadens
AEEPF

SEQ ID NO: 2746133 - protein, 5 aa, Entamoeba invadens
AEEPL

SEQ ID NO: 2746134 - protein, 6 aa, Entamoeba invadens
AEEQAI

SEQ ID NO: 2746135 - protein, 10 aa, Entamoeba invadens
AEESGSTKMY

SEQ ID NO: 2746136 - protein, 7 aa, Entamoeba invadens
AEESKAR

SEQ ID NO: 2746137 - protein, 117 aa, Entamoeba invadens
AEESTEETKETTKEEAKEESQKSEESSSESSMSLSSKSDSKSGSGSKSGSQTTSKPQSKSDKKSETKPESQPANNGAESKTDEESKNKENSNDQDNKSENKQVETVAEPKPENTHEL

SEQ ID NO: 2746138 - protein, 15 aa, Entamoeba invadens
AEETMEFQKRFVKLN

SEQ ID NO: 2746139 - protein, 4 aa, Entamoeba invadens
AEEV

SEQ ID NO: 2746140 - protein, 8 aa, Entamoeba invadens
AEEYKKEK

SEQ ID NO: 2746141 - protein, 5 aa, Entamoeba invadens
AEGAE

SEQ ID NO: 2746142 - protein, 7 aa, Entamoeba invadens
AEGASGK

SEQ ID NO: 2746143 - protein, 6 aa, Entamoeba invadens
AEGECK

SEQ ID NO: 2746144 - protein, 9 aa, Entamoeba invadens
AEGETKNEL

SEQ ID NO: 2746145 - protein, 5 aa, Entamoeba invadens
AEGFG

SEQ ID NO: 2746146 - protein, 13 aa, Entamoeba invadens
AEGGFSNAESTGY

SEQ ID NO: 2746147 - protein, 5 aa, Entamoeba invadens
AEGKP

SEQ ID NO: 2746148 - protein, 7 aa, Entamoeba invadens
AEGNRFE

SEQ ID NO: 2746149 - protein, 7 aa, Entamoeba invadens
AEGQKVN

SEQ ID NO: 2746150 - protein, 4 aa, Entamoeba invadens
AEGT

SEQ ID NO: 2746151 - protein, 14 aa, Entamoeba invadens
AEGTKDVQKMSNNP

SEQ ID NO: 2746152 - protein, 7 aa, Entamoeba invadens
AEHSGRY

SEQ ID NO: 2746153 - protein, 17 aa, Entamoeba invadens
AEIEKKGEPLKETKEGN

SEQ ID NO: 2746154 - protein, 4 aa, Entamoeba invadens
AEIG

SEQ ID NO: 2746155 - protein, 7 aa, Entamoeba invadens
AEIKDKK

SEQ ID NO: 2746156 - protein, 5 aa, Entamoeba invadens
AEINL

SEQ ID NO: 2746157 - protein, 13 aa, Entamoeba invadens
AEIPRTRKHRKKN

SEQ ID NO: 2746158 - protein, 4 aa, Entamoeba invadens
AEIT

SEQ ID NO: 2746159 - protein, 15 aa, Entamoeba invadens
AEKEDLPVEPQSAEE

SEQ ID NO: 2746160 - protein, 10 aa, Entamoeba invadens
AEKGSGVTTY

SEQ ID NO: 2746161 - protein, 5 aa, Entamoeba invadens
AEKGV

SEQ ID NO: 2746162 - protein, 6 aa, Entamoeba invadens
AEKIRS

SEQ ID NO: 2746163 - protein, 6 aa, Entamoeba invadens
AEKISG

SEQ ID NO: 2746164 - protein, 8 aa, Entamoeba invadens
AEKITSAV

SEQ ID NO: 2746165 - protein, 28 aa, Entamoeba invadens
AEKNKNDTSKGDAKTEENNTENCLERTN

SEQ ID NO: 2746166 - protein, 5 aa, Entamoeba invadens
AEKNT

SEQ ID NO: 2746167 - protein, 7 aa, Entamoeba invadens
AEKQKEG

SEQ ID NO: 2746168 - protein, 6 aa, Entamoeba invadens
AEKSGR

SEQ ID NO: 2746169 - protein, 19 aa, Entamoeba invadens
AEKSKFSCGDVPPESAGGV

SEQ ID NO: 2746170 - protein, 11 aa, Entamoeba invadens
AEKSNQISEGR

SEQ ID NO: 2746171 - protein, 6 aa, Entamoeba invadens
AEKTIP

SEQ ID NO: 2746172 - protein, 10 aa, Entamoeba invadens
AEKVEQETEL

SEQ ID NO: 2746173 - protein, 14 aa, Entamoeba invadens
AEKYRTQCNKDNKK

SEQ ID NO: 2746174 - protein, 13 aa, Entamoeba invadens
AELARRKVGGEFD

SEQ ID NO: 2746175 - protein, 7 aa, Entamoeba invadens
AELEPQE

SEQ ID NO: 2746176 - protein, 4 aa, Entamoeba invadens
AELQ

SEQ ID NO: 2746177 - protein, 12 aa, Entamoeba invadens
AELSDKRVKSTA

SEQ ID NO: 2746178 - protein, 6 aa, Entamoeba invadens
AEMRER

SEQ ID NO: 2746179 - protein, 4 aa, Entamoeba invadens
AENE

SEQ ID NO: 2746180 - protein, 6 aa, Entamoeba invadens
AENECF

SEQ ID NO: 2746181 - protein, 7 aa, Entamoeba invadens
AENECTD

SEQ ID NO: 2746182 - protein, 9 aa, Entamoeba invadens
AENGNKKSD

SEQ ID NO: 2746183 - protein, 10 aa, Entamoeba invadens
AENGQGECLS

SEQ ID NO: 2746184 - protein, 11 aa, Entamoeba invadens
AENKGGFSQSQ

SEQ ID NO: 2746185 - protein, 10 aa, Entamoeba invadens
AENNFDGEQY

SEQ ID NO: 2746186 - protein, 8 aa, Entamoeba invadens
AENNRCTK

SEQ ID NO: 2746187 - protein, 19 aa, Entamoeba invadens
AENPQFQAAENVADNTNFN

SEQ ID NO: 2746188 - protein, 7 aa, Entamoeba invadens
AENQQDA

SEQ ID NO: 2746189 - protein, 9 aa, Entamoeba invadens
AENRPHSED

SEQ ID NO: 2746190 - protein, 7 aa, Entamoeba invadens
AENTEQQ

SEQ ID NO: 2746191 - protein, 7 aa, Entamoeba invadens
AENVKQN

SEQ ID NO: 2746192 - protein, 6 aa, Entamoeba invadens
AENVRP

SEQ ID NO: 2746193 - protein, 15 aa, Entamoeba invadens
AENYTGVHEKTEENG

SEQ ID NO: 2746194 - protein, 6 aa, Entamoeba invadens
AEPDER

SEQ ID NO: 2746195 - protein, 19 aa, Entamoeba invadens
AEPDKRTKINEIIDALKSL

SEQ ID NO: 2746196 - protein, 5 aa, Entamoeba invadens
AEPIQ

SEQ ID NO: 2746197 - protein, 7 aa, Entamoeba invadens
AEPRCGA

SEQ ID NO: 2746198 - protein, 6 aa, Entamoeba invadens
AEQCTK

SEQ ID NO: 2746199 - protein, 8 aa, Entamoeba invadens
AEQEKAGV

SEQ ID NO: 2746200 - protein, 5 aa, Entamoeba invadens
AEQGE

SEQ ID NO: 2746201 - protein, 6 aa, Entamoeba invadens
AEQTHS

SEQ ID NO: 2746202 - protein, 7 aa, Entamoeba invadens
AEQTPIP

SEQ ID NO: 2746203 - protein, 14 aa, Entamoeba invadens
AERGSNLSGGQRQR

SEQ ID NO: 2746204 - protein, 7 aa, Entamoeba invadens
AERGTHE

SEQ ID NO: 2746205 - protein, 9 aa, Entamoeba invadens
AERKGEEVV

SEQ ID NO: 2746206 - protein, 18 aa, Entamoeba invadens
AERLQKEYDDEKKKLKHS

SEQ ID NO: 2746207 - protein, 8 aa, Entamoeba invadens
AERNVGDS

SEQ ID NO: 2746208 - protein, 6 aa, Entamoeba invadens
AERPSI

SEQ ID NO: 2746209 - protein, 5 aa, Entamoeba invadens
AERRG

SEQ ID NO: 2746210 - protein, 6 aa, Entamoeba invadens
AERSKD

SEQ ID NO: 2746211 - protein, 8 aa, Entamoeba invadens
AESAVEPD

SEQ ID NO: 2746212 - protein, 5 aa, Entamoeba invadens
AESEK

SEQ ID NO: 2746213 - protein, 12 aa, Entamoeba invadens
AESETETHKERK

SEQ ID NO: 2746214 - protein, 14 aa, Entamoeba invadens
AESGFSNAESTGTE

SEQ ID NO: 2746215 - protein, 10 aa, Entamoeba invadens
AESGQGECVT

SEQ ID NO: 2746216 - protein, 6 aa, Entamoeba invadens
AESGTC

SEQ ID NO: 2746217 - protein, 9 aa, Entamoeba invadens
AESHDENKV

SEQ ID NO: 2746218 - protein, 55 aa, Entamoeba invadens
AESHSSSQPSQSSSSSHETSSASSNTSTESKSDESGHSTTSSESNSSSEGSENVK

SEQ ID NO: 2746219 - protein, 4 aa, Entamoeba invadens
AESK

SEQ ID NO: 2746220 - protein, 8 aa, Entamoeba invadens
AESKLSTK

SEQ ID NO: 2746221 - protein, 12 aa, Entamoeba invadens
AESKTQLSGEEK

SEQ ID NO: 2746222 - protein, 10 aa, Entamoeba invadens
AESPNEQFGQ

SEQ ID NO: 2746223 - protein, 5 aa, Entamoeba invadens
AESQL

SEQ ID NO: 2746224 - protein, 7 aa, Entamoeba invadens
AESQTPL

SEQ ID NO: 2746225 - protein, 72 aa, Entamoeba invadens
AESSEETKETTKEETKDDSQKSDESSSSSLSSSSKSDSKSGSGSKSASESKSKSDNKDNKDNKSESTNDGSS

SEQ ID NO: 2746226 - protein, 69 aa, Entamoeba invadens
AESSEETKETTKEETKDDSQKSDESSSSSLSSSSKSDSKSGSGSKSASESKSKSDNKDNKSESTNDGSS

SEQ ID NO: 2746227 - protein, 12 aa, Entamoeba invadens
AESSNCKTCHSN

SEQ ID NO: 2746228 - protein, 17 aa, Entamoeba invadens
AESSQSVVEKKRTSELY

SEQ ID NO: 2746229 - protein, 5 aa, Entamoeba invadens
AESST

SEQ ID NO: 2746230 - protein, 7 aa, Entamoeba invadens
AESTLQE

SEQ ID NO: 2746231 - protein, 7 aa, Entamoeba invadens
AESTSSI

SEQ ID NO: 2746232 - protein, 9 aa, Entamoeba invadens
AESTTSKIS

SEQ ID NO: 2746233 - protein, 14 aa, Entamoeba invadens
AESTVTPYSNSASL

SEQ ID NO: 2746234 - protein, 8 aa, Entamoeba invadens
AETCEECT

SEQ ID NO: 2746235 - protein, 4 aa, Entamoeba invadens
AETD

SEQ ID NO: 2746236 - protein, 9 aa, Entamoeba invadens
AETGSTTDS

SEQ ID NO: 2746237 - protein, 7 aa, Entamoeba invadens
AETIITD

SEQ ID NO: 2746238 - protein, 14 aa, Entamoeba invadens
AETKMSSKIDPDEL

SEQ ID NO: 2746239 - protein, 7 aa, Entamoeba invadens
AETKTSN

SEQ ID NO: 2746240 - protein, 4 aa, Entamoeba invadens
AETL

SEQ ID NO: 2746241 - protein, 8 aa, Entamoeba invadens
AETPNTDI

SEQ ID NO: 2746242 - protein, 4 aa, Entamoeba invadens
AETQ

SEQ ID NO: 2746243 - protein, 5 aa, Entamoeba invadens
AETQC

SEQ ID NO: 2746244 - protein, 7 aa, Entamoeba invadens
AETSAEY

SEQ ID NO: 2746245 - protein, 8 aa, Entamoeba invadens
AETSNKKK

SEQ ID NO: 2746246 - protein, 10 aa, Entamoeba invadens
AETSNPDCST

SEQ ID NO: 2746247 - protein, 12 aa, Entamoeba invadens
AETSRKRKPYDL

SEQ ID NO: 2746248 - protein, 8 aa, Entamoeba invadens
AETTDEVY

SEQ ID NO: 2746249 - protein, 11 aa, Entamoeba invadens
AETTEYPQPTY

SEQ ID NO: 2746250 - protein, 5 aa, Entamoeba invadens
AEVGE

SEQ ID NO: 2746251 - protein, 5 aa, Entamoeba invadens
AEVTI

SEQ ID NO: 2746252 - protein, 4 aa, Entamoeba invadens
AEYG

SEQ ID NO: 2746253 - protein, 8 aa, Entamoeba invadens
AEYTKPTI

SEQ ID NO: 2746254 - protein, 20 aa, Entamoeba invadens
AFDPSQTSTGSRISYVSSTD

SEQ ID NO: 2746255 - protein, 6 aa, Entamoeba invadens
AFDSEK

SEQ ID NO: 2746256 - protein, 4 aa, Entamoeba invadens
AFEA

SEQ ID NO: 2746257 - protein, 9 aa, Entamoeba invadens
AFEESEESI

SEQ ID NO: 2746258 - protein, 19 aa, Entamoeba invadens
AFEGATKLTSISANNGIED

SEQ ID NO: 2746259 - protein, 9 aa, Entamoeba invadens
AFENESKSD

SEQ ID NO: 2746260 - protein, 9 aa, Entamoeba invadens
AFENTPSLE

SEQ ID NO: 2746261 - protein, 8 aa, Entamoeba invadens
AFGAEEKW

SEQ ID NO: 2746262 - protein, 5 aa, Entamoeba invadens
AFHGY

SEQ ID NO: 2746263 - protein, 8 aa, Entamoeba invadens
AFKGATKL

SEQ ID NO: 2746264 - protein, 5 aa, Entamoeba invadens
AFKGS

SEQ ID NO: 2746265 - protein, 10 aa, Entamoeba invadens
AFKGYYKEPD

SEQ ID NO: 2746266 - protein, 8 aa, Entamoeba invadens
AFKQTDQL

SEQ ID NO: 2746267 - protein, 8 aa, Entamoeba invadens
AFKQTNKL

SEQ ID NO: 2746268 - protein, 4 aa, Entamoeba invadens
AFPA

SEQ ID NO: 2746269 - protein, 5 aa, Entamoeba invadens
AFPKE

SEQ ID NO: 2746270 - protein, 5 aa, Entamoeba invadens
AFPKS

SEQ ID NO: 2746271 - protein, 5 aa, Entamoeba invadens
AFPNE

SEQ ID NO: 2746272 - protein, 4 aa, Entamoeba invadens
AFPP

SEQ ID NO: 2746273 - protein, 5 aa, Entamoeba invadens
AFPRG

SEQ ID NO: 2746274 - protein, 7 aa, Entamoeba invadens
AFPSTQR

SEQ ID NO: 2746275 - protein, 4 aa, Entamoeba invadens
AFQG

SEQ ID NO: 2746276 - protein, 18 aa, Entamoeba invadens
AFQTTSNDNPSSDKISEV

SEQ ID NO: 2746277 - protein, 7 aa, Entamoeba invadens
AFRNSGL

SEQ ID NO: 2746278 - protein, 25 aa, Entamoeba invadens
AFSDGTEESYNIQPPCTPRGDQNAS

SEQ ID NO: 2746279 - protein, 4 aa, Entamoeba invadens
AFSG

SEQ ID NO: 2746280 - protein, 10 aa, Entamoeba invadens
AFSQTNKTNE

SEQ ID NO: 2746281 - protein, 4 aa, Entamoeba invadens
AFST

SEQ ID NO: 2746282 - protein, 8 aa, Entamoeba invadens
AFTENTLT

SEQ ID NO: 2746283 - protein, 17 aa, Entamoeba invadens
AFTQPELEERCKDTHNE

SEQ ID NO: 2746284 - protein, 9 aa, Entamoeba invadens
AFVPSDTST

SEQ ID NO: 2746285 - protein, 5 aa, Entamoeba invadens
AGADS

SEQ ID NO: 2746286 - protein, 8 aa, Entamoeba invadens
AGAENSYN

SEQ ID NO: 2746287 - protein, 6 aa, Entamoeba invadens
AGAIYS

SEQ ID NO: 2746288 - protein, 6 aa, Entamoeba invadens
AGAIYT

SEQ ID NO: 2746289 - protein, 9 aa, Entamoeba invadens
AGAKVASPE

SEQ ID NO: 2746290 - protein, 9 aa, Entamoeba invadens
AGAMKEEQV

SEQ ID NO: 2746291 - protein, 8 aa, Entamoeba invadens
AGAPDVEN

SEQ ID NO: 2746292 - protein, 9 aa, Entamoeba invadens
AGCENTTTH

SEQ ID NO: 2746293 - protein, 10 aa, Entamoeba invadens
AGCPNTRTGK

SEQ ID NO: 2746294 - protein, 5 aa, Entamoeba invadens
AGCQP

SEQ ID NO: 2746295 - protein, 4 aa, Entamoeba invadens
AGDD

SEQ ID NO: 2746296 - protein, 10 aa, Entamoeba invadens
AGDDSFQLDS

SEQ ID NO: 2746297 - protein, 9 aa, Entamoeba invadens
AGDEVENKE

SEQ ID NO: 2746298 - protein, 17 aa, Entamoeba invadens
AGDQADAYKSFPSGHSS

SEQ ID NO: 2746299 - protein, 8 aa, Entamoeba invadens
AGEDIQTA

SEQ ID NO: 2746300 - protein, 10 aa, Entamoeba invadens
AGEDRAFDAD

SEQ ID NO: 2746301 - protein, 6 aa, Entamoeba invadens
AGEFTP

SEQ ID NO: 2746302 - protein, 30 aa, Entamoeba invadens
AGEKSPKNKRYSNIPSLSNSKVISDRDKLK

SEQ ID NO: 2746303 - protein, 22 aa, Entamoeba invadens
AGELTTKITSDVKTISDAMSPR

SEQ ID NO: 2746304 - protein, 6 aa, Entamoeba invadens
AGEQSK

SEQ ID NO: 2746305 - protein, 4 aa, Entamoeba invadens
AGER

SEQ ID NO: 2746306 - protein, 7 aa, Entamoeba invadens
AGETEGV

SEQ ID NO: 2746307 - protein, 13 aa, Entamoeba invadens
AGEYQDRVGQSRC

SEQ ID NO: 2746308 - protein, 8 aa, Entamoeba invadens
AGFAQPAS

SEQ ID NO: 2746309 - protein, 6 aa, Entamoeba invadens
AGFDPI

SEQ ID NO: 2746310 - protein, 8 aa, Entamoeba invadens
AGFSDSGT

SEQ ID NO: 2746311 - protein, 6 aa, Entamoeba invadens
AGFSQK

SEQ ID NO: 2746312 - protein, 5 aa, Entamoeba invadens
AGGET

SEQ ID NO: 2746313 - protein, 6 aa, Entamoeba invadens
AGGNGQ

SEQ ID NO: 2746314 - protein, 7 aa, Entamoeba invadens
AGGTKLN

SEQ ID NO: 2746315 - protein, 9 aa, Entamoeba invadens
AGGVGARTT

SEQ ID NO: 2746316 - protein, 8 aa, Entamoeba invadens
AGHDHKDS

SEQ ID NO: 2746317 - protein, 4 aa, Entamoeba invadens
AGIK

SEQ ID NO: 2746318 - protein, 17 aa, Entamoeba invadens
AGIKEKRCGSGSKNRYL

SEQ ID NO: 2746319 - protein, 9 aa, Entamoeba invadens
AGITDSSGN

SEQ ID NO: 2746320 - protein, 7 aa, Entamoeba invadens
AGITEDL

SEQ ID NO: 2746321 - protein, 10 aa, Entamoeba invadens
AGKAAKTLET

SEQ ID NO: 2746322 - protein, 21 aa, Entamoeba invadens
AGKEEKEEKEKKDEKNENSIS

SEQ ID NO: 2746323 - protein, 10 aa, Entamoeba invadens
AGKEVAEATK

SEQ ID NO: 2746324 - protein, 9 aa, Entamoeba invadens
AGKKSCSLA

SEQ ID NO: 2746325 - protein, 8 aa, Entamoeba invadens
AGKLEVGT

SEQ ID NO: 2746326 - protein, 8 aa, Entamoeba invadens
AGKLGDKV

SEQ ID NO: 2746327 - protein, 13 aa, Entamoeba invadens
AGKPGPKDECIAG

SEQ ID NO: 2746328 - protein, 16 aa, Entamoeba invadens
AGKSLEKRGDMTSKEY

SEQ ID NO: 2746329 - protein, 6 aa, Entamoeba invadens
AGKSYA

SEQ ID NO: 2746330 - protein, 8 aa, Entamoeba invadens
AGKTVDQC

SEQ ID NO: 2746331 - protein, 27 aa, Entamoeba invadens
AGKYSSSTGSTSCSTCPAGKYSSSGAS

SEQ ID NO: 2746332 - protein, 6 aa, Entamoeba invadens
AGLPKC

SEQ ID NO: 2746333 - protein, 4 aa, Entamoeba invadens
AGLQ

SEQ ID NO: 2746334 - protein, 4 aa, Entamoeba invadens
AGND

SEQ ID NO: 2746335 - protein, 5 aa, Entamoeba invadens
AGNFK

SEQ ID NO: 2746336 - protein, 6 aa, Entamoeba invadens
AGNGEY

SEQ ID NO: 2746337 - protein, 13 aa, Entamoeba invadens
AGNGGGMSAGELG

SEQ ID NO: 2746338 - protein, 7 aa, Entamoeba invadens
AGNGYAN

SEQ ID NO: 2746339 - protein, 9 aa, Entamoeba invadens
AGNKKIDNS

SEQ ID NO: 2746340 - protein, 7 aa, Entamoeba invadens
AGNPYLS

SEQ ID NO: 2746341 - protein, 7 aa, Entamoeba invadens
AGNRIQK

SEQ ID NO: 2746342 - protein, 11 aa, Entamoeba invadens
AGNRRPKLENM

SEQ ID NO: 2746343 - protein, 8 aa, Entamoeba invadens
AGNTEANC

SEQ ID NO: 2746344 - protein, 4 aa, Entamoeba invadens
AGNY

SEQ ID NO: 2746345 - protein, 13 aa, Entamoeba invadens
AGPCGPCTAGGKT

SEQ ID NO: 2746346 - protein, 8 aa, Entamoeba invadens
AGPHPNSE

SEQ ID NO: 2746347 - protein, 6 aa, Entamoeba invadens
AGPQLN

SEQ ID NO: 2746348 - protein, 5 aa, Entamoeba invadens
AGPSL

SEQ ID NO: 2746349 - protein, 9 aa, Entamoeba invadens
AGQDVNDSL

SEQ ID NO: 2746350 - protein, 6 aa, Entamoeba invadens
AGQSGI

SEQ ID NO: 2746351 - protein, 6 aa, Entamoeba invadens
AGQTLL

SEQ ID NO: 2746352 - protein, 31 aa, Entamoeba invadens
AGQYTSTSGSTSCKKCTSGYYASSGATSCTK

SEQ ID NO: 2746353 - protein, 8 aa, Entamoeba invadens
AGRKDCGN

SEQ ID NO: 2746354 - protein, 5 aa, Entamoeba invadens
AGSGY

SEQ ID NO: 2746355 - protein, 5 aa, Entamoeba invadens
AGSIK

SEQ ID NO: 2746356 - protein, 8 aa, Entamoeba invadens
AGSKRRDY

SEQ ID NO: 2746357 - protein, 8 aa, Entamoeba invadens
AGSNPGIA

SEQ ID NO: 2746358 - protein, 13 aa, Entamoeba invadens
AGSRPSQYGDITD

SEQ ID NO: 2746359 - protein, 5 aa, Entamoeba invadens
AGSSE

SEQ ID NO: 2746360 - protein, 8 aa, Entamoeba invadens
AGSSGGCE

SEQ ID NO: 2746361 - protein, 6 aa, Entamoeba invadens
AGSSYP

SEQ ID NO: 2746362 - protein, 8 aa, Entamoeba invadens
AGSTFLPE

SEQ ID NO: 2746363 - protein, 10 aa, Entamoeba invadens
AGSTINNESI

SEQ ID NO: 2746364 - protein, 41 aa, Entamoeba invadens
AGSTNKVLKTEESIQLPSTSNNNIQIPTTTPQQSDKKSKVY

SEQ ID NO: 2746365 - protein, 17 aa, Entamoeba invadens
AGSTTAKCTKCTKETDY

SEQ ID NO: 2746366 - protein, 8 aa, Entamoeba invadens
AGSTTCKS

SEQ ID NO: 2746367 - protein, 23 aa, Entamoeba invadens
AGSTTCKSCSSTCSSCDKTNGYC

SEQ ID NO: 2746368 - protein, 8 aa, Entamoeba invadens
AGSYQNMT

SEQ ID NO: 2746369 - protein, 11 aa, Entamoeba invadens
AGSYSNGSDKL

SEQ ID NO: 2746370 - protein, 30 aa, Entamoeba invadens
AGSYSNKGATTCTTCTGGYYSQYSESASCT

SEQ ID NO: 2746371 - protein, 11 aa, Entamoeba invadens
AGSYSSKISSS

SEQ ID NO: 2746372 - protein, 26 aa, Entamoeba invadens
AGSYSVSGSSNCTKCETGYYSKSGYS

SEQ ID NO: 2746373 - protein, 5 aa, Entamoeba invadens
AGTAL

SEQ ID NO: 2746374 - protein, 12 aa, Entamoeba invadens
AGTATNKDTNTC

SEQ ID NO: 2746375 - protein, 13 aa, Entamoeba invadens
AGTCEKESNNNLR

SEQ ID NO: 2746376 - protein, 9 aa, Entamoeba invadens
AGTDLETAR

SEQ ID NO: 2746377 - protein, 10 aa, Entamoeba invadens
AGTKANQVTN

SEQ ID NO: 2746378 - protein, 5 aa, Entamoeba invadens
AGTKN

SEQ ID NO: 2746379 - protein, 11 aa, Entamoeba invadens
AGTKPNYYNST

SEQ ID NO: 2746380 - protein, 11 aa, Entamoeba invadens
AGTKSNQTTNV

SEQ ID NO: 2746381 - protein, 20 aa, Entamoeba invadens
AGTMPPQNYSVDPQHNETIK

SEQ ID NO: 2746382 - protein, 9 aa, Entamoeba invadens
AGTNDTNTL

SEQ ID NO: 2746383 - protein, 16 aa, Entamoeba invadens
AGTQTNGVTSSGTAQV

SEQ ID NO: 2746384 - protein, 12 aa, Entamoeba invadens
AGTRANQETNKC

SEQ ID NO: 2746385 - protein, 7 aa, Entamoeba invadens
AGTSTIE

SEQ ID NO: 2746386 - protein, 15 aa, Entamoeba invadens
AGTTNTDFSTFMSFL

SEQ ID NO: 2746387 - protein, 10 aa, Entamoeba invadens
AGTTTLQSSS

SEQ ID NO: 2746388 - protein, 9 aa, Entamoeba invadens
AGTVDPTHE

SEQ ID NO: 2746389 - protein, 6 aa, Entamoeba invadens
AGTVGN

SEQ ID NO: 2746390 - protein, 4 aa, Entamoeba invadens
AGTY

SEQ ID NO: 2746391 - protein, 14 aa, Entamoeba invadens
AGTYASSGASSCTK

SEQ ID NO: 2746392 - protein, 14 aa, Entamoeba invadens
AGTYATSGSSSCYS

SEQ ID NO: 2746393 - protein, 12 aa, Entamoeba invadens
AGTYKKTETTCD

SEQ ID NO: 2746394 - protein, 42 aa, Entamoeba invadens
AGTYKNEIGNSTCTQCEAGTYSNEGAQTCTSCSGGTYSPQNS

SEQ ID NO: 2746395 - protein, 12 aa, Entamoeba invadens
AGTYNNKNKQSV

SEQ ID NO: 2746396 - protein, 7 aa, Entamoeba invadens
AGTYPSG

SEQ ID NO: 2746397 - protein, 6 aa, Entamoeba invadens
AGTYQS

SEQ ID NO: 2746398 - protein, 7 aa, Entamoeba invadens
AGTYRDE

SEQ ID NO: 2746399 - protein, 9 aa, Entamoeba invadens
AGTYSENGV

SEQ ID NO: 2746400 - protein, 9 aa, Entamoeba invadens
AGTYSKDGS

SEQ ID NO: 2746401 - protein, 29 aa, Entamoeba invadens
AGTYSKQNAPSCTNCGDGTYSKEGATSCT

SEQ ID NO: 2746402 - protein, 30 aa, Entamoeba invadens
AGTYSNGTSKISCSNCPAGYYSKTKAGSCT

SEQ ID NO: 2746403 - protein, 10 aa, Entamoeba invadens
AGTYSNNKSM

SEQ ID NO: 2746404 - protein, 9 aa, Entamoeba invadens
AGTYSSANK

SEQ ID NO: 2746405 - protein, 12 aa, Entamoeba invadens
AGTYSSGGTTIS

SEQ ID NO: 2746406 - protein, 127 aa, Entamoeba invadens
AGTYSSGGTTTNCTSCSPGSYSNSGASSCTKCNPGKYASGTGSTSCSTCSAGTYSGTGASSCTKCSAGSYSSTGSSSCSTCSAGTYSSSGSSKCTKCNAGTYSSSSGASSCTKCSAGYYSGTGASSC

SEQ ID NO: 2746407 - protein, 13 aa, Entamoeba invadens
AGTYSSNDGASSC

SEQ ID NO: 2746408 - protein, 7 aa, Entamoeba invadens
AGTYSSS

SEQ ID NO: 2746409 - protein, 28 aa, Entamoeba invadens
AGTYSSSGSSTCTKCNAGSYSSSGSTSC

SEQ ID NO: 2746410 - protein, 25 aa, Entamoeba invadens
AGTYSSTKNANTCSKCPSGTFSYTG

SEQ ID NO: 2746411 - protein, 9 aa, Entamoeba invadens
AGTYSTENK

SEQ ID NO: 2746412 - protein, 7 aa, Entamoeba invadens
AGTYSVA

SEQ ID NO: 2746413 - protein, 12 aa, Entamoeba invadens
AGTYSYLGSSKC

SEQ ID NO: 2746414 - protein, 9 aa, Entamoeba invadens
AGTYTLDRG

SEQ ID NO: 2746415 - protein, 9 aa, Entamoeba invadens
AGTYTNGGV

SEQ ID NO: 2746416 - protein, 17 aa, Entamoeba invadens
AGTYTSSNGSSSCTQCN

SEQ ID NO: 2746417 - protein, 9 aa, Entamoeba invadens
AGVGKDAKP

SEQ ID NO: 2746418 - protein, 6 aa, Entamoeba invadens
AGVSAD

SEQ ID NO: 2746419 - protein, 23 aa, Entamoeba invadens
AGVTPSPIVPSSTNTPREDLKNQ

SEQ ID NO: 2746420 - protein, 7 aa, Entamoeba invadens
AGVTRTA

SEQ ID NO: 2746421 - protein, 4 aa, Entamoeba invadens
AGYG

SEQ ID NO: 2746422 - protein, 10 aa, Entamoeba invadens
AGYHSAGGAI

SEQ ID NO: 2746423 - protein, 5 aa, Entamoeba invadens
AGYNT

SEQ ID NO: 2746424 - protein, 6 aa, Entamoeba invadens
AGYNTF

SEQ ID NO: 2746425 - protein, 12 aa, Entamoeba invadens
AGYSSYSGSSSC

SEQ ID NO: 2746426 - protein, 7 aa, Entamoeba invadens
AGYTDTK

SEQ ID NO: 2746427 - protein, 8 aa, Entamoeba invadens
AGYTKVGE

SEQ ID NO: 2746428 - protein, 12 aa, Entamoeba invadens
AGYYPQTNSPFT

SEQ ID NO: 2746429 - protein, 45 aa, Entamoeba invadens
AGYYSGSASSSCRQCSEGTYSSYGASTCTSCSAGTYSSSSGSSVC

SEQ ID NO: 2746430 - protein, 19 aa, Entamoeba invadens
AGYYSPDGTSCSKCPTNSY

SEQ ID NO: 2746431 - protein, 7 aa, Entamoeba invadens
AHASLKD

SEQ ID NO: 2746432 - protein, 6 aa, Entamoeba invadens
AHATNK

SEQ ID NO: 2746433 - protein, 5 aa, Entamoeba invadens
AHCET

SEQ ID NO: 2746434 - protein, 7 aa, Entamoeba invadens
AHDGQCS

SEQ ID NO: 2746435 - protein, 5 aa, Entamoeba invadens
AHFPQ

SEQ ID NO: 2746436 - protein, 7 aa, Entamoeba invadens
AHKEKEM

SEQ ID NO: 2746437 - protein, 11 aa, Entamoeba invadens
AHNPGQKSDFR

SEQ ID NO: 2746438 - protein, 8 aa, Entamoeba invadens
AHNSTNMG

SEQ ID NO: 2746439 - protein, 7 aa, Entamoeba invadens
AHNSTSY

SEQ ID NO: 2746440 - protein, 11 aa, Entamoeba invadens
AHNTTFDESQY

SEQ ID NO: 2746441 - protein, 5 aa, Entamoeba invadens
AHPGA

SEQ ID NO: 2746442 - protein, 5 aa, Entamoeba invadens
AHPPP

SEQ ID NO: 2746443 - protein, 5 aa, Entamoeba invadens
AHPTL

SEQ ID NO: 2746444 - protein, 6 aa, Entamoeba invadens
AHQCKK

SEQ ID NO: 2746445 - protein, 12 aa, Entamoeba invadens
AHQEDKTQLYTT

SEQ ID NO: 2746446 - protein, 11 aa, Entamoeba invadens
AHQPDTRVSAN

SEQ ID NO: 2746447 - protein, 6 aa, Entamoeba invadens
AHRNDG

SEQ ID NO: 2746448 - protein, 8 aa, Entamoeba invadens
AHSAEEIK

SEQ ID NO: 2746449 - protein, 8 aa, Entamoeba invadens
AHSASQRI

SEQ ID NO: 2746450 - protein, 7 aa, Entamoeba invadens
AHSDSEK

SEQ ID NO: 2746451 - protein, 8 aa, Entamoeba invadens
AHSNKTPF

SEQ ID NO: 2746452 - protein, 10 aa, Entamoeba invadens
AHTDKSEYIP

SEQ ID NO: 2746453 - protein, 10 aa, Entamoeba invadens
AHTENSTRID

SEQ ID NO: 2746454 - protein, 6 aa, Entamoeba invadens
AHTNSL

SEQ ID NO: 2746455 - protein, 7 aa, Entamoeba invadens
AHTSIGS

SEQ ID NO: 2746456 - protein, 13 aa, Entamoeba invadens
AHTTSESKTNSKQ

SEQ ID NO: 2746457 - protein, 8 aa, Entamoeba invadens
AHVGGPER

SEQ ID NO: 2746458 - protein, 7 aa, Entamoeba invadens
AIAESTI

SEQ ID NO: 2746459 - protein, 6 aa, Entamoeba invadens
AIAKAT

SEQ ID NO: 2746460 - protein, 7 aa, Entamoeba invadens
AIDGETN

SEQ ID NO: 2746461 - protein, 10 aa, Entamoeba invadens
AIDNEDLGDF

SEQ ID NO: 2746462 - protein, 11 aa, Entamoeba invadens
AIDNGKCRKCD

SEQ ID NO: 2746463 - protein, 7 aa, Entamoeba invadens
AIDTANK

SEQ ID NO: 2746464 - protein, 6 aa, Entamoeba invadens
AIESED

SEQ ID NO: 2746465 - protein, 19 aa, Entamoeba invadens
AIGEGKNEVITTQSSHSLP

SEQ ID NO: 2746466 - protein, 11 aa, Entamoeba invadens
AIGGSSSTSFF

SEQ ID NO: 2746467 - protein, 5 aa, Entamoeba invadens
AIGTE

SEQ ID NO: 2746468 - protein, 5 aa, Entamoeba invadens
AIKDT

SEQ ID NO: 2746469 - protein, 5 aa, Entamoeba invadens
AIKRT

SEQ ID NO: 2746470 - protein, 12 aa, Entamoeba invadens
AINAINSQTEIN

SEQ ID NO: 2746471 - protein, 10 aa, Entamoeba invadens
AINDKTLAGT

SEQ ID NO: 2746472 - protein, 10 aa, Entamoeba invadens
AINEKGRGME

SEQ ID NO: 2746473 - protein, 6 aa, Entamoeba invadens
AINSNK

SEQ ID NO: 2746474 - protein, 10 aa, Entamoeba invadens
AIPDSTFSGC

SEQ ID NO: 2746475 - protein, 6 aa, Entamoeba invadens
AIPTGG

SEQ ID NO: 2746476 - protein, 9 aa, Entamoeba invadens
AIQDSLTDE

SEQ ID NO: 2746477 - protein, 4 aa, Entamoeba invadens
AIQP

SEQ ID NO: 2746478 - protein, 7 aa, Entamoeba invadens
AIRNKAE

SEQ ID NO: 2746479 - protein, 10 aa, Entamoeba invadens
AISEDQKEAW

SEQ ID NO: 2746480 - protein, 18 aa, Entamoeba invadens
AISGKCKSCTSGYGYSNG

SEQ ID NO: 2746481 - protein, 15 aa, Entamoeba invadens
AISHSSSTSPSPSEV

SEQ ID NO: 2746482 - protein, 19 aa, Entamoeba invadens
AISKRGKQVEQLNQASTVN

SEQ ID NO: 2746483 - protein, 10 aa, Entamoeba invadens
AISNKTTSKI

SEQ ID NO: 2746484 - protein, 7 aa, Entamoeba invadens
AISNTEY

SEQ ID NO: 2746485 - protein, 5 aa, Entamoeba invadens
AISSA

SEQ ID NO: 2746486 - protein, 18 aa, Entamoeba invadens
AISTNPSRSSSPTKIEVP

SEQ ID NO: 2746487 - protein, 5 aa, Entamoeba invadens
AITEE

SEQ ID NO: 2746488 - protein, 20 aa, Entamoeba invadens
AITNKGKKTIDFRKDKKKDD

SEQ ID NO: 2746489 - protein, 6 aa, Entamoeba invadens
AITNTT

SEQ ID NO: 2746490 - protein, 8 aa, Entamoeba invadens
AITRTTGT

SEQ ID NO: 2746491 - protein, 5 aa, Entamoeba invadens
AKADD

SEQ ID NO: 2746492 - protein, 7 aa, Entamoeba invadens
AKAKPWS

SEQ ID NO: 2746493 - protein, 10 aa, Entamoeba invadens
AKAQDAKENL

SEQ ID NO: 2746494 - protein, 7 aa, Entamoeba invadens
AKATESF

SEQ ID NO: 2746495 - protein, 5 aa, Entamoeba invadens
AKATY

SEQ ID NO: 2746496 - protein, 7 aa, Entamoeba invadens
AKAVGNY

SEQ ID NO: 2746497 - protein, 13 aa, Entamoeba invadens
AKCDEQCAKSATE

SEQ ID NO: 2746498 - protein, 6 aa, Entamoeba invadens
AKCDNT

SEQ ID NO: 2746499 - protein, 7 aa, Entamoeba invadens
AKCDSQS

SEQ ID NO: 2746500 - protein, 9 aa, Entamoeba invadens
AKCDSTCKT

SEQ ID NO: 2746501 - protein, 9 aa, Entamoeba invadens
AKCEKCDGS

SEQ ID NO: 2746502 - protein, 7 aa, Entamoeba invadens
AKCETTK

SEQ ID NO: 2746503 - protein, 7 aa, Entamoeba invadens
AKCNENC

SEQ ID NO: 2746504 - protein, 14 aa, Entamoeba invadens
AKCSGESACDECES

SEQ ID NO: 2746505 - protein, 9 aa, Entamoeba invadens
AKCSQTSNE

SEQ ID NO: 2746506 - protein, 10 aa, Entamoeba invadens
AKCSTPNMYP

SEQ ID NO: 2746507 - protein, 8 aa, Entamoeba invadens
AKCTGGCV

SEQ ID NO: 2746508 - protein, 10 aa, Entamoeba invadens
AKDAKKMKEQ

SEQ ID NO: 2746509 - protein, 8 aa, Entamoeba invadens
AKDGTNQL

SEQ ID NO: 2746510 - protein, 5 aa, Entamoeba invadens
AKDIA

SEQ ID NO: 2746511 - protein, 7 aa, Entamoeba invadens
AKDQSAT

SEQ ID NO: 2746512 - protein, 12 aa, Entamoeba invadens
AKDSASPEDQER

SEQ ID NO: 2746513 - protein, 5 aa, Entamoeba invadens
AKDVI

SEQ ID NO: 2746514 - protein, 13 aa, Entamoeba invadens
AKEDQKVADDDIS

SEQ ID NO: 2746515 - protein, 8 aa, Entamoeba invadens
AKEECTSC

SEQ ID NO: 2746516 - protein, 7 aa, Entamoeba invadens
AKEGQNI

SEQ ID NO: 2746517 - protein, 8 aa, Entamoeba invadens
AKENEEKM

SEQ ID NO: 2746518 - protein, 6 aa, Entamoeba invadens
AKENGR

SEQ ID NO: 2746519 - protein, 48 aa, Entamoeba invadens
AKEQKAKLLESAEKDTTKNVSKNKKRDIYKQKQKQKTQESVETRPSEN

SEQ ID NO: 2746520 - protein, 12 aa, Entamoeba invadens
AKESESLRTSES

SEQ ID NO: 2746521 - protein, 4 aa, Entamoeba invadens
AKET

SEQ ID NO: 2746522 - protein, 9 aa, Entamoeba invadens
AKETEASLA

SEQ ID NO: 2746523 - protein, 7 aa, Entamoeba invadens
AKETGDI

SEQ ID NO: 2746524 - protein, 36 aa, Entamoeba invadens
AKEVSQPKETWKQKSERLAREKQEKEKQEQLARDEK

SEQ ID NO: 2746525 - protein, 4 aa, Entamoeba invadens
AKFD

SEQ ID NO: 2746526 - protein, 8 aa, Entamoeba invadens
AKGDITED

SEQ ID NO: 2746527 - protein, 7 aa, Entamoeba invadens
AKGEGYS

SEQ ID NO: 2746528 - protein, 26 aa, Entamoeba invadens
AKGETSIAETLKNTEHKDEAHQEHTE

SEQ ID NO: 2746529 - protein, 40 aa, Entamoeba invadens
AKGETSIAETLKNTEHKEEGDDDDDDKNGEDAKQETPNGT

SEQ ID NO: 2746530 - protein, 5 aa, Entamoeba invadens
AKGFT

SEQ ID NO: 2746531 - protein, 51 aa, Entamoeba invadens
AKGFTKNSTVESSNRNLTKNATKNMTKNNTTNNSSMTTRDKTAAEKQMDKK

SEQ ID NO: 2746532 - protein, 56 aa, Entamoeba invadens
AKGFTKNSTVESSSRNLTKNTTKNMTKNNTTGNLSATVRDKTAAEKQMDKKMEEFG

SEQ ID NO: 2746533 - protein, 6 aa, Entamoeba invadens
AKGGEC

SEQ ID NO: 2746534 - protein, 13 aa, Entamoeba invadens
AKGGETDKDFDEF

SEQ ID NO: 2746535 - protein, 14 aa, Entamoeba invadens
AKGGLTQEEAQKQI

SEQ ID NO: 2746536 - protein, 6 aa, Entamoeba invadens
AKGKNI

SEQ ID NO: 2746537 - protein, 11 aa, Entamoeba invadens
AKGKRNYKTEQ

SEQ ID NO: 2746538 - protein, 9 aa, Entamoeba invadens
AKGNSLNAI

SEQ ID NO: 2746539 - protein, 7 aa, Entamoeba invadens
AKGQTSE

SEQ ID NO: 2746540 - protein, 25 aa, Entamoeba invadens
AKGSFKENMDNSSNEEKSGSLSPQI

SEQ ID NO: 2746541 - protein, 7 aa, Entamoeba invadens
AKGYKKN

SEQ ID NO: 2746542 - protein, 11 aa, Entamoeba invadens
AKHRTAEGKVP

SEQ ID NO: 2746543 - protein, 14 aa, Entamoeba invadens
AKHVKKTCNFKMQS

SEQ ID NO: 2746544 - protein, 5 aa, Entamoeba invadens
AKHYP

SEQ ID NO: 2746545 - protein, 10 aa, Entamoeba invadens
AKIESKEKIE

SEQ ID NO: 2746546 - protein, 16 aa, Entamoeba invadens
AKIPRSVSLPKSNNKL

SEQ ID NO: 2746547 - protein, 6 aa, Entamoeba invadens
AKITGK

SEQ ID NO: 2746548 - protein, 10 aa, Entamoeba invadens
AKKADSVGEA

SEQ ID NO: 2746549 - protein, 7 aa, Entamoeba invadens
AKKALAD

SEQ ID NO: 2746550 - protein, 6 aa, Entamoeba invadens
AKKATE

SEQ ID NO: 2746551 - protein, 12 aa, Entamoeba invadens
AKKCHYNAETQG

SEQ ID NO: 2746552 - protein, 24 aa, Entamoeba invadens
AKKCIKDGSGEAKCKDDVKITKED

SEQ ID NO: 2746553 - protein, 9 aa, Entamoeba invadens
AKKDANGKA

SEQ ID NO: 2746554 - protein, 10 aa, Entamoeba invadens
AKKENLNDFQ

SEQ ID NO: 2746555 - protein, 11 aa, Entamoeba invadens
AKKESSDLKEL

SEQ ID NO: 2746556 - protein, 50 aa, Entamoeba invadens
AKKEVSALADNTEKKEENVVAPAKAEEKKEAVKATVASSEWEDQKKEEKK

SEQ ID NO: 2746557 - protein, 19 aa, Entamoeba invadens
AKKKKEKEEKINQSETKKD

SEQ ID NO: 2746558 - protein, 7 aa, Entamoeba invadens
AKKKKVV

SEQ ID NO: 2746559 - protein, 5 aa, Entamoeba invadens
AKKNK

SEQ ID NO: 2746560 - protein, 8 aa, Entamoeba invadens
AKKNKRDV

SEQ ID NO: 2746561 - protein, 12 aa, Entamoeba invadens
AKKNPNGIPYGC

SEQ ID NO: 2746562 - protein, 7 aa, Entamoeba invadens
AKKQEYA

SEQ ID NO: 2746563 - protein, 9 aa, Entamoeba invadens
AKKQTGQIK

SEQ ID NO: 2746564 - protein, 5 aa, Entamoeba invadens
AKKRM

SEQ ID NO: 2746565 - protein, 5 aa, Entamoeba invadens
AKKTI

SEQ ID NO: 2746566 - protein, 24 aa, Entamoeba invadens
AKKTTEKSQVYDTKASSIAESTLG

SEQ ID NO: 2746567 - protein, 5 aa, Entamoeba invadens
AKKTV

SEQ ID NO: 2746568 - protein, 9 aa, Entamoeba invadens
AKLGEKAYK

SEQ ID NO: 2746569 - protein, 22 aa, Entamoeba invadens
AKLQEDKKKCYTTCPSGTYATA

SEQ ID NO: 2746570 - protein, 4 aa, Entamoeba invadens
AKLS

SEQ ID NO: 2746571 - protein, 10 aa, Entamoeba invadens
AKLSKSPKQM

SEQ ID NO: 2746572 - protein, 10 aa, Entamoeba invadens
AKLTDFGSAR

SEQ ID NO: 2746573 - protein, 13 aa, Entamoeba invadens
AKLTDFGSARIST

SEQ ID NO: 2746574 - protein, 11 aa, Entamoeba invadens
AKLTDFGSARN

SEQ ID NO: 2746575 - protein, 11 aa, Entamoeba invadens
AKLTDFGSSRN

SEQ ID NO: 2746576 - protein, 11 aa, Entamoeba invadens
AKLTRRRNRLT

SEQ ID NO: 2746577 - protein, 7 aa, Entamoeba invadens
AKMGEGS

SEQ ID NO: 2746578 - protein, 10 aa, Entamoeba invadens
AKNEFNNKTN

SEQ ID NO: 2746579 - protein, 7 aa, Entamoeba invadens
AKNERDI

SEQ ID NO: 2746580 - protein, 10 aa, Entamoeba invadens
AKNGDFDEAA

SEQ ID NO: 2746581 - protein, 7 aa, Entamoeba invadens
AKNGKTC

SEQ ID NO: 2746582 - protein, 10 aa, Entamoeba invadens
AKNGPTEVSE

SEQ ID NO: 2746583 - protein, 25 aa, Entamoeba invadens
AKNGSNQNNYDEQMKTKSLDTSGDF

SEQ ID NO: 2746584 - protein, 7 aa, Entamoeba invadens
AKNGTLE

SEQ ID NO: 2746585 - protein, 21 aa, Entamoeba invadens
AKNINEKTARCRKKKSALGES

SEQ ID NO: 2746586 - protein, 9 aa, Entamoeba invadens
AKNINSDTV

SEQ ID NO: 2746587 - protein, 5 aa, Entamoeba invadens
AKNNK

SEQ ID NO: 2746588 - protein, 16 aa, Entamoeba invadens
AKNPPQPSGHDGYFPP

SEQ ID NO: 2746589 - protein, 8 aa, Entamoeba invadens
AKNREGDG

SEQ ID NO: 2746590 - protein, 8 aa, Entamoeba invadens
AKNRNDNL

SEQ ID NO: 2746591 - protein, 6 aa, Entamoeba invadens
AKNSKC

SEQ ID NO: 2746592 - protein, 7 aa, Entamoeba invadens
AKNSKCA

SEQ ID NO: 2746593 - protein, 9 aa, Entamoeba invadens
AKNSKLRNY

SEQ ID NO: 2746594 - protein, 7 aa, Entamoeba invadens
AKNTNSA

SEQ ID NO: 2746595 - protein, 7 aa, Entamoeba invadens
AKPGNLR

SEQ ID NO: 2746596 - protein, 14 aa, Entamoeba invadens
AKPISGSNECPTRG

SEQ ID NO: 2746597 - protein, 5 aa, Entamoeba invadens
AKPKL

SEQ ID NO: 2746598 - protein, 27 aa, Entamoeba invadens
AKPKVSSSIKTEDASDVNCQEGEYQKG

SEQ ID NO: 2746599 - protein, 8 aa, Entamoeba invadens
AKPPRENA

SEQ ID NO: 2746600 - protein, 4 aa, Entamoeba invadens
AKPV

SEQ ID NO: 2746601 - protein, 8 aa, Entamoeba invadens
AKQKKLGR

SEQ ID NO: 2746602 - protein, 12 aa, Entamoeba invadens
AKQKKTTKGSCE

SEQ ID NO: 2746603 - protein, 10 aa, Entamoeba invadens
AKQNCETSHN

SEQ ID NO: 2746604 - protein, 11 aa, Entamoeba invadens
AKQNELTDNDK

SEQ ID NO: 2746605 - protein, 5 aa, Entamoeba invadens
AKQNG

SEQ ID NO: 2746606 - protein, 8 aa, Entamoeba invadens
AKQNSEEK

SEQ ID NO: 2746607 - protein, 6 aa, Entamoeba invadens
AKQPSF

SEQ ID NO: 2746608 - protein, 7 aa, Entamoeba invadens
AKQQCGI

SEQ ID NO: 2746609 - protein, 6 aa, Entamoeba invadens
AKQQNV

SEQ ID NO: 2746610 - protein, 5 aa, Entamoeba invadens
AKRDE

SEQ ID NO: 2746611 - protein, 8 aa, Entamoeba invadens
AKRDKNGV

SEQ ID NO: 2746612 - protein, 14 aa, Entamoeba invadens
AKRKRSHSRGSQST

SEQ ID NO: 2746613 - protein, 16 aa, Entamoeba invadens
AKRQEQFGKNKTPDPV

SEQ ID NO: 2746614 - protein, 17 aa, Entamoeba invadens
AKSEEENSKEPSTSVEP

SEQ ID NO: 2746615 - protein, 7 aa, Entamoeba invadens
AKSEFSK

SEQ ID NO: 2746616 - protein, 8 aa, Entamoeba invadens
AKSEISED

SEQ ID NO: 2746617 - protein, 5 aa, Entamoeba invadens
AKSEL

SEQ ID NO: 2746618 - protein, 8 aa, Entamoeba invadens
AKSGEGVS

SEQ ID NO: 2746619 - protein, 15 aa, Entamoeba invadens
AKSGIQSLGTSAFEG

SEQ ID NO: 2746620 - protein, 5 aa, Entamoeba invadens
AKSGY

SEQ ID NO: 2746621 - protein, 15 aa, Entamoeba invadens
AKSIGIPIGGDPEDN

SEQ ID NO: 2746622 - protein, 10 aa, Entamoeba invadens
AKSKTGSANV

SEQ ID NO: 2746623 - protein, 12 aa, Entamoeba invadens
AKSKTKTNTESV

SEQ ID NO: 2746624 - protein, 14 aa, Entamoeba invadens
AKSNRKKRKTTTVL

SEQ ID NO: 2746625 - protein, 5 aa, Entamoeba invadens
AKSPL

SEQ ID NO: 2746626 - protein, 4 aa, Entamoeba invadens
AKSQ

SEQ ID NO: 2746627 - protein, 12 aa, Entamoeba invadens
AKSQDVNKEETM

SEQ ID NO: 2746628 - protein, 7 aa, Entamoeba invadens
AKSQTQS

SEQ ID NO: 2746629 - protein, 7 aa, Entamoeba invadens
AKSRTLG

SEQ ID NO: 2746630 - protein, 12 aa, Entamoeba invadens
AKSSNKKSRHHL

SEQ ID NO: 2746631 - protein, 9 aa, Entamoeba invadens
AKSTNLNDE

SEQ ID NO: 2746632 - protein, 7 aa, Entamoeba invadens
AKSTQNI

SEQ ID NO: 2746633 - protein, 9 aa, Entamoeba invadens
AKSVTSNNI

SEQ ID NO: 2746634 - protein, 8 aa, Entamoeba invadens
AKTAEGGK

SEQ ID NO: 2746635 - protein, 14 aa, Entamoeba invadens
AKTAGDVTNFATGS

SEQ ID NO: 2746636 - protein, 9 aa, Entamoeba invadens
AKTEAEESS

SEQ ID NO: 2746637 - protein, 10 aa, Entamoeba invadens
AKTELEGKQE

SEQ ID NO: 2746638 - protein, 7 aa, Entamoeba invadens
AKTETKI

SEQ ID NO: 2746639 - protein, 12 aa, Entamoeba invadens
AKTETNDYDTGI

SEQ ID NO: 2746640 - protein, 8 aa, Entamoeba invadens
AKTGGVSQ

SEQ ID NO: 2746641 - protein, 7 aa, Entamoeba invadens
AKTGQNV

SEQ ID NO: 2746642 - protein, 7 aa, Entamoeba invadens
AKTGSIV

SEQ ID NO: 2746643 - protein, 6 aa, Entamoeba invadens
AKTGTT

SEQ ID NO: 2746644 - protein, 6 aa, Entamoeba invadens
AKTKDT

SEQ ID NO: 2746645 - protein, 12 aa, Entamoeba invadens
AKTKKDKTKVKP

SEQ ID NO: 2746646 - protein, 14 aa, Entamoeba invadens
AKTKVSSRLDPDEL

SEQ ID NO: 2746647 - protein, 4 aa, Entamoeba invadens
AKTL

SEQ ID NO: 2746648 - protein, 8 aa, Entamoeba invadens
AKTNNTQF

SEQ ID NO: 2746649 - protein, 8 aa, Entamoeba invadens
AKTNRDVT

SEQ ID NO: 2746650 - protein, 8 aa, Entamoeba invadens
AKTSDIPS

SEQ ID NO: 2746651 - protein, 19 aa, Entamoeba invadens
AKTSDKSNLIYQNESRGIF

SEQ ID NO: 2746652 - protein, 6 aa, Entamoeba invadens
AKTTLD

SEQ ID NO: 2746653 - protein, 7 aa, Entamoeba invadens
AKTTSMS

SEQ ID NO: 2746654 - protein, 10 aa, Entamoeba invadens
AKVGDETPSK

SEQ ID NO: 2746655 - protein, 12 aa, Entamoeba invadens
AKVGGCKATYGT

SEQ ID NO: 2746656 - protein, 8 aa, Entamoeba invadens
AKVGQEYN

SEQ ID NO: 2746657 - protein, 5 aa, Entamoeba invadens
AKVQP

SEQ ID NO: 2746658 - protein, 8 aa, Entamoeba invadens
AKYGKPAD

SEQ ID NO: 2746659 - protein, 6 aa, Entamoeba invadens
AKYGSL

SEQ ID NO: 2746660 - protein, 5 aa, Entamoeba invadens
AKYNT

SEQ ID NO: 2746661 - protein, 5 aa, Entamoeba invadens
AKYPE

SEQ ID NO: 2746662 - protein, 11 aa, Entamoeba invadens
AKYTNGKCTRC

SEQ ID NO: 2746663 - protein, 6 aa, Entamoeba invadens
ALADND

SEQ ID NO: 2746664 - protein, 28 aa, Entamoeba invadens
ALASKSAKIKGDIKKGVEGMKKDIKKEL

SEQ ID NO: 2746665 - protein, 8 aa, Entamoeba invadens
ALDGETDF

SEQ ID NO: 2746666 - protein, 12 aa, Entamoeba invadens
ALDGKESGHDAM

SEQ ID NO: 2746667 - protein, 12 aa, Entamoeba invadens
ALDTPATSTRQL

SEQ ID NO: 2746668 - protein, 7 aa, Entamoeba invadens
ALEAPDT

SEQ ID NO: 2746669 - protein, 26 aa, Entamoeba invadens
ALEASQPHKIDKNEEKKKEKKEEKTP

SEQ ID NO: 2746670 - protein, 14 aa, Entamoeba invadens
ALEDPTNADSNCST

SEQ ID NO: 2746671 - protein, 11 aa, Entamoeba invadens
ALENASKGRTT

SEQ ID NO: 2746672 - protein, 7 aa, Entamoeba invadens
ALERSEM

SEQ ID NO: 2746673 - protein, 4 aa, Entamoeba invadens
ALGD

SEQ ID NO: 2746674 - protein, 9 aa, Entamoeba invadens
ALGDQTEKH

SEQ ID NO: 2746675 - protein, 7 aa, Entamoeba invadens
ALGGGDF

SEQ ID NO: 2746676 - protein, 4 aa, Entamoeba invadens
ALGT

SEQ ID NO: 2746677 - protein, 5 aa, Entamoeba invadens
ALGTN

SEQ ID NO: 2746678 - protein, 6 aa, Entamoeba invadens
ALGTTR

SEQ ID NO: 2746679 - protein, 7 aa, Entamoeba invadens
ALKCGND

SEQ ID NO: 2746680 - protein, 8 aa, Entamoeba invadens
ALKDDSQI

SEQ ID NO: 2746681 - protein, 7 aa, Entamoeba invadens
ALKEQEE

SEQ ID NO: 2746682 - protein, 8 aa, Entamoeba invadens
ALKGDKRS

SEQ ID NO: 2746683 - protein, 6 aa, Entamoeba invadens
ALKKSE

SEQ ID NO: 2746684 - protein, 10 aa, Entamoeba invadens
ALKTRTPRAF

SEQ ID NO: 2746685 - protein, 10 aa, Entamoeba invadens
ALKTSKGNPK

SEQ ID NO: 2746686 - protein, 7 aa, Entamoeba invadens
ALNPPET

SEQ ID NO: 2746687 - protein, 8 aa, Entamoeba invadens
ALPPITDE

SEQ ID NO: 2746688 - protein, 5 aa, Entamoeba invadens
ALPSA

SEQ ID NO: 2746689 - protein, 5 aa, Entamoeba invadens
ALPSF

SEQ ID NO: 2746690 - protein, 7 aa, Entamoeba invadens
ALPSGGG

SEQ ID NO: 2746691 - protein, 7 aa, Entamoeba invadens
ALPSSEL

SEQ ID NO: 2746692 - protein, 16 aa, Entamoeba invadens
ALPSSVSTVTVDGTSL

SEQ ID NO: 2746693 - protein, 7 aa, Entamoeba invadens
ALPTEAE

SEQ ID NO: 2746694 - protein, 8 aa, Entamoeba invadens
ALPTPIPY

SEQ ID NO: 2746695 - protein, 11 aa, Entamoeba invadens
ALQDAKSCGSK

SEQ ID NO: 2746696 - protein, 11 aa, Entamoeba invadens
ALQDGEKDDIN

SEQ ID NO: 2746697 - protein, 13 aa, Entamoeba invadens
ALQDSLRKTTREQ

SEQ ID NO: 2746698 - protein, 13 aa, Entamoeba invadens
ALQNASDPESQCQ

SEQ ID NO: 2746699 - protein, 28 aa, Entamoeba invadens
ALQSEKTGKCNSQSNEEQLTKENEDLKA

SEQ ID NO: 2746700 - protein, 12 aa, Entamoeba invadens
ALRCNNEDTPIQ

SEQ ID NO: 2746701 - protein, 6 aa, Entamoeba invadens
ALREGG

SEQ ID NO: 2746702 - protein, 6 aa, Entamoeba invadens
ALSDQE

SEQ ID NO: 2746703 - protein, 8 aa, Entamoeba invadens
ALSETYQR

SEQ ID NO: 2746704 - protein, 22 aa, Entamoeba invadens
ALSGSSIESASLNSATALTNGY

SEQ ID NO: 2746705 - protein, 8 aa, Entamoeba invadens
ALSITSNK

SEQ ID NO: 2746706 - protein, 12 aa, Entamoeba invadens
ALSQSQNKTTPL

SEQ ID NO: 2746707 - protein, 5 aa, Entamoeba invadens
ALSSG

SEQ ID NO: 2746708 - protein, 7 aa, Entamoeba invadens
ALSSNGN

SEQ ID NO: 2746709 - protein, 8 aa, Entamoeba invadens
ALSSSFEQ

SEQ ID NO: 2746710 - protein, 7 aa, Entamoeba invadens
ALSTNTS

SEQ ID NO: 2746711 - protein, 5 aa, Entamoeba invadens
ALTEA

SEQ ID NO: 2746712 - protein, 6 aa, Entamoeba invadens
ALTEDD

SEQ ID NO: 2746713 - protein, 7 aa, Entamoeba invadens
ALTGNTI

SEQ ID NO: 2746714 - protein, 8 aa, Entamoeba invadens
ALTPANDA

SEQ ID NO: 2746715 - protein, 5 aa, Entamoeba invadens
ALTVE

SEQ ID NO: 2746716 - protein, 5 aa, Entamoeba invadens
AMAGE

SEQ ID NO: 2746717 - protein, 4 aa, Entamoeba invadens
AMEE

SEQ ID NO: 2746718 - protein, 11 aa, Entamoeba invadens
AMEKQNTEQLG

SEQ ID NO: 2746719 - protein, 6 aa, Entamoeba invadens
AMESTT

SEQ ID NO: 2746720 - protein, 4 aa, Entamoeba invadens
AMGS

SEQ ID NO: 2746721 - protein, 5 aa, Entamoeba invadens
AMNID

SEQ ID NO: 2746722 - protein, 25 aa, Entamoeba invadens
AMNSSYNGREVRIPNDSPYPLEPSR

SEQ ID NO: 2746723 - protein, 7 aa, Entamoeba invadens
AMPSGGG

SEQ ID NO: 2746724 - protein, 8 aa, Entamoeba invadens
AMREKREE

SEQ ID NO: 2746725 - protein, 13 aa, Entamoeba invadens
AMSDEASSQASTI

SEQ ID NO: 2746726 - protein, 7 aa, Entamoeba invadens
AMSSTTK

SEQ ID NO: 2746727 - protein, 8 aa, Entamoeba invadens
AMTAAKNT

SEQ ID NO: 2746728 - protein, 7 aa, Entamoeba invadens
AMTNTNT

SEQ ID NO: 2746729 - protein, 7 aa, Entamoeba invadens
AMYPQGG

SEQ ID NO: 2746730 - protein, 13 aa, Entamoeba invadens
ANAKLTDFGSSRN

SEQ ID NO: 2746731 - protein, 7 aa, Entamoeba invadens
ANALPDT

SEQ ID NO: 2746732 - protein, 10 aa, Entamoeba invadens
ANAPQKVTGK

SEQ ID NO: 2746733 - protein, 4 aa, Entamoeba invadens
ANAS

SEQ ID NO: 2746734 - protein, 7 aa, Entamoeba invadens
ANASPEQ

SEQ ID NO: 2746735 - protein, 5 aa, Entamoeba invadens
ANCAE

SEQ ID NO: 2746736 - protein, 14 aa, Entamoeba invadens
ANCASTSTQSCGND

SEQ ID NO: 2746737 - protein, 11 aa, Entamoeba invadens
ANCDAEDSGQC

SEQ ID NO: 2746738 - protein, 6 aa, Entamoeba invadens
ANCDNG

SEQ ID NO: 2746739 - protein, 5 aa, Entamoeba invadens
ANDDN

SEQ ID NO: 2746740 - protein, 6 aa, Entamoeba invadens
ANDISR

SEQ ID NO: 2746741 - protein, 11 aa, Entamoeba invadens
ANDITADVTST

SEQ ID NO: 2746742 - protein, 7 aa, Entamoeba invadens
ANDITGE

SEQ ID NO: 2746743 - protein, 17 aa, Entamoeba invadens
ANDKSSNGDGTNNIPTF

SEQ ID NO: 2746744 - protein, 4 aa, Entamoeba invadens
ANDL

SEQ ID NO: 2746745 - protein, 9 aa, Entamoeba invadens
ANDLSTATS

SEQ ID NO: 2746746 - protein, 21 aa, Entamoeba invadens
ANDNKRDAKNVKKYSDRVKES

SEQ ID NO: 2746747 - protein, 6 aa, Entamoeba invadens
ANDSNR

SEQ ID NO: 2746748 - protein, 7 aa, Entamoeba invadens
ANDTVNA

SEQ ID NO: 2746749 - protein, 7 aa, Entamoeba invadens
ANDYGSK

SEQ ID NO: 2746750 - protein, 9 aa, Entamoeba invadens
ANEDAKEKC

SEQ ID NO: 2746751 - protein, 9 aa, Entamoeba invadens
ANEDDKKRT

SEQ ID NO: 2746752 - protein, 6 aa, Entamoeba invadens
ANEDLS

SEQ ID NO: 2746753 - protein, 4 aa, Entamoeba invadens
ANEE

SEQ ID NO: 2746754 - protein, 11 aa, Entamoeba invadens
ANEEIDECDGE

SEQ ID NO: 2746755 - protein, 7 aa, Entamoeba invadens
ANEENVR

SEQ ID NO: 2746756 - protein, 4 aa, Entamoeba invadens
ANEK

SEQ ID NO: 2746757 - protein, 5 aa, Entamoeba invadens
ANEKE

SEQ ID NO: 2746758 - protein, 5 aa, Entamoeba invadens
ANEKV

SEQ ID NO: 2746759 - protein, 9 aa, Entamoeba invadens
ANELEAKSV

SEQ ID NO: 2746760 - protein, 16 aa, Entamoeba invadens
ANENSTDPKRKAALAS

SEQ ID NO: 2746761 - protein, 20 aa, Entamoeba invadens
ANENTQFKAAENVAANTNFN

SEQ ID NO: 2746762 - protein, 7 aa, Entamoeba invadens
ANEPEKC

SEQ ID NO: 2746763 - protein, 4 aa, Entamoeba invadens
ANES

SEQ ID NO: 2746764 - protein, 5 aa, Entamoeba invadens
ANETA

SEQ ID NO: 2746765 - protein, 10 aa, Entamoeba invadens
ANEVSDPSFG

SEQ ID NO: 2746766 - protein, 4 aa, Entamoeba invadens
ANEY

SEQ ID NO: 2746767 - protein, 9 aa, Entamoeba invadens
ANFETEGDV

SEQ ID NO: 2746768 - protein, 8 aa, Entamoeba invadens
ANFNSECG

SEQ ID NO: 2746769 - protein, 9 aa, Entamoeba invadens
ANFQNNNDA

SEQ ID NO: 2746770 - protein, 9 aa, Entamoeba invadens
ANFQNNNNA

SEQ ID NO: 2746771 - protein, 10 aa, Entamoeba invadens
ANGAKTNHYQ

SEQ ID NO: 2746772 - protein, 8 aa, Entamoeba invadens
ANGCTQCS

SEQ ID NO: 2746773 - protein, 7 aa, Entamoeba invadens
ANGDNSM

SEQ ID NO: 2746774 - protein, 12 aa, Entamoeba invadens
ANGEGRKHKPGL

SEQ ID NO: 2746775 - protein, 9 aa, Entamoeba invadens
ANGKYDTLS

SEQ ID NO: 2746776 - protein, 9 aa, Entamoeba invadens
ANGPIQKQD

SEQ ID NO: 2746777 - protein, 8 aa, Entamoeba invadens
ANGPNSET

SEQ ID NO: 2746778 - protein, 8 aa, Entamoeba invadens
ANGRQEMT

SEQ ID NO: 2746779 - protein, 9 aa, Entamoeba invadens
ANGSGNYRM

SEQ ID NO: 2746780 - protein, 6 aa, Entamoeba invadens
ANGSLS

SEQ ID NO: 2746781 - protein, 5 aa, Entamoeba invadens
ANGTV

SEQ ID NO: 2746782 - protein, 6 aa, Entamoeba invadens
ANGTYC

SEQ ID NO: 2746783 - protein, 4 aa, Entamoeba invadens
ANGW

SEQ ID NO: 2746784 - protein, 4 aa, Entamoeba invadens
ANGY

SEQ ID NO: 2746785 - protein, 9 aa, Entamoeba invadens
ANHPELDNT

SEQ ID NO: 2746786 - protein, 4 aa, Entamoeba invadens
ANHQ

SEQ ID NO: 2746787 - protein, 8 aa, Entamoeba invadens
ANIDIQTD

SEQ ID NO: 2746788 - protein, 12 aa, Entamoeba invadens
ANIDIQTDKTIQ

SEQ ID NO: 2746789 - protein, 7 aa, Entamoeba invadens
ANIDSSE

SEQ ID NO: 2746790 - protein, 12 aa, Entamoeba invadens
ANIKTVDQKTCR

SEQ ID NO: 2746791 - protein, 4 aa, Entamoeba invadens
ANIS

SEQ ID NO: 2746792 - protein, 6 aa, Entamoeba invadens
ANIYGD

SEQ ID NO: 2746793 - protein, 10 aa, Entamoeba invadens
ANKCNSSTGY

SEQ ID NO: 2746794 - protein, 17 aa, Entamoeba invadens
ANKDKADKAKRMSSKKE

SEQ ID NO: 2746795 - protein, 9 aa, Entamoeba invadens
ANKDYTADG

SEQ ID NO: 2746796 - protein, 5 aa, Entamoeba invadens
ANKEC

SEQ ID NO: 2746797 - protein, 9 aa, Entamoeba invadens
ANKEKMGKD

SEQ ID NO: 2746798 - protein, 8 aa, Entamoeba invadens
ANKENLKR

SEQ ID NO: 2746799 - protein, 5 aa, Entamoeba invadens
ANKFG

SEQ ID NO: 2746800 - protein, 6 aa, Entamoeba invadens
ANKGGV

SEQ ID NO: 2746801 - protein, 12 aa, Entamoeba invadens
ANKGSDDDSYTS

SEQ ID NO: 2746802 - protein, 25 aa, Entamoeba invadens
ANKKCEKNTCQYPENTQMDQNGVCS

SEQ ID NO: 2746803 - protein, 5 aa, Entamoeba invadens
ANKKE

SEQ ID NO: 2746804 - protein, 7 aa, Entamoeba invadens
ANKNPYK

SEQ ID NO: 2746805 - protein, 9 aa, Entamoeba invadens
ANKNTTSNV

SEQ ID NO: 2746806 - protein, 12 aa, Entamoeba invadens
ANKQKSKNLESF

SEQ ID NO: 2746807 - protein, 8 aa, Entamoeba invadens
ANKSEVDQ

SEQ ID NO: 2746808 - protein, 7 aa, Entamoeba invadens
ANKTRSK

SEQ ID NO: 2746809 - protein, 7 aa, Entamoeba invadens
ANKVPSA

SEQ ID NO: 2746810 - protein, 17 aa, Entamoeba invadens
ANLDQAEELEDKTNDMV

SEQ ID NO: 2746811 - protein, 9 aa, Entamoeba invadens
ANLENERST

SEQ ID NO: 2746812 - protein, 10 aa, Entamoeba invadens
ANLGKDKKDG

SEQ ID NO: 2746813 - protein, 12 aa, Entamoeba invadens
ANLNQTLDKTAT

SEQ ID NO: 2746814 - protein, 9 aa, Entamoeba invadens
ANLSRSQKL

SEQ ID NO: 2746815 - protein, 7 aa, Entamoeba invadens
ANLTLDN

SEQ ID NO: 2746816 - protein, 8 aa, Entamoeba invadens
ANLTTTSS

SEQ ID NO: 2746817 - protein, 9 aa, Entamoeba invadens
ANMKSETIS

SEQ ID NO: 2746818 - protein, 22 aa, Entamoeba invadens
ANMPPPPQQSFGDQGTAENQPL

SEQ ID NO: 2746819 - protein, 8 aa, Entamoeba invadens
ANNCDSCK

SEQ ID NO: 2746820 - protein, 10 aa, Entamoeba invadens
ANNCLDDTNS

SEQ ID NO: 2746821 - protein, 6 aa, Entamoeba invadens
ANNGTC

SEQ ID NO: 2746822 - protein, 7 aa, Entamoeba invadens
ANNGYCT

SEQ ID NO: 2746823 - protein, 16 aa, Entamoeba invadens
ANNKTLGTKEEICKSK

SEQ ID NO: 2746824 - protein, 7 aa, Entamoeba invadens
ANNSKCV

SEQ ID NO: 2746825 - protein, 8 aa, Entamoeba invadens
ANNTEALA

SEQ ID NO: 2746826 - protein, 6 aa, Entamoeba invadens
ANNTHR

SEQ ID NO: 2746827 - protein, 8 aa, Entamoeba invadens
ANNTKKKY

SEQ ID NO: 2746828 - protein, 6 aa, Entamoeba invadens
ANNVNS

SEQ ID NO: 2746829 - protein, 5 aa, Entamoeba invadens
ANNYP

SEQ ID NO: 2746830 - protein, 5 aa, Entamoeba invadens
ANPHS

SEQ ID NO: 2746831 - protein, 7 aa, Entamoeba invadens
ANPLSPT

SEQ ID NO: 2746832 - protein, 5 aa, Entamoeba invadens
ANPTK

SEQ ID NO: 2746833 - protein, 5 aa, Entamoeba invadens
ANPYA

SEQ ID NO: 2746834 - protein, 9 aa, Entamoeba invadens
ANQEHDNDS

SEQ ID NO: 2746835 - protein, 7 aa, Entamoeba invadens
ANQEPHR

SEQ ID NO: 2746836 - protein, 6 aa, Entamoeba invadens
ANQNPL

SEQ ID NO: 2746837 - protein, 5 aa, Entamoeba invadens
ANQSW

SEQ ID NO: 2746838 - protein, 16 aa, Entamoeba invadens
ANRAASNSSNEKTEMG

SEQ ID NO: 2746839 - protein, 11 aa, Entamoeba invadens
ANRCNSSNGYC

SEQ ID NO: 2746840 - protein, 16 aa, Entamoeba invadens
ANRKPVSGNKCDGCED

SEQ ID NO: 2746841 - protein, 14 aa, Entamoeba invadens
ANRVSIDRIVNLLT

SEQ ID NO: 2746842 - protein, 10 aa, Entamoeba invadens
ANRYKKESSL

SEQ ID NO: 2746843 - protein, 14 aa, Entamoeba invadens
ANRYSGKNDSTENN

SEQ ID NO: 2746844 - protein, 10 aa, Entamoeba invadens
ANSAQTSGNN

SEQ ID NO: 2746845 - protein, 5 aa, Entamoeba invadens
ANSAT

SEQ ID NO: 2746846 - protein, 8 aa, Entamoeba invadens
ANSCASNG

SEQ ID NO: 2746847 - protein, 10 aa, Entamoeba invadens
ANSCASNGNR

SEQ ID NO: 2746848 - protein, 10 aa, Entamoeba invadens
ANSCASNGSR

SEQ ID NO: 2746849 - protein, 11 aa, Entamoeba invadens
ANSCASNGSRI

SEQ ID NO: 2746850 - protein, 11 aa, Entamoeba invadens
ANSCDGSTGNC

SEQ ID NO: 2746851 - protein, 7 aa, Entamoeba invadens
ANSDGAV

SEQ ID NO: 2746852 - protein, 4 aa, Entamoeba invadens
ANSE

SEQ ID NO: 2746853 - protein, 9 aa, Entamoeba invadens
ANSEPSLKE

SEQ ID NO: 2746854 - protein, 5 aa, Entamoeba invadens
ANSEV

SEQ ID NO: 2746855 - protein, 15 aa, Entamoeba invadens
ANSGIQSLGTSAFEG

SEQ ID NO: 2746856 - protein, 12 aa, Entamoeba invadens
ANSNIQTKEGEE

SEQ ID NO: 2746857 - protein, 8 aa, Entamoeba invadens
ANSPNGYH

SEQ ID NO: 2746858 - protein, 7 aa, Entamoeba invadens
ANSQELN

SEQ ID NO: 2746859 - protein, 7 aa, Entamoeba invadens
ANSQITK

SEQ ID NO: 2746860 - protein, 20 aa, Entamoeba invadens
ANSSGQPQQRFGAPPPSQPY

SEQ ID NO: 2746861 - protein, 7 aa, Entamoeba invadens
ANSTGTI

SEQ ID NO: 2746862 - protein, 6 aa, Entamoeba invadens
ANSVQC

SEQ ID NO: 2746863 - protein, 5 aa, Entamoeba invadens
ANSYR

SEQ ID NO: 2746864 - protein, 5 aa, Entamoeba invadens
ANTAL

SEQ ID NO: 2746865 - protein, 10 aa, Entamoeba invadens
ANTCNSTNGY

SEQ ID NO: 2746866 - protein, 8 aa, Entamoeba invadens
ANTCPKSL

SEQ ID NO: 2746867 - protein, 5 aa, Entamoeba invadens
ANTCT

SEQ ID NO: 2746868 - protein, 6 aa, Entamoeba invadens
ANTCTG

SEQ ID NO: 2746869 - protein, 8 aa, Entamoeba invadens
ANTCTGCN

SEQ ID NO: 2746870 - protein, 6 aa, Entamoeba invadens
ANTCTQ

SEQ ID NO: 2746871 - protein, 7 aa, Entamoeba invadens
ANTDKEI

SEQ ID NO: 2746872 - protein, 6 aa, Entamoeba invadens
ANTDTC

SEQ ID NO: 2746873 - protein, 25 aa, Entamoeba invadens
ANTEISSKLDPKELRETKKLGEGSF

SEQ ID NO: 2746874 - protein, 10 aa, Entamoeba invadens
ANTENECTKC

SEQ ID NO: 2746875 - protein, 5 aa, Entamoeba invadens
ANTEV

SEQ ID NO: 2746876 - protein, 24 aa, Entamoeba invadens
ANTEVTTRLDPNELEEEKQIGEGS

SEQ ID NO: 2746877 - protein, 8 aa, Entamoeba invadens
ANTKSYQT

SEQ ID NO: 2746878 - protein, 5 aa, Entamoeba invadens
ANTLQ

SEQ ID NO: 2746879 - protein, 19 aa, Entamoeba invadens
ANTPNEITKTSNCPNRQKG

SEQ ID NO: 2746880 - protein, 8 aa, Entamoeba invadens
ANTQMSTR

SEQ ID NO: 2746881 - protein, 4 aa, Entamoeba invadens
ANTR

SEQ ID NO: 2746882 - protein, 6 aa, Entamoeba invadens
ANTTHL

SEQ ID NO: 2746883 - protein, 6 aa, Entamoeba invadens
ANTTNK

SEQ ID NO: 2746884 - protein, 6 aa, Entamoeba invadens
ANTTSQ

SEQ ID NO: 2746885 - protein, 8 aa, Entamoeba invadens
ANVDLQTE

SEQ ID NO: 2746886 - protein, 4 aa, Entamoeba invadens
ANVE

SEQ ID NO: 2746887 - protein, 12 aa, Entamoeba invadens
ANVSHQDEHGKR

SEQ ID NO: 2746888 - protein, 12 aa, Entamoeba invadens
ANYNTKFDDENF

SEQ ID NO: 2746889 - protein, 5 aa, Entamoeba invadens
ANYQE

SEQ ID NO: 2746890 - protein, 4 aa, Entamoeba invadens
ANYT

SEQ ID NO: 2746891 - protein, 5 aa, Entamoeba invadens
ANYTD

SEQ ID NO: 2746892 - protein, 10 aa, Entamoeba invadens
APAEIGTYDT

SEQ ID NO: 2746893 - protein, 11 aa, Entamoeba invadens
APAEKKGKTHI

SEQ ID NO: 2746894 - protein, 10 aa, Entamoeba invadens
APAERNEREI

SEQ ID NO: 2746895 - protein, 8 aa, Entamoeba invadens
APAGIPKS

SEQ ID NO: 2746896 - protein, 14 aa, Entamoeba invadens
APAVASGAKDDTPL

SEQ ID NO: 2746897 - protein, 5 aa, Entamoeba invadens
APCSE

SEQ ID NO: 2746898 - protein, 6 aa, Entamoeba invadens
APDKLG

SEQ ID NO: 2746899 - protein, 11 aa, Entamoeba invadens
APDSSGTYCDK

SEQ ID NO: 2746900 - protein, 8 aa, Entamoeba invadens
APDVKNTD

SEQ ID NO: 2746901 - protein, 5 aa, Entamoeba invadens
APEAV

SEQ ID NO: 2746902 - protein, 8 aa, Entamoeba invadens
APEGRRSR

SEQ ID NO: 2746903 - protein, 31 aa, Entamoeba invadens
APEKVKGKEEKKEKKEKKEKKEKKVDTEVKN

SEQ ID NO: 2746904 - protein, 11 aa, Entamoeba invadens
APENKVSSQQK

SEQ ID NO: 2746905 - protein, 6 aa, Entamoeba invadens
APENSL

SEQ ID NO: 2746906 - protein, 10 aa, Entamoeba invadens
APEPNETQIN

SEQ ID NO: 2746907 - protein, 8 aa, Entamoeba invadens
APESFKDE

SEQ ID NO: 2746908 - protein, 13 aa, Entamoeba invadens
APESFRDEYTYSG

SEQ ID NO: 2746909 - protein, 7 aa, Entamoeba invadens
APESYSR

SEQ ID NO: 2746910 - protein, 14 aa, Entamoeba invadens
APETFRDEYTYSGD

SEQ ID NO: 2746911 - protein, 12 aa, Entamoeba invadens
APETLEKRNYKM

SEQ ID NO: 2746912 - protein, 17 aa, Entamoeba invadens
APETLNGDASIGKESDI

SEQ ID NO: 2746913 - protein, 6 aa, Entamoeba invadens
APETYN

SEQ ID NO: 2746914 - protein, 5 aa, Entamoeba invadens
APFGG

SEQ ID NO: 2746915 - protein, 26 aa, Entamoeba invadens
APFPSSVPAGSDKGYGIGDSRVNYGD

SEQ ID NO: 2746916 - protein, 11 aa, Entamoeba invadens
APFSKGEEESF

SEQ ID NO: 2746917 - protein, 8 aa, Entamoeba invadens
APGFGEDD

SEQ ID NO: 2746918 - protein, 6 aa, Entamoeba invadens
APGTGE

SEQ ID NO: 2746919 - protein, 9 aa, Entamoeba invadens
APGTHSDGF

SEQ ID NO: 2746920 - protein, 11 aa, Entamoeba invadens
APGTSDNTWTG

SEQ ID NO: 2746921 - protein, 9 aa, Entamoeba invadens
APGYNLNSN

SEQ ID NO: 2746922 - protein, 6 aa, Entamoeba invadens
APHSET

SEQ ID NO: 2746923 - protein, 4 aa, Entamoeba invadens
APIS

SEQ ID NO: 2746924 - protein, 4 aa, Entamoeba invadens
APIT

SEQ ID NO: 2746925 - protein, 4 aa, Entamoeba invadens
APKD

SEQ ID NO: 2746926 - protein, 7 aa, Entamoeba invadens
APKGSFT

SEQ ID NO: 2746927 - protein, 8 aa, Entamoeba invadens
APKGTLAY

SEQ ID NO: 2746928 - protein, 8 aa, Entamoeba invadens
APKLEAGS

SEQ ID NO: 2746929 - protein, 7 aa, Entamoeba invadens
APKSFTV

SEQ ID NO: 2746930 - protein, 11 aa, Entamoeba invadens
APKTTQSIPQS

SEQ ID NO: 2746931 - protein, 7 aa, Entamoeba invadens
APKVFND

SEQ ID NO: 2746932 - protein, 9 aa, Entamoeba invadens
APLAEESFK

SEQ ID NO: 2746933 - protein, 11 aa, Entamoeba invadens
APLDPNTNNQR

SEQ ID NO: 2746934 - protein, 5 aa, Entamoeba invadens
APLGE

SEQ ID NO: 2746935 - protein, 8 aa, Entamoeba invadens
APLKATEN

SEQ ID NO: 2746936 - protein, 6 aa, Entamoeba invadens
APLPGN

SEQ ID NO: 2746937 - protein, 4 aa, Entamoeba invadens
APLQ

SEQ ID NO: 2746938 - protein, 6 aa, Entamoeba invadens
APLSQD

SEQ ID NO: 2746939 - protein, 12 aa, Entamoeba invadens
APMNPKANREKM

SEQ ID NO: 2746940 - protein, 4 aa, Entamoeba invadens
APND

SEQ ID NO: 2746941 - protein, 10 aa, Entamoeba invadens
APNDDGTECV

SEQ ID NO: 2746942 - protein, 10 aa, Entamoeba invadens
APNDNGDGCN

SEQ ID NO: 2746943 - protein, 9 aa, Entamoeba invadens
APNEEGTAC

SEQ ID NO: 2746944 - protein, 13 aa, Entamoeba invadens
APNETEFYGDNNA

SEQ ID NO: 2746945 - protein, 12 aa, Entamoeba invadens
APNFIQPAPSNL

SEQ ID NO: 2746946 - protein, 4 aa, Entamoeba invadens
APNG

SEQ ID NO: 2746947 - protein, 9 aa, Entamoeba invadens
APNLSNPPV

SEQ ID NO: 2746948 - protein, 11 aa, Entamoeba invadens
APNSESDGNLG

SEQ ID NO: 2746949 - protein, 15 aa, Entamoeba invadens
APNTPVMKKTSVKIE

SEQ ID NO: 2746950 - protein, 8 aa, Entamoeba invadens
APPEGTRK

SEQ ID NO: 2746951 - protein, 6 aa, Entamoeba invadens
APPERK

SEQ ID NO: 2746952 - protein, 14 aa, Entamoeba invadens
APPFDVKNGSVNIE

SEQ ID NO: 2746953 - protein, 5 aa, Entamoeba invadens
APPME

SEQ ID NO: 2746954 - protein, 4 aa, Entamoeba invadens
APPN

SEQ ID NO: 2746955 - protein, 15 aa, Entamoeba invadens
APPNAIDISQSSTVS

SEQ ID NO: 2746956 - protein, 6 aa, Entamoeba invadens
APPNGD

SEQ ID NO: 2746957 - protein, 7 aa, Entamoeba invadens
APPPQQY

SEQ ID NO: 2746958 - protein, 5 aa, Entamoeba invadens
APPQD

SEQ ID NO: 2746959 - protein, 7 aa, Entamoeba invadens
APPQQQY

SEQ ID NO: 2746960 - protein, 4 aa, Entamoeba invadens
APPT

SEQ ID NO: 2746961 - protein, 20 aa, Entamoeba invadens
APPTCNNNKIDSNEECDGGL

SEQ ID NO: 2746962 - protein, 8 aa, Entamoeba invadens
APPTGETF

SEQ ID NO: 2746963 - protein, 7 aa, Entamoeba invadens
APPTTRT

SEQ ID NO: 2746964 - protein, 5 aa, Entamoeba invadens
APQDD

SEQ ID NO: 2746965 - protein, 8 aa, Entamoeba invadens
APQDKKYG

SEQ ID NO: 2746966 - protein, 8 aa, Entamoeba invadens
APQGDSSM

SEQ ID NO: 2746967 - protein, 11 aa, Entamoeba invadens
APQHSTTQFKE

SEQ ID NO: 2746968 - protein, 5 aa, Entamoeba invadens
APQKK

SEQ ID NO: 2746969 - protein, 4 aa, Entamoeba invadens
APQN

SEQ ID NO: 2746970 - protein, 5 aa, Entamoeba invadens
APQTK

SEQ ID NO: 2746971 - protein, 9 aa, Entamoeba invadens
APRDVSDQD

SEQ ID NO: 2746972 - protein, 5 aa, Entamoeba invadens
APRTL

SEQ ID NO: 2746973 - protein, 9 aa, Entamoeba invadens
APRVTDKGT

SEQ ID NO: 2746974 - protein, 28 aa, Entamoeba invadens
APSASNYIQSPNKNTFGDTQHNDITRQS

SEQ ID NO: 2746975 - protein, 9 aa, Entamoeba invadens
APSDAKPIE

SEQ ID NO: 2746976 - protein, 4 aa, Entamoeba invadens
APSE

SEQ ID NO: 2746977 - protein, 7 aa, Entamoeba invadens
APSEKSF

SEQ ID NO: 2746978 - protein, 4 aa, Entamoeba invadens
APSG

SEQ ID NO: 2746979 - protein, 6 aa, Entamoeba invadens
APSKYT

SEQ ID NO: 2746980 - protein, 5 aa, Entamoeba invadens
APSLT

SEQ ID NO: 2746981 - protein, 4 aa, Entamoeba invadens
APSN

SEQ ID NO: 2746982 - protein, 8 aa, Entamoeba invadens
APSQSGTF

SEQ ID NO: 2746983 - protein, 11 aa, Entamoeba invadens
APSTPQQKAYE

SEQ ID NO: 2746984 - protein, 5 aa, Entamoeba invadens
APSYI

SEQ ID NO: 2746985 - protein, 6 aa, Entamoeba invadens
APTEEF

SEQ ID NO: 2746986 - protein, 55 aa, Entamoeba invadens
APTGGISVAQSDTDNMTRQPAPTPNPRRHPIGEENTQIREGREGVEDRGERTVHG

SEQ ID NO: 2746987 - protein, 5 aa, Entamoeba invadens
APTGV

SEQ ID NO: 2746988 - protein, 5 aa, Entamoeba invadens
APTKE

SEQ ID NO: 2746989 - protein, 8 aa, Entamoeba invadens
APTNQNIR

SEQ ID NO: 2746990 - protein, 5 aa, Entamoeba invadens
APTNT

SEQ ID NO: 2746991 - protein, 5 aa, Entamoeba invadens
APTPF

SEQ ID NO: 2746992 - protein, 5 aa, Entamoeba invadens
APTPS

SEQ ID NO: 2746993 - protein, 11 aa, Entamoeba invadens
APTSDGKSCEK

SEQ ID NO: 2746994 - protein, 6 aa, Entamoeba invadens
APTSTE

SEQ ID NO: 2746995 - protein, 4 aa, Entamoeba invadens
APTT

SEQ ID NO: 2746996 - protein, 6 aa, Entamoeba invadens
APTTSL

SEQ ID NO: 2746997 - protein, 4 aa, Entamoeba invadens
APVA

SEQ ID NO: 2746998 - protein, 5 aa, Entamoeba invadens
APVFP

SEQ ID NO: 2746999 - protein, 5 aa, Entamoeba invadens
APVGW

SEQ ID NO: 2747000 - protein, 4 aa, Entamoeba invadens
APVN

SEQ ID NO: 2747001 - protein, 21 aa, Entamoeba invadens
APVPDQSSSHHNDDDNKKPPV

SEQ ID NO: 2747002 - protein, 24 aa, Entamoeba invadens
APVQPTQPVQQPVQQQQATSGAFD

SEQ ID NO: 2747003 - protein, 5 aa, Entamoeba invadens
APYGS

SEQ ID NO: 2747004 - protein, 6 aa, Entamoeba invadens
APYGSL

SEQ ID NO: 2747005 - protein, 4 aa, Entamoeba invadens
APYS

SEQ ID NO: 2747006 - protein, 4 aa, Entamoeba invadens
APYV

SEQ ID NO: 2747007 - protein, 7 aa, Entamoeba invadens
APYVPDG

SEQ ID NO: 2747008 - protein, 4 aa, Entamoeba invadens
AQAD

SEQ ID NO: 2747009 - protein, 7 aa, Entamoeba invadens
AQAGMEN

SEQ ID NO: 2747010 - protein, 6 aa, Entamoeba invadens
AQALSN

SEQ ID NO: 2747011 - protein, 4 aa, Entamoeba invadens
AQCD

SEQ ID NO: 2747012 - protein, 11 aa, Entamoeba invadens
AQCISPPYEHA

SEQ ID NO: 2747013 - protein, 10 aa, Entamoeba invadens
AQCKTQPKQC

SEQ ID NO: 2747014 - protein, 11 aa, Entamoeba invadens
AQCSSNCSKCS

SEQ ID NO: 2747015 - protein, 4 aa, Entamoeba invadens
AQDC

SEQ ID NO: 2747016 - protein, 6 aa, Entamoeba invadens
AQDERA

SEQ ID NO: 2747017 - protein, 6 aa, Entamoeba invadens
AQDIPP

SEQ ID NO: 2747018 - protein, 10 aa, Entamoeba invadens
AQDNCKTRIS

SEQ ID NO: 2747019 - protein, 6 aa, Entamoeba invadens
AQDPKD

SEQ ID NO: 2747020 - protein, 9 aa, Entamoeba invadens
AQDPKDRIP

SEQ ID NO: 2747021 - protein, 8 aa, Entamoeba invadens
AQDPKERI

SEQ ID NO: 2747022 - protein, 6 aa, Entamoeba invadens
AQDSFS

SEQ ID NO: 2747023 - protein, 7 aa, Entamoeba invadens
AQDTDKY

SEQ ID NO: 2747024 - protein, 6 aa, Entamoeba invadens
AQECTR

SEQ ID NO: 2747025 - protein, 6 aa, Entamoeba invadens
AQEGAE

SEQ ID NO: 2747026 - protein, 7 aa, Entamoeba invadens
AQEGEGI

SEQ ID NO: 2747027 - protein, 4 aa, Entamoeba invadens
AQEP

SEQ ID NO: 2747028 - protein, 4 aa, Entamoeba invadens
AQEQ

SEQ ID NO: 2747029 - protein, 8 aa, Entamoeba invadens
AQESSENP

SEQ ID NO: 2747030 - protein, 6 aa, Entamoeba invadens
AQFRPK

SEQ ID NO: 2747031 - protein, 8 aa, Entamoeba invadens
AQGGPVAK

SEQ ID NO: 2747032 - protein, 4 aa, Entamoeba invadens
AQGL

SEQ ID NO: 2747033 - protein, 4 aa, Entamoeba invadens
AQGS

SEQ ID NO: 2747034 - protein, 9 aa, Entamoeba invadens
AQHEENEGT

SEQ ID NO: 2747035 - protein, 11 aa, Entamoeba invadens
AQITANKNTTF

SEQ ID NO: 2747036 - protein, 7 aa, Entamoeba invadens
AQITCPE

SEQ ID NO: 2747037 - protein, 6 aa, Entamoeba invadens
AQITVS

SEQ ID NO: 2747038 - protein, 10 aa, Entamoeba invadens
AQKATTGDPM

SEQ ID NO: 2747039 - protein, 9 aa, Entamoeba invadens
AQKHEEERY

SEQ ID NO: 2747040 - protein, 8 aa, Entamoeba invadens
AQKKTVDG

SEQ ID NO: 2747041 - protein, 9 aa, Entamoeba invadens
AQKMPSREN

SEQ ID NO: 2747042 - protein, 30 aa, Entamoeba invadens
AQKNEPNASLSPSPTMSPAEGDTSTSLSPK

SEQ ID NO: 2747043 - protein, 8 aa, Entamoeba invadens
AQKPDGHV

SEQ ID NO: 2747044 - protein, 8 aa, Entamoeba invadens
AQKPSDTI

SEQ ID NO: 2747045 - protein, 5 aa, Entamoeba invadens
AQKQI

SEQ ID NO: 2747046 - protein, 10 aa, Entamoeba invadens
AQKQSNCQIT

SEQ ID NO: 2747047 - protein, 6 aa, Entamoeba invadens
AQKSYF

SEQ ID NO: 2747048 - protein, 10 aa, Entamoeba invadens
AQKTDKKALE

SEQ ID NO: 2747049 - protein, 6 aa, Entamoeba invadens
AQKTFS

SEQ ID NO: 2747050 - protein, 8 aa, Entamoeba invadens
AQKVAEDT

SEQ ID NO: 2747051 - protein, 6 aa, Entamoeba invadens
AQKVTQ

SEQ ID NO: 2747052 - protein, 9 aa, Entamoeba invadens
AQLNTYGSS

SEQ ID NO: 2747053 - protein, 9 aa, Entamoeba invadens
AQNEELGEL

SEQ ID NO: 2747054 - protein, 8 aa, Entamoeba invadens
AQNLKNGS

SEQ ID NO: 2747055 - protein, 10 aa, Entamoeba invadens
AQNPLTQIKD

SEQ ID NO: 2747056 - protein, 13 aa, Entamoeba invadens
AQNRLGKVKGDSV

SEQ ID NO: 2747057 - protein, 8 aa, Entamoeba invadens
AQNSSLKI

SEQ ID NO: 2747058 - protein, 6 aa, Entamoeba invadens
AQNSST

SEQ ID NO: 2747059 - protein, 12 aa, Entamoeba invadens
AQNTTTTERTEL

SEQ ID NO: 2747060 - protein, 16 aa, Entamoeba invadens
AQNVDTETPIGVSGGE

SEQ ID NO: 2747061 - protein, 11 aa, Entamoeba invadens
AQPKTVTTSLN

SEQ ID NO: 2747062 - protein, 6 aa, Entamoeba invadens
AQPLPS

SEQ ID NO: 2747063 - protein, 5 aa, Entamoeba invadens
AQPPV

SEQ ID NO: 2747064 - protein, 9 aa, Entamoeba invadens
AQPQEMPQQ

SEQ ID NO: 2747065 - protein, 15 aa, Entamoeba invadens
AQPQKRRKQTHRERR

SEQ ID NO: 2747066 - protein, 15 aa, Entamoeba invadens
AQPSPSQKEKEASLV

SEQ ID NO: 2747067 - protein, 18 aa, Entamoeba invadens
AQQASKLKHDMERKRVSS

SEQ ID NO: 2747068 - protein, 25 aa, Entamoeba invadens
AQQEPYQQEEYSVPPSLTQSEQDPM

SEQ ID NO: 2747069 - protein, 5 aa, Entamoeba invadens
AQQES

SEQ ID NO: 2747070 - protein, 5 aa, Entamoeba invadens
AQQGA

SEQ ID NO: 2747071 - protein, 5 aa, Entamoeba invadens
AQQGS

SEQ ID NO: 2747072 - protein, 6 aa, Entamoeba invadens
AQQGSE

SEQ ID NO: 2747073 - protein, 6 aa, Entamoeba invadens
AQQHRK

SEQ ID NO: 2747074 - protein, 5 aa, Entamoeba invadens
AQQYE

SEQ ID NO: 2747075 - protein, 18 aa, Entamoeba invadens
AQRSDIPEDSSQTANEEK

SEQ ID NO: 2747076 - protein, 9 aa, Entamoeba invadens
AQSAGLTAP

SEQ ID NO: 2747077 - protein, 6 aa, Entamoeba invadens
AQSATL

SEQ ID NO: 2747078 - protein, 5 aa, Entamoeba invadens
AQSDN

SEQ ID NO: 2747079 - protein, 8 aa, Entamoeba invadens
AQSKLSTR

SEQ ID NO: 2747080 - protein, 13 aa, Entamoeba invadens
AQSSRIDPEELQE

SEQ ID NO: 2747081 - protein, 21 aa, Entamoeba invadens
AQSTRIDPDELKEEKKLGEGS

SEQ ID NO: 2747082 - protein, 9 aa, Entamoeba invadens
AQTAENVDY

SEQ ID NO: 2747083 - protein, 10 aa, Entamoeba invadens
AQTEEEKRRI

SEQ ID NO: 2747084 - protein, 13 aa, Entamoeba invadens
AQTELSTSIDPDE

SEQ ID NO: 2747085 - protein, 7 aa, Entamoeba invadens
AQTKMTT

SEQ ID NO: 2747086 - protein, 8 aa, Entamoeba invadens
AQTKQTEV

SEQ ID NO: 2747087 - protein, 7 aa, Entamoeba invadens
AQTPSER

SEQ ID NO: 2747088 - protein, 18 aa, Entamoeba invadens
AQTQSGKCFGRANQSVAD

SEQ ID NO: 2747089 - protein, 7 aa, Entamoeba invadens
AQTSQNR

SEQ ID NO: 2747090 - protein, 67 aa, Entamoeba invadens
AQTSQSSQNSEGEKSSSSVKRRVSNSETRPSTQTTTSSSKGRSSSKDKSSKSSSKNSSSRRKKSKVS

SEQ ID NO: 2747091 - protein, 7 aa, Entamoeba invadens
AQTTEVV

SEQ ID NO: 2747092 - protein, 6 aa, Entamoeba invadens
AQTTTH

SEQ ID NO: 2747093 - protein, 4 aa, Entamoeba invadens
AQVN

SEQ ID NO: 2747094 - protein, 8 aa, Entamoeba invadens
AQVPRGKT

SEQ ID NO: 2747095 - protein, 5 aa, Entamoeba invadens
AQVTQ

SEQ ID NO: 2747096 - protein, 14 aa, Entamoeba invadens
AQVTTQSNITLNGR

SEQ ID NO: 2747097 - protein, 4 aa, Entamoeba invadens
AQYL

SEQ ID NO: 2747098 - protein, 6 aa, Entamoeba invadens
ARADQY

SEQ ID NO: 2747099 - protein, 9 aa, Entamoeba invadens
ARARDTYGN

SEQ ID NO: 2747100 - protein, 6 aa, Entamoeba invadens
ARCYKQ

SEQ ID NO: 2747101 - protein, 11 aa, Entamoeba invadens
ARDKKTLPLKQ

SEQ ID NO: 2747102 - protein, 5 aa, Entamoeba invadens
ARDKT

SEQ ID NO: 2747103 - protein, 7 aa, Entamoeba invadens
ARETSSF

SEQ ID NO: 2747104 - protein, 10 aa, Entamoeba invadens
ARFENKKKTT

SEQ ID NO: 2747105 - protein, 6 aa, Entamoeba invadens
ARFNRD

SEQ ID NO: 2747106 - protein, 5 aa, Entamoeba invadens
ARFQG

SEQ ID NO: 2747107 - protein, 6 aa, Entamoeba invadens
ARGDQV

SEQ ID NO: 2747108 - protein, 6 aa, Entamoeba invadens
ARGEVS

SEQ ID NO: 2747109 - protein, 12 aa, Entamoeba invadens
ARGNSNVSTTKN

SEQ ID NO: 2747110 - protein, 10 aa, Entamoeba invadens
ARGPVKNAVS

SEQ ID NO: 2747111 - protein, 8 aa, Entamoeba invadens
ARIQPKEK

SEQ ID NO: 2747112 - protein, 4 aa, Entamoeba invadens
ARKQ

SEQ ID NO: 2747113 - protein, 8 aa, Entamoeba invadens
ARNDDGTA

SEQ ID NO: 2747114 - protein, 13 aa, Entamoeba invadens
ARNLTDEQQKEFT

SEQ ID NO: 2747115 - protein, 13 aa, Entamoeba invadens
ARNMTEEQEKEFN

SEQ ID NO: 2747116 - protein, 5 aa, Entamoeba invadens
ARNRL

SEQ ID NO: 2747117 - protein, 20 aa, Entamoeba invadens
ARNRSEKYTKEAEELKSTYR

SEQ ID NO: 2747118 - protein, 7 aa, Entamoeba invadens
ARNSKCS

SEQ ID NO: 2747119 - protein, 9 aa, Entamoeba invadens
ARNSTKTYR

SEQ ID NO: 2747120 - protein, 8 aa, Entamoeba invadens
ARNSTNVT

SEQ ID NO: 2747121 - protein, 4 aa, Entamoeba invadens
ARPE

SEQ ID NO: 2747122 - protein, 8 aa, Entamoeba invadens
ARPKIEGD

SEQ ID NO: 2747123 - protein, 5 aa, Entamoeba invadens
ARPPL

SEQ ID NO: 2747124 - protein, 4 aa, Entamoeba invadens
ARQP

SEQ ID NO: 2747125 - protein, 6 aa, Entamoeba invadens
ARRGET

SEQ ID NO: 2747126 - protein, 17 aa, Entamoeba invadens
ARRPKKVSDAEEEEKQI

SEQ ID NO: 2747127 - protein, 9 aa, Entamoeba invadens
ARRRSKQAK

SEQ ID NO: 2747128 - protein, 10 aa, Entamoeba invadens
ARSAGSSELP

SEQ ID NO: 2747129 - protein, 12 aa, Entamoeba invadens
ARSDSDYSNGHI

SEQ ID NO: 2747130 - protein, 19 aa, Entamoeba invadens
ARSEGKEELKETGAENDFE

SEQ ID NO: 2747131 - protein, 25 aa, Entamoeba invadens
ARSKADFDSPTLQKVENASRGVNEA

SEQ ID NO: 2747132 - protein, 16 aa, Entamoeba invadens
ARSKKSEKRKSFAPRK

SEQ ID NO: 2747133 - protein, 19 aa, Entamoeba invadens
ARSKSEGKRPSRSMIIETI

SEQ ID NO: 2747134 - protein, 7 aa, Entamoeba invadens
ARSSGMD

SEQ ID NO: 2747135 - protein, 9 aa, Entamoeba invadens
ARSVETKEF

SEQ ID NO: 2747136 - protein, 21 aa, Entamoeba invadens
ARTDKALKEVQEECQKQNPVT

SEQ ID NO: 2747137 - protein, 7 aa, Entamoeba invadens
ARTKQTT

SEQ ID NO: 2747138 - protein, 31 aa, Entamoeba invadens
ARTPRNNKTNEKLPGSPLARRNRRVNEDEKM

SEQ ID NO: 2747139 - protein, 7 aa, Entamoeba invadens
ARTSGAA

SEQ ID NO: 2747140 - protein, 6 aa, Entamoeba invadens
ARTTEE

SEQ ID NO: 2747141 - protein, 17 aa, Entamoeba invadens
ARVPTDGVPLATTNDDG

SEQ ID NO: 2747142 - protein, 6 aa, Entamoeba invadens
ARYGAT

SEQ ID NO: 2747143 - protein, 6 aa, Entamoeba invadens
ARYNTT

SEQ ID NO: 2747144 - protein, 19 aa, Entamoeba invadens
ASADGEMINTSGKKLHEEG

SEQ ID NO: 2747145 - protein, 8 aa, Entamoeba invadens
ASADTQTI

SEQ ID NO: 2747146 - protein, 9 aa, Entamoeba invadens
ASAEQCTKC

SEQ ID NO: 2747147 - protein, 6 aa, Entamoeba invadens
ASAFEG

SEQ ID NO: 2747148 - protein, 8 aa, Entamoeba invadens
ASAFEGAA

SEQ ID NO: 2747149 - protein, 4 aa, Entamoeba invadens
ASAG

SEQ ID NO: 2747150 - protein, 7 aa, Entamoeba invadens
ASAIQDQ

SEQ ID NO: 2747151 - protein, 5 aa, Entamoeba invadens
ASAIT

SEQ ID NO: 2747152 - protein, 6 aa, Entamoeba invadens
ASALKK

SEQ ID NO: 2747153 - protein, 20 aa, Entamoeba invadens
ASAPSSVDTESYNIKSATNV

SEQ ID NO: 2747154 - protein, 5 aa, Entamoeba invadens
ASASD

SEQ ID NO: 2747155 - protein, 33 aa, Entamoeba invadens
ASASPTASSPKPEKPEEVESPKPKPELTTPEPI

SEQ ID NO: 2747156 - protein, 20 aa, Entamoeba invadens
ASCDKTDGKCTTCKAGYGYD

SEQ ID NO: 2747157 - protein, 22 aa, Entamoeba invadens
ASCDKTNGKCTTCKAGYGYDDG

SEQ ID NO: 2747158 - protein, 23 aa, Entamoeba invadens
ASCDKTNGKCTTCKAGYGYDDGS

SEQ ID NO: 2747159 - protein, 24 aa, Entamoeba invadens
ASCDKTNGKCTTCKAGYGYDSGSC

SEQ ID NO: 2747160 - protein, 20 aa, Entamoeba invadens
ASCDKTNGKCTTCKSGYGYD

SEQ ID NO: 2747161 - protein, 10 aa, Entamoeba invadens
ASCDPETGDV

SEQ ID NO: 2747162 - protein, 7 aa, Entamoeba invadens
ASCDRKT

SEQ ID NO: 2747163 - protein, 9 aa, Entamoeba invadens
ASCDSTNGN

SEQ ID NO: 2747164 - protein, 7 aa, Entamoeba invadens
ASCKTAE

SEQ ID NO: 2747165 - protein, 8 aa, Entamoeba invadens
ASCNATNG

SEQ ID NO: 2747166 - protein, 6 aa, Entamoeba invadens
ASCPSN

SEQ ID NO: 2747167 - protein, 7 aa, Entamoeba invadens
ASCQSCE

SEQ ID NO: 2747168 - protein, 13 aa, Entamoeba invadens
ASCSEGNSDTKCT

SEQ ID NO: 2747169 - protein, 7 aa, Entamoeba invadens
ASCSNRG

SEQ ID NO: 2747170 - protein, 6 aa, Entamoeba invadens
ASCTQD

SEQ ID NO: 2747171 - protein, 7 aa, Entamoeba invadens
ASCTSQN

SEQ ID NO: 2747172 - protein, 7 aa, Entamoeba invadens
ASCTSSS

SEQ ID NO: 2747173 - protein, 9 aa, Entamoeba invadens
ASDARRKRK

SEQ ID NO: 2747174 - protein, 7 aa, Entamoeba invadens
ASDDGTY

SEQ ID NO: 2747175 - protein, 8 aa, Entamoeba invadens
ASDDNGDC

SEQ ID NO: 2747176 - protein, 13 aa, Entamoeba invadens
ASDDTYKNENNFD

SEQ ID NO: 2747177 - protein, 5 aa, Entamoeba invadens
ASDEF

SEQ ID NO: 2747178 - protein, 7 aa, Entamoeba invadens
ASDGKNC

SEQ ID NO: 2747179 - protein, 4 aa, Entamoeba invadens
ASDI

SEQ ID NO: 2747180 - protein, 11 aa, Entamoeba invadens
ASDINSCNDSI

SEQ ID NO: 2747181 - protein, 9 aa, Entamoeba invadens
ASDKARGKV

SEQ ID NO: 2747182 - protein, 12 aa, Entamoeba invadens
ASDKSRKCEKCT

SEQ ID NO: 2747183 - protein, 9 aa, Entamoeba invadens
ASDNKCTKC

SEQ ID NO: 2747184 - protein, 7 aa, Entamoeba invadens
ASDNQAV

SEQ ID NO: 2747185 - protein, 8 aa, Entamoeba invadens
ASDPDKKK

SEQ ID NO: 2747186 - protein, 10 aa, Entamoeba invadens
ASDPGRISSR

SEQ ID NO: 2747187 - protein, 10 aa, Entamoeba invadens
ASDPRYTHSI

SEQ ID NO: 2747188 - protein, 7 aa, Entamoeba invadens
ASDPSQC

SEQ ID NO: 2747189 - protein, 8 aa, Entamoeba invadens
ASDPTKSG

SEQ ID NO: 2747190 - protein, 9 aa, Entamoeba invadens
ASDQNNSSI

SEQ ID NO: 2747191 - protein, 10 aa, Entamoeba invadens
ASDQSRACEE

SEQ ID NO: 2747192 - protein, 7 aa, Entamoeba invadens
ASDSSRK

SEQ ID NO: 2747193 - protein, 15 aa, Entamoeba invadens
ASDSSRNCTKCESGY

SEQ ID NO: 2747194 - protein, 9 aa, Entamoeba invadens
ASDSSRNCV

SEQ ID NO: 2747195 - protein, 8 aa, Entamoeba invadens
ASDSTRKC

SEQ ID NO: 2747196 - protein, 18 aa, Entamoeba invadens
ASDSTRKCKQCNTGYYPK

SEQ ID NO: 2747197 - protein, 8 aa, Entamoeba invadens
ASDSVSKM

SEQ ID NO: 2747198 - protein, 6 aa, Entamoeba invadens
ASDYNK

SEQ ID NO: 2747199 - protein, 7 aa, Entamoeba invadens
ASDYNPI

SEQ ID NO: 2747200 - protein, 9 aa, Entamoeba invadens
ASEDNVDEN

SEQ ID NO: 2747201 - protein, 9 aa, Entamoeba invadens
ASEDPRSNI

SEQ ID NO: 2747202 - protein, 10 aa, Entamoeba invadens
ASEEDVSHKE

SEQ ID NO: 2747203 - protein, 6 aa, Entamoeba invadens
ASEGSH

SEQ ID NO: 2747204 - protein, 8 aa, Entamoeba invadens
ASEGSKVE

SEQ ID NO: 2747205 - protein, 8 aa, Entamoeba invadens
ASEKVNAK

SEQ ID NO: 2747206 - protein, 10 aa, Entamoeba invadens
ASENKTKMGA

SEQ ID NO: 2747207 - protein, 27 aa, Entamoeba invadens
ASEQEQDIEDNQQKEEMKNDSEYSKLK

SEQ ID NO: 2747208 - protein, 6 aa, Entamoeba invadens
ASESDI

SEQ ID NO: 2747209 - protein, 6 aa, Entamoeba invadens
ASESNK

SEQ ID NO: 2747210 - protein, 14 aa, Entamoeba invadens
ASESNKLCSSNTTL

SEQ ID NO: 2747211 - protein, 23 aa, Entamoeba invadens
ASETSTALDPDELHKENKLGEGG

SEQ ID NO: 2747212 - protein, 5 aa, Entamoeba invadens
ASEYG

SEQ ID NO: 2747213 - protein, 11 aa, Entamoeba invadens
ASEYGACKQGD

SEQ ID NO: 2747214 - protein, 8 aa, Entamoeba invadens
ASEYGCET

SEQ ID NO: 2747215 - protein, 5 aa, Entamoeba invadens
ASFAR

SEQ ID NO: 2747216 - protein, 6 aa, Entamoeba invadens
ASFDPI

SEQ ID NO: 2747217 - protein, 11 aa, Entamoeba invadens
ASFDSETSQKT

SEQ ID NO: 2747218 - protein, 6 aa, Entamoeba invadens
ASFQSY

SEQ ID NO: 2747219 - protein, 12 aa, Entamoeba invadens
ASFSGKVTEDTK

SEQ ID NO: 2747220 - protein, 7 aa, Entamoeba invadens
ASFSSAK

SEQ ID NO: 2747221 - protein, 7 aa, Entamoeba invadens
ASGALKP

SEQ ID NO: 2747222 - protein, 7 aa, Entamoeba invadens
ASGATSA

SEQ ID NO: 2747223 - protein, 8 aa, Entamoeba invadens
ASGATTTN

SEQ ID NO: 2747224 - protein, 8 aa, Entamoeba invadens
ASGCGKST

SEQ ID NO: 2747225 - protein, 9 aa, Entamoeba invadens
ASGCGKSTI

SEQ ID NO: 2747226 - protein, 10 aa, Entamoeba invadens
ASGCGKSTSV

SEQ ID NO: 2747227 - protein, 15 aa, Entamoeba invadens
ASGCKTCTKADDCSA

SEQ ID NO: 2747228 - protein, 4 aa, Entamoeba invadens
ASGD

SEQ ID NO: 2747229 - protein, 10 aa, Entamoeba invadens
ASGKRTTEKV

SEQ ID NO: 2747230 - protein, 6 aa, Entamoeba invadens
ASGNGN

SEQ ID NO: 2747231 - protein, 10 aa, Entamoeba invadens
ASGNKTTSKF

SEQ ID NO: 2747232 - protein, 8 aa, Entamoeba invadens
ASGQCDGN

SEQ ID NO: 2747233 - protein, 16 aa, Entamoeba invadens
ASGRRRELQSNMNEEA

SEQ ID NO: 2747234 - protein, 14 aa, Entamoeba invadens
ASGRSRNPTKRRIT

SEQ ID NO: 2747235 - protein, 8 aa, Entamoeba invadens
ASGSLSGN

SEQ ID NO: 2747236 - protein, 8 aa, Entamoeba invadens
ASGSNSTI

SEQ ID NO: 2747237 - protein, 9 aa, Entamoeba invadens
ASGTGIQQY

SEQ ID NO: 2747238 - protein, 6 aa, Entamoeba invadens
ASGWSD

SEQ ID NO: 2747239 - protein, 7 aa, Entamoeba invadens
ASGYSSG

SEQ ID NO: 2747240 - protein, 11 aa, Entamoeba invadens
ASGYTKNISDS

SEQ ID NO: 2747241 - protein, 12 aa, Entamoeba invadens
ASIEAAGSVTVA

SEQ ID NO: 2747242 - protein, 13 aa, Entamoeba invadens
ASIPTSINEVEPQ

SEQ ID NO: 2747243 - protein, 4 aa, Entamoeba invadens
ASIQ

SEQ ID NO: 2747244 - protein, 34 aa, Entamoeba invadens
ASISETLKSKNDRERMENEQEKNDEETMTNTSEK

SEQ ID NO: 2747245 - protein, 18 aa, Entamoeba invadens
ASITTQEDISSSLAESKS

SEQ ID NO: 2747246 - protein, 8 aa, Entamoeba invadens
ASKANATW

SEQ ID NO: 2747247 - protein, 10 aa, Entamoeba invadens
ASKATDTEGT

SEQ ID NO: 2747248 - protein, 7 aa, Entamoeba invadens
ASKESVD

SEQ ID NO: 2747249 - protein, 4 aa, Entamoeba invadens
ASKG

SEQ ID NO: 2747250 - protein, 6 aa, Entamoeba invadens
ASKHSL

SEQ ID NO: 2747251 - protein, 7 aa, Entamoeba invadens
ASKHTKK

SEQ ID NO: 2747252 - protein, 7 aa, Entamoeba invadens
ASKIDNV

SEQ ID NO: 2747253 - protein, 9 aa, Entamoeba invadens
ASKKANADD

SEQ ID NO: 2747254 - protein, 6 aa, Entamoeba invadens
ASKKCV

SEQ ID NO: 2747255 - protein, 5 aa, Entamoeba invadens
ASKKE

SEQ ID NO: 2747256 - protein, 4 aa, Entamoeba invadens
ASKL

SEQ ID NO: 2747257 - protein, 6 aa, Entamoeba invadens
ASKNLR

SEQ ID NO: 2747258 - protein, 15 aa, Entamoeba invadens
ASKSPEGYHELESEP

SEQ ID NO: 2747259 - protein, 9 aa, Entamoeba invadens
ASKSVTGDA

SEQ ID NO: 2747260 - protein, 7 aa, Entamoeba invadens
ASKTEPI

SEQ ID NO: 2747261 - protein, 11 aa, Entamoeba invadens
ASKTQNQGECG

SEQ ID NO: 2747262 - protein, 9 aa, Entamoeba invadens
ASKYAISNN

SEQ ID NO: 2747263 - protein, 4 aa, Entamoeba invadens
ASLE

SEQ ID NO: 2747264 - protein, 4 aa, Entamoeba invadens
ASLI

SEQ ID NO: 2747265 - protein, 5 aa, Entamoeba invadens
ASLPD

SEQ ID NO: 2747266 - protein, 5 aa, Entamoeba invadens
ASLPT

SEQ ID NO: 2747267 - protein, 7 aa, Entamoeba invadens
ASLSGLT

SEQ ID NO: 2747268 - protein, 7 aa, Entamoeba invadens
ASLSSHE

SEQ ID NO: 2747269 - protein, 10 aa, Entamoeba invadens
ASMGSTESIA

SEQ ID NO: 2747270 - protein, 5 aa, Entamoeba invadens
ASMTS

SEQ ID NO: 2747271 - protein, 7 aa, Entamoeba invadens
ASNADRK

SEQ ID NO: 2747272 - protein, 8 aa, Entamoeba invadens
ASNAERKC

SEQ ID NO: 2747273 - protein, 5 aa, Entamoeba invadens
ASNAK

SEQ ID NO: 2747274 - protein, 16 aa, Entamoeba invadens
ASNDDDFDDTTCEGGK

SEQ ID NO: 2747275 - protein, 6 aa, Entamoeba invadens
ASNEQL

SEQ ID NO: 2747276 - protein, 9 aa, Entamoeba invadens
ASNETETIK

SEQ ID NO: 2747277 - protein, 7 aa, Entamoeba invadens
ASNGERV

SEQ ID NO: 2747278 - protein, 10 aa, Entamoeba invadens
ASNGYRPGMD

SEQ ID NO: 2747279 - protein, 9 aa, Entamoeba invadens
ASNKIQNEY

SEQ ID NO: 2747280 - protein, 11 aa, Entamoeba invadens
ASNNEQCGRCQ

SEQ ID NO: 2747281 - protein, 7 aa, Entamoeba invadens
ASNNKAL

SEQ ID NO: 2747282 - protein, 7 aa, Entamoeba invadens
ASNNKYT

SEQ ID NO: 2747283 - protein, 10 aa, Entamoeba invadens
ASNNSCTSCS

SEQ ID NO: 2747284 - protein, 6 aa, Entamoeba invadens
ASNSSR

SEQ ID NO: 2747285 - protein, 10 aa, Entamoeba invadens
ASNYGTTENV

SEQ ID NO: 2747286 - protein, 11 aa, Entamoeba invadens
ASPATLPNDLN

SEQ ID NO: 2747287 - protein, 7 aa, Entamoeba invadens
ASPATTS

SEQ ID NO: 2747288 - protein, 6 aa, Entamoeba invadens
ASPEKF

SEQ ID NO: 2747289 - protein, 8 aa, Entamoeba invadens
ASPESEVS

SEQ ID NO: 2747290 - protein, 12 aa, Entamoeba invadens
ASPIATSITSDY

SEQ ID NO: 2747291 - protein, 24 aa, Entamoeba invadens
ASPIPPPTKITNLEKSESPNPQVK

SEQ ID NO: 2747292 - protein, 9 aa, Entamoeba invadens
ASPKDENDG

SEQ ID NO: 2747293 - protein, 5 aa, Entamoeba invadens
ASPKK

SEQ ID NO: 2747294 - protein, 9 aa, Entamoeba invadens
ASPKQKSEI

SEQ ID NO: 2747295 - protein, 4 aa, Entamoeba invadens
ASPL

SEQ ID NO: 2747296 - protein, 4 aa, Entamoeba invadens
ASPM

SEQ ID NO: 2747297 - protein, 6 aa, Entamoeba invadens
ASPSQR

SEQ ID NO: 2747298 - protein, 11 aa, Entamoeba invadens
ASQDSLPDQQD

SEQ ID NO: 2747299 - protein, 6 aa, Entamoeba invadens
ASQEEG

SEQ ID NO: 2747300 - protein, 5 aa, Entamoeba invadens
ASQQA

SEQ ID NO: 2747301 - protein, 7 aa, Entamoeba invadens
ASQQPTV

SEQ ID NO: 2747302 - protein, 62 aa, Entamoeba invadens
ASQSSQNSEMDDTKSFGKKSLSSADGKEKSSSKTKSTGKDSGTKDKSSSSLNSKNKKSKTAI

SEQ ID NO: 2747303 - protein, 64 aa, Entamoeba invadens
ASQSSQNSESDNKSKSSGAGSNKNSHPSHPSNNPSNPSKSTPSGSGKSDSDDSKKKKKGKSKVS

SEQ ID NO: 2747304 - protein, 69 aa, Entamoeba invadens
ASQSSQNSESDNKSKSSGAGSNKNSHPSHPSNPSNPSNPSNPSKSTPSGSGKSNSDDSKKKKKGKSKVS

SEQ ID NO: 2747305 - protein, 71 aa, Entamoeba invadens
ASQSSQNSESDNKSKSSGTNGSNGNTNSSNKNSRPTNPSNPSNPSKSTPSGSGKSDSDDSRKNKKGKSKVT

SEQ ID NO: 2747306 - protein, 6 aa, Entamoeba invadens
ASQSTA

SEQ ID NO: 2747307 - protein, 12 aa, Entamoeba invadens
ASQTCSKCSSEC

SEQ ID NO: 2747308 - protein, 18 aa, Entamoeba invadens
ASQTEEKFRTANSDLGCG

SEQ ID NO: 2747309 - protein, 5 aa, Entamoeba invadens
ASQYE

SEQ ID NO: 2747310 - protein, 7 aa, Entamoeba invadens
ASRCTSC

SEQ ID NO: 2747311 - protein, 9 aa, Entamoeba invadens
ASRDKEKKN

SEQ ID NO: 2747312 - protein, 41 aa, Entamoeba invadens
ASREKSFSPKNDNSEHYRGSLRNSVDNSPKSKNSDSSKGVE

SEQ ID NO: 2747313 - protein, 10 aa, Entamoeba invadens
ASRGNHETYY

SEQ ID NO: 2747314 - protein, 6 aa, Entamoeba invadens
ASRNVS

SEQ ID NO: 2747315 - protein, 11 aa, Entamoeba invadens
ASRQTSTDYGN

SEQ ID NO: 2747316 - protein, 7 aa, Entamoeba invadens
ASRSFHP

SEQ ID NO: 2747317 - protein, 10 aa, Entamoeba invadens
ASRSGLKNYK

SEQ ID NO: 2747318 - protein, 7 aa, Entamoeba invadens
ASRSKDF

SEQ ID NO: 2747319 - protein, 5 aa, Entamoeba invadens
ASRSP

SEQ ID NO: 2747320 - protein, 7 aa, Entamoeba invadens
ASRSYND

SEQ ID NO: 2747321 - protein, 6 aa, Entamoeba invadens
ASRYST

SEQ ID NO: 2747322 - protein, 6 aa, Entamoeba invadens
ASSAVK

SEQ ID NO: 2747323 - protein, 6 aa, Entamoeba invadens
ASSEIA

SEQ ID NO: 2747324 - protein, 7 aa, Entamoeba invadens
ASSEKEG

SEQ ID NO: 2747325 - protein, 20 aa, Entamoeba invadens
ASSGERKCNTCTNKTHPDEI

SEQ ID NO: 2747326 - protein, 7 aa, Entamoeba invadens
ASSHENG

SEQ ID NO: 2747327 - protein, 10 aa, Entamoeba invadens
ASSKDKNYTY

SEQ ID NO: 2747328 - protein, 11 aa, Entamoeba invadens
ASSKKSQVNFD

SEQ ID NO: 2747329 - protein, 5 aa, Entamoeba invadens
ASSKM

SEQ ID NO: 2747330 - protein, 6 aa, Entamoeba invadens
ASSKMG

SEQ ID NO: 2747331 - protein, 7 aa, Entamoeba invadens
ASSNLSA

SEQ ID NO: 2747332 - protein, 7 aa, Entamoeba invadens
ASSNQGQ

SEQ ID NO: 2747333 - protein, 7 aa, Entamoeba invadens
ASSNYKY

SEQ ID NO: 2747334 - protein, 5 aa, Entamoeba invadens
ASSPV

SEQ ID NO: 2747335 - protein, 6 aa, Entamoeba invadens
ASSQVS

SEQ ID NO: 2747336 - protein, 4 aa, Entamoeba invadens
ASSS

SEQ ID NO: 2747337 - protein, 25 aa, Entamoeba invadens
ASSSGSASCSQCSSGTYSSFSGSTS

SEQ ID NO: 2747338 - protein, 23 aa, Entamoeba invadens
ASSSKCTECSGRHKPSEDGDECV

SEQ ID NO: 2747339 - protein, 5 aa, Entamoeba invadens
ASSSL

SEQ ID NO: 2747340 - protein, 10 aa, Entamoeba invadens
ASSSMQQITG

SEQ ID NO: 2747341 - protein, 22 aa, Entamoeba invadens
ASSSSPKSEETSSDKSQNLGYT

SEQ ID NO: 2747342 - protein, 7 aa, Entamoeba invadens
ASSTAEI

SEQ ID NO: 2747343 - protein, 7 aa, Entamoeba invadens
ASSTTNV

SEQ ID NO: 2747344 - protein, 7 aa, Entamoeba invadens
ASSTTSL

SEQ ID NO: 2747345 - protein, 5 aa, Entamoeba invadens
ASSTY

SEQ ID NO: 2747346 - protein, 4 aa, Entamoeba invadens
ASSV

SEQ ID NO: 2747347 - protein, 11 aa, Entamoeba invadens
ASTAMDKATKN

SEQ ID NO: 2747348 - protein, 70 aa, Entamoeba invadens
ASTCSKCEAGTYSGAESSSCKKCNAGYYSVSGSSSCTKCDAGTYSSNSGASNCQNCDPGYYSEKGATTCA

SEQ ID NO: 2747349 - protein, 8 aa, Entamoeba invadens
ASTCSTTT

SEQ ID NO: 2747350 - protein, 6 aa, Entamoeba invadens
ASTEIK

SEQ ID NO: 2747351 - protein, 6 aa, Entamoeba invadens
ASTEPS

SEQ ID NO: 2747352 - protein, 12 aa, Entamoeba invadens
ASTGISSRLNPE

SEQ ID NO: 2747353 - protein, 15 aa, Entamoeba invadens
ASTGQVQRTTPNFSD

SEQ ID NO: 2747354 - protein, 5 aa, Entamoeba invadens
ASTIP

SEQ ID NO: 2747355 - protein, 5 aa, Entamoeba invadens
ASTKM

SEQ ID NO: 2747356 - protein, 12 aa, Entamoeba invadens
ASTMFDDKESVE

SEQ ID NO: 2747357 - protein, 4 aa, Entamoeba invadens
ASTN

SEQ ID NO: 2747358 - protein, 8 aa, Entamoeba invadens
ASTNPRVS

SEQ ID NO: 2747359 - protein, 7 aa, Entamoeba invadens
ASTNQTN

SEQ ID NO: 2747360 - protein, 16 aa, Entamoeba invadens
ASTPQTPTVGLSPSSM

SEQ ID NO: 2747361 - protein, 17 aa, Entamoeba invadens
ASTSGTEEREEGGEQNF

SEQ ID NO: 2747362 - protein, 15 aa, Entamoeba invadens
ASTSKGNEFSTSQIQ

SEQ ID NO: 2747363 - protein, 6 aa, Entamoeba invadens
ASTSKQ

SEQ ID NO: 2747364 - protein, 6 aa, Entamoeba invadens
ASTSPS

SEQ ID NO: 2747365 - protein, 12 aa, Entamoeba invadens
ASTSQAADRCET

SEQ ID NO: 2747366 - protein, 11 aa, Entamoeba invadens
ASTSTRTCTTC

SEQ ID NO: 2747367 - protein, 5 aa, Entamoeba invadens
ASTTA

SEQ ID NO: 2747368 - protein, 11 aa, Entamoeba invadens
ASTTNESGKYS

SEQ ID NO: 2747369 - protein, 7 aa, Entamoeba invadens
ASTTQSV

SEQ ID NO: 2747370 - protein, 7 aa, Entamoeba invadens
ASVDGEL

SEQ ID NO: 2747371 - protein, 9 aa, Entamoeba invadens
ASVGTNDGT

SEQ ID NO: 2747372 - protein, 12 aa, Entamoeba invadens
ASVKSAKHIETK

SEQ ID NO: 2747373 - protein, 12 aa, Entamoeba invadens
ASVSGEVEVSNT

SEQ ID NO: 2747374 - protein, 8 aa, Entamoeba invadens
ASWPNSGK

SEQ ID NO: 2747375 - protein, 7 aa, Entamoeba invadens
ASWQSSA

SEQ ID NO: 2747376 - protein, 5 aa, Entamoeba invadens
ASWTT

SEQ ID NO: 2747377 - protein, 5 aa, Entamoeba invadens
ASYDQ

SEQ ID NO: 2747378 - protein, 6 aa, Entamoeba invadens
ASYNEN

SEQ ID NO: 2747379 - protein, 26 aa, Entamoeba invadens
ASYNSSTRKCSKCSGSHTVSENGDEC

SEQ ID NO: 2747380 - protein, 26 aa, Entamoeba invadens
ASYNSSTRKCSKCSRSRTVSENGDEC

SEQ ID NO: 2747381 - protein, 6 aa, Entamoeba invadens
ASYTQT

SEQ ID NO: 2747382 - protein, 6 aa, Entamoeba invadens
ASYTSC

SEQ ID NO: 2747383 - protein, 18 aa, Entamoeba invadens
ATAESPSVSTGGKKLHEE

SEQ ID NO: 2747384 - protein, 5 aa, Entamoeba invadens
ATAGG

SEQ ID NO: 2747385 - protein, 7 aa, Entamoeba invadens
ATAIQNQ

SEQ ID NO: 2747386 - protein, 12 aa, Entamoeba invadens
ATALQKSSTSNF

SEQ ID NO: 2747387 - protein, 7 aa, Entamoeba invadens
ATANGSV

SEQ ID NO: 2747388 - protein, 6 aa, Entamoeba invadens
ATASGF

SEQ ID NO: 2747389 - protein, 6 aa, Entamoeba invadens
ATATNN

SEQ ID NO: 2747390 - protein, 7 aa, Entamoeba invadens
ATATTTI

SEQ ID NO: 2747391 - protein, 14 aa, Entamoeba invadens
ATCDKDKCATCNDG

SEQ ID NO: 2747392 - protein, 12 aa, Entamoeba invadens
ATCDTTTGLPVY

SEQ ID NO: 2747393 - protein, 14 aa, Entamoeba invadens
ATCGGKCDTTTGVC

SEQ ID NO: 2747394 - protein, 9 aa, Entamoeba invadens
ATCGNGKID

SEQ ID NO: 2747395 - protein, 6 aa, Entamoeba invadens
ATCGTN

SEQ ID NO: 2747396 - protein, 9 aa, Entamoeba invadens
ATCKGQRNR

SEQ ID NO: 2747397 - protein, 11 aa, Entamoeba invadens
ATCKNKNDSCL

SEQ ID NO: 2747398 - protein, 5 aa, Entamoeba invadens
ATCNR

SEQ ID NO: 2747399 - protein, 7 aa, Entamoeba invadens
ATCPTGA

SEQ ID NO: 2747400 - protein, 9 aa, Entamoeba invadens
ATCRENGED

SEQ ID NO: 2747401 - protein, 13 aa, Entamoeba invadens
ATCSEGNSDTKCT

SEQ ID NO: 2747402 - protein, 10 aa, Entamoeba invadens
ATCSGSSSTC

SEQ ID NO: 2747403 - protein, 9 aa, Entamoeba invadens
ATCSKTKEM

SEQ ID NO: 2747404 - protein, 16 aa, Entamoeba invadens
ATCSQTTDTCTSCDTN

SEQ ID NO: 2747405 - protein, 11 aa, Entamoeba invadens
ATCSTCSQTTD

SEQ ID NO: 2747406 - protein, 4 aa, Entamoeba invadens
ATCT

SEQ ID NO: 2747407 - protein, 13 aa, Entamoeba invadens
ATCTKQTETPNKV

SEQ ID NO: 2747408 - protein, 5 aa, Entamoeba invadens
ATCTN

SEQ ID NO: 2747409 - protein, 5 aa, Entamoeba invadens
ATDDD

SEQ ID NO: 2747410 - protein, 4 aa, Entamoeba invadens
ATDE

SEQ ID NO: 2747411 - protein, 14 aa, Entamoeba invadens
ATDETSKIPVATES

SEQ ID NO: 2747412 - protein, 8 aa, Entamoeba invadens
ATDKKRYE

SEQ ID NO: 2747413 - protein, 7 aa, Entamoeba invadens
ATDKQPL

SEQ ID NO: 2747414 - protein, 10 aa, Entamoeba invadens
ATDLNDDSSP

SEQ ID NO: 2747415 - protein, 8 aa, Entamoeba invadens
ATDQNGKC

SEQ ID NO: 2747416 - protein, 9 aa, Entamoeba invadens
ATDSNNKCE

SEQ ID NO: 2747417 - protein, 8 aa, Entamoeba invadens
ATDSTRKC

SEQ ID NO: 2747418 - protein, 7 aa, Entamoeba invadens
ATDVAKE

SEQ ID NO: 2747419 - protein, 5 aa, Entamoeba invadens
ATDYS

SEQ ID NO: 2747420 - protein, 7 aa, Entamoeba invadens
ATEINEE

SEQ ID NO: 2747421 - protein, 8 aa, Entamoeba invadens
ATENEKSS

SEQ ID NO: 2747422 - protein, 7 aa, Entamoeba invadens
ATESDTR

SEQ ID NO: 2747423 - protein, 6 aa, Entamoeba invadens
ATETMK

SEQ ID NO: 2747424 - protein, 10 aa, Entamoeba invadens
ATEVGTIKTS

SEQ ID NO: 2747425 - protein, 7 aa, Entamoeba invadens
ATFGGTE

SEQ ID NO: 2747426 - protein, 4 aa, Entamoeba invadens
ATFK

SEQ ID NO: 2747427 - protein, 14 aa, Entamoeba invadens
ATFNSQCNTSNGYC

SEQ ID NO: 2747428 - protein, 4 aa, Entamoeba invadens
ATGA

SEQ ID NO: 2747429 - protein, 6 aa, Entamoeba invadens
ATGDRY

SEQ ID NO: 2747430 - protein, 9 aa, Entamoeba invadens
ATGDRYASG

SEQ ID NO: 2747431 - protein, 11 aa, Entamoeba invadens
ATGKCEQCKEE

SEQ ID NO: 2747432 - protein, 26 aa, Entamoeba invadens
ATGNRDPKKNCQCKTGYYQANASSTV

SEQ ID NO: 2747433 - protein, 6 aa, Entamoeba invadens
ATGNRY

SEQ ID NO: 2747434 - protein, 7 aa, Entamoeba invadens
ATGNSII

SEQ ID NO: 2747435 - protein, 6 aa, Entamoeba invadens
ATGNYD

SEQ ID NO: 2747436 - protein, 6 aa, Entamoeba invadens
ATGPSL

SEQ ID NO: 2747437 - protein, 4 aa, Entamoeba invadens
ATGS

SEQ ID NO: 2747438 - protein, 6 aa, Entamoeba invadens
ATGTMY

SEQ ID NO: 2747439 - protein, 6 aa, Entamoeba invadens
ATGTTK

SEQ ID NO: 2747440 - protein, 4 aa, Entamoeba invadens
ATGW

SEQ ID NO: 2747441 - protein, 7 aa, Entamoeba invadens
ATGYPSS

SEQ ID NO: 2747442 - protein, 12 aa, Entamoeba invadens
ATGYTKKTTDSI

SEQ ID NO: 2747443 - protein, 13 aa, Entamoeba invadens
ATHAGQTATTDTH

SEQ ID NO: 2747444 - protein, 11 aa, Entamoeba invadens
ATIPPITEELT

SEQ ID NO: 2747445 - protein, 10 aa, Entamoeba invadens
ATIPSSSQPI

SEQ ID NO: 2747446 - protein, 4 aa, Entamoeba invadens
ATIQ

SEQ ID NO: 2747447 - protein, 13 aa, Entamoeba invadens
ATIRTTNKGLSPA

SEQ ID NO: 2747448 - protein, 17 aa, Entamoeba invadens
ATISSNDFKEQNTQNLV

SEQ ID NO: 2747449 - protein, 10 aa, Entamoeba invadens
ATITEKTKNT

SEQ ID NO: 2747450 - protein, 20 aa, Entamoeba invadens
ATKAEPCDDENCAQCADDGV

SEQ ID NO: 2747451 - protein, 16 aa, Entamoeba invadens
ATKCDSVSTINSNGTC

SEQ ID NO: 2747452 - protein, 10 aa, Entamoeba invadens
ATKCNTSTGV

SEQ ID NO: 2747453 - protein, 6 aa, Entamoeba invadens
ATKETL

SEQ ID NO: 2747454 - protein, 18 aa, Entamoeba invadens
ATKIAETSPVTKDGLEDV

SEQ ID NO: 2747455 - protein, 9 aa, Entamoeba invadens
ATKKDTENA

SEQ ID NO: 2747456 - protein, 5 aa, Entamoeba invadens
ATKNI

SEQ ID NO: 2747457 - protein, 6 aa, Entamoeba invadens
ATKNMG

SEQ ID NO: 2747458 - protein, 6 aa, Entamoeba invadens
ATKNTT

SEQ ID NO: 2747459 - protein, 6 aa, Entamoeba invadens
ATKPNF

SEQ ID NO: 2747460 - protein, 9 aa, Entamoeba invadens
ATKPSYPSG

SEQ ID NO: 2747461 - protein, 4 aa, Entamoeba invadens
ATKQ

SEQ ID NO: 2747462 - protein, 5 aa, Entamoeba invadens
ATKQI

SEQ ID NO: 2747463 - protein, 5 aa, Entamoeba invadens
ATKQR

SEQ ID NO: 2747464 - protein, 6 aa, Entamoeba invadens
ATKSHL

SEQ ID NO: 2747465 - protein, 19 aa, Entamoeba invadens
ATKSSCDEVDDDKQLKTNI

SEQ ID NO: 2747466 - protein, 8 aa, Entamoeba invadens
ATKSTEVV

SEQ ID NO: 2747467 - protein, 9 aa, Entamoeba invadens
ATKSTGSKF

SEQ ID NO: 2747468 - protein, 7 aa, Entamoeba invadens
ATKTGCD

SEQ ID NO: 2747469 - protein, 8 aa, Entamoeba invadens
ATKVADYN

SEQ ID NO: 2747470 - protein, 6 aa, Entamoeba invadens
ATLDDD

SEQ ID NO: 2747471 - protein, 6 aa, Entamoeba invadens
ATLDGD

SEQ ID NO: 2747472 - protein, 11 aa, Entamoeba invadens
ATLDSSSGSNV

SEQ ID NO: 2747473 - protein, 13 aa, Entamoeba invadens
ATLGGTTKIPKDT

SEQ ID NO: 2747474 - protein, 11 aa, Entamoeba invadens
ATLGIEKDQKV

SEQ ID NO: 2747475 - protein, 6 aa, Entamoeba invadens
ATLNEN

SEQ ID NO: 2747476 - protein, 6 aa, Entamoeba invadens
ATLNPR

SEQ ID NO: 2747477 - protein, 4 aa, Entamoeba invadens
ATLT

SEQ ID NO: 2747478 - protein, 9 aa, Entamoeba invadens
ATLTGNTKA

SEQ ID NO: 2747479 - protein, 18 aa, Entamoeba invadens
ATLTISTNSSFNSSGGLE

SEQ ID NO: 2747480 - protein, 8 aa, Entamoeba invadens
ATMEPTKE

SEQ ID NO: 2747481 - protein, 4 aa, Entamoeba invadens
ATMN

SEQ ID NO: 2747482 - protein, 9 aa, Entamoeba invadens
ATNCESNRQ

SEQ ID NO: 2747483 - protein, 6 aa, Entamoeba invadens
ATNCGA

SEQ ID NO: 2747484 - protein, 5 aa, Entamoeba invadens
ATNCT

SEQ ID NO: 2747485 - protein, 7 aa, Entamoeba invadens
ATNENYA

SEQ ID NO: 2747486 - protein, 22 aa, Entamoeba invadens
ATNETENSTIQESEMDSVQTKS

SEQ ID NO: 2747487 - protein, 10 aa, Entamoeba invadens
ATNGNPDNIE

SEQ ID NO: 2747488 - protein, 8 aa, Entamoeba invadens
ATNGVSGQ

SEQ ID NO: 2747489 - protein, 23 aa, Entamoeba invadens
ATNNENESKCTNCDSKCNSCNGP

SEQ ID NO: 2747490 - protein, 7 aa, Entamoeba invadens
ATNNTRT

SEQ ID NO: 2747491 - protein, 4 aa, Entamoeba invadens
ATNP

SEQ ID NO: 2747492 - protein, 18 aa, Entamoeba invadens
ATNPSFESANSSSNTHPS

SEQ ID NO: 2747493 - protein, 4 aa, Entamoeba invadens
ATNQ

SEQ ID NO: 2747494 - protein, 5 aa, Entamoeba invadens
ATNSK

SEQ ID NO: 2747495 - protein, 4 aa, Entamoeba invadens
ATNT

SEQ ID NO: 2747496 - protein, 4 aa, Entamoeba invadens
ATNV

SEQ ID NO: 2747497 - protein, 7 aa, Entamoeba invadens
ATNVKDF

SEQ ID NO: 2747498 - protein, 9 aa, Entamoeba invadens
ATNYKNKDG

SEQ ID NO: 2747499 - protein, 5 aa, Entamoeba invadens
ATPAT

SEQ ID NO: 2747500 - protein, 10 aa, Entamoeba invadens
ATPEKPWEKK

SEQ ID NO: 2747501 - protein, 16 aa, Entamoeba invadens
ATPERGSNPIQKTETS

SEQ ID NO: 2747502 - protein, 6 aa, Entamoeba invadens
ATPPTI

SEQ ID NO: 2747503 - protein, 5 aa, Entamoeba invadens
ATPPV

SEQ ID NO: 2747504 - protein, 10 aa, Entamoeba invadens
ATPSNGNDDI

SEQ ID NO: 2747505 - protein, 6 aa, Entamoeba invadens
ATPSYD

SEQ ID NO: 2747506 - protein, 13 aa, Entamoeba invadens
ATPTTPSESPSME

SEQ ID NO: 2747507 - protein, 8 aa, Entamoeba invadens
ATPVSSEL

SEQ ID NO: 2747508 - protein, 7 aa, Entamoeba invadens
ATQKHTQ

SEQ ID NO: 2747509 - protein, 11 aa, Entamoeba invadens
ATQKMSEKKYK

SEQ ID NO: 2747510 - protein, 7 aa, Entamoeba invadens
ATQNTLQ

SEQ ID NO: 2747511 - protein, 7 aa, Entamoeba invadens
ATQNTQL

SEQ ID NO: 2747512 - protein, 11 aa, Entamoeba invadens
ATQPITSTNKY

SEQ ID NO: 2747513 - protein, 6 aa, Entamoeba invadens
ATQPRL

SEQ ID NO: 2747514 - protein, 15 aa, Entamoeba invadens
ATQPSGLQYNPPQLN

SEQ ID NO: 2747515 - protein, 7 aa, Entamoeba invadens
ATQQEIR

SEQ ID NO: 2747516 - protein, 14 aa, Entamoeba invadens
ATQSVRLSKEAKDI

SEQ ID NO: 2747517 - protein, 7 aa, Entamoeba invadens
ATRDGSL

SEQ ID NO: 2747518 - protein, 4 aa, Entamoeba invadens
ATRL

SEQ ID NO: 2747519 - protein, 8 aa, Entamoeba invadens
ATRQSDKK

SEQ ID NO: 2747520 - protein, 6 aa, Entamoeba invadens
ATRTEN

SEQ ID NO: 2747521 - protein, 6 aa, Entamoeba invadens
ATRYDP

SEQ ID NO: 2747522 - protein, 9 aa, Entamoeba invadens
ATSAEYGSV

SEQ ID NO: 2747523 - protein, 13 aa, Entamoeba invadens
ATSALDSESEKIV

SEQ ID NO: 2747524 - protein, 5 aa, Entamoeba invadens
ATSCA

SEQ ID NO: 2747525 - protein, 32 aa, Entamoeba invadens
ATSCGSGNYISGSSCSRCQAGTYSSDGKTTSC

SEQ ID NO: 2747526 - protein, 19 aa, Entamoeba invadens
ATSDAGSSAFADINGDDAL

SEQ ID NO: 2747527 - protein, 10 aa, Entamoeba invadens
ATSDDMAADE

SEQ ID NO: 2747528 - protein, 7 aa, Entamoeba invadens
ATSDEAF

SEQ ID NO: 2747529 - protein, 8 aa, Entamoeba invadens
ATSDGANV

SEQ ID NO: 2747530 - protein, 5 aa, Entamoeba invadens
ATSGE

SEQ ID NO: 2747531 - protein, 9 aa, Entamoeba invadens
ATSGGMDSS

SEQ ID NO: 2747532 - protein, 20 aa, Entamoeba invadens
ATSHLDPNDLTYEKKIGEGS

SEQ ID NO: 2747533 - protein, 7 aa, Entamoeba invadens
ATSKDLK

SEQ ID NO: 2747534 - protein, 6 aa, Entamoeba invadens
ATSLLG

SEQ ID NO: 2747535 - protein, 14 aa, Entamoeba invadens
ATSLRTKGNVSGGA

SEQ ID NO: 2747536 - protein, 6 aa, Entamoeba invadens
ATSMDR

SEQ ID NO: 2747537 - protein, 4 aa, Entamoeba invadens
ATSQ

SEQ ID NO: 2747538 - protein, 8 aa, Entamoeba invadens
ATSQNTNY

SEQ ID NO: 2747539 - protein, 18 aa, Entamoeba invadens
ATSRKKKPNITGIPQNPA

SEQ ID NO: 2747540 - protein, 8 aa, Entamoeba invadens
ATSSDNSI

SEQ ID NO: 2747541 - protein, 10 aa, Entamoeba invadens
ATSSKSSSNV

SEQ ID NO: 2747542 - protein, 11 aa, Entamoeba invadens
ATSSQCTNCSS

SEQ ID NO: 2747543 - protein, 5 aa, Entamoeba invadens
ATSTS

SEQ ID NO: 2747544 - protein, 5 aa, Entamoeba invadens
ATSTY

SEQ ID NO: 2747545 - protein, 8 aa, Entamoeba invadens
ATSYTSKL

SEQ ID NO: 2747546 - protein, 12 aa, Entamoeba invadens
ATTANKKAKTYL

SEQ ID NO: 2747547 - protein, 10 aa, Entamoeba invadens
ATTASDPDVH

SEQ ID NO: 2747548 - protein, 11 aa, Entamoeba invadens
ATTASSGHCTS

SEQ ID NO: 2747549 - protein, 13 aa, Entamoeba invadens
ATTCDACSNGYYE

SEQ ID NO: 2747550 - protein, 11 aa, Entamoeba invadens
ATTCGGGQYLS

SEQ ID NO: 2747551 - protein, 6 aa, Entamoeba invadens
ATTCTT

SEQ ID NO: 2747552 - protein, 4 aa, Entamoeba invadens
ATTI

SEQ ID NO: 2747553 - protein, 11 aa, Entamoeba invadens
ATTKKCDNQTV

SEQ ID NO: 2747554 - protein, 15 aa, Entamoeba invadens
ATTKNGESVLEPSQQ

SEQ ID NO: 2747555 - protein, 6 aa, Entamoeba invadens
ATTLTD

SEQ ID NO: 2747556 - protein, 14 aa, Entamoeba invadens
ATTNAGRVNGYTPV

SEQ ID NO: 2747557 - protein, 5 aa, Entamoeba invadens
ATTNN

SEQ ID NO: 2747558 - protein, 24 aa, Entamoeba invadens
ATTNQCTSPSGACGEGEFGTAGNC

SEQ ID NO: 2747559 - protein, 10 aa, Entamoeba invadens
ATTPDASTAT

SEQ ID NO: 2747560 - protein, 9 aa, Entamoeba invadens
ATTPYSTDN

SEQ ID NO: 2747561 - protein, 6 aa, Entamoeba invadens
ATTQLE

SEQ ID NO: 2747562 - protein, 8 aa, Entamoeba invadens
ATTSTNSI

SEQ ID NO: 2747563 - protein, 7 aa, Entamoeba invadens
ATTSTQM

SEQ ID NO: 2747564 - protein, 5 aa, Entamoeba invadens
ATTTA

SEQ ID NO: 2747565 - protein, 7 aa, Entamoeba invadens
ATTTHKA

SEQ ID NO: 2747566 - protein, 5 aa, Entamoeba invadens
ATTTS

SEQ ID NO: 2747567 - protein, 6 aa, Entamoeba invadens
ATTTST

SEQ ID NO: 2747568 - protein, 17 aa, Entamoeba invadens
ATTVERPKELKDLNSDE

SEQ ID NO: 2747569 - protein, 19 aa, Entamoeba invadens
ATTVNQSPVNCPEAGNITT

SEQ ID NO: 2747570 - protein, 17 aa, Entamoeba invadens
ATTYKTSNGDCLPRSSI

SEQ ID NO: 2747571 - protein, 18 aa, Entamoeba invadens
ATVDQATHAYYKTKTENC

SEQ ID NO: 2747572 - protein, 4 aa, Entamoeba invadens
ATVE

SEQ ID NO: 2747573 - protein, 5 aa, Entamoeba invadens
ATVNG

SEQ ID NO: 2747574 - protein, 7 aa, Entamoeba invadens
ATVTATD

SEQ ID NO: 2747575 - protein, 12 aa, Entamoeba invadens
ATVVQQNPQTEI

SEQ ID NO: 2747576 - protein, 5 aa, Entamoeba invadens
ATYGI

SEQ ID NO: 2747577 - protein, 5 aa, Entamoeba invadens
ATYGS

SEQ ID NO: 2747578 - protein, 18 aa, Entamoeba invadens
ATYNGGADISTKDKDKFP

SEQ ID NO: 2747579 - protein, 9 aa, Entamoeba invadens
ATYNTTSAH

SEQ ID NO: 2747580 - protein, 8 aa, Entamoeba invadens
ATYPPTNY

SEQ ID NO: 2747581 - protein, 9 aa, Entamoeba invadens
ATYSSGCSP

SEQ ID NO: 2747582 - protein, 11 aa, Entamoeba invadens
AVADGENGECY

SEQ ID NO: 2747583 - protein, 7 aa, Entamoeba invadens
AVCGNGV

SEQ ID NO: 2747584 - protein, 6 aa, Entamoeba invadens
AVDESS

SEQ ID NO: 2747585 - protein, 11 aa, Entamoeba invadens
AVDESSKSVVT

SEQ ID NO: 2747586 - protein, 6 aa, Entamoeba invadens
AVDKQR

SEQ ID NO: 2747587 - protein, 59 aa, Entamoeba invadens
AVDPVEPSKPVEPSQPETSEKPSEPEKPVEPSKPVDPPVTSTEPSETDKPEEQVKPEEP

SEQ ID NO: 2747588 - protein, 25 aa, Entamoeba invadens
AVDTSPQCRKVNDKYSRCTNDPKIT

SEQ ID NO: 2747589 - protein, 14 aa, Entamoeba invadens
AVDYGEDCDGGNHC

SEQ ID NO: 2747590 - protein, 14 aa, Entamoeba invadens
AVEESGAKGNPVLQ

SEQ ID NO: 2747591 - protein, 8 aa, Entamoeba invadens
AVENNGQS

SEQ ID NO: 2747592 - protein, 10 aa, Entamoeba invadens
AVEQGTKAAV

SEQ ID NO: 2747593 - protein, 21 aa, Entamoeba invadens
AVEQNEGELGPKSSEENTRDP

SEQ ID NO: 2747594 - protein, 7 aa, Entamoeba invadens
AVERGTE

SEQ ID NO: 2747595 - protein, 11 aa, Entamoeba invadens
AVESAEQCTKC

SEQ ID NO: 2747596 - protein, 5 aa, Entamoeba invadens
AVEVS

SEQ ID NO: 2747597 - protein, 7 aa, Entamoeba invadens
AVGDTKS

SEQ ID NO: 2747598 - protein, 17 aa, Entamoeba invadens
AVGGSVSEIDQTNKTEC

SEQ ID NO: 2747599 - protein, 4 aa, Entamoeba invadens
AVGI

SEQ ID NO: 2747600 - protein, 4 aa, Entamoeba invadens
AVGQ

SEQ ID NO: 2747601 - protein, 7 aa, Entamoeba invadens
AVGSGTG

SEQ ID NO: 2747602 - protein, 14 aa, Entamoeba invadens
AVGSKTCKKCEDGY

SEQ ID NO: 2747603 - protein, 6 aa, Entamoeba invadens
AVHPTE

SEQ ID NO: 2747604 - protein, 15 aa, Entamoeba invadens
AVIPTQNDNSNSINS

SEQ ID NO: 2747605 - protein, 6 aa, Entamoeba invadens
AVKEAS

SEQ ID NO: 2747606 - protein, 6 aa, Entamoeba invadens
AVKNTY

SEQ ID NO: 2747607 - protein, 11 aa, Entamoeba invadens
AVNDADCGRCP

SEQ ID NO: 2747608 - protein, 7 aa, Entamoeba invadens
AVNQNEV

SEQ ID NO: 2747609 - protein, 7 aa, Entamoeba invadens
AVNSGEH

SEQ ID NO: 2747610 - protein, 5 aa, Entamoeba invadens
AVNTD

SEQ ID NO: 2747611 - protein, 4 aa, Entamoeba invadens
AVPE

SEQ ID NO: 2747612 - protein, 5 aa, Entamoeba invadens
AVPGC

SEQ ID NO: 2747613 - protein, 9 aa, Entamoeba invadens
AVPNSDDVY

SEQ ID NO: 2747614 - protein, 6 aa, Entamoeba invadens
AVPTFT

SEQ ID NO: 2747615 - protein, 12 aa, Entamoeba invadens
AVQQIKKDAKEK

SEQ ID NO: 2747616 - protein, 4 aa, Entamoeba invadens
AVQT

SEQ ID NO: 2747617 - protein, 7 aa, Entamoeba invadens
AVREKSQ

SEQ ID NO: 2747618 - protein, 5 aa, Entamoeba invadens
AVRPK

SEQ ID NO: 2747619 - protein, 15 aa, Entamoeba invadens
AVSADAYKSASDVNT

SEQ ID NO: 2747620 - protein, 4 aa, Entamoeba invadens
AVSD

SEQ ID NO: 2747621 - protein, 13 aa, Entamoeba invadens
AVSETLNGATDSK

SEQ ID NO: 2747622 - protein, 8 aa, Entamoeba invadens
AVSNSKCS

SEQ ID NO: 2747623 - protein, 6 aa, Entamoeba invadens
AVSTEY

SEQ ID NO: 2747624 - protein, 6 aa, Entamoeba invadens
AVSTQV

SEQ ID NO: 2747625 - protein, 6 aa, Entamoeba invadens
AVTGGS

SEQ ID NO: 2747626 - protein, 6 aa, Entamoeba invadens
AVTNNG

SEQ ID NO: 2747627 - protein, 16 aa, Entamoeba invadens
AVVRTAKKAGEAIKNG

SEQ ID NO: 2747628 - protein, 4 aa, Entamoeba invadens
AWAQ

SEQ ID NO: 2747629 - protein, 10 aa, Entamoeba invadens
AWKSSPKSRI

SEQ ID NO: 2747630 - protein, 6 aa, Entamoeba invadens
AYAGRT

SEQ ID NO: 2747631 - protein, 12 aa, Entamoeba invadens
AYANDDSKEKCK

SEQ ID NO: 2747632 - protein, 5 aa, Entamoeba invadens
AYDKQ

SEQ ID NO: 2747633 - protein, 6 aa, Entamoeba invadens
AYDYPD

SEQ ID NO: 2747634 - protein, 11 aa, Entamoeba invadens
AYEGTQTNPQK

SEQ ID NO: 2747635 - protein, 5 aa, Entamoeba invadens
AYEKP

SEQ ID NO: 2747636 - protein, 4 aa, Entamoeba invadens
AYEN

SEQ ID NO: 2747637 - protein, 6 aa, Entamoeba invadens
AYERSG

SEQ ID NO: 2747638 - protein, 12 aa, Entamoeba invadens
AYETGNEKGKEL

SEQ ID NO: 2747639 - protein, 8 aa, Entamoeba invadens
AYGAEPMV

SEQ ID NO: 2747640 - protein, 7 aa, Entamoeba invadens
AYGGDNC

SEQ ID NO: 2747641 - protein, 6 aa, Entamoeba invadens
AYGGEN

SEQ ID NO: 2747642 - protein, 7 aa, Entamoeba invadens
AYGPNVT

SEQ ID NO: 2747643 - protein, 12 aa, Entamoeba invadens
AYGTAKSSVGIS

SEQ ID NO: 2747644 - protein, 13 aa, Entamoeba invadens
AYGVDEANRFKNN

SEQ ID NO: 2747645 - protein, 7 aa, Entamoeba invadens
AYKAKAQ

SEQ ID NO: 2747646 - protein, 5 aa, Entamoeba invadens
AYKGD

SEQ ID NO: 2747647 - protein, 5 aa, Entamoeba invadens
AYKKK

SEQ ID NO: 2747648 - protein, 7 aa, Entamoeba invadens
AYKRTAT

SEQ ID NO: 2747649 - protein, 6 aa, Entamoeba invadens
AYKSGK

SEQ ID NO: 2747650 - protein, 4 aa, Entamoeba invadens
AYLD

SEQ ID NO: 2747651 - protein, 5 aa, Entamoeba invadens
AYNKN

SEQ ID NO: 2747652 - protein, 5 aa, Entamoeba invadens
AYNKT

SEQ ID NO: 2747653 - protein, 4 aa, Entamoeba invadens
AYNP

SEQ ID NO: 2747654 - protein, 5 aa, Entamoeba invadens
AYPKD

SEQ ID NO: 2747655 - protein, 6 aa, Entamoeba invadens
AYPKEE

SEQ ID NO: 2747656 - protein, 6 aa, Entamoeba invadens
AYPKET

SEQ ID NO: 2747657 - protein, 5 aa, Entamoeba invadens
AYPKK

SEQ ID NO: 2747658 - protein, 5 aa, Entamoeba invadens
AYPKN

SEQ ID NO: 2747659 - protein, 6 aa, Entamoeba invadens
AYPKQS

SEQ ID NO: 2747660 - protein, 6 aa, Entamoeba invadens
AYPKSQ

SEQ ID NO: 2747661 - protein, 5 aa, Entamoeba invadens
AYPND

SEQ ID NO: 2747662 - protein, 8 aa, Entamoeba invadens
AYPNNETA

SEQ ID NO: 2747663 - protein, 6 aa, Entamoeba invadens
AYPSNQ

SEQ ID NO: 2747664 - protein, 6 aa, Entamoeba invadens
AYPSPV

SEQ ID NO: 2747665 - protein, 5 aa, Entamoeba invadens
AYPTK

SEQ ID NO: 2747666 - protein, 12 aa, Entamoeba invadens
AYQLEGEGVDGD

SEQ ID NO: 2747667 - protein, 11 aa, Entamoeba invadens
AYRKNNTIASN

SEQ ID NO: 2747668 - protein, 5 aa, Entamoeba invadens
AYSGQ

SEQ ID NO: 2747669 - protein, 8 aa, Entamoeba invadens
AYSKNGNC

SEQ ID NO: 2747670 - protein, 10 aa, Entamoeba invadens
AYSSRTQTKR

SEQ ID NO: 2747671 - protein, 11 aa, Entamoeba invadens
AYSSTQKSSTC

SEQ ID NO: 2747672 - protein, 12 aa, Entamoeba invadens
AYSVRGKNLNSD

SEQ ID NO: 2747673 - protein, 10 aa, Entamoeba invadens
AYSYSKNGKC

SEQ ID NO: 2747674 - protein, 5 aa, Entamoeba invadens
AYSYT

SEQ ID NO: 2747675 - protein, 6 aa, Entamoeba invadens
AYTSQT

SEQ ID NO: 2747676 - protein, 11 aa, Entamoeba invadens
CAAGSNKDARG

SEQ ID NO: 2747677 - protein, 15 aa, Entamoeba invadens
CAAGTRSEFPTSSTK

SEQ ID NO: 2747678 - protein, 13 aa, Entamoeba invadens
CAAGTRSEYTVSS

SEQ ID NO: 2747679 - protein, 9 aa, Entamoeba invadens
CADDTSDVS

SEQ ID NO: 2747680 - protein, 8 aa, Entamoeba invadens
CADEKTDI

SEQ ID NO: 2747681 - protein, 16 aa, Entamoeba invadens
CADGTYANTTGSTSCK

SEQ ID NO: 2747682 - protein, 16 aa, Entamoeba invadens
CADGTYASTTGSTSCK

SEQ ID NO: 2747683 - protein, 9 aa, Entamoeba invadens
CADGYGGDS

SEQ ID NO: 2747684 - protein, 8 aa, Entamoeba invadens
CADNGERK

SEQ ID NO: 2747685 - protein, 13 aa, Entamoeba invadens
CAECDPRDGTCTK

SEQ ID NO: 2747686 - protein, 12 aa, Entamoeba invadens
CAEDTTDINGKC

SEQ ID NO: 2747687 - protein, 21 aa, Entamoeba invadens
CAEDTTDTNGKCTKCDTTTKY

SEQ ID NO: 2747688 - protein, 10 aa, Entamoeba invadens
CAEGKKDQKM

SEQ ID NO: 2747689 - protein, 4 aa, Entamoeba invadens
CAGC

SEQ ID NO: 2747690 - protein, 6 aa, Entamoeba invadens
CAGCGS

SEQ ID NO: 2747691 - protein, 8 aa, Entamoeba invadens
CAGCSSAT

SEQ ID NO: 2747692 - protein, 8 aa, Entamoeba invadens
CAISDTLN

SEQ ID NO: 2747693 - protein, 5 aa, Entamoeba invadens
CAKCG

SEQ ID NO: 2747694 - protein, 7 aa, Entamoeba invadens
CAKCGTD

SEQ ID NO: 2747695 - protein, 7 aa, Entamoeba invadens
CAKCNNS

SEQ ID NO: 2747696 - protein, 10 aa, Entamoeba invadens
CAKCSSKNYC

SEQ ID NO: 2747697 - protein, 25 aa, Entamoeba invadens
CAKGKLGNGDECIRNSEGCDSGCTC

SEQ ID NO: 2747698 - protein, 10 aa, Entamoeba invadens
CALPDTKENY

SEQ ID NO: 2747699 - protein, 12 aa, Entamoeba invadens
CANCPAGSFSNS

SEQ ID NO: 2747700 - protein, 4 aa, Entamoeba invadens
CANN

SEQ ID NO: 2747701 - protein, 16 aa, Entamoeba invadens
CANNTYSYSNSTTCER

SEQ ID NO: 2747702 - protein, 10 aa, Entamoeba invadens
CANSCDGSTG

SEQ ID NO: 2747703 - protein, 20 aa, Entamoeba invadens
CAPKTCNTSNGNCDKCTENK

SEQ ID NO: 2747704 - protein, 19 aa, Entamoeba invadens
CAPNTCNTSNGNCEKCTEN

SEQ ID NO: 2747705 - protein, 9 aa, Entamoeba invadens
CAQCDSASG

SEQ ID NO: 2747706 - protein, 13 aa, Entamoeba invadens
CASCDSNEFESEK

SEQ ID NO: 2747707 - protein, 6 aa, Entamoeba invadens
CASCEK

SEQ ID NO: 2747708 - protein, 8 aa, Entamoeba invadens
CASCESET

SEQ ID NO: 2747709 - protein, 11 aa, Entamoeba invadens
CASDYTRKCTQ

SEQ ID NO: 2747710 - protein, 8 aa, Entamoeba invadens
CASGYDQD

SEQ ID NO: 2747711 - protein, 5 aa, Entamoeba invadens
CASKS

SEQ ID NO: 2747712 - protein, 4 aa, Entamoeba invadens
CASN

SEQ ID NO: 2747713 - protein, 8 aa, Entamoeba invadens
CASNGERK

SEQ ID NO: 2747714 - protein, 19 aa, Entamoeba invadens
CASNSSALKEECRRGREGC

SEQ ID NO: 2747715 - protein, 9 aa, Entamoeba invadens
CASNYTRKC

SEQ ID NO: 2747716 - protein, 6 aa, Entamoeba invadens
CASQGI

SEQ ID NO: 2747717 - protein, 27 aa, Entamoeba invadens
CASYDSSTRKCSKCSGSHTVSENGDEC

SEQ ID NO: 2747718 - protein, 27 aa, Entamoeba invadens
CASYDSSTRKCSKCSRSRTVSENGDEC

SEQ ID NO: 2747719 - protein, 13 aa, Entamoeba invadens
CATCDDASTCTDC

SEQ ID NO: 2747720 - protein, 5 aa, Entamoeba invadens
CATCE

SEQ ID NO: 2747721 - protein, 7 aa, Entamoeba invadens
CATCGDE

SEQ ID NO: 2747722 - protein, 11 aa, Entamoeba invadens
CATCSGSSSTC

SEQ ID NO: 2747723 - protein, 8 aa, Entamoeba invadens
CATCSNDG

SEQ ID NO: 2747724 - protein, 11 aa, Entamoeba invadens
CATCSNGKTCT

SEQ ID NO: 2747725 - protein, 12 aa, Entamoeba invadens
CATCSNGKTCTT

SEQ ID NO: 2747726 - protein, 5 aa, Entamoeba invadens
CATDF

SEQ ID NO: 2747727 - protein, 5 aa, Entamoeba invadens
CATDY

SEQ ID NO: 2747728 - protein, 6 aa, Entamoeba invadens
CATDYS

SEQ ID NO: 2747729 - protein, 7 aa, Entamoeba invadens
CATGQLR

SEQ ID NO: 2747730 - protein, 6 aa, Entamoeba invadens
CATQTD

SEQ ID NO: 2747731 - protein, 15 aa, Entamoeba invadens
CATTCKTGKANEATM

SEQ ID NO: 2747732 - protein, 16 aa, Entamoeba invadens
CATTCKTGKANKDTMT

SEQ ID NO: 2747733 - protein, 6 aa, Entamoeba invadens
CATTKE

SEQ ID NO: 2747734 - protein, 4 aa, Entamoeba invadens
CATY

SEQ ID NO: 2747735 - protein, 21 aa, Entamoeba invadens
CCQSNTKTFENLNDSNTKEKG

SEQ ID NO: 2747736 - protein, 14 aa, Entamoeba invadens
CDAGSYSRSGATSC

SEQ ID NO: 2747737 - protein, 11 aa, Entamoeba invadens
CDANTQRRDAQ

SEQ ID NO: 2747738 - protein, 18 aa, Entamoeba invadens
CDASATGCSKCKEDKTTC

SEQ ID NO: 2747739 - protein, 22 aa, Entamoeba invadens
CDASTKIGETETCNKCSENNYL

SEQ ID NO: 2747740 - protein, 22 aa, Entamoeba invadens
CDASTKTGETETCNKCSENNYL

SEQ ID NO: 2747741 - protein, 5 aa, Entamoeba invadens
CDATS

SEQ ID NO: 2747742 - protein, 23 aa, Entamoeba invadens
CDDASKAQCVRTRTDGCNSSSRL

SEQ ID NO: 2747743 - protein, 9 aa, Entamoeba invadens
CDDDGKELE

SEQ ID NO: 2747744 - protein, 22 aa, Entamoeba invadens
CDDDRYKDTTGCLPKQDKYPDC

SEQ ID NO: 2747745 - protein, 8 aa, Entamoeba invadens
CDDENKGR

SEQ ID NO: 2747746 - protein, 7 aa, Entamoeba invadens
CDDKNTS

SEQ ID NO: 2747747 - protein, 7 aa, Entamoeba invadens
CDDSKTN

SEQ ID NO: 2747748 - protein, 7 aa, Entamoeba invadens
CDDSNPM

SEQ ID NO: 2747749 - protein, 11 aa, Entamoeba invadens
CDEADAATKCT

SEQ ID NO: 2747750 - protein, 13 aa, Entamoeba invadens
CDEADSASKCTDC

SEQ ID NO: 2747751 - protein, 5 aa, Entamoeba invadens
CDECQ

SEQ ID NO: 2747752 - protein, 5 aa, Entamoeba invadens
CDECS

SEQ ID NO: 2747753 - protein, 5 aa, Entamoeba invadens
CDEEN

SEQ ID NO: 2747754 - protein, 9 aa, Entamoeba invadens
CDEETKSKC

SEQ ID NO: 2747755 - protein, 8 aa, Entamoeba invadens
CDEGEYKI

SEQ ID NO: 2747756 - protein, 6 aa, Entamoeba invadens
CDENNT

SEQ ID NO: 2747757 - protein, 5 aa, Entamoeba invadens
CDETC

SEQ ID NO: 2747758 - protein, 6 aa, Entamoeba invadens
CDFTGA

SEQ ID NO: 2747759 - protein, 8 aa, Entamoeba invadens
CDGDKGNC

SEQ ID NO: 2747760 - protein, 12 aa, Entamoeba invadens
CDGDVSSTTGCN

SEQ ID NO: 2747761 - protein, 7 aa, Entamoeba invadens
CDGEGNF

SEQ ID NO: 2747762 - protein, 6 aa, Entamoeba invadens
CDGGCT

SEQ ID NO: 2747763 - protein, 6 aa, Entamoeba invadens
CDGGYY

SEQ ID NO: 2747764 - protein, 10 aa, Entamoeba invadens
CDGKEENGYY

SEQ ID NO: 2747765 - protein, 24 aa, Entamoeba invadens
CDGKKQVNLNKTKCENRPSEPDTV

SEQ ID NO: 2747766 - protein, 8 aa, Entamoeba invadens
CDGNQYID

SEQ ID NO: 2747767 - protein, 8 aa, Entamoeba invadens
CDGTAGCT

SEQ ID NO: 2747768 - protein, 10 aa, Entamoeba invadens
CDGTTGKCTA

SEQ ID NO: 2747769 - protein, 12 aa, Entamoeba invadens
CDIKGDSKATDA

SEQ ID NO: 2747770 - protein, 14 aa, Entamoeba invadens
CDIQSGSSCKKCDS

SEQ ID NO: 2747771 - protein, 9 aa, Entamoeba invadens
CDISNSDDD

SEQ ID NO: 2747772 - protein, 5 aa, Entamoeba invadens
CDKCE

SEQ ID NO: 2747773 - protein, 6 aa, Entamoeba invadens
CDKCQT

SEQ ID NO: 2747774 - protein, 8 aa, Entamoeba invadens
CDKCSRNA

SEQ ID NO: 2747775 - protein, 5 aa, Entamoeba invadens
CDKLT

SEQ ID NO: 2747776 - protein, 6 aa, Entamoeba invadens
CDKPNG

SEQ ID NO: 2747777 - protein, 5 aa, Entamoeba invadens
CDKPT

SEQ ID NO: 2747778 - protein, 6 aa, Entamoeba invadens
CDKQTG

SEQ ID NO: 2747779 - protein, 13 aa, Entamoeba invadens
CDKRRPKRQEHSL

SEQ ID NO: 2747780 - protein, 16 aa, Entamoeba invadens
CDKTCKTGKANKETMN

SEQ ID NO: 2747781 - protein, 20 aa, Entamoeba invadens
CDKTNGHCTSCNNGYGISGS

SEQ ID NO: 2747782 - protein, 8 aa, Entamoeba invadens
CDKTSEKE

SEQ ID NO: 2747783 - protein, 7 aa, Entamoeba invadens
CDKTTGE

SEQ ID NO: 2747784 - protein, 4 aa, Entamoeba invadens
CDNC

SEQ ID NO: 2747785 - protein, 11 aa, Entamoeba invadens
CDNCDGVTGKC

SEQ ID NO: 2747786 - protein, 6 aa, Entamoeba invadens
CDNDQN

SEQ ID NO: 2747787 - protein, 14 aa, Entamoeba invadens
CDNGVGKSKGNAGV

SEQ ID NO: 2747788 - protein, 9 aa, Entamoeba invadens
CDNNDADTE

SEQ ID NO: 2747789 - protein, 14 aa, Entamoeba invadens
CDNPNDENGQCTTN

SEQ ID NO: 2747790 - protein, 10 aa, Entamoeba invadens
CDNPTTCSSC

SEQ ID NO: 2747791 - protein, 7 aa, Entamoeba invadens
CDNSEKL

SEQ ID NO: 2747792 - protein, 12 aa, Entamoeba invadens
CDNTTNKYTPNC

SEQ ID NO: 2747793 - protein, 14 aa, Entamoeba invadens
CDPDRYTSKITSGV

SEQ ID NO: 2747794 - protein, 5 aa, Entamoeba invadens
CDPIN

SEQ ID NO: 2747795 - protein, 10 aa, Entamoeba invadens
CDPKCPTCQS

SEQ ID NO: 2747796 - protein, 14 aa, Entamoeba invadens
CDPKNGACSECKPD

SEQ ID NO: 2747797 - protein, 9 aa, Entamoeba invadens
CDPKPSSCQ

SEQ ID NO: 2747798 - protein, 14 aa, Entamoeba invadens
CDPNPNGNYCQDGT

SEQ ID NO: 2747799 - protein, 9 aa, Entamoeba invadens
CDPTTGDCT

SEQ ID NO: 2747800 - protein, 11 aa, Entamoeba invadens
CDQCKDGDTCT

SEQ ID NO: 2747801 - protein, 11 aa, Entamoeba invadens
CDQCNGQTGAC

SEQ ID NO: 2747802 - protein, 11 aa, Entamoeba invadens
CDQCNGRTGAC

SEQ ID NO: 2747803 - protein, 13 aa, Entamoeba invadens
CDQNPGGNYCDDK

SEQ ID NO: 2747804 - protein, 14 aa, Entamoeba invadens
CDQNPNGNYCQDGT

SEQ ID NO: 2747805 - protein, 7 aa, Entamoeba invadens
CDQTNGR

SEQ ID NO: 2747806 - protein, 14 aa, Entamoeba invadens
CDQTSGGDTPATCS

SEQ ID NO: 2747807 - protein, 10 aa, Entamoeba invadens
CDRCENNATS

SEQ ID NO: 2747808 - protein, 26 aa, Entamoeba invadens
CDRGSAGSKGTAGNCNKCKSSYNNYY

SEQ ID NO: 2747809 - protein, 9 aa, Entamoeba invadens
CDRQGHNNG

SEQ ID NO: 2747810 - protein, 15 aa, Entamoeba invadens
CDSASSSTPNCSRSV

SEQ ID NO: 2747811 - protein, 8 aa, Entamoeba invadens
CDSCPDDA

SEQ ID NO: 2747812 - protein, 22 aa, Entamoeba invadens
CDSCSSFDSNCKTCSSDSSRKC

SEQ ID NO: 2747813 - protein, 10 aa, Entamoeba invadens
CDSCSSSDKC

SEQ ID NO: 2747814 - protein, 14 aa, Entamoeba invadens
CDSFNNDADNTQAY

SEQ ID NO: 2747815 - protein, 15 aa, Entamoeba invadens
CDSFNSDADNTQDYC

SEQ ID NO: 2747816 - protein, 7 aa, Entamoeba invadens
CDSKKQQ

SEQ ID NO: 2747817 - protein, 10 aa, Entamoeba invadens
CDSKNGNCTS

SEQ ID NO: 2747818 - protein, 6 aa, Entamoeba invadens
CDSKSG

SEQ ID NO: 2747819 - protein, 12 aa, Entamoeba invadens
CDSKTTNCENCN

SEQ ID NO: 2747820 - protein, 12 aa, Entamoeba invadens
CDSKTTNCETCN

SEQ ID NO: 2747821 - protein, 11 aa, Entamoeba invadens
CDSKTTNCTEC

SEQ ID NO: 2747822 - protein, 31 aa, Entamoeba invadens
CDSKVEECQQCSGDYDVKDGKCEKRNDDAAK

SEQ ID NO: 2747823 - protein, 32 aa, Entamoeba invadens
CDSKVEECQQCSGDYDVKDGKCEKRNDDAANS

SEQ ID NO: 2747824 - protein, 10 aa, Entamoeba invadens
CDSNEELKQK

SEQ ID NO: 2747825 - protein, 8 aa, Entamoeba invadens
CDSNEELN

SEQ ID NO: 2747826 - protein, 7 aa, Entamoeba invadens
CDSNGQN

SEQ ID NO: 2747827 - protein, 10 aa, Entamoeba invadens
CDSNKNGCVS

SEQ ID NO: 2747828 - protein, 7 aa, Entamoeba invadens
CDSNNRQ

SEQ ID NO: 2747829 - protein, 23 aa, Entamoeba invadens
CDSNRPVCGTNGGSCKCNENTNY

SEQ ID NO: 2747830 - protein, 8 aa, Entamoeba invadens
CDSPDNTI

SEQ ID NO: 2747831 - protein, 8 aa, Entamoeba invadens
CDSQNGKC

SEQ ID NO: 2747832 - protein, 15 aa, Entamoeba invadens
CDSQTEDRVGETCKP

SEQ ID NO: 2747833 - protein, 16 aa, Entamoeba invadens
CDSSCENKCNTETGYC

SEQ ID NO: 2747834 - protein, 7 aa, Entamoeba invadens
CDSSCKS

SEQ ID NO: 2747835 - protein, 10 aa, Entamoeba invadens
CDSSDTATCK

SEQ ID NO: 2747836 - protein, 7 aa, Entamoeba invadens
CDSSDYS

SEQ ID NO: 2747837 - protein, 6 aa, Entamoeba invadens
CDSSRG

SEQ ID NO: 2747838 - protein, 7 aa, Entamoeba invadens
CDSSRGF

SEQ ID NO: 2747839 - protein, 7 aa, Entamoeba invadens
CDSSSEC

SEQ ID NO: 2747840 - protein, 9 aa, Entamoeba invadens
CDSSTSIRY

SEQ ID NO: 2747841 - protein, 4 aa, Entamoeba invadens
CDST

SEQ ID NO: 2747842 - protein, 15 aa, Entamoeba invadens
CDSTCGGQCSGSTGV

SEQ ID NO: 2747843 - protein, 14 aa, Entamoeba invadens
CDSTCGGSCDTTNG

SEQ ID NO: 2747844 - protein, 14 aa, Entamoeba invadens
CDSTCGGSCNTTNG

SEQ ID NO: 2747845 - protein, 17 aa, Entamoeba invadens
CDSTCGNQCDGKDGHCT

SEQ ID NO: 2747846 - protein, 14 aa, Entamoeba invadens
CDSTCNEDCNTANG

SEQ ID NO: 2747847 - protein, 6 aa, Entamoeba invadens
CDSTDH

SEQ ID NO: 2747848 - protein, 7 aa, Entamoeba invadens
CDSTNGM

SEQ ID NO: 2747849 - protein, 8 aa, Entamoeba invadens
CDSTPGCT

SEQ ID NO: 2747850 - protein, 7 aa, Entamoeba invadens
CDSTTCV

SEQ ID NO: 2747851 - protein, 12 aa, Entamoeba invadens
CDSTTGKCTQCK

SEQ ID NO: 2747852 - protein, 4 aa, Entamoeba invadens
CDTA

SEQ ID NO: 2747853 - protein, 6 aa, Entamoeba invadens
CDTASG

SEQ ID NO: 2747854 - protein, 4 aa, Entamoeba invadens
CDTC

SEQ ID NO: 2747855 - protein, 5 aa, Entamoeba invadens
CDTCE

SEQ ID NO: 2747856 - protein, 12 aa, Entamoeba invadens
CDTCSAGTYQSG

SEQ ID NO: 2747857 - protein, 11 aa, Entamoeba invadens
CDTCSSKSKIC

SEQ ID NO: 2747858 - protein, 13 aa, Entamoeba invadens
CDTFQANSDNTEV

SEQ ID NO: 2747859 - protein, 4 aa, Entamoeba invadens
CDTG

SEQ ID NO: 2747860 - protein, 18 aa, Entamoeba invadens
CDTGCKACTEKGKCTSCP

SEQ ID NO: 2747861 - protein, 19 aa, Entamoeba invadens
CDTGCKACTEKGKCTSCPE

SEQ ID NO: 2747862 - protein, 19 aa, Entamoeba invadens
CDTGCKTCTEKGKCTSCPE

SEQ ID NO: 2747863 - protein, 9 aa, Entamoeba invadens
CDTKNGACT

SEQ ID NO: 2747864 - protein, 11 aa, Entamoeba invadens
CDTNGKGKCDK

SEQ ID NO: 2747865 - protein, 10 aa, Entamoeba invadens
CDTNNTKHKV

SEQ ID NO: 2747866 - protein, 9 aa, Entamoeba invadens
CDTNNTNNK

SEQ ID NO: 2747867 - protein, 6 aa, Entamoeba invadens
CDTNTG

SEQ ID NO: 2747868 - protein, 8 aa, Entamoeba invadens
CDTNTTPV

SEQ ID NO: 2747869 - protein, 4 aa, Entamoeba invadens
CDTP

SEQ ID NO: 2747870 - protein, 13 aa, Entamoeba invadens
CDTQNSELQTDGT

SEQ ID NO: 2747871 - protein, 4 aa, Entamoeba invadens
CDTS

SEQ ID NO: 2747872 - protein, 14 aa, Entamoeba invadens
CDTSCGGSCNTTNG

SEQ ID NO: 2747873 - protein, 15 aa, Entamoeba invadens
CDTSCKTCSSTTGYC

SEQ ID NO: 2747874 - protein, 6 aa, Entamoeba invadens
CDTSES

SEQ ID NO: 2747875 - protein, 10 aa, Entamoeba invadens
CDTSGCSTQS

SEQ ID NO: 2747876 - protein, 5 aa, Entamoeba invadens
CDTSS

SEQ ID NO: 2747877 - protein, 4 aa, Entamoeba invadens
CDTT

SEQ ID NO: 2747878 - protein, 17 aa, Entamoeba invadens
CDTTATDETTCTGSGNS

SEQ ID NO: 2747879 - protein, 8 aa, Entamoeba invadens
CDTTCGGK

SEQ ID NO: 2747880 - protein, 16 aa, Entamoeba invadens
CDTTCGGRCNTENGYC

SEQ ID NO: 2747881 - protein, 9 aa, Entamoeba invadens
CDTTDGDKR

SEQ ID NO: 2747882 - protein, 5 aa, Entamoeba invadens
CDTTL

SEQ ID NO: 2747883 - protein, 12 aa, Entamoeba invadens
CDTTNGHCTGCS

SEQ ID NO: 2747884 - protein, 11 aa, Entamoeba invadens
CDTTNGNCKKC

SEQ ID NO: 2747885 - protein, 10 aa, Entamoeba invadens
CDTTNGNCKT

SEQ ID NO: 2747886 - protein, 7 aa, Entamoeba invadens
CDTTNGT

SEQ ID NO: 2747887 - protein, 8 aa, Entamoeba invadens
CDTTPNVC

SEQ ID NO: 2747888 - protein, 11 aa, Entamoeba invadens
CDTTTSNSYLQ

SEQ ID NO: 2747889 - protein, 23 aa, Entamoeba invadens
CDTTYSKSCSKCNADTSKNTTVG

SEQ ID NO: 2747890 - protein, 7 aa, Entamoeba invadens
CDTVDGN

SEQ ID NO: 2747891 - protein, 8 aa, Entamoeba invadens
CDTVDGND

SEQ ID NO: 2747892 - protein, 4 aa, Entamoeba invadens
CEAN

SEQ ID NO: 2747893 - protein, 7 aa, Entamoeba invadens
CEAQSTN

SEQ ID NO: 2747894 - protein, 11 aa, Entamoeba invadens
CEATKERINGT

SEQ ID NO: 2747895 - protein, 6 aa, Entamoeba invadens
CEATNG

SEQ ID NO: 2747896 - protein, 6 aa, Entamoeba invadens
CEATPT

SEQ ID NO: 2747897 - protein, 9 aa, Entamoeba invadens
CEDCSNGIS

SEQ ID NO: 2747898 - protein, 12 aa, Entamoeba invadens
CEDDHYKDTTGC

SEQ ID NO: 2747899 - protein, 10 aa, Entamoeba invadens
CEDDKTCKTC

SEQ ID NO: 2747900 - protein, 6 aa, Entamoeba invadens
CEDDYY

SEQ ID NO: 2747901 - protein, 6 aa, Entamoeba invadens
CEDGTS

SEQ ID NO: 2747902 - protein, 8 aa, Entamoeba invadens
CEDGYYKE

SEQ ID NO: 2747903 - protein, 11 aa, Entamoeba invadens
CEDKKATLDGD

SEQ ID NO: 2747904 - protein, 6 aa, Entamoeba invadens
CEDPEL

SEQ ID NO: 2747905 - protein, 5 aa, Entamoeba invadens
CEDSK

SEQ ID NO: 2747906 - protein, 7 aa, Entamoeba invadens
CEDTTNT

SEQ ID NO: 2747907 - protein, 4 aa, Entamoeba invadens
CEEC

SEQ ID NO: 2747908 - protein, 22 aa, Entamoeba invadens
CEECNTQQCTKCKSGNYLNSNG

SEQ ID NO: 2747909 - protein, 5 aa, Entamoeba invadens
CEECP

SEQ ID NO: 2747910 - protein, 6 aa, Entamoeba invadens
CEECSS

SEQ ID NO: 2747911 - protein, 22 aa, Entamoeba invadens
CEEDHYKDTSGCLPKQDKYKDC

SEQ ID NO: 2747912 - protein, 22 aa, Entamoeba invadens
CEEDHYKDTTGCLPKQDKYKDC

SEQ ID NO: 2747913 - protein, 16 aa, Entamoeba invadens
CEEDKTIKCDSQSAMN

SEQ ID NO: 2747914 - protein, 9 aa, Entamoeba invadens
CEEGKVKVT

SEQ ID NO: 2747915 - protein, 11 aa, Entamoeba invadens
CEEGKVKVTSN

SEQ ID NO: 2747916 - protein, 12 aa, Entamoeba invadens
CEEGKVKVTSNG

SEQ ID NO: 2747917 - protein, 5 aa, Entamoeba invadens
CEEKS

SEQ ID NO: 2747918 - protein, 15 aa, Entamoeba invadens
CEENKRDNCNTEGEA

SEQ ID NO: 2747919 - protein, 10 aa, Entamoeba invadens
CEENNNEPEV

SEQ ID NO: 2747920 - protein, 8 aa, Entamoeba invadens
CEERQQSV

SEQ ID NO: 2747921 - protein, 4 aa, Entamoeba invadens
CEES

SEQ ID NO: 2747922 - protein, 9 aa, Entamoeba invadens
CEESTDLQN

SEQ ID NO: 2747923 - protein, 6 aa, Entamoeba invadens
CEETHY

SEQ ID NO: 2747924 - protein, 8 aa, Entamoeba invadens
CEETTPTG

SEQ ID NO: 2747925 - protein, 5 aa, Entamoeba invadens
CEETY

SEQ ID NO: 2747926 - protein, 7 aa, Entamoeba invadens
CEEYNES

SEQ ID NO: 2747927 - protein, 18 aa, Entamoeba invadens
CEGCKSGTYSSRGSTTCS

SEQ ID NO: 2747928 - protein, 11 aa, Entamoeba invadens
CEGGKCKKCQE

SEQ ID NO: 2747929 - protein, 11 aa, Entamoeba invadens
CEGGKCKKCTE

SEQ ID NO: 2747930 - protein, 10 aa, Entamoeba invadens
CEGGKCKRCN

SEQ ID NO: 2747931 - protein, 45 aa, Entamoeba invadens
CEGGTYSAYGGSNSCTTCRAGTYSNKGASSCSQCPTGSYSPESSS

SEQ ID NO: 2747932 - protein, 9 aa, Entamoeba invadens
CEGKKEEEK

SEQ ID NO: 2747933 - protein, 15 aa, Entamoeba invadens
CEGNHKASDDGDSCV

SEQ ID NO: 2747934 - protein, 18 aa, Entamoeba invadens
CEGQQKPTDYGDSCTESV

SEQ ID NO: 2747935 - protein, 18 aa, Entamoeba invadens
CEGRREPTYSGDSCTDSV

SEQ ID NO: 2747936 - protein, 8 aa, Entamoeba invadens
CEHATPNV

SEQ ID NO: 2747937 - protein, 8 aa, Entamoeba invadens
CEISTDEK

SEQ ID NO: 2747938 - protein, 6 aa, Entamoeba invadens
CEITDN

SEQ ID NO: 2747939 - protein, 7 aa, Entamoeba invadens
CEITSNE

SEQ ID NO: 2747940 - protein, 7 aa, Entamoeba invadens
CEKCDGN

SEQ ID NO: 2747941 - protein, 14 aa, Entamoeba invadens
CEKCDGSNGHCTAC

SEQ ID NO: 2747942 - protein, 9 aa, Entamoeba invadens
CEKCEPGMS

SEQ ID NO: 2747943 - protein, 8 aa, Entamoeba invadens
CEKCPDNC

SEQ ID NO: 2747944 - protein, 6 aa, Entamoeba invadens
CEKCPN

SEQ ID NO: 2747945 - protein, 9 aa, Entamoeba invadens
CEKCPTGTF

SEQ ID NO: 2747946 - protein, 5 aa, Entamoeba invadens
CEKCS

SEQ ID NO: 2747947 - protein, 11 aa, Entamoeba invadens
CEKDKKSVDGN

SEQ ID NO: 2747948 - protein, 5 aa, Entamoeba invadens
CEKGV

SEQ ID NO: 2747949 - protein, 8 aa, Entamoeba invadens
CEKKPTSC

SEQ ID NO: 2747950 - protein, 17 aa, Entamoeba invadens
CEKKTGRCTSCEEGYTI

SEQ ID NO: 2747951 - protein, 4 aa, Entamoeba invadens
CEKN

SEQ ID NO: 2747952 - protein, 10 aa, Entamoeba invadens
CEKPENLEGK

SEQ ID NO: 2747953 - protein, 4 aa, Entamoeba invadens
CEKR

SEQ ID NO: 2747954 - protein, 7 aa, Entamoeba invadens
CEKSNNY

SEQ ID NO: 2747955 - protein, 4 aa, Entamoeba invadens
CELD

SEQ ID NO: 2747956 - protein, 12 aa, Entamoeba invadens
CELSKTEGCPNS

SEQ ID NO: 2747957 - protein, 4 aa, Entamoeba invadens
CELT

SEQ ID NO: 2747958 - protein, 5 aa, Entamoeba invadens
CELTS

SEQ ID NO: 2747959 - protein, 7 aa, Entamoeba invadens
CEMSSNN

SEQ ID NO: 2747960 - protein, 30 aa, Entamoeba invadens
CENCDGVTGNCKSCSENSVVQSGSTTQCET

SEQ ID NO: 2747961 - protein, 7 aa, Entamoeba invadens
CENCSSI

SEQ ID NO: 2747962 - protein, 4 aa, Entamoeba invadens
CEND

SEQ ID NO: 2747963 - protein, 24 aa, Entamoeba invadens
CENDTCTACTDGHYPQSSSCPSCN

SEQ ID NO: 2747964 - protein, 14 aa, Entamoeba invadens
CENETTTGCTSNDN

SEQ ID NO: 2747965 - protein, 5 aa, Entamoeba invadens
CENGK

SEQ ID NO: 2747966 - protein, 10 aa, Entamoeba invadens
CENGKPTKCE

SEQ ID NO: 2747967 - protein, 16 aa, Entamoeba invadens
CENGRVTKCDTNNEMS

SEQ ID NO: 2747968 - protein, 13 aa, Entamoeba invadens
CENGYGKDLSSGG

SEQ ID NO: 2747969 - protein, 8 aa, Entamoeba invadens
CENKEKCN

SEQ ID NO: 2747970 - protein, 10 aa, Entamoeba invadens
CENKTYSVGG

SEQ ID NO: 2747971 - protein, 10 aa, Entamoeba invadens
CENNNKNYSY

SEQ ID NO: 2747972 - protein, 9 aa, Entamoeba invadens
CENNTCDAV

SEQ ID NO: 2747973 - protein, 16 aa, Entamoeba invadens
CENSSCDQSNGKCKQC

SEQ ID NO: 2747974 - protein, 5 aa, Entamoeba invadens
CENYD

SEQ ID NO: 2747975 - protein, 7 aa, Entamoeba invadens
CENYNKN

SEQ ID NO: 2747976 - protein, 5 aa, Entamoeba invadens
CEPCA

SEQ ID NO: 2747977 - protein, 8 aa, Entamoeba invadens
CEPDTEYL

SEQ ID NO: 2747978 - protein, 6 aa, Entamoeba invadens
CEPPQS

SEQ ID NO: 2747979 - protein, 4 aa, Entamoeba invadens
CEPR

SEQ ID NO: 2747980 - protein, 5 aa, Entamoeba invadens
CEPVD

SEQ ID NO: 2747981 - protein, 7 aa, Entamoeba invadens
CEQCETG

SEQ ID NO: 2747982 - protein, 7 aa, Entamoeba invadens
CEQGGAD

SEQ ID NO: 2747983 - protein, 5 aa, Entamoeba invadens
CEQGN

SEQ ID NO: 2747984 - protein, 8 aa, Entamoeba invadens
CEQKDSTV

SEQ ID NO: 2747985 - protein, 11 aa, Entamoeba invadens
CEQNGKSGCKR

SEQ ID NO: 2747986 - protein, 5 aa, Entamoeba invadens
CEQYS

SEQ ID NO: 2747987 - protein, 4 aa, Entamoeba invadens
CERC

SEQ ID NO: 2747988 - protein, 14 aa, Entamoeba invadens
CERGKTTKCNSNGV

SEQ ID NO: 2747989 - protein, 12 aa, Entamoeba invadens
CERKDSNCVSSD

SEQ ID NO: 2747990 - protein, 7 aa, Entamoeba invadens
CERKSNL

SEQ ID NO: 2747991 - protein, 5 aa, Entamoeba invadens
CERNG

SEQ ID NO: 2747992 - protein, 9 aa, Entamoeba invadens
CERPTNSTS

SEQ ID NO: 2747993 - protein, 7 aa, Entamoeba invadens
CERTSQY

SEQ ID NO: 2747994 - protein, 4 aa, Entamoeba invadens
CESC

SEQ ID NO: 2747995 - protein, 8 aa, Entamoeba invadens
CESCDDGY

SEQ ID NO: 2747996 - protein, 27 aa, Entamoeba invadens
CESCEDGYELTADKKCSLKTKQQNDEK

SEQ ID NO: 2747997 - protein, 10 aa, Entamoeba invadens
CESCNGNSSL

SEQ ID NO: 2747998 - protein, 5 aa, Entamoeba invadens
CESCP

SEQ ID NO: 2747999 - protein, 5 aa, Entamoeba invadens
CESCT

SEQ ID NO: 2748000 - protein, 8 aa, Entamoeba invadens
CESCTKSN

SEQ ID NO: 2748001 - protein, 6 aa, Entamoeba invadens
CESCTN

SEQ ID NO: 2748002 - protein, 8 aa, Entamoeba invadens
CESEAQDI

SEQ ID NO: 2748003 - protein, 6 aa, Entamoeba invadens
CESFSG

SEQ ID NO: 2748004 - protein, 6 aa, Entamoeba invadens
CESGKL

SEQ ID NO: 2748005 - protein, 12 aa, Entamoeba invadens
CESGKVKSTDTT

SEQ ID NO: 2748006 - protein, 6 aa, Entamoeba invadens
CESIHK

SEQ ID NO: 2748007 - protein, 15 aa, Entamoeba invadens
CESKMSSVDGVSDEC

SEQ ID NO: 2748008 - protein, 8 aa, Entamoeba invadens
CESNDGTI

SEQ ID NO: 2748009 - protein, 9 aa, Entamoeba invadens
CESNGCNTY

SEQ ID NO: 2748010 - protein, 12 aa, Entamoeba invadens
CESNSRCEMNDN

SEQ ID NO: 2748011 - protein, 4 aa, Entamoeba invadens
CESP

SEQ ID NO: 2748012 - protein, 7 aa, Entamoeba invadens
CESPNNT

SEQ ID NO: 2748013 - protein, 8 aa, Entamoeba invadens
CESQRECD

SEQ ID NO: 2748014 - protein, 7 aa, Entamoeba invadens
CESRQSK

SEQ ID NO: 2748015 - protein, 8 aa, Entamoeba invadens
CESTTDLN

SEQ ID NO: 2748016 - protein, 5 aa, Entamoeba invadens
CETAE

SEQ ID NO: 2748017 - protein, 8 aa, Entamoeba invadens
CETAQEYT

SEQ ID NO: 2748018 - protein, 5 aa, Entamoeba invadens
CETCA

SEQ ID NO: 2748019 - protein, 10 aa, Entamoeba invadens
CETCAEGKTD

SEQ ID NO: 2748020 - protein, 12 aa, Entamoeba invadens
CETCAEGKTDVC

SEQ ID NO: 2748021 - protein, 7 aa, Entamoeba invadens
CETCEDN

SEQ ID NO: 2748022 - protein, 6 aa, Entamoeba invadens
CETCEE

SEQ ID NO: 2748023 - protein, 16 aa, Entamoeba invadens
CETCKKASCDKCDGVD

SEQ ID NO: 2748024 - protein, 10 aa, Entamoeba invadens
CETCNGGTCQ

SEQ ID NO: 2748025 - protein, 8 aa, Entamoeba invadens
CETCNQGD

SEQ ID NO: 2748026 - protein, 8 aa, Entamoeba invadens
CETCNSSC

SEQ ID NO: 2748027 - protein, 11 aa, Entamoeba invadens
CETCQNGGNRS

SEQ ID NO: 2748028 - protein, 10 aa, Entamoeba invadens
CETCSNDGNC

SEQ ID NO: 2748029 - protein, 6 aa, Entamoeba invadens
CETCSP

SEQ ID NO: 2748030 - protein, 11 aa, Entamoeba invadens
CETCSSDSSRF

SEQ ID NO: 2748031 - protein, 14 aa, Entamoeba invadens
CETCSSNSSRNCTK

SEQ ID NO: 2748032 - protein, 6 aa, Entamoeba invadens
CETDKR

SEQ ID NO: 2748033 - protein, 8 aa, Entamoeba invadens
CETESDAL

SEQ ID NO: 2748034 - protein, 13 aa, Entamoeba invadens
CETIGKGEQCTKC

SEQ ID NO: 2748035 - protein, 7 aa, Entamoeba invadens
CETKHTN

SEQ ID NO: 2748036 - protein, 11 aa, Entamoeba invadens
CETKSDQNSCL

SEQ ID NO: 2748037 - protein, 4 aa, Entamoeba invadens
CETL

SEQ ID NO: 2748038 - protein, 7 aa, Entamoeba invadens
CETNDNI

SEQ ID NO: 2748039 - protein, 11 aa, Entamoeba invadens
CETSKTALQGC

SEQ ID NO: 2748040 - protein, 10 aa, Entamoeba invadens
CETSTDRDEA

SEQ ID NO: 2748041 - protein, 7 aa, Entamoeba invadens
CETSTGT

SEQ ID NO: 2748042 - protein, 6 aa, Entamoeba invadens
CETVDS

SEQ ID NO: 2748043 - protein, 13 aa, Entamoeba invadens
CETVGKGEQCTKC

SEQ ID NO: 2748044 - protein, 13 aa, Entamoeba invadens
CETVGNAEQCTNC

SEQ ID NO: 2748045 - protein, 6 aa, Entamoeba invadens
CETYNK

SEQ ID NO: 2748046 - protein, 7 aa, Entamoeba invadens
CETYNKN

SEQ ID NO: 2748047 - protein, 8 aa, Entamoeba invadens
CETYNKNN

SEQ ID NO: 2748048 - protein, 8 aa, Entamoeba invadens
CEVGDERG

SEQ ID NO: 2748049 - protein, 5 aa, Entamoeba invadens
CEVGN

SEQ ID NO: 2748050 - protein, 5 aa, Entamoeba invadens
CEVSR

SEQ ID NO: 2748051 - protein, 8 aa, Entamoeba invadens
CEYANPSY

SEQ ID NO: 2748052 - protein, 8 aa, Entamoeba invadens
CEYGTTSN

SEQ ID NO: 2748053 - protein, 5 aa, Entamoeba invadens
CEYKE

SEQ ID NO: 2748054 - protein, 4 aa, Entamoeba invadens
CEYQ

SEQ ID NO: 2748055 - protein, 4 aa, Entamoeba invadens
CEYS

SEQ ID NO: 2748056 - protein, 6 aa, Entamoeba invadens
CEYSDG

SEQ ID NO: 2748057 - protein, 8 aa, Entamoeba invadens
CEYSDGKS

SEQ ID NO: 2748058 - protein, 14 aa, Entamoeba invadens
CEYYQKQKKESRKI

SEQ ID NO: 2748059 - protein, 12 aa, Entamoeba invadens
CFPKGTEAIQGL

SEQ ID NO: 2748060 - protein, 4 aa, Entamoeba invadens
CFSN

SEQ ID NO: 2748061 - protein, 20 aa, Entamoeba invadens
CFTKDGSGCLSGKGTCSGDM

SEQ ID NO: 2748062 - protein, 11 aa, Entamoeba invadens
CFTKDNNGCIS

SEQ ID NO: 2748063 - protein, 17 aa, Entamoeba invadens
CGASATGCSKCKADTTT

SEQ ID NO: 2748064 - protein, 8 aa, Entamoeba invadens
CGCKREND

SEQ ID NO: 2748065 - protein, 5 aa, Entamoeba invadens
CGDAS

SEQ ID NO: 2748066 - protein, 8 aa, Entamoeba invadens
CGDDPALD

SEQ ID NO: 2748067 - protein, 5 aa, Entamoeba invadens
CGDER

SEQ ID NO: 2748068 - protein, 7 aa, Entamoeba invadens
CGDETTN

SEQ ID NO: 2748069 - protein, 15 aa, Entamoeba invadens
CGDGIKQSNEECDGG

SEQ ID NO: 2748070 - protein, 12 aa, Entamoeba invadens
CGDGISSAGNCQ

SEQ ID NO: 2748071 - protein, 12 aa, Entamoeba invadens
CGDGISSTGNCQ

SEQ ID NO: 2748072 - protein, 13 aa, Entamoeba invadens
CGDGISSTGNCQI

SEQ ID NO: 2748073 - protein, 10 aa, Entamoeba invadens
CGDGKSPYNG

SEQ ID NO: 2748074 - protein, 12 aa, Entamoeba invadens
CGDINNNNIPTN

SEQ ID NO: 2748075 - protein, 4 aa, Entamoeba invadens
CGDL

SEQ ID NO: 2748076 - protein, 16 aa, Entamoeba invadens
CGDNDPSGSRGKCSVS

SEQ ID NO: 2748077 - protein, 5 aa, Entamoeba invadens
CGDNN

SEQ ID NO: 2748078 - protein, 9 aa, Entamoeba invadens
CGEAGDPMH

SEQ ID NO: 2748079 - protein, 14 aa, Entamoeba invadens
CGECSGSSTSCTTC

SEQ ID NO: 2748080 - protein, 10 aa, Entamoeba invadens
CGECSNSEKE

SEQ ID NO: 2748081 - protein, 19 aa, Entamoeba invadens
CGECTSKTECTKCTKGNLI

SEQ ID NO: 2748082 - protein, 7 aa, Entamoeba invadens
CGEDDTR

SEQ ID NO: 2748083 - protein, 12 aa, Entamoeba invadens
CGEDGCDKTTQK

SEQ ID NO: 2748084 - protein, 8 aa, Entamoeba invadens
CGEDNAND

SEQ ID NO: 2748085 - protein, 6 aa, Entamoeba invadens
CGEEAL

SEQ ID NO: 2748086 - protein, 10 aa, Entamoeba invadens
CGEEEEGRSC

SEQ ID NO: 2748087 - protein, 17 aa, Entamoeba invadens
CGEGYKLNETSGKCDGA

SEQ ID NO: 2748088 - protein, 6 aa, Entamoeba invadens
CGEITD

SEQ ID NO: 2748089 - protein, 5 aa, Entamoeba invadens
CGENC

SEQ ID NO: 2748090 - protein, 13 aa, Entamoeba invadens
CGENDDGTCKETV

SEQ ID NO: 2748091 - protein, 12 aa, Entamoeba invadens
CGENDTNGARGT

SEQ ID NO: 2748092 - protein, 5 aa, Entamoeba invadens
CGEQG

SEQ ID NO: 2748093 - protein, 11 aa, Entamoeba invadens
CGGCNGPERTN

SEQ ID NO: 2748094 - protein, 11 aa, Entamoeba invadens
CGGEQKNGNGC

SEQ ID NO: 2748095 - protein, 10 aa, Entamoeba invadens
CGGKCDKTTG

SEQ ID NO: 2748096 - protein, 11 aa, Entamoeba invadens
CGGKCDTSTGV

SEQ ID NO: 2748097 - protein, 16 aa, Entamoeba invadens
CGGKCNTENGECTGCQ

SEQ ID NO: 2748098 - protein, 11 aa, Entamoeba invadens
CGGKCNTTTGV

SEQ ID NO: 2748099 - protein, 5 aa, Entamoeba invadens
CGGKE

SEQ ID NO: 2748100 - protein, 15 aa, Entamoeba invadens
CGGKSRGRAEYATNA

SEQ ID NO: 2748101 - protein, 12 aa, Entamoeba invadens
CGGNCDLTTSNC

SEQ ID NO: 2748102 - protein, 7 aa, Entamoeba invadens
CGGNCNN

SEQ ID NO: 2748103 - protein, 4 aa, Entamoeba invadens
CGGS

SEQ ID NO: 2748104 - protein, 10 aa, Entamoeba invadens
CGGSCADNTG

SEQ ID NO: 2748105 - protein, 9 aa, Entamoeba invadens
CGGSSFNPK

SEQ ID NO: 2748106 - protein, 15 aa, Entamoeba invadens
CGGTCNTENGECTGC

SEQ ID NO: 2748107 - protein, 12 aa, Entamoeba invadens
CGHSSNAAIPSN

SEQ ID NO: 2748108 - protein, 5 aa, Entamoeba invadens
CGKCT

SEQ ID NO: 2748109 - protein, 7 aa, Entamoeba invadens
CGKCTPN

SEQ ID NO: 2748110 - protein, 16 aa, Entamoeba invadens
CGKCTQNCNDCNGPNY

SEQ ID NO: 2748111 - protein, 5 aa, Entamoeba invadens
CGKGE

SEQ ID NO: 2748112 - protein, 8 aa, Entamoeba invadens
CGKNVAGE

SEQ ID NO: 2748113 - protein, 18 aa, Entamoeba invadens
CGKQTQNVATTKCPSGYG

SEQ ID NO: 2748114 - protein, 5 aa, Entamoeba invadens
CGKRE

SEQ ID NO: 2748115 - protein, 20 aa, Entamoeba invadens
CGKRQLKNPWGNEKSVEGTV

SEQ ID NO: 2748116 - protein, 8 aa, Entamoeba invadens
CGKSTEIS

SEQ ID NO: 2748117 - protein, 10 aa, Entamoeba invadens
CGNANTNCEI

SEQ ID NO: 2748118 - protein, 10 aa, Entamoeba invadens
CGNCNSGTGI

SEQ ID NO: 2748119 - protein, 6 aa, Entamoeba invadens
CGNGIQ

SEQ ID NO: 2748120 - protein, 7 aa, Entamoeba invadens
CGNGKDY

SEQ ID NO: 2748121 - protein, 11 aa, Entamoeba invadens
CGNGKKNTYYD

SEQ ID NO: 2748122 - protein, 8 aa, Entamoeba invadens
CGNGNEAY

SEQ ID NO: 2748123 - protein, 16 aa, Entamoeba invadens
CGNGNTITSALNGTSY

SEQ ID NO: 2748124 - protein, 18 aa, Entamoeba invadens
CGNNVVDDGEDCDNGDGC

SEQ ID NO: 2748125 - protein, 10 aa, Entamoeba invadens
CGNQCNPTNG

SEQ ID NO: 2748126 - protein, 11 aa, Entamoeba invadens
CGNRCNPSNGY

SEQ ID NO: 2748127 - protein, 5 aa, Entamoeba invadens
CGNSR

SEQ ID NO: 2748128 - protein, 52 aa, Entamoeba invadens
CGPGTYSNGDNKESCTKCSAGTYSYMGSSECSKCSPGTYSSSSGSSRCTQCE

SEQ ID NO: 2748129 - protein, 14 aa, Entamoeba invadens
CGQGEVSGKCKENQ

SEQ ID NO: 2748130 - protein, 14 aa, Entamoeba invadens
CGQGEVSGKCKESI

SEQ ID NO: 2748131 - protein, 7 aa, Entamoeba invadens
CGQSPTA

SEQ ID NO: 2748132 - protein, 6 aa, Entamoeba invadens
CGRPDY

SEQ ID NO: 2748133 - protein, 17 aa, Entamoeba invadens
CGSATECESCEENYETV

SEQ ID NO: 2748134 - protein, 5 aa, Entamoeba invadens
CGSCT

SEQ ID NO: 2748135 - protein, 8 aa, Entamoeba invadens
CGSCTSPE

SEQ ID NO: 2748136 - protein, 4 aa, Entamoeba invadens
CGSD

SEQ ID NO: 2748137 - protein, 10 aa, Entamoeba invadens
CGSEGAEHNC

SEQ ID NO: 2748138 - protein, 10 aa, Entamoeba invadens
CGSGEAEHKC

SEQ ID NO: 2748139 - protein, 13 aa, Entamoeba invadens
CGSGEYQDETGQI

SEQ ID NO: 2748140 - protein, 11 aa, Entamoeba invadens
CGSGITQTGSC

SEQ ID NO: 2748141 - protein, 4 aa, Entamoeba invadens
CGSP

SEQ ID NO: 2748142 - protein, 6 aa, Entamoeba invadens
CGSRYE

SEQ ID NO: 2748143 - protein, 6 aa, Entamoeba invadens
CGSSRA

SEQ ID NO: 2748144 - protein, 8 aa, Entamoeba invadens
CGSTRSDT

SEQ ID NO: 2748145 - protein, 4 aa, Entamoeba invadens
CGSV

SEQ ID NO: 2748146 - protein, 5 aa, Entamoeba invadens
CGSVS

SEQ ID NO: 2748147 - protein, 10 aa, Entamoeba invadens
CGTASVGTAR

SEQ ID NO: 2748148 - protein, 5 aa, Entamoeba invadens
CGTCK

SEQ ID NO: 2748149 - protein, 6 aa, Entamoeba invadens
CGTCNN

SEQ ID NO: 2748150 - protein, 10 aa, Entamoeba invadens
CGTDSVGNAK

SEQ ID NO: 2748151 - protein, 5 aa, Entamoeba invadens
CGTET

SEQ ID NO: 2748152 - protein, 7 aa, Entamoeba invadens
CGTGCEA

SEQ ID NO: 2748153 - protein, 14 aa, Entamoeba invadens
CGTGCGTCSSASAC

SEQ ID NO: 2748154 - protein, 13 aa, Entamoeba invadens
CGTGYTKKTTDSI

SEQ ID NO: 2748155 - protein, 11 aa, Entamoeba invadens
CGTSTSCEYGY

SEQ ID NO: 2748156 - protein, 11 aa, Entamoeba invadens
CGVRGAAQQPK

SEQ ID NO: 2748157 - protein, 15 aa, Entamoeba invadens
CHENDGNGRCAPSEG

SEQ ID NO: 2748158 - protein, 8 aa, Entamoeba invadens
CHESTGNG

SEQ ID NO: 2748159 - protein, 11 aa, Entamoeba invadens
CHGDSKCPHDP

SEQ ID NO: 2748160 - protein, 6 aa, Entamoeba invadens
CHKCSE

SEQ ID NO: 2748161 - protein, 6 aa, Entamoeba invadens
CHKTNG

SEQ ID NO: 2748162 - protein, 4 aa, Entamoeba invadens
CHPL

SEQ ID NO: 2748163 - protein, 9 aa, Entamoeba invadens
CHPLSESNC

SEQ ID NO: 2748164 - protein, 17 aa, Entamoeba invadens
CHPLSESNCTSYTITNT

SEQ ID NO: 2748165 - protein, 7 aa, Entamoeba invadens
CHQNGCT

SEQ ID NO: 2748166 - protein, 6 aa, Entamoeba invadens
CHSNTE

SEQ ID NO: 2748167 - protein, 12 aa, Entamoeba invadens
CHTNDDSQCTNQ

SEQ ID NO: 2748168 - protein, 8 aa, Entamoeba invadens
CIERSSKG

SEQ ID NO: 2748169 - protein, 12 aa, Entamoeba invadens
CIKTSHNNNSTN

SEQ ID NO: 2748170 - protein, 20 aa, Entamoeba invadens
CIPKDNKNCKISNGRGCTKC

SEQ ID NO: 2748171 - protein, 10 aa, Entamoeba invadens
CIPYSENANC

SEQ ID NO: 2748172 - protein, 21 aa, Entamoeba invadens
CIQNSENNKQTNCKTTTQNGC

SEQ ID NO: 2748173 - protein, 5 aa, Entamoeba invadens
CIQTS

SEQ ID NO: 2748174 - protein, 11 aa, Entamoeba invadens
CISNKNNQELI

SEQ ID NO: 2748175 - protein, 9 aa, Entamoeba invadens
CKAGSHKDN

SEQ ID NO: 2748176 - protein, 13 aa, Entamoeba invadens
CKAGTYTNSDNSY

SEQ ID NO: 2748177 - protein, 5 aa, Entamoeba invadens
CKAGY

SEQ ID NO: 2748178 - protein, 14 aa, Entamoeba invadens
CKAGYYPKTSGDFK

SEQ ID NO: 2748179 - protein, 13 aa, Entamoeba invadens
CKAGYYPKTSGDY

SEQ ID NO: 2748180 - protein, 8 aa, Entamoeba invadens
CKAGYYPQ

SEQ ID NO: 2748181 - protein, 14 aa, Entamoeba invadens
CKAGYYSKTSGDFK

SEQ ID NO: 2748182 - protein, 10 aa, Entamoeba invadens
CKANNYSLDS

SEQ ID NO: 2748183 - protein, 12 aa, Entamoeba invadens
CKANTCDSTSGY

SEQ ID NO: 2748184 - protein, 9 aa, Entamoeba invadens
CKARDTQNC

SEQ ID NO: 2748185 - protein, 5 aa, Entamoeba invadens
CKCPA

SEQ ID NO: 2748186 - protein, 5 aa, Entamoeba invadens
CKCTR

SEQ ID NO: 2748187 - protein, 9 aa, Entamoeba invadens
CKDANTKFE

SEQ ID NO: 2748188 - protein, 13 aa, Entamoeba invadens
CKDGTQPKEINGV

SEQ ID NO: 2748189 - protein, 12 aa, Entamoeba invadens
CKDGYKLEEKNN

SEQ ID NO: 2748190 - protein, 8 aa, Entamoeba invadens
CKDKCDTQ

SEQ ID NO: 2748191 - protein, 11 aa, Entamoeba invadens
CKDKCNKRTGY

SEQ ID NO: 2748192 - protein, 12 aa, Entamoeba invadens
CKDNCDSTTGYC

SEQ ID NO: 2748193 - protein, 9 aa, Entamoeba invadens
CKDPQIIKG

SEQ ID NO: 2748194 - protein, 5 aa, Entamoeba invadens
CKDSK

SEQ ID NO: 2748195 - protein, 8 aa, Entamoeba invadens
CKDYASSG

SEQ ID NO: 2748196 - protein, 4 aa, Entamoeba invadens
CKEC

SEQ ID NO: 2748197 - protein, 7 aa, Entamoeba invadens
CKECNGE

SEQ ID NO: 2748198 - protein, 9 aa, Entamoeba invadens
CKEDLTSKN

SEQ ID NO: 2748199 - protein, 4 aa, Entamoeba invadens
CKEG

SEQ ID NO: 2748200 - protein, 9 aa, Entamoeba invadens
CKEGALESK

SEQ ID NO: 2748201 - protein, 9 aa, Entamoeba invadens
CKEGSHKDR

SEQ ID NO: 2748202 - protein, 8 aa, Entamoeba invadens
CKEGSTTY

SEQ ID NO: 2748203 - protein, 13 aa, Entamoeba invadens
CKEGSYSTGGSSE

SEQ ID NO: 2748204 - protein, 4 aa, Entamoeba invadens
CKEH

SEQ ID NO: 2748205 - protein, 4 aa, Entamoeba invadens
CKEL

SEQ ID NO: 2748206 - protein, 7 aa, Entamoeba invadens
CKEPKSV

SEQ ID NO: 2748207 - protein, 9 aa, Entamoeba invadens
CKEPPKTRY

SEQ ID NO: 2748208 - protein, 22 aa, Entamoeba invadens
CKERREKEEKTKKENKKDNEQI

SEQ ID NO: 2748209 - protein, 12 aa, Entamoeba invadens
CKESAVEGTNET

SEQ ID NO: 2748210 - protein, 6 aa, Entamoeba invadens
CKESGI

SEQ ID NO: 2748211 - protein, 7 aa, Entamoeba invadens
CKESNKA

SEQ ID NO: 2748212 - protein, 14 aa, Entamoeba invadens
CKETENYSSSTNTI

SEQ ID NO: 2748213 - protein, 7 aa, Entamoeba invadens
CKETTQY

SEQ ID NO: 2748214 - protein, 11 aa, Entamoeba invadens
CKGDFKENCTT

SEQ ID NO: 2748215 - protein, 8 aa, Entamoeba invadens
CKGEGAYT

SEQ ID NO: 2748216 - protein, 8 aa, Entamoeba invadens
CKGERPSL

SEQ ID NO: 2748217 - protein, 7 aa, Entamoeba invadens
CKGGYSL

SEQ ID NO: 2748218 - protein, 8 aa, Entamoeba invadens
CKGSADKR

SEQ ID NO: 2748219 - protein, 13 aa, Entamoeba invadens
CKGTCGDTYDNDN

SEQ ID NO: 2748220 - protein, 10 aa, Entamoeba invadens
CKIKESEARP

SEQ ID NO: 2748221 - protein, 7 aa, Entamoeba invadens
CKIPDTN

SEQ ID NO: 2748222 - protein, 7 aa, Entamoeba invadens
CKKARST

SEQ ID NO: 2748223 - protein, 13 aa, Entamoeba invadens
CKKCAEGCSSCTE

SEQ ID NO: 2748224 - protein, 5 aa, Entamoeba invadens
CKKCE

SEQ ID NO: 2748225 - protein, 9 aa, Entamoeba invadens
CKKCKTGSN

SEQ ID NO: 2748226 - protein, 7 aa, Entamoeba invadens
CKKDEKC

SEQ ID NO: 2748227 - protein, 9 aa, Entamoeba invadens
CKKGYGGSN

SEQ ID NO: 2748228 - protein, 9 aa, Entamoeba invadens
CKKHSTTTC

SEQ ID NO: 2748229 - protein, 44 aa, Entamoeba invadens
CKKKKGEDLAKNSDVEMEGDEEKQGEAQSPKRNSDVSDVEISKA

SEQ ID NO: 2748230 - protein, 7 aa, Entamoeba invadens
CKKSEEN

SEQ ID NO: 2748231 - protein, 8 aa, Entamoeba invadens
CKKTDENC

SEQ ID NO: 2748232 - protein, 9 aa, Entamoeba invadens
CKKTNNGGC

SEQ ID NO: 2748233 - protein, 11 aa, Entamoeba invadens
CKKYDQSGCKE

SEQ ID NO: 2748234 - protein, 9 aa, Entamoeba invadens
CKKYGEQNC

SEQ ID NO: 2748235 - protein, 12 aa, Entamoeba invadens
CKLDDNDKAYYS

SEQ ID NO: 2748236 - protein, 5 aa, Entamoeba invadens
CKMGN

SEQ ID NO: 2748237 - protein, 4 aa, Entamoeba invadens
CKNC

SEQ ID NO: 2748238 - protein, 6 aa, Entamoeba invadens
CKNCTE

SEQ ID NO: 2748239 - protein, 8 aa, Entamoeba invadens
CKNDRNPP

SEQ ID NO: 2748240 - protein, 5 aa, Entamoeba invadens
CKNEN

SEQ ID NO: 2748241 - protein, 11 aa, Entamoeba invadens
CKNKRNPPKCE

SEQ ID NO: 2748242 - protein, 5 aa, Entamoeba invadens
CKNKS

SEQ ID NO: 2748243 - protein, 9 aa, Entamoeba invadens
CKNKTETNA

SEQ ID NO: 2748244 - protein, 6 aa, Entamoeba invadens
CKNKYG

SEQ ID NO: 2748245 - protein, 8 aa, Entamoeba invadens
CKNNETLM

SEQ ID NO: 2748246 - protein, 16 aa, Entamoeba invadens
CKNNRCHNSEGCTSCE

SEQ ID NO: 2748247 - protein, 7 aa, Entamoeba invadens
CKNTEST

SEQ ID NO: 2748248 - protein, 8 aa, Entamoeba invadens
CKNTETEH

SEQ ID NO: 2748249 - protein, 24 aa, Entamoeba invadens
CKNTTCKQCRGDGNECTACNNGQY

SEQ ID NO: 2748250 - protein, 5 aa, Entamoeba invadens
CKNYD

SEQ ID NO: 2748251 - protein, 7 aa, Entamoeba invadens
CKNYSSI

SEQ ID NO: 2748252 - protein, 5 aa, Entamoeba invadens
CKPCE

SEQ ID NO: 2748253 - protein, 17 aa, Entamoeba invadens
CKPKVQEGTIRTTGSFN

SEQ ID NO: 2748254 - protein, 9 aa, Entamoeba invadens
CKPNYEEND

SEQ ID NO: 2748255 - protein, 5 aa, Entamoeba invadens
CKPQT

SEQ ID NO: 2748256 - protein, 23 aa, Entamoeba invadens
CKQCENGTHSSTGGSTACTPCQG

SEQ ID NO: 2748257 - protein, 9 aa, Entamoeba invadens
CKQCENGYK

SEQ ID NO: 2748258 - protein, 7 aa, Entamoeba invadens
CKQCGPG

SEQ ID NO: 2748259 - protein, 11 aa, Entamoeba invadens
CKQCSSQSFSV

SEQ ID NO: 2748260 - protein, 10 aa, Entamoeba invadens
CKQNGNLEGK

SEQ ID NO: 2748261 - protein, 9 aa, Entamoeba invadens
CKQTNERIT

SEQ ID NO: 2748262 - protein, 9 aa, Entamoeba invadens
CKQTTQQSC

SEQ ID NO: 2748263 - protein, 5 aa, Entamoeba invadens
CKRCS

SEQ ID NO: 2748264 - protein, 7 aa, Entamoeba invadens
CKREEQS

SEQ ID NO: 2748265 - protein, 15 aa, Entamoeba invadens
CKRGMNKQTAFRRYE

SEQ ID NO: 2748266 - protein, 9 aa, Entamoeba invadens
CKRIEQTKG

SEQ ID NO: 2748267 - protein, 10 aa, Entamoeba invadens
CKRSRWTQYD

SEQ ID NO: 2748268 - protein, 10 aa, Entamoeba invadens
CKSANNSKCV

SEQ ID NO: 2748269 - protein, 19 aa, Entamoeba invadens
CKSAQNCNSPSSLSPASCD

SEQ ID NO: 2748270 - protein, 6 aa, Entamoeba invadens
CKSATE

SEQ ID NO: 2748271 - protein, 4 aa, Entamoeba invadens
CKSC

SEQ ID NO: 2748272 - protein, 14 aa, Entamoeba invadens
CKSCDGKTGQCTSC

SEQ ID NO: 2748273 - protein, 13 aa, Entamoeba invadens
CKSCDKTNGYCTS

SEQ ID NO: 2748274 - protein, 10 aa, Entamoeba invadens
CKSCDNTNGD

SEQ ID NO: 2748275 - protein, 8 aa, Entamoeba invadens
CKSCDSQC

SEQ ID NO: 2748276 - protein, 8 aa, Entamoeba invadens
CKSCNSEN

SEQ ID NO: 2748277 - protein, 15 aa, Entamoeba invadens
CKSCNSGQSGKTKCN

SEQ ID NO: 2748278 - protein, 18 aa, Entamoeba invadens
CKSCPNYQYKKSQTSCDN

SEQ ID NO: 2748279 - protein, 13 aa, Entamoeba invadens
CKSCSKTTGECTS

SEQ ID NO: 2748280 - protein, 9 aa, Entamoeba invadens
CKSCTNEGN

SEQ ID NO: 2748281 - protein, 7 aa, Entamoeba invadens
CKSCTNS

SEQ ID NO: 2748282 - protein, 6 aa, Entamoeba invadens
CKSCTS

SEQ ID NO: 2748283 - protein, 7 aa, Entamoeba invadens
CKSCTST

SEQ ID NO: 2748284 - protein, 6 aa, Entamoeba invadens
CKSDFT

SEQ ID NO: 2748285 - protein, 8 aa, Entamoeba invadens
CKSDPTIE

SEQ ID NO: 2748286 - protein, 8 aa, Entamoeba invadens
CKSEETGI

SEQ ID NO: 2748287 - protein, 16 aa, Entamoeba invadens
CKSEKCHTTETADVSG

SEQ ID NO: 2748288 - protein, 6 aa, Entamoeba invadens
CKSGSE

SEQ ID NO: 2748289 - protein, 14 aa, Entamoeba invadens
CKSGSRSQGCTSCE

SEQ ID NO: 2748290 - protein, 11 aa, Entamoeba invadens
CKSNDALNDTC

SEQ ID NO: 2748291 - protein, 5 aa, Entamoeba invadens
CKSNE

SEQ ID NO: 2748292 - protein, 8 aa, Entamoeba invadens
CKSPRDYF

SEQ ID NO: 2748293 - protein, 8 aa, Entamoeba invadens
CKSQNPVQ

SEQ ID NO: 2748294 - protein, 6 aa, Entamoeba invadens
CKSSEF

SEQ ID NO: 2748295 - protein, 8 aa, Entamoeba invadens
CKSTNKEL

SEQ ID NO: 2748296 - protein, 9 aa, Entamoeba invadens
CKSYDTQTH

SEQ ID NO: 2748297 - protein, 26 aa, Entamoeba invadens
CKSYNTKTQKCSECSGSNKIGPNGDE

SEQ ID NO: 2748298 - protein, 6 aa, Entamoeba invadens
CKTADE

SEQ ID NO: 2748299 - protein, 5 aa, Entamoeba invadens
CKTCD

SEQ ID NO: 2748300 - protein, 8 aa, Entamoeba invadens
CKTCDATN

SEQ ID NO: 2748301 - protein, 10 aa, Entamoeba invadens
CKTCDPSTGE

SEQ ID NO: 2748302 - protein, 12 aa, Entamoeba invadens
CKTCDSASNRKC

SEQ ID NO: 2748303 - protein, 9 aa, Entamoeba invadens
CKTCDTKTG

SEQ ID NO: 2748304 - protein, 13 aa, Entamoeba invadens
CKTCEDSSTTCTS

SEQ ID NO: 2748305 - protein, 9 aa, Entamoeba invadens
CKTCENNGV

SEQ ID NO: 2748306 - protein, 10 aa, Entamoeba invadens
CKTCGTNKTN

SEQ ID NO: 2748307 - protein, 12 aa, Entamoeba invadens
CKTCKEKETKCT

SEQ ID NO: 2748308 - protein, 10 aa, Entamoeba invadens
CKTCNGPYST

SEQ ID NO: 2748309 - protein, 10 aa, Entamoeba invadens
CKTCNNTNGN

SEQ ID NO: 2748310 - protein, 11 aa, Entamoeba invadens
CKTCNPSNTNY

SEQ ID NO: 2748311 - protein, 6 aa, Entamoeba invadens
CKTCNS

SEQ ID NO: 2748312 - protein, 12 aa, Entamoeba invadens
CKTCQQSSQPTA

SEQ ID NO: 2748313 - protein, 5 aa, Entamoeba invadens
CKTCS

SEQ ID NO: 2748314 - protein, 6 aa, Entamoeba invadens
CKTCSD

SEQ ID NO: 2748315 - protein, 7 aa, Entamoeba invadens
CKTCSDN

SEQ ID NO: 2748316 - protein, 13 aa, Entamoeba invadens
CKTCSDNTTCDSC

SEQ ID NO: 2748317 - protein, 13 aa, Entamoeba invadens
CKTCSDSQTCTTC

SEQ ID NO: 2748318 - protein, 10 aa, Entamoeba invadens
CKTCSGTATH

SEQ ID NO: 2748319 - protein, 6 aa, Entamoeba invadens
CKTCSS

SEQ ID NO: 2748320 - protein, 7 aa, Entamoeba invadens
CKTCSSK

SEQ ID NO: 2748321 - protein, 7 aa, Entamoeba invadens
CKTCSSL

SEQ ID NO: 2748322 - protein, 8 aa, Entamoeba invadens
CKTCSSTS

SEQ ID NO: 2748323 - protein, 8 aa, Entamoeba invadens
CKTCTNEG

SEQ ID NO: 2748324 - protein, 7 aa, Entamoeba invadens
CKTCTSG

SEQ ID NO: 2748325 - protein, 4 aa, Entamoeba invadens
CKTD

SEQ ID NO: 2748326 - protein, 7 aa, Entamoeba invadens
CKTDDDD

SEQ ID NO: 2748327 - protein, 11 aa, Entamoeba invadens
CKTDDQPAPDG

SEQ ID NO: 2748328 - protein, 8 aa, Entamoeba invadens
CKTGKANI

SEQ ID NO: 2748329 - protein, 6 aa, Entamoeba invadens
CKTGSN

SEQ ID NO: 2748330 - protein, 11 aa, Entamoeba invadens
CKTGYQKVGDK

SEQ ID NO: 2748331 - protein, 4 aa, Entamoeba invadens
CKTP

SEQ ID NO: 2748332 - protein, 8 aa, Entamoeba invadens
CKTPCTSD

SEQ ID NO: 2748333 - protein, 19 aa, Entamoeba invadens
CKTTNCSTTTQDCSDCKDG

SEQ ID NO: 2748334 - protein, 9 aa, Entamoeba invadens
CKTTSTKGC

SEQ ID NO: 2748335 - protein, 8 aa, Entamoeba invadens
CKTYTSGL

SEQ ID NO: 2748336 - protein, 12 aa, Entamoeba invadens
CKVKPDDGSQFN

SEQ ID NO: 2748337 - protein, 8 aa, Entamoeba invadens
CKVSGGKC

SEQ ID NO: 2748338 - protein, 6 aa, Entamoeba invadens
CKVTDQ

SEQ ID NO: 2748339 - protein, 8 aa, Entamoeba invadens
CKVTGDKC

SEQ ID NO: 2748340 - protein, 13 aa, Entamoeba invadens
CKYQKNNKNQKEC

SEQ ID NO: 2748341 - protein, 10 aa, Entamoeba invadens
CKYQKTNKGV

SEQ ID NO: 2748342 - protein, 12 aa, Entamoeba invadens
CKYTYNNKNETT

SEQ ID NO: 2748343 - protein, 8 aa, Entamoeba invadens
CLDSEEAS

SEQ ID NO: 2748344 - protein, 5 aa, Entamoeba invadens
CLETT

SEQ ID NO: 2748345 - protein, 9 aa, Entamoeba invadens
CLKSNNSKC

SEQ ID NO: 2748346 - protein, 12 aa, Entamoeba invadens
CLKTQEEANAIQ

SEQ ID NO: 2748347 - protein, 4 aa, Entamoeba invadens
CLND

SEQ ID NO: 2748348 - protein, 4 aa, Entamoeba invadens
CLPQ

SEQ ID NO: 2748349 - protein, 5 aa, Entamoeba invadens
CLPQS

SEQ ID NO: 2748350 - protein, 7 aa, Entamoeba invadens
CLQKTSE

SEQ ID NO: 2748351 - protein, 8 aa, Entamoeba invadens
CLREPSHN

SEQ ID NO: 2748352 - protein, 5 aa, Entamoeba invadens
CLSPD

SEQ ID NO: 2748353 - protein, 7 aa, Entamoeba invadens
CLTPSGE

SEQ ID NO: 2748354 - protein, 6 aa, Entamoeba invadens
CMSGDG

SEQ ID NO: 2748355 - protein, 11 aa, Entamoeba invadens
CNAEKGFGRCD

SEQ ID NO: 2748356 - protein, 6 aa, Entamoeba invadens
CNAISN

SEQ ID NO: 2748357 - protein, 7 aa, Entamoeba invadens
CNAQTSF

SEQ ID NO: 2748358 - protein, 5 aa, Entamoeba invadens
CNATG

SEQ ID NO: 2748359 - protein, 7 aa, Entamoeba invadens
CNATNGK

SEQ ID NO: 2748360 - protein, 6 aa, Entamoeba invadens
CNATNS

SEQ ID NO: 2748361 - protein, 25 aa, Entamoeba invadens
CNAYDSKTKKCSRCKGNYNPSVSGD

SEQ ID NO: 2748362 - protein, 5 aa, Entamoeba invadens
CNDAK

SEQ ID NO: 2748363 - protein, 11 aa, Entamoeba invadens
CNDCTTDNEGS

SEQ ID NO: 2748364 - protein, 7 aa, Entamoeba invadens
CNDDENT

SEQ ID NO: 2748365 - protein, 6 aa, Entamoeba invadens
CNDDEY

SEQ ID NO: 2748366 - protein, 6 aa, Entamoeba invadens
CNDLEN

SEQ ID NO: 2748367 - protein, 11 aa, Entamoeba invadens
CNDNEYVNDNN

SEQ ID NO: 2748368 - protein, 12 aa, Entamoeba invadens
CNDNEYVNENNK

SEQ ID NO: 2748369 - protein, 6 aa, Entamoeba invadens
CNDQSY

SEQ ID NO: 2748370 - protein, 12 aa, Entamoeba invadens
CNDRTKENVGKK

SEQ ID NO: 2748371 - protein, 4 aa, Entamoeba invadens
CNEC

SEQ ID NO: 2748372 - protein, 6 aa, Entamoeba invadens
CNECDS

SEQ ID NO: 2748373 - protein, 18 aa, Entamoeba invadens
CNECKNGYRPVNETEGKC

SEQ ID NO: 2748374 - protein, 17 aa, Entamoeba invadens
CNEENDRIAYDSGNCSG

SEQ ID NO: 2748375 - protein, 11 aa, Entamoeba invadens
CNEENNGGNCS

SEQ ID NO: 2748376 - protein, 6 aa, Entamoeba invadens
CNELEP

SEQ ID NO: 2748377 - protein, 8 aa, Entamoeba invadens
CNENGGYF

SEQ ID NO: 2748378 - protein, 8 aa, Entamoeba invadens
CNEPKTKQ

SEQ ID NO: 2748379 - protein, 5 aa, Entamoeba invadens
CNETC

SEQ ID NO: 2748380 - protein, 6 aa, Entamoeba invadens
CNETTG

SEQ ID NO: 2748381 - protein, 10 aa, Entamoeba invadens
CNGETNSTGA

SEQ ID NO: 2748382 - protein, 8 aa, Entamoeba invadens
CNGGSNTN

SEQ ID NO: 2748383 - protein, 15 aa, Entamoeba invadens
CNGGSSKNCTSCKEG

SEQ ID NO: 2748384 - protein, 4 aa, Entamoeba invadens
CNGN

SEQ ID NO: 2748385 - protein, 9 aa, Entamoeba invadens
CNGNCDGLT

SEQ ID NO: 2748386 - protein, 26 aa, Entamoeba invadens
CNGPEKTNCTTCPNGKYVDKTHGEYN

SEQ ID NO: 2748387 - protein, 10 aa, Entamoeba invadens
CNGPRNRYVK

SEQ ID NO: 2748388 - protein, 6 aa, Entamoeba invadens
CNGPTR

SEQ ID NO: 2748389 - protein, 11 aa, Entamoeba invadens
CNGPTSQNCTS

SEQ ID NO: 2748390 - protein, 14 aa, Entamoeba invadens
CNGPTTSECNSCND

SEQ ID NO: 2748391 - protein, 10 aa, Entamoeba invadens
CNGQCNTSTG

SEQ ID NO: 2748392 - protein, 9 aa, Entamoeba invadens
CNGSGPNNC

SEQ ID NO: 2748393 - protein, 5 aa, Entamoeba invadens
CNGTL

SEQ ID NO: 2748394 - protein, 27 aa, Entamoeba invadens
CNGTNKLSVDKTTCSANCSSGEYEMNS

SEQ ID NO: 2748395 - protein, 8 aa, Entamoeba invadens
CNGYSSTT

SEQ ID NO: 2748396 - protein, 9 aa, Entamoeba invadens
CNHDTTKDG

SEQ ID NO: 2748397 - protein, 16 aa, Entamoeba invadens
CNHEKGFGSCSTREGK

SEQ ID NO: 2748398 - protein, 4 aa, Entamoeba invadens
CNKC

SEQ ID NO: 2748399 - protein, 11 aa, Entamoeba invadens
CNKCDSKSGNC

SEQ ID NO: 2748400 - protein, 5 aa, Entamoeba invadens
CNKCP

SEQ ID NO: 2748401 - protein, 6 aa, Entamoeba invadens
CNKCPD

SEQ ID NO: 2748402 - protein, 6 aa, Entamoeba invadens
CNKCSD

SEQ ID NO: 2748403 - protein, 7 aa, Entamoeba invadens
CNKCTKT

SEQ ID NO: 2748404 - protein, 7 aa, Entamoeba invadens
CNKENGI

SEQ ID NO: 2748405 - protein, 4 aa, Entamoeba invadens
CNKK

SEQ ID NO: 2748406 - protein, 13 aa, Entamoeba invadens
CNKNCNTTNGDCK

SEQ ID NO: 2748407 - protein, 5 aa, Entamoeba invadens
CNKRI

SEQ ID NO: 2748408 - protein, 25 aa, Entamoeba invadens
CNKTECTKCTDGNGILTPPSDNAAA

SEQ ID NO: 2748409 - protein, 5 aa, Entamoeba invadens
CNKTT

SEQ ID NO: 2748410 - protein, 15 aa, Entamoeba invadens
CNKVTSKKYLNEEVQ

SEQ ID NO: 2748411 - protein, 4 aa, Entamoeba invadens
CNKY

SEQ ID NO: 2748412 - protein, 8 aa, Entamoeba invadens
CNNDETTD

SEQ ID NO: 2748413 - protein, 8 aa, Entamoeba invadens
CNNDTIGP

SEQ ID NO: 2748414 - protein, 22 aa, Entamoeba invadens
CNNENKAECMRTRTDGCRDGSR

SEQ ID NO: 2748415 - protein, 7 aa, Entamoeba invadens
CNNNDSN

SEQ ID NO: 2748416 - protein, 12 aa, Entamoeba invadens
CNNNETNEENNL

SEQ ID NO: 2748417 - protein, 9 aa, Entamoeba invadens
CNNNKKPNC

SEQ ID NO: 2748418 - protein, 11 aa, Entamoeba invadens
CNNNNNQCSQC

SEQ ID NO: 2748419 - protein, 7 aa, Entamoeba invadens
CNNNTEL

SEQ ID NO: 2748420 - protein, 8 aa, Entamoeba invadens
CNNNTYLD

SEQ ID NO: 2748421 - protein, 10 aa, Entamoeba invadens
CNNPTKTSCD

SEQ ID NO: 2748422 - protein, 7 aa, Entamoeba invadens
CNNQCNP

SEQ ID NO: 2748423 - protein, 5 aa, Entamoeba invadens
CNNYD

SEQ ID NO: 2748424 - protein, 6 aa, Entamoeba invadens
CNPGCP

SEQ ID NO: 2748425 - protein, 8 aa, Entamoeba invadens
CNPGNYSD

SEQ ID NO: 2748426 - protein, 8 aa, Entamoeba invadens
CNPGSGFI

SEQ ID NO: 2748427 - protein, 8 aa, Entamoeba invadens
CNPNGCNT

SEQ ID NO: 2748428 - protein, 7 aa, Entamoeba invadens
CNPPNGR

SEQ ID NO: 2748429 - protein, 5 aa, Entamoeba invadens
CNPQD

SEQ ID NO: 2748430 - protein, 7 aa, Entamoeba invadens
CNPQDEL

SEQ ID NO: 2748431 - protein, 7 aa, Entamoeba invadens
CNPQEEL

SEQ ID NO: 2748432 - protein, 11 aa, Entamoeba invadens
CNPSTTDGEIQ

SEQ ID NO: 2748433 - protein, 10 aa, Entamoeba invadens
CNQCEDGETC

SEQ ID NO: 2748434 - protein, 6 aa, Entamoeba invadens
CNQCSR

SEQ ID NO: 2748435 - protein, 9 aa, Entamoeba invadens
CNQCTSQTT

SEQ ID NO: 2748436 - protein, 13 aa, Entamoeba invadens
CNQCTSQTTCQTC

SEQ ID NO: 2748437 - protein, 9 aa, Entamoeba invadens
CNQGSGECV

SEQ ID NO: 2748438 - protein, 7 aa, Entamoeba invadens
CNQIESN

SEQ ID NO: 2748439 - protein, 9 aa, Entamoeba invadens
CNQPSKKRY

SEQ ID NO: 2748440 - protein, 7 aa, Entamoeba invadens
CNQSSIK

SEQ ID NO: 2748441 - protein, 7 aa, Entamoeba invadens
CNQTEKS

SEQ ID NO: 2748442 - protein, 10 aa, Entamoeba invadens
CNRDTTVKTS

SEQ ID NO: 2748443 - protein, 12 aa, Entamoeba invadens
CNRNDLYSDDDG

SEQ ID NO: 2748444 - protein, 4 aa, Entamoeba invadens
CNRR

SEQ ID NO: 2748445 - protein, 22 aa, Entamoeba invadens
CNRSAPGKCNTFRDRKSTYMGK

SEQ ID NO: 2748446 - protein, 11 aa, Entamoeba invadens
CNSCDGSTGVC

SEQ ID NO: 2748447 - protein, 10 aa, Entamoeba invadens
CNSCNASNGV

SEQ ID NO: 2748448 - protein, 9 aa, Entamoeba invadens
CNSCSSTTK

SEQ ID NO: 2748449 - protein, 5 aa, Entamoeba invadens
CNSDD

SEQ ID NO: 2748450 - protein, 6 aa, Entamoeba invadens
CNSDIG

SEQ ID NO: 2748451 - protein, 7 aa, Entamoeba invadens
CNSDNGY

SEQ ID NO: 2748452 - protein, 11 aa, Entamoeba invadens
CNSDRKCTGCK

SEQ ID NO: 2748453 - protein, 7 aa, Entamoeba invadens
CNSDSNC

SEQ ID NO: 2748454 - protein, 8 aa, Entamoeba invadens
CNSDTTVQ

SEQ ID NO: 2748455 - protein, 12 aa, Entamoeba invadens
CNSEAKQDRGTW

SEQ ID NO: 2748456 - protein, 8 aa, Entamoeba invadens
CNSETAAY

SEQ ID NO: 2748457 - protein, 9 aa, Entamoeba invadens
CNSGPKTKY

SEQ ID NO: 2748458 - protein, 5 aa, Entamoeba invadens
CNSIT

SEQ ID NO: 2748459 - protein, 6 aa, Entamoeba invadens
CNSITN

SEQ ID NO: 2748460 - protein, 5 aa, Entamoeba invadens
CNSLS

SEQ ID NO: 2748461 - protein, 8 aa, Entamoeba invadens
CNSNPSVC

SEQ ID NO: 2748462 - protein, 8 aa, Entamoeba invadens
CNSQTDFS

SEQ ID NO: 2748463 - protein, 8 aa, Entamoeba invadens
CNSSTSCM

SEQ ID NO: 2748464 - protein, 7 aa, Entamoeba invadens
CNSTASI

SEQ ID NO: 2748465 - protein, 5 aa, Entamoeba invadens
CNSTC

SEQ ID NO: 2748466 - protein, 8 aa, Entamoeba invadens
CNSTGSDC

SEQ ID NO: 2748467 - protein, 9 aa, Entamoeba invadens
CNSTNTKSV

SEQ ID NO: 2748468 - protein, 9 aa, Entamoeba invadens
CNSTNYKTL

SEQ ID NO: 2748469 - protein, 16 aa, Entamoeba invadens
CNSTNYKTQDGNCLPQ

SEQ ID NO: 2748470 - protein, 8 aa, Entamoeba invadens
CNSTSEYD

SEQ ID NO: 2748471 - protein, 5 aa, Entamoeba invadens
CNSTT

SEQ ID NO: 2748472 - protein, 12 aa, Entamoeba invadens
CNTCDGGTSSSC

SEQ ID NO: 2748473 - protein, 8 aa, Entamoeba invadens
CNTCGQNG

SEQ ID NO: 2748474 - protein, 12 aa, Entamoeba invadens
CNTCNQTNGDCT

SEQ ID NO: 2748475 - protein, 12 aa, Entamoeba invadens
CNTCNSSSKYCS

SEQ ID NO: 2748476 - protein, 13 aa, Entamoeba invadens
CNTCSSDKQRSCT

SEQ ID NO: 2748477 - protein, 7 aa, Entamoeba invadens
CNTDASI

SEQ ID NO: 2748478 - protein, 11 aa, Entamoeba invadens
CNTDGTCNGCS

SEQ ID NO: 2748479 - protein, 6 aa, Entamoeba invadens
CNTENG

SEQ ID NO: 2748480 - protein, 5 aa, Entamoeba invadens
CNTES

SEQ ID NO: 2748481 - protein, 6 aa, Entamoeba invadens
CNTGCT

SEQ ID NO: 2748482 - protein, 9 aa, Entamoeba invadens
CNTGSSERC

SEQ ID NO: 2748483 - protein, 9 aa, Entamoeba invadens
CNTGYDPND

SEQ ID NO: 2748484 - protein, 5 aa, Entamoeba invadens
CNTKD

SEQ ID NO: 2748485 - protein, 9 aa, Entamoeba invadens
CNTKTDNCT

SEQ ID NO: 2748486 - protein, 5 aa, Entamoeba invadens
CNTLD

SEQ ID NO: 2748487 - protein, 5 aa, Entamoeba invadens
CNTND

SEQ ID NO: 2748488 - protein, 11 aa, Entamoeba invadens
CNTNEELETKC

SEQ ID NO: 2748489 - protein, 6 aa, Entamoeba invadens
CNTNEN

SEQ ID NO: 2748490 - protein, 5 aa, Entamoeba invadens
CNTNH

SEQ ID NO: 2748491 - protein, 6 aa, Entamoeba invadens
CNTNKD

SEQ ID NO: 2748492 - protein, 6 aa, Entamoeba invadens
CNTNKN

SEQ ID NO: 2748493 - protein, 6 aa, Entamoeba invadens
CNTNNE

SEQ ID NO: 2748494 - protein, 13 aa, Entamoeba invadens
CNTNNSLKDGKCE

SEQ ID NO: 2748495 - protein, 17 aa, Entamoeba invadens
CNTPGDSLLSNSTSGGE

SEQ ID NO: 2748496 - protein, 9 aa, Entamoeba invadens
CNTRKSSDC

SEQ ID NO: 2748497 - protein, 5 aa, Entamoeba invadens
CNVDG

SEQ ID NO: 2748498 - protein, 5 aa, Entamoeba invadens
CNVEN

SEQ ID NO: 2748499 - protein, 13 aa, Entamoeba invadens
CNVNRTEDCEISK

SEQ ID NO: 2748500 - protein, 31 aa, Entamoeba invadens
CPAGKFSSSSGSPSCSTCPAGKYSSSGSSAC

SEQ ID NO: 2748501 - protein, 30 aa, Entamoeba invadens
CPAGQTSNIRSSACTNCTDGYYSNSGDQTC

SEQ ID NO: 2748502 - protein, 14 aa, Entamoeba invadens
CPAGSYQSKKGTSY

SEQ ID NO: 2748503 - protein, 14 aa, Entamoeba invadens
CPAGSYSKSGDPTC

SEQ ID NO: 2748504 - protein, 20 aa, Entamoeba invadens
CPAGTKSTESYDNCEECENG

SEQ ID NO: 2748505 - protein, 34 aa, Entamoeba invadens
CPAGTYASSTGSRECQPCSPNSYSLEGSSNCTSC

SEQ ID NO: 2748506 - protein, 7 aa, Entamoeba invadens
CPAGTYS

SEQ ID NO: 2748507 - protein, 16 aa, Entamoeba invadens
CPAGTYSNDKSSTCTN

SEQ ID NO: 2748508 - protein, 17 aa, Entamoeba invadens
CPAGTYSNNKSSSCSNC

SEQ ID NO: 2748509 - protein, 27 aa, Entamoeba invadens
CPAGTYSSNGSSACSSCKDGEYSLSGS

SEQ ID NO: 2748510 - protein, 29 aa, Entamoeba invadens
CPAGTYSSTGSSTCSSCKDGEYSLSGSSA

SEQ ID NO: 2748511 - protein, 17 aa, Entamoeba invadens
CPAGYYSNSGSSGCTRC

SEQ ID NO: 2748512 - protein, 13 aa, Entamoeba invadens
CPASSNSEHCSGD

SEQ ID NO: 2748513 - protein, 4 aa, Entamoeba invadens
CPCK

SEQ ID NO: 2748514 - protein, 10 aa, Entamoeba invadens
CPDNKVTSKC

SEQ ID NO: 2748515 - protein, 11 aa, Entamoeba invadens
CPDQDFTNASP

SEQ ID NO: 2748516 - protein, 11 aa, Entamoeba invadens
CPEDKTGQWCE

SEQ ID NO: 2748517 - protein, 6 aa, Entamoeba invadens
CPEGCE

SEQ ID NO: 2748518 - protein, 13 aa, Entamoeba invadens
CPEGTYKNTTTSC

SEQ ID NO: 2748519 - protein, 5 aa, Entamoeba invadens
CPEGY

SEQ ID NO: 2748520 - protein, 13 aa, Entamoeba invadens
CPEGYNTDKTNKK

SEQ ID NO: 2748521 - protein, 5 aa, Entamoeba invadens
CPEND

SEQ ID NO: 2748522 - protein, 9 aa, Entamoeba invadens
CPENTPKIV

SEQ ID NO: 2748523 - protein, 16 aa, Entamoeba invadens
CPGAPSDVYSKDMKGG

SEQ ID NO: 2748524 - protein, 11 aa, Entamoeba invadens
CPGGAERKCKQ

SEQ ID NO: 2748525 - protein, 21 aa, Entamoeba invadens
CPGGVERKCNNCESGYYPKTV

SEQ ID NO: 2748526 - protein, 7 aa, Entamoeba invadens
CPKDQNG

SEQ ID NO: 2748527 - protein, 16 aa, Entamoeba invadens
CPKELNKEVPDDAVPL

SEQ ID NO: 2748528 - protein, 9 aa, Entamoeba invadens
CPKGTYESD

SEQ ID NO: 2748529 - protein, 4 aa, Entamoeba invadens
CPKM

SEQ ID NO: 2748530 - protein, 7 aa, Entamoeba invadens
CPKSPFN

SEQ ID NO: 2748531 - protein, 8 aa, Entamoeba invadens
CPLASAGS

SEQ ID NO: 2748532 - protein, 4 aa, Entamoeba invadens
CPND

SEQ ID NO: 2748533 - protein, 10 aa, Entamoeba invadens
CPNDPLGSSD

SEQ ID NO: 2748534 - protein, 5 aa, Entamoeba invadens
CPNDR

SEQ ID NO: 2748535 - protein, 9 aa, Entamoeba invadens
CPNEGKEKC

SEQ ID NO: 2748536 - protein, 6 aa, Entamoeba invadens
CPNGCS

SEQ ID NO: 2748537 - protein, 17 aa, Entamoeba invadens
CPNGEYAKGNNKQCTKC

SEQ ID NO: 2748538 - protein, 17 aa, Entamoeba invadens
CPNGQYPNANKQCTACT

SEQ ID NO: 2748539 - protein, 15 aa, Entamoeba invadens
CPNGYQLNSNTKKCD

SEQ ID NO: 2748540 - protein, 5 aa, Entamoeba invadens
CPNTT

SEQ ID NO: 2748541 - protein, 10 aa, Entamoeba invadens
CPPGTTSDEY

SEQ ID NO: 2748542 - protein, 6 aa, Entamoeba invadens
CPPNTY

SEQ ID NO: 2748543 - protein, 7 aa, Entamoeba invadens
CPPNTYL

SEQ ID NO: 2748544 - protein, 4 aa, Entamoeba invadens
CPQG

SEQ ID NO: 2748545 - protein, 5 aa, Entamoeba invadens
CPQGC

SEQ ID NO: 2748546 - protein, 7 aa, Entamoeba invadens
CPRDNGG

SEQ ID NO: 2748547 - protein, 8 aa, Entamoeba invadens
CPRQSGGV

SEQ ID NO: 2748548 - protein, 8 aa, Entamoeba invadens
CPSGQKEV

SEQ ID NO: 2748549 - protein, 5 aa, Entamoeba invadens
CPSGY

SEQ ID NO: 2748550 - protein, 18 aa, Entamoeba invadens
CPSKYSSNGVSDSCTQNC

SEQ ID NO: 2748551 - protein, 8 aa, Entamoeba invadens
CPSPTQEQ

SEQ ID NO: 2748552 - protein, 7 aa, Entamoeba invadens
CPSSEES

SEQ ID NO: 2748553 - protein, 7 aa, Entamoeba invadens
CPSSPLQ

SEQ ID NO: 2748554 - protein, 5 aa, Entamoeba invadens
CPSTI

SEQ ID NO: 2748555 - protein, 8 aa, Entamoeba invadens
CPSTNESY

SEQ ID NO: 2748556 - protein, 16 aa, Entamoeba invadens
CPTGYYNTTTKKCEPC

SEQ ID NO: 2748557 - protein, 10 aa, Entamoeba invadens
CPTLPEITGE

SEQ ID NO: 2748558 - protein, 20 aa, Entamoeba invadens
CPTLSDDTKCQSTEEHPDYG

SEQ ID NO: 2748559 - protein, 6 aa, Entamoeba invadens
CPTSNN

SEQ ID NO: 2748560 - protein, 5 aa, Entamoeba invadens
CPYGK

SEQ ID NO: 2748561 - protein, 7 aa, Entamoeba invadens
CPYPSYE

SEQ ID NO: 2748562 - protein, 8 aa, Entamoeba invadens
CPYTSSEA

SEQ ID NO: 2748563 - protein, 12 aa, Entamoeba invadens
CQADAKPSSDGY

SEQ ID NO: 2748564 - protein, 7 aa, Entamoeba invadens
CQATNGE

SEQ ID NO: 2748565 - protein, 7 aa, Entamoeba invadens
CQDASKR

SEQ ID NO: 2748566 - protein, 4 aa, Entamoeba invadens
CQDG

SEQ ID NO: 2748567 - protein, 10 aa, Entamoeba invadens
CQDGCSASGF

SEQ ID NO: 2748568 - protein, 6 aa, Entamoeba invadens
CQDITN

SEQ ID NO: 2748569 - protein, 17 aa, Entamoeba invadens
CQDNTGTTVKLTPTEDV

SEQ ID NO: 2748570 - protein, 9 aa, Entamoeba invadens
CQDPKDGSF

SEQ ID NO: 2748571 - protein, 5 aa, Entamoeba invadens
CQECN

SEQ ID NO: 2748572 - protein, 6 aa, Entamoeba invadens
CQECNN

SEQ ID NO: 2748573 - protein, 5 aa, Entamoeba invadens
CQEGY

SEQ ID NO: 2748574 - protein, 5 aa, Entamoeba invadens
CQERS

SEQ ID NO: 2748575 - protein, 11 aa, Entamoeba invadens
CQESGKNKCDV

SEQ ID NO: 2748576 - protein, 4 aa, Entamoeba invadens
CQFQ

SEQ ID NO: 2748577 - protein, 5 aa, Entamoeba invadens
CQGCQ

SEQ ID NO: 2748578 - protein, 6 aa, Entamoeba invadens
CQHGDG

SEQ ID NO: 2748579 - protein, 6 aa, Entamoeba invadens
CQHSRE

SEQ ID NO: 2748580 - protein, 11 aa, Entamoeba invadens
CQKCKNESEYY

SEQ ID NO: 2748581 - protein, 4 aa, Entamoeba invadens
CQKY

SEQ ID NO: 2748582 - protein, 16 aa, Entamoeba invadens
CQLADESGTELATDKE

SEQ ID NO: 2748583 - protein, 8 aa, Entamoeba invadens
CQLQSTGN

SEQ ID NO: 2748584 - protein, 6 aa, Entamoeba invadens
CQNCSS

SEQ ID NO: 2748585 - protein, 6 aa, Entamoeba invadens
CQNGGN

SEQ ID NO: 2748586 - protein, 5 aa, Entamoeba invadens
CQNKT

SEQ ID NO: 2748587 - protein, 18 aa, Entamoeba invadens
CQPEPYEGQGRDPANKCE

SEQ ID NO: 2748588 - protein, 19 aa, Entamoeba invadens
CQPEQYEGQGRDPTKQCEC

SEQ ID NO: 2748589 - protein, 4 aa, Entamoeba invadens
CQPF

SEQ ID NO: 2748590 - protein, 6 aa, Entamoeba invadens
CQPKDC

SEQ ID NO: 2748591 - protein, 4 aa, Entamoeba invadens
CQPN

SEQ ID NO: 2748592 - protein, 9 aa, Entamoeba invadens
CQPNTTNTN

SEQ ID NO: 2748593 - protein, 5 aa, Entamoeba invadens
CQPYT

SEQ ID NO: 2748594 - protein, 4 aa, Entamoeba invadens
CQQC

SEQ ID NO: 2748595 - protein, 5 aa, Entamoeba invadens
CQQCN

SEQ ID NO: 2748596 - protein, 17 aa, Entamoeba invadens
CQQCPEGEVKNDEKTCI

SEQ ID NO: 2748597 - protein, 11 aa, Entamoeba invadens
CQQDDTPAADG

SEQ ID NO: 2748598 - protein, 4 aa, Entamoeba invadens
CQRC

SEQ ID NO: 2748599 - protein, 6 aa, Entamoeba invadens
CQRKPK

SEQ ID NO: 2748600 - protein, 12 aa, Entamoeba invadens
CQSCESTTGFDE

SEQ ID NO: 2748601 - protein, 5 aa, Entamoeba invadens
CQSCN

SEQ ID NO: 2748602 - protein, 8 aa, Entamoeba invadens
CQSCSNKY

SEQ ID NO: 2748603 - protein, 8 aa, Entamoeba invadens
CQSCSTKY

SEQ ID NO: 2748604 - protein, 6 aa, Entamoeba invadens
CQSCTD

SEQ ID NO: 2748605 - protein, 9 aa, Entamoeba invadens
CQSEDQGGN

SEQ ID NO: 2748606 - protein, 8 aa, Entamoeba invadens
CQSKGYGE

SEQ ID NO: 2748607 - protein, 5 aa, Entamoeba invadens
CQSKS

SEQ ID NO: 2748608 - protein, 10 aa, Entamoeba invadens
CQSRNGEIEA

SEQ ID NO: 2748609 - protein, 6 aa, Entamoeba invadens
CQSSGQ

SEQ ID NO: 2748610 - protein, 24 aa, Entamoeba invadens
CQSYPTKEARNSNGSGGSLVSKYT

SEQ ID NO: 2748611 - protein, 6 aa, Entamoeba invadens
CQTCDE

SEQ ID NO: 2748612 - protein, 10 aa, Entamoeba invadens
CQTCDKTNGN

SEQ ID NO: 2748613 - protein, 11 aa, Entamoeba invadens
CQTCNTDGSCN

SEQ ID NO: 2748614 - protein, 12 aa, Entamoeba invadens
CQTCSKDENGCL

SEQ ID NO: 2748615 - protein, 6 aa, Entamoeba invadens
CQTCSN

SEQ ID NO: 2748616 - protein, 12 aa, Entamoeba invadens
CQTCSSDSSRRC

SEQ ID NO: 2748617 - protein, 10 aa, Entamoeba invadens
CQTCTSPNDY

SEQ ID NO: 2748618 - protein, 8 aa, Entamoeba invadens
CQTGSPSF

SEQ ID NO: 2748619 - protein, 5 aa, Entamoeba invadens
CQTKG

SEQ ID NO: 2748620 - protein, 17 aa, Entamoeba invadens
CQTNTCNTSTGKCDKCA

SEQ ID NO: 2748621 - protein, 15 aa, Entamoeba invadens
CQTTSEYCNSSSGYC

SEQ ID NO: 2748622 - protein, 13 aa, Entamoeba invadens
CQTVGNAEQCTNC

SEQ ID NO: 2748623 - protein, 8 aa, Entamoeba invadens
CQTVPNSS

SEQ ID NO: 2748624 - protein, 7 aa, Entamoeba invadens
CQTYSDT

SEQ ID NO: 2748625 - protein, 6 aa, Entamoeba invadens
CQYSDG

SEQ ID NO: 2748626 - protein, 5 aa, Entamoeba invadens
CQYSE

SEQ ID NO: 2748627 - protein, 9 aa, Entamoeba invadens
CQYSPTSEK

SEQ ID NO: 2748628 - protein, 4 aa, Entamoeba invadens
CQYT

SEQ ID NO: 2748629 - protein, 6 aa, Entamoeba invadens
CRDTTC

SEQ ID NO: 2748630 - protein, 13 aa, Entamoeba invadens
CRECSDATTCTEC

SEQ ID NO: 2748631 - protein, 6 aa, Entamoeba invadens
CREKSG

SEQ ID NO: 2748632 - protein, 4 aa, Entamoeba invadens
CREP

SEQ ID NO: 2748633 - protein, 5 aa, Entamoeba invadens
CRGNI

SEQ ID NO: 2748634 - protein, 8 aa, Entamoeba invadens
CRKCSTNC

SEQ ID NO: 2748635 - protein, 5 aa, Entamoeba invadens
CRKDV

SEQ ID NO: 2748636 - protein, 15 aa, Entamoeba invadens
CRKNVDDGHRTAPVV

SEQ ID NO: 2748637 - protein, 8 aa, Entamoeba invadens
CRNKPNNF

SEQ ID NO: 2748638 - protein, 6 aa, Entamoeba invadens
CRPAPE

SEQ ID NO: 2748639 - protein, 8 aa, Entamoeba invadens
CRQCSENR

SEQ ID NO: 2748640 - protein, 7 aa, Entamoeba invadens
CRSCTNE

SEQ ID NO: 2748641 - protein, 6 aa, Entamoeba invadens
CRSENE

SEQ ID NO: 2748642 - protein, 11 aa, Entamoeba invadens
CRSENSNEKYY

SEQ ID NO: 2748643 - protein, 15 aa, Entamoeba invadens
CRSFTNGSYRPTLEP

SEQ ID NO: 2748644 - protein, 12 aa, Entamoeba invadens
CRTCNGKKQNSC

SEQ ID NO: 2748645 - protein, 8 aa, Entamoeba invadens
CRTEGQNN

SEQ ID NO: 2748646 - protein, 7 aa, Entamoeba invadens
CRTEGTT

SEQ ID NO: 2748647 - protein, 5 aa, Entamoeba invadens
CRTGN

SEQ ID NO: 2748648 - protein, 4 aa, Entamoeba invadens
CRTN

SEQ ID NO: 2748649 - protein, 11 aa, Entamoeba invadens
CRTSGDSTHRS

SEQ ID NO: 2748650 - protein, 6 aa, Entamoeba invadens
CRTYST

SEQ ID NO: 2748651 - protein, 4 aa, Entamoeba invadens
CSAC

SEQ ID NO: 2748652 - protein, 5 aa, Entamoeba invadens
CSACS

SEQ ID NO: 2748653 - protein, 9 aa, Entamoeba invadens
CSADKYKTL

SEQ ID NO: 2748654 - protein, 30 aa, Entamoeba invadens
CSAGSYSSFGSSSCSKCSSGTYSGSGSSSC

SEQ ID NO: 2748655 - protein, 11 aa, Entamoeba invadens
CSAGTYQSGGR

SEQ ID NO: 2748656 - protein, 14 aa, Entamoeba invadens
CSAGTYSYLGSSKC

SEQ ID NO: 2748657 - protein, 11 aa, Entamoeba invadens
CSANKANKYVK

SEQ ID NO: 2748658 - protein, 6 aa, Entamoeba invadens
CSANQC

SEQ ID NO: 2748659 - protein, 8 aa, Entamoeba invadens
CSASSNNF

SEQ ID NO: 2748660 - protein, 6 aa, Entamoeba invadens
CSATSE

SEQ ID NO: 2748661 - protein, 6 aa, Entamoeba invadens
CSAVTN

SEQ ID NO: 2748662 - protein, 8 aa, Entamoeba invadens
CSDATTCT

SEQ ID NO: 2748663 - protein, 9 aa, Entamoeba invadens
CSDDSSRKC

SEQ ID NO: 2748664 - protein, 10 aa, Entamoeba invadens
CSDEREEVAE

SEQ ID NO: 2748665 - protein, 6 aa, Entamoeba invadens
CSDFTP

SEQ ID NO: 2748666 - protein, 13 aa, Entamoeba invadens
CSDGGKTTDGRCA

SEQ ID NO: 2748667 - protein, 9 aa, Entamoeba invadens
CSDGKAHPV

SEQ ID NO: 2748668 - protein, 15 aa, Entamoeba invadens
CSDGYTPSPNRKECT

SEQ ID NO: 2748669 - protein, 5 aa, Entamoeba invadens
CSDKH

SEQ ID NO: 2748670 - protein, 8 aa, Entamoeba invadens
CSDKSDFI

SEQ ID NO: 2748671 - protein, 18 aa, Entamoeba invadens
CSDKTYTYKSSTSTPVST

SEQ ID NO: 2748672 - protein, 7 aa, Entamoeba invadens
CSDNNTC

SEQ ID NO: 2748673 - protein, 23 aa, Entamoeba invadens
CSDSQSQTQNEDSESSAPEPTVQ

SEQ ID NO: 2748674 - protein, 9 aa, Entamoeba invadens
CSECENNYT

SEQ ID NO: 2748675 - protein, 9 aa, Entamoeba invadens
CSECESNEG

SEQ ID NO: 2748676 - protein, 5 aa, Entamoeba invadens
CSECN

SEQ ID NO: 2748677 - protein, 6 aa, Entamoeba invadens
CSECPS

SEQ ID NO: 2748678 - protein, 9 aa, Entamoeba invadens
CSECSDSKK

SEQ ID NO: 2748679 - protein, 13 aa, Entamoeba invadens
CSECSPSSNACTE

SEQ ID NO: 2748680 - protein, 22 aa, Entamoeba invadens
CSEDKCSECEDGYSLDSGEVSC

SEQ ID NO: 2748681 - protein, 7 aa, Entamoeba invadens
CSEDNNF

SEQ ID NO: 2748682 - protein, 8 aa, Entamoeba invadens
CSEDTDEC

SEQ ID NO: 2748683 - protein, 7 aa, Entamoeba invadens
CSEGGIN

SEQ ID NO: 2748684 - protein, 12 aa, Entamoeba invadens
CSEGGKTADGRC

SEQ ID NO: 2748685 - protein, 12 aa, Entamoeba invadens
CSEGKKIGKTKR

SEQ ID NO: 2748686 - protein, 6 aa, Entamoeba invadens
CSEGYY

SEQ ID NO: 2748687 - protein, 7 aa, Entamoeba invadens
CSEGYYS

SEQ ID NO: 2748688 - protein, 10 aa, Entamoeba invadens
CSEGYYTSST

SEQ ID NO: 2748689 - protein, 6 aa, Entamoeba invadens
CSEKRI

SEQ ID NO: 2748690 - protein, 9 aa, Entamoeba invadens
CSELNQSDY

SEQ ID NO: 2748691 - protein, 10 aa, Entamoeba invadens
CSELNQSDYV

SEQ ID NO: 2748692 - protein, 4 aa, Entamoeba invadens
CSEN

SEQ ID NO: 2748693 - protein, 5 aa, Entamoeba invadens
CSENC

SEQ ID NO: 2748694 - protein, 11 aa, Entamoeba invadens
CSENEGGGNCS

SEQ ID NO: 2748695 - protein, 5 aa, Entamoeba invadens
CSENS

SEQ ID NO: 2748696 - protein, 10 aa, Entamoeba invadens
CSEPTRCTSC

SEQ ID NO: 2748697 - protein, 7 aa, Entamoeba invadens
CSEQYQC

SEQ ID NO: 2748698 - protein, 4 aa, Entamoeba invadens
CSES

SEQ ID NO: 2748699 - protein, 9 aa, Entamoeba invadens
CSESGTNSC

SEQ ID NO: 2748700 - protein, 24 aa, Entamoeba invadens
CSESTATNYLDENDDFENCGTKSR

SEQ ID NO: 2748701 - protein, 8 aa, Entamoeba invadens
CSETTESE

SEQ ID NO: 2748702 - protein, 11 aa, Entamoeba invadens
CSETTNNCSYK

SEQ ID NO: 2748703 - protein, 6 aa, Entamoeba invadens
CSETYS

SEQ ID NO: 2748704 - protein, 7 aa, Entamoeba invadens
CSEVENK

SEQ ID NO: 2748705 - protein, 9 aa, Entamoeba invadens
CSEVENKDT

SEQ ID NO: 2748706 - protein, 10 aa, Entamoeba invadens
CSFTATDRKV

SEQ ID NO: 2748707 - protein, 4 aa, Entamoeba invadens
CSGC

SEQ ID NO: 2748708 - protein, 8 aa, Entamoeba invadens
CSGCTSSS

SEQ ID NO: 2748709 - protein, 4 aa, Entamoeba invadens
CSGD

SEQ ID NO: 2748710 - protein, 9 aa, Entamoeba invadens
CSGKCDSTG

SEQ ID NO: 2748711 - protein, 12 aa, Entamoeba invadens
CSGNPSAANVGA

SEQ ID NO: 2748712 - protein, 8 aa, Entamoeba invadens
CSGPNQYA

SEQ ID NO: 2748713 - protein, 9 aa, Entamoeba invadens
CSGRIEKDD

SEQ ID NO: 2748714 - protein, 28 aa, Entamoeba invadens
CSGTNKLSANKTKCTTSCAAGEYDSGNN

SEQ ID NO: 2748715 - protein, 16 aa, Entamoeba invadens
CSGTSSSCTSCKPNSS

SEQ ID NO: 2748716 - protein, 21 aa, Entamoeba invadens
CSHGGSAGWQAPEAIRGERLT

SEQ ID NO: 2748717 - protein, 9 aa, Entamoeba invadens
CSIEAGDVD

SEQ ID NO: 2748718 - protein, 7 aa, Entamoeba invadens
CSIGTTT

SEQ ID NO: 2748719 - protein, 14 aa, Entamoeba invadens
CSIPNDQNGRCSSP

SEQ ID NO: 2748720 - protein, 10 aa, Entamoeba invadens
CSISNKNKNC

SEQ ID NO: 2748721 - protein, 6 aa, Entamoeba invadens
CSITGT

SEQ ID NO: 2748722 - protein, 4 aa, Entamoeba invadens
CSKC

SEQ ID NO: 2748723 - protein, 11 aa, Entamoeba invadens
CSKCADNSTRI

SEQ ID NO: 2748724 - protein, 15 aa, Entamoeba invadens
CSKCETGTIKSTTKE

SEQ ID NO: 2748725 - protein, 7 aa, Entamoeba invadens
CSKCQTT

SEQ ID NO: 2748726 - protein, 21 aa, Entamoeba invadens
CSKCSKGKQLSDDRKSCEDMP

SEQ ID NO: 2748727 - protein, 7 aa, Entamoeba invadens
CSKCTGD

SEQ ID NO: 2748728 - protein, 8 aa, Entamoeba invadens
CSKCTTST

SEQ ID NO: 2748729 - protein, 10 aa, Entamoeba invadens
CSKDELDDHN

SEQ ID NO: 2748730 - protein, 14 aa, Entamoeba invadens
CSKDGEMKNGVNGY

SEQ ID NO: 2748731 - protein, 7 aa, Entamoeba invadens
CSKDTNY

SEQ ID NO: 2748732 - protein, 11 aa, Entamoeba invadens
CSKEKDQVDGM

SEQ ID NO: 2748733 - protein, 13 aa, Entamoeba invadens
CSKGTYSSSRSAY

SEQ ID NO: 2748734 - protein, 8 aa, Entamoeba invadens
CSKKKSSS

SEQ ID NO: 2748735 - protein, 4 aa, Entamoeba invadens
CSKM

SEQ ID NO: 2748736 - protein, 6 aa, Entamoeba invadens
CSKNEI

SEQ ID NO: 2748737 - protein, 11 aa, Entamoeba invadens
CSKNGNKYNGI

SEQ ID NO: 2748738 - protein, 6 aa, Entamoeba invadens
CSKNTH

SEQ ID NO: 2748739 - protein, 11 aa, Entamoeba invadens
CSKPEKRGRNS

SEQ ID NO: 2748740 - protein, 11 aa, Entamoeba invadens
CSKRNKENKAK

SEQ ID NO: 2748741 - protein, 4 aa, Entamoeba invadens
CSKS

SEQ ID NO: 2748742 - protein, 8 aa, Entamoeba invadens
CSKSGEDC

SEQ ID NO: 2748743 - protein, 8 aa, Entamoeba invadens
CSKTKKTC

SEQ ID NO: 2748744 - protein, 10 aa, Entamoeba invadens
CSKTTGECTS

SEQ ID NO: 2748745 - protein, 7 aa, Entamoeba invadens
CSKYTNT

SEQ ID NO: 2748746 - protein, 5 aa, Entamoeba invadens
CSLDT

SEQ ID NO: 2748747 - protein, 5 aa, Entamoeba invadens
CSLNE

SEQ ID NO: 2748748 - protein, 11 aa, Entamoeba invadens
CSLSGTAEAPI

SEQ ID NO: 2748749 - protein, 4 aa, Entamoeba invadens
CSNA

SEQ ID NO: 2748750 - protein, 6 aa, Entamoeba invadens
CSNAAS

SEQ ID NO: 2748751 - protein, 11 aa, Entamoeba invadens
CSNANTCSGCT

SEQ ID NO: 2748752 - protein, 17 aa, Entamoeba invadens
CSNCGDGYYSNSGDKTC

SEQ ID NO: 2748753 - protein, 10 aa, Entamoeba invadens
CSNDSSRVCT

SEQ ID NO: 2748754 - protein, 4 aa, Entamoeba invadens
CSNE

SEQ ID NO: 2748755 - protein, 7 aa, Entamoeba invadens
CSNECSN

SEQ ID NO: 2748756 - protein, 15 aa, Entamoeba invadens
CSNERYDDTKDETRA

SEQ ID NO: 2748757 - protein, 7 aa, Entamoeba invadens
CSNGGEI

SEQ ID NO: 2748758 - protein, 12 aa, Entamoeba invadens
CSNGGKTTDGRC

SEQ ID NO: 2748759 - protein, 14 aa, Entamoeba invadens
CSNGQSSNEGSSSC

SEQ ID NO: 2748760 - protein, 6 aa, Entamoeba invadens
CSNHRR

SEQ ID NO: 2748761 - protein, 6 aa, Entamoeba invadens
CSNKNP

SEQ ID NO: 2748762 - protein, 9 aa, Entamoeba invadens
CSNNNTCST

SEQ ID NO: 2748763 - protein, 10 aa, Entamoeba invadens
CSNNNTCSTC

SEQ ID NO: 2748764 - protein, 7 aa, Entamoeba invadens
CSNNSSV

SEQ ID NO: 2748765 - protein, 5 aa, Entamoeba invadens
CSNQY

SEQ ID NO: 2748766 - protein, 8 aa, Entamoeba invadens
CSNSTEEC

SEQ ID NO: 2748767 - protein, 10 aa, Entamoeba invadens
CSNSTSVGCT

SEQ ID NO: 2748768 - protein, 9 aa, Entamoeba invadens
CSNTITSTG

SEQ ID NO: 2748769 - protein, 8 aa, Entamoeba invadens
CSNTQERI

SEQ ID NO: 2748770 - protein, 9 aa, Entamoeba invadens
CSNTTHCET

SEQ ID NO: 2748771 - protein, 6 aa, Entamoeba invadens
CSNTTV

SEQ ID NO: 2748772 - protein, 6 aa, Entamoeba invadens
CSPCDS

SEQ ID NO: 2748773 - protein, 4 aa, Entamoeba invadens
CSPD

SEQ ID NO: 2748774 - protein, 5 aa, Entamoeba invadens
CSPDF

SEQ ID NO: 2748775 - protein, 7 aa, Entamoeba invadens
CSPEDKK

SEQ ID NO: 2748776 - protein, 5 aa, Entamoeba invadens
CSPEN

SEQ ID NO: 2748777 - protein, 14 aa, Entamoeba invadens
CSPGCQNNCTSDYT

SEQ ID NO: 2748778 - protein, 29 aa, Entamoeba invadens
CSPGQEVSKDLSSCEKECSNGCKSCSNDE

SEQ ID NO: 2748779 - protein, 11 aa, Entamoeba invadens
CSPGTYSSKGA

SEQ ID NO: 2748780 - protein, 8 aa, Entamoeba invadens
CSPGYGGD

SEQ ID NO: 2748781 - protein, 4 aa, Entamoeba invadens
CSPI

SEQ ID NO: 2748782 - protein, 9 aa, Entamoeba invadens
CSPKSNDCL

SEQ ID NO: 2748783 - protein, 6 aa, Entamoeba invadens
CSPKSS

SEQ ID NO: 2748784 - protein, 8 aa, Entamoeba invadens
CSPKTNDC

SEQ ID NO: 2748785 - protein, 15 aa, Entamoeba invadens
CSPNCASCDSKTGKC

SEQ ID NO: 2748786 - protein, 6 aa, Entamoeba invadens
CSPPTV

SEQ ID NO: 2748787 - protein, 7 aa, Entamoeba invadens
CSPQDEL

SEQ ID NO: 2748788 - protein, 7 aa, Entamoeba invadens
CSPQDKK

SEQ ID NO: 2748789 - protein, 8 aa, Entamoeba invadens
CSPQDKKR

SEQ ID NO: 2748790 - protein, 8 aa, Entamoeba invadens
CSPQDKQR

SEQ ID NO: 2748791 - protein, 5 aa, Entamoeba invadens
CSPQN

SEQ ID NO: 2748792 - protein, 7 aa, Entamoeba invadens
CSPQQKT

SEQ ID NO: 2748793 - protein, 11 aa, Entamoeba invadens
CSPQSELTSCA

SEQ ID NO: 2748794 - protein, 17 aa, Entamoeba invadens
CSPQSELTSCANRTTTG

SEQ ID NO: 2748795 - protein, 8 aa, Entamoeba invadens
CSPQTTPY

SEQ ID NO: 2748796 - protein, 9 aa, Entamoeba invadens
CSPSIRRDI

SEQ ID NO: 2748797 - protein, 8 aa, Entamoeba invadens
CSPTNPNT

SEQ ID NO: 2748798 - protein, 6 aa, Entamoeba invadens
CSPTQK

SEQ ID NO: 2748799 - protein, 20 aa, Entamoeba invadens
CSPTTNNSKYITKSQDNQMT

SEQ ID NO: 2748800 - protein, 5 aa, Entamoeba invadens
CSPTY

SEQ ID NO: 2748801 - protein, 4 aa, Entamoeba invadens
CSPV

SEQ ID NO: 2748802 - protein, 5 aa, Entamoeba invadens
CSPYS

SEQ ID NO: 2748803 - protein, 5 aa, Entamoeba invadens
CSQAN

SEQ ID NO: 2748804 - protein, 15 aa, Entamoeba invadens
CSQCDQTTGRCTTCD

SEQ ID NO: 2748805 - protein, 6 aa, Entamoeba invadens
CSQCPS

SEQ ID NO: 2748806 - protein, 4 aa, Entamoeba invadens
CSQD

SEQ ID NO: 2748807 - protein, 6 aa, Entamoeba invadens
CSQIDN

SEQ ID NO: 2748808 - protein, 5 aa, Entamoeba invadens
CSQIK

SEQ ID NO: 2748809 - protein, 4 aa, Entamoeba invadens
CSQM

SEQ ID NO: 2748810 - protein, 5 aa, Entamoeba invadens
CSQNS

SEQ ID NO: 2748811 - protein, 5 aa, Entamoeba invadens
CSQPQ

SEQ ID NO: 2748812 - protein, 4 aa, Entamoeba invadens
CSQS

SEQ ID NO: 2748813 - protein, 7 aa, Entamoeba invadens
CSQSEDK

SEQ ID NO: 2748814 - protein, 6 aa, Entamoeba invadens
CSQSGR

SEQ ID NO: 2748815 - protein, 6 aa, Entamoeba invadens
CSQSTQ

SEQ ID NO: 2748816 - protein, 4 aa, Entamoeba invadens
CSQT

SEQ ID NO: 2748817 - protein, 6 aa, Entamoeba invadens
CSQTEE

SEQ ID NO: 2748818 - protein, 12 aa, Entamoeba invadens
CSQTEKKCQQCK

SEQ ID NO: 2748819 - protein, 8 aa, Entamoeba invadens
CSQTEPQK

SEQ ID NO: 2748820 - protein, 8 aa, Entamoeba invadens
CSQTKSDC

SEQ ID NO: 2748821 - protein, 5 aa, Entamoeba invadens
CSQTL

SEQ ID NO: 2748822 - protein, 7 aa, Entamoeba invadens
CSQTNGS

SEQ ID NO: 2748823 - protein, 7 aa, Entamoeba invadens
CSQTTKT

SEQ ID NO: 2748824 - protein, 13 aa, Entamoeba invadens
CSRADPKDRPSFD

SEQ ID NO: 2748825 - protein, 4 aa, Entamoeba invadens
CSRC

SEQ ID NO: 2748826 - protein, 6 aa, Entamoeba invadens
CSRCSA

SEQ ID NO: 2748827 - protein, 7 aa, Entamoeba invadens
CSRCSSS

SEQ ID NO: 2748828 - protein, 10 aa, Entamoeba invadens
CSRNTDPTQC

SEQ ID NO: 2748829 - protein, 7 aa, Entamoeba invadens
CSRSDVT

SEQ ID NO: 2748830 - protein, 12 aa, Entamoeba invadens
CSRSSNKETDVK

SEQ ID NO: 2748831 - protein, 4 aa, Entamoeba invadens
CSRT

SEQ ID NO: 2748832 - protein, 6 aa, Entamoeba invadens
CSRTER

SEQ ID NO: 2748833 - protein, 10 aa, Entamoeba invadens
CSRTTSECTS

SEQ ID NO: 2748834 - protein, 7 aa, Entamoeba invadens
CSSATTC

SEQ ID NO: 2748835 - protein, 9 aa, Entamoeba invadens
CSSCDQKGC

SEQ ID NO: 2748836 - protein, 7 aa, Entamoeba invadens
CSSCDSN

SEQ ID NO: 2748837 - protein, 13 aa, Entamoeba invadens
CSSCEEGYYPNDN

SEQ ID NO: 2748838 - protein, 5 aa, Entamoeba invadens
CSSCK

SEQ ID NO: 2748839 - protein, 8 aa, Entamoeba invadens
CSSCNPTT

SEQ ID NO: 2748840 - protein, 11 aa, Entamoeba invadens
CSSCSKNAGSC

SEQ ID NO: 2748841 - protein, 4 aa, Entamoeba invadens
CSSD

SEQ ID NO: 2748842 - protein, 12 aa, Entamoeba invadens
CSSDENCSSYSN

SEQ ID NO: 2748843 - protein, 6 aa, Entamoeba invadens
CSSDKE

SEQ ID NO: 2748844 - protein, 10 aa, Entamoeba invadens
CSSDKQRSCT

SEQ ID NO: 2748845 - protein, 10 aa, Entamoeba invadens
CSSDNNFEPK

SEQ ID NO: 2748846 - protein, 9 aa, Entamoeba invadens
CSSDSSRRC

SEQ ID NO: 2748847 - protein, 7 aa, Entamoeba invadens
CSSEKCS

SEQ ID NO: 2748848 - protein, 9 aa, Entamoeba invadens
CSSEKQRSC

SEQ ID NO: 2748849 - protein, 6 aa, Entamoeba invadens
CSSEST

SEQ ID NO: 2748850 - protein, 4 aa, Entamoeba invadens
CSSF

SEQ ID NO: 2748851 - protein, 14 aa, Entamoeba invadens
CSSGDMKKECNNCG

SEQ ID NO: 2748852 - protein, 15 aa, Entamoeba invadens
CSSGDMKKECNNCGD

SEQ ID NO: 2748853 - protein, 29 aa, Entamoeba invadens
CSSGKYPSSSGTCQECDKSCGGQCNGTTG

SEQ ID NO: 2748854 - protein, 6 aa, Entamoeba invadens
CSSGSI

SEQ ID NO: 2748855 - protein, 31 aa, Entamoeba invadens
CSSGTYKSNSGNSSCTPCAEGKYSQNEGSIT

SEQ ID NO: 2748856 - protein, 7 aa, Entamoeba invadens
CSSKPNC

SEQ ID NO: 2748857 - protein, 10 aa, Entamoeba invadens
CSSKPTETAC

SEQ ID NO: 2748858 - protein, 7 aa, Entamoeba invadens
CSSKYEG

SEQ ID NO: 2748859 - protein, 8 aa, Entamoeba invadens
CSSNGERK

SEQ ID NO: 2748860 - protein, 8 aa, Entamoeba invadens
CSSNKNVC

SEQ ID NO: 2748861 - protein, 6 aa, Entamoeba invadens
CSSNSN

SEQ ID NO: 2748862 - protein, 5 aa, Entamoeba invadens
CSSNT

SEQ ID NO: 2748863 - protein, 4 aa, Entamoeba invadens
CSSP

SEQ ID NO: 2748864 - protein, 11 aa, Entamoeba invadens
CSSPRLEQEEP

SEQ ID NO: 2748865 - protein, 4 aa, Entamoeba invadens
CSSQ

SEQ ID NO: 2748866 - protein, 15 aa, Entamoeba invadens
CSSQIKDTTMSKEEI

SEQ ID NO: 2748867 - protein, 5 aa, Entamoeba invadens
CSSQT

SEQ ID NO: 2748868 - protein, 4 aa, Entamoeba invadens
CSSR

SEQ ID NO: 2748869 - protein, 7 aa, Entamoeba invadens
CSSSAGN

SEQ ID NO: 2748870 - protein, 8 aa, Entamoeba invadens
CSSSGGGE

SEQ ID NO: 2748871 - protein, 7 aa, Entamoeba invadens
CSSSGQC

SEQ ID NO: 2748872 - protein, 7 aa, Entamoeba invadens
CSSSIQN

SEQ ID NO: 2748873 - protein, 9 aa, Entamoeba invadens
CSSSSLRNC

SEQ ID NO: 2748874 - protein, 8 aa, Entamoeba invadens
CSSSSLST

SEQ ID NO: 2748875 - protein, 5 aa, Entamoeba invadens
CSSST

SEQ ID NO: 2748876 - protein, 7 aa, Entamoeba invadens
CSSSTQI

SEQ ID NO: 2748877 - protein, 7 aa, Entamoeba invadens
CSSSTSC

SEQ ID NO: 2748878 - protein, 13 aa, Entamoeba invadens
CSSTCESNGCNTY

SEQ ID NO: 2748879 - protein, 17 aa, Entamoeba invadens
CSSTGNCNSCTNETSDG

SEQ ID NO: 2748880 - protein, 9 aa, Entamoeba invadens
CSSTSNKCT

SEQ ID NO: 2748881 - protein, 7 aa, Entamoeba invadens
CSSTSPT

SEQ ID NO: 2748882 - protein, 11 aa, Entamoeba invadens
CSSTTGQCTSC

SEQ ID NO: 2748883 - protein, 8 aa, Entamoeba invadens
CSTCANST

SEQ ID NO: 2748884 - protein, 11 aa, Entamoeba invadens
CSTCDSNFGSE

SEQ ID NO: 2748885 - protein, 9 aa, Entamoeba invadens
CSTCETDGC

SEQ ID NO: 2748886 - protein, 7 aa, Entamoeba invadens
CSTCGTD

SEQ ID NO: 2748887 - protein, 5 aa, Entamoeba invadens
CSTCK

SEQ ID NO: 2748888 - protein, 9 aa, Entamoeba invadens
CSTCNNENS

SEQ ID NO: 2748889 - protein, 8 aa, Entamoeba invadens
CSTCNNRD

SEQ ID NO: 2748890 - protein, 7 aa, Entamoeba invadens
CSTCNTA

SEQ ID NO: 2748891 - protein, 5 aa, Entamoeba invadens
CSTCQ

SEQ ID NO: 2748892 - protein, 13 aa, Entamoeba invadens
CSTCSDATTCTGC

SEQ ID NO: 2748893 - protein, 7 aa, Entamoeba invadens
CSTCSTS

SEQ ID NO: 2748894 - protein, 7 aa, Entamoeba invadens
CSTCTDT

SEQ ID NO: 2748895 - protein, 6 aa, Entamoeba invadens
CSTCTN

SEQ ID NO: 2748896 - protein, 21 aa, Entamoeba invadens
CSTCTSSSLTNESDSTDSTRD

SEQ ID NO: 2748897 - protein, 7 aa, Entamoeba invadens
CSTDCDP

SEQ ID NO: 2748898 - protein, 9 aa, Entamoeba invadens
CSTDEGRAY

SEQ ID NO: 2748899 - protein, 9 aa, Entamoeba invadens
CSTDNSRTC

SEQ ID NO: 2748900 - protein, 5 aa, Entamoeba invadens
CSTEI

SEQ ID NO: 2748901 - protein, 6 aa, Entamoeba invadens
CSTEIS

SEQ ID NO: 2748902 - protein, 6 aa, Entamoeba invadens
CSTEKC

SEQ ID NO: 2748903 - protein, 30 aa, Entamoeba invadens
CSTGKYPQASGKCGECESTCGGKCNTTNGY

SEQ ID NO: 2748904 - protein, 17 aa, Entamoeba invadens
CSTGQYYNEESSTCETC

SEQ ID NO: 2748905 - protein, 5 aa, Entamoeba invadens
CSTHI

SEQ ID NO: 2748906 - protein, 5 aa, Entamoeba invadens
CSTKI

SEQ ID NO: 2748907 - protein, 6 aa, Entamoeba invadens
CSTKID

SEQ ID NO: 2748908 - protein, 6 aa, Entamoeba invadens
CSTKTV

SEQ ID NO: 2748909 - protein, 9 aa, Entamoeba invadens
CSTLERADG

SEQ ID NO: 2748910 - protein, 6 aa, Entamoeba invadens
CSTNKD

SEQ ID NO: 2748911 - protein, 5 aa, Entamoeba invadens
CSTNS

SEQ ID NO: 2748912 - protein, 8 aa, Entamoeba invadens
CSTNSWGT

SEQ ID NO: 2748913 - protein, 8 aa, Entamoeba invadens
CSTPGRDF

SEQ ID NO: 2748914 - protein, 4 aa, Entamoeba invadens
CSTQ

SEQ ID NO: 2748915 - protein, 5 aa, Entamoeba invadens
CSTQI

SEQ ID NO: 2748916 - protein, 6 aa, Entamoeba invadens
CSTQID

SEQ ID NO: 2748917 - protein, 5 aa, Entamoeba invadens
CSTQN

SEQ ID NO: 2748918 - protein, 7 aa, Entamoeba invadens
CSTQSET

SEQ ID NO: 2748919 - protein, 4 aa, Entamoeba invadens
CSTR

SEQ ID NO: 2748920 - protein, 12 aa, Entamoeba invadens
CSTRGCTTCNST

SEQ ID NO: 2748921 - protein, 8 aa, Entamoeba invadens
CSTRQEKG

SEQ ID NO: 2748922 - protein, 11 aa, Entamoeba invadens
CSTSDVTTNKT

SEQ ID NO: 2748923 - protein, 6 aa, Entamoeba invadens
CSTSER

SEQ ID NO: 2748924 - protein, 10 aa, Entamoeba invadens
CSTTKKECYS

SEQ ID NO: 2748925 - protein, 10 aa, Entamoeba invadens
CSTTQNATGK

SEQ ID NO: 2748926 - protein, 6 aa, Entamoeba invadens
CSTTSQ

SEQ ID NO: 2748927 - protein, 12 aa, Entamoeba invadens
CSVAPSNLNTRN

SEQ ID NO: 2748928 - protein, 5 aa, Entamoeba invadens
CSVSG

SEQ ID NO: 2748929 - protein, 8 aa, Entamoeba invadens
CSVSGNSC

SEQ ID NO: 2748930 - protein, 17 aa, Entamoeba invadens
CTACTNGCSKCTDAKTC

SEQ ID NO: 2748931 - protein, 6 aa, Entamoeba invadens
CTACTP

SEQ ID NO: 2748932 - protein, 18 aa, Entamoeba invadens
CTADNCDKCTKVGGVEQC

SEQ ID NO: 2748933 - protein, 22 aa, Entamoeba invadens
CTANKSYNTTTKKCESNGNGCA

SEQ ID NO: 2748934 - protein, 11 aa, Entamoeba invadens
CTAQDTSGYCS

SEQ ID NO: 2748935 - protein, 9 aa, Entamoeba invadens
CTATNSMPM

SEQ ID NO: 2748936 - protein, 6 aa, Entamoeba invadens
CTCQRE

SEQ ID NO: 2748937 - protein, 11 aa, Entamoeba invadens
CTCTTSTTQME

SEQ ID NO: 2748938 - protein, 6 aa, Entamoeba invadens
CTDCNP

SEQ ID NO: 2748939 - protein, 4 aa, Entamoeba invadens
CTDE

SEQ ID NO: 2748940 - protein, 5 aa, Entamoeba invadens
CTDEC

SEQ ID NO: 2748941 - protein, 15 aa, Entamoeba invadens
CTDISNEKRLTRNNK

SEQ ID NO: 2748942 - protein, 10 aa, Entamoeba invadens
CTDKTNQLRT

SEQ ID NO: 2748943 - protein, 10 aa, Entamoeba invadens
CTDPPKTKYN

SEQ ID NO: 2748944 - protein, 10 aa, Entamoeba invadens
CTDRCSTTTG

SEQ ID NO: 2748945 - protein, 5 aa, Entamoeba invadens
CTDSQ

SEQ ID NO: 2748946 - protein, 5 aa, Entamoeba invadens
CTDST

SEQ ID NO: 2748947 - protein, 40 aa, Entamoeba invadens
CTDTNTCSRCSDGYYKNGNKCKKCENNCETCSSATKCSKC

SEQ ID NO: 2748948 - protein, 9 aa, Entamoeba invadens
CTDTNYDND

SEQ ID NO: 2748949 - protein, 10 aa, Entamoeba invadens
CTECDSQSGI

SEQ ID NO: 2748950 - protein, 6 aa, Entamoeba invadens
CTECKN

SEQ ID NO: 2748951 - protein, 13 aa, Entamoeba invadens
CTECSGANTCSEC

SEQ ID NO: 2748952 - protein, 13 aa, Entamoeba invadens
CTECSGANTCTEC

SEQ ID NO: 2748953 - protein, 7 aa, Entamoeba invadens
CTECTTY

SEQ ID NO: 2748954 - protein, 7 aa, Entamoeba invadens
CTEDANC

SEQ ID NO: 2748955 - protein, 6 aa, Entamoeba invadens
CTEDSS

SEQ ID NO: 2748956 - protein, 6 aa, Entamoeba invadens
CTEEVA

SEQ ID NO: 2748957 - protein, 11 aa, Entamoeba invadens
CTEGGKTTDGR

SEQ ID NO: 2748958 - protein, 26 aa, Entamoeba invadens
CTEGRSLESVKRRGERGYKNTPYSCG

SEQ ID NO: 2748959 - protein, 5 aa, Entamoeba invadens
CTEGY

SEQ ID NO: 2748960 - protein, 9 aa, Entamoeba invadens
CTEKDPTWS

SEQ ID NO: 2748961 - protein, 16 aa, Entamoeba invadens
CTENCDSCKGSGATEC

SEQ ID NO: 2748962 - protein, 9 aa, Entamoeba invadens
CTENGCADG

SEQ ID NO: 2748963 - protein, 9 aa, Entamoeba invadens
CTENPKTKY

SEQ ID NO: 2748964 - protein, 5 aa, Entamoeba invadens
CTEPI

SEQ ID NO: 2748965 - protein, 9 aa, Entamoeba invadens
CTEPPKTKY

SEQ ID NO: 2748966 - protein, 8 aa, Entamoeba invadens
CTEQSTHL

SEQ ID NO: 2748967 - protein, 10 aa, Entamoeba invadens
CTETDTGNVN

SEQ ID NO: 2748968 - protein, 5 aa, Entamoeba invadens
CTFTT

SEQ ID NO: 2748969 - protein, 12 aa, Entamoeba invadens
CTGDSTRTCKRC

SEQ ID NO: 2748970 - protein, 4 aa, Entamoeba invadens
CTGN

SEQ ID NO: 2748971 - protein, 14 aa, Entamoeba invadens
CTGNECNKCSSGYH

SEQ ID NO: 2748972 - protein, 13 aa, Entamoeba invadens
CTGNNKPTTSGDS

SEQ ID NO: 2748973 - protein, 20 aa, Entamoeba invadens
CTGNTYSNEGASSCRNCDSS

SEQ ID NO: 2748974 - protein, 25 aa, Entamoeba invadens
CTGREEPNDCRENGCKWDDDEMNCS

SEQ ID NO: 2748975 - protein, 11 aa, Entamoeba invadens
CTGSATKCTSC

SEQ ID NO: 2748976 - protein, 9 aa, Entamoeba invadens
CTGSGYGQC

SEQ ID NO: 2748977 - protein, 23 aa, Entamoeba invadens
CTGTNKLSVDKTKCSSTCPSGQT

SEQ ID NO: 2748978 - protein, 7 aa, Entamoeba invadens
CTHDPTN

SEQ ID NO: 2748979 - protein, 4 aa, Entamoeba invadens
CTHQ

SEQ ID NO: 2748980 - protein, 7 aa, Entamoeba invadens
CTIETSG

SEQ ID NO: 2748981 - protein, 27 aa, Entamoeba invadens
CTKCDSKQHISQGKCSQNSANCDNQNG

SEQ ID NO: 2748982 - protein, 5 aa, Entamoeba invadens
CTKCE

SEQ ID NO: 2748983 - protein, 6 aa, Entamoeba invadens
CTKCGN

SEQ ID NO: 2748984 - protein, 27 aa, Entamoeba invadens
CTKCNSKQHISQGKCSQNSANCDNQNG

SEQ ID NO: 2748985 - protein, 20 aa, Entamoeba invadens
CTKCPTNCSACDDANTCTDC

SEQ ID NO: 2748986 - protein, 6 aa, Entamoeba invadens
CTKCSP

SEQ ID NO: 2748987 - protein, 11 aa, Entamoeba invadens
CTKCSSGTTCT

SEQ ID NO: 2748988 - protein, 6 aa, Entamoeba invadens
CTKCST

SEQ ID NO: 2748989 - protein, 10 aa, Entamoeba invadens
CTKCTPGCTE

SEQ ID NO: 2748990 - protein, 17 aa, Entamoeba invadens
CTKCTTGCSKCSDATKC

SEQ ID NO: 2748991 - protein, 5 aa, Entamoeba invadens
CTKDP

SEQ ID NO: 2748992 - protein, 9 aa, Entamoeba invadens
CTKENEKGR

SEQ ID NO: 2748993 - protein, 19 aa, Entamoeba invadens
CTKESSQCSSCTKDNSYSL

SEQ ID NO: 2748994 - protein, 9 aa, Entamoeba invadens
CTKGGLNKI

SEQ ID NO: 2748995 - protein, 8 aa, Entamoeba invadens
CTKLSKQV

SEQ ID NO: 2748996 - protein, 5 aa, Entamoeba invadens
CTKPY

SEQ ID NO: 2748997 - protein, 5 aa, Entamoeba invadens
CTKSG

SEQ ID NO: 2748998 - protein, 6 aa, Entamoeba invadens
CTKSNG

SEQ ID NO: 2748999 - protein, 9 aa, Entamoeba invadens
CTKSSVSSF

SEQ ID NO: 2749000 - protein, 9 aa, Entamoeba invadens
CTKTKDSKC

SEQ ID NO: 2749001 - protein, 4 aa, Entamoeba invadens
CTLS

SEQ ID NO: 2749002 - protein, 6 aa, Entamoeba invadens
CTMNPS

SEQ ID NO: 2749003 - protein, 10 aa, Entamoeba invadens
CTNCDGTTGI

SEQ ID NO: 2749004 - protein, 20 aa, Entamoeba invadens
CTNCSSGTYSNSGDSTCTKC

SEQ ID NO: 2749005 - protein, 6 aa, Entamoeba invadens
CTNDPS

SEQ ID NO: 2749006 - protein, 6 aa, Entamoeba invadens
CTNDSY

SEQ ID NO: 2749007 - protein, 5 aa, Entamoeba invadens
CTNEN

SEQ ID NO: 2749008 - protein, 5 aa, Entamoeba invadens
CTNET

SEQ ID NO: 2749009 - protein, 8 aa, Entamoeba invadens
CTNETGNV

SEQ ID NO: 2749010 - protein, 4 aa, Entamoeba invadens
CTNN

SEQ ID NO: 2749011 - protein, 11 aa, Entamoeba invadens
CTNNQEKGLGT

SEQ ID NO: 2749012 - protein, 5 aa, Entamoeba invadens
CTNSE

SEQ ID NO: 2749013 - protein, 6 aa, Entamoeba invadens
CTNSEC

SEQ ID NO: 2749014 - protein, 9 aa, Entamoeba invadens
CTNTTNCET

SEQ ID NO: 2749015 - protein, 13 aa, Entamoeba invadens
CTNYYQGATSSVC

SEQ ID NO: 2749016 - protein, 4 aa, Entamoeba invadens
CTPC

SEQ ID NO: 2749017 - protein, 5 aa, Entamoeba invadens
CTPCR

SEQ ID NO: 2749018 - protein, 12 aa, Entamoeba invadens
CTPNGNDETNGF

SEQ ID NO: 2749019 - protein, 17 aa, Entamoeba invadens
CTPNGNDETNGFSQTNG

SEQ ID NO: 2749020 - protein, 10 aa, Entamoeba invadens
CTPNGNLETY

SEQ ID NO: 2749021 - protein, 7 aa, Entamoeba invadens
CTPPALN

SEQ ID NO: 2749022 - protein, 7 aa, Entamoeba invadens
CTPQGGN

SEQ ID NO: 2749023 - protein, 14 aa, Entamoeba invadens
CTPQKTVPTKFDTT

SEQ ID NO: 2749024 - protein, 5 aa, Entamoeba invadens
CTPTL

SEQ ID NO: 2749025 - protein, 12 aa, Entamoeba invadens
CTPTTCTSFSGE

SEQ ID NO: 2749026 - protein, 20 aa, Entamoeba invadens
CTQCKDGNAVLNGPASEPTK

SEQ ID NO: 2749027 - protein, 7 aa, Entamoeba invadens
CTQCSNS

SEQ ID NO: 2749028 - protein, 12 aa, Entamoeba invadens
CTQKSTVTCDSS

SEQ ID NO: 2749029 - protein, 6 aa, Entamoeba invadens
CTQNNN

SEQ ID NO: 2749030 - protein, 9 aa, Entamoeba invadens
CTQQDGGFV

SEQ ID NO: 2749031 - protein, 10 aa, Entamoeba invadens
CTQSDSSKCT

SEQ ID NO: 2749032 - protein, 8 aa, Entamoeba invadens
CTQSKDVN

SEQ ID NO: 2749033 - protein, 5 aa, Entamoeba invadens
CTRAS

SEQ ID NO: 2749034 - protein, 4 aa, Entamoeba invadens
CTRC

SEQ ID NO: 2749035 - protein, 5 aa, Entamoeba invadens
CTRCA

SEQ ID NO: 2749036 - protein, 10 aa, Entamoeba invadens
CTRCDSSGNC

SEQ ID NO: 2749037 - protein, 6 aa, Entamoeba invadens
CTRQQN

SEQ ID NO: 2749038 - protein, 8 aa, Entamoeba invadens
CTRSSNSF

SEQ ID NO: 2749039 - protein, 10 aa, Entamoeba invadens
CTRTNDAKGN

SEQ ID NO: 2749040 - protein, 30 aa, Entamoeba invadens
CTSADNSKCTSCEGSNKVSDDGESCVSKTN

SEQ ID NO: 2749041 - protein, 30 aa, Entamoeba invadens
CTSADNSKCTSCEGSNKVTDDGESCVSKTN

SEQ ID NO: 2749042 - protein, 10 aa, Entamoeba invadens
CTSADPSATP

SEQ ID NO: 2749043 - protein, 5 aa, Entamoeba invadens
CTSCE

SEQ ID NO: 2749044 - protein, 6 aa, Entamoeba invadens
CTSCED

SEQ ID NO: 2749045 - protein, 6 aa, Entamoeba invadens
CTSCKS

SEQ ID NO: 2749046 - protein, 7 aa, Entamoeba invadens
CTSCNEN

SEQ ID NO: 2749047 - protein, 6 aa, Entamoeba invadens
CTSCPP

SEQ ID NO: 2749048 - protein, 10 aa, Entamoeba invadens
CTSCTSDNNG

SEQ ID NO: 2749049 - protein, 8 aa, Entamoeba invadens
CTSCTTDS

SEQ ID NO: 2749050 - protein, 4 aa, Entamoeba invadens
CTSD

SEQ ID NO: 2749051 - protein, 7 aa, Entamoeba invadens
CTSDEDN

SEQ ID NO: 2749052 - protein, 13 aa, Entamoeba invadens
CTSEQNKECSVQN

SEQ ID NO: 2749053 - protein, 6 aa, Entamoeba invadens
CTSGHI

SEQ ID NO: 2749054 - protein, 8 aa, Entamoeba invadens
CTSGNTFD

SEQ ID NO: 2749055 - protein, 7 aa, Entamoeba invadens
CTSGTEV

SEQ ID NO: 2749056 - protein, 5 aa, Entamoeba invadens
CTSGV

SEQ ID NO: 2749057 - protein, 11 aa, Entamoeba invadens
CTSKEDKQIKY

SEQ ID NO: 2749058 - protein, 6 aa, Entamoeba invadens
CTSKID

SEQ ID NO: 2749059 - protein, 8 aa, Entamoeba invadens
CTSKSQSG

SEQ ID NO: 2749060 - protein, 8 aa, Entamoeba invadens
CTSPTDEW

SEQ ID NO: 2749061 - protein, 26 aa, Entamoeba invadens
CTSQEPKSEFCENKKTTKCDTKSEFY

SEQ ID NO: 2749062 - protein, 5 aa, Entamoeba invadens
CTSSR

SEQ ID NO: 2749063 - protein, 7 aa, Entamoeba invadens
CTSSSGC

SEQ ID NO: 2749064 - protein, 10 aa, Entamoeba invadens
CTSSSGCTQC

SEQ ID NO: 2749065 - protein, 7 aa, Entamoeba invadens
CTSTNTS

SEQ ID NO: 2749066 - protein, 5 aa, Entamoeba invadens
CTTAE

SEQ ID NO: 2749067 - protein, 4 aa, Entamoeba invadens
CTTC

SEQ ID NO: 2749068 - protein, 10 aa, Entamoeba invadens
CTTCASNGSR

SEQ ID NO: 2749069 - protein, 8 aa, Entamoeba invadens
CTTCDSAT

SEQ ID NO: 2749070 - protein, 15 aa, Entamoeba invadens
CTTCEKKTGKCTSCK

SEQ ID NO: 2749071 - protein, 5 aa, Entamoeba invadens
CTTCP

SEQ ID NO: 2749072 - protein, 11 aa, Entamoeba invadens
CTTCPTDNYYK

SEQ ID NO: 2749073 - protein, 9 aa, Entamoeba invadens
CTTCSEDFT

SEQ ID NO: 2749074 - protein, 10 aa, Entamoeba invadens
CTTCSEGGVI

SEQ ID NO: 2749075 - protein, 12 aa, Entamoeba invadens
CTTCSSTDISPH

SEQ ID NO: 2749076 - protein, 13 aa, Entamoeba invadens
CTTCTQPEKCSSC

SEQ ID NO: 2749077 - protein, 12 aa, Entamoeba invadens
CTTCTSNTACSK

SEQ ID NO: 2749078 - protein, 7 aa, Entamoeba invadens
CTTCTSQ

SEQ ID NO: 2749079 - protein, 4 aa, Entamoeba invadens
CTTD

SEQ ID NO: 2749080 - protein, 10 aa, Entamoeba invadens
CTTGCNGQTG

SEQ ID NO: 2749081 - protein, 11 aa, Entamoeba invadens
CTTGKPVETPI

SEQ ID NO: 2749082 - protein, 11 aa, Entamoeba invadens
CTTGKSVDTPI

SEQ ID NO: 2749083 - protein, 12 aa, Entamoeba invadens
CTTKNCNTCNNK

SEQ ID NO: 2749084 - protein, 6 aa, Entamoeba invadens
CTTKVD

SEQ ID NO: 2749085 - protein, 4 aa, Entamoeba invadens
CTTN

SEQ ID NO: 2749086 - protein, 11 aa, Entamoeba invadens
CTTNESETHCY

SEQ ID NO: 2749087 - protein, 5 aa, Entamoeba invadens
CTTNL

SEQ ID NO: 2749088 - protein, 15 aa, Entamoeba invadens
CTTNNNGKNGKCAPQ

SEQ ID NO: 2749089 - protein, 17 aa, Entamoeba invadens
CTTNSNQVTKSATIYPV

SEQ ID NO: 2749090 - protein, 11 aa, Entamoeba invadens
CTTQKSTCGEF

SEQ ID NO: 2749091 - protein, 19 aa, Entamoeba invadens
CTTQTKTLNDDGEKSGDEK

SEQ ID NO: 2749092 - protein, 13 aa, Entamoeba invadens
CTTRNGGRTDYIQ

SEQ ID NO: 2749093 - protein, 8 aa, Entamoeba invadens
CTTSGTLK

SEQ ID NO: 2749094 - protein, 6 aa, Entamoeba invadens
CTTSSR

SEQ ID NO: 2749095 - protein, 9 aa, Entamoeba invadens
CTTTDNCPY

SEQ ID NO: 2749096 - protein, 6 aa, Entamoeba invadens
CTTYRR

SEQ ID NO: 2749097 - protein, 9 aa, Entamoeba invadens
CTVTNTSVD

SEQ ID NO: 2749098 - protein, 5 aa, Entamoeba invadens
CTYDP

SEQ ID NO: 2749099 - protein, 14 aa, Entamoeba invadens
CVATTTKDCQHEIS

SEQ ID NO: 2749100 - protein, 8 aa, Entamoeba invadens
CVDASKGR

SEQ ID NO: 2749101 - protein, 8 aa, Entamoeba invadens
CVDGSGCT

SEQ ID NO: 2749102 - protein, 9 aa, Entamoeba invadens
CVDKQSTCL

SEQ ID NO: 2749103 - protein, 15 aa, Entamoeba invadens
CVDSSTHCDTATGCS

SEQ ID NO: 2749104 - protein, 5 aa, Entamoeba invadens
CVEKP

SEQ ID NO: 2749105 - protein, 21 aa, Entamoeba invadens
CVEKSTKSCSVVDPKTSQCSE

SEQ ID NO: 2749106 - protein, 22 aa, Entamoeba invadens
CVEKSTKSCSVVDPKTSQCSEC

SEQ ID NO: 2749107 - protein, 5 aa, Entamoeba invadens
CVENE

SEQ ID NO: 2749108 - protein, 6 aa, Entamoeba invadens
CVEPSK

SEQ ID NO: 2749109 - protein, 5 aa, Entamoeba invadens
CVETD

SEQ ID NO: 2749110 - protein, 8 aa, Entamoeba invadens
CVGSPDGC

SEQ ID NO: 2749111 - protein, 12 aa, Entamoeba invadens
CVKNDEDCSIEN

SEQ ID NO: 2749112 - protein, 12 aa, Entamoeba invadens
CVKQEESNQTEL

SEQ ID NO: 2749113 - protein, 12 aa, Entamoeba invadens
CVKSEEEHCEQQ

SEQ ID NO: 2749114 - protein, 14 aa, Entamoeba invadens
CVNADNDTKYTNQN

SEQ ID NO: 2749115 - protein, 14 aa, Entamoeba invadens
CVNANGCNNPSKLS

SEQ ID NO: 2749116 - protein, 5 aa, Entamoeba invadens
CVNDT

SEQ ID NO: 2749117 - protein, 8 aa, Entamoeba invadens
CVNGETCT

SEQ ID NO: 2749118 - protein, 5 aa, Entamoeba invadens
CVNSK

SEQ ID NO: 2749119 - protein, 5 aa, Entamoeba invadens
CVNTE

SEQ ID NO: 2749120 - protein, 4 aa, Entamoeba invadens
CVNY

SEQ ID NO: 2749121 - protein, 5 aa, Entamoeba invadens
CVPAT

SEQ ID NO: 2749122 - protein, 5 aa, Entamoeba invadens
CVPND

SEQ ID NO: 2749123 - protein, 5 aa, Entamoeba invadens
CVPTE

SEQ ID NO: 2749124 - protein, 4 aa, Entamoeba invadens
CVQT

SEQ ID NO: 2749125 - protein, 12 aa, Entamoeba invadens
CVSDENCKQANG

SEQ ID NO: 2749126 - protein, 9 aa, Entamoeba invadens
CVSGEDNCS

SEQ ID NO: 2749127 - protein, 8 aa, Entamoeba invadens
CVSGVDET

SEQ ID NO: 2749128 - protein, 4 aa, Entamoeba invadens
CVSK

SEQ ID NO: 2749129 - protein, 11 aa, Entamoeba invadens
CVSNNNDNLNR

SEQ ID NO: 2749130 - protein, 5 aa, Entamoeba invadens
CVSNT

SEQ ID NO: 2749131 - protein, 11 aa, Entamoeba invadens
CVSSEDALDEF

SEQ ID NO: 2749132 - protein, 14 aa, Entamoeba invadens
CVSSETCESPSLTS

SEQ ID NO: 2749133 - protein, 5 aa, Entamoeba invadens
CVSTD

SEQ ID NO: 2749134 - protein, 6 aa, Entamoeba invadens
CVSTDS

SEQ ID NO: 2749135 - protein, 10 aa, Entamoeba invadens
CVSTKDEEIK

SEQ ID NO: 2749136 - protein, 5 aa, Entamoeba invadens
CVTAE

SEQ ID NO: 2749137 - protein, 13 aa, Entamoeba invadens
CVTDEKCSETLTS

SEQ ID NO: 2749138 - protein, 8 aa, Entamoeba invadens
CVTEDNKG

SEQ ID NO: 2749139 - protein, 21 aa, Entamoeba invadens
CVTGERKCTRCSTPNMYPDDT

SEQ ID NO: 2749140 - protein, 17 aa, Entamoeba invadens
CVTPTTCSSPNTITTTS

SEQ ID NO: 2749141 - protein, 5 aa, Entamoeba invadens
CVTPV

SEQ ID NO: 2749142 - protein, 13 aa, Entamoeba invadens
CVTQNDTNCSVSS

SEQ ID NO: 2749143 - protein, 17 aa, Entamoeba invadens
CVTSSKYNNTCDRYTSN

SEQ ID NO: 2749144 - protein, 7 aa, Entamoeba invadens
CYDSSSN

SEQ ID NO: 2749145 - protein, 17 aa, Entamoeba invadens
CYEGTDNCKSCTSTSTY

SEQ ID NO: 2749146 - protein, 10 aa, Entamoeba invadens
CYETAKDTLP

SEQ ID NO: 2749147 - protein, 8 aa, Entamoeba invadens
CYGTSEPV

SEQ ID NO: 2749148 - protein, 4 aa, Entamoeba invadens
CYKC

SEQ ID NO: 2749149 - protein, 8 aa, Entamoeba invadens
CYNNEEAL

SEQ ID NO: 2749150 - protein, 5 aa, Entamoeba invadens
CYNPS

SEQ ID NO: 2749151 - protein, 13 aa, Entamoeba invadens
CYPKATNCGTYNT

SEQ ID NO: 2749152 - protein, 13 aa, Entamoeba invadens
CYPNSEGCTPTCK

SEQ ID NO: 2749153 - protein, 30 aa, Entamoeba invadens
CYPPYNLSSNGKSCDQCASTSYYDRTTNRC

SEQ ID NO: 2749154 - protein, 10 aa, Entamoeba invadens
CYSNAENKCY

SEQ ID NO: 2749155 - protein, 9 aa, Entamoeba invadens
CYSQDNEYD

SEQ ID NO: 2749156 - protein, 6 aa, Entamoeba invadens
CYTNKS

SEQ ID NO: 2749157 - protein, 10 aa, Entamoeba invadens
CYTSSTCSSC

SEQ ID NO: 2749158 - protein, 5 aa, Entamoeba invadens
DAAAK

SEQ ID NO: 2749159 - protein, 23 aa, Entamoeba invadens
DAAKTPATPKEKESLLDHDEESK

SEQ ID NO: 2749160 - protein, 20 aa, Entamoeba invadens
DAAKTTEVIDDKKPLLGEEE

SEQ ID NO: 2749161 - protein, 8 aa, Entamoeba invadens
DAANKEGY

SEQ ID NO: 2749162 - protein, 8 aa, Entamoeba invadens
DAASSTHL

SEQ ID NO: 2749163 - protein, 9 aa, Entamoeba invadens
DAASSTQLD

SEQ ID NO: 2749164 - protein, 7 aa, Entamoeba invadens
DAATSIT

SEQ ID NO: 2749165 - protein, 17 aa, Entamoeba invadens
DACNNTNGYKLSASTQK

SEQ ID NO: 2749166 - protein, 9 aa, Entamoeba invadens
DACTSCTTD

SEQ ID NO: 2749167 - protein, 8 aa, Entamoeba invadens
DADGKCES

SEQ ID NO: 2749168 - protein, 8 aa, Entamoeba invadens
DADGTQTV

SEQ ID NO: 2749169 - protein, 6 aa, Entamoeba invadens
DADNED

SEQ ID NO: 2749170 - protein, 6 aa, Entamoeba invadens
DADNET

SEQ ID NO: 2749171 - protein, 7 aa, Entamoeba invadens
DADSGEN

SEQ ID NO: 2749172 - protein, 9 aa, Entamoeba invadens
DADSGTEVF

SEQ ID NO: 2749173 - protein, 8 aa, Entamoeba invadens
DADTCTKC

SEQ ID NO: 2749174 - protein, 5 aa, Entamoeba invadens
DAEAE

SEQ ID NO: 2749175 - protein, 4 aa, Entamoeba invadens
DAEG

SEQ ID NO: 2749176 - protein, 8 aa, Entamoeba invadens
DAEGIDGG

SEQ ID NO: 2749177 - protein, 7 aa, Entamoeba invadens
DAELKNK

SEQ ID NO: 2749178 - protein, 13 aa, Entamoeba invadens
DAELTEKTEISHP

SEQ ID NO: 2749179 - protein, 6 aa, Entamoeba invadens
DAESAL

SEQ ID NO: 2749180 - protein, 6 aa, Entamoeba invadens
DAESIT

SEQ ID NO: 2749181 - protein, 4 aa, Entamoeba invadens
DAET

SEQ ID NO: 2749182 - protein, 12 aa, Entamoeba invadens
DAETTRKRKPYD

SEQ ID NO: 2749183 - protein, 5 aa, Entamoeba invadens
DAFPE

SEQ ID NO: 2749184 - protein, 7 aa, Entamoeba invadens
DAGCPNA

SEQ ID NO: 2749185 - protein, 9 aa, Entamoeba invadens
DAGNTTGPT

SEQ ID NO: 2749186 - protein, 11 aa, Entamoeba invadens
DAGRTQVEPGS

SEQ ID NO: 2749187 - protein, 8 aa, Entamoeba invadens
DAGSRNTS

SEQ ID NO: 2749188 - protein, 5 aa, Entamoeba invadens
DAHKS

SEQ ID NO: 2749189 - protein, 4 aa, Entamoeba invadens
DAID

SEQ ID NO: 2749190 - protein, 8 aa, Entamoeba invadens
DAIPEKER

SEQ ID NO: 2749191 - protein, 5 aa, Entamoeba invadens
DAIQD

SEQ ID NO: 2749192 - protein, 6 aa, Entamoeba invadens
DAIQNK

SEQ ID NO: 2749193 - protein, 7 aa, Entamoeba invadens
DAKANYP

SEQ ID NO: 2749194 - protein, 8 aa, Entamoeba invadens
DAKISTPL

SEQ ID NO: 2749195 - protein, 19 aa, Entamoeba invadens
DAKKRKDPKNAVSAATEQE

SEQ ID NO: 2749196 - protein, 17 aa, Entamoeba invadens
DAKLQKELEDEKKKSDF

SEQ ID NO: 2749197 - protein, 6 aa, Entamoeba invadens
DAKPME

SEQ ID NO: 2749198 - protein, 8 aa, Entamoeba invadens
DAKPNDVH

SEQ ID NO: 2749199 - protein, 8 aa, Entamoeba invadens
DAKQNTMR

SEQ ID NO: 2749200 - protein, 4 aa, Entamoeba invadens
DAKT

SEQ ID NO: 2749201 - protein, 8 aa, Entamoeba invadens
DAKTCTHQ

SEQ ID NO: 2749202 - protein, 16 aa, Entamoeba invadens
DAKVTANGDASAESLE

SEQ ID NO: 2749203 - protein, 9 aa, Entamoeba invadens
DALAPLSKK

SEQ ID NO: 2749204 - protein, 7 aa, Entamoeba invadens
DALNETA

SEQ ID NO: 2749205 - protein, 7 aa, Entamoeba invadens
DALNRSH

SEQ ID NO: 2749206 - protein, 13 aa, Entamoeba invadens
DALSDSSSSDKVK

SEQ ID NO: 2749207 - protein, 5 aa, Entamoeba invadens
DAMYP

SEQ ID NO: 2749208 - protein, 6 aa, Entamoeba invadens
DANCNN

SEQ ID NO: 2749209 - protein, 11 aa, Entamoeba invadens
DANCQNQSASN

SEQ ID NO: 2749210 - protein, 7 aa, Entamoeba invadens
DANDGDI

SEQ ID NO: 2749211 - protein, 5 aa, Entamoeba invadens
DANEV

SEQ ID NO: 2749212 - protein, 6 aa, Entamoeba invadens
DANGLG

SEQ ID NO: 2749213 - protein, 10 aa, Entamoeba invadens
DANNVRDDQK

SEQ ID NO: 2749214 - protein, 4 aa, Entamoeba invadens
DANP

SEQ ID NO: 2749215 - protein, 20 aa, Entamoeba invadens
DANPTPESNSKVVSLLAQDM

SEQ ID NO: 2749216 - protein, 6 aa, Entamoeba invadens
DANSAC

SEQ ID NO: 2749217 - protein, 10 aa, Entamoeba invadens
DANSCEKCKE

SEQ ID NO: 2749218 - protein, 9 aa, Entamoeba invadens
DANSDQETL

SEQ ID NO: 2749219 - protein, 5 aa, Entamoeba invadens
DANSN

SEQ ID NO: 2749220 - protein, 9 aa, Entamoeba invadens
DANTDDEAL

SEQ ID NO: 2749221 - protein, 13 aa, Entamoeba invadens
DANYSPNYSPQTF

SEQ ID NO: 2749222 - protein, 7 aa, Entamoeba invadens
DAPDVPD

SEQ ID NO: 2749223 - protein, 6 aa, Entamoeba invadens
DAPGGV

SEQ ID NO: 2749224 - protein, 8 aa, Entamoeba invadens
DAPLSEAN

SEQ ID NO: 2749225 - protein, 4 aa, Entamoeba invadens
DAPN

SEQ ID NO: 2749226 - protein, 6 aa, Entamoeba invadens
DAPNNT

SEQ ID NO: 2749227 - protein, 8 aa, Entamoeba invadens
DAPSQYTL

SEQ ID NO: 2749228 - protein, 8 aa, Entamoeba invadens
DAPSYDPV

SEQ ID NO: 2749229 - protein, 7 aa, Entamoeba invadens
DAPTGLK

SEQ ID NO: 2749230 - protein, 12 aa, Entamoeba invadens
DAPYTLDTTKNT

SEQ ID NO: 2749231 - protein, 6 aa, Entamoeba invadens
DAQAGI

SEQ ID NO: 2749232 - protein, 15 aa, Entamoeba invadens
DAQDHTNNKEEKYDE

SEQ ID NO: 2749233 - protein, 6 aa, Entamoeba invadens
DAQGMS

SEQ ID NO: 2749234 - protein, 11 aa, Entamoeba invadens
DAQKSDDYPRM

SEQ ID NO: 2749235 - protein, 7 aa, Entamoeba invadens
DAQSKYG

SEQ ID NO: 2749236 - protein, 9 aa, Entamoeba invadens
DAQTSASLR

SEQ ID NO: 2749237 - protein, 9 aa, Entamoeba invadens
DARAKTDIE

SEQ ID NO: 2749238 - protein, 13 aa, Entamoeba invadens
DAREKDTDSDPPL

SEQ ID NO: 2749239 - protein, 7 aa, Entamoeba invadens
DARPSFK

SEQ ID NO: 2749240 - protein, 7 aa, Entamoeba invadens
DARRTHF

SEQ ID NO: 2749241 - protein, 12 aa, Entamoeba invadens
DARTKTKIAPIG

SEQ ID NO: 2749242 - protein, 10 aa, Entamoeba invadens
DASATQNDST

SEQ ID NO: 2749243 - protein, 10 aa, Entamoeba invadens
DASDPATCTT

SEQ ID NO: 2749244 - protein, 8 aa, Entamoeba invadens
DASEYSEE

SEQ ID NO: 2749245 - protein, 9 aa, Entamoeba invadens
DASGNFEQS

SEQ ID NO: 2749246 - protein, 15 aa, Entamoeba invadens
DASGSVKSSNTPGSA

SEQ ID NO: 2749247 - protein, 11 aa, Entamoeba invadens
DASGTETPFDT

SEQ ID NO: 2749248 - protein, 20 aa, Entamoeba invadens
DASKAECVRTRTDGCSSTSR

SEQ ID NO: 2749249 - protein, 5 aa, Entamoeba invadens
DASKG

SEQ ID NO: 2749250 - protein, 19 aa, Entamoeba invadens
DASKKEENSNLASENREKL

SEQ ID NO: 2749251 - protein, 4 aa, Entamoeba invadens
DASQ

SEQ ID NO: 2749252 - protein, 8 aa, Entamoeba invadens
DASSNLKT

SEQ ID NO: 2749253 - protein, 9 aa, Entamoeba invadens
DASTNNKCQ

SEQ ID NO: 2749254 - protein, 8 aa, Entamoeba invadens
DASVKQND

SEQ ID NO: 2749255 - protein, 8 aa, Entamoeba invadens
DASVTQND

SEQ ID NO: 2749256 - protein, 11 aa, Entamoeba invadens
DATCGGKCDTI

SEQ ID NO: 2749257 - protein, 15 aa, Entamoeba invadens
DATCGGNCNTTNGQC

SEQ ID NO: 2749258 - protein, 14 aa, Entamoeba invadens
DATCNGSCNTRNGY

SEQ ID NO: 2749259 - protein, 13 aa, Entamoeba invadens
DATDKSVLSSPSL

SEQ ID NO: 2749260 - protein, 10 aa, Entamoeba invadens
DATDNKKCGT

SEQ ID NO: 2749261 - protein, 9 aa, Entamoeba invadens
DATDRQSGY

SEQ ID NO: 2749262 - protein, 14 aa, Entamoeba invadens
DATEVAQDLQKRAM

SEQ ID NO: 2749263 - protein, 7 aa, Entamoeba invadens
DATGKFT

SEQ ID NO: 2749264 - protein, 11 aa, Entamoeba invadens
DATGSGKMNNL

SEQ ID NO: 2749265 - protein, 7 aa, Entamoeba invadens
DATIPTF

SEQ ID NO: 2749266 - protein, 12 aa, Entamoeba invadens
DATKDSKQYSKI

SEQ ID NO: 2749267 - protein, 9 aa, Entamoeba invadens
DATKRPQDN

SEQ ID NO: 2749268 - protein, 9 aa, Entamoeba invadens
DATMGRRST

SEQ ID NO: 2749269 - protein, 16 aa, Entamoeba invadens
DATNILEGRDDAINQL

SEQ ID NO: 2749270 - protein, 7 aa, Entamoeba invadens
DATNKKC

SEQ ID NO: 2749271 - protein, 10 aa, Entamoeba invadens
DATPTGCAGK

SEQ ID NO: 2749272 - protein, 7 aa, Entamoeba invadens
DATSNFT

SEQ ID NO: 2749273 - protein, 12 aa, Entamoeba invadens
DATSQTVATDPA

SEQ ID NO: 2749274 - protein, 8 aa, Entamoeba invadens
DATSSTHI

SEQ ID NO: 2749275 - protein, 11 aa, Entamoeba invadens
DATTFPSTYPS

SEQ ID NO: 2749276 - protein, 7 aa, Entamoeba invadens
DATTGLS

SEQ ID NO: 2749277 - protein, 10 aa, Entamoeba invadens
DATTQIRDDT

SEQ ID NO: 2749278 - protein, 7 aa, Entamoeba invadens
DATTRRY

SEQ ID NO: 2749279 - protein, 6 aa, Entamoeba invadens
DATVDD

SEQ ID NO: 2749280 - protein, 8 aa, Entamoeba invadens
DATVPTFT

SEQ ID NO: 2749281 - protein, 8 aa, Entamoeba invadens
DAVKGAPN

SEQ ID NO: 2749282 - protein, 17 aa, Entamoeba invadens
DAVSDSLPSKSITTGDL

SEQ ID NO: 2749283 - protein, 10 aa, Entamoeba invadens
DAVTNGPDDQ

SEQ ID NO: 2749284 - protein, 6 aa, Entamoeba invadens
DAWNDI

SEQ ID NO: 2749285 - protein, 15 aa, Entamoeba invadens
DAYATKVREESREVG

SEQ ID NO: 2749286 - protein, 6 aa, Entamoeba invadens
DAYDEI

SEQ ID NO: 2749287 - protein, 8 aa, Entamoeba invadens
DAYDPDKI

SEQ ID NO: 2749288 - protein, 8 aa, Entamoeba invadens
DAYGITPN

SEQ ID NO: 2749289 - protein, 6 aa, Entamoeba invadens
DAYNTY

SEQ ID NO: 2749290 - protein, 7 aa, Entamoeba invadens
DAYPKNK

SEQ ID NO: 2749291 - protein, 7 aa, Entamoeba invadens
DAYPSTG

SEQ ID NO: 2749292 - protein, 11 aa, Entamoeba invadens
DCAEGNYKDTI

SEQ ID NO: 2749293 - protein, 8 aa, Entamoeba invadens
DCCSKSHT

SEQ ID NO: 2749294 - protein, 5 aa, Entamoeba invadens
DCDDA

SEQ ID NO: 2749295 - protein, 5 aa, Entamoeba invadens
DCDEA

SEQ ID NO: 2749296 - protein, 7 aa, Entamoeba invadens
DCDGGLN

SEQ ID NO: 2749297 - protein, 7 aa, Entamoeba invadens
DCDNGTY

SEQ ID NO: 2749298 - protein, 16 aa, Entamoeba invadens
DCDSTCGSQCNGSTGV

SEQ ID NO: 2749299 - protein, 12 aa, Entamoeba invadens
DCDTSCETCSTY

SEQ ID NO: 2749300 - protein, 6 aa, Entamoeba invadens
DCEECS

SEQ ID NO: 2749301 - protein, 5 aa, Entamoeba invadens
DCEKY

SEQ ID NO: 2749302 - protein, 18 aa, Entamoeba invadens
DCEQCRSSEYKRDSTNTK

SEQ ID NO: 2749303 - protein, 8 aa, Entamoeba invadens
DCESTLTD

SEQ ID NO: 2749304 - protein, 8 aa, Entamoeba invadens
DCEVNNGT

SEQ ID NO: 2749305 - protein, 8 aa, Entamoeba invadens
DCGCTDDT

SEQ ID NO: 2749306 - protein, 4 aa, Entamoeba invadens
DCGE

SEQ ID NO: 2749307 - protein, 8 aa, Entamoeba invadens
DCGNPSSH

SEQ ID NO: 2749308 - protein, 14 aa, Entamoeba invadens
DCGSYENRGRCLPS

SEQ ID NO: 2749309 - protein, 11 aa, Entamoeba invadens
DCIKSTNRVQK

SEQ ID NO: 2749310 - protein, 6 aa, Entamoeba invadens
DCISDT

SEQ ID NO: 2749311 - protein, 8 aa, Entamoeba invadens
DCKKSEDA

SEQ ID NO: 2749312 - protein, 5 aa, Entamoeba invadens
DCKKT

SEQ ID NO: 2749313 - protein, 6 aa, Entamoeba invadens
DCKNCD

SEQ ID NO: 2749314 - protein, 10 aa, Entamoeba invadens
DCKNTQDRNK

SEQ ID NO: 2749315 - protein, 5 aa, Entamoeba invadens
DCKPQ

SEQ ID NO: 2749316 - protein, 5 aa, Entamoeba invadens
DCKTI

SEQ ID NO: 2749317 - protein, 5 aa, Entamoeba invadens
DCLPQ

SEQ ID NO: 2749318 - protein, 7 aa, Entamoeba invadens
DCNAGNE

SEQ ID NO: 2749319 - protein, 7 aa, Entamoeba invadens
DCNECDK

SEQ ID NO: 2749320 - protein, 16 aa, Entamoeba invadens
DCNNERGYGSCSTREG

SEQ ID NO: 2749321 - protein, 6 aa, Entamoeba invadens
DCNPPV

SEQ ID NO: 2749322 - protein, 7 aa, Entamoeba invadens
DCNQNST

SEQ ID NO: 2749323 - protein, 17 aa, Entamoeba invadens
DCNSKSGHGQCSTKRGE

SEQ ID NO: 2749324 - protein, 15 aa, Entamoeba invadens
DCNTRIPGTYSGRTI

SEQ ID NO: 2749325 - protein, 4 aa, Entamoeba invadens
DCPE

SEQ ID NO: 2749326 - protein, 10 aa, Entamoeba invadens
DCQSCTDNTY

SEQ ID NO: 2749327 - protein, 6 aa, Entamoeba invadens
DCRQCN

SEQ ID NO: 2749328 - protein, 11 aa, Entamoeba invadens
DCRQSDSAHYY

SEQ ID NO: 2749329 - protein, 8 aa, Entamoeba invadens
DCSDSPIN

SEQ ID NO: 2749330 - protein, 21 aa, Entamoeba invadens
DCSEEEKEDAKRRASLAQKYG

SEQ ID NO: 2749331 - protein, 8 aa, Entamoeba invadens
DCSGPRVS

SEQ ID NO: 2749332 - protein, 13 aa, Entamoeba invadens
DCSRNKCEKKSSV

SEQ ID NO: 2749333 - protein, 8 aa, Entamoeba invadens
DCSSKKPY

SEQ ID NO: 2749334 - protein, 7 aa, Entamoeba invadens
DCSTPVD

SEQ ID NO: 2749335 - protein, 13 aa, Entamoeba invadens
DCSTRGCTTCNST

SEQ ID NO: 2749336 - protein, 12 aa, Entamoeba invadens
DCSTSGCTTCNS

SEQ ID NO: 2749337 - protein, 4 aa, Entamoeba invadens
DCTE

SEQ ID NO: 2749338 - protein, 6 aa, Entamoeba invadens
DCTECT

SEQ ID NO: 2749339 - protein, 19 aa, Entamoeba invadens
DCTGNALDETTFTKGKCQP

SEQ ID NO: 2749340 - protein, 6 aa, Entamoeba invadens
DCTKNS

SEQ ID NO: 2749341 - protein, 13 aa, Entamoeba invadens
DCTKSENDADCGR

SEQ ID NO: 2749342 - protein, 16 aa, Entamoeba invadens
DCTQTADGYSVDENGN

SEQ ID NO: 2749343 - protein, 7 aa, Entamoeba invadens
DCTRLSP

SEQ ID NO: 2749344 - protein, 9 aa, Entamoeba invadens
DCTTNNDGS

SEQ ID NO: 2749345 - protein, 9 aa, Entamoeba invadens
DCTTNNEGS

SEQ ID NO: 2749346 - protein, 8 aa, Entamoeba invadens
DCWSSQED

SEQ ID NO: 2749347 - protein, 4 aa, Entamoeba invadens
DCYP

SEQ ID NO: 2749348 - protein, 13 aa, Entamoeba invadens
DCYPQDKFPDGES

SEQ ID NO: 2749349 - protein, 17 aa, Entamoeba invadens
DDADGQCKPVDDSCNGA

SEQ ID NO: 2749350 - protein, 22 aa, Entamoeba invadens
DDADKMQGLQNTKAVTGNTSIT

SEQ ID NO: 2749351 - protein, 6 aa, Entamoeba invadens
DDADTN

SEQ ID NO: 2749352 - protein, 7 aa, Entamoeba invadens
DDALGDA

SEQ ID NO: 2749353 - protein, 7 aa, Entamoeba invadens
DDATGEL

SEQ ID NO: 2749354 - protein, 8 aa, Entamoeba invadens
DDAVGDTL

SEQ ID NO: 2749355 - protein, 7 aa, Entamoeba invadens
DDAYEEP

SEQ ID NO: 2749356 - protein, 9 aa, Entamoeba invadens
DDCDENEID

SEQ ID NO: 2749357 - protein, 10 aa, Entamoeba invadens
DDCNKNSKTN

SEQ ID NO: 2749358 - protein, 8 aa, Entamoeba invadens
DDCSSPSL

SEQ ID NO: 2749359 - protein, 6 aa, Entamoeba invadens
DDDDEI

SEQ ID NO: 2749360 - protein, 6 aa, Entamoeba invadens
DDDGNC

SEQ ID NO: 2749361 - protein, 9 aa, Entamoeba invadens
DDDGNDADD

SEQ ID NO: 2749362 - protein, 10 aa, Entamoeba invadens
DDDKAEEEHT

SEQ ID NO: 2749363 - protein, 23 aa, Entamoeba invadens
DDDLKDDNFDQQEEHQEGQFKDE

SEQ ID NO: 2749364 - protein, 4 aa, Entamoeba invadens
DDDN

SEQ ID NO: 2749365 - protein, 9 aa, Entamoeba invadens
DDDNKNEVR

SEQ ID NO: 2749366 - protein, 7 aa, Entamoeba invadens
DDDPTKR

SEQ ID NO: 2749367 - protein, 6 aa, Entamoeba invadens
DDDQDY

SEQ ID NO: 2749368 - protein, 9 aa, Entamoeba invadens
DDDQDYDEI

SEQ ID NO: 2749369 - protein, 8 aa, Entamoeba invadens
DDDQDYEE

SEQ ID NO: 2749370 - protein, 9 aa, Entamoeba invadens
DDDSNNRYR

SEQ ID NO: 2749371 - protein, 4 aa, Entamoeba invadens
DDDT

SEQ ID NO: 2749372 - protein, 9 aa, Entamoeba invadens
DDDTNNQYR

SEQ ID NO: 2749373 - protein, 5 aa, Entamoeba invadens
DDDVK

SEQ ID NO: 2749374 - protein, 10 aa, Entamoeba invadens
DDDVNKRSQI

SEQ ID NO: 2749375 - protein, 6 aa, Entamoeba invadens
DDDVPT

SEQ ID NO: 2749376 - protein, 9 aa, Entamoeba invadens
DDDVTNTKQ

SEQ ID NO: 2749377 - protein, 21 aa, Entamoeba invadens
DDDYYKDTTGCLPKQEKYKDC

SEQ ID NO: 2749378 - protein, 8 aa, Entamoeba invadens
DDEEEDDV

SEQ ID NO: 2749379 - protein, 13 aa, Entamoeba invadens
DDEEEDENNGIVN

SEQ ID NO: 2749380 - protein, 12 aa, Entamoeba invadens
DDEEEVKDENGK

SEQ ID NO: 2749381 - protein, 5 aa, Entamoeba invadens
DDEEN

SEQ ID NO: 2749382 - protein, 7 aa, Entamoeba invadens
DDEHNEK

SEQ ID NO: 2749383 - protein, 5 aa, Entamoeba invadens
DDEIH

SEQ ID NO: 2749384 - protein, 6 aa, Entamoeba invadens
DDEKNV

SEQ ID NO: 2749385 - protein, 4 aa, Entamoeba invadens
DDEL

SEQ ID NO: 2749386 - protein, 6 aa, Entamoeba invadens
DDEMAE

SEQ ID NO: 2749387 - protein, 5 aa, Entamoeba invadens
DDEMR

SEQ ID NO: 2749388 - protein, 18 aa, Entamoeba invadens
DDENDENNLTNTKQEIKG

SEQ ID NO: 2749389 - protein, 7 aa, Entamoeba invadens
DDEQHEK

SEQ ID NO: 2749390 - protein, 9 aa, Entamoeba invadens
DDEQKMSNL

SEQ ID NO: 2749391 - protein, 6 aa, Entamoeba invadens
DDESFN

SEQ ID NO: 2749392 - protein, 9 aa, Entamoeba invadens
DDESPFSDT

SEQ ID NO: 2749393 - protein, 16 aa, Entamoeba invadens
DDETFEEENQTEAFNS

SEQ ID NO: 2749394 - protein, 25 aa, Entamoeba invadens
DDETFEEENQTEAFNSLKGDLKTQE

SEQ ID NO: 2749395 - protein, 9 aa, Entamoeba invadens
DDEVNLSSG

SEQ ID NO: 2749396 - protein, 7 aa, Entamoeba invadens
DDFDGTK

SEQ ID NO: 2749397 - protein, 4 aa, Entamoeba invadens
DDFE

SEQ ID NO: 2749398 - protein, 10 aa, Entamoeba invadens
DDFEKEKGEE

SEQ ID NO: 2749399 - protein, 7 aa, Entamoeba invadens
DDFEPGA

SEQ ID NO: 2749400 - protein, 11 aa, Entamoeba invadens
DDFKPQPSDFD

SEQ ID NO: 2749401 - protein, 12 aa, Entamoeba invadens
DDFNDAKCSSGR

SEQ ID NO: 2749402 - protein, 11 aa, Entamoeba invadens
DDGCSKTSTSS

SEQ ID NO: 2749403 - protein, 10 aa, Entamoeba invadens
DDGDNGKNRV

SEQ ID NO: 2749404 - protein, 15 aa, Entamoeba invadens
DDGDNMYRRYELEIM

SEQ ID NO: 2749405 - protein, 5 aa, Entamoeba invadens
DDGEL

SEQ ID NO: 2749406 - protein, 5 aa, Entamoeba invadens
DDGFT

SEQ ID NO: 2749407 - protein, 4 aa, Entamoeba invadens
DDGG

SEQ ID NO: 2749408 - protein, 5 aa, Entamoeba invadens
DDGGD

SEQ ID NO: 2749409 - protein, 10 aa, Entamoeba invadens
DDGKGGKNAA

SEQ ID NO: 2749410 - protein, 8 aa, Entamoeba invadens
DDGKWSQT

SEQ ID NO: 2749411 - protein, 24 aa, Entamoeba invadens
DDGNETKETPKKPQKTPSPFPDIP

SEQ ID NO: 2749412 - protein, 7 aa, Entamoeba invadens
DDGNVLE

SEQ ID NO: 2749413 - protein, 11 aa, Entamoeba invadens
DDGPIPVDAES

SEQ ID NO: 2749414 - protein, 12 aa, Entamoeba invadens
DDGPTKTFSSER

SEQ ID NO: 2749415 - protein, 12 aa, Entamoeba invadens
DDGRRISSMESQ

SEQ ID NO: 2749416 - protein, 5 aa, Entamoeba invadens
DDGRW

SEQ ID NO: 2749417 - protein, 10 aa, Entamoeba invadens
DDGSRLTDQS

SEQ ID NO: 2749418 - protein, 7 aa, Entamoeba invadens
DDGTDEK

SEQ ID NO: 2749419 - protein, 13 aa, Entamoeba invadens
DDGVGGSKGTAGI

SEQ ID NO: 2749420 - protein, 4 aa, Entamoeba invadens
DDGY

SEQ ID NO: 2749421 - protein, 7 aa, Entamoeba invadens
DDHQHKM

SEQ ID NO: 2749422 - protein, 9 aa, Entamoeba invadens
DDHQTDSEM

SEQ ID NO: 2749423 - protein, 7 aa, Entamoeba invadens
DDIDQQK

SEQ ID NO: 2749424 - protein, 4 aa, Entamoeba invadens
DDIE

SEQ ID NO: 2749425 - protein, 7 aa, Entamoeba invadens
DDIETVG

SEQ ID NO: 2749426 - protein, 4 aa, Entamoeba invadens
DDIK

SEQ ID NO: 2749427 - protein, 8 aa, Entamoeba invadens
DDIPQQRK

SEQ ID NO: 2749428 - protein, 11 aa, Entamoeba invadens
DDIPRTQKLRK

SEQ ID NO: 2749429 - protein, 7 aa, Entamoeba invadens
DDIPTQI

SEQ ID NO: 2749430 - protein, 15 aa, Entamoeba invadens
DDIQKGAEVVVITSD

SEQ ID NO: 2749431 - protein, 4 aa, Entamoeba invadens
DDIS

SEQ ID NO: 2749432 - protein, 8 aa, Entamoeba invadens
DDKAAEVM

SEQ ID NO: 2749433 - protein, 6 aa, Entamoeba invadens
DDKCSK

SEQ ID NO: 2749434 - protein, 8 aa, Entamoeba invadens
DDKCTKCK

SEQ ID NO: 2749435 - protein, 6 aa, Entamoeba invadens
DDKDTN

SEQ ID NO: 2749436 - protein, 5 aa, Entamoeba invadens
DDKEE

SEQ ID NO: 2749437 - protein, 4 aa, Entamoeba invadens
DDKG

SEQ ID NO: 2749438 - protein, 42 aa, Entamoeba invadens
DDKGSQQRNLKESATKKEMKNEEGKEEKKRTEENVGSPKAKD

SEQ ID NO: 2749439 - protein, 7 aa, Entamoeba invadens
DDKIDSE

SEQ ID NO: 2749440 - protein, 13 aa, Entamoeba invadens
DDKKGTATAFDST

SEQ ID NO: 2749441 - protein, 7 aa, Entamoeba invadens
DDKKGVK

SEQ ID NO: 2749442 - protein, 16 aa, Entamoeba invadens
DDKKNDDISSTSEEGV

SEQ ID NO: 2749443 - protein, 7 aa, Entamoeba invadens
DDKKNTQ

SEQ ID NO: 2749444 - protein, 4 aa, Entamoeba invadens
DDKL

SEQ ID NO: 2749445 - protein, 7 aa, Entamoeba invadens
DDKLSES

SEQ ID NO: 2749446 - protein, 18 aa, Entamoeba invadens
DDKMEGAEVRNSSIPEEL

SEQ ID NO: 2749447 - protein, 8 aa, Entamoeba invadens
DDKMKDQV

SEQ ID NO: 2749448 - protein, 11 aa, Entamoeba invadens
DDKNKRRSINN

SEQ ID NO: 2749449 - protein, 5 aa, Entamoeba invadens
DDKNM

SEQ ID NO: 2749450 - protein, 8 aa, Entamoeba invadens
DDKNPHGE

SEQ ID NO: 2749451 - protein, 5 aa, Entamoeba invadens
DDKRE

SEQ ID NO: 2749452 - protein, 9 aa, Entamoeba invadens
DDKSEEGNY

SEQ ID NO: 2749453 - protein, 6 aa, Entamoeba invadens
DDKSFE

SEQ ID NO: 2749454 - protein, 11 aa, Entamoeba invadens
DDKSRPEVGQV

SEQ ID NO: 2749455 - protein, 12 aa, Entamoeba invadens
DDKTLSNKGPTV

SEQ ID NO: 2749456 - protein, 6 aa, Entamoeba invadens
DDKYSG

SEQ ID NO: 2749457 - protein, 12 aa, Entamoeba invadens
DDLDEDKIDVNK

SEQ ID NO: 2749458 - protein, 9 aa, Entamoeba invadens
DDLDETQGL

SEQ ID NO: 2749459 - protein, 13 aa, Entamoeba invadens
DDLESAVDYNERH

SEQ ID NO: 2749460 - protein, 10 aa, Entamoeba invadens
DDLKASTTEV

SEQ ID NO: 2749461 - protein, 10 aa, Entamoeba invadens
DDLKNDRETI

SEQ ID NO: 2749462 - protein, 12 aa, Entamoeba invadens
DDLKTSTTEVSD

SEQ ID NO: 2749463 - protein, 9 aa, Entamoeba invadens
DDLNETQTV

SEQ ID NO: 2749464 - protein, 5 aa, Entamoeba invadens
DDLSD

SEQ ID NO: 2749465 - protein, 13 aa, Entamoeba invadens
DDMAEKVRNAKDM

SEQ ID NO: 2749466 - protein, 8 aa, Entamoeba invadens
DDMPKTKG

SEQ ID NO: 2749467 - protein, 17 aa, Entamoeba invadens
DDMRECSTETEKCLENG

SEQ ID NO: 2749468 - protein, 17 aa, Entamoeba invadens
DDMTEAKQLTTREKNKP

SEQ ID NO: 2749469 - protein, 9 aa, Entamoeba invadens
DDNEKETAK

SEQ ID NO: 2749470 - protein, 8 aa, Entamoeba invadens
DDNEMTEL

SEQ ID NO: 2749471 - protein, 15 aa, Entamoeba invadens
DDNENNDIPVGKETR

SEQ ID NO: 2749472 - protein, 14 aa, Entamoeba invadens
DDNESSDIPVGQET

SEQ ID NO: 2749473 - protein, 9 aa, Entamoeba invadens
DDNGNPTDT

SEQ ID NO: 2749474 - protein, 7 aa, Entamoeba invadens
DDNKWTT

SEQ ID NO: 2749475 - protein, 4 aa, Entamoeba invadens
DDNL

SEQ ID NO: 2749476 - protein, 5 aa, Entamoeba invadens
DDNNI

SEQ ID NO: 2749477 - protein, 9 aa, Entamoeba invadens
DDNNKALSW

SEQ ID NO: 2749478 - protein, 9 aa, Entamoeba invadens
DDNNKETAK

SEQ ID NO: 2749479 - protein, 7 aa, Entamoeba invadens
DDNNPIP

SEQ ID NO: 2749480 - protein, 7 aa, Entamoeba invadens
DDNNTCS

SEQ ID NO: 2749481 - protein, 7 aa, Entamoeba invadens
DDNPDTM

SEQ ID NO: 2749482 - protein, 11 aa, Entamoeba invadens
DDNPIPVDEET

SEQ ID NO: 2749483 - protein, 16 aa, Entamoeba invadens
DDNPSSSKSESESSDD

SEQ ID NO: 2749484 - protein, 5 aa, Entamoeba invadens
DDNQC

SEQ ID NO: 2749485 - protein, 7 aa, Entamoeba invadens
DDNRTAW

SEQ ID NO: 2749486 - protein, 13 aa, Entamoeba invadens
DDNTNCSYQNEKG

SEQ ID NO: 2749487 - protein, 6 aa, Entamoeba invadens
DDNTTS

SEQ ID NO: 2749488 - protein, 7 aa, Entamoeba invadens
DDPIKRP

SEQ ID NO: 2749489 - protein, 7 aa, Entamoeba invadens
DDPKEIQ

SEQ ID NO: 2749490 - protein, 6 aa, Entamoeba invadens
DDPPDK

SEQ ID NO: 2749491 - protein, 5 aa, Entamoeba invadens
DDPPI

SEQ ID NO: 2749492 - protein, 6 aa, Entamoeba invadens
DDPPNK

SEQ ID NO: 2749493 - protein, 11 aa, Entamoeba invadens
DDPQSNNSNRA

SEQ ID NO: 2749494 - protein, 11 aa, Entamoeba invadens
DDPVKVGAESR

SEQ ID NO: 2749495 - protein, 7 aa, Entamoeba invadens
DDQGIER

SEQ ID NO: 2749496 - protein, 4 aa, Entamoeba invadens
DDQI

SEQ ID NO: 2749497 - protein, 9 aa, Entamoeba invadens
DDQKKRPSI

SEQ ID NO: 2749498 - protein, 6 aa, Entamoeba invadens
DDQKTK

SEQ ID NO: 2749499 - protein, 9 aa, Entamoeba invadens
DDQSPSNVE

SEQ ID NO: 2749500 - protein, 6 aa, Entamoeba invadens
DDQTRD

SEQ ID NO: 2749501 - protein, 23 aa, Entamoeba invadens
DDRANESEATAKDETPIVTTNSK

SEQ ID NO: 2749502 - protein, 10 aa, Entamoeba invadens
DDRDYPADTI

SEQ ID NO: 2749503 - protein, 12 aa, Entamoeba invadens
DDREKDVQQTNK

SEQ ID NO: 2749504 - protein, 8 aa, Entamoeba invadens
DDRENLSP

SEQ ID NO: 2749505 - protein, 4 aa, Entamoeba invadens
DDRI

SEQ ID NO: 2749506 - protein, 10 aa, Entamoeba invadens
DDRNGGNHQI

SEQ ID NO: 2749507 - protein, 6 aa, Entamoeba invadens
DDRNND

SEQ ID NO: 2749508 - protein, 26 aa, Entamoeba invadens
DDRNYPSASELKNEYSESYSVSEDYS

SEQ ID NO: 2749509 - protein, 5 aa, Entamoeba invadens
DDRTY

SEQ ID NO: 2749510 - protein, 9 aa, Entamoeba invadens
DDRYKDTTG

SEQ ID NO: 2749511 - protein, 12 aa, Entamoeba invadens
DDSAIPVDSETR

SEQ ID NO: 2749512 - protein, 14 aa, Entamoeba invadens
DDSCGGSCDGATGY

SEQ ID NO: 2749513 - protein, 14 aa, Entamoeba invadens
DDSCGGSCDGNNGN

SEQ ID NO: 2749514 - protein, 14 aa, Entamoeba invadens
DDSCSEKQCNKDSG

SEQ ID NO: 2749515 - protein, 8 aa, Entamoeba invadens
DDSDNCDN

SEQ ID NO: 2749516 - protein, 7 aa, Entamoeba invadens
DDSDPNF

SEQ ID NO: 2749517 - protein, 7 aa, Entamoeba invadens
DDSDTKE

SEQ ID NO: 2749518 - protein, 7 aa, Entamoeba invadens
DDSDVQL

SEQ ID NO: 2749519 - protein, 6 aa, Entamoeba invadens
DDSETL

SEQ ID NO: 2749520 - protein, 6 aa, Entamoeba invadens
DDSGNI

SEQ ID NO: 2749521 - protein, 7 aa, Entamoeba invadens
DDSIDNK

SEQ ID NO: 2749522 - protein, 5 aa, Entamoeba invadens
DDSIN

SEQ ID NO: 2749523 - protein, 29 aa, Entamoeba invadens
DDSIQNSLDNSSSSSQQKCATGEYLDTET

SEQ ID NO: 2749524 - protein, 9 aa, Entamoeba invadens
DDSKCTKCD

SEQ ID NO: 2749525 - protein, 6 aa, Entamoeba invadens
DDSKTN

SEQ ID NO: 2749526 - protein, 18 aa, Entamoeba invadens
DDSKTPNAKLSDFGSSRN

SEQ ID NO: 2749527 - protein, 8 aa, Entamoeba invadens
DDSNESGF

SEQ ID NO: 2749528 - protein, 10 aa, Entamoeba invadens
DDSPSNQTEQ

SEQ ID NO: 2749529 - protein, 9 aa, Entamoeba invadens
DDSPSQATK

SEQ ID NO: 2749530 - protein, 5 aa, Entamoeba invadens
DDSRE

SEQ ID NO: 2749531 - protein, 4 aa, Entamoeba invadens
DDSS

SEQ ID NO: 2749532 - protein, 7 aa, Entamoeba invadens
DDSSASV

SEQ ID NO: 2749533 - protein, 40 aa, Entamoeba invadens
DDSSHTQSSENSKVPTESSSESTSKSSATPSTSESSEEPA

SEQ ID NO: 2749534 - protein, 11 aa, Entamoeba invadens
DDSSIPVDEET

SEQ ID NO: 2749535 - protein, 12 aa, Entamoeba invadens
DDSSIPVDEETR

SEQ ID NO: 2749536 - protein, 13 aa, Entamoeba invadens
DDSSNFSTTIPDG

SEQ ID NO: 2749537 - protein, 9 aa, Entamoeba invadens
DDSSTAISN

SEQ ID NO: 2749538 - protein, 9 aa, Entamoeba invadens
DDSTCTSCT

SEQ ID NO: 2749539 - protein, 9 aa, Entamoeba invadens
DDSTHTARN

SEQ ID NO: 2749540 - protein, 13 aa, Entamoeba invadens
DDSTTEVEEKSNE

SEQ ID NO: 2749541 - protein, 29 aa, Entamoeba invadens
DDSTYDSKKLSKREKHTLDSRVNKNKRSV

SEQ ID NO: 2749542 - protein, 10 aa, Entamoeba invadens
DDSYNQCGSS

SEQ ID NO: 2749543 - protein, 8 aa, Entamoeba invadens
DDTCGGKC

SEQ ID NO: 2749544 - protein, 13 aa, Entamoeba invadens
DDTCGNKCDQQYG

SEQ ID NO: 2749545 - protein, 7 aa, Entamoeba invadens
DDTDDKK

SEQ ID NO: 2749546 - protein, 7 aa, Entamoeba invadens
DDTEDRI

SEQ ID NO: 2749547 - protein, 5 aa, Entamoeba invadens
DDTIS

SEQ ID NO: 2749548 - protein, 8 aa, Entamoeba invadens
DDTKCTKC

SEQ ID NO: 2749549 - protein, 22 aa, Entamoeba invadens
DDTLSRTLEKGEFEAYPERDFE

SEQ ID NO: 2749550 - protein, 7 aa, Entamoeba invadens
DDTMYTP

SEQ ID NO: 2749551 - protein, 7 aa, Entamoeba invadens
DDTNEKV

SEQ ID NO: 2749552 - protein, 12 aa, Entamoeba invadens
DDTPRERREELS

SEQ ID NO: 2749553 - protein, 6 aa, Entamoeba invadens
DDTQHV

SEQ ID NO: 2749554 - protein, 6 aa, Entamoeba invadens
DDTQLV

SEQ ID NO: 2749555 - protein, 9 aa, Entamoeba invadens
DDTQQISDI

SEQ ID NO: 2749556 - protein, 6 aa, Entamoeba invadens
DDTQST

SEQ ID NO: 2749557 - protein, 10 aa, Entamoeba invadens
DDTRDTSVDK

SEQ ID NO: 2749558 - protein, 4 aa, Entamoeba invadens
DDTT

SEQ ID NO: 2749559 - protein, 8 aa, Entamoeba invadens
DDTTISTS

SEQ ID NO: 2749560 - protein, 9 aa, Entamoeba invadens
DDTTKSTSL

SEQ ID NO: 2749561 - protein, 7 aa, Entamoeba invadens
DDTTPEN

SEQ ID NO: 2749562 - protein, 5 aa, Entamoeba invadens
DDTTQ

SEQ ID NO: 2749563 - protein, 6 aa, Entamoeba invadens
DDTTSD

SEQ ID NO: 2749564 - protein, 11 aa, Entamoeba invadens
DDTYGRSLSGT

SEQ ID NO: 2749565 - protein, 12 aa, Entamoeba invadens
DDTYKDDIPEPI

SEQ ID NO: 2749566 - protein, 18 aa, Entamoeba invadens
DDVFENSKKAKILTENGT

SEQ ID NO: 2749567 - protein, 5 aa, Entamoeba invadens
DDVNA

SEQ ID NO: 2749568 - protein, 5 aa, Entamoeba invadens
DDVNQ

SEQ ID NO: 2749569 - protein, 6 aa, Entamoeba invadens
DDVPTN

SEQ ID NO: 2749570 - protein, 14 aa, Entamoeba invadens
DDVSNHTDLDSGYT

SEQ ID NO: 2749571 - protein, 7 aa, Entamoeba invadens
DDVTYTR

SEQ ID NO: 2749572 - protein, 5 aa, Entamoeba invadens
DDVVP

SEQ ID NO: 2749573 - protein, 9 aa, Entamoeba invadens
DDWDQDSQY

SEQ ID NO: 2749574 - protein, 11 aa, Entamoeba invadens
DDYGSGNYQKC

SEQ ID NO: 2749575 - protein, 7 aa, Entamoeba invadens
DDYNNNM

SEQ ID NO: 2749576 - protein, 6 aa, Entamoeba invadens
DDYTQE

SEQ ID NO: 2749577 - protein, 6 aa, Entamoeba invadens
DDYYKT

SEQ ID NO: 2749578 - protein, 9 aa, Entamoeba invadens
DDYYNTNGK

SEQ ID NO: 2749579 - protein, 7 aa, Entamoeba invadens
DEAEKFC

SEQ ID NO: 2749580 - protein, 6 aa, Entamoeba invadens
DEAFEK

SEQ ID NO: 2749581 - protein, 11 aa, Entamoeba invadens
DEAGDAVDPVD

SEQ ID NO: 2749582 - protein, 9 aa, Entamoeba invadens
DEAKTMGGT

SEQ ID NO: 2749583 - protein, 9 aa, Entamoeba invadens
DEASKKVGV

SEQ ID NO: 2749584 - protein, 5 aa, Entamoeba invadens
DEATH

SEQ ID NO: 2749585 - protein, 10 aa, Entamoeba invadens
DEATKENLTQ

SEQ ID NO: 2749586 - protein, 13 aa, Entamoeba invadens
DEATKSGSRKHSA

SEQ ID NO: 2749587 - protein, 18 aa, Entamoeba invadens
DECDEDNCTKCQDGYGVN

SEQ ID NO: 2749588 - protein, 18 aa, Entamoeba invadens
DECDEDSCTKCQDGYGVN

SEQ ID NO: 2749589 - protein, 7 aa, Entamoeba invadens
DECGPDI

SEQ ID NO: 2749590 - protein, 10 aa, Entamoeba invadens
DECKNTKEGE

SEQ ID NO: 2749591 - protein, 10 aa, Entamoeba invadens
DECKSCDPIN

SEQ ID NO: 2749592 - protein, 13 aa, Entamoeba invadens
DECKTRKYKTDTM

SEQ ID NO: 2749593 - protein, 9 aa, Entamoeba invadens
DECPKRENG

SEQ ID NO: 2749594 - protein, 6 aa, Entamoeba invadens
DECPQC

SEQ ID NO: 2749595 - protein, 4 aa, Entamoeba invadens
DECQ

SEQ ID NO: 2749596 - protein, 13 aa, Entamoeba invadens
DECSKDDTCDKCS

SEQ ID NO: 2749597 - protein, 7 aa, Entamoeba invadens
DECSQDN

SEQ ID NO: 2749598 - protein, 6 aa, Entamoeba invadens
DECSSN

SEQ ID NO: 2749599 - protein, 8 aa, Entamoeba invadens
DEDCMPSR

SEQ ID NO: 2749600 - protein, 9 aa, Entamoeba invadens
DEDDQGIVG

SEQ ID NO: 2749601 - protein, 5 aa, Entamoeba invadens
DEDKG

SEQ ID NO: 2749602 - protein, 4 aa, Entamoeba invadens
DEDL

SEQ ID NO: 2749603 - protein, 14 aa, Entamoeba invadens
DEDLSSSDESDIEL

SEQ ID NO: 2749604 - protein, 6 aa, Entamoeba invadens
DEDNTF

SEQ ID NO: 2749605 - protein, 6 aa, Entamoeba invadens
DEDQRE

SEQ ID NO: 2749606 - protein, 9 aa, Entamoeba invadens
DEDRTSDFK

SEQ ID NO: 2749607 - protein, 12 aa, Entamoeba invadens
DEDSSVISSTSK

SEQ ID NO: 2749608 - protein, 10 aa, Entamoeba invadens
DEDSSVVSST

SEQ ID NO: 2749609 - protein, 12 aa, Entamoeba invadens
DEDSSVVSSTNK

SEQ ID NO: 2749610 - protein, 7 aa, Entamoeba invadens
DEDSVDK

SEQ ID NO: 2749611 - protein, 6 aa, Entamoeba invadens
DEDTNN

SEQ ID NO: 2749612 - protein, 7 aa, Entamoeba invadens
DEDYTKF

SEQ ID NO: 2749613 - protein, 6 aa, Entamoeba invadens
DEEDRY

SEQ ID NO: 2749614 - protein, 12 aa, Entamoeba invadens
DEEEKPSLVFID

SEQ ID NO: 2749615 - protein, 13 aa, Entamoeba invadens
DEEENQSAPPLED

SEQ ID NO: 2749616 - protein, 7 aa, Entamoeba invadens
DEEESTL

SEQ ID NO: 2749617 - protein, 8 aa, Entamoeba invadens
DEEEVSEL

SEQ ID NO: 2749618 - protein, 4 aa, Entamoeba invadens
DEEF

SEQ ID NO: 2749619 - protein, 27 aa, Entamoeba invadens
DEEGDYEIDDGKFGKIEKDDSKSNDAT

SEQ ID NO: 2749620 - protein, 5 aa, Entamoeba invadens
DEEGE

SEQ ID NO: 2749621 - protein, 8 aa, Entamoeba invadens
DEEHPQGD

SEQ ID NO: 2749622 - protein, 4 aa, Entamoeba invadens
DEEI

SEQ ID NO: 2749623 - protein, 7 aa, Entamoeba invadens
DEEIGGN

SEQ ID NO: 2749624 - protein, 4 aa, Entamoeba invadens
DEEM

SEQ ID NO: 2749625 - protein, 5 aa, Entamoeba invadens
DEEMS

SEQ ID NO: 2749626 - protein, 5 aa, Entamoeba invadens
DEENC

SEQ ID NO: 2749627 - protein, 8 aa, Entamoeba invadens
DEENIDES

SEQ ID NO: 2749628 - protein, 14 aa, Entamoeba invadens
DEENIPVGKENEET

SEQ ID NO: 2749629 - protein, 8 aa, Entamoeba invadens
DEENLEGT

SEQ ID NO: 2749630 - protein, 8 aa, Entamoeba invadens
DEENPTLQ

SEQ ID NO: 2749631 - protein, 7 aa, Entamoeba invadens
DEENSSV

SEQ ID NO: 2749632 - protein, 5 aa, Entamoeba invadens
DEERV

SEQ ID NO: 2749633 - protein, 10 aa, Entamoeba invadens
DEESPMPKVS

SEQ ID NO: 2749634 - protein, 11 aa, Entamoeba invadens
DEESRDYNCTT

SEQ ID NO: 2749635 - protein, 14 aa, Entamoeba invadens
DEESSSSSSSTREE

SEQ ID NO: 2749636 - protein, 7 aa, Entamoeba invadens
DEESTNL

SEQ ID NO: 2749637 - protein, 5 aa, Entamoeba invadens
DEETR

SEQ ID NO: 2749638 - protein, 9 aa, Entamoeba invadens
DEEVVRDDD

SEQ ID NO: 2749639 - protein, 4 aa, Entamoeba invadens
DEEY

SEQ ID NO: 2749640 - protein, 4 aa, Entamoeba invadens
DEFD

SEQ ID NO: 2749641 - protein, 5 aa, Entamoeba invadens
DEFSS

SEQ ID NO: 2749642 - protein, 4 aa, Entamoeba invadens
DEFT

SEQ ID NO: 2749643 - protein, 11 aa, Entamoeba invadens
DEGDKTKQKEF

SEQ ID NO: 2749644 - protein, 5 aa, Entamoeba invadens
DEGEE

SEQ ID NO: 2749645 - protein, 7 aa, Entamoeba invadens
DEGLDTK

SEQ ID NO: 2749646 - protein, 11 aa, Entamoeba invadens
DEGQCDPEHEG

SEQ ID NO: 2749647 - protein, 9 aa, Entamoeba invadens
DEGQEKSNT

SEQ ID NO: 2749648 - protein, 6 aa, Entamoeba invadens
DEGQYL

SEQ ID NO: 2749649 - protein, 13 aa, Entamoeba invadens
DEGTGKSFNANTD

SEQ ID NO: 2749650 - protein, 13 aa, Entamoeba invadens
DEGTVDDQAFREN

SEQ ID NO: 2749651 - protein, 4 aa, Entamoeba invadens
DEGY

SEQ ID NO: 2749652 - protein, 11 aa, Entamoeba invadens
DEGYKEEEIEP

SEQ ID NO: 2749653 - protein, 9 aa, Entamoeba invadens
DEHQTTEEC

SEQ ID NO: 2749654 - protein, 12 aa, Entamoeba invadens
DEHTRSPGITET

SEQ ID NO: 2749655 - protein, 5 aa, Entamoeba invadens
DEIDN

SEQ ID NO: 2749656 - protein, 6 aa, Entamoeba invadens
DEIELP

SEQ ID NO: 2749657 - protein, 15 aa, Entamoeba invadens
DEIENAPKKDGDKIK

SEQ ID NO: 2749658 - protein, 6 aa, Entamoeba invadens
DEIENS

SEQ ID NO: 2749659 - protein, 5 aa, Entamoeba invadens
DEIER

SEQ ID NO: 2749660 - protein, 22 aa, Entamoeba invadens
DEIGESYDKEDDSLNEHDKSKF

SEQ ID NO: 2749661 - protein, 4 aa, Entamoeba invadens
DEIN

SEQ ID NO: 2749662 - protein, 13 aa, Entamoeba invadens
DEINKDKKVGEGS

SEQ ID NO: 2749663 - protein, 13 aa, Entamoeba invadens
DEINSKLTDFGSA

SEQ ID NO: 2749664 - protein, 8 aa, Entamoeba invadens
DEIQAAKS

SEQ ID NO: 2749665 - protein, 17 aa, Entamoeba invadens
DEITKNRDAEENGYKEI

SEQ ID NO: 2749666 - protein, 4 aa, Entamoeba invadens
DEKA

SEQ ID NO: 2749667 - protein, 18 aa, Entamoeba invadens
DEKAGISDETISQRVQQY

SEQ ID NO: 2749668 - protein, 19 aa, Entamoeba invadens
DEKCKEEIKRDKIQDCNTC

SEQ ID NO: 2749669 - protein, 5 aa, Entamoeba invadens
DEKDE

SEQ ID NO: 2749670 - protein, 5 aa, Entamoeba invadens
DEKDV

SEQ ID NO: 2749671 - protein, 4 aa, Entamoeba invadens
DEKE

SEQ ID NO: 2749672 - protein, 9 aa, Entamoeba invadens
DEKENGFKK

SEQ ID NO: 2749673 - protein, 10 aa, Entamoeba invadens
DEKETDVETG

SEQ ID NO: 2749674 - protein, 4 aa, Entamoeba invadens
DEKF

SEQ ID NO: 2749675 - protein, 10 aa, Entamoeba invadens
DEKIKQSSMS

SEQ ID NO: 2749676 - protein, 8 aa, Entamoeba invadens
DEKLGEGS

SEQ ID NO: 2749677 - protein, 8 aa, Entamoeba invadens
DEKNSKLK

SEQ ID NO: 2749678 - protein, 12 aa, Entamoeba invadens
DEKNTEKKHNTK

SEQ ID NO: 2749679 - protein, 4 aa, Entamoeba invadens
DEKR

SEQ ID NO: 2749680 - protein, 7 aa, Entamoeba invadens
DEKRALR

SEQ ID NO: 2749681 - protein, 5 aa, Entamoeba invadens
DEKRE

SEQ ID NO: 2749682 - protein, 4 aa, Entamoeba invadens
DEKS

SEQ ID NO: 2749683 - protein, 9 aa, Entamoeba invadens
DEKSERTAT

SEQ ID NO: 2749684 - protein, 11 aa, Entamoeba invadens
DEKSKNCVPGN

SEQ ID NO: 2749685 - protein, 5 aa, Entamoeba invadens
DEKSN

SEQ ID NO: 2749686 - protein, 8 aa, Entamoeba invadens
DEKSTDVS

SEQ ID NO: 2749687 - protein, 9 aa, Entamoeba invadens
DEKSVPNQK

SEQ ID NO: 2749688 - protein, 5 aa, Entamoeba invadens
DEKVD

SEQ ID NO: 2749689 - protein, 15 aa, Entamoeba invadens
DEKVESRSETIEKER

SEQ ID NO: 2749690 - protein, 8 aa, Entamoeba invadens
DEKVTHAD

SEQ ID NO: 2749691 - protein, 9 aa, Entamoeba invadens
DEKYYNGRP

SEQ ID NO: 2749692 - protein, 14 aa, Entamoeba invadens
DELEAAKKRVEDGV

SEQ ID NO: 2749693 - protein, 6 aa, Entamoeba invadens
DELKTG

SEQ ID NO: 2749694 - protein, 20 aa, Entamoeba invadens
DELKTRVEEISKTANINNEK

SEQ ID NO: 2749695 - protein, 13 aa, Entamoeba invadens
DELNEEKKLGEGS

SEQ ID NO: 2749696 - protein, 15 aa, Entamoeba invadens
DELNESGGKRKFGDV

SEQ ID NO: 2749697 - protein, 6 aa, Entamoeba invadens
DELPTP

SEQ ID NO: 2749698 - protein, 8 aa, Entamoeba invadens
DELQDNVQ

SEQ ID NO: 2749699 - protein, 13 aa, Entamoeba invadens
DELSEDKKIGEGS

SEQ ID NO: 2749700 - protein, 5 aa, Entamoeba invadens
DELTD

SEQ ID NO: 2749701 - protein, 13 aa, Entamoeba invadens
DELTEDKKLGEGS

SEQ ID NO: 2749702 - protein, 17 aa, Entamoeba invadens
DELTETTQTLENSGDLK

SEQ ID NO: 2749703 - protein, 9 aa, Entamoeba invadens
DEMKTSGNG

SEQ ID NO: 2749704 - protein, 5 aa, Entamoeba invadens
DEMTQ

SEQ ID NO: 2749705 - protein, 4 aa, Entamoeba invadens
DEMY

SEQ ID NO: 2749706 - protein, 4 aa, Entamoeba invadens
DENA

SEQ ID NO: 2749707 - protein, 5 aa, Entamoeba invadens
DENAL

SEQ ID NO: 2749708 - protein, 4 aa, Entamoeba invadens
DENC

SEQ ID NO: 2749709 - protein, 9 aa, Entamoeba invadens
DENCETCSQ

SEQ ID NO: 2749710 - protein, 9 aa, Entamoeba invadens
DENCKSNIK

SEQ ID NO: 2749711 - protein, 5 aa, Entamoeba invadens
DENCP

SEQ ID NO: 2749712 - protein, 7 aa, Entamoeba invadens
DENDLSQ

SEQ ID NO: 2749713 - protein, 9 aa, Entamoeba invadens
DENDTANTL

SEQ ID NO: 2749714 - protein, 10 aa, Entamoeba invadens
DENEEEPKID

SEQ ID NO: 2749715 - protein, 11 aa, Entamoeba invadens
DENENAAPDYM

SEQ ID NO: 2749716 - protein, 5 aa, Entamoeba invadens
DENEY

SEQ ID NO: 2749717 - protein, 8 aa, Entamoeba invadens
DENEYQGE

SEQ ID NO: 2749718 - protein, 4 aa, Entamoeba invadens
DENF

SEQ ID NO: 2749719 - protein, 14 aa, Entamoeba invadens
DENGDEQCSISESS

SEQ ID NO: 2749720 - protein, 17 aa, Entamoeba invadens
DENGSFAPNKDDLKKAP

SEQ ID NO: 2749721 - protein, 6 aa, Entamoeba invadens
DENHTT

SEQ ID NO: 2749722 - protein, 6 aa, Entamoeba invadens
DENKLN

SEQ ID NO: 2749723 - protein, 8 aa, Entamoeba invadens
DENKNTRL

SEQ ID NO: 2749724 - protein, 16 aa, Entamoeba invadens
DENKQIENKNHYQKTS

SEQ ID NO: 2749725 - protein, 4 aa, Entamoeba invadens
DENL

SEQ ID NO: 2749726 - protein, 8 aa, Entamoeba invadens
DENNCKTC

SEQ ID NO: 2749727 - protein, 6 aa, Entamoeba invadens
DENNGT

SEQ ID NO: 2749728 - protein, 14 aa, Entamoeba invadens
DENNIKIENESQQY

SEQ ID NO: 2749729 - protein, 9 aa, Entamoeba invadens
DENNKETAK

SEQ ID NO: 2749730 - protein, 17 aa, Entamoeba invadens
DENSEQDDEIKNEENKI

SEQ ID NO: 2749731 - protein, 8 aa, Entamoeba invadens
DENSMDEF

SEQ ID NO: 2749732 - protein, 10 aa, Entamoeba invadens
DENTCTSCKT

SEQ ID NO: 2749733 - protein, 6 aa, Entamoeba invadens
DENTEQ

SEQ ID NO: 2749734 - protein, 16 aa, Entamoeba invadens
DENTKLVNENRISSTI

SEQ ID NO: 2749735 - protein, 5 aa, Entamoeba invadens
DENTN

SEQ ID NO: 2749736 - protein, 36 aa, Entamoeba invadens
DENVDPFGVNSSDKFDPFAKQPNDPFNIPPPTHPTI

SEQ ID NO: 2749737 - protein, 13 aa, Entamoeba invadens
DENVELTSTDNQI

SEQ ID NO: 2749738 - protein, 8 aa, Entamoeba invadens
DENVTTQE

SEQ ID NO: 2749739 - protein, 7 aa, Entamoeba invadens
DEPDIEK

SEQ ID NO: 2749740 - protein, 15 aa, Entamoeba invadens
DEPETQNWSTTPSSI

SEQ ID NO: 2749741 - protein, 4 aa, Entamoeba invadens
DEPF

SEQ ID NO: 2749742 - protein, 7 aa, Entamoeba invadens
DEPGASC

SEQ ID NO: 2749743 - protein, 8 aa, Entamoeba invadens
DEPKVGRS

SEQ ID NO: 2749744 - protein, 134 aa, Entamoeba invadens
DEPSETPSESSEQSLSSSTVISSGSPSPSSDEQSDASRQSTDSNNSSDEESSSQSGEDSSSSQSTSSDGSESVSSSNSQESSNDLDNSSVTSNNSNESKSSGDSSEESEYSNNTSSDNIESSDNTHNGLSGGAI

SEQ ID NO: 2749745 - protein, 11 aa, Entamoeba invadens
DEPVKVGADSR

SEQ ID NO: 2749746 - protein, 4 aa, Entamoeba invadens
DEPY

SEQ ID NO: 2749747 - protein, 4 aa, Entamoeba invadens
DEQE

SEQ ID NO: 2749748 - protein, 6 aa, Entamoeba invadens
DEQKCA

SEQ ID NO: 2749749 - protein, 17 aa, Entamoeba invadens
DEQKKKSTDDLSALAEK

SEQ ID NO: 2749750 - protein, 11 aa, Entamoeba invadens
DEQNENKRNSH

SEQ ID NO: 2749751 - protein, 20 aa, Entamoeba invadens
DEQRSLATDRRLKSAADKMK

SEQ ID NO: 2749752 - protein, 20 aa, Entamoeba invadens
DEQTKKWKAVKNKGTIGTSY

SEQ ID NO: 2749753 - protein, 7 aa, Entamoeba invadens
DEQTNGV

SEQ ID NO: 2749754 - protein, 13 aa, Entamoeba invadens
DEQTSGDENSEGL

SEQ ID NO: 2749755 - protein, 8 aa, Entamoeba invadens
DERDFTRK

SEQ ID NO: 2749756 - protein, 5 aa, Entamoeba invadens
DERDV

SEQ ID NO: 2749757 - protein, 10 aa, Entamoeba invadens
DEREDRPQAT

SEQ ID NO: 2749758 - protein, 12 aa, Entamoeba invadens
DERITARSKALS

SEQ ID NO: 2749759 - protein, 9 aa, Entamoeba invadens
DERKKAASM

SEQ ID NO: 2749760 - protein, 30 aa, Entamoeba invadens
DERKTSSDRQSDKTRNEYDYTDYPAESEMC

SEQ ID NO: 2749761 - protein, 5 aa, Entamoeba invadens
DERND

SEQ ID NO: 2749762 - protein, 7 aa, Entamoeba invadens
DERSDIE

SEQ ID NO: 2749763 - protein, 8 aa, Entamoeba invadens
DERSSENL

SEQ ID NO: 2749764 - protein, 4 aa, Entamoeba invadens
DERY

SEQ ID NO: 2749765 - protein, 14 aa, Entamoeba invadens
DESCNAQCNTTNGY

SEQ ID NO: 2749766 - protein, 11 aa, Entamoeba invadens
DESDMTGEPIA

SEQ ID NO: 2749767 - protein, 5 aa, Entamoeba invadens
DESEE

SEQ ID NO: 2749768 - protein, 9 aa, Entamoeba invadens
DESENPLNV

SEQ ID NO: 2749769 - protein, 4 aa, Entamoeba invadens
DESF

SEQ ID NO: 2749770 - protein, 4 aa, Entamoeba invadens
DESG

SEQ ID NO: 2749771 - protein, 7 aa, Entamoeba invadens
DESIDVR

SEQ ID NO: 2749772 - protein, 6 aa, Entamoeba invadens
DESKCY

SEQ ID NO: 2749773 - protein, 5 aa, Entamoeba invadens
DESKN

SEQ ID NO: 2749774 - protein, 8 aa, Entamoeba invadens
DESMPSDY

SEQ ID NO: 2749775 - protein, 6 aa, Entamoeba invadens
DESNAS

SEQ ID NO: 2749776 - protein, 7 aa, Entamoeba invadens
DESNTQI

SEQ ID NO: 2749777 - protein, 8 aa, Entamoeba invadens
DESRKNVV

SEQ ID NO: 2749778 - protein, 5 aa, Entamoeba invadens
DESSK

SEQ ID NO: 2749779 - protein, 11 aa, Entamoeba invadens
DESTKQCEGCD

SEQ ID NO: 2749780 - protein, 6 aa, Entamoeba invadens
DETANM

SEQ ID NO: 2749781 - protein, 4 aa, Entamoeba invadens
DETC

SEQ ID NO: 2749782 - protein, 11 aa, Entamoeba invadens
DETCGNNCDQQ

SEQ ID NO: 2749783 - protein, 9 aa, Entamoeba invadens
DETCKSCDK

SEQ ID NO: 2749784 - protein, 8 aa, Entamoeba invadens
DETENVEG

SEQ ID NO: 2749785 - protein, 8 aa, Entamoeba invadens
DETETSKL

SEQ ID NO: 2749786 - protein, 5 aa, Entamoeba invadens
DETFG

SEQ ID NO: 2749787 - protein, 10 aa, Entamoeba invadens
DETGKTSGIY

SEQ ID NO: 2749788 - protein, 13 aa, Entamoeba invadens
DETIEDPVESNGN

SEQ ID NO: 2749789 - protein, 5 aa, Entamoeba invadens
DETIK

SEQ ID NO: 2749790 - protein, 7 aa, Entamoeba invadens
DETKMTT

SEQ ID NO: 2749791 - protein, 7 aa, Entamoeba invadens
DETKSSK

SEQ ID NO: 2749792 - protein, 6 aa, Entamoeba invadens
DETNGD

SEQ ID NO: 2749793 - protein, 7 aa, Entamoeba invadens
DETNNNA

SEQ ID NO: 2749794 - protein, 10 aa, Entamoeba invadens
DETNNSKIKG

SEQ ID NO: 2749795 - protein, 6 aa, Entamoeba invadens
DETNNT

SEQ ID NO: 2749796 - protein, 7 aa, Entamoeba invadens
DETPECG

SEQ ID NO: 2749797 - protein, 6 aa, Entamoeba invadens
DETPMV

SEQ ID NO: 2749798 - protein, 24 aa, Entamoeba invadens
DETRNQMNDRKNEESGVEARPPSF

SEQ ID NO: 2749799 - protein, 7 aa, Entamoeba invadens
DETSGTC

SEQ ID NO: 2749800 - protein, 8 aa, Entamoeba invadens
DETSHYPD

SEQ ID NO: 2749801 - protein, 7 aa, Entamoeba invadens
DETSTIE

SEQ ID NO: 2749802 - protein, 8 aa, Entamoeba invadens
DETSYKNG

SEQ ID NO: 2749803 - protein, 8 aa, Entamoeba invadens
DETTADNT

SEQ ID NO: 2749804 - protein, 7 aa, Entamoeba invadens
DETTIPG

SEQ ID NO: 2749805 - protein, 14 aa, Entamoeba invadens
DETTNGECSSCDTN

SEQ ID NO: 2749806 - protein, 14 aa, Entamoeba invadens
DETTNGECSSCNTN

SEQ ID NO: 2749807 - protein, 5 aa, Entamoeba invadens
DETTT

SEQ ID NO: 2749808 - protein, 6 aa, Entamoeba invadens
DETTTY

SEQ ID NO: 2749809 - protein, 8 aa, Entamoeba invadens
DEVDTDKG

SEQ ID NO: 2749810 - protein, 8 aa, Entamoeba invadens
DEVENGED

SEQ ID NO: 2749811 - protein, 17 aa, Entamoeba invadens
DEVNGKLTDFGASRNVD

SEQ ID NO: 2749812 - protein, 8 aa, Entamoeba invadens
DEVRNSES

SEQ ID NO: 2749813 - protein, 10 aa, Entamoeba invadens
DEVTEEVNGE

SEQ ID NO: 2749814 - protein, 7 aa, Entamoeba invadens
DEVTEQM

SEQ ID NO: 2749815 - protein, 7 aa, Entamoeba invadens
DEWDEAN

SEQ ID NO: 2749816 - protein, 5 aa, Entamoeba invadens
DEWYS

SEQ ID NO: 2749817 - protein, 9 aa, Entamoeba invadens
DEYAATKIG

SEQ ID NO: 2749818 - protein, 12 aa, Entamoeba invadens
DEYESESVRIGN

SEQ ID NO: 2749819 - protein, 7 aa, Entamoeba invadens
DEYGGDD

SEQ ID NO: 2749820 - protein, 11 aa, Entamoeba invadens
DEYGTTTEQKA

SEQ ID NO: 2749821 - protein, 7 aa, Entamoeba invadens
DEYSDYV

SEQ ID NO: 2749822 - protein, 9 aa, Entamoeba invadens
DEYSNESDV

SEQ ID NO: 2749823 - protein, 4 aa, Entamoeba invadens
DEYT

SEQ ID NO: 2749824 - protein, 8 aa, Entamoeba invadens
DEYTNAGD

SEQ ID NO: 2749825 - protein, 5 aa, Entamoeba invadens
DEYTT

SEQ ID NO: 2749826 - protein, 6 aa, Entamoeba invadens
DFAIEG

SEQ ID NO: 2749827 - protein, 6 aa, Entamoeba invadens
DFASSK

SEQ ID NO: 2749828 - protein, 5 aa, Entamoeba invadens
DFDSK

SEQ ID NO: 2749829 - protein, 15 aa, Entamoeba invadens
DFDSNCKNCSSNYTQ

SEQ ID NO: 2749830 - protein, 9 aa, Entamoeba invadens
DFEPSEGDV

SEQ ID NO: 2749831 - protein, 9 aa, Entamoeba invadens
DFESADGNL

SEQ ID NO: 2749832 - protein, 7 aa, Entamoeba invadens
DFESGTK

SEQ ID NO: 2749833 - protein, 4 aa, Entamoeba invadens
DFET

SEQ ID NO: 2749834 - protein, 5 aa, Entamoeba invadens
DFGAS

SEQ ID NO: 2749835 - protein, 14 aa, Entamoeba invadens
DFGERRPEIDEPCE

SEQ ID NO: 2749836 - protein, 7 aa, Entamoeba invadens
DFGFPST

SEQ ID NO: 2749837 - protein, 7 aa, Entamoeba invadens
DFGSSKS

SEQ ID NO: 2749838 - protein, 4 aa, Entamoeba invadens
DFGT

SEQ ID NO: 2749839 - protein, 6 aa, Entamoeba invadens
DFGTNY

SEQ ID NO: 2749840 - protein, 7 aa, Entamoeba invadens
DFGTSKN

SEQ ID NO: 2749841 - protein, 6 aa, Entamoeba invadens
DFGTSR

SEQ ID NO: 2749842 - protein, 12 aa, Entamoeba invadens
DFGTSRGVQEFE

SEQ ID NO: 2749843 - protein, 18 aa, Entamoeba invadens
DFGTTRDITEKSLKEHEL

SEQ ID NO: 2749844 - protein, 9 aa, Entamoeba invadens
DFKAQEQKA

SEQ ID NO: 2749845 - protein, 12 aa, Entamoeba invadens
DFKPNPTTHRGW

SEQ ID NO: 2749846 - protein, 4 aa, Entamoeba invadens
DFNA

SEQ ID NO: 2749847 - protein, 15 aa, Entamoeba invadens
DFNNEDDEIPVSEET

SEQ ID NO: 2749848 - protein, 13 aa, Entamoeba invadens
DFNSEEETIQGNV

SEQ ID NO: 2749849 - protein, 12 aa, Entamoeba invadens
DFNVGGNAVDRA

SEQ ID NO: 2749850 - protein, 4 aa, Entamoeba invadens
DFPT

SEQ ID NO: 2749851 - protein, 6 aa, Entamoeba invadens
DFPTLG

SEQ ID NO: 2749852 - protein, 11 aa, Entamoeba invadens
DFPTMNARKKN

SEQ ID NO: 2749853 - protein, 8 aa, Entamoeba invadens
DFQTSAPE

SEQ ID NO: 2749854 - protein, 11 aa, Entamoeba invadens
DFSAAEYSYSD

SEQ ID NO: 2749855 - protein, 5 aa, Entamoeba invadens
DFSAG

SEQ ID NO: 2749856 - protein, 37 aa, Entamoeba invadens
DFSAQQNQNILPPPSTNDEEKQPDDTKVPAEGEEQQE

SEQ ID NO: 2749857 - protein, 7 aa, Entamoeba invadens
DFSEKEY

SEQ ID NO: 2749858 - protein, 10 aa, Entamoeba invadens
DFSTKTDQNG

SEQ ID NO: 2749859 - protein, 6 aa, Entamoeba invadens
DFTENG

SEQ ID NO: 2749860 - protein, 9 aa, Entamoeba invadens
DFTGETSIK

SEQ ID NO: 2749861 - protein, 4 aa, Entamoeba invadens
DFTP

SEQ ID NO: 2749862 - protein, 7 aa, Entamoeba invadens
DFTRNQK

SEQ ID NO: 2749863 - protein, 5 aa, Entamoeba invadens
DFTVT

SEQ ID NO: 2749864 - protein, 7 aa, Entamoeba invadens
DGACTTN

SEQ ID NO: 2749865 - protein, 5 aa, Entamoeba invadens
DGAKG

SEQ ID NO: 2749866 - protein, 11 aa, Entamoeba invadens
DGAKQPEAAKS

SEQ ID NO: 2749867 - protein, 6 aa, Entamoeba invadens
DGANDV

SEQ ID NO: 2749868 - protein, 11 aa, Entamoeba invadens
DGARDKSKHFK

SEQ ID NO: 2749869 - protein, 5 aa, Entamoeba invadens
DGARG

SEQ ID NO: 2749870 - protein, 7 aa, Entamoeba invadens
DGATSSV

SEQ ID NO: 2749871 - protein, 8 aa, Entamoeba invadens
DGATVTTS

SEQ ID NO: 2749872 - protein, 9 aa, Entamoeba invadens
DGCASYDTE

SEQ ID NO: 2749873 - protein, 9 aa, Entamoeba invadens
DGCDATNGK

SEQ ID NO: 2749874 - protein, 8 aa, Entamoeba invadens
DGCDATTG

SEQ ID NO: 2749875 - protein, 5 aa, Entamoeba invadens
DGCES

SEQ ID NO: 2749876 - protein, 19 aa, Entamoeba invadens
DGCGNISEEVKEPKRTIPR

SEQ ID NO: 2749877 - protein, 10 aa, Entamoeba invadens
DGCGTEKKST

SEQ ID NO: 2749878 - protein, 5 aa, Entamoeba invadens
DGCIS

SEQ ID NO: 2749879 - protein, 5 aa, Entamoeba invadens
DGCKE

SEQ ID NO: 2749880 - protein, 9 aa, Entamoeba invadens
DGCKEKSGF

SEQ ID NO: 2749881 - protein, 10 aa, Entamoeba invadens
DGCKEKTGVL

SEQ ID NO: 2749882 - protein, 11 aa, Entamoeba invadens
DGCKTCSSSEL

SEQ ID NO: 2749883 - protein, 11 aa, Entamoeba invadens
DGCQDAQENYP

SEQ ID NO: 2749884 - protein, 9 aa, Entamoeba invadens
DGCQPSCGT

SEQ ID NO: 2749885 - protein, 15 aa, Entamoeba invadens
DGCTKCKSGYYKNGK

SEQ ID NO: 2749886 - protein, 15 aa, Entamoeba invadens
DGCTKCKSGYYKSGK

SEQ ID NO: 2749887 - protein, 5 aa, Entamoeba invadens
DGCTY

SEQ ID NO: 2749888 - protein, 10 aa, Entamoeba invadens
DGDDDDPSVA

SEQ ID NO: 2749889 - protein, 10 aa, Entamoeba invadens
DGDEKKASVH

SEQ ID NO: 2749890 - protein, 4 aa, Entamoeba invadens
DGDF

SEQ ID NO: 2749891 - protein, 5 aa, Entamoeba invadens
DGDGL

SEQ ID NO: 2749892 - protein, 5 aa, Entamoeba invadens
DGDLR

SEQ ID NO: 2749893 - protein, 5 aa, Entamoeba invadens
DGDTF

SEQ ID NO: 2749894 - protein, 5 aa, Entamoeba invadens
DGDTL

SEQ ID NO: 2749895 - protein, 4 aa, Entamoeba invadens
DGEC

SEQ ID NO: 2749896 - protein, 15 aa, Entamoeba invadens
DGECKHCPSEGKERC

SEQ ID NO: 2749897 - protein, 6 aa, Entamoeba invadens
DGECKK

SEQ ID NO: 2749898 - protein, 5 aa, Entamoeba invadens
DGEDF

SEQ ID NO: 2749899 - protein, 6 aa, Entamoeba invadens
DGEDVE

SEQ ID NO: 2749900 - protein, 10 aa, Entamoeba invadens
DGEEANVNEK

SEQ ID NO: 2749901 - protein, 12 aa, Entamoeba invadens
DGEEENEEGIKT

SEQ ID NO: 2749902 - protein, 72 aa, Entamoeba invadens
DGEELDVDNQKQDEEIKNEGNKTGDNKANEEKHNAIEAPVPSEIPLANDQKTTSVLEKTSESGSESGSGSKK

SEQ ID NO: 2749903 - protein, 4 aa, Entamoeba invadens
DGEI

SEQ ID NO: 2749904 - protein, 11 aa, Entamoeba invadens
DGEIDKGHYSA

SEQ ID NO: 2749905 - protein, 12 aa, Entamoeba invadens
DGEKEGSIGPKQ

SEQ ID NO: 2749906 - protein, 8 aa, Entamoeba invadens
DGEKFENL

SEQ ID NO: 2749907 - protein, 9 aa, Entamoeba invadens
DGEKPDKLR

SEQ ID NO: 2749908 - protein, 7 aa, Entamoeba invadens
DGEKQSW

SEQ ID NO: 2749909 - protein, 4 aa, Entamoeba invadens
DGEL

SEQ ID NO: 2749910 - protein, 4 aa, Entamoeba invadens
DGES

SEQ ID NO: 2749911 - protein, 8 aa, Entamoeba invadens
DGETQEIA

SEQ ID NO: 2749912 - protein, 5 aa, Entamoeba invadens
DGETT

SEQ ID NO: 2749913 - protein, 4 aa, Entamoeba invadens
DGEY

SEQ ID NO: 2749914 - protein, 9 aa, Entamoeba invadens
DGEYGECGD

SEQ ID NO: 2749915 - protein, 5 aa, Entamoeba invadens
DGEYI

SEQ ID NO: 2749916 - protein, 6 aa, Entamoeba invadens
DGEYRS

SEQ ID NO: 2749917 - protein, 6 aa, Entamoeba invadens
DGFDIS

SEQ ID NO: 2749918 - protein, 7 aa, Entamoeba invadens
DGFGGDD

SEQ ID NO: 2749919 - protein, 7 aa, Entamoeba invadens
DGFGGDN

SEQ ID NO: 2749920 - protein, 5 aa, Entamoeba invadens
DGFSL

SEQ ID NO: 2749921 - protein, 8 aa, Entamoeba invadens
DGFSNQPY

SEQ ID NO: 2749922 - protein, 4 aa, Entamoeba invadens
DGGD

SEQ ID NO: 2749923 - protein, 5 aa, Entamoeba invadens
DGGDY

SEQ ID NO: 2749924 - protein, 4 aa, Entamoeba invadens
DGGE

SEQ ID NO: 2749925 - protein, 4 aa, Entamoeba invadens
DGGL

SEQ ID NO: 2749926 - protein, 13 aa, Entamoeba invadens
DGGMGQGKTDDGE

SEQ ID NO: 2749927 - protein, 4 aa, Entamoeba invadens
DGGN

SEQ ID NO: 2749928 - protein, 13 aa, Entamoeba invadens
DGGRLSKPDTMSD

SEQ ID NO: 2749929 - protein, 8 aa, Entamoeba invadens
DGGRPQLS

SEQ ID NO: 2749930 - protein, 6 aa, Entamoeba invadens
DGGRVK

SEQ ID NO: 2749931 - protein, 16 aa, Entamoeba invadens
DGGSECAISDKEGEAY

SEQ ID NO: 2749932 - protein, 23 aa, Entamoeba invadens
DGGVDNSSVEKVDDVIDDQQNLL

SEQ ID NO: 2749933 - protein, 6 aa, Entamoeba invadens
DGHAND

SEQ ID NO: 2749934 - protein, 12 aa, Entamoeba invadens
DGHYSSPNGGEC

SEQ ID NO: 2749935 - protein, 9 aa, Entamoeba invadens
DGIDQGQCG

SEQ ID NO: 2749936 - protein, 7 aa, Entamoeba invadens
DGIQGYK

SEQ ID NO: 2749937 - protein, 11 aa, Entamoeba invadens
DGIRARSSGIC

SEQ ID NO: 2749938 - protein, 6 aa, Entamoeba invadens
DGISTK

SEQ ID NO: 2749939 - protein, 9 aa, Entamoeba invadens
DGKACETEI

SEQ ID NO: 2749940 - protein, 8 aa, Entamoeba invadens
DGKATLTK

SEQ ID NO: 2749941 - protein, 13 aa, Entamoeba invadens
DGKCDTCEAGTYS

SEQ ID NO: 2749942 - protein, 13 aa, Entamoeba invadens
DGKCEKRNDDAAK

SEQ ID NO: 2749943 - protein, 8 aa, Entamoeba invadens
DGKCNEVV

SEQ ID NO: 2749944 - protein, 8 aa, Entamoeba invadens
DGKCSKCK

SEQ ID NO: 2749945 - protein, 21 aa, Entamoeba invadens
DGKDANAGTLCNPRGDQNSAV

SEQ ID NO: 2749946 - protein, 6 aa, Entamoeba invadens
DGKDDE

SEQ ID NO: 2749947 - protein, 5 aa, Entamoeba invadens
DGKEK

SEQ ID NO: 2749948 - protein, 8 aa, Entamoeba invadens
DGKEKRDM

SEQ ID NO: 2749949 - protein, 6 aa, Entamoeba invadens
DGKELY

SEQ ID NO: 2749950 - protein, 9 aa, Entamoeba invadens
DGKHDEEYY

SEQ ID NO: 2749951 - protein, 8 aa, Entamoeba invadens
DGKLNPNI

SEQ ID NO: 2749952 - protein, 7 aa, Entamoeba invadens
DGKNESR

SEQ ID NO: 2749953 - protein, 8 aa, Entamoeba invadens
DGKNNNLG

SEQ ID NO: 2749954 - protein, 8 aa, Entamoeba invadens
DGKPVTTP

SEQ ID NO: 2749955 - protein, 15 aa, Entamoeba invadens
DGKQARKTGSGSPLG

SEQ ID NO: 2749956 - protein, 11 aa, Entamoeba invadens
DGKQKYSVERD

SEQ ID NO: 2749957 - protein, 11 aa, Entamoeba invadens
DGKQPKFNNGK

SEQ ID NO: 2749958 - protein, 4 aa, Entamoeba invadens
DGKR

SEQ ID NO: 2749959 - protein, 9 aa, Entamoeba invadens
DGKSCNTEG

SEQ ID NO: 2749960 - protein, 11 aa, Entamoeba invadens
DGKSDVASSEI

SEQ ID NO: 2749961 - protein, 8 aa, Entamoeba invadens
DGKSEYRN

SEQ ID NO: 2749962 - protein, 8 aa, Entamoeba invadens
DGKSQSPR

SEQ ID NO: 2749963 - protein, 9 aa, Entamoeba invadens
DGKSVTNIN

SEQ ID NO: 2749964 - protein, 11 aa, Entamoeba invadens
DGKTAKMSGDF

SEQ ID NO: 2749965 - protein, 5 aa, Entamoeba invadens
DGKTI

SEQ ID NO: 2749966 - protein, 7 aa, Entamoeba invadens
DGKTNTA

SEQ ID NO: 2749967 - protein, 14 aa, Entamoeba invadens
DGKVDNVENPQSFS

SEQ ID NO: 2749968 - protein, 10 aa, Entamoeba invadens
DGKVNGDDCA

SEQ ID NO: 2749969 - protein, 7 aa, Entamoeba invadens
DGKVSLP

SEQ ID NO: 2749970 - protein, 11 aa, Entamoeba invadens
DGKYPGSNGKC

SEQ ID NO: 2749971 - protein, 15 aa, Entamoeba invadens
DGKYTIGKDEANLYP

SEQ ID NO: 2749972 - protein, 5 aa, Entamoeba invadens
DGLAN

SEQ ID NO: 2749973 - protein, 14 aa, Entamoeba invadens
DGLDTSSGKPTCKT

SEQ ID NO: 2749974 - protein, 15 aa, Entamoeba invadens
DGLGNAATGSSGAKV

SEQ ID NO: 2749975 - protein, 8 aa, Entamoeba invadens
DGLTPEIT

SEQ ID NO: 2749976 - protein, 11 aa, Entamoeba invadens
DGMNERVDDQE

SEQ ID NO: 2749977 - protein, 6 aa, Entamoeba invadens
DGMSCK

SEQ ID NO: 2749978 - protein, 8 aa, Entamoeba invadens
DGNAFEEP

SEQ ID NO: 2749979 - protein, 6 aa, Entamoeba invadens
DGNCEE

SEQ ID NO: 2749980 - protein, 7 aa, Entamoeba invadens
DGNCQKC

SEQ ID NO: 2749981 - protein, 7 aa, Entamoeba invadens
DGNCQPC

SEQ ID NO: 2749982 - protein, 14 aa, Entamoeba invadens
DGNCSTCTETNKEV

SEQ ID NO: 2749983 - protein, 7 aa, Entamoeba invadens
DGNDVGT

SEQ ID NO: 2749984 - protein, 6 aa, Entamoeba invadens
DGNEEC

SEQ ID NO: 2749985 - protein, 5 aa, Entamoeba invadens
DGNEL

SEQ ID NO: 2749986 - protein, 6 aa, Entamoeba invadens
DGNENL

SEQ ID NO: 2749987 - protein, 16 aa, Entamoeba invadens
DGNFASTDTRERPSLN

SEQ ID NO: 2749988 - protein, 7 aa, Entamoeba invadens
DGNFGQD

SEQ ID NO: 2749989 - protein, 7 aa, Entamoeba invadens
DGNFPDQ

SEQ ID NO: 2749990 - protein, 4 aa, Entamoeba invadens
DGNG

SEQ ID NO: 2749991 - protein, 7 aa, Entamoeba invadens
DGNGLSP

SEQ ID NO: 2749992 - protein, 14 aa, Entamoeba invadens
DGNGNSENGAKHEW

SEQ ID NO: 2749993 - protein, 7 aa, Entamoeba invadens
DGNGNVD

SEQ ID NO: 2749994 - protein, 4 aa, Entamoeba invadens
DGNI

SEQ ID NO: 2749995 - protein, 9 aa, Entamoeba invadens
DGNKADNLK

SEQ ID NO: 2749996 - protein, 4 aa, Entamoeba invadens
DGNL

SEQ ID NO: 2749997 - protein, 5 aa, Entamoeba invadens
DGNPP

SEQ ID NO: 2749998 - protein, 8 aa, Entamoeba invadens
DGNTSRYG

SEQ ID NO: 2749999 - protein, 6 aa, Entamoeba invadens
DGNTTQ

SEQ ID NO: 2750000 - protein, 5 aa, Entamoeba invadens
DGNVD

SEQ ID NO: 2750001 - protein, 7 aa, Entamoeba invadens
DGNVEIP

SEQ ID NO: 2750002 - protein, 6 aa, Entamoeba invadens
DGNVTG

SEQ ID NO: 2750003 - protein, 6 aa, Entamoeba invadens
DGNYTD

SEQ ID NO: 2750004 - protein, 10 aa, Entamoeba invadens
DGPMSTQTKD

SEQ ID NO: 2750005 - protein, 7 aa, Entamoeba invadens
DGPSRSY

SEQ ID NO: 2750006 - protein, 7 aa, Entamoeba invadens
DGPYRTN

SEQ ID NO: 2750007 - protein, 5 aa, Entamoeba invadens
DGQGC

SEQ ID NO: 2750008 - protein, 4 aa, Entamoeba invadens
DGQK

SEQ ID NO: 2750009 - protein, 11 aa, Entamoeba invadens
DGQNKDVPVGS

SEQ ID NO: 2750010 - protein, 10 aa, Entamoeba invadens
DGQRPSLDNI

SEQ ID NO: 2750011 - protein, 8 aa, Entamoeba invadens
DGQTYTSG

SEQ ID NO: 2750012 - protein, 13 aa, Entamoeba invadens
DGQYAPKTNSSNC

SEQ ID NO: 2750013 - protein, 4 aa, Entamoeba invadens
DGRR

SEQ ID NO: 2750014 - protein, 9 aa, Entamoeba invadens
DGRSETTTL

SEQ ID NO: 2750015 - protein, 17 aa, Entamoeba invadens
DGSCGGCAKGKYSSNGE

SEQ ID NO: 2750016 - protein, 8 aa, Entamoeba invadens
DGSCKETN

SEQ ID NO: 2750017 - protein, 7 aa, Entamoeba invadens
DGSCKTC

SEQ ID NO: 2750018 - protein, 8 aa, Entamoeba invadens
DGSCRGIN

SEQ ID NO: 2750019 - protein, 7 aa, Entamoeba invadens
DGSCRSI

SEQ ID NO: 2750020 - protein, 9 aa, Entamoeba invadens
DGSEKSTLK

SEQ ID NO: 2750021 - protein, 4 aa, Entamoeba invadens
DGSF

SEQ ID NO: 2750022 - protein, 8 aa, Entamoeba invadens
DGSFQRGE

SEQ ID NO: 2750023 - protein, 16 aa, Entamoeba invadens
DGSGNVKRGKTEAEIN

SEQ ID NO: 2750024 - protein, 5 aa, Entamoeba invadens
DGSIE

SEQ ID NO: 2750025 - protein, 6 aa, Entamoeba invadens
DGSIQQ

SEQ ID NO: 2750026 - protein, 6 aa, Entamoeba invadens
DGSKAK

SEQ ID NO: 2750027 - protein, 6 aa, Entamoeba invadens
DGSKYE

SEQ ID NO: 2750028 - protein, 5 aa, Entamoeba invadens
DGSLS

SEQ ID NO: 2750029 - protein, 8 aa, Entamoeba invadens
DGSLTTAV

SEQ ID NO: 2750030 - protein, 8 aa, Entamoeba invadens
DGSNATWS

SEQ ID NO: 2750031 - protein, 20 aa, Entamoeba invadens
DGSNFDTSGVCNNDNKDDLY

SEQ ID NO: 2750032 - protein, 7 aa, Entamoeba invadens
DGSNGEC

SEQ ID NO: 2750033 - protein, 5 aa, Entamoeba invadens
DGSPN

SEQ ID NO: 2750034 - protein, 5 aa, Entamoeba invadens
DGSRI

SEQ ID NO: 2750035 - protein, 8 aa, Entamoeba invadens
DGSSITLP

SEQ ID NO: 2750036 - protein, 4 aa, Entamoeba invadens
DGSV

SEQ ID NO: 2750037 - protein, 14 aa, Entamoeba invadens
DGSVERLDEDGEGV

SEQ ID NO: 2750038 - protein, 13 aa, Entamoeba invadens
DGSVGANKKDRYY

SEQ ID NO: 2750039 - protein, 6 aa, Entamoeba invadens
DGSYRS

SEQ ID NO: 2750040 - protein, 5 aa, Entamoeba invadens
DGTCD

SEQ ID NO: 2750041 - protein, 5 aa, Entamoeba invadens
DGTEG

SEQ ID NO: 2750042 - protein, 4 aa, Entamoeba invadens
DGTF

SEQ ID NO: 2750043 - protein, 16 aa, Entamoeba invadens
DGTFSKETGTTTCQNC

SEQ ID NO: 2750044 - protein, 7 aa, Entamoeba invadens
DGTGTMY

SEQ ID NO: 2750045 - protein, 5 aa, Entamoeba invadens
DGTGY

SEQ ID NO: 2750046 - protein, 25 aa, Entamoeba invadens
DGTISQSGSATCERCPSGTVSAGNN

SEQ ID NO: 2750047 - protein, 9 aa, Entamoeba invadens
DGTKSLTFD

SEQ ID NO: 2750048 - protein, 6 aa, Entamoeba invadens
DGTKSQ

SEQ ID NO: 2750049 - protein, 7 aa, Entamoeba invadens
DGTNDVG

SEQ ID NO: 2750050 - protein, 6 aa, Entamoeba invadens
DGTNQT

SEQ ID NO: 2750051 - protein, 5 aa, Entamoeba invadens
DGTPS

SEQ ID NO: 2750052 - protein, 5 aa, Entamoeba invadens
DGTPV

SEQ ID NO: 2750053 - protein, 6 aa, Entamoeba invadens
DGTQIT

SEQ ID NO: 2750054 - protein, 9 aa, Entamoeba invadens
DGTSEVDAI

SEQ ID NO: 2750055 - protein, 7 aa, Entamoeba invadens
DGTSKNE

SEQ ID NO: 2750056 - protein, 14 aa, Entamoeba invadens
DGTSPTGYRDENEY

SEQ ID NO: 2750057 - protein, 7 aa, Entamoeba invadens
DGTSSDC

SEQ ID NO: 2750058 - protein, 8 aa, Entamoeba invadens
DGTSTPRL

SEQ ID NO: 2750059 - protein, 9 aa, Entamoeba invadens
DGTTADPTT

SEQ ID NO: 2750060 - protein, 6 aa, Entamoeba invadens
DGTTGR

SEQ ID NO: 2750061 - protein, 11 aa, Entamoeba invadens
DGTTLNTEDYP

SEQ ID NO: 2750062 - protein, 8 aa, Entamoeba invadens
DGTTTDKN

SEQ ID NO: 2750063 - protein, 5 aa, Entamoeba invadens
DGTVI

SEQ ID NO: 2750064 - protein, 10 aa, Entamoeba invadens
DGTVNDTTKF

SEQ ID NO: 2750065 - protein, 6 aa, Entamoeba invadens
DGTVYT

SEQ ID NO: 2750066 - protein, 5 aa, Entamoeba invadens
DGTYC

SEQ ID NO: 2750067 - protein, 5 aa, Entamoeba invadens
DGVDA

SEQ ID NO: 2750068 - protein, 5 aa, Entamoeba invadens
DGVDE

SEQ ID NO: 2750069 - protein, 5 aa, Entamoeba invadens
DGVDV

SEQ ID NO: 2750070 - protein, 4 aa, Entamoeba invadens
DGVP

SEQ ID NO: 2750071 - protein, 4 aa, Entamoeba invadens
DGVS

SEQ ID NO: 2750072 - protein, 7 aa, Entamoeba invadens
DGVSDRT

SEQ ID NO: 2750073 - protein, 23 aa, Entamoeba invadens
DGVTGKCKSCSENSVVQAGSNDM

SEQ ID NO: 2750074 - protein, 5 aa, Entamoeba invadens
DGVVN

SEQ ID NO: 2750075 - protein, 7 aa, Entamoeba invadens
DGWGDAE

SEQ ID NO: 2750076 - protein, 23 aa, Entamoeba invadens
DGYALKEDAEAKDAYNKLTGETA

SEQ ID NO: 2750077 - protein, 21 aa, Entamoeba invadens
DGYDTKVGDKGSKLSGGQKQR

SEQ ID NO: 2750078 - protein, 17 aa, Entamoeba invadens
DGYEKVNGKCEKSADKC

SEQ ID NO: 2750079 - protein, 11 aa, Entamoeba invadens
DGYETGNTCYK

SEQ ID NO: 2750080 - protein, 13 aa, Entamoeba invadens
DGYFPSMEGEDDR

SEQ ID NO: 2750081 - protein, 8 aa, Entamoeba invadens
DGYGGDNC

SEQ ID NO: 2750082 - protein, 6 aa, Entamoeba invadens
DGYGGE

SEQ ID NO: 2750083 - protein, 10 aa, Entamoeba invadens
DGYGLSNDNS

SEQ ID NO: 2750084 - protein, 10 aa, Entamoeba invadens
DGYGVDTDGN

SEQ ID NO: 2750085 - protein, 10 aa, Entamoeba invadens
DGYGVDTNGN

SEQ ID NO: 2750086 - protein, 4 aa, Entamoeba invadens
DGYI

SEQ ID NO: 2750087 - protein, 10 aa, Entamoeba invadens
DGYKATKVEG

SEQ ID NO: 2750088 - protein, 9 aa, Entamoeba invadens
DGYKKEDTG

SEQ ID NO: 2750089 - protein, 12 aa, Entamoeba invadens
DGYQVSSCDGGS

SEQ ID NO: 2750090 - protein, 5 aa, Entamoeba invadens
DGYRC

SEQ ID NO: 2750091 - protein, 9 aa, Entamoeba invadens
DGYSKLSNN

SEQ ID NO: 2750092 - protein, 5 aa, Entamoeba invadens
DGYSP

SEQ ID NO: 2750093 - protein, 16 aa, Entamoeba invadens
DGYTGDSRGPRRYHTT

SEQ ID NO: 2750094 - protein, 6 aa, Entamoeba invadens
DGYTLQ

SEQ ID NO: 2750095 - protein, 9 aa, Entamoeba invadens
DGYTPDHKG

SEQ ID NO: 2750096 - protein, 14 aa, Entamoeba invadens
DGYTTPEPQDKSLP

SEQ ID NO: 2750097 - protein, 6 aa, Entamoeba invadens
DGYTVS

SEQ ID NO: 2750098 - protein, 5 aa, Entamoeba invadens
DGYYK

SEQ ID NO: 2750099 - protein, 9 aa, Entamoeba invadens
DGYYPNNET

SEQ ID NO: 2750100 - protein, 6 aa, Entamoeba invadens
DGYYRS

SEQ ID NO: 2750101 - protein, 11 aa, Entamoeba invadens
DHCETKNQKGC

SEQ ID NO: 2750102 - protein, 12 aa, Entamoeba invadens
DHETTPVATRGT

SEQ ID NO: 2750103 - protein, 6 aa, Entamoeba invadens
DHFNSN

SEQ ID NO: 2750104 - protein, 4 aa, Entamoeba invadens
DHKC

SEQ ID NO: 2750105 - protein, 4 aa, Entamoeba invadens
DHLT

SEQ ID NO: 2750106 - protein, 9 aa, Entamoeba invadens
DHNDVPSSV

SEQ ID NO: 2750107 - protein, 4 aa, Entamoeba invadens
DHNE

SEQ ID NO: 2750108 - protein, 6 aa, Entamoeba invadens
DHNNRQ

SEQ ID NO: 2750109 - protein, 11 aa, Entamoeba invadens
DHPCKSHSKTI

SEQ ID NO: 2750110 - protein, 9 aa, Entamoeba invadens
DHQTDGGAL

SEQ ID NO: 2750111 - protein, 8 aa, Entamoeba invadens
DHQTNSEM

SEQ ID NO: 2750112 - protein, 7 aa, Entamoeba invadens
DHRCNDC

SEQ ID NO: 2750113 - protein, 12 aa, Entamoeba invadens
DHREENNNEPEV

SEQ ID NO: 2750114 - protein, 13 aa, Entamoeba invadens
DHTACSDGNMGSK

SEQ ID NO: 2750115 - protein, 5 aa, Entamoeba invadens
DHTCN

SEQ ID NO: 2750116 - protein, 7 aa, Entamoeba invadens
DHTKNVE

SEQ ID NO: 2750117 - protein, 8 aa, Entamoeba invadens
DHTKRPTF

SEQ ID NO: 2750118 - protein, 8 aa, Entamoeba invadens
DHTKVGDN

SEQ ID NO: 2750119 - protein, 9 aa, Entamoeba invadens
DHTNESYSD

SEQ ID NO: 2750120 - protein, 8 aa, Entamoeba invadens
DHTTETCT

SEQ ID NO: 2750121 - protein, 5 aa, Entamoeba invadens
DHTTY

SEQ ID NO: 2750122 - protein, 9 aa, Entamoeba invadens
DHTVTISNS

SEQ ID NO: 2750123 - protein, 10 aa, Entamoeba invadens
DHVSNKPENY

SEQ ID NO: 2750124 - protein, 17 aa, Entamoeba invadens
DHYEKPCKDAECEKCTG

SEQ ID NO: 2750125 - protein, 8 aa, Entamoeba invadens
DIAKPGLN

SEQ ID NO: 2750126 - protein, 8 aa, Entamoeba invadens
DIAPKNLD

SEQ ID NO: 2750127 - protein, 5 aa, Entamoeba invadens
DIASK

SEQ ID NO: 2750128 - protein, 4 aa, Entamoeba invadens
DIDA

SEQ ID NO: 2750129 - protein, 9 aa, Entamoeba invadens
DIDATTNVG

SEQ ID NO: 2750130 - protein, 12 aa, Entamoeba invadens
DIDDKDLKRTYR

SEQ ID NO: 2750131 - protein, 6 aa, Entamoeba invadens
DIDEKS

SEQ ID NO: 2750132 - protein, 5 aa, Entamoeba invadens
DIDNP

SEQ ID NO: 2750133 - protein, 4 aa, Entamoeba invadens
DIDR

SEQ ID NO: 2750134 - protein, 5 aa, Entamoeba invadens
DIDSK

SEQ ID NO: 2750135 - protein, 6 aa, Entamoeba invadens
DIDTTT

SEQ ID NO: 2750136 - protein, 6 aa, Entamoeba invadens
DIEEIE

SEQ ID NO: 2750137 - protein, 10 aa, Entamoeba invadens
DIEGCDGNVT

SEQ ID NO: 2750138 - protein, 11 aa, Entamoeba invadens
DIEKAQKEAAT

SEQ ID NO: 2750139 - protein, 8 aa, Entamoeba invadens
DIEKNNDQ

SEQ ID NO: 2750140 - protein, 6 aa, Entamoeba invadens
DIEMSE

SEQ ID NO: 2750141 - protein, 17 aa, Entamoeba invadens
DIENNTPRDNTKLEEDK

SEQ ID NO: 2750142 - protein, 9 aa, Entamoeba invadens
DIETNQIDK

SEQ ID NO: 2750143 - protein, 7 aa, Entamoeba invadens
DIFESSP

SEQ ID NO: 2750144 - protein, 11 aa, Entamoeba invadens
DIFKETKSGII

SEQ ID NO: 2750145 - protein, 7 aa, Entamoeba invadens
DIGETLQ

SEQ ID NO: 2750146 - protein, 4 aa, Entamoeba invadens
DIHT

SEQ ID NO: 2750147 - protein, 5 aa, Entamoeba invadens
DIITT

SEQ ID NO: 2750148 - protein, 16 aa, Entamoeba invadens
DIKGEVNDINAPQGIN

SEQ ID NO: 2750149 - protein, 55 aa, Entamoeba invadens
DIKKGSTKVKESFEDDVKETKSVSLSTESSSEASSLVNSPQNTESKTEEKEPVKK

SEQ ID NO: 2750150 - protein, 8 aa, Entamoeba invadens
DIKQEIDD

SEQ ID NO: 2750151 - protein, 4 aa, Entamoeba invadens
DILS

SEQ ID NO: 2750152 - protein, 16 aa, Entamoeba invadens
DILSNKNEISFGDEDD

SEQ ID NO: 2750153 - protein, 18 aa, Entamoeba invadens
DILSNKNEISFGDESDKI

SEQ ID NO: 2750154 - protein, 25 aa, Entamoeba invadens
DILSNKNEISFGDESDKIQIESESR

SEQ ID NO: 2750155 - protein, 25 aa, Entamoeba invadens
DILSNKNEISFGDESDKIQIGSEGR

SEQ ID NO: 2750156 - protein, 24 aa, Entamoeba invadens
DILSNKNEISFGNESDKIQIETES

SEQ ID NO: 2750157 - protein, 18 aa, Entamoeba invadens
DINDDPKYSSCHDATKRI

SEQ ID NO: 2750158 - protein, 4 aa, Entamoeba invadens
DINE

SEQ ID NO: 2750159 - protein, 5 aa, Entamoeba invadens
DINEN

SEQ ID NO: 2750160 - protein, 6 aa, Entamoeba invadens
DINKQY

SEQ ID NO: 2750161 - protein, 6 aa, Entamoeba invadens
DINNGT

SEQ ID NO: 2750162 - protein, 13 aa, Entamoeba invadens
DINTQKRESSDPQ

SEQ ID NO: 2750163 - protein, 8 aa, Entamoeba invadens
DIPDDSKD

SEQ ID NO: 2750164 - protein, 15 aa, Entamoeba invadens
DIPDETIEDSNEDLT

SEQ ID NO: 2750165 - protein, 6 aa, Entamoeba invadens
DIPDTA

SEQ ID NO: 2750166 - protein, 8 aa, Entamoeba invadens
DIPHTEEQ

SEQ ID NO: 2750167 - protein, 4 aa, Entamoeba invadens
DIPK

SEQ ID NO: 2750168 - protein, 15 aa, Entamoeba invadens
DIPKDVRKKDFPEED

SEQ ID NO: 2750169 - protein, 6 aa, Entamoeba invadens
DIPPDF

SEQ ID NO: 2750170 - protein, 8 aa, Entamoeba invadens
DIPQSKST

SEQ ID NO: 2750171 - protein, 9 aa, Entamoeba invadens
DIPQSTSLT

SEQ ID NO: 2750172 - protein, 9 aa, Entamoeba invadens
DIPQTENKE

SEQ ID NO: 2750173 - protein, 5 aa, Entamoeba invadens
DIPSN

SEQ ID NO: 2750174 - protein, 7 aa, Entamoeba invadens
DIPTTPV

SEQ ID NO: 2750175 - protein, 5 aa, Entamoeba invadens
DIQNS

SEQ ID NO: 2750176 - protein, 7 aa, Entamoeba invadens
DIQTGAA

SEQ ID NO: 2750177 - protein, 12 aa, Entamoeba invadens
DIQTGDTSDVSN

SEQ ID NO: 2750178 - protein, 8 aa, Entamoeba invadens
DIRRDSSL

SEQ ID NO: 2750179 - protein, 8 aa, Entamoeba invadens
DISESDTC

SEQ ID NO: 2750180 - protein, 4 aa, Entamoeba invadens
DISG

SEQ ID NO: 2750181 - protein, 5 aa, Entamoeba invadens
DISNN

SEQ ID NO: 2750182 - protein, 6 aa, Entamoeba invadens
DISNQH

SEQ ID NO: 2750183 - protein, 6 aa, Entamoeba invadens
DISSER

SEQ ID NO: 2750184 - protein, 12 aa, Entamoeba invadens
DISSSDSSRDYS

SEQ ID NO: 2750185 - protein, 6 aa, Entamoeba invadens
DITENT

SEQ ID NO: 2750186 - protein, 10 aa, Entamoeba invadens
DITNPTDNTK

SEQ ID NO: 2750187 - protein, 7 aa, Entamoeba invadens
DITNSSL

SEQ ID NO: 2750188 - protein, 5 aa, Entamoeba invadens
DITPQ

SEQ ID NO: 2750189 - protein, 5 aa, Entamoeba invadens
DITQY

SEQ ID NO: 2750190 - protein, 11 aa, Entamoeba invadens
DIYKSSDVNGR

SEQ ID NO: 2750191 - protein, 9 aa, Entamoeba invadens
DKAAISTGG

SEQ ID NO: 2750192 - protein, 8 aa, Entamoeba invadens
DKAAQGRT

SEQ ID NO: 2750193 - protein, 7 aa, Entamoeba invadens
DKADGDC

SEQ ID NO: 2750194 - protein, 6 aa, Entamoeba invadens
DKADVK

SEQ ID NO: 2750195 - protein, 9 aa, Entamoeba invadens
DKAEKSLLT

SEQ ID NO: 2750196 - protein, 16 aa, Entamoeba invadens
DKAETSVTPPDPSLKG

SEQ ID NO: 2750197 - protein, 5 aa, Entamoeba invadens
DKAKG

SEQ ID NO: 2750198 - protein, 6 aa, Entamoeba invadens
DKAKKV

SEQ ID NO: 2750199 - protein, 15 aa, Entamoeba invadens
DKANAKLTDFGSSRN

SEQ ID NO: 2750200 - protein, 8 aa, Entamoeba invadens
DKAPSDKN

SEQ ID NO: 2750201 - protein, 8 aa, Entamoeba invadens
DKAQSSVE

SEQ ID NO: 2750202 - protein, 9 aa, Entamoeba invadens
DKASAGRTS

SEQ ID NO: 2750203 - protein, 14 aa, Entamoeba invadens
DKAVDSSEGYNTTE

SEQ ID NO: 2750204 - protein, 6 aa, Entamoeba invadens
DKCGEH

SEQ ID NO: 2750205 - protein, 34 aa, Entamoeba invadens
DKCNSGFEQDNSCSRCAQYDETAAISDTNQLYTP

SEQ ID NO: 2750206 - protein, 12 aa, Entamoeba invadens
DKCPSGQYADSN

SEQ ID NO: 2750207 - protein, 7 aa, Entamoeba invadens
DKCQEGY

SEQ ID NO: 2750208 - protein, 5 aa, Entamoeba invadens
DKCQS

SEQ ID NO: 2750209 - protein, 8 aa, Entamoeba invadens
DKCSQQKI

SEQ ID NO: 2750210 - protein, 9 aa, Entamoeba invadens
DKCSTYYDN

SEQ ID NO: 2750211 - protein, 13 aa, Entamoeba invadens
DKCTTGKPVETPI

SEQ ID NO: 2750212 - protein, 7 aa, Entamoeba invadens
DKDASGN

SEQ ID NO: 2750213 - protein, 4 aa, Entamoeba invadens
DKDD

SEQ ID NO: 2750214 - protein, 9 aa, Entamoeba invadens
DKDDDELEL

SEQ ID NO: 2750215 - protein, 10 aa, Entamoeba invadens
DKDDKCTKCK

SEQ ID NO: 2750216 - protein, 10 aa, Entamoeba invadens
DKDDKCTKCN

SEQ ID NO: 2750217 - protein, 10 aa, Entamoeba invadens
DKDDKGTQCK

SEQ ID NO: 2750218 - protein, 5 aa, Entamoeba invadens
DKDGC

SEQ ID NO: 2750219 - protein, 30 aa, Entamoeba invadens
DKDKEWNQEDKSEYNEYTQKSTFKGVSETL

SEQ ID NO: 2750220 - protein, 5 aa, Entamoeba invadens
DKDNL

SEQ ID NO: 2750221 - protein, 9 aa, Entamoeba invadens
DKDNTESYS

SEQ ID NO: 2750222 - protein, 7 aa, Entamoeba invadens
DKDPDHP

SEQ ID NO: 2750223 - protein, 7 aa, Entamoeba invadens
DKDQCSV

SEQ ID NO: 2750224 - protein, 4 aa, Entamoeba invadens
DKDS

SEQ ID NO: 2750225 - protein, 12 aa, Entamoeba invadens
DKDSCKKCENPY

SEQ ID NO: 2750226 - protein, 4 aa, Entamoeba invadens
DKDT

SEQ ID NO: 2750227 - protein, 4 aa, Entamoeba invadens
DKDV

SEQ ID NO: 2750228 - protein, 17 aa, Entamoeba invadens
DKECEKCNNNCTTCTQH

SEQ ID NO: 2750229 - protein, 7 aa, Entamoeba invadens
DKEDANQ

SEQ ID NO: 2750230 - protein, 22 aa, Entamoeba invadens
DKEDETKCSKYSQKTCDQCESN

SEQ ID NO: 2750231 - protein, 6 aa, Entamoeba invadens
DKEDKM

SEQ ID NO: 2750232 - protein, 10 aa, Entamoeba invadens
DKEDNFVPTT

SEQ ID NO: 2750233 - protein, 6 aa, Entamoeba invadens
DKEDNL

SEQ ID NO: 2750234 - protein, 9 aa, Entamoeba invadens
DKEDSATAR

SEQ ID NO: 2750235 - protein, 9 aa, Entamoeba invadens
DKEDTSNDL

SEQ ID NO: 2750236 - protein, 7 aa, Entamoeba invadens
DKEDVSK

SEQ ID NO: 2750237 - protein, 8 aa, Entamoeba invadens
DKEEGEDE

SEQ ID NO: 2750238 - protein, 19 aa, Entamoeba invadens
DKEERTNIETIREKLENMI

SEQ ID NO: 2750239 - protein, 19 aa, Entamoeba invadens
DKEERTNIETVREKLQKMI

SEQ ID NO: 2750240 - protein, 13 aa, Entamoeba invadens
DKEHAVRKAGNIV

SEQ ID NO: 2750241 - protein, 18 aa, Entamoeba invadens
DKEIKGAEVRNSTLPEEL

SEQ ID NO: 2750242 - protein, 6 aa, Entamoeba invadens
DKEIQS

SEQ ID NO: 2750243 - protein, 7 aa, Entamoeba invadens
DKEKRKS

SEQ ID NO: 2750244 - protein, 8 aa, Entamoeba invadens
DKENVNKS

SEQ ID NO: 2750245 - protein, 5 aa, Entamoeba invadens
DKEQV

SEQ ID NO: 2750246 - protein, 8 aa, Entamoeba invadens
DKERGNEW

SEQ ID NO: 2750247 - protein, 7 aa, Entamoeba invadens
DKESPDH

SEQ ID NO: 2750248 - protein, 10 aa, Entamoeba invadens
DKETEENASN

SEQ ID NO: 2750249 - protein, 6 aa, Entamoeba invadens
DKETRD

SEQ ID NO: 2750250 - protein, 9 aa, Entamoeba invadens
DKEVRDKVE

SEQ ID NO: 2750251 - protein, 7 aa, Entamoeba invadens
DKEYTES

SEQ ID NO: 2750252 - protein, 7 aa, Entamoeba invadens
DKEYVNN

SEQ ID NO: 2750253 - protein, 15 aa, Entamoeba invadens
DKFQPSPTPEIQRTS

SEQ ID NO: 2750254 - protein, 9 aa, Entamoeba invadens
DKGAEKNRC

SEQ ID NO: 2750255 - protein, 7 aa, Entamoeba invadens
DKGDSIL

SEQ ID NO: 2750256 - protein, 43 aa, Entamoeba invadens
DKGEEKHSESPIEKEQKEESSPSKPVEHKEEKTEKPEETNESH

SEQ ID NO: 2750257 - protein, 7 aa, Entamoeba invadens
DKGEQHV

SEQ ID NO: 2750258 - protein, 37 aa, Entamoeba invadens
DKGEQIEMDNNDSKQINIKSDTEDSDETFKGNGAVLP

SEQ ID NO: 2750259 - protein, 8 aa, Entamoeba invadens
DKGETKTV

SEQ ID NO: 2750260 - protein, 7 aa, Entamoeba invadens
DKGGSTF

SEQ ID NO: 2750261 - protein, 7 aa, Entamoeba invadens
DKGLSPN

SEQ ID NO: 2750262 - protein, 7 aa, Entamoeba invadens
DKGYPEK

SEQ ID NO: 2750263 - protein, 5 aa, Entamoeba invadens
DKGYY

SEQ ID NO: 2750264 - protein, 5 aa, Entamoeba invadens
DKHEA

SEQ ID NO: 2750265 - protein, 19 aa, Entamoeba invadens
DKHKMEEEKTPQDKEITEK

SEQ ID NO: 2750266 - protein, 7 aa, Entamoeba invadens
DKIGEGT

SEQ ID NO: 2750267 - protein, 40 aa, Entamoeba invadens
DKIGSESDKIQETEKGKGKESEENKEKAPVNEGSKAKEPV

SEQ ID NO: 2750268 - protein, 7 aa, Entamoeba invadens
DKIGTSF

SEQ ID NO: 2750269 - protein, 26 aa, Entamoeba invadens
DKIKTSDEKSSKEIATTSSSSDKDSV

SEQ ID NO: 2750270 - protein, 6 aa, Entamoeba invadens
DKILSN

SEQ ID NO: 2750271 - protein, 15 aa, Entamoeba invadens
DKINSSEEKKQNVSL

SEQ ID NO: 2750272 - protein, 10 aa, Entamoeba invadens
DKIQAGDGNY

SEQ ID NO: 2750273 - protein, 7 aa, Entamoeba invadens
DKIRISP

SEQ ID NO: 2750274 - protein, 6 aa, Entamoeba invadens
DKISKS

SEQ ID NO: 2750275 - protein, 6 aa, Entamoeba invadens
DKITFS

SEQ ID NO: 2750276 - protein, 16 aa, Entamoeba invadens
DKITGEDLTVSEETIT

SEQ ID NO: 2750277 - protein, 7 aa, Entamoeba invadens
DKKASKL

SEQ ID NO: 2750278 - protein, 5 aa, Entamoeba invadens
DKKCS

SEQ ID NO: 2750279 - protein, 9 aa, Entamoeba invadens
DKKEEIESV

SEQ ID NO: 2750280 - protein, 13 aa, Entamoeba invadens
DKKEMEKENTKVY

SEQ ID NO: 2750281 - protein, 5 aa, Entamoeba invadens
DKKEN

SEQ ID NO: 2750282 - protein, 6 aa, Entamoeba invadens
DKKENN

SEQ ID NO: 2750283 - protein, 10 aa, Entamoeba invadens
DKKETATSVA

SEQ ID NO: 2750284 - protein, 8 aa, Entamoeba invadens
DKKETAYN

SEQ ID NO: 2750285 - protein, 5 aa, Entamoeba invadens
DKKEV

SEQ ID NO: 2750286 - protein, 5 aa, Entamoeba invadens
DKKEY

SEQ ID NO: 2750287 - protein, 7 aa, Entamoeba invadens
DKKISEL

SEQ ID NO: 2750288 - protein, 42 aa, Entamoeba invadens
DKKKAQQDDADDGEDDEEQNEINNATVNNSNNSSNSVPPHPQ

SEQ ID NO: 2750289 - protein, 8 aa, Entamoeba invadens
DKKKSNGC

SEQ ID NO: 2750290 - protein, 17 aa, Entamoeba invadens
DKKNQNNFKNMKNDDLT

SEQ ID NO: 2750291 - protein, 10 aa, Entamoeba invadens
DKKNQNSYKY

SEQ ID NO: 2750292 - protein, 7 aa, Entamoeba invadens
DKKQYKQ

SEQ ID NO: 2750293 - protein, 6 aa, Entamoeba invadens
DKKREM

SEQ ID NO: 2750294 - protein, 9 aa, Entamoeba invadens
DKKRQTILT

SEQ ID NO: 2750295 - protein, 7 aa, Entamoeba invadens
DKKRTKV

SEQ ID NO: 2750296 - protein, 7 aa, Entamoeba invadens
DKKSLNE

SEQ ID NO: 2750297 - protein, 6 aa, Entamoeba invadens
DKKSTH

SEQ ID NO: 2750298 - protein, 8 aa, Entamoeba invadens
DKKTQELE

SEQ ID NO: 2750299 - protein, 8 aa, Entamoeba invadens
DKKYTNAE

SEQ ID NO: 2750300 - protein, 7 aa, Entamoeba invadens
DKLDDND

SEQ ID NO: 2750301 - protein, 5 aa, Entamoeba invadens
DKLEI

SEQ ID NO: 2750302 - protein, 4 aa, Entamoeba invadens
DKLG

SEQ ID NO: 2750303 - protein, 8 aa, Entamoeba invadens
DKLGEGGF

SEQ ID NO: 2750304 - protein, 7 aa, Entamoeba invadens
DKLGSNA

SEQ ID NO: 2750305 - protein, 12 aa, Entamoeba invadens
DKLGSNAFEGNS

SEQ ID NO: 2750306 - protein, 6 aa, Entamoeba invadens
DKLNEK

SEQ ID NO: 2750307 - protein, 14 aa, Entamoeba invadens
DKLNEWREKDSYSD

SEQ ID NO: 2750308 - protein, 8 aa, Entamoeba invadens
DKLPPESM

SEQ ID NO: 2750309 - protein, 8 aa, Entamoeba invadens
DKLPPETM

SEQ ID NO: 2750310 - protein, 4 aa, Entamoeba invadens
DKLQ

SEQ ID NO: 2750311 - protein, 9 aa, Entamoeba invadens
DKLQEGVKE

SEQ ID NO: 2750312 - protein, 10 aa, Entamoeba invadens
DKLTNENNEI

SEQ ID NO: 2750313 - protein, 8 aa, Entamoeba invadens
DKMGKSST

SEQ ID NO: 2750314 - protein, 22 aa, Entamoeba invadens
DKMKEPVKSIDTKSLNKPRERK

SEQ ID NO: 2750315 - protein, 8 aa, Entamoeba invadens
DKMQEGVR

SEQ ID NO: 2750316 - protein, 6 aa, Entamoeba invadens
DKNDER

SEQ ID NO: 2750317 - protein, 4 aa, Entamoeba invadens
DKNE

SEQ ID NO: 2750318 - protein, 8 aa, Entamoeba invadens
DKNEVKCD

SEQ ID NO: 2750319 - protein, 8 aa, Entamoeba invadens
DKNGCAKC

SEQ ID NO: 2750320 - protein, 13 aa, Entamoeba invadens
DKNGCKVAPKTTT

SEQ ID NO: 2750321 - protein, 11 aa, Entamoeba invadens
DKNGCSKTNRY

SEQ ID NO: 2750322 - protein, 14 aa, Entamoeba invadens
DKNGGVIKSSEDCK

SEQ ID NO: 2750323 - protein, 9 aa, Entamoeba invadens
DKNGRHAEF

SEQ ID NO: 2750324 - protein, 7 aa, Entamoeba invadens
DKNHEAI

SEQ ID NO: 2750325 - protein, 4 aa, Entamoeba invadens
DKNI

SEQ ID NO: 2750326 - protein, 11 aa, Entamoeba invadens
DKNKTNETLPQ

SEQ ID NO: 2750327 - protein, 5 aa, Entamoeba invadens
DKNPM

SEQ ID NO: 2750328 - protein, 14 aa, Entamoeba invadens
DKNRQYKLGSPFGG

SEQ ID NO: 2750329 - protein, 4 aa, Entamoeba invadens
DKNS

SEQ ID NO: 2750330 - protein, 21 aa, Entamoeba invadens
DKNSDNPDKKLCPQSNETTKF

SEQ ID NO: 2750331 - protein, 14 aa, Entamoeba invadens
DKNSENLTDKTKCD

SEQ ID NO: 2750332 - protein, 9 aa, Entamoeba invadens
DKNSKKTKY

SEQ ID NO: 2750333 - protein, 9 aa, Entamoeba invadens
DKNSTNNNC

SEQ ID NO: 2750334 - protein, 6 aa, Entamoeba invadens
DKNTDR

SEQ ID NO: 2750335 - protein, 6 aa, Entamoeba invadens
DKNTEG

SEQ ID NO: 2750336 - protein, 13 aa, Entamoeba invadens
DKNTESSDQTNFE

SEQ ID NO: 2750337 - protein, 6 aa, Entamoeba invadens
DKNTGL

SEQ ID NO: 2750338 - protein, 16 aa, Entamoeba invadens
DKNTKEEENKTPIDRK

SEQ ID NO: 2750339 - protein, 7 aa, Entamoeba invadens
DKNVTVE

SEQ ID NO: 2750340 - protein, 14 aa, Entamoeba invadens
DKNYEKSQTKQYDD

SEQ ID NO: 2750341 - protein, 7 aa, Entamoeba invadens
DKNYTTP

SEQ ID NO: 2750342 - protein, 7 aa, Entamoeba invadens
DKPEDIP

SEQ ID NO: 2750343 - protein, 6 aa, Entamoeba invadens
DKPEIP

SEQ ID NO: 2750344 - protein, 19 aa, Entamoeba invadens
DKPIKNEKVEKSDKSDIKR

SEQ ID NO: 2750345 - protein, 4 aa, Entamoeba invadens
DKPP

SEQ ID NO: 2750346 - protein, 7 aa, Entamoeba invadens
DKPPKTI

SEQ ID NO: 2750347 - protein, 10 aa, Entamoeba invadens
DKPQSERYGT

SEQ ID NO: 2750348 - protein, 7 aa, Entamoeba invadens
DKPTEIN

SEQ ID NO: 2750349 - protein, 6 aa, Entamoeba invadens
DKPTIE

SEQ ID NO: 2750350 - protein, 12 aa, Entamoeba invadens
DKPTQISDETSH

SEQ ID NO: 2750351 - protein, 8 aa, Entamoeba invadens
DKQETAIS

SEQ ID NO: 2750352 - protein, 16 aa, Entamoeba invadens
DKQGEQYYEKSSSGYV

SEQ ID NO: 2750353 - protein, 15 aa, Entamoeba invadens
DKQGKDMLTFHISRL

SEQ ID NO: 2750354 - protein, 7 aa, Entamoeba invadens
DKQKFEK

SEQ ID NO: 2750355 - protein, 8 aa, Entamoeba invadens
DKQQKMSK

SEQ ID NO: 2750356 - protein, 7 aa, Entamoeba invadens
DKQTTPV

SEQ ID NO: 2750357 - protein, 5 aa, Entamoeba invadens
DKQVG

SEQ ID NO: 2750358 - protein, 5 aa, Entamoeba invadens
DKQVS

SEQ ID NO: 2750359 - protein, 8 aa, Entamoeba invadens
DKRDPSQI

SEQ ID NO: 2750360 - protein, 7 aa, Entamoeba invadens
DKRDRVT

SEQ ID NO: 2750361 - protein, 22 aa, Entamoeba invadens
DKREDEKKRAEDTKDNIYSIEL

SEQ ID NO: 2750362 - protein, 30 aa, Entamoeba invadens
DKRKEIKKQMKDKEKEKEKKKPKKEMEKKE

SEQ ID NO: 2750363 - protein, 14 aa, Entamoeba invadens
DKRNELKDGLKGGG

SEQ ID NO: 2750364 - protein, 13 aa, Entamoeba invadens
DKRPEINEPVSTE

SEQ ID NO: 2750365 - protein, 23 aa, Entamoeba invadens
DKRPQIAQDAPKRNVKNIPNESV

SEQ ID NO: 2750366 - protein, 8 aa, Entamoeba invadens
DKRSYKER

SEQ ID NO: 2750367 - protein, 10 aa, Entamoeba invadens
DKSADARATF

SEQ ID NO: 2750368 - protein, 26 aa, Entamoeba invadens
DKSCKNCAEQNKGCLDANPDCGTCTG

SEQ ID NO: 2750369 - protein, 23 aa, Entamoeba invadens
DKSEVVASEKYTKVPDEESDKAI

SEQ ID NO: 2750370 - protein, 10 aa, Entamoeba invadens
DKSGTIYDPE

SEQ ID NO: 2750371 - protein, 13 aa, Entamoeba invadens
DKSGVNTTKEYKY

SEQ ID NO: 2750372 - protein, 5 aa, Entamoeba invadens
DKSKA

SEQ ID NO: 2750373 - protein, 10 aa, Entamoeba invadens
DKSKETQKKM

SEQ ID NO: 2750374 - protein, 7 aa, Entamoeba invadens
DKSKSVS

SEQ ID NO: 2750375 - protein, 10 aa, Entamoeba invadens
DKSKTVINEN

SEQ ID NO: 2750376 - protein, 6 aa, Entamoeba invadens
DKSSER

SEQ ID NO: 2750377 - protein, 5 aa, Entamoeba invadens
DKSSF

SEQ ID NO: 2750378 - protein, 9 aa, Entamoeba invadens
DKSSSKCHA

SEQ ID NO: 2750379 - protein, 17 aa, Entamoeba invadens
DKSSSKKFTVSNKDNSF

SEQ ID NO: 2750380 - protein, 8 aa, Entamoeba invadens
DKSSSTCH

SEQ ID NO: 2750381 - protein, 9 aa, Entamoeba invadens
DKSSYSIPS

SEQ ID NO: 2750382 - protein, 4 aa, Entamoeba invadens
DKST

SEQ ID NO: 2750383 - protein, 6 aa, Entamoeba invadens
DKSTCK

SEQ ID NO: 2750384 - protein, 15 aa, Entamoeba invadens
DKSTRVTCKPTPQPH

SEQ ID NO: 2750385 - protein, 9 aa, Entamoeba invadens
DKSTTKQHL

SEQ ID NO: 2750386 - protein, 8 aa, Entamoeba invadens
DKSYKQIK

SEQ ID NO: 2750387 - protein, 5 aa, Entamoeba invadens
DKSYL

SEQ ID NO: 2750388 - protein, 8 aa, Entamoeba invadens
DKTACKPE

SEQ ID NO: 2750389 - protein, 6 aa, Entamoeba invadens
DKTAQD

SEQ ID NO: 2750390 - protein, 6 aa, Entamoeba invadens
DKTARN

SEQ ID NO: 2750391 - protein, 13 aa, Entamoeba invadens
DKTASNGTTRIGG

SEQ ID NO: 2750392 - protein, 8 aa, Entamoeba invadens
DKTASNQC

SEQ ID NO: 2750393 - protein, 7 aa, Entamoeba invadens
DKTASSI

SEQ ID NO: 2750394 - protein, 22 aa, Entamoeba invadens
DKTCGKCETGMKVTETKKCETV

SEQ ID NO: 2750395 - protein, 4 aa, Entamoeba invadens
DKTD

SEQ ID NO: 2750396 - protein, 6 aa, Entamoeba invadens
DKTDHQ

SEQ ID NO: 2750397 - protein, 6 aa, Entamoeba invadens
DKTDPA

SEQ ID NO: 2750398 - protein, 29 aa, Entamoeba invadens
DKTEKIPEKTPEKSPDRVGEKKNILQSTT

SEQ ID NO: 2750399 - protein, 13 aa, Entamoeba invadens
DKTETTEVSEPPI

SEQ ID NO: 2750400 - protein, 6 aa, Entamoeba invadens
DKTEVN

SEQ ID NO: 2750401 - protein, 19 aa, Entamoeba invadens
DKTGEYDNKKTEVEKKPNR

SEQ ID NO: 2750402 - protein, 7 aa, Entamoeba invadens
DKTGTLT

SEQ ID NO: 2750403 - protein, 8 aa, Entamoeba invadens
DKTGTLTE

SEQ ID NO: 2750404 - protein, 10 aa, Entamoeba invadens
DKTGTLTENE

SEQ ID NO: 2750405 - protein, 9 aa, Entamoeba invadens
DKTGTLTKN

SEQ ID NO: 2750406 - protein, 9 aa, Entamoeba invadens
DKTGTLTQG

SEQ ID NO: 2750407 - protein, 8 aa, Entamoeba invadens
DKTKALPN

SEQ ID NO: 2750408 - protein, 11 aa, Entamoeba invadens
DKTKAPVDEEL

SEQ ID NO: 2750409 - protein, 8 aa, Entamoeba invadens
DKTKEELG

SEQ ID NO: 2750410 - protein, 8 aa, Entamoeba invadens
DKTKQFED

SEQ ID NO: 2750411 - protein, 6 aa, Entamoeba invadens
DKTKQI

SEQ ID NO: 2750412 - protein, 4 aa, Entamoeba invadens
DKTL

SEQ ID NO: 2750413 - protein, 14 aa, Entamoeba invadens
DKTLNEEKHCQTKQ

SEQ ID NO: 2750414 - protein, 5 aa, Entamoeba invadens
DKTLQ

SEQ ID NO: 2750415 - protein, 4 aa, Entamoeba invadens
DKTN

SEQ ID NO: 2750416 - protein, 7 aa, Entamoeba invadens
DKTNDYR

SEQ ID NO: 2750417 - protein, 6 aa, Entamoeba invadens
DKTNGH

SEQ ID NO: 2750418 - protein, 6 aa, Entamoeba invadens
DKTNGK

SEQ ID NO: 2750419 - protein, 8 aa, Entamoeba invadens
DKTNGKCT

SEQ ID NO: 2750420 - protein, 21 aa, Entamoeba invadens
DKTNGKCTSCYSGNALNSNGN

SEQ ID NO: 2750421 - protein, 6 aa, Entamoeba invadens
DKTNGL

SEQ ID NO: 2750422 - protein, 6 aa, Entamoeba invadens
DKTNGN

SEQ ID NO: 2750423 - protein, 5 aa, Entamoeba invadens
DKTPF

SEQ ID NO: 2750424 - protein, 9 aa, Entamoeba invadens
DKTPLPGSS

SEQ ID NO: 2750425 - protein, 10 aa, Entamoeba invadens
DKTPNDKDTV

SEQ ID NO: 2750426 - protein, 16 aa, Entamoeba invadens
DKTPVTHPISTPLEQN

SEQ ID NO: 2750427 - protein, 7 aa, Entamoeba invadens
DKTQAMD

SEQ ID NO: 2750428 - protein, 6 aa, Entamoeba invadens
DKTQFG

SEQ ID NO: 2750429 - protein, 7 aa, Entamoeba invadens
DKTSEEI

SEQ ID NO: 2750430 - protein, 6 aa, Entamoeba invadens
DKTSGY

SEQ ID NO: 2750431 - protein, 4 aa, Entamoeba invadens
DKTT

SEQ ID NO: 2750432 - protein, 7 aa, Entamoeba invadens
DKTTCTY

SEQ ID NO: 2750433 - protein, 8 aa, Entamoeba invadens
DKTTCTYK

SEQ ID NO: 2750434 - protein, 7 aa, Entamoeba invadens
DKTTDYQ

SEQ ID NO: 2750435 - protein, 21 aa, Entamoeba invadens
DKTTEPSTQSNETKPLLEKKT

SEQ ID NO: 2750436 - protein, 6 aa, Entamoeba invadens
DKTTSL

SEQ ID NO: 2750437 - protein, 6 aa, Entamoeba invadens
DKTTTV

SEQ ID NO: 2750438 - protein, 5 aa, Entamoeba invadens
DKTTV

SEQ ID NO: 2750439 - protein, 15 aa, Entamoeba invadens
DKTVEKWKDSDKQQM

SEQ ID NO: 2750440 - protein, 11 aa, Entamoeba invadens
DKTWTSGNGVT

SEQ ID NO: 2750441 - protein, 8 aa, Entamoeba invadens
DKTYHDEP

SEQ ID NO: 2750442 - protein, 20 aa, Entamoeba invadens
DKVEEKEGGTMKSDVQENAL

SEQ ID NO: 2750443 - protein, 23 aa, Entamoeba invadens
DKVEGITEKRTTRLKKRLSENNA

SEQ ID NO: 2750444 - protein, 13 aa, Entamoeba invadens
DKVETATGIAQTS

SEQ ID NO: 2750445 - protein, 4 aa, Entamoeba invadens
DKVG

SEQ ID NO: 2750446 - protein, 9 aa, Entamoeba invadens
DKVGSDHVK

SEQ ID NO: 2750447 - protein, 10 aa, Entamoeba invadens
DKVLDKNGNC

SEQ ID NO: 2750448 - protein, 16 aa, Entamoeba invadens
DKVNAKLTDFGSARNV

SEQ ID NO: 2750449 - protein, 14 aa, Entamoeba invadens
DKVNAKLTDFGSSR

SEQ ID NO: 2750450 - protein, 15 aa, Entamoeba invadens
DKVNAKLTDFGSSRN

SEQ ID NO: 2750451 - protein, 13 aa, Entamoeba invadens
DKVNTKLTDFGAS

SEQ ID NO: 2750452 - protein, 8 aa, Entamoeba invadens
DKVTSDGC

SEQ ID NO: 2750453 - protein, 4 aa, Entamoeba invadens
DKVV

SEQ ID NO: 2750454 - protein, 7 aa, Entamoeba invadens
DKYGGED

SEQ ID NO: 2750455 - protein, 6 aa, Entamoeba invadens
DKYKDC

SEQ ID NO: 2750456 - protein, 8 aa, Entamoeba invadens
DKYKKPAD

SEQ ID NO: 2750457 - protein, 9 aa, Entamoeba invadens
DKYKKPADV

SEQ ID NO: 2750458 - protein, 8 aa, Entamoeba invadens
DKYQTVTG

SEQ ID NO: 2750459 - protein, 10 aa, Entamoeba invadens
DKYTLTDDQN

SEQ ID NO: 2750460 - protein, 8 aa, Entamoeba invadens
DKYTNPDN

SEQ ID NO: 2750461 - protein, 21 aa, Entamoeba invadens
DKYYDNEGKYLRTEETLSNGE

SEQ ID NO: 2750462 - protein, 14 aa, Entamoeba invadens
DLADKVSKKSIKRG

SEQ ID NO: 2750463 - protein, 10 aa, Entamoeba invadens
DLAPQLPAIG

SEQ ID NO: 2750464 - protein, 16 aa, Entamoeba invadens
DLASLEAKKTKSGCLR

SEQ ID NO: 2750465 - protein, 14 aa, Entamoeba invadens
DLCERGKNHCQSNC

SEQ ID NO: 2750466 - protein, 4 aa, Entamoeba invadens
DLCG

SEQ ID NO: 2750467 - protein, 10 aa, Entamoeba invadens
DLDEDEIDVN

SEQ ID NO: 2750468 - protein, 8 aa, Entamoeba invadens
DLDENEID

SEQ ID NO: 2750469 - protein, 7 aa, Entamoeba invadens
DLDGEPE

SEQ ID NO: 2750470 - protein, 5 aa, Entamoeba invadens
DLDGM

SEQ ID NO: 2750471 - protein, 4 aa, Entamoeba invadens
DLDT

SEQ ID NO: 2750472 - protein, 7 aa, Entamoeba invadens
DLDTNRQ

SEQ ID NO: 2750473 - protein, 14 aa, Entamoeba invadens
DLEDGGIADRPGDC

SEQ ID NO: 2750474 - protein, 7 aa, Entamoeba invadens
DLEKDGE

SEQ ID NO: 2750475 - protein, 6 aa, Entamoeba invadens
DLEKPN

SEQ ID NO: 2750476 - protein, 5 aa, Entamoeba invadens
DLEKS

SEQ ID NO: 2750477 - protein, 7 aa, Entamoeba invadens
DLEKSDE

SEQ ID NO: 2750478 - protein, 11 aa, Entamoeba invadens
DLENEREVEYN

SEQ ID NO: 2750479 - protein, 6 aa, Entamoeba invadens
DLEQPT

SEQ ID NO: 2750480 - protein, 31 aa, Entamoeba invadens
DLEQQTVEQAGKIKESVDEKEKVEKETAKHL

SEQ ID NO: 2750481 - protein, 17 aa, Entamoeba invadens
DLESERKVTTEEGQKLA

SEQ ID NO: 2750482 - protein, 10 aa, Entamoeba invadens
DLESSRQVPF

SEQ ID NO: 2750483 - protein, 5 aa, Entamoeba invadens
DLEST

SEQ ID NO: 2750484 - protein, 4 aa, Entamoeba invadens
DLET

SEQ ID NO: 2750485 - protein, 9 aa, Entamoeba invadens
DLFKNSGEI

SEQ ID NO: 2750486 - protein, 6 aa, Entamoeba invadens
DLGASS

SEQ ID NO: 2750487 - protein, 5 aa, Entamoeba invadens
DLGCG

SEQ ID NO: 2750488 - protein, 7 aa, Entamoeba invadens
DLGKQPN

SEQ ID NO: 2750489 - protein, 8 aa, Entamoeba invadens
DLGTSPNC

SEQ ID NO: 2750490 - protein, 5 aa, Entamoeba invadens
DLISG

SEQ ID NO: 2750491 - protein, 11 aa, Entamoeba invadens
DLKDTETSNGI

SEQ ID NO: 2750492 - protein, 4 aa, Entamoeba invadens
DLKE

SEQ ID NO: 2750493 - protein, 5 aa, Entamoeba invadens
DLKGA

SEQ ID NO: 2750494 - protein, 9 aa, Entamoeba invadens
DLKNDFDNN

SEQ ID NO: 2750495 - protein, 5 aa, Entamoeba invadens
DLKPD

SEQ ID NO: 2750496 - protein, 18 aa, Entamoeba invadens
DLKPNGRNIDVTDENKHE

SEQ ID NO: 2750497 - protein, 10 aa, Entamoeba invadens
DLKPTKPVDS

SEQ ID NO: 2750498 - protein, 5 aa, Entamoeba invadens
DLKSD

SEQ ID NO: 2750499 - protein, 7 aa, Entamoeba invadens
DLKTAAK

SEQ ID NO: 2750500 - protein, 9 aa, Entamoeba invadens
DLKTEARKV

SEQ ID NO: 2750501 - protein, 8 aa, Entamoeba invadens
DLKTQTMN

SEQ ID NO: 2750502 - protein, 7 aa, Entamoeba invadens
DLNATEK

SEQ ID NO: 2750503 - protein, 16 aa, Entamoeba invadens
DLNESFSGTFDQQETV

SEQ ID NO: 2750504 - protein, 16 aa, Entamoeba invadens
DLNEYKDNEELYTSDS

SEQ ID NO: 2750505 - protein, 4 aa, Entamoeba invadens
DLNG

SEQ ID NO: 2750506 - protein, 17 aa, Entamoeba invadens
DLNGNVEMSGNNLSSGM

SEQ ID NO: 2750507 - protein, 10 aa, Entamoeba invadens
DLNQPRKGWD

SEQ ID NO: 2750508 - protein, 4 aa, Entamoeba invadens
DLNY

SEQ ID NO: 2750509 - protein, 8 aa, Entamoeba invadens
DLNYASQG

SEQ ID NO: 2750510 - protein, 19 aa, Entamoeba invadens
DLPIGERGTSVEYDMKSGE

SEQ ID NO: 2750511 - protein, 6 aa, Entamoeba invadens
DLPNEQ

SEQ ID NO: 2750512 - protein, 20 aa, Entamoeba invadens
DLPPKDANNFEEKFTESPEE

SEQ ID NO: 2750513 - protein, 7 aa, Entamoeba invadens
DLPTGDR

SEQ ID NO: 2750514 - protein, 27 aa, Entamoeba invadens
DLQQPQESFRSTLQSQNSQNENERSSI

SEQ ID NO: 2750515 - protein, 15 aa, Entamoeba invadens
DLQSTTDTSSSSTDS

SEQ ID NO: 2750516 - protein, 16 aa, Entamoeba invadens
DLRESEEKIESNIPKG

SEQ ID NO: 2750517 - protein, 15 aa, Entamoeba invadens
DLRESNGNIESDFPQ

SEQ ID NO: 2750518 - protein, 8 aa, Entamoeba invadens
DLRTKVED

SEQ ID NO: 2750519 - protein, 4 aa, Entamoeba invadens
DLSD

SEQ ID NO: 2750520 - protein, 45 aa, Entamoeba invadens
DLSDSDVEDESDSKRVHRTKKSTVQAKERKRNNRVNANRNDYGNE

SEQ ID NO: 2750521 - protein, 8 aa, Entamoeba invadens
DLSEDDLV

SEQ ID NO: 2750522 - protein, 7 aa, Entamoeba invadens
DLSENTM

SEQ ID NO: 2750523 - protein, 9 aa, Entamoeba invadens
DLSKKENSV

SEQ ID NO: 2750524 - protein, 7 aa, Entamoeba invadens
DLSQQLN

SEQ ID NO: 2750525 - protein, 16 aa, Entamoeba invadens
DLSSENGLKSVGDSYR

SEQ ID NO: 2750526 - protein, 6 aa, Entamoeba invadens
DLSSNL

SEQ ID NO: 2750527 - protein, 46 aa, Entamoeba invadens
DLSSSENSKNSSQVNSEENGNKINDKTDQNDIQTVNENVTDNTTLK

SEQ ID NO: 2750528 - protein, 6 aa, Entamoeba invadens
DLSSSK

SEQ ID NO: 2750529 - protein, 6 aa, Entamoeba invadens
DLSTQK

SEQ ID NO: 2750530 - protein, 8 aa, Entamoeba invadens
DLSTSKQK

SEQ ID NO: 2750531 - protein, 11 aa, Entamoeba invadens
DLTEEQATQIR

SEQ ID NO: 2750532 - protein, 6 aa, Entamoeba invadens
DLTPKE

SEQ ID NO: 2750533 - protein, 4 aa, Entamoeba invadens
DLTS

SEQ ID NO: 2750534 - protein, 13 aa, Entamoeba invadens
DLTSNPETYDNSR

SEQ ID NO: 2750535 - protein, 5 aa, Entamoeba invadens
DLTSS

SEQ ID NO: 2750536 - protein, 5 aa, Entamoeba invadens
DLTST

SEQ ID NO: 2750537 - protein, 6 aa, Entamoeba invadens
DLTTSF

SEQ ID NO: 2750538 - protein, 4 aa, Entamoeba invadens
DLVA

SEQ ID NO: 2750539 - protein, 14 aa, Entamoeba invadens
DLVSSTDISYPTFT

SEQ ID NO: 2750540 - protein, 8 aa, Entamoeba invadens
DMATLNDT

SEQ ID NO: 2750541 - protein, 9 aa, Entamoeba invadens
DMDSPSNII

SEQ ID NO: 2750542 - protein, 16 aa, Entamoeba invadens
DMEISKGKCSKCETEN

SEQ ID NO: 2750543 - protein, 13 aa, Entamoeba invadens
DMEPADKGDLTKK

SEQ ID NO: 2750544 - protein, 5 aa, Entamoeba invadens
DMERT

SEQ ID NO: 2750545 - protein, 19 aa, Entamoeba invadens
DMESTLRKKEGDLDNYHLL

SEQ ID NO: 2750546 - protein, 7 aa, Entamoeba invadens
DMGGADN

SEQ ID NO: 2750547 - protein, 9 aa, Entamoeba invadens
DMGNKSATS

SEQ ID NO: 2750548 - protein, 4 aa, Entamoeba invadens
DMIP

SEQ ID NO: 2750549 - protein, 20 aa, Entamoeba invadens
DMKASEKKGSETVSSKEDKV

SEQ ID NO: 2750550 - protein, 17 aa, Entamoeba invadens
DMKEEDVSDSSSSVEPL

SEQ ID NO: 2750551 - protein, 6 aa, Entamoeba invadens
DMNDSK

SEQ ID NO: 2750552 - protein, 10 aa, Entamoeba invadens
DMNNNTSYQN

SEQ ID NO: 2750553 - protein, 10 aa, Entamoeba invadens
DMNNNTSYQS

SEQ ID NO: 2750554 - protein, 6 aa, Entamoeba invadens
DMNTAV

SEQ ID NO: 2750555 - protein, 12 aa, Entamoeba invadens
DMQNASKTQPIS

SEQ ID NO: 2750556 - protein, 6 aa, Entamoeba invadens
DMQSTE

SEQ ID NO: 2750557 - protein, 8 aa, Entamoeba invadens
DMRYEEKS

SEQ ID NO: 2750558 - protein, 7 aa, Entamoeba invadens
DMSHRSP

SEQ ID NO: 2750559 - protein, 6 aa, Entamoeba invadens
DMSTNI

SEQ ID NO: 2750560 - protein, 4 aa, Entamoeba invadens
DMTN

SEQ ID NO: 2750561 - protein, 4 aa, Entamoeba invadens
DMVP

SEQ ID NO: 2750562 - protein, 7 aa, Entamoeba invadens
DMYQSGD

SEQ ID NO: 2750563 - protein, 10 aa, Entamoeba invadens
DNADGNACRD

SEQ ID NO: 2750564 - protein, 9 aa, Entamoeba invadens
DNAEKTKDY

SEQ ID NO: 2750565 - protein, 13 aa, Entamoeba invadens
DNAENQIPVATES

SEQ ID NO: 2750566 - protein, 7 aa, Entamoeba invadens
DNANAPQ

SEQ ID NO: 2750567 - protein, 21 aa, Entamoeba invadens
DNANDENIQTTKDQEDTKVET

SEQ ID NO: 2750568 - protein, 6 aa, Entamoeba invadens
DNANEC

SEQ ID NO: 2750569 - protein, 6 aa, Entamoeba invadens
DNANIN

SEQ ID NO: 2750570 - protein, 8 aa, Entamoeba invadens
DNAPQDTV

SEQ ID NO: 2750571 - protein, 8 aa, Entamoeba invadens
DNARVETN

SEQ ID NO: 2750572 - protein, 5 aa, Entamoeba invadens
DNASI

SEQ ID NO: 2750573 - protein, 4 aa, Entamoeba invadens
DNAT

SEQ ID NO: 2750574 - protein, 8 aa, Entamoeba invadens
DNATTESY

SEQ ID NO: 2750575 - protein, 4 aa, Entamoeba invadens
DNCD

SEQ ID NO: 2750576 - protein, 5 aa, Entamoeba invadens
DNCEK

SEQ ID NO: 2750577 - protein, 15 aa, Entamoeba invadens
DNCELSDSDGHPLEN

SEQ ID NO: 2750578 - protein, 9 aa, Entamoeba invadens
DNCEYSTNG

SEQ ID NO: 2750579 - protein, 11 aa, Entamoeba invadens
DNCGGYSTNGY

SEQ ID NO: 2750580 - protein, 12 aa, Entamoeba invadens
DNCNENSGAGFC

SEQ ID NO: 2750581 - protein, 9 aa, Entamoeba invadens
DNCNQENGK

SEQ ID NO: 2750582 - protein, 7 aa, Entamoeba invadens
DNCNSEI

SEQ ID NO: 2750583 - protein, 6 aa, Entamoeba invadens
DNCNTC

SEQ ID NO: 2750584 - protein, 4 aa, Entamoeba invadens
DNCS

SEQ ID NO: 2750585 - protein, 15 aa, Entamoeba invadens
DNCSENAITTNGDCS

SEQ ID NO: 2750586 - protein, 6 aa, Entamoeba invadens
DNCSPE

SEQ ID NO: 2750587 - protein, 5 aa, Entamoeba invadens
DNCTT

SEQ ID NO: 2750588 - protein, 7 aa, Entamoeba invadens
DNDDDIS

SEQ ID NO: 2750589 - protein, 9 aa, Entamoeba invadens
DNDDSKCEN

SEQ ID NO: 2750590 - protein, 4 aa, Entamoeba invadens
DNDF

SEQ ID NO: 2750591 - protein, 8 aa, Entamoeba invadens
DNDKTQRL

SEQ ID NO: 2750592 - protein, 5 aa, Entamoeba invadens
DNDLP

SEQ ID NO: 2750593 - protein, 8 aa, Entamoeba invadens
DNDNISNS

SEQ ID NO: 2750594 - protein, 10 aa, Entamoeba invadens
DNDPNERPEF

SEQ ID NO: 2750595 - protein, 13 aa, Entamoeba invadens
DNDPNKRPKFPEI

SEQ ID NO: 2750596 - protein, 4 aa, Entamoeba invadens
DNDQ

SEQ ID NO: 2750597 - protein, 7 aa, Entamoeba invadens
DNDQENA

SEQ ID NO: 2750598 - protein, 8 aa, Entamoeba invadens
DNDQNCNN

SEQ ID NO: 2750599 - protein, 9 aa, Entamoeba invadens
DNDQSCKSC

SEQ ID NO: 2750600 - protein, 9 aa, Entamoeba invadens
DNDRNKDTP

SEQ ID NO: 2750601 - protein, 8 aa, Entamoeba invadens
DNDSELST

SEQ ID NO: 2750602 - protein, 7 aa, Entamoeba invadens
DNDSIPD

SEQ ID NO: 2750603 - protein, 8 aa, Entamoeba invadens
DNDTEESI

SEQ ID NO: 2750604 - protein, 9 aa, Entamoeba invadens
DNDTIKQPI

SEQ ID NO: 2750605 - protein, 7 aa, Entamoeba invadens
DNDVAEY

SEQ ID NO: 2750606 - protein, 149 aa, Entamoeba invadens
DNEESSSAVDNSSVDVSSGIDNSSVESSDNSQQNSSENSIETSSTTSLESSDNSQEDSSVSSQDVSSENSQASSESSQVESSDNTSSNIQESSDSLENSSENSQQDSSENSIETSSTASLASSDNSQEDNSTNSEHQSSNNTTSDGDND

SEQ ID NO: 2750607 - protein, 8 aa, Entamoeba invadens
DNEETGIP

SEQ ID NO: 2750608 - protein, 4 aa, Entamoeba invadens
DNEG

SEQ ID NO: 2750609 - protein, 8 aa, Entamoeba invadens
DNEGIRRD

SEQ ID NO: 2750610 - protein, 8 aa, Entamoeba invadens
DNEGYTPL

SEQ ID NO: 2750611 - protein, 7 aa, Entamoeba invadens
DNEITTK

SEQ ID NO: 2750612 - protein, 6 aa, Entamoeba invadens
DNEKAV

SEQ ID NO: 2750613 - protein, 6 aa, Entamoeba invadens
DNEKFP

SEQ ID NO: 2750614 - protein, 8 aa, Entamoeba invadens
DNEKPTNY

SEQ ID NO: 2750615 - protein, 8 aa, Entamoeba invadens
DNELGNKT

SEQ ID NO: 2750616 - protein, 8 aa, Entamoeba invadens
DNEMKTKT

SEQ ID NO: 2750617 - protein, 4 aa, Entamoeba invadens
DNEN

SEQ ID NO: 2750618 - protein, 14 aa, Entamoeba invadens
DNENGDIPVGKETR

SEQ ID NO: 2750619 - protein, 12 aa, Entamoeba invadens
DNENTMDSNKNC

SEQ ID NO: 2750620 - protein, 8 aa, Entamoeba invadens
DNENYGET

SEQ ID NO: 2750621 - protein, 4 aa, Entamoeba invadens
DNEP

SEQ ID NO: 2750622 - protein, 23 aa, Entamoeba invadens
DNEPTKRSSLENVKYELETIFNH

SEQ ID NO: 2750623 - protein, 8 aa, Entamoeba invadens
DNEPTNIK

SEQ ID NO: 2750624 - protein, 5 aa, Entamoeba invadens
DNEQL

SEQ ID NO: 2750625 - protein, 6 aa, Entamoeba invadens
DNEQTI

SEQ ID NO: 2750626 - protein, 4 aa, Entamoeba invadens
DNER

SEQ ID NO: 2750627 - protein, 7 aa, Entamoeba invadens
DNERVNA

SEQ ID NO: 2750628 - protein, 16 aa, Entamoeba invadens
DNESKMEGEGQDKGEN

SEQ ID NO: 2750629 - protein, 14 aa, Entamoeba invadens
DNESRELLCVGNAS

SEQ ID NO: 2750630 - protein, 6 aa, Entamoeba invadens
DNESTE

SEQ ID NO: 2750631 - protein, 6 aa, Entamoeba invadens
DNETHI

SEQ ID NO: 2750632 - protein, 24 aa, Entamoeba invadens
DNETKKCETCSEGCDTCTSESGIT

SEQ ID NO: 2750633 - protein, 4 aa, Entamoeba invadens
DNEV

SEQ ID NO: 2750634 - protein, 5 aa, Entamoeba invadens
DNEVA

SEQ ID NO: 2750635 - protein, 7 aa, Entamoeba invadens
DNEVATA

SEQ ID NO: 2750636 - protein, 5 aa, Entamoeba invadens
DNEYT

SEQ ID NO: 2750637 - protein, 4 aa, Entamoeba invadens
DNFG

SEQ ID NO: 2750638 - protein, 7 aa, Entamoeba invadens
DNFKPSV

SEQ ID NO: 2750639 - protein, 22 aa, Entamoeba invadens
DNGANNENIKEEDTGCGTDETI

SEQ ID NO: 2750640 - protein, 7 aa, Entamoeba invadens
DNGANTD

SEQ ID NO: 2750641 - protein, 7 aa, Entamoeba invadens
DNGCTNC

SEQ ID NO: 2750642 - protein, 8 aa, Entamoeba invadens
DNGCTSCK

SEQ ID NO: 2750643 - protein, 6 aa, Entamoeba invadens
DNGEAL

SEQ ID NO: 2750644 - protein, 11 aa, Entamoeba invadens
DNGEEDEQECD

SEQ ID NO: 2750645 - protein, 6 aa, Entamoeba invadens
DNGERY

SEQ ID NO: 2750646 - protein, 5 aa, Entamoeba invadens
DNGGS

SEQ ID NO: 2750647 - protein, 8 aa, Entamoeba invadens
DNGHPTKC

SEQ ID NO: 2750648 - protein, 8 aa, Entamoeba invadens
DNGLTSSN

SEQ ID NO: 2750649 - protein, 4 aa, Entamoeba invadens
DNGN

SEQ ID NO: 2750650 - protein, 7 aa, Entamoeba invadens
DNGNATT

SEQ ID NO: 2750651 - protein, 8 aa, Entamoeba invadens
DNGNETTS

SEQ ID NO: 2750652 - protein, 6 aa, Entamoeba invadens
DNGNKM

SEQ ID NO: 2750653 - protein, 9 aa, Entamoeba invadens
DNGRNPNKI

SEQ ID NO: 2750654 - protein, 5 aa, Entamoeba invadens
DNGSN

SEQ ID NO: 2750655 - protein, 8 aa, Entamoeba invadens
DNGSNNDC

SEQ ID NO: 2750656 - protein, 7 aa, Entamoeba invadens
DNGVFSE

SEQ ID NO: 2750657 - protein, 10 aa, Entamoeba invadens
DNGVSREGGY

SEQ ID NO: 2750658 - protein, 7 aa, Entamoeba invadens
DNHAEVA

SEQ ID NO: 2750659 - protein, 6 aa, Entamoeba invadens
DNHIPT

SEQ ID NO: 2750660 - protein, 5 aa, Entamoeba invadens
DNHLQ

SEQ ID NO: 2750661 - protein, 6 aa, Entamoeba invadens
DNHPKK

SEQ ID NO: 2750662 - protein, 21 aa, Entamoeba invadens
DNHSGCNACPPGTFAANTGSY

SEQ ID NO: 2750663 - protein, 9 aa, Entamoeba invadens
DNIATAKSI

SEQ ID NO: 2750664 - protein, 8 aa, Entamoeba invadens
DNIDQETV

SEQ ID NO: 2750665 - protein, 5 aa, Entamoeba invadens
DNIGK

SEQ ID NO: 2750666 - protein, 8 aa, Entamoeba invadens
DNIPGDVA

SEQ ID NO: 2750667 - protein, 13 aa, Entamoeba invadens
DNIPLTSSTFSQT

SEQ ID NO: 2750668 - protein, 10 aa, Entamoeba invadens
DNIQTKPPSM

SEQ ID NO: 2750669 - protein, 14 aa, Entamoeba invadens
DNKCEGKVISTENQ

SEQ ID NO: 2750670 - protein, 8 aa, Entamoeba invadens
DNKCESTE

SEQ ID NO: 2750671 - protein, 8 aa, Entamoeba invadens
DNKCQSTE

SEQ ID NO: 2750672 - protein, 6 aa, Entamoeba invadens
DNKEIK

SEQ ID NO: 2750673 - protein, 11 aa, Entamoeba invadens
DNKELDLPSQR

SEQ ID NO: 2750674 - protein, 9 aa, Entamoeba invadens
DNKFYSKNA

SEQ ID NO: 2750675 - protein, 4 aa, Entamoeba invadens
DNKG

SEQ ID NO: 2750676 - protein, 11 aa, Entamoeba invadens
DNKGESTAFQC

SEQ ID NO: 2750677 - protein, 30 aa, Entamoeba invadens
DNKKGDGERLDENTKLEETKESDLEVPPPL

SEQ ID NO: 2750678 - protein, 9 aa, Entamoeba invadens
DNKKSEEIT

SEQ ID NO: 2750679 - protein, 6 aa, Entamoeba invadens
DNKKTS

SEQ ID NO: 2750680 - protein, 6 aa, Entamoeba invadens
DNKNDW

SEQ ID NO: 2750681 - protein, 9 aa, Entamoeba invadens
DNKNFPMKT

SEQ ID NO: 2750682 - protein, 6 aa, Entamoeba invadens
DNKNVT

SEQ ID NO: 2750683 - protein, 9 aa, Entamoeba invadens
DNKQAGACS

SEQ ID NO: 2750684 - protein, 10 aa, Entamoeba invadens
DNKRCINKSD

SEQ ID NO: 2750685 - protein, 13 aa, Entamoeba invadens
DNKRMEKSDNITA

SEQ ID NO: 2750686 - protein, 9 aa, Entamoeba invadens
DNKSQSIDL

SEQ ID NO: 2750687 - protein, 5 aa, Entamoeba invadens
DNKTF

SEQ ID NO: 2750688 - protein, 10 aa, Entamoeba invadens
DNKTKISSDV

SEQ ID NO: 2750689 - protein, 12 aa, Entamoeba invadens
DNKTNKGNAATR

SEQ ID NO: 2750690 - protein, 8 aa, Entamoeba invadens
DNKWTPTC

SEQ ID NO: 2750691 - protein, 6 aa, Entamoeba invadens
DNLAEK

SEQ ID NO: 2750692 - protein, 4 aa, Entamoeba invadens
DNLD

SEQ ID NO: 2750693 - protein, 18 aa, Entamoeba invadens
DNLDGKQARRTKNGSPLG

SEQ ID NO: 2750694 - protein, 8 aa, Entamoeba invadens
DNLDNSMG

SEQ ID NO: 2750695 - protein, 16 aa, Entamoeba invadens
DNLDPEGKYDDKQIKE

SEQ ID NO: 2750696 - protein, 14 aa, Entamoeba invadens
DNLDPTHMKSDEEM

SEQ ID NO: 2750697 - protein, 13 aa, Entamoeba invadens
DNLDPTLKKTEED

SEQ ID NO: 2750698 - protein, 9 aa, Entamoeba invadens
DNLEKESGT

SEQ ID NO: 2750699 - protein, 14 aa, Entamoeba invadens
DNMDPENTKTEDEI

SEQ ID NO: 2750700 - protein, 19 aa, Entamoeba invadens
DNMNDQTKNTLKKNNITSK

SEQ ID NO: 2750701 - protein, 6 aa, Entamoeba invadens
DNMNKN

SEQ ID NO: 2750702 - protein, 5 aa, Entamoeba invadens
DNNCK

SEQ ID NO: 2750703 - protein, 6 aa, Entamoeba invadens
DNNDPL

SEQ ID NO: 2750704 - protein, 7 aa, Entamoeba invadens
DNNDPLK

SEQ ID NO: 2750705 - protein, 23 aa, Entamoeba invadens
DNNECKKIGEDDNNADNHENASE

SEQ ID NO: 2750706 - protein, 12 aa, Entamoeba invadens
DNNELSQDKTCN

SEQ ID NO: 2750707 - protein, 6 aa, Entamoeba invadens
DNNFPL

SEQ ID NO: 2750708 - protein, 14 aa, Entamoeba invadens
DNNGEKKNERLYSA

SEQ ID NO: 2750709 - protein, 4 aa, Entamoeba invadens
DNNI

SEQ ID NO: 2750710 - protein, 11 aa, Entamoeba invadens
DNNKCSKCDAS

SEQ ID NO: 2750711 - protein, 10 aa, Entamoeba invadens
DNNKNQTVVP

SEQ ID NO: 2750712 - protein, 6 aa, Entamoeba invadens
DNNNGP

SEQ ID NO: 2750713 - protein, 5 aa, Entamoeba invadens
DNNNI

SEQ ID NO: 2750714 - protein, 8 aa, Entamoeba invadens
DNNNKCTK

SEQ ID NO: 2750715 - protein, 11 aa, Entamoeba invadens
DNNSKNCQPND

SEQ ID NO: 2750716 - protein, 5 aa, Entamoeba invadens
DNNTD

SEQ ID NO: 2750717 - protein, 4 aa, Entamoeba invadens
DNNY

SEQ ID NO: 2750718 - protein, 5 aa, Entamoeba invadens
DNNYL

SEQ ID NO: 2750719 - protein, 5 aa, Entamoeba invadens
DNPEV

SEQ ID NO: 2750720 - protein, 12 aa, Entamoeba invadens
DNPKDPTSTKDG

SEQ ID NO: 2750721 - protein, 6 aa, Entamoeba invadens
DNPNNC

SEQ ID NO: 2750722 - protein, 7 aa, Entamoeba invadens
DNPNSDV

SEQ ID NO: 2750723 - protein, 7 aa, Entamoeba invadens
DNPQGEI

SEQ ID NO: 2750724 - protein, 4 aa, Entamoeba invadens
DNPR

SEQ ID NO: 2750725 - protein, 4 aa, Entamoeba invadens
DNPT

SEQ ID NO: 2750726 - protein, 9 aa, Entamoeba invadens
DNPTKEQSC

SEQ ID NO: 2750727 - protein, 9 aa, Entamoeba invadens
DNQNGECKN

SEQ ID NO: 2750728 - protein, 7 aa, Entamoeba invadens
DNQNTSK

SEQ ID NO: 2750729 - protein, 7 aa, Entamoeba invadens
DNQPTLE

SEQ ID NO: 2750730 - protein, 5 aa, Entamoeba invadens
DNQVY

SEQ ID NO: 2750731 - protein, 6 aa, Entamoeba invadens
DNRPTF

SEQ ID NO: 2750732 - protein, 4 aa, Entamoeba invadens
DNRR

SEQ ID NO: 2750733 - protein, 6 aa, Entamoeba invadens
DNRTPG

SEQ ID NO: 2750734 - protein, 10 aa, Entamoeba invadens
DNSAEGSKIP

SEQ ID NO: 2750735 - protein, 10 aa, Entamoeba invadens
DNSATKQNSQ

SEQ ID NO: 2750736 - protein, 8 aa, Entamoeba invadens
DNSCGGMN

SEQ ID NO: 2750737 - protein, 11 aa, Entamoeba invadens
DNSDGEFTSEG

SEQ ID NO: 2750738 - protein, 6 aa, Entamoeba invadens
DNSDNV

SEQ ID NO: 2750739 - protein, 6 aa, Entamoeba invadens
DNSDSC

SEQ ID NO: 2750740 - protein, 5 aa, Entamoeba invadens
DNSGI

SEQ ID NO: 2750741 - protein, 6 aa, Entamoeba invadens
DNSGSL

SEQ ID NO: 2750742 - protein, 19 aa, Entamoeba invadens
DNSITETGECSALERTNEC

SEQ ID NO: 2750743 - protein, 6 aa, Entamoeba invadens
DNSKCE

SEQ ID NO: 2750744 - protein, 7 aa, Entamoeba invadens
DNSKQRC

SEQ ID NO: 2750745 - protein, 9 aa, Entamoeba invadens
DNSKVTKGY

SEQ ID NO: 2750746 - protein, 4 aa, Entamoeba invadens
DNSL

SEQ ID NO: 2750747 - protein, 22 aa, Entamoeba invadens
DNSLSVGPKDVPLNSNPTTVES

SEQ ID NO: 2750748 - protein, 8 aa, Entamoeba invadens
DNSLTQFN

SEQ ID NO: 2750749 - protein, 9 aa, Entamoeba invadens
DNSNGSVKG

SEQ ID NO: 2750750 - protein, 15 aa, Entamoeba invadens
DNSNIDTSANTDHIT

SEQ ID NO: 2750751 - protein, 6 aa, Entamoeba invadens
DNSNIT

SEQ ID NO: 2750752 - protein, 5 aa, Entamoeba invadens
DNSNK

SEQ ID NO: 2750753 - protein, 22 aa, Entamoeba invadens
DNSPDKTGAKVQELQKAGHKCE

SEQ ID NO: 2750754 - protein, 5 aa, Entamoeba invadens
DNSQD

SEQ ID NO: 2750755 - protein, 6 aa, Entamoeba invadens
DNSQNS

SEQ ID NO: 2750756 - protein, 7 aa, Entamoeba invadens
DNSRGSF

SEQ ID NO: 2750757 - protein, 5 aa, Entamoeba invadens
DNSSA

SEQ ID NO: 2750758 - protein, 8 aa, Entamoeba invadens
DNSTDGKY

SEQ ID NO: 2750759 - protein, 7 aa, Entamoeba invadens
DNSTKCR

SEQ ID NO: 2750760 - protein, 7 aa, Entamoeba invadens
DNSTLSN

SEQ ID NO: 2750761 - protein, 8 aa, Entamoeba invadens
DNSTLSNM

SEQ ID NO: 2750762 - protein, 9 aa, Entamoeba invadens
DNSTNSPPL

SEQ ID NO: 2750763 - protein, 9 aa, Entamoeba invadens
DNSTQSPPY

SEQ ID NO: 2750764 - protein, 5 aa, Entamoeba invadens
DNSVL

SEQ ID NO: 2750765 - protein, 12 aa, Entamoeba invadens
DNSVSGDTTGAK

SEQ ID NO: 2750766 - protein, 5 aa, Entamoeba invadens
DNSWC

SEQ ID NO: 2750767 - protein, 7 aa, Entamoeba invadens
DNTAGVQ

SEQ ID NO: 2750768 - protein, 8 aa, Entamoeba invadens
DNTAQAKD

SEQ ID NO: 2750769 - protein, 4 aa, Entamoeba invadens
DNTC

SEQ ID NO: 2750770 - protein, 7 aa, Entamoeba invadens
DNTCASC

SEQ ID NO: 2750771 - protein, 8 aa, Entamoeba invadens
DNTCEPTE

SEQ ID NO: 2750772 - protein, 8 aa, Entamoeba invadens
DNTCERTE

SEQ ID NO: 2750773 - protein, 7 aa, Entamoeba invadens
DNTCQEC

SEQ ID NO: 2750774 - protein, 8 aa, Entamoeba invadens
DNTDSGIP

SEQ ID NO: 2750775 - protein, 5 aa, Entamoeba invadens
DNTDT

SEQ ID NO: 2750776 - protein, 5 aa, Entamoeba invadens
DNTEC

SEQ ID NO: 2750777 - protein, 14 aa, Entamoeba invadens
DNTEGTPIDVDAEA

SEQ ID NO: 2750778 - protein, 13 aa, Entamoeba invadens
DNTFEDSSADIVE

SEQ ID NO: 2750779 - protein, 7 aa, Entamoeba invadens
DNTFENG

SEQ ID NO: 2750780 - protein, 15 aa, Entamoeba invadens
DNTIETTDKLNAEDA

SEQ ID NO: 2750781 - protein, 11 aa, Entamoeba invadens
DNTIKASENVF

SEQ ID NO: 2750782 - protein, 6 aa, Entamoeba invadens
DNTIRG

SEQ ID NO: 2750783 - protein, 7 aa, Entamoeba invadens
DNTIRYD

SEQ ID NO: 2750784 - protein, 6 aa, Entamoeba invadens
DNTKEL

SEQ ID NO: 2750785 - protein, 5 aa, Entamoeba invadens
DNTKK

SEQ ID NO: 2750786 - protein, 10 aa, Entamoeba invadens
DNTKKTLSKN

SEQ ID NO: 2750787 - protein, 5 aa, Entamoeba invadens
DNTKS

SEQ ID NO: 2750788 - protein, 4 aa, Entamoeba invadens
DNTL

SEQ ID NO: 2750789 - protein, 8 aa, Entamoeba invadens
DNTNETPV

SEQ ID NO: 2750790 - protein, 14 aa, Entamoeba invadens
DNTNHSSTGVPKTR

SEQ ID NO: 2750791 - protein, 6 aa, Entamoeba invadens
DNTNID

SEQ ID NO: 2750792 - protein, 10 aa, Entamoeba invadens
DNTNNKYDPM

SEQ ID NO: 2750793 - protein, 9 aa, Entamoeba invadens
DNTPMKSET

SEQ ID NO: 2750794 - protein, 5 aa, Entamoeba invadens
DNTQL

SEQ ID NO: 2750795 - protein, 13 aa, Entamoeba invadens
DNTQTKQTAPEYE

SEQ ID NO: 2750796 - protein, 4 aa, Entamoeba invadens
DNTR

SEQ ID NO: 2750797 - protein, 14 aa, Entamoeba invadens
DNTSGSDQNPGDSK

SEQ ID NO: 2750798 - protein, 7 aa, Entamoeba invadens
DNTSNSC

SEQ ID NO: 2750799 - protein, 10 aa, Entamoeba invadens
DNTSYEKKKD

SEQ ID NO: 2750800 - protein, 6 aa, Entamoeba invadens
DNTTEN

SEQ ID NO: 2750801 - protein, 5 aa, Entamoeba invadens
DNTTI

SEQ ID NO: 2750802 - protein, 5 aa, Entamoeba invadens
DNTTL

SEQ ID NO: 2750803 - protein, 7 aa, Entamoeba invadens
DNTTPNK

SEQ ID NO: 2750804 - protein, 7 aa, Entamoeba invadens
DNTTSAT

SEQ ID NO: 2750805 - protein, 4 aa, Entamoeba invadens
DNTY

SEQ ID NO: 2750806 - protein, 5 aa, Entamoeba invadens
DNTYK

SEQ ID NO: 2750807 - protein, 7 aa, Entamoeba invadens
DNVAGDY

SEQ ID NO: 2750808 - protein, 6 aa, Entamoeba invadens
DNVDKS

SEQ ID NO: 2750809 - protein, 9 aa, Entamoeba invadens
DNVDSPNGM

SEQ ID NO: 2750810 - protein, 4 aa, Entamoeba invadens
DNVE

SEQ ID NO: 2750811 - protein, 6 aa, Entamoeba invadens
DNVEDP

SEQ ID NO: 2750812 - protein, 5 aa, Entamoeba invadens
DNVKL

SEQ ID NO: 2750813 - protein, 8 aa, Entamoeba invadens
DNVKTDTI

SEQ ID NO: 2750814 - protein, 10 aa, Entamoeba invadens
DNVNRGSPLT

SEQ ID NO: 2750815 - protein, 14 aa, Entamoeba invadens
DNVNTKLTDFGSAR

SEQ ID NO: 2750816 - protein, 17 aa, Entamoeba invadens
DNVPSESESNGNESNNH

SEQ ID NO: 2750817 - protein, 13 aa, Entamoeba invadens
DNVRDQALGDPQV

SEQ ID NO: 2750818 - protein, 16 aa, Entamoeba invadens
DNVSAKLTDFGSSRNY

SEQ ID NO: 2750819 - protein, 7 aa, Entamoeba invadens
DNWGELD

SEQ ID NO: 2750820 - protein, 10 aa, Entamoeba invadens
DNWSTTNPQM

SEQ ID NO: 2750821 - protein, 10 aa, Entamoeba invadens
DNYESGLEEF

SEQ ID NO: 2750822 - protein, 12 aa, Entamoeba invadens
DNYKSEGNQCVP

SEQ ID NO: 2750823 - protein, 7 aa, Entamoeba invadens
DNYNEKE

SEQ ID NO: 2750824 - protein, 8 aa, Entamoeba invadens
DNYPPSIK

SEQ ID NO: 2750825 - protein, 7 aa, Entamoeba invadens
DNYPSGS

SEQ ID NO: 2750826 - protein, 7 aa, Entamoeba invadens
DNYSPSE

SEQ ID NO: 2750827 - protein, 4 aa, Entamoeba invadens
DNYT

SEQ ID NO: 2750828 - protein, 6 aa, Entamoeba invadens
DNYTES

SEQ ID NO: 2750829 - protein, 12 aa, Entamoeba invadens
DNYTPNSGICTS

SEQ ID NO: 2750830 - protein, 5 aa, Entamoeba invadens
DNYYK

SEQ ID NO: 2750831 - protein, 6 aa, Entamoeba invadens
DPAERI

SEQ ID NO: 2750832 - protein, 5 aa, Entamoeba invadens
DPAKY

SEQ ID NO: 2750833 - protein, 7 aa, Entamoeba invadens
DPAYTAP

SEQ ID NO: 2750834 - protein, 11 aa, Entamoeba invadens
DPCDTSNDVSI

SEQ ID NO: 2750835 - protein, 10 aa, Entamoeba invadens
DPCKENKNEF

SEQ ID NO: 2750836 - protein, 6 aa, Entamoeba invadens
DPCSPQ

SEQ ID NO: 2750837 - protein, 12 aa, Entamoeba invadens
DPDCSSCSQTTR

SEQ ID NO: 2750838 - protein, 6 aa, Entamoeba invadens
DPDDEF

SEQ ID NO: 2750839 - protein, 15 aa, Entamoeba invadens
DPDELDTEKKLGEGS

SEQ ID NO: 2750840 - protein, 9 aa, Entamoeba invadens
DPDERPTFS

SEQ ID NO: 2750841 - protein, 5 aa, Entamoeba invadens
DPDKY

SEQ ID NO: 2750842 - protein, 7 aa, Entamoeba invadens
DPDTNIG

SEQ ID NO: 2750843 - protein, 14 aa, Entamoeba invadens
DPECSHKRTPGQYY

SEQ ID NO: 2750844 - protein, 9 aa, Entamoeba invadens
DPEDAAKFG

SEQ ID NO: 2750845 - protein, 14 aa, Entamoeba invadens
DPEDPSRKTSLNDL

SEQ ID NO: 2750846 - protein, 6 aa, Entamoeba invadens
DPENAD

SEQ ID NO: 2750847 - protein, 6 aa, Entamoeba invadens
DPENGI

SEQ ID NO: 2750848 - protein, 6 aa, Entamoeba invadens
DPENNE

SEQ ID NO: 2750849 - protein, 10 aa, Entamoeba invadens
DPEPWADASS

SEQ ID NO: 2750850 - protein, 5 aa, Entamoeba invadens
DPERT

SEQ ID NO: 2750851 - protein, 6 aa, Entamoeba invadens
DPESAY

SEQ ID NO: 2750852 - protein, 7 aa, Entamoeba invadens
DPETATT

SEQ ID NO: 2750853 - protein, 16 aa, Entamoeba invadens
DPFAPNDKDSLPQNRA

SEQ ID NO: 2750854 - protein, 14 aa, Entamoeba invadens
DPFASNNTIPTSIP

SEQ ID NO: 2750855 - protein, 16 aa, Entamoeba invadens
DPFETPPYLKNNTSQL

SEQ ID NO: 2750856 - protein, 6 aa, Entamoeba invadens
DPFNRP

SEQ ID NO: 2750857 - protein, 4 aa, Entamoeba invadens
DPFP

SEQ ID NO: 2750858 - protein, 5 aa, Entamoeba invadens
DPFPI

SEQ ID NO: 2750859 - protein, 6 aa, Entamoeba invadens
DPFPKE

SEQ ID NO: 2750860 - protein, 5 aa, Entamoeba invadens
DPFTK

SEQ ID NO: 2750861 - protein, 7 aa, Entamoeba invadens
DPGKNSG

SEQ ID NO: 2750862 - protein, 10 aa, Entamoeba invadens
DPGNNGSCES

SEQ ID NO: 2750863 - protein, 5 aa, Entamoeba invadens
DPGYM

SEQ ID NO: 2750864 - protein, 4 aa, Entamoeba invadens
DPID

SEQ ID NO: 2750865 - protein, 7 aa, Entamoeba invadens
DPKDYGY

SEQ ID NO: 2750866 - protein, 5 aa, Entamoeba invadens
DPKEQ

SEQ ID NO: 2750867 - protein, 5 aa, Entamoeba invadens
DPKGL

SEQ ID NO: 2750868 - protein, 4 aa, Entamoeba invadens
DPKN

SEQ ID NO: 2750869 - protein, 9 aa, Entamoeba invadens
DPKPDQNPL

SEQ ID NO: 2750870 - protein, 14 aa, Entamoeba invadens
DPKQENRPTINTSV

SEQ ID NO: 2750871 - protein, 12 aa, Entamoeba invadens
DPKQSSESGVST

SEQ ID NO: 2750872 - protein, 8 aa, Entamoeba invadens
DPKQYNCS

SEQ ID NO: 2750873 - protein, 5 aa, Entamoeba invadens
DPKRT

SEQ ID NO: 2750874 - protein, 18 aa, Entamoeba invadens
DPKSRPQMEIVVDQLENL

SEQ ID NO: 2750875 - protein, 18 aa, Entamoeba invadens
DPKSRPQMEIVVNQLENL

SEQ ID NO: 2750876 - protein, 18 aa, Entamoeba invadens
DPKSRPQMEMVVDQLSKL

SEQ ID NO: 2750877 - protein, 10 aa, Entamoeba invadens
DPKSVNCTSC

SEQ ID NO: 2750878 - protein, 10 aa, Entamoeba invadens
DPKTKTCQNC

SEQ ID NO: 2750879 - protein, 7 aa, Entamoeba invadens
DPKVSPV

SEQ ID NO: 2750880 - protein, 6 aa, Entamoeba invadens
DPLAPK

SEQ ID NO: 2750881 - protein, 11 aa, Entamoeba invadens
DPLKPSENDYS

SEQ ID NO: 2750882 - protein, 38 aa, Entamoeba invadens
DPLQDTNLENTTDETSSYSEVGKNLSSEEEDPNYKDTT

SEQ ID NO: 2750883 - protein, 7 aa, Entamoeba invadens
DPLRNPL

SEQ ID NO: 2750884 - protein, 4 aa, Entamoeba invadens
DPLT

SEQ ID NO: 2750885 - protein, 7 aa, Entamoeba invadens
DPNAPSM

SEQ ID NO: 2750886 - protein, 7 aa, Entamoeba invadens
DPNEDNY

SEQ ID NO: 2750887 - protein, 7 aa, Entamoeba invadens
DPNERER

SEQ ID NO: 2750888 - protein, 6 aa, Entamoeba invadens
DPNESV

SEQ ID NO: 2750889 - protein, 7 aa, Entamoeba invadens
DPNIVQE

SEQ ID NO: 2750890 - protein, 8 aa, Entamoeba invadens
DPNPTQST

SEQ ID NO: 2750891 - protein, 6 aa, Entamoeba invadens
DPNSAC

SEQ ID NO: 2750892 - protein, 5 aa, Entamoeba invadens
DPNSL

SEQ ID NO: 2750893 - protein, 7 aa, Entamoeba invadens
DPNSLNP

SEQ ID NO: 2750894 - protein, 8 aa, Entamoeba invadens
DPNTENFN

SEQ ID NO: 2750895 - protein, 6 aa, Entamoeba invadens
DPNTNQ

SEQ ID NO: 2750896 - protein, 6 aa, Entamoeba invadens
DPNTRI

SEQ ID NO: 2750897 - protein, 6 aa, Entamoeba invadens
DPPAVT

SEQ ID NO: 2750898 - protein, 5 aa, Entamoeba invadens
DPPEN

SEQ ID NO: 2750899 - protein, 5 aa, Entamoeba invadens
DPPND

SEQ ID NO: 2750900 - protein, 7 aa, Entamoeba invadens
DPPQFST

SEQ ID NO: 2750901 - protein, 8 aa, Entamoeba invadens
DPPRNESA

SEQ ID NO: 2750902 - protein, 11 aa, Entamoeba invadens
DPPSNPSDPNA

SEQ ID NO: 2750903 - protein, 9 aa, Entamoeba invadens
DPPSTSCET

SEQ ID NO: 2750904 - protein, 8 aa, Entamoeba invadens
DPPTTTAQ

SEQ ID NO: 2750905 - protein, 15 aa, Entamoeba invadens
DPQHDLSKGFSSIKV

SEQ ID NO: 2750906 - protein, 8 aa, Entamoeba invadens
DPQIPSGV

SEQ ID NO: 2750907 - protein, 5 aa, Entamoeba invadens
DPQNL

SEQ ID NO: 2750908 - protein, 6 aa, Entamoeba invadens
DPQQRL

SEQ ID NO: 2750909 - protein, 23 aa, Entamoeba invadens
DPQSSNGTAQSIRGTGKSFGPDV

SEQ ID NO: 2750910 - protein, 4 aa, Entamoeba invadens
DPQT

SEQ ID NO: 2750911 - protein, 12 aa, Entamoeba invadens
DPQYTNNSYKTL

SEQ ID NO: 2750912 - protein, 6 aa, Entamoeba invadens
DPQYVA

SEQ ID NO: 2750913 - protein, 9 aa, Entamoeba invadens
DPRDPGAYG

SEQ ID NO: 2750914 - protein, 5 aa, Entamoeba invadens
DPRSR

SEQ ID NO: 2750915 - protein, 5 aa, Entamoeba invadens
DPSEL

SEQ ID NO: 2750916 - protein, 7 aa, Entamoeba invadens
DPSEVAT

SEQ ID NO: 2750917 - protein, 25 aa, Entamoeba invadens
DPSGKSGSSLSGAHAPFRGETTQAL

SEQ ID NO: 2750918 - protein, 5 aa, Entamoeba invadens
DPSIE

SEQ ID NO: 2750919 - protein, 6 aa, Entamoeba invadens
DPSKCE

SEQ ID NO: 2750920 - protein, 10 aa, Entamoeba invadens
DPSKKDQYEF

SEQ ID NO: 2750921 - protein, 6 aa, Entamoeba invadens
DPSKTK

SEQ ID NO: 2750922 - protein, 17 aa, Entamoeba invadens
DPSKYLQDNGKASPEGI

SEQ ID NO: 2750923 - protein, 12 aa, Entamoeba invadens
DPSLGKPLPERE

SEQ ID NO: 2750924 - protein, 9 aa, Entamoeba invadens
DPSLSQSDI

SEQ ID NO: 2750925 - protein, 12 aa, Entamoeba invadens
DPSLTKNKTNMD

SEQ ID NO: 2750926 - protein, 8 aa, Entamoeba invadens
DPSNCSVT

SEQ ID NO: 2750927 - protein, 17 aa, Entamoeba invadens
DPSQNISDVDGNPLLET

SEQ ID NO: 2750928 - protein, 9 aa, Entamoeba invadens
DPSQSSNSL

SEQ ID NO: 2750929 - protein, 10 aa, Entamoeba invadens
DPSQVDIGKE

SEQ ID NO: 2750930 - protein, 13 aa, Entamoeba invadens
DPSRNISDVDGNP

SEQ ID NO: 2750931 - protein, 20 aa, Entamoeba invadens
DPSSLDLPPLTQSTSPPTIK

SEQ ID NO: 2750932 - protein, 12 aa, Entamoeba invadens
DPSTKKCEACTS

SEQ ID NO: 2750933 - protein, 6 aa, Entamoeba invadens
DPSTTA

SEQ ID NO: 2750934 - protein, 5 aa, Entamoeba invadens
DPTAG

SEQ ID NO: 2750935 - protein, 21 aa, Entamoeba invadens
DPTCGDSYKRRGQTLAATGNL

SEQ ID NO: 2750936 - protein, 13 aa, Entamoeba invadens
DPTCGGSCDPQNG

SEQ ID NO: 2750937 - protein, 13 aa, Entamoeba invadens
DPTCSSCTSENEC

SEQ ID NO: 2750938 - protein, 4 aa, Entamoeba invadens
DPTK

SEQ ID NO: 2750939 - protein, 11 aa, Entamoeba invadens
DPTKTSLNTNL

SEQ ID NO: 2750940 - protein, 5 aa, Entamoeba invadens
DPTKV

SEQ ID NO: 2750941 - protein, 14 aa, Entamoeba invadens
DPTLGGEKQFESSG

SEQ ID NO: 2750942 - protein, 9 aa, Entamoeba invadens
DPTNSKNGK

SEQ ID NO: 2750943 - protein, 8 aa, Entamoeba invadens
DPTQQASY

SEQ ID NO: 2750944 - protein, 7 aa, Entamoeba invadens
DPTSPIQ

SEQ ID NO: 2750945 - protein, 6 aa, Entamoeba invadens
DPTTEG

SEQ ID NO: 2750946 - protein, 8 aa, Entamoeba invadens
DPTTGLKS

SEQ ID NO: 2750947 - protein, 18 aa, Entamoeba invadens
DPTTGTPYWTESDSTHVG

SEQ ID NO: 2750948 - protein, 6 aa, Entamoeba invadens
DPTTQI

SEQ ID NO: 2750949 - protein, 4 aa, Entamoeba invadens
DPVH

SEQ ID NO: 2750950 - protein, 10 aa, Entamoeba invadens
DPVKVGADSR

SEQ ID NO: 2750951 - protein, 6 aa, Entamoeba invadens
DPVNNG

SEQ ID NO: 2750952 - protein, 4 aa, Entamoeba invadens
DPVQ

SEQ ID NO: 2750953 - protein, 5 aa, Entamoeba invadens
DPYHE

SEQ ID NO: 2750954 - protein, 4 aa, Entamoeba invadens
DPYN

SEQ ID NO: 2750955 - protein, 10 aa, Entamoeba invadens
DPYPGDDPKF

SEQ ID NO: 2750956 - protein, 5 aa, Entamoeba invadens
DPYPI

SEQ ID NO: 2750957 - protein, 5 aa, Entamoeba invadens
DPYPK

SEQ ID NO: 2750958 - protein, 6 aa, Entamoeba invadens
DPYPKQ

SEQ ID NO: 2750959 - protein, 6 aa, Entamoeba invadens
DPYQTR

SEQ ID NO: 2750960 - protein, 13 aa, Entamoeba invadens
DPYSSPRKFAKNG

SEQ ID NO: 2750961 - protein, 4 aa, Entamoeba invadens
DQAD

SEQ ID NO: 2750962 - protein, 8 aa, Entamoeba invadens
DQAGCKEC

SEQ ID NO: 2750963 - protein, 8 aa, Entamoeba invadens
DQATLSDG

SEQ ID NO: 2750964 - protein, 5 aa, Entamoeba invadens
DQCGE

SEQ ID NO: 2750965 - protein, 6 aa, Entamoeba invadens
DQCTSA

SEQ ID NO: 2750966 - protein, 9 aa, Entamoeba invadens
DQDERLNDR

SEQ ID NO: 2750967 - protein, 9 aa, Entamoeba invadens
DQDKNKRLT

SEQ ID NO: 2750968 - protein, 10 aa, Entamoeba invadens
DQDPETRPTF

SEQ ID NO: 2750969 - protein, 10 aa, Entamoeba invadens
DQDPNKRPTF

SEQ ID NO: 2750970 - protein, 7 aa, Entamoeba invadens
DQDYEEI

SEQ ID NO: 2750971 - protein, 10 aa, Entamoeba invadens
DQEENGQAAK

SEQ ID NO: 2750972 - protein, 5 aa, Entamoeba invadens
DQEFQ

SEQ ID NO: 2750973 - protein, 22 aa, Entamoeba invadens
DQEIQSEENSENENEKEKDDAA

SEQ ID NO: 2750974 - protein, 6 aa, Entamoeba invadens
DQEMGE

SEQ ID NO: 2750975 - protein, 14 aa, Entamoeba invadens
DQENTEFPELTGPE

SEQ ID NO: 2750976 - protein, 9 aa, Entamoeba invadens
DQEPQNEKI

SEQ ID NO: 2750977 - protein, 20 aa, Entamoeba invadens
DQEQKDRANVGLVLSSLLLV

SEQ ID NO: 2750978 - protein, 8 aa, Entamoeba invadens
DQETGTCT

SEQ ID NO: 2750979 - protein, 7 aa, Entamoeba invadens
DQFDEIS

SEQ ID NO: 2750980 - protein, 8 aa, Entamoeba invadens
DQFDKEGK

SEQ ID NO: 2750981 - protein, 11 aa, Entamoeba invadens
DQFPKTNDENC

SEQ ID NO: 2750982 - protein, 7 aa, Entamoeba invadens
DQGFGDG

SEQ ID NO: 2750983 - protein, 5 aa, Entamoeba invadens
DQGGC

SEQ ID NO: 2750984 - protein, 7 aa, Entamoeba invadens
DQGVTFN

SEQ ID NO: 2750985 - protein, 5 aa, Entamoeba invadens
DQIGY

SEQ ID NO: 2750986 - protein, 13 aa, Entamoeba invadens
DQISVGSDCQSTL

SEQ ID NO: 2750987 - protein, 6 aa, Entamoeba invadens
DQITER

SEQ ID NO: 2750988 - protein, 7 aa, Entamoeba invadens
DQKASIT

SEQ ID NO: 2750989 - protein, 10 aa, Entamoeba invadens
DQKCSSSSYQ

SEQ ID NO: 2750990 - protein, 8 aa, Entamoeba invadens
DQKDEEVV

SEQ ID NO: 2750991 - protein, 8 aa, Entamoeba invadens
DQKDVSNG

SEQ ID NO: 2750992 - protein, 12 aa, Entamoeba invadens
DQKEAYRKITGQ

SEQ ID NO: 2750993 - protein, 6 aa, Entamoeba invadens
DQKEFA

SEQ ID NO: 2750994 - protein, 9 aa, Entamoeba invadens
DQKGSELRL

SEQ ID NO: 2750995 - protein, 7 aa, Entamoeba invadens
DQKGTIV

SEQ ID NO: 2750996 - protein, 14 aa, Entamoeba invadens
DQKKIQVNSPNNYK

SEQ ID NO: 2750997 - protein, 9 aa, Entamoeba invadens
DQKLNDMNK

SEQ ID NO: 2750998 - protein, 7 aa, Entamoeba invadens
DQKPTDT

SEQ ID NO: 2750999 - protein, 4 aa, Entamoeba invadens
DQKR

SEQ ID NO: 2751000 - protein, 6 aa, Entamoeba invadens
DQKSME

SEQ ID NO: 2751001 - protein, 4 aa, Entamoeba invadens
DQLT

SEQ ID NO: 2751002 - protein, 19 aa, Entamoeba invadens
DQMESPRTRAGTVNDKGIV

SEQ ID NO: 2751003 - protein, 22 aa, Entamoeba invadens
DQMKQTKGDEHVNRYNQTKRRF

SEQ ID NO: 2751004 - protein, 10 aa, Entamoeba invadens
DQNCKSEVSA

SEQ ID NO: 2751005 - protein, 5 aa, Entamoeba invadens
DQNDL

SEQ ID NO: 2751006 - protein, 5 aa, Entamoeba invadens
DQNFP

SEQ ID NO: 2751007 - protein, 16 aa, Entamoeba invadens
DQNGDGCKDNDKIDGV

SEQ ID NO: 2751008 - protein, 17 aa, Entamoeba invadens
DQNGSENTTESNTENKM

SEQ ID NO: 2751009 - protein, 5 aa, Entamoeba invadens
DQNGY

SEQ ID NO: 2751010 - protein, 14 aa, Entamoeba invadens
DQNIYRKDTNYETI

SEQ ID NO: 2751011 - protein, 5 aa, Entamoeba invadens
DQNKF

SEQ ID NO: 2751012 - protein, 9 aa, Entamoeba invadens
DQNKSRNIE

SEQ ID NO: 2751013 - protein, 13 aa, Entamoeba invadens
DQNPNGNYCQDGT

SEQ ID NO: 2751014 - protein, 9 aa, Entamoeba invadens
DQNSQEKLT

SEQ ID NO: 2751015 - protein, 5 aa, Entamoeba invadens
DQNSY

SEQ ID NO: 2751016 - protein, 8 aa, Entamoeba invadens
DQNTRPHA

SEQ ID NO: 2751017 - protein, 12 aa, Entamoeba invadens
DQPNVANSDIED

SEQ ID NO: 2751018 - protein, 7 aa, Entamoeba invadens
DQPPKTR

SEQ ID NO: 2751019 - protein, 8 aa, Entamoeba invadens
DQQGIRDK

SEQ ID NO: 2751020 - protein, 5 aa, Entamoeba invadens
DQQKD

SEQ ID NO: 2751021 - protein, 8 aa, Entamoeba invadens
DQQKLSSQ

SEQ ID NO: 2751022 - protein, 8 aa, Entamoeba invadens
DQQNEASR

SEQ ID NO: 2751023 - protein, 6 aa, Entamoeba invadens
DQQNEQ

SEQ ID NO: 2751024 - protein, 7 aa, Entamoeba invadens
DQQNKPC

SEQ ID NO: 2751025 - protein, 5 aa, Entamoeba invadens
DQQRY

SEQ ID NO: 2751026 - protein, 5 aa, Entamoeba invadens
DQQTK

SEQ ID NO: 2751027 - protein, 7 aa, Entamoeba invadens
DQRDSAL

SEQ ID NO: 2751028 - protein, 7 aa, Entamoeba invadens
DQRFDTT

SEQ ID NO: 2751029 - protein, 22 aa, Entamoeba invadens
DQRNDPEQEIDQNEQRENQPKR

SEQ ID NO: 2751030 - protein, 10 aa, Entamoeba invadens
DQRNNAKYAD

SEQ ID NO: 2751031 - protein, 5 aa, Entamoeba invadens
DQRSN

SEQ ID NO: 2751032 - protein, 13 aa, Entamoeba invadens
DQSDCEKSFASTS

SEQ ID NO: 2751033 - protein, 9 aa, Entamoeba invadens
DQSDDLDNA

SEQ ID NO: 2751034 - protein, 4 aa, Entamoeba invadens
DQSE

SEQ ID NO: 2751035 - protein, 5 aa, Entamoeba invadens
DQSKD

SEQ ID NO: 2751036 - protein, 18 aa, Entamoeba invadens
DQSSFDCSNTECTVDEKS

SEQ ID NO: 2751037 - protein, 4 aa, Entamoeba invadens
DQST

SEQ ID NO: 2751038 - protein, 9 aa, Entamoeba invadens
DQSTPMSSN

SEQ ID NO: 2751039 - protein, 8 aa, Entamoeba invadens
DQTCGGRC

SEQ ID NO: 2751040 - protein, 14 aa, Entamoeba invadens
DQTCNSQCDSITGN

SEQ ID NO: 2751041 - protein, 4 aa, Entamoeba invadens
DQTE

SEQ ID NO: 2751042 - protein, 12 aa, Entamoeba invadens
DQTGKQAIRGDE

SEQ ID NO: 2751043 - protein, 8 aa, Entamoeba invadens
DQTGLKGF

SEQ ID NO: 2751044 - protein, 10 aa, Entamoeba invadens
DQTIGSIKDG

SEQ ID NO: 2751045 - protein, 10 aa, Entamoeba invadens
DQTKEALNSL

SEQ ID NO: 2751046 - protein, 4 aa, Entamoeba invadens
DQTL

SEQ ID NO: 2751047 - protein, 5 aa, Entamoeba invadens
DQTLN

SEQ ID NO: 2751048 - protein, 9 aa, Entamoeba invadens
DQTLTKDNN

SEQ ID NO: 2751049 - protein, 6 aa, Entamoeba invadens
DQTNGN

SEQ ID NO: 2751050 - protein, 7 aa, Entamoeba invadens
DQTNGNC

SEQ ID NO: 2751051 - protein, 12 aa, Entamoeba invadens
DQTPKNRPTTQT

SEQ ID NO: 2751052 - protein, 8 aa, Entamoeba invadens
DQTQHISE

SEQ ID NO: 2751053 - protein, 8 aa, Entamoeba invadens
DQTSDRCT

SEQ ID NO: 2751054 - protein, 13 aa, Entamoeba invadens
DQTTKGCVEGTDG

SEQ ID NO: 2751055 - protein, 11 aa, Entamoeba invadens
DQTYGEIEGNW

SEQ ID NO: 2751056 - protein, 6 aa, Entamoeba invadens
DQTYSF

SEQ ID NO: 2751057 - protein, 5 aa, Entamoeba invadens
DQVPS

SEQ ID NO: 2751058 - protein, 10 aa, Entamoeba invadens
DQVPSQYRKD

SEQ ID NO: 2751059 - protein, 7 aa, Entamoeba invadens
DQVQREE

SEQ ID NO: 2751060 - protein, 7 aa, Entamoeba invadens
DQVTNGV

SEQ ID NO: 2751061 - protein, 5 aa, Entamoeba invadens
DQVVD

SEQ ID NO: 2751062 - protein, 11 aa, Entamoeba invadens
DQYEKNSKKYS

SEQ ID NO: 2751063 - protein, 6 aa, Entamoeba invadens
DQYKAE

SEQ ID NO: 2751064 - protein, 9 aa, Entamoeba invadens
DQYKTAALE

SEQ ID NO: 2751065 - protein, 13 aa, Entamoeba invadens
DQYNKTIEGPYDM

SEQ ID NO: 2751066 - protein, 13 aa, Entamoeba invadens
DRAERPSANEMTK

SEQ ID NO: 2751067 - protein, 5 aa, Entamoeba invadens
DRAGT

SEQ ID NO: 2751068 - protein, 8 aa, Entamoeba invadens
DRDASAIP

SEQ ID NO: 2751069 - protein, 7 aa, Entamoeba invadens
DRDGCQQ

SEQ ID NO: 2751070 - protein, 8 aa, Entamoeba invadens
DRDGSAIP

SEQ ID NO: 2751071 - protein, 5 aa, Entamoeba invadens
DRDKA

SEQ ID NO: 2751072 - protein, 7 aa, Entamoeba invadens
DRDQIES

SEQ ID NO: 2751073 - protein, 14 aa, Entamoeba invadens
DRDTKTLKTTKNSE

SEQ ID NO: 2751074 - protein, 18 aa, Entamoeba invadens
DRECKPCGDTCEEDKCDM

SEQ ID NO: 2751075 - protein, 5 aa, Entamoeba invadens
DREDH

SEQ ID NO: 2751076 - protein, 4 aa, Entamoeba invadens
DREF

SEQ ID NO: 2751077 - protein, 4 aa, Entamoeba invadens
DREN

SEQ ID NO: 2751078 - protein, 10 aa, Entamoeba invadens
DRENSTDCDP

SEQ ID NO: 2751079 - protein, 7 aa, Entamoeba invadens
DRERLSN

SEQ ID NO: 2751080 - protein, 18 aa, Entamoeba invadens
DRERSGMGDVQKGMPTVN

SEQ ID NO: 2751081 - protein, 4 aa, Entamoeba invadens
DRET

SEQ ID NO: 2751082 - protein, 10 aa, Entamoeba invadens
DRGDPNKDSA

SEQ ID NO: 2751083 - protein, 5 aa, Entamoeba invadens
DRGGY

SEQ ID NO: 2751084 - protein, 13 aa, Entamoeba invadens
DRGNDLDNLQGES

SEQ ID NO: 2751085 - protein, 5 aa, Entamoeba invadens
DRGPF

SEQ ID NO: 2751086 - protein, 4 aa, Entamoeba invadens
DRGS

SEQ ID NO: 2751087 - protein, 6 aa, Entamoeba invadens
DRGTDY

SEQ ID NO: 2751088 - protein, 5 aa, Entamoeba invadens
DRGTH

SEQ ID NO: 2751089 - protein, 6 aa, Entamoeba invadens
DRIETP

SEQ ID NO: 2751090 - protein, 9 aa, Entamoeba invadens
DRIPSDHTA

SEQ ID NO: 2751091 - protein, 8 aa, Entamoeba invadens
DRKELSRM

SEQ ID NO: 2751092 - protein, 9 aa, Entamoeba invadens
DRKERKKKK

SEQ ID NO: 2751093 - protein, 13 aa, Entamoeba invadens
DRKFDNSGNPTDT

SEQ ID NO: 2751094 - protein, 18 aa, Entamoeba invadens
DRKPKISCTADGIEPETM

SEQ ID NO: 2751095 - protein, 17 aa, Entamoeba invadens
DRKSGACTTCEDGQKKM

SEQ ID NO: 2751096 - protein, 6 aa, Entamoeba invadens
DRKSGI

SEQ ID NO: 2751097 - protein, 10 aa, Entamoeba invadens
DRKSPNVRDD

SEQ ID NO: 2751098 - protein, 4 aa, Entamoeba invadens
DRLD

SEQ ID NO: 2751099 - protein, 8 aa, Entamoeba invadens
DRLDGTKV

SEQ ID NO: 2751100 - protein, 13 aa, Entamoeba invadens
DRLEKEKNANEKR

SEQ ID NO: 2751101 - protein, 4 aa, Entamoeba invadens
DRLQ

SEQ ID NO: 2751102 - protein, 55 aa, Entamoeba invadens
  misc_feature (29)..(30): Xaa can be any naturally occurring amino acid
DRLSDYNDAEIAEEAQSLPLKTDTRGNDXXPMIQLSETEEYKIEKPNEQQSDELK

SEQ ID NO: 2751103 - protein, 7 aa, Entamoeba invadens
DRMGNEA

SEQ ID NO: 2751104 - protein, 11 aa, Entamoeba invadens
DRMPSESREFP

SEQ ID NO: 2751105 - protein, 16 aa, Entamoeba invadens
DRMRVENGENKDDYYQ

SEQ ID NO: 2751106 - protein, 9 aa, Entamoeba invadens
DRMSCEQKS

SEQ ID NO: 2751107 - protein, 9 aa, Entamoeba invadens
DRMSQYKGS

SEQ ID NO: 2751108 - protein, 6 aa, Entamoeba invadens
DRNEAL

SEQ ID NO: 2751109 - protein, 9 aa, Entamoeba invadens
DRNKPDVNE

SEQ ID NO: 2751110 - protein, 7 aa, Entamoeba invadens
DRNTFEY

SEQ ID NO: 2751111 - protein, 9 aa, Entamoeba invadens
DRPIGDGAN

SEQ ID NO: 2751112 - protein, 26 aa, Entamoeba invadens
DRPQRAKVRRTRHASFKKAKEKKTAE

SEQ ID NO: 2751113 - protein, 10 aa, Entamoeba invadens
DRPSDNGKYC

SEQ ID NO: 2751114 - protein, 4 aa, Entamoeba invadens
DRQA

SEQ ID NO: 2751115 - protein, 7 aa, Entamoeba invadens
DRRAQEG

SEQ ID NO: 2751116 - protein, 9 aa, Entamoeba invadens
DRSENSVGS

SEQ ID NO: 2751117 - protein, 5 aa, Entamoeba invadens
DRSET

SEQ ID NO: 2751118 - protein, 21 aa, Entamoeba invadens
DRSTKCESTCTKDTHFEKTNN

SEQ ID NO: 2751119 - protein, 5 aa, Entamoeba invadens
DRSTQ

SEQ ID NO: 2751120 - protein, 7 aa, Entamoeba invadens
DRTGGSV

SEQ ID NO: 2751121 - protein, 7 aa, Entamoeba invadens
DRTHRTE

SEQ ID NO: 2751122 - protein, 9 aa, Entamoeba invadens
DRTKKMKEA

SEQ ID NO: 2751123 - protein, 9 aa, Entamoeba invadens
DRTNKGCQR

SEQ ID NO: 2751124 - protein, 11 aa, Entamoeba invadens
DRYRDESTDLV

SEQ ID NO: 2751125 - protein, 14 aa, Entamoeba invadens
DRYSDGSQTIEPVD

SEQ ID NO: 2751126 - protein, 6 aa, Entamoeba invadens
DRYSFG

SEQ ID NO: 2751127 - protein, 6 aa, Entamoeba invadens
DRYTRN

SEQ ID NO: 2751128 - protein, 14 aa, Entamoeba invadens
DSADLRLSDTQNYR

SEQ ID NO: 2751129 - protein, 5 aa, Entamoeba invadens
DSADS

SEQ ID NO: 2751130 - protein, 6 aa, Entamoeba invadens
DSAKGI

SEQ ID NO: 2751131 - protein, 6 aa, Entamoeba invadens
DSALSR

SEQ ID NO: 2751132 - protein, 11 aa, Entamoeba invadens
DSANKKQRILT

SEQ ID NO: 2751133 - protein, 17 aa, Entamoeba invadens
DSANNKCSKCDDNYKLS

SEQ ID NO: 2751134 - protein, 7 aa, Entamoeba invadens
DSASEHY

SEQ ID NO: 2751135 - protein, 10 aa, Entamoeba invadens
DSASKGNNVR

SEQ ID NO: 2751136 - protein, 15 aa, Entamoeba invadens
DSATGYTKTASSQQC

SEQ ID NO: 2751137 - protein, 8 aa, Entamoeba invadens
DSATNTYT

SEQ ID NO: 2751138 - protein, 4 aa, Entamoeba invadens
DSAV

SEQ ID NO: 2751139 - protein, 10 aa, Entamoeba invadens
DSAVSYETTT

SEQ ID NO: 2751140 - protein, 6 aa, Entamoeba invadens
DSCDYY

SEQ ID NO: 2751141 - protein, 13 aa, Entamoeba invadens
DSCEEGSEKGCNR

SEQ ID NO: 2751142 - protein, 5 aa, Entamoeba invadens
DSCEI

SEQ ID NO: 2751143 - protein, 8 aa, Entamoeba invadens
DSCEKPRN

SEQ ID NO: 2751144 - protein, 9 aa, Entamoeba invadens
DSCGGKCDT

SEQ ID NO: 2751145 - protein, 11 aa, Entamoeba invadens
DSCKSGMDSKC

SEQ ID NO: 2751146 - protein, 12 aa, Entamoeba invadens
DSCPANADNIPC

SEQ ID NO: 2751147 - protein, 5 aa, Entamoeba invadens
DSCQN

SEQ ID NO: 2751148 - protein, 12 aa, Entamoeba invadens
DSCQSGSDSDSA

SEQ ID NO: 2751149 - protein, 5 aa, Entamoeba invadens
DSCQT

SEQ ID NO: 2751150 - protein, 13 aa, Entamoeba invadens
DSCRPNSNNMYRP

SEQ ID NO: 2751151 - protein, 10 aa, Entamoeba invadens
DSCRTCNDSS

SEQ ID NO: 2751152 - protein, 13 aa, Entamoeba invadens
DSCSEKQCTQESG

SEQ ID NO: 2751153 - protein, 8 aa, Entamoeba invadens
DSCSENQC

SEQ ID NO: 2751154 - protein, 6 aa, Entamoeba invadens
DSCTKC

SEQ ID NO: 2751155 - protein, 16 aa, Entamoeba invadens
DSCTSCNGGANKCNGC

SEQ ID NO: 2751156 - protein, 4 aa, Entamoeba invadens
DSDD

SEQ ID NO: 2751157 - protein, 11 aa, Entamoeba invadens
DSDDSSDSIMK

SEQ ID NO: 2751158 - protein, 7 aa, Entamoeba invadens
DSDEAVE

SEQ ID NO: 2751159 - protein, 10 aa, Entamoeba invadens
DSDGITTTKE

SEQ ID NO: 2751160 - protein, 5 aa, Entamoeba invadens
DSDMN

SEQ ID NO: 2751161 - protein, 6 aa, Entamoeba invadens
DSDRKR

SEQ ID NO: 2751162 - protein, 9 aa, Entamoeba invadens
DSDSSEKIV

SEQ ID NO: 2751163 - protein, 7 aa, Entamoeba invadens
DSDVEIK

SEQ ID NO: 2751164 - protein, 7 aa, Entamoeba invadens
DSDVNSE

SEQ ID NO: 2751165 - protein, 6 aa, Entamoeba invadens
DSEDIG

SEQ ID NO: 2751166 - protein, 7 aa, Entamoeba invadens
DSEDTTR

SEQ ID NO: 2751167 - protein, 14 aa, Entamoeba invadens
DSEEESESEQDNGL

SEQ ID NO: 2751168 - protein, 6 aa, Entamoeba invadens
DSEEQF

SEQ ID NO: 2751169 - protein, 6 aa, Entamoeba invadens
DSEGHC

SEQ ID NO: 2751170 - protein, 7 aa, Entamoeba invadens
DSEKTNF

SEQ ID NO: 2751171 - protein, 4 aa, Entamoeba invadens
DSEL

SEQ ID NO: 2751172 - protein, 7 aa, Entamoeba invadens
DSELSLG

SEQ ID NO: 2751173 - protein, 8 aa, Entamoeba invadens
DSENDEIS

SEQ ID NO: 2751174 - protein, 8 aa, Entamoeba invadens
DSENPIKV

SEQ ID NO: 2751175 - protein, 8 aa, Entamoeba invadens
DSENQKGI

SEQ ID NO: 2751176 - protein, 7 aa, Entamoeba invadens
DSEQFET

SEQ ID NO: 2751177 - protein, 5 aa, Entamoeba invadens
DSESR

SEQ ID NO: 2751178 - protein, 7 aa, Entamoeba invadens
DSESTSH

SEQ ID NO: 2751179 - protein, 7 aa, Entamoeba invadens
DSETKYD

SEQ ID NO: 2751180 - protein, 9 aa, Entamoeba invadens
DSETSISSQ

SEQ ID NO: 2751181 - protein, 14 aa, Entamoeba invadens
DSEVDSSPCYSTSK

SEQ ID NO: 2751182 - protein, 14 aa, Entamoeba invadens
DSEVNKTDIQNSQI

SEQ ID NO: 2751183 - protein, 11 aa, Entamoeba invadens
DSEYKGPNLDK

SEQ ID NO: 2751184 - protein, 6 aa, Entamoeba invadens
DSFDSI

SEQ ID NO: 2751185 - protein, 12 aa, Entamoeba invadens
DSFESEKRKKGV

SEQ ID NO: 2751186 - protein, 13 aa, Entamoeba invadens
DSFGKSVSLENDE

SEQ ID NO: 2751187 - protein, 7 aa, Entamoeba invadens
DSFNDEQ

SEQ ID NO: 2751188 - protein, 4 aa, Entamoeba invadens
DSFR

SEQ ID NO: 2751189 - protein, 7 aa, Entamoeba invadens
DSFSSLS

SEQ ID NO: 2751190 - protein, 18 aa, Entamoeba invadens
DSFTQNADFSNMSNNKLS

SEQ ID NO: 2751191 - protein, 10 aa, Entamoeba invadens
DSFTSVDDNL

SEQ ID NO: 2751192 - protein, 4 aa, Entamoeba invadens
DSGD

SEQ ID NO: 2751193 - protein, 4 aa, Entamoeba invadens
DSGE

SEQ ID NO: 2751194 - protein, 8 aa, Entamoeba invadens
DSGFKIPD

SEQ ID NO: 2751195 - protein, 6 aa, Entamoeba invadens
DSGLTE

SEQ ID NO: 2751196 - protein, 6 aa, Entamoeba invadens
DSGMET

SEQ ID NO: 2751197 - protein, 6 aa, Entamoeba invadens
DSGNCE

SEQ ID NO: 2751198 - protein, 7 aa, Entamoeba invadens
DSGTQQC

SEQ ID NO: 2751199 - protein, 10 aa, Entamoeba invadens
DSHKEKQPLF

SEQ ID NO: 2751200 - protein, 5 aa, Entamoeba invadens
DSHLH

SEQ ID NO: 2751201 - protein, 15 aa, Entamoeba invadens
DSHLTDSNTCSNEIN

SEQ ID NO: 2751202 - protein, 7 aa, Entamoeba invadens
DSIDSGV

SEQ ID NO: 2751203 - protein, 8 aa, Entamoeba invadens
DSIEESKV

SEQ ID NO: 2751204 - protein, 9 aa, Entamoeba invadens
DSIGGRDEN

SEQ ID NO: 2751205 - protein, 10 aa, Entamoeba invadens
DSIGRYSTNT

SEQ ID NO: 2751206 - protein, 4 aa, Entamoeba invadens
DSII

SEQ ID NO: 2751207 - protein, 12 aa, Entamoeba invadens
DSIKADPKNIKR

SEQ ID NO: 2751208 - protein, 12 aa, Entamoeba invadens
DSIKHKTGDEVN

SEQ ID NO: 2751209 - protein, 7 aa, Entamoeba invadens
DSIPGAN

SEQ ID NO: 2751210 - protein, 7 aa, Entamoeba invadens
DSIPTDT

SEQ ID NO: 2751211 - protein, 4 aa, Entamoeba invadens
DSIQ

SEQ ID NO: 2751212 - protein, 18 aa, Entamoeba invadens
DSISGDFGKEISNEKEAN

SEQ ID NO: 2751213 - protein, 4 aa, Entamoeba invadens
DSIT

SEQ ID NO: 2751214 - protein, 4 aa, Entamoeba invadens
DSKC

SEQ ID NO: 2751215 - protein, 6 aa, Entamoeba invadens
DSKCIS

SEQ ID NO: 2751216 - protein, 5 aa, Entamoeba invadens
DSKCT

SEQ ID NO: 2751217 - protein, 8 aa, Entamoeba invadens
DSKDNYKC

SEQ ID NO: 2751218 - protein, 9 aa, Entamoeba invadens
DSKDSYGIY

SEQ ID NO: 2751219 - protein, 8 aa, Entamoeba invadens
DSKEETSL

SEQ ID NO: 2751220 - protein, 7 aa, Entamoeba invadens
DSKGKFT

SEQ ID NO: 2751221 - protein, 8 aa, Entamoeba invadens
DSKLGEGS

SEQ ID NO: 2751222 - protein, 9 aa, Entamoeba invadens
DSKNGTCTK

SEQ ID NO: 2751223 - protein, 13 aa, Entamoeba invadens
DSKNNGRDVAGGL

SEQ ID NO: 2751224 - protein, 7 aa, Entamoeba invadens
DSKPFAN

SEQ ID NO: 2751225 - protein, 14 aa, Entamoeba invadens
DSKPTLCTNETSEI

SEQ ID NO: 2751226 - protein, 8 aa, Entamoeba invadens
DSKRKLSN

SEQ ID NO: 2751227 - protein, 8 aa, Entamoeba invadens
DSKSDKVK

SEQ ID NO: 2751228 - protein, 16 aa, Entamoeba invadens
DSKSPEFSNTRTDSEF

SEQ ID NO: 2751229 - protein, 8 aa, Entamoeba invadens
DSKTENDV

SEQ ID NO: 2751230 - protein, 13 aa, Entamoeba invadens
DSKTLEEKTETVE

SEQ ID NO: 2751231 - protein, 6 aa, Entamoeba invadens
DSKTMN

SEQ ID NO: 2751232 - protein, 10 aa, Entamoeba invadens
DSKTNTMGYT

SEQ ID NO: 2751233 - protein, 10 aa, Entamoeba invadens
DSKTTNCTEC

SEQ ID NO: 2751234 - protein, 8 aa, Entamoeba invadens
DSLNDDID

SEQ ID NO: 2751235 - protein, 10 aa, Entamoeba invadens
DSLNNPSKVK

SEQ ID NO: 2751236 - protein, 5 aa, Entamoeba invadens
DSLPN

SEQ ID NO: 2751237 - protein, 6 aa, Entamoeba invadens
DSLREK

SEQ ID NO: 2751238 - protein, 5 aa, Entamoeba invadens
DSLRP

SEQ ID NO: 2751239 - protein, 22 aa, Entamoeba invadens
DSLTSSEDTSTTDYSDSSETFI

SEQ ID NO: 2751240 - protein, 13 aa, Entamoeba invadens
DSMCSTTSGVCEG

SEQ ID NO: 2751241 - protein, 6 aa, Entamoeba invadens
DSNAEI

SEQ ID NO: 2751242 - protein, 12 aa, Entamoeba invadens
DSNATFGDENTI

SEQ ID NO: 2751243 - protein, 11 aa, Entamoeba invadens
DSNCERCSSTF

SEQ ID NO: 2751244 - protein, 16 aa, Entamoeba invadens
DSNCETCSKTTRKCNK

SEQ ID NO: 2751245 - protein, 5 aa, Entamoeba invadens
DSNCK

SEQ ID NO: 2751246 - protein, 8 aa, Entamoeba invadens
DSNDIEAD

SEQ ID NO: 2751247 - protein, 9 aa, Entamoeba invadens
DSNDNSQIS

SEQ ID NO: 2751248 - protein, 21 aa, Entamoeba invadens
DSNDRDMTKECGQTSKNSFSF

SEQ ID NO: 2751249 - protein, 7 aa, Entamoeba invadens
DSNDTIG

SEQ ID NO: 2751250 - protein, 6 aa, Entamoeba invadens
DSNEAL

SEQ ID NO: 2751251 - protein, 7 aa, Entamoeba invadens
DSNEGFD

SEQ ID NO: 2751252 - protein, 10 aa, Entamoeba invadens
DSNEIETTET

SEQ ID NO: 2751253 - protein, 17 aa, Entamoeba invadens
DSNEMSPTSFISIAVLP

SEQ ID NO: 2751254 - protein, 10 aa, Entamoeba invadens
DSNENESQRK

SEQ ID NO: 2751255 - protein, 13 aa, Entamoeba invadens
DSNGKAVAKSIGR

SEQ ID NO: 2751256 - protein, 5 aa, Entamoeba invadens
DSNGN

SEQ ID NO: 2751257 - protein, 7 aa, Entamoeba invadens
DSNGYDS

SEQ ID NO: 2751258 - protein, 7 aa, Entamoeba invadens
DSNINDI

SEQ ID NO: 2751259 - protein, 9 aa, Entamoeba invadens
DSNKLGERV

SEQ ID NO: 2751260 - protein, 9 aa, Entamoeba invadens
DSNLEEITS

SEQ ID NO: 2751261 - protein, 5 aa, Entamoeba invadens
DSNPK

SEQ ID NO: 2751262 - protein, 8 aa, Entamoeba invadens
DSNQTNEY

SEQ ID NO: 2751263 - protein, 6 aa, Entamoeba invadens
DSNSAC

SEQ ID NO: 2751264 - protein, 5 aa, Entamoeba invadens
DSNSG

SEQ ID NO: 2751265 - protein, 5 aa, Entamoeba invadens
DSNSV

SEQ ID NO: 2751266 - protein, 4 aa, Entamoeba invadens
DSNT

SEQ ID NO: 2751267 - protein, 13 aa, Entamoeba invadens
DSNTCRSKIESNC

SEQ ID NO: 2751268 - protein, 15 aa, Entamoeba invadens
DSPCNGKCDPTNGNC

SEQ ID NO: 2751269 - protein, 6 aa, Entamoeba invadens
DSPFPF

SEQ ID NO: 2751270 - protein, 7 aa, Entamoeba invadens
DSPFPSF

SEQ ID NO: 2751271 - protein, 6 aa, Entamoeba invadens
DSPKSK

SEQ ID NO: 2751272 - protein, 8 aa, Entamoeba invadens
DSPKSTKC

SEQ ID NO: 2751273 - protein, 7 aa, Entamoeba invadens
DSPLGVT

SEQ ID NO: 2751274 - protein, 7 aa, Entamoeba invadens
DSPMGTQ

SEQ ID NO: 2751275 - protein, 4 aa, Entamoeba invadens
DSPS

SEQ ID NO: 2751276 - protein, 6 aa, Entamoeba invadens
DSPYGC

SEQ ID NO: 2751277 - protein, 5 aa, Entamoeba invadens
DSPYL

SEQ ID NO: 2751278 - protein, 7 aa, Entamoeba invadens
DSQAETF

SEQ ID NO: 2751279 - protein, 10 aa, Entamoeba invadens
DSQANDIEEY

SEQ ID NO: 2751280 - protein, 7 aa, Entamoeba invadens
DSQDSEI

SEQ ID NO: 2751281 - protein, 7 aa, Entamoeba invadens
DSQKNLK

SEQ ID NO: 2751282 - protein, 5 aa, Entamoeba invadens
DSQKV

SEQ ID NO: 2751283 - protein, 6 aa, Entamoeba invadens
DSQQNI

SEQ ID NO: 2751284 - protein, 6 aa, Entamoeba invadens
DSQQYE

SEQ ID NO: 2751285 - protein, 4 aa, Entamoeba invadens
DSQT

SEQ ID NO: 2751286 - protein, 7 aa, Entamoeba invadens
DSQTDSV

SEQ ID NO: 2751287 - protein, 7 aa, Entamoeba invadens
DSQTLTL

SEQ ID NO: 2751288 - protein, 7 aa, Entamoeba invadens
DSQVTVN

SEQ ID NO: 2751289 - protein, 4 aa, Entamoeba invadens
DSRC

SEQ ID NO: 2751290 - protein, 12 aa, Entamoeba invadens
DSRCTSCSTNSR

SEQ ID NO: 2751291 - protein, 19 aa, Entamoeba invadens
DSRDNFEDERNIEDFSKEG

SEQ ID NO: 2751292 - protein, 5 aa, Entamoeba invadens
DSRIS

SEQ ID NO: 2751293 - protein, 4 aa, Entamoeba invadens
DSRL

SEQ ID NO: 2751294 - protein, 7 aa, Entamoeba invadens
DSRNDYF

SEQ ID NO: 2751295 - protein, 13 aa, Entamoeba invadens
DSSCNKKCNTQTG

SEQ ID NO: 2751296 - protein, 8 aa, Entamoeba invadens
DSSCSKCK

SEQ ID NO: 2751297 - protein, 8 aa, Entamoeba invadens
DSSDDEKI

SEQ ID NO: 2751298 - protein, 14 aa, Entamoeba invadens
DSSDISNATIRGGA

SEQ ID NO: 2751299 - protein, 12 aa, Entamoeba invadens
DSSDVTTNSTIV

SEQ ID NO: 2751300 - protein, 28 aa, Entamoeba invadens
DSSEAPHPEWSSDDSHNNNSEDKNGISG

SEQ ID NO: 2751301 - protein, 9 aa, Entamoeba invadens
DSSEPSALT

SEQ ID NO: 2751302 - protein, 5 aa, Entamoeba invadens
DSSFG

SEQ ID NO: 2751303 - protein, 6 aa, Entamoeba invadens
DSSGER

SEQ ID NO: 2751304 - protein, 4 aa, Entamoeba invadens
DSSK

SEQ ID NO: 2751305 - protein, 9 aa, Entamoeba invadens
DSSKKVATQ

SEQ ID NO: 2751306 - protein, 11 aa, Entamoeba invadens
DSSKPDTCTKC

SEQ ID NO: 2751307 - protein, 15 aa, Entamoeba invadens
DSSKPVESSDINEQI

SEQ ID NO: 2751308 - protein, 19 aa, Entamoeba invadens
DSSKSTNSAAYDTEPNTPY

SEQ ID NO: 2751309 - protein, 9 aa, Entamoeba invadens
DSSNSLTTV

SEQ ID NO: 2751310 - protein, 14 aa, Entamoeba invadens
DSSNTKTCRKCPQS

SEQ ID NO: 2751311 - protein, 7 aa, Entamoeba invadens
DSSNTLT

SEQ ID NO: 2751312 - protein, 5 aa, Entamoeba invadens
DSSTL

SEQ ID NO: 2751313 - protein, 8 aa, Entamoeba invadens
DSSTMTIK

SEQ ID NO: 2751314 - protein, 7 aa, Entamoeba invadens
DSSTTID

SEQ ID NO: 2751315 - protein, 9 aa, Entamoeba invadens
DSSTTSPFS

SEQ ID NO: 2751316 - protein, 6 aa, Entamoeba invadens
DSSYQR

SEQ ID NO: 2751317 - protein, 6 aa, Entamoeba invadens
DSTAKG

SEQ ID NO: 2751318 - protein, 24 aa, Entamoeba invadens
DSTAQEELEDTEPLETSETPREGL

SEQ ID NO: 2751319 - protein, 10 aa, Entamoeba invadens
DSTCGGNCNT

SEQ ID NO: 2751320 - protein, 10 aa, Entamoeba invadens
DSTCGGQCSG

SEQ ID NO: 2751321 - protein, 13 aa, Entamoeba invadens
DSTCGGQCSGSTG

SEQ ID NO: 2751322 - protein, 16 aa, Entamoeba invadens
DSTCGNQCDGKDGHCT

SEQ ID NO: 2751323 - protein, 18 aa, Entamoeba invadens
DSTCGSCDKNNGNCTSCS

SEQ ID NO: 2751324 - protein, 7 aa, Entamoeba invadens
DSTCNGD

SEQ ID NO: 2751325 - protein, 13 aa, Entamoeba invadens
DSTCNGDCNTSSG

SEQ ID NO: 2751326 - protein, 14 aa, Entamoeba invadens
DSTCNGDCNTSSGI

SEQ ID NO: 2751327 - protein, 13 aa, Entamoeba invadens
DSTCNGGCDQSTG

SEQ ID NO: 2751328 - protein, 14 aa, Entamoeba invadens
DSTCNNRCDTNSGY

SEQ ID NO: 2751329 - protein, 9 aa, Entamoeba invadens
DSTCSKCSP

SEQ ID NO: 2751330 - protein, 8 aa, Entamoeba invadens
DSTCSTCD

SEQ ID NO: 2751331 - protein, 4 aa, Entamoeba invadens
DSTD

SEQ ID NO: 2751332 - protein, 5 aa, Entamoeba invadens
DSTDC

SEQ ID NO: 2751333 - protein, 6 aa, Entamoeba invadens
DSTDNS

SEQ ID NO: 2751334 - protein, 12 aa, Entamoeba invadens
DSTENDQCANAQ

SEQ ID NO: 2751335 - protein, 13 aa, Entamoeba invadens
DSTFSSKKAANVN

SEQ ID NO: 2751336 - protein, 7 aa, Entamoeba invadens
DSTGHCT

SEQ ID NO: 2751337 - protein, 8 aa, Entamoeba invadens
DSTISAKK

SEQ ID NO: 2751338 - protein, 10 aa, Entamoeba invadens
DSTKGQCQKC

SEQ ID NO: 2751339 - protein, 28 aa, Entamoeba invadens
DSTKNDKNKNIKKVDDDFTDESTTIGNT

SEQ ID NO: 2751340 - protein, 28 aa, Entamoeba invadens
DSTKNYKNKNIKKVDDDFTDESATIGNT

SEQ ID NO: 2751341 - protein, 9 aa, Entamoeba invadens
DSTKPTKTT

SEQ ID NO: 2751342 - protein, 10 aa, Entamoeba invadens
DSTKRPEVDE

SEQ ID NO: 2751343 - protein, 10 aa, Entamoeba invadens
DSTKTGDEYV

SEQ ID NO: 2751344 - protein, 11 aa, Entamoeba invadens
DSTKTNPQCAD

SEQ ID NO: 2751345 - protein, 4 aa, Entamoeba invadens
DSTL

SEQ ID NO: 2751346 - protein, 7 aa, Entamoeba invadens
DSTLDDP

SEQ ID NO: 2751347 - protein, 6 aa, Entamoeba invadens
DSTNCE

SEQ ID NO: 2751348 - protein, 8 aa, Entamoeba invadens
DSTNVSEL

SEQ ID NO: 2751349 - protein, 11 aa, Entamoeba invadens
DSTPEKRGNFE

SEQ ID NO: 2751350 - protein, 7 aa, Entamoeba invadens
DSTPVDY

SEQ ID NO: 2751351 - protein, 6 aa, Entamoeba invadens
DSTSNS

SEQ ID NO: 2751352 - protein, 7 aa, Entamoeba invadens
DSTSSRY

SEQ ID NO: 2751353 - protein, 11 aa, Entamoeba invadens
DSTSSTTYVRS

SEQ ID NO: 2751354 - protein, 4 aa, Entamoeba invadens
DSTT

SEQ ID NO: 2751355 - protein, 7 aa, Entamoeba invadens
DSTTEPS

SEQ ID NO: 2751356 - protein, 5 aa, Entamoeba invadens
DSTTF

SEQ ID NO: 2751357 - protein, 7 aa, Entamoeba invadens
DSTTGRC

SEQ ID NO: 2751358 - protein, 8 aa, Entamoeba invadens
DSTTKDSC

SEQ ID NO: 2751359 - protein, 9 aa, Entamoeba invadens
DSTTNTMSY

SEQ ID NO: 2751360 - protein, 5 aa, Entamoeba invadens
DSTTS

SEQ ID NO: 2751361 - protein, 12 aa, Entamoeba invadens
DSVKNKGQSIAS

SEQ ID NO: 2751362 - protein, 4 aa, Entamoeba invadens
DSVL

SEQ ID NO: 2751363 - protein, 12 aa, Entamoeba invadens
DSVLKGTQNGYN

SEQ ID NO: 2751364 - protein, 21 aa, Entamoeba invadens
DSVNEKEQKVEVQTSENQLEI

SEQ ID NO: 2751365 - protein, 4 aa, Entamoeba invadens
DSVP

SEQ ID NO: 2751366 - protein, 23 aa, Entamoeba invadens
DSVTTHPNTASCGTNNQRVSNNN

SEQ ID NO: 2751367 - protein, 6 aa, Entamoeba invadens
DSVTTK

SEQ ID NO: 2751368 - protein, 6 aa, Entamoeba invadens
DSVYTK

SEQ ID NO: 2751369 - protein, 9 aa, Entamoeba invadens
DSYGRGGGL

SEQ ID NO: 2751370 - protein, 12 aa, Entamoeba invadens
DSYNKYVEASSN

SEQ ID NO: 2751371 - protein, 7 aa, Entamoeba invadens
DSYPKSE

SEQ ID NO: 2751372 - protein, 9 aa, Entamoeba invadens
DSYPSSSQC

SEQ ID NO: 2751373 - protein, 4 aa, Entamoeba invadens
DSYT

SEQ ID NO: 2751374 - protein, 5 aa, Entamoeba invadens
DSYTS

SEQ ID NO: 2751375 - protein, 8 aa, Entamoeba invadens
DSYTSSTF

SEQ ID NO: 2751376 - protein, 8 aa, Entamoeba invadens
DSYTSTTF

SEQ ID NO: 2751377 - protein, 5 aa, Entamoeba invadens
DSYTY

SEQ ID NO: 2751378 - protein, 14 aa, Entamoeba invadens
DTAGSPSSFTAEEV

SEQ ID NO: 2751379 - protein, 6 aa, Entamoeba invadens
DTANDT

SEQ ID NO: 2751380 - protein, 6 aa, Entamoeba invadens
DTAPGD

SEQ ID NO: 2751381 - protein, 8 aa, Entamoeba invadens
DTASQTEV

SEQ ID NO: 2751382 - protein, 8 aa, Entamoeba invadens
DTASTNKL

SEQ ID NO: 2751383 - protein, 6 aa, Entamoeba invadens
DTATPA

SEQ ID NO: 2751384 - protein, 5 aa, Entamoeba invadens
DTATY

SEQ ID NO: 2751385 - protein, 4 aa, Entamoeba invadens
DTAV

SEQ ID NO: 2751386 - protein, 4 aa, Entamoeba invadens
DTAY

SEQ ID NO: 2751387 - protein, 4 aa, Entamoeba invadens
DTCA

SEQ ID NO: 2751388 - protein, 13 aa, Entamoeba invadens
DTCDTSENACGSG

SEQ ID NO: 2751389 - protein, 6 aa, Entamoeba invadens
DTCEDS

SEQ ID NO: 2751390 - protein, 5 aa, Entamoeba invadens
DTCEE

SEQ ID NO: 2751391 - protein, 9 aa, Entamoeba invadens
DTCGSEGCY

SEQ ID NO: 2751392 - protein, 13 aa, Entamoeba invadens
DTCKDSKCNTTTG

SEQ ID NO: 2751393 - protein, 7 aa, Entamoeba invadens
DTCLSTT

SEQ ID NO: 2751394 - protein, 7 aa, Entamoeba invadens
DTCNSNC

SEQ ID NO: 2751395 - protein, 7 aa, Entamoeba invadens
DTCQNRG

SEQ ID NO: 2751396 - protein, 4 aa, Entamoeba invadens
DTCS

SEQ ID NO: 2751397 - protein, 13 aa, Entamoeba invadens
DTCSDKCSTTNGT

SEQ ID NO: 2751398 - protein, 10 aa, Entamoeba invadens
DTCSSDAKKC

SEQ ID NO: 2751399 - protein, 8 aa, Entamoeba invadens
DTCSTTSK

SEQ ID NO: 2751400 - protein, 8 aa, Entamoeba invadens
DTDCADGH

SEQ ID NO: 2751401 - protein, 7 aa, Entamoeba invadens
DTDCTDM

SEQ ID NO: 2751402 - protein, 13 aa, Entamoeba invadens
DTDDSEESIDTNN

SEQ ID NO: 2751403 - protein, 9 aa, Entamoeba invadens
DTDGATDYK

SEQ ID NO: 2751404 - protein, 13 aa, Entamoeba invadens
DTDGLSDIDKAKR

SEQ ID NO: 2751405 - protein, 9 aa, Entamoeba invadens
DTDIKKDET

SEQ ID NO: 2751406 - protein, 11 aa, Entamoeba invadens
DTDKPNCPTGN

SEQ ID NO: 2751407 - protein, 7 aa, Entamoeba invadens
DTDNKPL

SEQ ID NO: 2751408 - protein, 12 aa, Entamoeba invadens
DTDNTNNKVVDK

SEQ ID NO: 2751409 - protein, 5 aa, Entamoeba invadens
DTDNV

SEQ ID NO: 2751410 - protein, 7 aa, Entamoeba invadens
DTDSDTP

SEQ ID NO: 2751411 - protein, 9 aa, Entamoeba invadens
DTDSTYNET

SEQ ID NO: 2751412 - protein, 7 aa, Entamoeba invadens
DTDTSVE

SEQ ID NO: 2751413 - protein, 7 aa, Entamoeba invadens
DTEAPHN

SEQ ID NO: 2751414 - protein, 7 aa, Entamoeba invadens
DTECPEN

SEQ ID NO: 2751415 - protein, 4 aa, Entamoeba invadens
DTEE

SEQ ID NO: 2751416 - protein, 48 aa, Entamoeba invadens
DTEEALAKKSQKTFDTRKSTSQKTAKQPKVTKSSSTVMATKSKSGDIE

SEQ ID NO: 2751417 - protein, 13 aa, Entamoeba invadens
DTEEWKPVPYSTC

SEQ ID NO: 2751418 - protein, 13 aa, Entamoeba invadens
DTEGKNDNNEDIS

SEQ ID NO: 2751419 - protein, 12 aa, Entamoeba invadens
DTEKQKSERKIS

SEQ ID NO: 2751420 - protein, 9 aa, Entamoeba invadens
DTEKVDDGV

SEQ ID NO: 2751421 - protein, 17 aa, Entamoeba invadens
DTENCHRKDTNKDYKQR

SEQ ID NO: 2751422 - protein, 8 aa, Entamoeba invadens
DTERDGEY

SEQ ID NO: 2751423 - protein, 10 aa, Entamoeba invadens
DTERESTENL

SEQ ID NO: 2751424 - protein, 19 aa, Entamoeba invadens
DTERHSRKDLEKGPTETLE

SEQ ID NO: 2751425 - protein, 20 aa, Entamoeba invadens
DTERKTDTTVEEKVGGSTKA

SEQ ID NO: 2751426 - protein, 4 aa, Entamoeba invadens
DTES

SEQ ID NO: 2751427 - protein, 10 aa, Entamoeba invadens
DTESGGGALE

SEQ ID NO: 2751428 - protein, 7 aa, Entamoeba invadens
DTESMTL

SEQ ID NO: 2751429 - protein, 5 aa, Entamoeba invadens
DTETF

SEQ ID NO: 2751430 - protein, 6 aa, Entamoeba invadens
DTETFT

SEQ ID NO: 2751431 - protein, 5 aa, Entamoeba invadens
DTETL

SEQ ID NO: 2751432 - protein, 7 aa, Entamoeba invadens
DTETQGK

SEQ ID NO: 2751433 - protein, 5 aa, Entamoeba invadens
DTETR

SEQ ID NO: 2751434 - protein, 7 aa, Entamoeba invadens
DTEYTET

SEQ ID NO: 2751435 - protein, 13 aa, Entamoeba invadens
DTFDITNSDSSYI

SEQ ID NO: 2751436 - protein, 14 aa, Entamoeba invadens
DTFETVRTDGPFRS

SEQ ID NO: 2751437 - protein, 4 aa, Entamoeba invadens
DTGC

SEQ ID NO: 2751438 - protein, 9 aa, Entamoeba invadens
DTGNLDENG

SEQ ID NO: 2751439 - protein, 5 aa, Entamoeba invadens
DTGNN

SEQ ID NO: 2751440 - protein, 8 aa, Entamoeba invadens
DTGYDSKK

SEQ ID NO: 2751441 - protein, 9 aa, Entamoeba invadens
DTHAGSKDC

SEQ ID NO: 2751442 - protein, 10 aa, Entamoeba invadens
DTHCSETKCL

SEQ ID NO: 2751443 - protein, 6 aa, Entamoeba invadens
DTHDGL

SEQ ID NO: 2751444 - protein, 9 aa, Entamoeba invadens
DTHDSSTDI

SEQ ID NO: 2751445 - protein, 7 aa, Entamoeba invadens
DTHKDNK

SEQ ID NO: 2751446 - protein, 5 aa, Entamoeba invadens
DTHSP

SEQ ID NO: 2751447 - protein, 4 aa, Entamoeba invadens
DTIA

SEQ ID NO: 2751448 - protein, 9 aa, Entamoeba invadens
DTIDDKNGV

SEQ ID NO: 2751449 - protein, 13 aa, Entamoeba invadens
DTIEDGPNPFTKE

SEQ ID NO: 2751450 - protein, 5 aa, Entamoeba invadens
DTIEK

SEQ ID NO: 2751451 - protein, 5 aa, Entamoeba invadens
DTINV

SEQ ID NO: 2751452 - protein, 7 aa, Entamoeba invadens
DTIPPDP

SEQ ID NO: 2751453 - protein, 8 aa, Entamoeba invadens
DTIQTQDT

SEQ ID NO: 2751454 - protein, 7 aa, Entamoeba invadens
DTITQRN

SEQ ID NO: 2751455 - protein, 12 aa, Entamoeba invadens
DTKCDGCDATNG

SEQ ID NO: 2751456 - protein, 6 aa, Entamoeba invadens
DTKCTR

SEQ ID NO: 2751457 - protein, 5 aa, Entamoeba invadens
DTKNG

SEQ ID NO: 2751458 - protein, 10 aa, Entamoeba invadens
DTKNNVIKGT

SEQ ID NO: 2751459 - protein, 6 aa, Entamoeba invadens
DTKNSF

SEQ ID NO: 2751460 - protein, 6 aa, Entamoeba invadens
DTKNYT

SEQ ID NO: 2751461 - protein, 7 aa, Entamoeba invadens
DTKPKNI

SEQ ID NO: 2751462 - protein, 8 aa, Entamoeba invadens
DTKPNGVY

SEQ ID NO: 2751463 - protein, 10 aa, Entamoeba invadens
DTKPTTVTTL

SEQ ID NO: 2751464 - protein, 9 aa, Entamoeba invadens
DTKSCEKES

SEQ ID NO: 2751465 - protein, 5 aa, Entamoeba invadens
DTKSS

SEQ ID NO: 2751466 - protein, 4 aa, Entamoeba invadens
DTKT

SEQ ID NO: 2751467 - protein, 6 aa, Entamoeba invadens
DTKTPI

SEQ ID NO: 2751468 - protein, 5 aa, Entamoeba invadens
DTKTS

SEQ ID NO: 2751469 - protein, 4 aa, Entamoeba invadens
DTKY

SEQ ID NO: 2751470 - protein, 8 aa, Entamoeba invadens
DTLNTDSA

SEQ ID NO: 2751471 - protein, 9 aa, Entamoeba invadens
DTLPPRSLN

SEQ ID NO: 2751472 - protein, 19 aa, Entamoeba invadens
DTLPQDEVEYKDDPTGSNG

SEQ ID NO: 2751473 - protein, 7 aa, Entamoeba invadens
DTLPTTS

SEQ ID NO: 2751474 - protein, 5 aa, Entamoeba invadens
DTLST

SEQ ID NO: 2751475 - protein, 6 aa, Entamoeba invadens
DTLSVN

SEQ ID NO: 2751476 - protein, 6 aa, Entamoeba invadens
DTLTDN

SEQ ID NO: 2751477 - protein, 9 aa, Entamoeba invadens
DTNAQTTLQ

SEQ ID NO: 2751478 - protein, 5 aa, Entamoeba invadens
DTNAT

SEQ ID NO: 2751479 - protein, 4 aa, Entamoeba invadens
DTNC

SEQ ID NO: 2751480 - protein, 13 aa, Entamoeba invadens
DTNCDGCDATNGK

SEQ ID NO: 2751481 - protein, 9 aa, Entamoeba invadens
DTNCSSCEP

SEQ ID NO: 2751482 - protein, 4 aa, Entamoeba invadens
DTND

SEQ ID NO: 2751483 - protein, 6 aa, Entamoeba invadens
DTNDCS

SEQ ID NO: 2751484 - protein, 15 aa, Entamoeba invadens
DTNEFQSTKSLRNLD

SEQ ID NO: 2751485 - protein, 17 aa, Entamoeba invadens
DTNFTSDESKYSTPNIK

SEQ ID NO: 2751486 - protein, 15 aa, Entamoeba invadens
DTNGFNNKTRKGCDC

SEQ ID NO: 2751487 - protein, 6 aa, Entamoeba invadens
DTNGKV

SEQ ID NO: 2751488 - protein, 4 aa, Entamoeba invadens
DTNI

SEQ ID NO: 2751489 - protein, 7 aa, Entamoeba invadens
DTNIGKP

SEQ ID NO: 2751490 - protein, 4 aa, Entamoeba invadens
DTNK

SEQ ID NO: 2751491 - protein, 10 aa, Entamoeba invadens
DTNKQKGENV

SEQ ID NO: 2751492 - protein, 5 aa, Entamoeba invadens
DTNND

SEQ ID NO: 2751493 - protein, 8 aa, Entamoeba invadens
DTNNEMSI

SEQ ID NO: 2751494 - protein, 7 aa, Entamoeba invadens
DTNRPNG

SEQ ID NO: 2751495 - protein, 23 aa, Entamoeba invadens
DTNTGKEGQLYDEDNALNVSKLD

SEQ ID NO: 2751496 - protein, 13 aa, Entamoeba invadens
DTNTMKGIGGERI

SEQ ID NO: 2751497 - protein, 17 aa, Entamoeba invadens
DTNVRTISNTNTSTYSN

SEQ ID NO: 2751498 - protein, 6 aa, Entamoeba invadens
DTPAIV

SEQ ID NO: 2751499 - protein, 12 aa, Entamoeba invadens
DTPAPESRCDQP

SEQ ID NO: 2751500 - protein, 5 aa, Entamoeba invadens
DTPDQ

SEQ ID NO: 2751501 - protein, 7 aa, Entamoeba invadens
DTPFNTE

SEQ ID NO: 2751502 - protein, 9 aa, Entamoeba invadens
DTPKEDSNV

SEQ ID NO: 2751503 - protein, 8 aa, Entamoeba invadens
DTPMPGTS

SEQ ID NO: 2751504 - protein, 13 aa, Entamoeba invadens
DTPPIKRASNIKR

SEQ ID NO: 2751505 - protein, 14 aa, Entamoeba invadens
DTPPQPKTDVPKML

SEQ ID NO: 2751506 - protein, 7 aa, Entamoeba invadens
DTPPTYK

SEQ ID NO: 2751507 - protein, 5 aa, Entamoeba invadens
DTPQY

SEQ ID NO: 2751508 - protein, 6 aa, Entamoeba invadens
DTPRCE

SEQ ID NO: 2751509 - protein, 5 aa, Entamoeba invadens
DTPTF

SEQ ID NO: 2751510 - protein, 7 aa, Entamoeba invadens
DTPVNVA

SEQ ID NO: 2751511 - protein, 13 aa, Entamoeba invadens
DTPYRSDGYSHTQ

SEQ ID NO: 2751512 - protein, 14 aa, Entamoeba invadens
DTQCPSEYKEYGAN

SEQ ID NO: 2751513 - protein, 4 aa, Entamoeba invadens
DTQD

SEQ ID NO: 2751514 - protein, 11 aa, Entamoeba invadens
DTQDKLAGSPY

SEQ ID NO: 2751515 - protein, 7 aa, Entamoeba invadens
DTQEGIK

SEQ ID NO: 2751516 - protein, 5 aa, Entamoeba invadens
DTQLG

SEQ ID NO: 2751517 - protein, 7 aa, Entamoeba invadens
DTQNLKG

SEQ ID NO: 2751518 - protein, 6 aa, Entamoeba invadens
DTQNLS

SEQ ID NO: 2751519 - protein, 9 aa, Entamoeba invadens
DTQNVSRQD

SEQ ID NO: 2751520 - protein, 8 aa, Entamoeba invadens
DTQPKNQT

SEQ ID NO: 2751521 - protein, 10 aa, Entamoeba invadens
DTQSTNCTSC

SEQ ID NO: 2751522 - protein, 4 aa, Entamoeba invadens
DTQT

SEQ ID NO: 2751523 - protein, 6 aa, Entamoeba invadens
DTQTPI

SEQ ID NO: 2751524 - protein, 6 aa, Entamoeba invadens
DTQTTL

SEQ ID NO: 2751525 - protein, 5 aa, Entamoeba invadens
DTQVG

SEQ ID NO: 2751526 - protein, 8 aa, Entamoeba invadens
DTRAVPTI

SEQ ID NO: 2751527 - protein, 9 aa, Entamoeba invadens
DTRCGTPPF

SEQ ID NO: 2751528 - protein, 5 aa, Entamoeba invadens
DTRDG

SEQ ID NO: 2751529 - protein, 20 aa, Entamoeba invadens
DTRDSQNELYDQSTENAAPS

SEQ ID NO: 2751530 - protein, 20 aa, Entamoeba invadens
DTRDSQNSEYDGTNENAASS

SEQ ID NO: 2751531 - protein, 8 aa, Entamoeba invadens
DTRDTNGV

SEQ ID NO: 2751532 - protein, 7 aa, Entamoeba invadens
DTRLDEL

SEQ ID NO: 2751533 - protein, 17 aa, Entamoeba invadens
DTRLDNNTIPKGSTEFT

SEQ ID NO: 2751534 - protein, 5 aa, Entamoeba invadens
DTRYN

SEQ ID NO: 2751535 - protein, 8 aa, Entamoeba invadens
DTSADYGL

SEQ ID NO: 2751536 - protein, 11 aa, Entamoeba invadens
DTSANIQPSKS

SEQ ID NO: 2751537 - protein, 6 aa, Entamoeba invadens
DTSATG

SEQ ID NO: 2751538 - protein, 5 aa, Entamoeba invadens
DTSCG

SEQ ID NO: 2751539 - protein, 10 aa, Entamoeba invadens
DTSCGGQCDT

SEQ ID NO: 2751540 - protein, 7 aa, Entamoeba invadens
DTSDQRL

SEQ ID NO: 2751541 - protein, 4 aa, Entamoeba invadens
DTSE

SEQ ID NO: 2751542 - protein, 7 aa, Entamoeba invadens
DTSFNGK

SEQ ID NO: 2751543 - protein, 20 aa, Entamoeba invadens
DTSIRSPKKKRVTVEEPKLD

SEQ ID NO: 2751544 - protein, 5 aa, Entamoeba invadens
DTSKF

SEQ ID NO: 2751545 - protein, 4 aa, Entamoeba invadens
DTSL

SEQ ID NO: 2751546 - protein, 9 aa, Entamoeba invadens
DTSPLEVNK

SEQ ID NO: 2751547 - protein, 12 aa, Entamoeba invadens
DTSQDNCTSCRD

SEQ ID NO: 2751548 - protein, 7 aa, Entamoeba invadens
DTSSYEN

SEQ ID NO: 2751549 - protein, 8 aa, Entamoeba invadens
DTSSYSNT

SEQ ID NO: 2751550 - protein, 12 aa, Entamoeba invadens
DTSTTQEENGRC

SEQ ID NO: 2751551 - protein, 4 aa, Entamoeba invadens
DTSY

SEQ ID NO: 2751552 - protein, 5 aa, Entamoeba invadens
DTSYT

SEQ ID NO: 2751553 - protein, 11 aa, Entamoeba invadens
DTTCGNNCNGV

SEQ ID NO: 2751554 - protein, 7 aa, Entamoeba invadens
DTTCGSA

SEQ ID NO: 2751555 - protein, 5 aa, Entamoeba invadens
DTTCT

SEQ ID NO: 2751556 - protein, 9 aa, Entamoeba invadens
DTTDETTIY

SEQ ID NO: 2751557 - protein, 10 aa, Entamoeba invadens
DTTEDCDDSY

SEQ ID NO: 2751558 - protein, 10 aa, Entamoeba invadens
DTTENEPSKN

SEQ ID NO: 2751559 - protein, 6 aa, Entamoeba invadens
DTTFLN

SEQ ID NO: 2751560 - protein, 7 aa, Entamoeba invadens
DTTGKNI

SEQ ID NO: 2751561 - protein, 12 aa, Entamoeba invadens
DTTGSINCTTQT

SEQ ID NO: 2751562 - protein, 20 aa, Entamoeba invadens
DTTHYNNSSATKKDNINGCT

SEQ ID NO: 2751563 - protein, 5 aa, Entamoeba invadens
DTTIE

SEQ ID NO: 2751564 - protein, 11 aa, Entamoeba invadens
DTTIPTPIAPE

SEQ ID NO: 2751565 - protein, 19 aa, Entamoeba invadens
DTTKGTLDNEKVTRSTELS

SEQ ID NO: 2751566 - protein, 11 aa, Entamoeba invadens
DTTKKATSATL

SEQ ID NO: 2751567 - protein, 41 aa, Entamoeba invadens
DTTKPAPAVPTTKTAPSVPTTKHGKLPETEKEKPKEKTEVK

SEQ ID NO: 2751568 - protein, 4 aa, Entamoeba invadens
DTTL

SEQ ID NO: 2751569 - protein, 6 aa, Entamoeba invadens
DTTNVN

SEQ ID NO: 2751570 - protein, 6 aa, Entamoeba invadens
DTTPNW

SEQ ID NO: 2751571 - protein, 7 aa, Entamoeba invadens
DTTPNWT

SEQ ID NO: 2751572 - protein, 7 aa, Entamoeba invadens
DTTPQTE

SEQ ID NO: 2751573 - protein, 14 aa, Entamoeba invadens
DTTPRDKITEKNQQ

SEQ ID NO: 2751574 - protein, 7 aa, Entamoeba invadens
DTTQAPN

SEQ ID NO: 2751575 - protein, 6 aa, Entamoeba invadens
DTTRPF

SEQ ID NO: 2751576 - protein, 6 aa, Entamoeba invadens
DTTRPG

SEQ ID NO: 2751577 - protein, 21 aa, Entamoeba invadens
DTTRSATHSISSQLTSDKIEK

SEQ ID NO: 2751578 - protein, 6 aa, Entamoeba invadens
DTTSEL

SEQ ID NO: 2751579 - protein, 18 aa, Entamoeba invadens
DTTSGENSYECTTAGRDP

SEQ ID NO: 2751580 - protein, 5 aa, Entamoeba invadens
DTTSW

SEQ ID NO: 2751581 - protein, 6 aa, Entamoeba invadens
DTTSYG

SEQ ID NO: 2751582 - protein, 5 aa, Entamoeba invadens
DTTTG

SEQ ID NO: 2751583 - protein, 6 aa, Entamoeba invadens
DTTTGK

SEQ ID NO: 2751584 - protein, 9 aa, Entamoeba invadens
DTTTKGIRR

SEQ ID NO: 2751585 - protein, 7 aa, Entamoeba invadens
DTTTMGR

SEQ ID NO: 2751586 - protein, 7 aa, Entamoeba invadens
DTTTNGV

SEQ ID NO: 2751587 - protein, 15 aa, Entamoeba invadens
DTTTTDTKEFGYNND

SEQ ID NO: 2751588 - protein, 4 aa, Entamoeba invadens
DTTV

SEQ ID NO: 2751589 - protein, 7 aa, Entamoeba invadens
DTTVDTE

SEQ ID NO: 2751590 - protein, 8 aa, Entamoeba invadens
DTTVSGTN

SEQ ID NO: 2751591 - protein, 4 aa, Entamoeba invadens
DTTY

SEQ ID NO: 2751592 - protein, 7 aa, Entamoeba invadens
DTTYQDG

SEQ ID NO: 2751593 - protein, 4 aa, Entamoeba invadens
DTVD

SEQ ID NO: 2751594 - protein, 5 aa, Entamoeba invadens
DTVEE

SEQ ID NO: 2751595 - protein, 6 aa, Entamoeba invadens
DTVGRT

SEQ ID NO: 2751596 - protein, 6 aa, Entamoeba invadens
DTVHRS

SEQ ID NO: 2751597 - protein, 14 aa, Entamoeba invadens
DTVNPIAETDPNCP

SEQ ID NO: 2751598 - protein, 7 aa, Entamoeba invadens
DTVRDGL

SEQ ID NO: 2751599 - protein, 16 aa, Entamoeba invadens
DTVTATRKKSKTGSNC

SEQ ID NO: 2751600 - protein, 7 aa, Entamoeba invadens
DTVTSLD

SEQ ID NO: 2751601 - protein, 4 aa, Entamoeba invadens
DTVV

SEQ ID NO: 2751602 - protein, 4 aa, Entamoeba invadens
DTYD

SEQ ID NO: 2751603 - protein, 5 aa, Entamoeba invadens
DTYDK

SEQ ID NO: 2751604 - protein, 10 aa, Entamoeba invadens
DTYKPNPNGG

SEQ ID NO: 2751605 - protein, 4 aa, Entamoeba invadens
DTYP

SEQ ID NO: 2751606 - protein, 8 aa, Entamoeba invadens
DTYPPTKY

SEQ ID NO: 2751607 - protein, 6 aa, Entamoeba invadens
DTYSQH

SEQ ID NO: 2751608 - protein, 4 aa, Entamoeba invadens
DTYY

SEQ ID NO: 2751609 - protein, 5 aa, Entamoeba invadens
DTYYE

SEQ ID NO: 2751610 - protein, 12 aa, Entamoeba invadens
DVANHSELDNGF

SEQ ID NO: 2751611 - protein, 10 aa, Entamoeba invadens
DVASGKRPIT

SEQ ID NO: 2751612 - protein, 14 aa, Entamoeba invadens
DVASGKRPKEIKTL

SEQ ID NO: 2751613 - protein, 13 aa, Entamoeba invadens
DVASGKRPNTIKT

SEQ ID NO: 2751614 - protein, 12 aa, Entamoeba invadens
DVCEDSAKLGSK

SEQ ID NO: 2751615 - protein, 4 aa, Entamoeba invadens
DVDA

SEQ ID NO: 2751616 - protein, 15 aa, Entamoeba invadens
DVDESESEEEDDKVQ

SEQ ID NO: 2751617 - protein, 5 aa, Entamoeba invadens
DVDGQ

SEQ ID NO: 2751618 - protein, 10 aa, Entamoeba invadens
DVDNNGNTAA

SEQ ID NO: 2751619 - protein, 9 aa, Entamoeba invadens
DVDSNSVTT

SEQ ID NO: 2751620 - protein, 4 aa, Entamoeba invadens
DVDT

SEQ ID NO: 2751621 - protein, 7 aa, Entamoeba invadens
DVDTQQR

SEQ ID NO: 2751622 - protein, 21 aa, Entamoeba invadens
DVDTQYERSDDAEEAESDDMA

SEQ ID NO: 2751623 - protein, 15 aa, Entamoeba invadens
DVEEGASFASENPFE

SEQ ID NO: 2751624 - protein, 9 aa, Entamoeba invadens
DVEEKDDGI

SEQ ID NO: 2751625 - protein, 7 aa, Entamoeba invadens
DVEEQED

SEQ ID NO: 2751626 - protein, 11 aa, Entamoeba invadens
DVEEQGDNLTD

SEQ ID NO: 2751627 - protein, 8 aa, Entamoeba invadens
DVEEYTNE

SEQ ID NO: 2751628 - protein, 4 aa, Entamoeba invadens
DVEG

SEQ ID NO: 2751629 - protein, 5 aa, Entamoeba invadens
DVEGQ

SEQ ID NO: 2751630 - protein, 7 aa, Entamoeba invadens
DVEGQTE

SEQ ID NO: 2751631 - protein, 6 aa, Entamoeba invadens
DVEIEG

SEQ ID NO: 2751632 - protein, 13 aa, Entamoeba invadens
DVENGKLKGNAPV

SEQ ID NO: 2751633 - protein, 11 aa, Entamoeba invadens
DVENRSDLDAD

SEQ ID NO: 2751634 - protein, 6 aa, Entamoeba invadens
DVESKG

SEQ ID NO: 2751635 - protein, 10 aa, Entamoeba invadens
DVESTNAGLN

SEQ ID NO: 2751636 - protein, 5 aa, Entamoeba invadens
DVESV

SEQ ID NO: 2751637 - protein, 13 aa, Entamoeba invadens
DVFGGSNPSTSCD

SEQ ID NO: 2751638 - protein, 17 aa, Entamoeba invadens
DVFGSGKSESDKIRTSD

SEQ ID NO: 2751639 - protein, 10 aa, Entamoeba invadens
DVGATPTQIT

SEQ ID NO: 2751640 - protein, 15 aa, Entamoeba invadens
DVGEEESVMSEREPV

SEQ ID NO: 2751641 - protein, 5 aa, Entamoeba invadens
DVGEQ

SEQ ID NO: 2751642 - protein, 9 aa, Entamoeba invadens
DVGKPEEYQ

SEQ ID NO: 2751643 - protein, 6 aa, Entamoeba invadens
DVGTNY

SEQ ID NO: 2751644 - protein, 13 aa, Entamoeba invadens
DVHGAGDSLSAAT

SEQ ID NO: 2751645 - protein, 4 aa, Entamoeba invadens
DVIS

SEQ ID NO: 2751646 - protein, 11 aa, Entamoeba invadens
DVKAKEKQMEK

SEQ ID NO: 2751647 - protein, 17 aa, Entamoeba invadens
DVKANAKLTDFGASRNI

SEQ ID NO: 2751648 - protein, 9 aa, Entamoeba invadens
DVKEDSTDL

SEQ ID NO: 2751649 - protein, 10 aa, Entamoeba invadens
DVKKGKEENL

SEQ ID NO: 2751650 - protein, 15 aa, Entamoeba invadens
DVKPNGREEECDGGI

SEQ ID NO: 2751651 - protein, 9 aa, Entamoeba invadens
DVKPTTTGT

SEQ ID NO: 2751652 - protein, 5 aa, Entamoeba invadens
DVLGN

SEQ ID NO: 2751653 - protein, 11 aa, Entamoeba invadens
DVNDKSGRLTS

SEQ ID NO: 2751654 - protein, 9 aa, Entamoeba invadens
DVNGPNGIN

SEQ ID NO: 2751655 - protein, 14 aa, Entamoeba invadens
DVNKNKDEATPLQE

SEQ ID NO: 2751656 - protein, 6 aa, Entamoeba invadens
DVNLPN

SEQ ID NO: 2751657 - protein, 7 aa, Entamoeba invadens
DVNLTNK

SEQ ID NO: 2751658 - protein, 4 aa, Entamoeba invadens
DVNQ

SEQ ID NO: 2751659 - protein, 12 aa, Entamoeba invadens
DVNQYDDDTTKY

SEQ ID NO: 2751660 - protein, 21 aa, Entamoeba invadens
DVNRSTSAKTDEENMKQGKGV

SEQ ID NO: 2751661 - protein, 10 aa, Entamoeba invadens
DVNRTTECGQ

SEQ ID NO: 2751662 - protein, 9 aa, Entamoeba invadens
DVPEDDEGL

SEQ ID NO: 2751663 - protein, 5 aa, Entamoeba invadens
DVPEL

SEQ ID NO: 2751664 - protein, 4 aa, Entamoeba invadens
DVPN

SEQ ID NO: 2751665 - protein, 6 aa, Entamoeba invadens
DVPPTY

SEQ ID NO: 2751666 - protein, 5 aa, Entamoeba invadens
DVPTD

SEQ ID NO: 2751667 - protein, 4 aa, Entamoeba invadens
DVPV

SEQ ID NO: 2751668 - protein, 9 aa, Entamoeba invadens
DVQKSSTQL

SEQ ID NO: 2751669 - protein, 9 aa, Entamoeba invadens
DVQNKTNSV

SEQ ID NO: 2751670 - protein, 5 aa, Entamoeba invadens
DVQNM

SEQ ID NO: 2751671 - protein, 9 aa, Entamoeba invadens
DVQNSGEDL

SEQ ID NO: 2751672 - protein, 32 aa, Entamoeba invadens
DVQNTDCTTASNIESVPYSDVSNRTSTTNNAK

SEQ ID NO: 2751673 - protein, 8 aa, Entamoeba invadens
DVQPISNE

SEQ ID NO: 2751674 - protein, 12 aa, Entamoeba invadens
DVREEGTTEEFE

SEQ ID NO: 2751675 - protein, 15 aa, Entamoeba invadens
DVSDDSSNEKESKDA

SEQ ID NO: 2751676 - protein, 8 aa, Entamoeba invadens
DVSDEELQ

SEQ ID NO: 2751677 - protein, 9 aa, Entamoeba invadens
DVSDGNDLK

SEQ ID NO: 2751678 - protein, 12 aa, Entamoeba invadens
DVSEEKREVGGV

SEQ ID NO: 2751679 - protein, 6 aa, Entamoeba invadens
DVSKEF

SEQ ID NO: 2751680 - protein, 10 aa, Entamoeba invadens
DVSKPASRNL

SEQ ID NO: 2751681 - protein, 7 aa, Entamoeba invadens
DVSKRTL

SEQ ID NO: 2751682 - protein, 6 aa, Entamoeba invadens
DVSMND

SEQ ID NO: 2751683 - protein, 13 aa, Entamoeba invadens
DVSNSQRDDPYGT

SEQ ID NO: 2751684 - protein, 21 aa, Entamoeba invadens
DVSQDTEGRTFTRAPVDPQNL

SEQ ID NO: 2751685 - protein, 8 aa, Entamoeba invadens
DVSSNSEI

SEQ ID NO: 2751686 - protein, 6 aa, Entamoeba invadens
DVSSRT

SEQ ID NO: 2751687 - protein, 10 aa, Entamoeba invadens
DVSSSSNTLP

SEQ ID NO: 2751688 - protein, 10 aa, Entamoeba invadens
DVSSSTPPEE

SEQ ID NO: 2751689 - protein, 17 aa, Entamoeba invadens
DVSTTSSETDCQDAPNV

SEQ ID NO: 2751690 - protein, 7 aa, Entamoeba invadens
DVSYEAL

SEQ ID NO: 2751691 - protein, 8 aa, Entamoeba invadens
DVTFSNSK

SEQ ID NO: 2751692 - protein, 8 aa, Entamoeba invadens
DVTGKNSV

SEQ ID NO: 2751693 - protein, 15 aa, Entamoeba invadens
DVTKGSIKVDGQDVR

SEQ ID NO: 2751694 - protein, 7 aa, Entamoeba invadens
DVTNFDG

SEQ ID NO: 2751695 - protein, 5 aa, Entamoeba invadens
DVTNN

SEQ ID NO: 2751696 - protein, 6 aa, Entamoeba invadens
DVTVEQ

SEQ ID NO: 2751697 - protein, 30 aa, Entamoeba invadens
DVVEEKNNLEISSEDEDGVMENDEDDDDHV

SEQ ID NO: 2751698 - protein, 17 aa, Entamoeba invadens
DVVSTDKKTCEAPKTTA

SEQ ID NO: 2751699 - protein, 13 aa, Entamoeba invadens
DVYTDKPRLAPPF

SEQ ID NO: 2751700 - protein, 9 aa, Entamoeba invadens
DWDEGAYGN

SEQ ID NO: 2751701 - protein, 7 aa, Entamoeba invadens
DWRGYES

SEQ ID NO: 2751702 - protein, 9 aa, Entamoeba invadens
DWSSQEKSY

SEQ ID NO: 2751703 - protein, 13 aa, Entamoeba invadens
DYADEDSEVENSQ

SEQ ID NO: 2751704 - protein, 6 aa, Entamoeba invadens
DYANQA

SEQ ID NO: 2751705 - protein, 10 aa, Entamoeba invadens
DYCDTQPVTG

SEQ ID NO: 2751706 - protein, 16 aa, Entamoeba invadens
DYDASNSCTGTPSNII

SEQ ID NO: 2751707 - protein, 9 aa, Entamoeba invadens
DYDGGENKR

SEQ ID NO: 2751708 - protein, 9 aa, Entamoeba invadens
DYDRLEDGN

SEQ ID NO: 2751709 - protein, 11 aa, Entamoeba invadens
DYDTTKKEYTC

SEQ ID NO: 2751710 - protein, 5 aa, Entamoeba invadens
DYEDQ

SEQ ID NO: 2751711 - protein, 15 aa, Entamoeba invadens
DYEDTSSEDSQENTV

SEQ ID NO: 2751712 - protein, 22 aa, Entamoeba invadens
DYEEEEKTEKNVNKEEADIKKT

SEQ ID NO: 2751713 - protein, 5 aa, Entamoeba invadens
DYEKT

SEQ ID NO: 2751714 - protein, 4 aa, Entamoeba invadens
DYFT

SEQ ID NO: 2751715 - protein, 6 aa, Entamoeba invadens
DYGDDD

SEQ ID NO: 2751716 - protein, 5 aa, Entamoeba invadens
DYGDT

SEQ ID NO: 2751717 - protein, 8 aa, Entamoeba invadens
DYHPSKGS

SEQ ID NO: 2751718 - protein, 13 aa, Entamoeba invadens
DYIDDKPEVEPMP

SEQ ID NO: 2751719 - protein, 12 aa, Entamoeba invadens
DYKKRDENGYSC

SEQ ID NO: 2751720 - protein, 17 aa, Entamoeba invadens
DYLKKQKQKSRSQEAAL

SEQ ID NO: 2751721 - protein, 5 aa, Entamoeba invadens
DYNNG

SEQ ID NO: 2751722 - protein, 5 aa, Entamoeba invadens
DYNSN

SEQ ID NO: 2751723 - protein, 5 aa, Entamoeba invadens
DYNTE

SEQ ID NO: 2751724 - protein, 9 aa, Entamoeba invadens
DYPEDPTHY

SEQ ID NO: 2751725 - protein, 6 aa, Entamoeba invadens
DYPETH

SEQ ID NO: 2751726 - protein, 6 aa, Entamoeba invadens
DYQYEN

SEQ ID NO: 2751727 - protein, 5 aa, Entamoeba invadens
DYRQE

SEQ ID NO: 2751728 - protein, 5 aa, Entamoeba invadens
DYRTP

SEQ ID NO: 2751729 - protein, 12 aa, Entamoeba invadens
DYSCPGSSSTNV

SEQ ID NO: 2751730 - protein, 7 aa, Entamoeba invadens
DYSKQSK

SEQ ID NO: 2751731 - protein, 7 aa, Entamoeba invadens
DYSNTNN

SEQ ID NO: 2751732 - protein, 4 aa, Entamoeba invadens
DYSP

SEQ ID NO: 2751733 - protein, 9 aa, Entamoeba invadens
DYSPSNPIL

SEQ ID NO: 2751734 - protein, 4 aa, Entamoeba invadens
DYSR

SEQ ID NO: 2751735 - protein, 9 aa, Entamoeba invadens
DYSSKTCTD

SEQ ID NO: 2751736 - protein, 10 aa, Entamoeba invadens
DYSSKTCTDI

SEQ ID NO: 2751737 - protein, 7 aa, Entamoeba invadens
DYSSSPD

SEQ ID NO: 2751738 - protein, 14 aa, Entamoeba invadens
DYSTASMKSFGTNY

SEQ ID NO: 2751739 - protein, 11 aa, Entamoeba invadens
DYSYANSKGVC

SEQ ID NO: 2751740 - protein, 5 aa, Entamoeba invadens
DYTDP

SEQ ID NO: 2751741 - protein, 7 aa, Entamoeba invadens
DYTGTSA

SEQ ID NO: 2751742 - protein, 6 aa, Entamoeba invadens
DYTHKD

SEQ ID NO: 2751743 - protein, 4 aa, Entamoeba invadens
DYTK

SEQ ID NO: 2751744 - protein, 17 aa, Entamoeba invadens
DYTKSDHCEKCKEGYRL

SEQ ID NO: 2751745 - protein, 7 aa, Entamoeba invadens
DYTSEFD

SEQ ID NO: 2751746 - protein, 17 aa, Entamoeba invadens
DYTSNGKRLPIPNTVPE

SEQ ID NO: 2751747 - protein, 7 aa, Entamoeba invadens
DYTTPTN

SEQ ID NO: 2751748 - protein, 6 aa, Entamoeba invadens
DYTYGY

SEQ ID NO: 2751749 - protein, 10 aa, Entamoeba invadens
DYVGQGENGE

SEQ ID NO: 2751750 - protein, 8 aa, Entamoeba invadens
DYVPGQRY

SEQ ID NO: 2751751 - protein, 11 aa, Entamoeba invadens
DYVPQNETNNV

SEQ ID NO: 2751752 - protein, 11 aa, Entamoeba invadens
DYYPAGKKCDT

SEQ ID NO: 2751753 - protein, 16 aa, Entamoeba invadens
DYYPNGKGCSSCASQN

SEQ ID NO: 2751754 - protein, 8 aa, Entamoeba invadens
DYYSPDEW

SEQ ID NO: 2751755 - protein, 13 aa, Entamoeba invadens
DYYTSSVTSAKQN

SEQ ID NO: 2751756 - protein, 13 aa, Entamoeba invadens
EAAEENKKLNKKW

SEQ ID NO: 2751757 - protein, 11 aa, Entamoeba invadens
EAAEKEKENMK

SEQ ID NO: 2751758 - protein, 65 aa, Entamoeba invadens
EAAEKVEKEQKKAAKEAEKEAEKEQKKAEKEAEKEAEKEAEKAEKKAEKEAKKAEKEAEKAAEEK

SEQ ID NO: 2751759 - protein, 8 aa, Entamoeba invadens
EAAEPTED

SEQ ID NO: 2751760 - protein, 10 aa, Entamoeba invadens
EAAPNGNEVF

SEQ ID NO: 2751761 - protein, 6 aa, Entamoeba invadens
EAASTV

SEQ ID NO: 2751762 - protein, 6 aa, Entamoeba invadens
EACNSN

SEQ ID NO: 2751763 - protein, 8 aa, Entamoeba invadens
EADAKPLC

SEQ ID NO: 2751764 - protein, 11 aa, Entamoeba invadens
EADEAQIELPT

SEQ ID NO: 2751765 - protein, 5 aa, Entamoeba invadens
EADGV

SEQ ID NO: 2751766 - protein, 6 aa, Entamoeba invadens
EADKRI

SEQ ID NO: 2751767 - protein, 5 aa, Entamoeba invadens
EADNG

SEQ ID NO: 2751768 - protein, 6 aa, Entamoeba invadens
EADQMV

SEQ ID NO: 2751769 - protein, 4 aa, Entamoeba invadens
EAEE

SEQ ID NO: 2751770 - protein, 6 aa, Entamoeba invadens
EAEFTN

SEQ ID NO: 2751771 - protein, 8 aa, Entamoeba invadens
EAEKGKTV

SEQ ID NO: 2751772 - protein, 8 aa, Entamoeba invadens
EAEKTNTI

SEQ ID NO: 2751773 - protein, 8 aa, Entamoeba invadens
EAESAKEN

SEQ ID NO: 2751774 - protein, 5 aa, Entamoeba invadens
EAETI

SEQ ID NO: 2751775 - protein, 7 aa, Entamoeba invadens
EAEVQEL

SEQ ID NO: 2751776 - protein, 4 aa, Entamoeba invadens
EAEY

SEQ ID NO: 2751777 - protein, 5 aa, Entamoeba invadens
EAFPC

SEQ ID NO: 2751778 - protein, 10 aa, Entamoeba invadens
EAFQSGERNE

SEQ ID NO: 2751779 - protein, 5 aa, Entamoeba invadens
EAGDG

SEQ ID NO: 2751780 - protein, 4 aa, Entamoeba invadens
EAGK

SEQ ID NO: 2751781 - protein, 5 aa, Entamoeba invadens
EAGNT

SEQ ID NO: 2751782 - protein, 8 aa, Entamoeba invadens
EAGTQSKE

SEQ ID NO: 2751783 - protein, 8 aa, Entamoeba invadens
EAHEDEFE

SEQ ID NO: 2751784 - protein, 5 aa, Entamoeba invadens
EAHGK

SEQ ID NO: 2751785 - protein, 5 aa, Entamoeba invadens
EAIDG

SEQ ID NO: 2751786 - protein, 7 aa, Entamoeba invadens
EAINEQK

SEQ ID NO: 2751787 - protein, 5 aa, Entamoeba invadens
EAITT

SEQ ID NO: 2751788 - protein, 4 aa, Entamoeba invadens
EAKD

SEQ ID NO: 2751789 - protein, 40 aa, Entamoeba invadens
EAKDKIKDKTKDNAQKTPDLPDGVDEVKTKYSEPVNTHEH

SEQ ID NO: 2751790 - protein, 6 aa, Entamoeba invadens
EAKEKD

SEQ ID NO: 2751791 - protein, 6 aa, Entamoeba invadens
EAKGGK

SEQ ID NO: 2751792 - protein, 5 aa, Entamoeba invadens
EAKGN

SEQ ID NO: 2751793 - protein, 5 aa, Entamoeba invadens
EAKIS

SEQ ID NO: 2751794 - protein, 9 aa, Entamoeba invadens
EAKKNEGIA

SEQ ID NO: 2751795 - protein, 7 aa, Entamoeba invadens
EAKKPLM

SEQ ID NO: 2751796 - protein, 9 aa, Entamoeba invadens
EAKKSGSSK

SEQ ID NO: 2751797 - protein, 34 aa, Entamoeba invadens
EAKKSQKNEKIEKLEEVNNKSNNKNEKSETFEGL

SEQ ID NO: 2751798 - protein, 9 aa, Entamoeba invadens
EAKKVGNAK

SEQ ID NO: 2751799 - protein, 4 aa, Entamoeba invadens
EAKQ

SEQ ID NO: 2751800 - protein, 8 aa, Entamoeba invadens
EAKSLEER

SEQ ID NO: 2751801 - protein, 12 aa, Entamoeba invadens
EAKSLKGNFDVS

SEQ ID NO: 2751802 - protein, 11 aa, Entamoeba invadens
EAKTKQSTKLN

SEQ ID NO: 2751803 - protein, 6 aa, Entamoeba invadens
EAKTRQ

SEQ ID NO: 2751804 - protein, 14 aa, Entamoeba invadens
EAKTVQAQFTGENI

SEQ ID NO: 2751805 - protein, 5 aa, Entamoeba invadens
EAKVN

SEQ ID NO: 2751806 - protein, 6 aa, Entamoeba invadens
EALSTN

SEQ ID NO: 2751807 - protein, 8 aa, Entamoeba invadens
EANAREKE

SEQ ID NO: 2751808 - protein, 6 aa, Entamoeba invadens
EANESI

SEQ ID NO: 2751809 - protein, 8 aa, Entamoeba invadens
EANGHTER

SEQ ID NO: 2751810 - protein, 6 aa, Entamoeba invadens
EANIET

SEQ ID NO: 2751811 - protein, 22 aa, Entamoeba invadens
EANKKLDENEITENPNTGEQNI

SEQ ID NO: 2751812 - protein, 8 aa, Entamoeba invadens
EANLTQSL

SEQ ID NO: 2751813 - protein, 4 aa, Entamoeba invadens
EANN

SEQ ID NO: 2751814 - protein, 7 aa, Entamoeba invadens
EANNDSL

SEQ ID NO: 2751815 - protein, 9 aa, Entamoeba invadens
EANQSGVDE

SEQ ID NO: 2751816 - protein, 8 aa, Entamoeba invadens
EANSLSEV

SEQ ID NO: 2751817 - protein, 9 aa, Entamoeba invadens
EANTTNVPR

SEQ ID NO: 2751818 - protein, 14 aa, Entamoeba invadens
EAPKIIPSDPTLSQ

SEQ ID NO: 2751819 - protein, 14 aa, Entamoeba invadens
EAPKKVGNAQSSLR

SEQ ID NO: 2751820 - protein, 13 aa, Entamoeba invadens
EAPKSERTMNRRN

SEQ ID NO: 2751821 - protein, 5 aa, Entamoeba invadens
EAPTG

SEQ ID NO: 2751822 - protein, 7 aa, Entamoeba invadens
EAPTTTN

SEQ ID NO: 2751823 - protein, 44 aa, Entamoeba invadens
EAQEAELQKARDEKNARKKAAKKARKEAAKLQKEKDKKTEETHL

SEQ ID NO: 2751824 - protein, 15 aa, Entamoeba invadens
EAQPAEANEKENEEI

SEQ ID NO: 2751825 - protein, 7 aa, Entamoeba invadens
EAQTKTV

SEQ ID NO: 2751826 - protein, 9 aa, Entamoeba invadens
EAQYVEEQA

SEQ ID NO: 2751827 - protein, 8 aa, Entamoeba invadens
EARDSKCT

SEQ ID NO: 2751828 - protein, 9 aa, Entamoeba invadens
EARKLGEIG

SEQ ID NO: 2751829 - protein, 6 aa, Entamoeba invadens
EARPTV

SEQ ID NO: 2751830 - protein, 10 aa, Entamoeba invadens
EASKDNKIQS

SEQ ID NO: 2751831 - protein, 14 aa, Entamoeba invadens
EASKTSPVVCVSYS

SEQ ID NO: 2751832 - protein, 8 aa, Entamoeba invadens
EASNERTT

SEQ ID NO: 2751833 - protein, 5 aa, Entamoeba invadens
EASNL

SEQ ID NO: 2751834 - protein, 6 aa, Entamoeba invadens
EASQNG

SEQ ID NO: 2751835 - protein, 7 aa, Entamoeba invadens
EASRRDQ

SEQ ID NO: 2751836 - protein, 7 aa, Entamoeba invadens
EASSANG

SEQ ID NO: 2751837 - protein, 8 aa, Entamoeba invadens
EASYPYGG

SEQ ID NO: 2751838 - protein, 20 aa, Entamoeba invadens
EATEETTDHSDKKKRRYSWS

SEQ ID NO: 2751839 - protein, 5 aa, Entamoeba invadens
EATEN

SEQ ID NO: 2751840 - protein, 4 aa, Entamoeba invadens
EATG

SEQ ID NO: 2751841 - protein, 10 aa, Entamoeba invadens
EATNNFTNSK

SEQ ID NO: 2751842 - protein, 9 aa, Entamoeba invadens
EATNNSDAI

SEQ ID NO: 2751843 - protein, 6 aa, Entamoeba invadens
EATNSK

SEQ ID NO: 2751844 - protein, 14 aa, Entamoeba invadens
EATPNNNKPPLHRE

SEQ ID NO: 2751845 - protein, 10 aa, Entamoeba invadens
EATRDSHGEA

SEQ ID NO: 2751846 - protein, 6 aa, Entamoeba invadens
EATSTS

SEQ ID NO: 2751847 - protein, 5 aa, Entamoeba invadens
EATTG

SEQ ID NO: 2751848 - protein, 10 aa, Entamoeba invadens
EAVAKSVSKI

SEQ ID NO: 2751849 - protein, 11 aa, Entamoeba invadens
EAVQKDQEQEF

SEQ ID NO: 2751850 - protein, 4 aa, Entamoeba invadens
EAVR

SEQ ID NO: 2751851 - protein, 6 aa, Entamoeba invadens
EAYDKK

SEQ ID NO: 2751852 - protein, 10 aa, Entamoeba invadens
EAYDKKRREY

SEQ ID NO: 2751853 - protein, 6 aa, Entamoeba invadens
EAYDKN

SEQ ID NO: 2751854 - protein, 5 aa, Entamoeba invadens
EAYEK

SEQ ID NO: 2751855 - protein, 6 aa, Entamoeba invadens
EAYGTN

SEQ ID NO: 2751856 - protein, 7 aa, Entamoeba invadens
EAYPKNE

SEQ ID NO: 2751857 - protein, 6 aa, Entamoeba invadens
EAYPKT

SEQ ID NO: 2751858 - protein, 7 aa, Entamoeba invadens
EAYPSSK

SEQ ID NO: 2751859 - protein, 13 aa, Entamoeba invadens
EAYSTVKKPLSQI

SEQ ID NO: 2751860 - protein, 7 aa, Entamoeba invadens
EAYTSEN

SEQ ID NO: 2751861 - protein, 7 aa, Entamoeba invadens
ECARGEI

SEQ ID NO: 2751862 - protein, 12 aa, Entamoeba invadens
ECASTSSCTKCS

SEQ ID NO: 2751863 - protein, 24 aa, Entamoeba invadens
ECASTSSCTKCSEGFTVGTDNTCH

SEQ ID NO: 2751864 - protein, 12 aa, Entamoeba invadens
ECASTSSCTTCS

SEQ ID NO: 2751865 - protein, 17 aa, Entamoeba invadens
ECDARNSTIDSEDNNLR

SEQ ID NO: 2751866 - protein, 9 aa, Entamoeba invadens
ECDATKASY

SEQ ID NO: 2751867 - protein, 15 aa, Entamoeba invadens
ECDESCATCQKSGSC

SEQ ID NO: 2751868 - protein, 15 aa, Entamoeba invadens
ECDETQESIKAKTDC

SEQ ID NO: 2751869 - protein, 9 aa, Entamoeba invadens
ECDGTEGCT

SEQ ID NO: 2751870 - protein, 9 aa, Entamoeba invadens
ECDNGTNCD

SEQ ID NO: 2751871 - protein, 9 aa, Entamoeba invadens
ECDNGTNCN

SEQ ID NO: 2751872 - protein, 10 aa, Entamoeba invadens
ECDPTIPSRS

SEQ ID NO: 2751873 - protein, 7 aa, Entamoeba invadens
ECDRNTE

SEQ ID NO: 2751874 - protein, 8 aa, Entamoeba invadens
ECDSENGI

SEQ ID NO: 2751875 - protein, 8 aa, Entamoeba invadens
ECDSGTNC

SEQ ID NO: 2751876 - protein, 7 aa, Entamoeba invadens
ECDSSCS

SEQ ID NO: 2751877 - protein, 11 aa, Entamoeba invadens
ECEDAPNGDEI

SEQ ID NO: 2751878 - protein, 14 aa, Entamoeba invadens
ECEEGYTLKKNNNK

SEQ ID NO: 2751879 - protein, 5 aa, Entamoeba invadens
ECEKC

SEQ ID NO: 2751880 - protein, 8 aa, Entamoeba invadens
ECEKCDNS

SEQ ID NO: 2751881 - protein, 7 aa, Entamoeba invadens
ECENGYT

SEQ ID NO: 2751882 - protein, 19 aa, Entamoeba invadens
ECEQTSSKCTKCSEGTLKD

SEQ ID NO: 2751883 - protein, 7 aa, Entamoeba invadens
ECERCSE

SEQ ID NO: 2751884 - protein, 13 aa, Entamoeba invadens
ECESCNDPERTNC

SEQ ID NO: 2751885 - protein, 9 aa, Entamoeba invadens
ECETCQSKG

SEQ ID NO: 2751886 - protein, 11 aa, Entamoeba invadens
ECETYDNTNTK

SEQ ID NO: 2751887 - protein, 10 aa, Entamoeba invadens
ECEYSTSDPL

SEQ ID NO: 2751888 - protein, 5 aa, Entamoeba invadens
ECGND

SEQ ID NO: 2751889 - protein, 8 aa, Entamoeba invadens
ECGRGVNQ

SEQ ID NO: 2751890 - protein, 5 aa, Entamoeba invadens
ECGTY

SEQ ID NO: 2751891 - protein, 7 aa, Entamoeba invadens
ECHDNGT

SEQ ID NO: 2751892 - protein, 6 aa, Entamoeba invadens
ECHQDG

SEQ ID NO: 2751893 - protein, 5 aa, Entamoeba invadens
ECITT

SEQ ID NO: 2751894 - protein, 6 aa, Entamoeba invadens
ECKGWD

SEQ ID NO: 2751895 - protein, 11 aa, Entamoeba invadens
ECKNCSSRNTN

SEQ ID NO: 2751896 - protein, 6 aa, Entamoeba invadens
ECKPPF

SEQ ID NO: 2751897 - protein, 6 aa, Entamoeba invadens
ECKPPV

SEQ ID NO: 2751898 - protein, 7 aa, Entamoeba invadens
ECKPPVK

SEQ ID NO: 2751899 - protein, 6 aa, Entamoeba invadens
ECKRCS

SEQ ID NO: 2751900 - protein, 7 aa, Entamoeba invadens
ECKSCNT

SEQ ID NO: 2751901 - protein, 10 aa, Entamoeba invadens
ECKSCSTNNA

SEQ ID NO: 2751902 - protein, 8 aa, Entamoeba invadens
ECKSNENL

SEQ ID NO: 2751903 - protein, 8 aa, Entamoeba invadens
ECKTCTNT

SEQ ID NO: 2751904 - protein, 7 aa, Entamoeba invadens
ECKTCTS

SEQ ID NO: 2751905 - protein, 6 aa, Entamoeba invadens
ECKVDP

SEQ ID NO: 2751906 - protein, 6 aa, Entamoeba invadens
ECLTST

SEQ ID NO: 2751907 - protein, 4 aa, Entamoeba invadens
ECNA

SEQ ID NO: 2751908 - protein, 5 aa, Entamoeba invadens
ECNDG

SEQ ID NO: 2751909 - protein, 5 aa, Entamoeba invadens
ECNEC

SEQ ID NO: 2751910 - protein, 8 aa, Entamoeba invadens
ECNGPNAN

SEQ ID NO: 2751911 - protein, 17 aa, Entamoeba invadens
ECNKCDDNCNTCTTTGN

SEQ ID NO: 2751912 - protein, 9 aa, Entamoeba invadens
ECNKSYQQP

SEQ ID NO: 2751913 - protein, 5 aa, Entamoeba invadens
ECNQK

SEQ ID NO: 2751914 - protein, 5 aa, Entamoeba invadens
ECNQR

SEQ ID NO: 2751915 - protein, 8 aa, Entamoeba invadens
ECNSENGY

SEQ ID NO: 2751916 - protein, 10 aa, Entamoeba invadens
ECPDSTDISQ

SEQ ID NO: 2751917 - protein, 9 aa, Entamoeba invadens
ECPETTDIG

SEQ ID NO: 2751918 - protein, 5 aa, Entamoeba invadens
ECPPE

SEQ ID NO: 2751919 - protein, 16 aa, Entamoeba invadens
ECPTDPTDAGEQNNLE

SEQ ID NO: 2751920 - protein, 11 aa, Entamoeba invadens
ECPTGGVNPLT

SEQ ID NO: 2751921 - protein, 8 aa, Entamoeba invadens
ECQECNDN

SEQ ID NO: 2751922 - protein, 11 aa, Entamoeba invadens
ECQESNDNCNT

SEQ ID NO: 2751923 - protein, 5 aa, Entamoeba invadens
ECQIS

SEQ ID NO: 2751924 - protein, 9 aa, Entamoeba invadens
ECQKCQNEG

SEQ ID NO: 2751925 - protein, 8 aa, Entamoeba invadens
ECQKTDVN

SEQ ID NO: 2751926 - protein, 20 aa, Entamoeba invadens
ECRKCDDNCNTCTSTSTKCT

SEQ ID NO: 2751927 - protein, 25 aa, Entamoeba invadens
ECRNGKLGSGDECKQKSEGCQTGCT

SEQ ID NO: 2751928 - protein, 21 aa, Entamoeba invadens
ECRSGKIGSGEQCKQTTEGCN

SEQ ID NO: 2751929 - protein, 5 aa, Entamoeba invadens
ECRTN

SEQ ID NO: 2751930 - protein, 17 aa, Entamoeba invadens
ECSDGINNEENGKCAPQ

SEQ ID NO: 2751931 - protein, 17 aa, Entamoeba invadens
ECSDGTNNEENGKCAPQ

SEQ ID NO: 2751932 - protein, 14 aa, Entamoeba invadens
ECSKCGQGKKLSYD

SEQ ID NO: 2751933 - protein, 12 aa, Entamoeba invadens
ECSKPGNNPNNL

SEQ ID NO: 2751934 - protein, 10 aa, Entamoeba invadens
ECSNKEDSAM

SEQ ID NO: 2751935 - protein, 10 aa, Entamoeba invadens
ECSPTDGDTR

SEQ ID NO: 2751936 - protein, 12 aa, Entamoeba invadens
ECSQGKDAATRM

SEQ ID NO: 2751937 - protein, 5 aa, Entamoeba invadens
ECSQL

SEQ ID NO: 2751938 - protein, 5 aa, Entamoeba invadens
ECSRV

SEQ ID NO: 2751939 - protein, 12 aa, Entamoeba invadens
ECSSDCGSCVSE

SEQ ID NO: 2751940 - protein, 17 aa, Entamoeba invadens
ECSSGINNEENGKCAPQ

SEQ ID NO: 2751941 - protein, 9 aa, Entamoeba invadens
ECSSSNEEC

SEQ ID NO: 2751942 - protein, 8 aa, Entamoeba invadens
ECSYDSKK

SEQ ID NO: 2751943 - protein, 5 aa, Entamoeba invadens
ECTAC

SEQ ID NO: 2751944 - protein, 4 aa, Entamoeba invadens
ECTE

SEQ ID NO: 2751945 - protein, 6 aa, Entamoeba invadens
ECTECG

SEQ ID NO: 2751946 - protein, 7 aa, Entamoeba invadens
ECTEEIE

SEQ ID NO: 2751947 - protein, 10 aa, Entamoeba invadens
ECTESKDSKC

SEQ ID NO: 2751948 - protein, 5 aa, Entamoeba invadens
ECTID

SEQ ID NO: 2751949 - protein, 11 aa, Entamoeba invadens
ECTISGDNLGI

SEQ ID NO: 2751950 - protein, 6 aa, Entamoeba invadens
ECTNAY

SEQ ID NO: 2751951 - protein, 8 aa, Entamoeba invadens
ECTNSQSA

SEQ ID NO: 2751952 - protein, 14 aa, Entamoeba invadens
ECTSYNSKGNCEEC

SEQ ID NO: 2751953 - protein, 4 aa, Entamoeba invadens
ECTT

SEQ ID NO: 2751954 - protein, 13 aa, Entamoeba invadens
ECVKKDANCNQLK

SEQ ID NO: 2751955 - protein, 10 aa, Entamoeba invadens
ECVSGDNETE

SEQ ID NO: 2751956 - protein, 13 aa, Entamoeba invadens
ECVSYSKSTCENC

SEQ ID NO: 2751957 - protein, 5 aa, Entamoeba invadens
ECYGP

SEQ ID NO: 2751958 - protein, 11 aa, Entamoeba invadens
ECYKNTKNSVN

SEQ ID NO: 2751959 - protein, 4 aa, Entamoeba invadens
ECYN

SEQ ID NO: 2751960 - protein, 6 aa, Entamoeba invadens
EDAETR

SEQ ID NO: 2751961 - protein, 5 aa, Entamoeba invadens
EDAGV

SEQ ID NO: 2751962 - protein, 21 aa, Entamoeba invadens
EDALSGPQSPEDNSNDEANGD

SEQ ID NO: 2751963 - protein, 7 aa, Entamoeba invadens
EDAPIGD

SEQ ID NO: 2751964 - protein, 5 aa, Entamoeba invadens
EDAQT

SEQ ID NO: 2751965 - protein, 26 aa, Entamoeba invadens
EDASKKPNKGEGKHAKDLIKSYVKHA

SEQ ID NO: 2751966 - protein, 39 aa, Entamoeba invadens
EDATSNTSLTSGTTDSSSSEKKRSKTSKNTKSTNTPPSL

SEQ ID NO: 2751967 - protein, 8 aa, Entamoeba invadens
EDCDSSQH

SEQ ID NO: 2751968 - protein, 6 aa, Entamoeba invadens
EDCMPS

SEQ ID NO: 2751969 - protein, 13 aa, Entamoeba invadens
EDCNKGKKVDEHT

SEQ ID NO: 2751970 - protein, 5 aa, Entamoeba invadens
EDCPR

SEQ ID NO: 2751971 - protein, 13 aa, Entamoeba invadens
EDCPSQSTVTNAD

SEQ ID NO: 2751972 - protein, 7 aa, Entamoeba invadens
EDCYPSR

SEQ ID NO: 2751973 - protein, 10 aa, Entamoeba invadens
EDDEEENEKM

SEQ ID NO: 2751974 - protein, 10 aa, Entamoeba invadens
EDDEEGTSTV

SEQ ID NO: 2751975 - protein, 22 aa, Entamoeba invadens
EDDEGLVKENKEENNIENHEKN

SEQ ID NO: 2751976 - protein, 23 aa, Entamoeba invadens
EDDGFNKEMGYDPRDESSIQETP

SEQ ID NO: 2751977 - protein, 5 aa, Entamoeba invadens
EDDIH

SEQ ID NO: 2751978 - protein, 6 aa, Entamoeba invadens
EDDKNC

SEQ ID NO: 2751979 - protein, 13 aa, Entamoeba invadens
EDDLPKIENDNPM

SEQ ID NO: 2751980 - protein, 4 aa, Entamoeba invadens
EDDM

SEQ ID NO: 2751981 - protein, 8 aa, Entamoeba invadens
EDDPEQQW

SEQ ID NO: 2751982 - protein, 9 aa, Entamoeba invadens
EDDPTHTKR

SEQ ID NO: 2751983 - protein, 8 aa, Entamoeba invadens
EDDSTKID

SEQ ID NO: 2751984 - protein, 8 aa, Entamoeba invadens
EDECGEKG

SEQ ID NO: 2751985 - protein, 10 aa, Entamoeba invadens
EDEDENDLKT

SEQ ID NO: 2751986 - protein, 6 aa, Entamoeba invadens
EDEDGL

SEQ ID NO: 2751987 - protein, 7 aa, Entamoeba invadens
EDEDTNF

SEQ ID NO: 2751988 - protein, 6 aa, Entamoeba invadens
EDEEGL

SEQ ID NO: 2751989 - protein, 5 aa, Entamoeba invadens
EDEKT

SEQ ID NO: 2751990 - protein, 10 aa, Entamoeba invadens
EDELQDDVQQ

SEQ ID NO: 2751991 - protein, 5 aa, Entamoeba invadens
EDEMK

SEQ ID NO: 2751992 - protein, 6 aa, Entamoeba invadens
EDENFG

SEQ ID NO: 2751993 - protein, 7 aa, Entamoeba invadens
EDENFGN

SEQ ID NO: 2751994 - protein, 9 aa, Entamoeba invadens
EDENTNDEL

SEQ ID NO: 2751995 - protein, 6 aa, Entamoeba invadens
EDEPKD

SEQ ID NO: 2751996 - protein, 47 aa, Entamoeba invadens
EDEPPKSGKNEGELPKDEKPQNLTGEATLTSTTETKQESTQPEKIED

SEQ ID NO: 2751997 - protein, 9 aa, Entamoeba invadens
EDERKEYTT

SEQ ID NO: 2751998 - protein, 4 aa, Entamoeba invadens
EDES

SEQ ID NO: 2751999 - protein, 9 aa, Entamoeba invadens
EDESKELKK

SEQ ID NO: 2752000 - protein, 6 aa, Entamoeba invadens
EDESNV

SEQ ID NO: 2752001 - protein, 11 aa, Entamoeba invadens
EDEVKETDETP

SEQ ID NO: 2752002 - protein, 5 aa, Entamoeba invadens
EDGCT

SEQ ID NO: 2752003 - protein, 4 aa, Entamoeba invadens
EDGE

SEQ ID NO: 2752004 - protein, 5 aa, Entamoeba invadens
EDGEI

SEQ ID NO: 2752005 - protein, 6 aa, Entamoeba invadens
EDGEVS

SEQ ID NO: 2752006 - protein, 11 aa, Entamoeba invadens
EDGFKTKENKC

SEQ ID NO: 2752007 - protein, 8 aa, Entamoeba invadens
EDGGFDDS

SEQ ID NO: 2752008 - protein, 12 aa, Entamoeba invadens
EDGGGSGTAGAH

SEQ ID NO: 2752009 - protein, 4 aa, Entamoeba invadens
EDGK

SEQ ID NO: 2752010 - protein, 8 aa, Entamoeba invadens
EDGKHTEE

SEQ ID NO: 2752011 - protein, 5 aa, Entamoeba invadens
EDGKY

SEQ ID NO: 2752012 - protein, 7 aa, Entamoeba invadens
EDGLTGG

SEQ ID NO: 2752013 - protein, 8 aa, Entamoeba invadens
EDGPRPNL

SEQ ID NO: 2752014 - protein, 8 aa, Entamoeba invadens
EDGSCENK

SEQ ID NO: 2752015 - protein, 13 aa, Entamoeba invadens
EDGSLPNENNSKC

SEQ ID NO: 2752016 - protein, 5 aa, Entamoeba invadens
EDGSS

SEQ ID NO: 2752017 - protein, 15 aa, Entamoeba invadens
EDGSVQNTTGKAKCE

SEQ ID NO: 2752018 - protein, 45 aa, Entamoeba invadens
EDGSYNSLIGQSSCSACSAGTYSNGTSKSSCTKCPAGYYSKEGAY

SEQ ID NO: 2752019 - protein, 10 aa, Entamoeba invadens
EDGTEARGNE

SEQ ID NO: 2752020 - protein, 8 aa, Entamoeba invadens
EDGVGKKN

SEQ ID NO: 2752021 - protein, 9 aa, Entamoeba invadens
EDGYGGDNC

SEQ ID NO: 2752022 - protein, 9 aa, Entamoeba invadens
EDHKPLSET

SEQ ID NO: 2752023 - protein, 13 aa, Entamoeba invadens
EDIDRETKPVETK

SEQ ID NO: 2752024 - protein, 5 aa, Entamoeba invadens
EDIKR

SEQ ID NO: 2752025 - protein, 10 aa, Entamoeba invadens
EDINKKDEKT

SEQ ID NO: 2752026 - protein, 13 aa, Entamoeba invadens
EDIPRTLKQRKKN

SEQ ID NO: 2752027 - protein, 4 aa, Entamoeba invadens
EDIQ

SEQ ID NO: 2752028 - protein, 4 aa, Entamoeba invadens
EDIR

SEQ ID NO: 2752029 - protein, 5 aa, Entamoeba invadens
EDITR

SEQ ID NO: 2752030 - protein, 9 aa, Entamoeba invadens
EDKDGKVGV

SEQ ID NO: 2752031 - protein, 9 aa, Entamoeba invadens
EDKEDENEF

SEQ ID NO: 2752032 - protein, 5 aa, Entamoeba invadens
EDKGV

SEQ ID NO: 2752033 - protein, 9 aa, Entamoeba invadens
EDKKLGEGS

SEQ ID NO: 2752034 - protein, 12 aa, Entamoeba invadens
EDKKVRKKYTER

SEQ ID NO: 2752035 - protein, 16 aa, Entamoeba invadens
EDKKYETVSGFSAGKK

SEQ ID NO: 2752036 - protein, 4 aa, Entamoeba invadens
EDKL

SEQ ID NO: 2752037 - protein, 6 aa, Entamoeba invadens
EDKLPE

SEQ ID NO: 2752038 - protein, 8 aa, Entamoeba invadens
EDKMPNEK

SEQ ID NO: 2752039 - protein, 7 aa, Entamoeba invadens
EDKNRIK

SEQ ID NO: 2752040 - protein, 10 aa, Entamoeba invadens
EDKNSKWKKT

SEQ ID NO: 2752041 - protein, 10 aa, Entamoeba invadens
EDKPFENEPP

SEQ ID NO: 2752042 - protein, 13 aa, Entamoeba invadens
EDKTENCTLPNDK

SEQ ID NO: 2752043 - protein, 19 aa, Entamoeba invadens
EDKTKLQNDKQNCSTQNDN

SEQ ID NO: 2752044 - protein, 7 aa, Entamoeba invadens
EDKTLTI

SEQ ID NO: 2752045 - protein, 25 aa, Entamoeba invadens
EDKTMDDGKCKDNSELNCKEGSKTY

SEQ ID NO: 2752046 - protein, 13 aa, Entamoeba invadens
EDLEEEQKIGEGS

SEQ ID NO: 2752047 - protein, 10 aa, Entamoeba invadens
EDLGKKEGLV

SEQ ID NO: 2752048 - protein, 6 aa, Entamoeba invadens
EDLKGK

SEQ ID NO: 2752049 - protein, 24 aa, Entamoeba invadens
EDLKTYHESDVYKNRKKKDPKIRE

SEQ ID NO: 2752050 - protein, 4 aa, Entamoeba invadens
EDLT

SEQ ID NO: 2752051 - protein, 5 aa, Entamoeba invadens
EDLTK

SEQ ID NO: 2752052 - protein, 8 aa, Entamoeba invadens
EDLYTNEY

SEQ ID NO: 2752053 - protein, 29 aa, Entamoeba invadens
EDMNEQEKEEKESFRKKSKTVDLENSSEL

SEQ ID NO: 2752054 - protein, 8 aa, Entamoeba invadens
EDNAEMAK

SEQ ID NO: 2752055 - protein, 16 aa, Entamoeba invadens
EDNASMDRQTSSMNRV

SEQ ID NO: 2752056 - protein, 8 aa, Entamoeba invadens
EDNEQVNA

SEQ ID NO: 2752057 - protein, 10 aa, Entamoeba invadens
EDNEYNDINN

SEQ ID NO: 2752058 - protein, 5 aa, Entamoeba invadens
EDNGH

SEQ ID NO: 2752059 - protein, 14 aa, Entamoeba invadens
EDNHTAFESGLQEG

SEQ ID NO: 2752060 - protein, 8 aa, Entamoeba invadens
EDNKKEIT

SEQ ID NO: 2752061 - protein, 8 aa, Entamoeba invadens
EDNKNGEY

SEQ ID NO: 2752062 - protein, 10 aa, Entamoeba invadens
EDNLNGDNYD

SEQ ID NO: 2752063 - protein, 6 aa, Entamoeba invadens
EDNPHN

SEQ ID NO: 2752064 - protein, 9 aa, Entamoeba invadens
EDNPTTTST

SEQ ID NO: 2752065 - protein, 5 aa, Entamoeba invadens
EDNQN

SEQ ID NO: 2752066 - protein, 10 aa, Entamoeba invadens
EDNQYTTPPN

SEQ ID NO: 2752067 - protein, 18 aa, Entamoeba invadens
EDNSDNYNASACLLIRTV

SEQ ID NO: 2752068 - protein, 19 aa, Entamoeba invadens
EDNTQHHVQSRDRALSGGN

SEQ ID NO: 2752069 - protein, 6 aa, Entamoeba invadens
EDNVNK

SEQ ID NO: 2752070 - protein, 11 aa, Entamoeba invadens
EDPDKADPIPE

SEQ ID NO: 2752071 - protein, 6 aa, Entamoeba invadens
EDPKAT

SEQ ID NO: 2752072 - protein, 11 aa, Entamoeba invadens
EDPKNERKGKL

SEQ ID NO: 2752073 - protein, 9 aa, Entamoeba invadens
EDPLQSLSQ

SEQ ID NO: 2752074 - protein, 8 aa, Entamoeba invadens
EDPNNRYQ

SEQ ID NO: 2752075 - protein, 6 aa, Entamoeba invadens
EDPNPD

SEQ ID NO: 2752076 - protein, 12 aa, Entamoeba invadens
EDPPIGVDEETR

SEQ ID NO: 2752077 - protein, 12 aa, Entamoeba invadens
EDPPINVDSETR

SEQ ID NO: 2752078 - protein, 14 aa, Entamoeba invadens
EDPPVVEKGKAKNG

SEQ ID NO: 2752079 - protein, 6 aa, Entamoeba invadens
EDPSLT

SEQ ID NO: 2752080 - protein, 5 aa, Entamoeba invadens
EDPSV

SEQ ID NO: 2752081 - protein, 4 aa, Entamoeba invadens
EDPT

SEQ ID NO: 2752082 - protein, 6 aa, Entamoeba invadens
EDPTPQ

SEQ ID NO: 2752083 - protein, 8 aa, Entamoeba invadens
EDPTTPLT

SEQ ID NO: 2752084 - protein, 8 aa, Entamoeba invadens
EDQDYDTE

SEQ ID NO: 2752085 - protein, 9 aa, Entamoeba invadens
EDQEESELF

SEQ ID NO: 2752086 - protein, 6 aa, Entamoeba invadens
EDQEIT

SEQ ID NO: 2752087 - protein, 7 aa, Entamoeba invadens
EDQGKEG

SEQ ID NO: 2752088 - protein, 9 aa, Entamoeba invadens
EDQKSCTYK

SEQ ID NO: 2752089 - protein, 4 aa, Entamoeba invadens
EDQQ

SEQ ID NO: 2752090 - protein, 7 aa, Entamoeba invadens
EDQQPEA

SEQ ID NO: 2752091 - protein, 5 aa, Entamoeba invadens
EDQRP

SEQ ID NO: 2752092 - protein, 7 aa, Entamoeba invadens
EDQTHKS

SEQ ID NO: 2752093 - protein, 5 aa, Entamoeba invadens
EDQTN

SEQ ID NO: 2752094 - protein, 6 aa, Entamoeba invadens
EDRCSK

SEQ ID NO: 2752095 - protein, 6 aa, Entamoeba invadens
EDRPGF

SEQ ID NO: 2752096 - protein, 24 aa, Entamoeba invadens
EDRPQGCQSQCDDGDYETTENGIA

SEQ ID NO: 2752097 - protein, 9 aa, Entamoeba invadens
EDRQNYPDC

SEQ ID NO: 2752098 - protein, 7 aa, Entamoeba invadens
EDRRGNF

SEQ ID NO: 2752099 - protein, 4 aa, Entamoeba invadens
EDRY

SEQ ID NO: 2752100 - protein, 32 aa, Entamoeba invadens
EDSDDDKSEDSEQMGTKNRLNEKSVSSEEGSC

SEQ ID NO: 2752101 - protein, 31 aa, Entamoeba invadens
EDSDKFKSDPCCNREAEGKCNTFRDRKSTYM

SEQ ID NO: 2752102 - protein, 18 aa, Entamoeba invadens
EDSEDKNTGYAKAASQKF

SEQ ID NO: 2752103 - protein, 14 aa, Entamoeba invadens
EDSEDSNNEDGVSS

SEQ ID NO: 2752104 - protein, 43 aa, Entamoeba invadens
EDSEPEDDLEDEEEEVESGVEKKEGEEKKKETVSGKNKPQSVY

SEQ ID NO: 2752105 - protein, 31 aa, Entamoeba invadens
EDSFEERSGDSPKDRSRSFDNSKHELSENEK

SEQ ID NO: 2752106 - protein, 7 aa, Entamoeba invadens
EDSGTID

SEQ ID NO: 2752107 - protein, 5 aa, Entamoeba invadens
EDSKK

SEQ ID NO: 2752108 - protein, 8 aa, Entamoeba invadens
EDSKRNRF

SEQ ID NO: 2752109 - protein, 10 aa, Entamoeba invadens
EDSKVGEGSF

SEQ ID NO: 2752110 - protein, 5 aa, Entamoeba invadens
EDSLK

SEQ ID NO: 2752111 - protein, 7 aa, Entamoeba invadens
EDSNNQK

SEQ ID NO: 2752112 - protein, 8 aa, Entamoeba invadens
EDSPHEAI

SEQ ID NO: 2752113 - protein, 12 aa, Entamoeba invadens
EDSPINVDQETR

SEQ ID NO: 2752114 - protein, 8 aa, Entamoeba invadens
EDSRAQVS

SEQ ID NO: 2752115 - protein, 6 aa, Entamoeba invadens
EDSSFP

SEQ ID NO: 2752116 - protein, 12 aa, Entamoeba invadens
EDSSKCETTTEG

SEQ ID NO: 2752117 - protein, 10 aa, Entamoeba invadens
EDSTCKSNEF

SEQ ID NO: 2752118 - protein, 10 aa, Entamoeba invadens
EDSVAGKCVT

SEQ ID NO: 2752119 - protein, 8 aa, Entamoeba invadens
EDSVESRD

SEQ ID NO: 2752120 - protein, 10 aa, Entamoeba invadens
EDSVSVAGKI

SEQ ID NO: 2752121 - protein, 9 aa, Entamoeba invadens
EDSVTDEKL

SEQ ID NO: 2752122 - protein, 6 aa, Entamoeba invadens
EDSVYT

SEQ ID NO: 2752123 - protein, 4 aa, Entamoeba invadens
EDSY

SEQ ID NO: 2752124 - protein, 10 aa, Entamoeba invadens
EDTDNFNSDP

SEQ ID NO: 2752125 - protein, 11 aa, Entamoeba invadens
EDTDNFNSDPC

SEQ ID NO: 2752126 - protein, 18 aa, Entamoeba invadens
EDTDRSDKTENSEKVETH

SEQ ID NO: 2752127 - protein, 4 aa, Entamoeba invadens
EDTG

SEQ ID NO: 2752128 - protein, 9 aa, Entamoeba invadens
EDTGDTEIT

SEQ ID NO: 2752129 - protein, 6 aa, Entamoeba invadens
EDTGRV

SEQ ID NO: 2752130 - protein, 5 aa, Entamoeba invadens
EDTKD

SEQ ID NO: 2752131 - protein, 5 aa, Entamoeba invadens
EDTKT

SEQ ID NO: 2752132 - protein, 5 aa, Entamoeba invadens
EDTLP

SEQ ID NO: 2752133 - protein, 10 aa, Entamoeba invadens
EDTNLNYSQK

SEQ ID NO: 2752134 - protein, 6 aa, Entamoeba invadens
EDTNNY

SEQ ID NO: 2752135 - protein, 10 aa, Entamoeba invadens
EDTPMPGSSL

SEQ ID NO: 2752136 - protein, 8 aa, Entamoeba invadens
EDTQTSKG

SEQ ID NO: 2752137 - protein, 7 aa, Entamoeba invadens
EDTSDID

SEQ ID NO: 2752138 - protein, 9 aa, Entamoeba invadens
EDTSNDQKS

SEQ ID NO: 2752139 - protein, 20 aa, Entamoeba invadens
EDTSRGKLSDKSPQLPPNIS

SEQ ID NO: 2752140 - protein, 10 aa, Entamoeba invadens
EDTTDTNNVK

SEQ ID NO: 2752141 - protein, 7 aa, Entamoeba invadens
EDTTELP

SEQ ID NO: 2752142 - protein, 6 aa, Entamoeba invadens
EDTTRQ

SEQ ID NO: 2752143 - protein, 8 aa, Entamoeba invadens
EDTTSQEI

SEQ ID NO: 2752144 - protein, 5 aa, Entamoeba invadens
EDTYV

SEQ ID NO: 2752145 - protein, 10 aa, Entamoeba invadens
EDVDVDKKTR

SEQ ID NO: 2752146 - protein, 58 aa, Entamoeba invadens
EDVEPLNSSPTSEDNDENQKEEQNQAENDISMSPSPIPGYVGNEKSPEKVGEDVSLLK

SEQ ID NO: 2752147 - protein, 4 aa, Entamoeba invadens
EDVK

SEQ ID NO: 2752148 - protein, 7 aa, Entamoeba invadens
EDVKEGF

SEQ ID NO: 2752149 - protein, 6 aa, Entamoeba invadens
EDVKKA

SEQ ID NO: 2752150 - protein, 15 aa, Entamoeba invadens
EDVNNNLEEGNQNDR

SEQ ID NO: 2752151 - protein, 5 aa, Entamoeba invadens
EDVNT

SEQ ID NO: 2752152 - protein, 6 aa, Entamoeba invadens
EDVPYD

SEQ ID NO: 2752153 - protein, 4 aa, Entamoeba invadens
EDVQ

SEQ ID NO: 2752154 - protein, 5 aa, Entamoeba invadens
EDVVD

SEQ ID NO: 2752155 - protein, 10 aa, Entamoeba invadens
EDVVKKTKTN

SEQ ID NO: 2752156 - protein, 8 aa, Entamoeba invadens
EDVYTEKS

SEQ ID NO: 2752157 - protein, 7 aa, Entamoeba invadens
EDYNSAA

SEQ ID NO: 2752158 - protein, 5 aa, Entamoeba invadens
EDYSN

SEQ ID NO: 2752159 - protein, 6 aa, Entamoeba invadens
EDYTPT

SEQ ID NO: 2752160 - protein, 8 aa, Entamoeba invadens
EEADESGS

SEQ ID NO: 2752161 - protein, 6 aa, Entamoeba invadens
EEADKE

SEQ ID NO: 2752162 - protein, 15 aa, Entamoeba invadens
EEALKSAKENNKNIE

SEQ ID NO: 2752163 - protein, 6 aa, Entamoeba invadens
EEALNK

SEQ ID NO: 2752164 - protein, 14 aa, Entamoeba invadens
EEANAKLTDFGSSR

SEQ ID NO: 2752165 - protein, 8 aa, Entamoeba invadens
EEAPRKQV

SEQ ID NO: 2752166 - protein, 10 aa, Entamoeba invadens
EEAPVEKKED

SEQ ID NO: 2752167 - protein, 17 aa, Entamoeba invadens
EEAQKTSVPDEEEGTEM

SEQ ID NO: 2752168 - protein, 5 aa, Entamoeba invadens
EEASS

SEQ ID NO: 2752169 - protein, 6 aa, Entamoeba invadens
EEASYT

SEQ ID NO: 2752170 - protein, 25 aa, Entamoeba invadens
EECASGSIGINDECSAKSEGCTPTC

SEQ ID NO: 2752171 - protein, 7 aa, Entamoeba invadens
EECDGGH

SEQ ID NO: 2752172 - protein, 7 aa, Entamoeba invadens
EECDGGM

SEQ ID NO: 2752173 - protein, 9 aa, Entamoeba invadens
EECDGGPNC

SEQ ID NO: 2752174 - protein, 8 aa, Entamoeba invadens
EECDGGRG

SEQ ID NO: 2752175 - protein, 9 aa, Entamoeba invadens
EECDGGVNC

SEQ ID NO: 2752176 - protein, 10 aa, Entamoeba invadens
EECDGTEGCT

SEQ ID NO: 2752177 - protein, 11 aa, Entamoeba invadens
EECDGTPGCGD

SEQ ID NO: 2752178 - protein, 12 aa, Entamoeba invadens
EECDNGTNCQKD

SEQ ID NO: 2752179 - protein, 6 aa, Entamoeba invadens
EECDSG

SEQ ID NO: 2752180 - protein, 16 aa, Entamoeba invadens
EECPSGSYSDNEGASL

SEQ ID NO: 2752181 - protein, 6 aa, Entamoeba invadens
EECSKE

SEQ ID NO: 2752182 - protein, 13 aa, Entamoeba invadens
EECSQCDKTPNNC

SEQ ID NO: 2752183 - protein, 5 aa, Entamoeba invadens
EECTE

SEQ ID NO: 2752184 - protein, 18 aa, Entamoeba invadens
EECTNHQLTSSTEEDEEV

SEQ ID NO: 2752185 - protein, 5 aa, Entamoeba invadens
EECTT

SEQ ID NO: 2752186 - protein, 6 aa, Entamoeba invadens
EEDAVN

SEQ ID NO: 2752187 - protein, 5 aa, Entamoeba invadens
EEDCE

SEQ ID NO: 2752188 - protein, 4 aa, Entamoeba invadens
EEDD

SEQ ID NO: 2752189 - protein, 10 aa, Entamoeba invadens
EEDDKREQRY

SEQ ID NO: 2752190 - protein, 7 aa, Entamoeba invadens
EEDDVPD

SEQ ID NO: 2752191 - protein, 13 aa, Entamoeba invadens
EEDDYIPVDEESR

SEQ ID NO: 2752192 - protein, 8 aa, Entamoeba invadens
EEDEDADQ

SEQ ID NO: 2752193 - protein, 8 aa, Entamoeba invadens
EEDFKSPQ

SEQ ID NO: 2752194 - protein, 11 aa, Entamoeba invadens
EEDFPTEIRKN

SEQ ID NO: 2752195 - protein, 10 aa, Entamoeba invadens
EEDGKKLEET

SEQ ID NO: 2752196 - protein, 4 aa, Entamoeba invadens
EEDK

SEQ ID NO: 2752197 - protein, 11 aa, Entamoeba invadens
EEDKNKISLSS

SEQ ID NO: 2752198 - protein, 5 aa, Entamoeba invadens
EEDNQ

SEQ ID NO: 2752199 - protein, 5 aa, Entamoeba invadens
EEDNV

SEQ ID NO: 2752200 - protein, 9 aa, Entamoeba invadens
EEDQGPKTN

SEQ ID NO: 2752201 - protein, 7 aa, Entamoeba invadens
EEDRDDC

SEQ ID NO: 2752202 - protein, 5 aa, Entamoeba invadens
EEDSN

SEQ ID NO: 2752203 - protein, 18 aa, Entamoeba invadens
EEDTCKQTCSDGYYKDTT

SEQ ID NO: 2752204 - protein, 4 aa, Entamoeba invadens
EEDV

SEQ ID NO: 2752205 - protein, 19 aa, Entamoeba invadens
EEDVDKEKNATITDEEKTL

SEQ ID NO: 2752206 - protein, 9 aa, Entamoeba invadens
EEDVKETAK

SEQ ID NO: 2752207 - protein, 7 aa, Entamoeba invadens
EEEAAQI

SEQ ID NO: 2752208 - protein, 10 aa, Entamoeba invadens
EEECDNGTNC

SEQ ID NO: 2752209 - protein, 25 aa, Entamoeba invadens
EEEDDGEEEEDKDEQKPKQKDKGFD

SEQ ID NO: 2752210 - protein, 6 aa, Entamoeba invadens
EEEDER

SEQ ID NO: 2752211 - protein, 7 aa, Entamoeba invadens
EEEDTED

SEQ ID NO: 2752212 - protein, 14 aa, Entamoeba invadens
EEEDYGYSTSTEIT

SEQ ID NO: 2752213 - protein, 21 aa, Entamoeba invadens
EEEEKYSNSPNSQNASKIDED

SEQ ID NO: 2752214 - protein, 5 aa, Entamoeba invadens
EEEEM

SEQ ID NO: 2752215 - protein, 5 aa, Entamoeba invadens
EEEEV

SEQ ID NO: 2752216 - protein, 6 aa, Entamoeba invadens
EEEEVG

SEQ ID NO: 2752217 - protein, 9 aa, Entamoeba invadens
EEEFGENSD

SEQ ID NO: 2752218 - protein, 4 aa, Entamoeba invadens
EEEG

SEQ ID NO: 2752219 - protein, 16 aa, Entamoeba invadens
EEEGKYKATYSSKTVS

SEQ ID NO: 2752220 - protein, 4 aa, Entamoeba invadens
EEEI

SEQ ID NO: 2752221 - protein, 5 aa, Entamoeba invadens
EEEKT

SEQ ID NO: 2752222 - protein, 18 aa, Entamoeba invadens
EEEKVRVEENGKSILSKS

SEQ ID NO: 2752223 - protein, 4 aa, Entamoeba invadens
EEEL

SEQ ID NO: 2752224 - protein, 5 aa, Entamoeba invadens
EEELE

SEQ ID NO: 2752225 - protein, 6 aa, Entamoeba invadens
EEELPS

SEQ ID NO: 2752226 - protein, 5 aa, Entamoeba invadens
EEELS

SEQ ID NO: 2752227 - protein, 6 aa, Entamoeba invadens
EEEMND

SEQ ID NO: 2752228 - protein, 6 aa, Entamoeba invadens
EEEMNE

SEQ ID NO: 2752229 - protein, 27 aa, Entamoeba invadens
EEENDDDDVSSESKSVEPKDDGLSGGE

SEQ ID NO: 2752230 - protein, 10 aa, Entamoeba invadens
EEENETTNWR

SEQ ID NO: 2752231 - protein, 15 aa, Entamoeba invadens
EEENQDEKSPFEEEV

SEQ ID NO: 2752232 - protein, 10 aa, Entamoeba invadens
EEENQHTGEN

SEQ ID NO: 2752233 - protein, 5 aa, Entamoeba invadens
EEERI

SEQ ID NO: 2752234 - protein, 32 aa, Entamoeba invadens
EEERTKVKNWEKKGEEFENYKKKQREYEEQNR

SEQ ID NO: 2752235 - protein, 8 aa, Entamoeba invadens
EEESSKKR

SEQ ID NO: 2752236 - protein, 12 aa, Entamoeba invadens
EEESTSTVKCPE

SEQ ID NO: 2752237 - protein, 50 aa, Entamoeba invadens
EEESYLPPKAQNDGLSNTTTTATSATNAPIDTGKKDDVNQQNLPFEINEE

SEQ ID NO: 2752238 - protein, 9 aa, Entamoeba invadens
EEETKAEES

SEQ ID NO: 2752239 - protein, 6 aa, Entamoeba invadens
EEETQS

SEQ ID NO: 2752240 - protein, 6 aa, Entamoeba invadens
EEEVAE

SEQ ID NO: 2752241 - protein, 5 aa, Entamoeba invadens
EEEVD

SEQ ID NO: 2752242 - protein, 15 aa, Entamoeba invadens
EEEVDFNGNTVSIDS

SEQ ID NO: 2752243 - protein, 11 aa, Entamoeba invadens
EEEVGKGIEEA

SEQ ID NO: 2752244 - protein, 9 aa, Entamoeba invadens
EEEVRENTI

SEQ ID NO: 2752245 - protein, 13 aa, Entamoeba invadens
EEEYYDGNNCTLN

SEQ ID NO: 2752246 - protein, 8 aa, Entamoeba invadens
EEFKSGEE

SEQ ID NO: 2752247 - protein, 8 aa, Entamoeba invadens
EEFSPDGT

SEQ ID NO: 2752248 - protein, 8 aa, Entamoeba invadens
EEGAENVA

SEQ ID NO: 2752249 - protein, 8 aa, Entamoeba invadens
EEGANGEL

SEQ ID NO: 2752250 - protein, 4 aa, Entamoeba invadens
EEGD

SEQ ID NO: 2752251 - protein, 8 aa, Entamoeba invadens
EEGPDLPA

SEQ ID NO: 2752252 - protein, 4 aa, Entamoeba invadens
EEGQ

SEQ ID NO: 2752253 - protein, 7 aa, Entamoeba invadens
EEGRRQV

SEQ ID NO: 2752254 - protein, 8 aa, Entamoeba invadens
EEGSETDD

SEQ ID NO: 2752255 - protein, 7 aa, Entamoeba invadens
EEGTGRV

SEQ ID NO: 2752256 - protein, 14 aa, Entamoeba invadens
EEGVNHKKSPTPSI

SEQ ID NO: 2752257 - protein, 5 aa, Entamoeba invadens
EEGVV

SEQ ID NO: 2752258 - protein, 8 aa, Entamoeba invadens
EEGYDMRS

SEQ ID NO: 2752259 - protein, 7 aa, Entamoeba invadens
EEGYGGD

SEQ ID NO: 2752260 - protein, 4 aa, Entamoeba invadens
EEHE

SEQ ID NO: 2752261 - protein, 10 aa, Entamoeba invadens
EEHEKGSNIT

SEQ ID NO: 2752262 - protein, 8 aa, Entamoeba invadens
EEHGSMTK

SEQ ID NO: 2752263 - protein, 8 aa, Entamoeba invadens
EEHKETAE

SEQ ID NO: 2752264 - protein, 13 aa, Entamoeba invadens
EEHKKAKKVSHEV

SEQ ID NO: 2752265 - protein, 11 aa, Entamoeba invadens
EEHNTNDKYKR

SEQ ID NO: 2752266 - protein, 33 aa, Entamoeba invadens
EEHSDLSSSEEKTNPLLSDEELDEELDDDLEDK

SEQ ID NO: 2752267 - protein, 4 aa, Entamoeba invadens
EEHY

SEQ ID NO: 2752268 - protein, 28 aa, Entamoeba invadens
EEIAVDEKKQDEEIKNEDNKPIATPHNQ

SEQ ID NO: 2752269 - protein, 11 aa, Entamoeba invadens
EEIGNEEKTAM

SEQ ID NO: 2752270 - protein, 5 aa, Entamoeba invadens
EEIHS

SEQ ID NO: 2752271 - protein, 11 aa, Entamoeba invadens
EEIKEKDVYED

SEQ ID NO: 2752272 - protein, 12 aa, Entamoeba invadens
EEINKKQSYYTS

SEQ ID NO: 2752273 - protein, 6 aa, Entamoeba invadens
EEIPTL

SEQ ID NO: 2752274 - protein, 10 aa, Entamoeba invadens
EEIPVDSGSR

SEQ ID NO: 2752275 - protein, 19 aa, Entamoeba invadens
EEISSDGSDDATNPKNEVF

SEQ ID NO: 2752276 - protein, 4 aa, Entamoeba invadens
EEIT

SEQ ID NO: 2752277 - protein, 7 aa, Entamoeba invadens
EEITEDG

SEQ ID NO: 2752278 - protein, 5 aa, Entamoeba invadens
EEITP

SEQ ID NO: 2752279 - protein, 13 aa, Entamoeba invadens
EEIVSDSKTSGTV

SEQ ID NO: 2752280 - protein, 11 aa, Entamoeba invadens
EEKAETEGACD

SEQ ID NO: 2752281 - protein, 7 aa, Entamoeba invadens
EEKDENL

SEQ ID NO: 2752282 - protein, 16 aa, Entamoeba invadens
EEKDESNCIEKSSKGC

SEQ ID NO: 2752283 - protein, 10 aa, Entamoeba invadens
EEKDESSPQF

SEQ ID NO: 2752284 - protein, 13 aa, Entamoeba invadens
EEKDNECEDGTVA

SEQ ID NO: 2752285 - protein, 23 aa, Entamoeba invadens
EEKDVKPSENQVPPIQPKTPRYS

SEQ ID NO: 2752286 - protein, 12 aa, Entamoeba invadens
EEKEAKAKKKVL

SEQ ID NO: 2752287 - protein, 9 aa, Entamoeba invadens
EEKEERNKL

SEQ ID NO: 2752288 - protein, 15 aa, Entamoeba invadens
EEKEKNEKGGEEQLT

SEQ ID NO: 2752289 - protein, 7 aa, Entamoeba invadens
EEKENLK

SEQ ID NO: 2752290 - protein, 7 aa, Entamoeba invadens
EEKEVTK

SEQ ID NO: 2752291 - protein, 31 aa, Entamoeba invadens
EEKGDKVKGYTSNKCGDWEEQGSSSSGDIEI

SEQ ID NO: 2752292 - protein, 13 aa, Entamoeba invadens
EEKGSEVDTTTFS

SEQ ID NO: 2752293 - protein, 20 aa, Entamoeba invadens
EEKIDQCDGTKTSGTYDLLA

SEQ ID NO: 2752294 - protein, 7 aa, Entamoeba invadens
EEKIGEI

SEQ ID NO: 2752295 - protein, 19 aa, Entamoeba invadens
EEKKESGEEEEEDNEEGNS

SEQ ID NO: 2752296 - protein, 9 aa, Entamoeba invadens
EEKKIGEGS

SEQ ID NO: 2752297 - protein, 7 aa, Entamoeba invadens
EEKKKIS

SEQ ID NO: 2752298 - protein, 8 aa, Entamoeba invadens
EEKKRHAE

SEQ ID NO: 2752299 - protein, 19 aa, Entamoeba invadens
EEKLEEKIEEEQHQEEDEW

SEQ ID NO: 2752300 - protein, 6 aa, Entamoeba invadens
EEKLKK

SEQ ID NO: 2752301 - protein, 8 aa, Entamoeba invadens
EEKLNEKV

SEQ ID NO: 2752302 - protein, 12 aa, Entamoeba invadens
EEKNGVSNGIST

SEQ ID NO: 2752303 - protein, 9 aa, Entamoeba invadens
EEKNGVSTG

SEQ ID NO: 2752304 - protein, 9 aa, Entamoeba invadens
EEKNKTKQY

SEQ ID NO: 2752305 - protein, 9 aa, Entamoeba invadens
EEKNSKCEK

SEQ ID NO: 2752306 - protein, 9 aa, Entamoeba invadens
EEKNVTEIS

SEQ ID NO: 2752307 - protein, 10 aa, Entamoeba invadens
EEKNVTKTEI

SEQ ID NO: 2752308 - protein, 17 aa, Entamoeba invadens
EEKPEEVCEEDSDEIVD

SEQ ID NO: 2752309 - protein, 4 aa, Entamoeba invadens
EEKQ

SEQ ID NO: 2752310 - protein, 10 aa, Entamoeba invadens
EEKQKLGEGS

SEQ ID NO: 2752311 - protein, 8 aa, Entamoeba invadens
EEKRKLER

SEQ ID NO: 2752312 - protein, 5 aa, Entamoeba invadens
EEKRV

SEQ ID NO: 2752313 - protein, 32 aa, Entamoeba invadens
EEKSEEKKVEQQEVKEVKEVKEEKVEEKPTEE

SEQ ID NO: 2752314 - protein, 8 aa, Entamoeba invadens
EEKSEENC

SEQ ID NO: 2752315 - protein, 9 aa, Entamoeba invadens
EEKSGDDAL

SEQ ID NO: 2752316 - protein, 5 aa, Entamoeba invadens
EEKSL

SEQ ID NO: 2752317 - protein, 24 aa, Entamoeba invadens
EEKTEQTAQDPSRDIKEEANRERI

SEQ ID NO: 2752318 - protein, 5 aa, Entamoeba invadens
EEKTY

SEQ ID NO: 2752319 - protein, 10 aa, Entamoeba invadens
EEKVKKVEEC

SEQ ID NO: 2752320 - protein, 4 aa, Entamoeba invadens
EEKY

SEQ ID NO: 2752321 - protein, 10 aa, Entamoeba invadens
EEKYKPSDDG

SEQ ID NO: 2752322 - protein, 18 aa, Entamoeba invadens
EEKYKPSDDGLSCKKEPN

SEQ ID NO: 2752323 - protein, 4 aa, Entamoeba invadens
EELG

SEQ ID NO: 2752324 - protein, 8 aa, Entamoeba invadens
EELKRSDF

SEQ ID NO: 2752325 - protein, 10 aa, Entamoeba invadens
EELPVRKSRK

SEQ ID NO: 2752326 - protein, 8 aa, Entamoeba invadens
EELTGQKI

SEQ ID NO: 2752327 - protein, 12 aa, Entamoeba invadens
EELTKATDEAME

SEQ ID NO: 2752328 - protein, 18 aa, Entamoeba invadens
EELYKQPTADAQPDVSGQ

SEQ ID NO: 2752329 - protein, 8 aa, Entamoeba invadens
EEMDKENL

SEQ ID NO: 2752330 - protein, 13 aa, Entamoeba invadens
EEMKKSDKCNSTA

SEQ ID NO: 2752331 - protein, 13 aa, Entamoeba invadens
EEMPTTETTVSES

SEQ ID NO: 2752332 - protein, 18 aa, Entamoeba invadens
EEMSPQAKKQQKKEEEDR

SEQ ID NO: 2752333 - protein, 15 aa, Entamoeba invadens
EENAAVKQEKETEIE

SEQ ID NO: 2752334 - protein, 4 aa, Entamoeba invadens
EENC

SEQ ID NO: 2752335 - protein, 4 aa, Entamoeba invadens
EEND

SEQ ID NO: 2752336 - protein, 8 aa, Entamoeba invadens
EENDASNC

SEQ ID NO: 2752337 - protein, 16 aa, Entamoeba invadens
EENDASNCIEKSSKGC

SEQ ID NO: 2752338 - protein, 7 aa, Entamoeba invadens
EENEMGT

SEQ ID NO: 2752339 - protein, 9 aa, Entamoeba invadens
EENENEVPC

SEQ ID NO: 2752340 - protein, 12 aa, Entamoeba invadens
EENGDKVKGYVS

SEQ ID NO: 2752341 - protein, 5 aa, Entamoeba invadens
EENGQ

SEQ ID NO: 2752342 - protein, 4 aa, Entamoeba invadens
EENI

SEQ ID NO: 2752343 - protein, 4 aa, Entamoeba invadens
EENK

SEQ ID NO: 2752344 - protein, 14 aa, Entamoeba invadens
EENKDEDHKEQCEQ

SEQ ID NO: 2752345 - protein, 14 aa, Entamoeba invadens
EENKEQEFDDYENT

SEQ ID NO: 2752346 - protein, 12 aa, Entamoeba invadens
EENKGNVENPTT

SEQ ID NO: 2752347 - protein, 8 aa, Entamoeba invadens
EENKSSKK

SEQ ID NO: 2752348 - protein, 5 aa, Entamoeba invadens
EENNK

SEQ ID NO: 2752349 - protein, 13 aa, Entamoeba invadens
EENNKNKRNKTAS

SEQ ID NO: 2752350 - protein, 13 aa, Entamoeba invadens
EENNQSYKQSSII

SEQ ID NO: 2752351 - protein, 8 aa, Entamoeba invadens
EENNTETL

SEQ ID NO: 2752352 - protein, 8 aa, Entamoeba invadens
EENNYKTE

SEQ ID NO: 2752353 - protein, 11 aa, Entamoeba invadens
EENNYKTETKC

SEQ ID NO: 2752354 - protein, 7 aa, Entamoeba invadens
EENPKTY

SEQ ID NO: 2752355 - protein, 8 aa, Entamoeba invadens
EENSDQID

SEQ ID NO: 2752356 - protein, 7 aa, Entamoeba invadens
EENSPYC

SEQ ID NO: 2752357 - protein, 6 aa, Entamoeba invadens
EENSQS

SEQ ID NO: 2752358 - protein, 7 aa, Entamoeba invadens
EENSTGQ

SEQ ID NO: 2752359 - protein, 10 aa, Entamoeba invadens
EENTGGIKEK

SEQ ID NO: 2752360 - protein, 5 aa, Entamoeba invadens
EENTS

SEQ ID NO: 2752361 - protein, 7 aa, Entamoeba invadens
EENTTTF

SEQ ID NO: 2752362 - protein, 7 aa, Entamoeba invadens
EENWENE

SEQ ID NO: 2752363 - protein, 6 aa, Entamoeba invadens
EEPKDR

SEQ ID NO: 2752364 - protein, 6 aa, Entamoeba invadens
EEPQPI

SEQ ID NO: 2752365 - protein, 8 aa, Entamoeba invadens
EEPTPALE

SEQ ID NO: 2752366 - protein, 6 aa, Entamoeba invadens
EEPTSS

SEQ ID NO: 2752367 - protein, 4 aa, Entamoeba invadens
EEPY

SEQ ID NO: 2752368 - protein, 6 aa, Entamoeba invadens
EEPYKD

SEQ ID NO: 2752369 - protein, 6 aa, Entamoeba invadens
EEPYNN

SEQ ID NO: 2752370 - protein, 8 aa, Entamoeba invadens
EEQEKETK

SEQ ID NO: 2752371 - protein, 6 aa, Entamoeba invadens
EEQIPK

SEQ ID NO: 2752372 - protein, 27 aa, Entamoeba invadens
EEQKLQKSGNDEIEKLKNEKDDLSKQV

SEQ ID NO: 2752373 - protein, 6 aa, Entamoeba invadens
EEQLAQ

SEQ ID NO: 2752374 - protein, 8 aa, Entamoeba invadens
EEQPITKD

SEQ ID NO: 2752375 - protein, 4 aa, Entamoeba invadens
EEQQ

SEQ ID NO: 2752376 - protein, 7 aa, Entamoeba invadens
EEQREKT

SEQ ID NO: 2752377 - protein, 7 aa, Entamoeba invadens
EEQRKKT

SEQ ID NO: 2752378 - protein, 4 aa, Entamoeba invadens
EEQS

SEQ ID NO: 2752379 - protein, 4 aa, Entamoeba invadens
EEQT

SEQ ID NO: 2752380 - protein, 6 aa, Entamoeba invadens
EEQTDE

SEQ ID NO: 2752381 - protein, 9 aa, Entamoeba invadens
EEQTTSKYD

SEQ ID NO: 2752382 - protein, 4 aa, Entamoeba invadens
EERD

SEQ ID NO: 2752383 - protein, 10 aa, Entamoeba invadens
EERHKNNDSF

SEQ ID NO: 2752384 - protein, 8 aa, Entamoeba invadens
EERPSFDD

SEQ ID NO: 2752385 - protein, 6 aa, Entamoeba invadens
EERSEL

SEQ ID NO: 2752386 - protein, 7 aa, Entamoeba invadens
EERTNKP

SEQ ID NO: 2752387 - protein, 5 aa, Entamoeba invadens
EERVG

SEQ ID NO: 2752388 - protein, 12 aa, Entamoeba invadens
EERVGTTCKTPC

SEQ ID NO: 2752389 - protein, 5 aa, Entamoeba invadens
EESCG

SEQ ID NO: 2752390 - protein, 6 aa, Entamoeba invadens
EESDLT

SEQ ID NO: 2752391 - protein, 42 aa, Entamoeba invadens
EESEKERNEKDRKREEEIATYKKEESELRKQVEEAKSVNQSL

SEQ ID NO: 2752392 - protein, 5 aa, Entamoeba invadens
EESFT

SEQ ID NO: 2752393 - protein, 4 aa, Entamoeba invadens
EESG

SEQ ID NO: 2752394 - protein, 40 aa, Entamoeba invadens
EESGSEIQNPEPTSNSSQNNSSNVEESSLEDANKKSEVGI

SEQ ID NO: 2752395 - protein, 7 aa, Entamoeba invadens
EESGTID

SEQ ID NO: 2752396 - protein, 19 aa, Entamoeba invadens
EESKSCTKCTEGCKTCTSA

SEQ ID NO: 2752397 - protein, 19 aa, Entamoeba invadens
EESLQRELESEKKEHQKAI

SEQ ID NO: 2752398 - protein, 47 aa, Entamoeba invadens
EESNKKSEEKSTSKSSEKSKEHSQSKSREPETPSVESPSEDDICKGK

SEQ ID NO: 2752399 - protein, 8 aa, Entamoeba invadens
EESNTFKG

SEQ ID NO: 2752400 - protein, 8 aa, Entamoeba invadens
EESQNKEC

SEQ ID NO: 2752401 - protein, 20 aa, Entamoeba invadens
EESSSNTNHVAKDPKEDEKQ

SEQ ID NO: 2752402 - protein, 9 aa, Entamoeba invadens
EESTNSHRI

SEQ ID NO: 2752403 - protein, 6 aa, Entamoeba invadens
EESVDK

SEQ ID NO: 2752404 - protein, 4 aa, Entamoeba invadens
EESY

SEQ ID NO: 2752405 - protein, 9 aa, Entamoeba invadens
EESYELNEG

SEQ ID NO: 2752406 - protein, 8 aa, Entamoeba invadens
EESYGGDD

SEQ ID NO: 2752407 - protein, 17 aa, Entamoeba invadens
EETADEKTAVYAQRANY

SEQ ID NO: 2752408 - protein, 8 aa, Entamoeba invadens
EETAQGTT

SEQ ID NO: 2752409 - protein, 13 aa, Entamoeba invadens
EETAQVNASIAES

SEQ ID NO: 2752410 - protein, 9 aa, Entamoeba invadens
EETAQWNDE

SEQ ID NO: 2752411 - protein, 9 aa, Entamoeba invadens
EETDENSLE

SEQ ID NO: 2752412 - protein, 16 aa, Entamoeba invadens
EETEEKIKRVNKARLS

SEQ ID NO: 2752413 - protein, 10 aa, Entamoeba invadens
EETEEQSNTK

SEQ ID NO: 2752414 - protein, 29 aa, Entamoeba invadens
EETEKLKTEANDKAGEETRKRKEAEKQNE

SEQ ID NO: 2752415 - protein, 4 aa, Entamoeba invadens
EETG

SEQ ID NO: 2752416 - protein, 15 aa, Entamoeba invadens
EETGCPNLDTDTCNK

SEQ ID NO: 2752417 - protein, 6 aa, Entamoeba invadens
EETGSF

SEQ ID NO: 2752418 - protein, 4 aa, Entamoeba invadens
EETH

SEQ ID NO: 2752419 - protein, 15 aa, Entamoeba invadens
EETIHPKPYSDPDYR

SEQ ID NO: 2752420 - protein, 4 aa, Entamoeba invadens
EETK

SEQ ID NO: 2752421 - protein, 11 aa, Entamoeba invadens
EETKESTEISD

SEQ ID NO: 2752422 - protein, 33 aa, Entamoeba invadens
EETLKEKKEMQQSPNNSENASNVIETEDVKNKP

SEQ ID NO: 2752423 - protein, 15 aa, Entamoeba invadens
EETLKSAKENNKNIE

SEQ ID NO: 2752424 - protein, 17 aa, Entamoeba invadens
EETLKTSKCPLTGDPHD

SEQ ID NO: 2752425 - protein, 5 aa, Entamoeba invadens
EETLL

SEQ ID NO: 2752426 - protein, 5 aa, Entamoeba invadens
EETPK

SEQ ID NO: 2752427 - protein, 24 aa, Entamoeba invadens
EETPRTQLNVEKKTKVDIKENNKS

SEQ ID NO: 2752428 - protein, 7 aa, Entamoeba invadens
EETPTNP

SEQ ID NO: 2752429 - protein, 5 aa, Entamoeba invadens
EETPY

SEQ ID NO: 2752430 - protein, 7 aa, Entamoeba invadens
EETQFNM

SEQ ID NO: 2752431 - protein, 11 aa, Entamoeba invadens
EETRGSDSLET

SEQ ID NO: 2752432 - protein, 7 aa, Entamoeba invadens
EETRPKD

SEQ ID NO: 2752433 - protein, 4 aa, Entamoeba invadens
EETS

SEQ ID NO: 2752434 - protein, 9 aa, Entamoeba invadens
EETSATRLP

SEQ ID NO: 2752435 - protein, 7 aa, Entamoeba invadens
EETSSQE

SEQ ID NO: 2752436 - protein, 5 aa, Entamoeba invadens
EETSV

SEQ ID NO: 2752437 - protein, 13 aa, Entamoeba invadens
EETVGKHDSYSAI

SEQ ID NO: 2752438 - protein, 11 aa, Entamoeba invadens
EETVGKHDSYT

SEQ ID NO: 2752439 - protein, 12 aa, Entamoeba invadens
EETVKYDKSPNS

SEQ ID NO: 2752440 - protein, 10 aa, Entamoeba invadens
EETYRVDGSG

SEQ ID NO: 2752441 - protein, 13 aa, Entamoeba invadens
EEVAEEKKIGEGS

SEQ ID NO: 2752442 - protein, 9 aa, Entamoeba invadens
EEVDGVKTK

SEQ ID NO: 2752443 - protein, 10 aa, Entamoeba invadens
EEVDVNEKQR

SEQ ID NO: 2752444 - protein, 10 aa, Entamoeba invadens
EEVGKSDNKY

SEQ ID NO: 2752445 - protein, 4 aa, Entamoeba invadens
EEVK

SEQ ID NO: 2752446 - protein, 7 aa, Entamoeba invadens
EEVKETA

SEQ ID NO: 2752447 - protein, 11 aa, Entamoeba invadens
EEVKEVKEEDP

SEQ ID NO: 2752448 - protein, 13 aa, Entamoeba invadens
EEVNKKRNDFHPK

SEQ ID NO: 2752449 - protein, 5 aa, Entamoeba invadens
EEVNT

SEQ ID NO: 2752450 - protein, 13 aa, Entamoeba invadens
EEVRIDTTDFRKS

SEQ ID NO: 2752451 - protein, 10 aa, Entamoeba invadens
EEVSASEKAH

SEQ ID NO: 2752452 - protein, 7 aa, Entamoeba invadens
EEVSGPI

SEQ ID NO: 2752453 - protein, 5 aa, Entamoeba invadens
EEVSN

SEQ ID NO: 2752454 - protein, 7 aa, Entamoeba invadens
EEWKTSN

SEQ ID NO: 2752455 - protein, 9 aa, Entamoeba invadens
EEWTSTDQL

SEQ ID NO: 2752456 - protein, 7 aa, Entamoeba invadens
EEWTTEN

SEQ ID NO: 2752457 - protein, 13 aa, Entamoeba invadens
EEYETKPDNTFQS

SEQ ID NO: 2752458 - protein, 22 aa, Entamoeba invadens
EEYEVPNSNIQGPLTPAFKPES

SEQ ID NO: 2752459 - protein, 11 aa, Entamoeba invadens
EEYGDTSRIPY

SEQ ID NO: 2752460 - protein, 4 aa, Entamoeba invadens
EEYK

SEQ ID NO: 2752461 - protein, 13 aa, Entamoeba invadens
EEYKKDGKGDFGS

SEQ ID NO: 2752462 - protein, 6 aa, Entamoeba invadens
EEYKSR

SEQ ID NO: 2752463 - protein, 12 aa, Entamoeba invadens
EEYNQQTETELK

SEQ ID NO: 2752464 - protein, 8 aa, Entamoeba invadens
EEYPPEQI

SEQ ID NO: 2752465 - protein, 4 aa, Entamoeba invadens
EEYQ

SEQ ID NO: 2752466 - protein, 5 aa, Entamoeba invadens
EEYSA

SEQ ID NO: 2752467 - protein, 6 aa, Entamoeba invadens
EEYSAS

SEQ ID NO: 2752468 - protein, 5 aa, Entamoeba invadens
EEYTN

SEQ ID NO: 2752469 - protein, 8 aa, Entamoeba invadens
EEYTTGNK

SEQ ID NO: 2752470 - protein, 6 aa, Entamoeba invadens
EFAKNQ

SEQ ID NO: 2752471 - protein, 5 aa, Entamoeba invadens
EFDER

SEQ ID NO: 2752472 - protein, 4 aa, Entamoeba invadens
EFDN

SEQ ID NO: 2752473 - protein, 5 aa, Entamoeba invadens
EFDSE

SEQ ID NO: 2752474 - protein, 5 aa, Entamoeba invadens
EFDSN

SEQ ID NO: 2752475 - protein, 22 aa, Entamoeba invadens
EFEETQMKKNQDKWPLLYGVSS

SEQ ID NO: 2752476 - protein, 10 aa, Entamoeba invadens
EFESDSQYTA

SEQ ID NO: 2752477 - protein, 6 aa, Entamoeba invadens
EFETPE

SEQ ID NO: 2752478 - protein, 13 aa, Entamoeba invadens
EFGNDETKVNEIE

SEQ ID NO: 2752479 - protein, 13 aa, Entamoeba invadens
EFGNDKTKSNEFE

SEQ ID NO: 2752480 - protein, 13 aa, Entamoeba invadens
EFGNDKTKVDEFE

SEQ ID NO: 2752481 - protein, 13 aa, Entamoeba invadens
EFGNDRTKVDEFE

SEQ ID NO: 2752482 - protein, 12 aa, Entamoeba invadens
EFGTSQKSVPKE

SEQ ID NO: 2752483 - protein, 11 aa, Entamoeba invadens
EFKDNTDETIE

SEQ ID NO: 2752484 - protein, 7 aa, Entamoeba invadens
EFKGDAI

SEQ ID NO: 2752485 - protein, 9 aa, Entamoeba invadens
EFKNEESSI

SEQ ID NO: 2752486 - protein, 8 aa, Entamoeba invadens
EFKPENND

SEQ ID NO: 2752487 - protein, 8 aa, Entamoeba invadens
EFKSESNA

SEQ ID NO: 2752488 - protein, 10 aa, Entamoeba invadens
EFNENNIEEF

SEQ ID NO: 2752489 - protein, 12 aa, Entamoeba invadens
EFNENNNDEFTK

SEQ ID NO: 2752490 - protein, 10 aa, Entamoeba invadens
EFNKQTDGRG

SEQ ID NO: 2752491 - protein, 10 aa, Entamoeba invadens
EFNRNANETV

SEQ ID NO: 2752492 - protein, 7 aa, Entamoeba invadens
EFNTNTT

SEQ ID NO: 2752493 - protein, 7 aa, Entamoeba invadens
EFPDERN

SEQ ID NO: 2752494 - protein, 13 aa, Entamoeba invadens
EFPEGTNTKRAKT

SEQ ID NO: 2752495 - protein, 5 aa, Entamoeba invadens
EFPIP

SEQ ID NO: 2752496 - protein, 7 aa, Entamoeba invadens
EFPPTYD

SEQ ID NO: 2752497 - protein, 6 aa, Entamoeba invadens
EFQANG

SEQ ID NO: 2752498 - protein, 23 aa, Entamoeba invadens
EFQESKANSDTTTSMNKSEPKQV

SEQ ID NO: 2752499 - protein, 7 aa, Entamoeba invadens
EFQNTSN

SEQ ID NO: 2752500 - protein, 5 aa, Entamoeba invadens
EFRGN

SEQ ID NO: 2752501 - protein, 6 aa, Entamoeba invadens
EFSDSN

SEQ ID NO: 2752502 - protein, 7 aa, Entamoeba invadens
EFSEDGK

SEQ ID NO: 2752503 - protein, 12 aa, Entamoeba invadens
EFSETAKAIEEF

SEQ ID NO: 2752504 - protein, 13 aa, Entamoeba invadens
EFSGCSSCSGTTW

SEQ ID NO: 2752505 - protein, 5 aa, Entamoeba invadens
EFSGQ

SEQ ID NO: 2752506 - protein, 8 aa, Entamoeba invadens
EFSKTNGT

SEQ ID NO: 2752507 - protein, 5 aa, Entamoeba invadens
EFTDA

SEQ ID NO: 2752508 - protein, 10 aa, Entamoeba invadens
EFTTPTGEYL

SEQ ID NO: 2752509 - protein, 22 aa, Entamoeba invadens
EFTTTEDTTVTPLSSARVGTQV

SEQ ID NO: 2752510 - protein, 11 aa, Entamoeba invadens
EFTVGTDNTCH

SEQ ID NO: 2752511 - protein, 7 aa, Entamoeba invadens
EGAEQAS

SEQ ID NO: 2752512 - protein, 4 aa, Entamoeba invadens
EGAK

SEQ ID NO: 2752513 - protein, 11 aa, Entamoeba invadens
EGALEKQGIDQ

SEQ ID NO: 2752514 - protein, 13 aa, Entamoeba invadens
EGANQPSDDGENC

SEQ ID NO: 2752515 - protein, 8 aa, Entamoeba invadens
EGASTGHS

SEQ ID NO: 2752516 - protein, 6 aa, Entamoeba invadens
EGATGG

SEQ ID NO: 2752517 - protein, 16 aa, Entamoeba invadens
EGATGKVSFDSNGDRV

SEQ ID NO: 2752518 - protein, 5 aa, Entamoeba invadens
EGATR

SEQ ID NO: 2752519 - protein, 13 aa, Entamoeba invadens
EGCETQSKVKEFE

SEQ ID NO: 2752520 - protein, 14 aa, Entamoeba invadens
EGCETQSKVKEFEK

SEQ ID NO: 2752521 - protein, 12 aa, Entamoeba invadens
EGCETRSKMKEF

SEQ ID NO: 2752522 - protein, 12 aa, Entamoeba invadens
EGCGNCESPSGK

SEQ ID NO: 2752523 - protein, 9 aa, Entamoeba invadens
EGCGSGYRA

SEQ ID NO: 2752524 - protein, 7 aa, Entamoeba invadens
EGCLPDS

SEQ ID NO: 2752525 - protein, 5 aa, Entamoeba invadens
EGCQD

SEQ ID NO: 2752526 - protein, 10 aa, Entamoeba invadens
EGCQGDVSSV

SEQ ID NO: 2752527 - protein, 9 aa, Entamoeba invadens
EGCSKCDQN

SEQ ID NO: 2752528 - protein, 9 aa, Entamoeba invadens
EGCSNNKNY

SEQ ID NO: 2752529 - protein, 9 aa, Entamoeba invadens
EGCSTDGKY

SEQ ID NO: 2752530 - protein, 8 aa, Entamoeba invadens
EGCSTEGK

SEQ ID NO: 2752531 - protein, 7 aa, Entamoeba invadens
EGCSTEN

SEQ ID NO: 2752532 - protein, 4 aa, Entamoeba invadens
EGDC

SEQ ID NO: 2752533 - protein, 11 aa, Entamoeba invadens
EGDEEETEYPY

SEQ ID NO: 2752534 - protein, 4 aa, Entamoeba invadens
EGDG

SEQ ID NO: 2752535 - protein, 7 aa, Entamoeba invadens
EGDKKTM

SEQ ID NO: 2752536 - protein, 9 aa, Entamoeba invadens
EGDKSSLSQ

SEQ ID NO: 2752537 - protein, 6 aa, Entamoeba invadens
EGDKTH

SEQ ID NO: 2752538 - protein, 4 aa, Entamoeba invadens
EGDM

SEQ ID NO: 2752539 - protein, 14 aa, Entamoeba invadens
EGDNIQTSSSCECQ

SEQ ID NO: 2752540 - protein, 13 aa, Entamoeba invadens
EGDNTQTSSSCEC

SEQ ID NO: 2752541 - protein, 10 aa, Entamoeba invadens
EGDPEGTIEE

SEQ ID NO: 2752542 - protein, 7 aa, Entamoeba invadens
EGDRTAR

SEQ ID NO: 2752543 - protein, 16 aa, Entamoeba invadens
EGECLPKKEDCEATDQ

SEQ ID NO: 2752544 - protein, 30 aa, Entamoeba invadens
EGEEIAVDENKQDEEIKNEDNKPMNNEVKR

SEQ ID NO: 2752545 - protein, 30 aa, Entamoeba invadens
EGEEIAVDENKQDEEIKNEDNKPTNNEVKR

SEQ ID NO: 2752546 - protein, 30 aa, Entamoeba invadens
EGEEIDVDEKKQDEEIKNQDNKPIEPTNEV

SEQ ID NO: 2752547 - protein, 20 aa, Entamoeba invadens
EGEEIDVEDEKKEEKAVDQA

SEQ ID NO: 2752548 - protein, 7 aa, Entamoeba invadens
EGEERVN

SEQ ID NO: 2752549 - protein, 6 aa, Entamoeba invadens
EGEGHG

SEQ ID NO: 2752550 - protein, 5 aa, Entamoeba invadens
EGEHN

SEQ ID NO: 2752551 - protein, 7 aa, Entamoeba invadens
EGEHPDY

SEQ ID NO: 2752552 - protein, 6 aa, Entamoeba invadens
EGEKGH

SEQ ID NO: 2752553 - protein, 67 aa, Entamoeba invadens
EGEKKAGAGGASDISSNSTPSVPSSAQEPSITSSSDNTPSGPQSSLPKSVGKRVEKDKEKSSSSSSE

SEQ ID NO: 2752554 - protein, 6 aa, Entamoeba invadens
EGEMSK

SEQ ID NO: 2752555 - protein, 6 aa, Entamoeba invadens
EGEPTH

SEQ ID NO: 2752556 - protein, 4 aa, Entamoeba invadens
EGES

SEQ ID NO: 2752557 - protein, 12 aa, Entamoeba invadens
EGEYFDQTTATC

SEQ ID NO: 2752558 - protein, 5 aa, Entamoeba invadens
EGFNP

SEQ ID NO: 2752559 - protein, 21 aa, Entamoeba invadens
EGFQNSNTKFGSKESSEEKSH

SEQ ID NO: 2752560 - protein, 4 aa, Entamoeba invadens
EGFV

SEQ ID NO: 2752561 - protein, 10 aa, Entamoeba invadens
EGGCDPSSGI

SEQ ID NO: 2752562 - protein, 18 aa, Entamoeba invadens
EGGGCSKENVLTTEKKDY

SEQ ID NO: 2752563 - protein, 5 aa, Entamoeba invadens
EGGIS

SEQ ID NO: 2752564 - protein, 9 aa, Entamoeba invadens
EGGKCKKCN

SEQ ID NO: 2752565 - protein, 10 aa, Entamoeba invadens
EGGKCKKCSK

SEQ ID NO: 2752566 - protein, 8 aa, Entamoeba invadens
EGGKCNGA

SEQ ID NO: 2752567 - protein, 9 aa, Entamoeba invadens
EGGKCNGTN

SEQ ID NO: 2752568 - protein, 17 aa, Entamoeba invadens
EGGKKEQKVDENSLESM

SEQ ID NO: 2752569 - protein, 17 aa, Entamoeba invadens
EGGKKMNDVAANPQTQA

SEQ ID NO: 2752570 - protein, 13 aa, Entamoeba invadens
EGGKNAKSPFTTA

SEQ ID NO: 2752571 - protein, 8 aa, Entamoeba invadens
EGGLQNTA

SEQ ID NO: 2752572 - protein, 8 aa, Entamoeba invadens
EGGNIKSD

SEQ ID NO: 2752573 - protein, 6 aa, Entamoeba invadens
EGGNND

SEQ ID NO: 2752574 - protein, 11 aa, Entamoeba invadens
EGGNSDENTSP

SEQ ID NO: 2752575 - protein, 12 aa, Entamoeba invadens
EGGQYANAATNS

SEQ ID NO: 2752576 - protein, 12 aa, Entamoeba invadens
EGGQYANATTNS

SEQ ID NO: 2752577 - protein, 8 aa, Entamoeba invadens
EGGRCNGA

SEQ ID NO: 2752578 - protein, 6 aa, Entamoeba invadens
EGGRTD

SEQ ID NO: 2752579 - protein, 7 aa, Entamoeba invadens
EGGSDYY

SEQ ID NO: 2752580 - protein, 10 aa, Entamoeba invadens
EGGSNSEKLE

SEQ ID NO: 2752581 - protein, 6 aa, Entamoeba invadens
EGGSQG

SEQ ID NO: 2752582 - protein, 5 aa, Entamoeba invadens
EGGSV

SEQ ID NO: 2752583 - protein, 9 aa, Entamoeba invadens
EGGYDNKKM

SEQ ID NO: 2752584 - protein, 6 aa, Entamoeba invadens
EGGYNE

SEQ ID NO: 2752585 - protein, 16 aa, Entamoeba invadens
EGHDYDDGTYTKPYKT

SEQ ID NO: 2752586 - protein, 4 aa, Entamoeba invadens
EGHR

SEQ ID NO: 2752587 - protein, 7 aa, Entamoeba invadens
EGHSEKT

SEQ ID NO: 2752588 - protein, 7 aa, Entamoeba invadens
EGHSQLQ

SEQ ID NO: 2752589 - protein, 5 aa, Entamoeba invadens
EGIED

SEQ ID NO: 2752590 - protein, 6 aa, Entamoeba invadens
EGIGNK

SEQ ID NO: 2752591 - protein, 4 aa, Entamoeba invadens
EGIN

SEQ ID NO: 2752592 - protein, 7 aa, Entamoeba invadens
EGISADQ

SEQ ID NO: 2752593 - protein, 7 aa, Entamoeba invadens
EGISPEA

SEQ ID NO: 2752594 - protein, 8 aa, Entamoeba invadens
EGITSSES

SEQ ID NO: 2752595 - protein, 4 aa, Entamoeba invadens
EGIV

SEQ ID NO: 2752596 - protein, 8 aa, Entamoeba invadens
EGKAPSKR

SEQ ID NO: 2752597 - protein, 15 aa, Entamoeba invadens
EGKCAKCDTNGNGTD

SEQ ID NO: 2752598 - protein, 9 aa, Entamoeba invadens
EGKDEEWNN

SEQ ID NO: 2752599 - protein, 7 aa, Entamoeba invadens
EGKDPTV

SEQ ID NO: 2752600 - protein, 8 aa, Entamoeba invadens
EGKESCET

SEQ ID NO: 2752601 - protein, 9 aa, Entamoeba invadens
EGKKCNEAN

SEQ ID NO: 2752602 - protein, 7 aa, Entamoeba invadens
EGKKGYY

SEQ ID NO: 2752603 - protein, 10 aa, Entamoeba invadens
EGKLSQDYNP

SEQ ID NO: 2752604 - protein, 8 aa, Entamoeba invadens
EGKNGEKM

SEQ ID NO: 2752605 - protein, 11 aa, Entamoeba invadens
EGKRLEKPNEI

SEQ ID NO: 2752606 - protein, 13 aa, Entamoeba invadens
EGKRLEKPNGIPE

SEQ ID NO: 2752607 - protein, 13 aa, Entamoeba invadens
EGKRPDLSTVDKD

SEQ ID NO: 2752608 - protein, 8 aa, Entamoeba invadens
EGKRPLQN

SEQ ID NO: 2752609 - protein, 13 aa, Entamoeba invadens
EGKRPVKSEGMSK

SEQ ID NO: 2752610 - protein, 12 aa, Entamoeba invadens
EGKRRPKANLPD

SEQ ID NO: 2752611 - protein, 6 aa, Entamoeba invadens
EGKSLL

SEQ ID NO: 2752612 - protein, 15 aa, Entamoeba invadens
EGKSQDSKVKDSKFS

SEQ ID NO: 2752613 - protein, 6 aa, Entamoeba invadens
EGKSVD

SEQ ID NO: 2752614 - protein, 10 aa, Entamoeba invadens
EGKVKSTETT

SEQ ID NO: 2752615 - protein, 7 aa, Entamoeba invadens
EGKVKVT

SEQ ID NO: 2752616 - protein, 11 aa, Entamoeba invadens
EGLGRGNSTGG

SEQ ID NO: 2752617 - protein, 4 aa, Entamoeba invadens
EGLK

SEQ ID NO: 2752618 - protein, 19 aa, Entamoeba invadens
EGLKKRSEMGMDGESSTKN

SEQ ID NO: 2752619 - protein, 5 aa, Entamoeba invadens
EGLKT

SEQ ID NO: 2752620 - protein, 6 aa, Entamoeba invadens
EGLKTK

SEQ ID NO: 2752621 - protein, 7 aa, Entamoeba invadens
EGLKTKY

SEQ ID NO: 2752622 - protein, 8 aa, Entamoeba invadens
EGLNGSSV

SEQ ID NO: 2752623 - protein, 8 aa, Entamoeba invadens
EGLNKNQL

SEQ ID NO: 2752624 - protein, 10 aa, Entamoeba invadens
EGLPSPLPHN

SEQ ID NO: 2752625 - protein, 12 aa, Entamoeba invadens
EGLRDRKTTLKA

SEQ ID NO: 2752626 - protein, 4 aa, Entamoeba invadens
EGLS

SEQ ID NO: 2752627 - protein, 10 aa, Entamoeba invadens
EGLSSNPLGF

SEQ ID NO: 2752628 - protein, 9 aa, Entamoeba invadens
EGMEKNENM

SEQ ID NO: 2752629 - protein, 8 aa, Entamoeba invadens
EGMRTTPV

SEQ ID NO: 2752630 - protein, 7 aa, Entamoeba invadens
EGNCEQC

SEQ ID NO: 2752631 - protein, 9 aa, Entamoeba invadens
EGNCKPQTD

SEQ ID NO: 2752632 - protein, 7 aa, Entamoeba invadens
EGNCKQC

SEQ ID NO: 2752633 - protein, 22 aa, Entamoeba invadens
EGNCVTSSCEQNEIKEANGKCT

SEQ ID NO: 2752634 - protein, 16 aa, Entamoeba invadens
EGNDDQKESIPVGTQT

SEQ ID NO: 2752635 - protein, 10 aa, Entamoeba invadens
EGNDYSPSVD

SEQ ID NO: 2752636 - protein, 6 aa, Entamoeba invadens
EGNECR

SEQ ID NO: 2752637 - protein, 6 aa, Entamoeba invadens
EGNEIE

SEQ ID NO: 2752638 - protein, 6 aa, Entamoeba invadens
EGNENG

SEQ ID NO: 2752639 - protein, 4 aa, Entamoeba invadens
EGNF

SEQ ID NO: 2752640 - protein, 6 aa, Entamoeba invadens
EGNGGI

SEQ ID NO: 2752641 - protein, 14 aa, Entamoeba invadens
EGNQKFSQNDIETA

SEQ ID NO: 2752642 - protein, 11 aa, Entamoeba invadens
EGNRIPSDDGL

SEQ ID NO: 2752643 - protein, 10 aa, Entamoeba invadens
EGNRLDKPDL

SEQ ID NO: 2752644 - protein, 15 aa, Entamoeba invadens
EGNTALSTRLDPTEL

SEQ ID NO: 2752645 - protein, 8 aa, Entamoeba invadens
EGNTEANC

SEQ ID NO: 2752646 - protein, 9 aa, Entamoeba invadens
EGNVNTNCD

SEQ ID NO: 2752647 - protein, 5 aa, Entamoeba invadens
EGPFR

SEQ ID NO: 2752648 - protein, 4 aa, Entamoeba invadens
EGPI

SEQ ID NO: 2752649 - protein, 13 aa, Entamoeba invadens
EGPIPNEKPLPNE

SEQ ID NO: 2752650 - protein, 13 aa, Entamoeba invadens
EGPISKNRCSKCE

SEQ ID NO: 2752651 - protein, 6 aa, Entamoeba invadens
EGPNGI

SEQ ID NO: 2752652 - protein, 6 aa, Entamoeba invadens
EGPPKV

SEQ ID NO: 2752653 - protein, 8 aa, Entamoeba invadens
EGPTHDGT

SEQ ID NO: 2752654 - protein, 5 aa, Entamoeba invadens
EGPVC

SEQ ID NO: 2752655 - protein, 17 aa, Entamoeba invadens
EGQDYYDGSYNKPYRTV

SEQ ID NO: 2752656 - protein, 9 aa, Entamoeba invadens
EGQNKETAK

SEQ ID NO: 2752657 - protein, 6 aa, Entamoeba invadens
EGQQQS

SEQ ID NO: 2752658 - protein, 7 aa, Entamoeba invadens
EGQRVDT

SEQ ID NO: 2752659 - protein, 6 aa, Entamoeba invadens
EGQSEA

SEQ ID NO: 2752660 - protein, 8 aa, Entamoeba invadens
EGQSGEHK

SEQ ID NO: 2752661 - protein, 8 aa, Entamoeba invadens
EGRCSTNE

SEQ ID NO: 2752662 - protein, 6 aa, Entamoeba invadens
EGREER

SEQ ID NO: 2752663 - protein, 7 aa, Entamoeba invadens
EGRGEFR

SEQ ID NO: 2752664 - protein, 14 aa, Entamoeba invadens
EGRRELTDSGDSCT

SEQ ID NO: 2752665 - protein, 17 aa, Entamoeba invadens
EGRREPTDSGDNCTDSV

SEQ ID NO: 2752666 - protein, 17 aa, Entamoeba invadens
EGRREPTDSGDSCTDSV

SEQ ID NO: 2752667 - protein, 8 aa, Entamoeba invadens
EGSCQNDE

SEQ ID NO: 2752668 - protein, 14 aa, Entamoeba invadens
EGSDGSSREDDYSF

SEQ ID NO: 2752669 - protein, 6 aa, Entamoeba invadens
EGSEKD

SEQ ID NO: 2752670 - protein, 4 aa, Entamoeba invadens
EGSF

SEQ ID NO: 2752671 - protein, 6 aa, Entamoeba invadens
EGSIEA

SEQ ID NO: 2752672 - protein, 11 aa, Entamoeba invadens
EGSISGREGRW

SEQ ID NO: 2752673 - protein, 4 aa, Entamoeba invadens
EGSK

SEQ ID NO: 2752674 - protein, 8 aa, Entamoeba invadens
EGSKTNIS

SEQ ID NO: 2752675 - protein, 12 aa, Entamoeba invadens
EGSMKQSTSAQI

SEQ ID NO: 2752676 - protein, 13 aa, Entamoeba invadens
EGSNRPSDDGESC

SEQ ID NO: 2752677 - protein, 18 aa, Entamoeba invadens
EGSNRPSDDGESCVNTTN

SEQ ID NO: 2752678 - protein, 8 aa, Entamoeba invadens
EGSNTVHD

SEQ ID NO: 2752679 - protein, 6 aa, Entamoeba invadens
EGSNVN

SEQ ID NO: 2752680 - protein, 9 aa, Entamoeba invadens
EGSPGVGKT

SEQ ID NO: 2752681 - protein, 25 aa, Entamoeba invadens
EGSQKFSSKDIETALNRNEEKGDIS

SEQ ID NO: 2752682 - protein, 4 aa, Entamoeba invadens
EGSR

SEQ ID NO: 2752683 - protein, 8 aa, Entamoeba invadens
EGSRKIEA

SEQ ID NO: 2752684 - protein, 10 aa, Entamoeba invadens
EGSRSQRTSC

SEQ ID NO: 2752685 - protein, 9 aa, Entamoeba invadens
EGSSHINKK

SEQ ID NO: 2752686 - protein, 5 aa, Entamoeba invadens
EGSSM

SEQ ID NO: 2752687 - protein, 4 aa, Entamoeba invadens
EGST

SEQ ID NO: 2752688 - protein, 9 aa, Entamoeba invadens
EGSTKQKRE

SEQ ID NO: 2752689 - protein, 9 aa, Entamoeba invadens
EGSTNITNN

SEQ ID NO: 2752690 - protein, 7 aa, Entamoeba invadens
EGSTNKL

SEQ ID NO: 2752691 - protein, 7 aa, Entamoeba invadens
EGSTNRC

SEQ ID NO: 2752692 - protein, 6 aa, Entamoeba invadens
EGSTSR

SEQ ID NO: 2752693 - protein, 10 aa, Entamoeba invadens
EGSVDDSQLN

SEQ ID NO: 2752694 - protein, 5 aa, Entamoeba invadens
EGSYL

SEQ ID NO: 2752695 - protein, 15 aa, Entamoeba invadens
EGSYYNYDTKTSTLN

SEQ ID NO: 2752696 - protein, 5 aa, Entamoeba invadens
EGTAK

SEQ ID NO: 2752697 - protein, 6 aa, Entamoeba invadens
EGTCSA

SEQ ID NO: 2752698 - protein, 8 aa, Entamoeba invadens
EGTCSGCN

SEQ ID NO: 2752699 - protein, 10 aa, Entamoeba invadens
EGTCSTNEKL

SEQ ID NO: 2752700 - protein, 9 aa, Entamoeba invadens
EGTFPTKET

SEQ ID NO: 2752701 - protein, 4 aa, Entamoeba invadens
EGTG

SEQ ID NO: 2752702 - protein, 6 aa, Entamoeba invadens
EGTGRY

SEQ ID NO: 2752703 - protein, 4 aa, Entamoeba invadens
EGTH

SEQ ID NO: 2752704 - protein, 18 aa, Entamoeba invadens
EGTHYNYGTNKSTLNDGN

SEQ ID NO: 2752705 - protein, 14 aa, Entamoeba invadens
EGTHYNYNTNTSIL

SEQ ID NO: 2752706 - protein, 5 aa, Entamoeba invadens
EGTNF

SEQ ID NO: 2752707 - protein, 5 aa, Entamoeba invadens
EGTQF

SEQ ID NO: 2752708 - protein, 5 aa, Entamoeba invadens
EGTQS

SEQ ID NO: 2752709 - protein, 11 aa, Entamoeba invadens
EGTRVKPDKLI

SEQ ID NO: 2752710 - protein, 4 aa, Entamoeba invadens
EGTT

SEQ ID NO: 2752711 - protein, 7 aa, Entamoeba invadens
EGTTDAP

SEQ ID NO: 2752712 - protein, 5 aa, Entamoeba invadens
EGTTL

SEQ ID NO: 2752713 - protein, 5 aa, Entamoeba invadens
EGTTV

SEQ ID NO: 2752714 - protein, 15 aa, Entamoeba invadens
EGTVSTKVADKDKYY

SEQ ID NO: 2752715 - protein, 7 aa, Entamoeba invadens
EGTYSSN

SEQ ID NO: 2752716 - protein, 5 aa, Entamoeba invadens
EGTYY

SEQ ID NO: 2752717 - protein, 7 aa, Entamoeba invadens
EGVATSH

SEQ ID NO: 2752718 - protein, 10 aa, Entamoeba invadens
EGVDGPSKKR

SEQ ID NO: 2752719 - protein, 7 aa, Entamoeba invadens
EGVGKQF

SEQ ID NO: 2752720 - protein, 5 aa, Entamoeba invadens
EGVKT

SEQ ID NO: 2752721 - protein, 4 aa, Entamoeba invadens
EGVN

SEQ ID NO: 2752722 - protein, 8 aa, Entamoeba invadens
EGVNGSSK

SEQ ID NO: 2752723 - protein, 8 aa, Entamoeba invadens
EGVNSNEQ

SEQ ID NO: 2752724 - protein, 21 aa, Entamoeba invadens
EGYDDEDQVQEQEKGDEVVIE

SEQ ID NO: 2752725 - protein, 7 aa, Entamoeba invadens
EGYDNDN

SEQ ID NO: 2752726 - protein, 12 aa, Entamoeba invadens
EGYETNPDDELS

SEQ ID NO: 2752727 - protein, 5 aa, Entamoeba invadens
EGYIR

SEQ ID NO: 2752728 - protein, 5 aa, Entamoeba invadens
EGYKR

SEQ ID NO: 2752729 - protein, 4 aa, Entamoeba invadens
EGYN

SEQ ID NO: 2752730 - protein, 8 aa, Entamoeba invadens
EGYNETHE

SEQ ID NO: 2752731 - protein, 21 aa, Entamoeba invadens
EGYNTEVGDRGSQMSGGQKQR

SEQ ID NO: 2752732 - protein, 5 aa, Entamoeba invadens
EGYPG

SEQ ID NO: 2752733 - protein, 9 aa, Entamoeba invadens
EGYRQEKDS

SEQ ID NO: 2752734 - protein, 8 aa, Entamoeba invadens
EGYSEAQK

SEQ ID NO: 2752735 - protein, 5 aa, Entamoeba invadens
EGYSL

SEQ ID NO: 2752736 - protein, 20 aa, Entamoeba invadens
EGYSSSNDQCIKNSNASGVI

SEQ ID NO: 2752737 - protein, 7 aa, Entamoeba invadens
EGYTDAS

SEQ ID NO: 2752738 - protein, 9 aa, Entamoeba invadens
EGYTQSGSD

SEQ ID NO: 2752739 - protein, 12 aa, Entamoeba invadens
EGYVPDKESELG

SEQ ID NO: 2752740 - protein, 5 aa, Entamoeba invadens
EGYYK

SEQ ID NO: 2752741 - protein, 14 aa, Entamoeba invadens
EGYYNTKNNCTNVP

SEQ ID NO: 2752742 - protein, 15 aa, Entamoeba invadens
EGYYNTNSDCTSVPT

SEQ ID NO: 2752743 - protein, 14 aa, Entamoeba invadens
EGYYRESTGECQPC

SEQ ID NO: 2752744 - protein, 6 aa, Entamoeba invadens
EGYYSQ

SEQ ID NO: 2752745 - protein, 4 aa, Entamoeba invadens
EHDP

SEQ ID NO: 2752746 - protein, 7 aa, Entamoeba invadens
EHDPQKR

SEQ ID NO: 2752747 - protein, 5 aa, Entamoeba invadens
EHDTD

SEQ ID NO: 2752748 - protein, 5 aa, Entamoeba invadens
EHEEE

SEQ ID NO: 2752749 - protein, 7 aa, Entamoeba invadens
EHEPKKR

SEQ ID NO: 2752750 - protein, 19 aa, Entamoeba invadens
EHGGEPIKEVPQAKTPTDI

SEQ ID NO: 2752751 - protein, 4 aa, Entamoeba invadens
EHGS

SEQ ID NO: 2752752 - protein, 4 aa, Entamoeba invadens
EHIE

SEQ ID NO: 2752753 - protein, 23 aa, Entamoeba invadens
EHKDGTYKGTMGSISANDTSFNN

SEQ ID NO: 2752754 - protein, 5 aa, Entamoeba invadens
EHKHT

SEQ ID NO: 2752755 - protein, 6 aa, Entamoeba invadens
EHKQDY

SEQ ID NO: 2752756 - protein, 5 aa, Entamoeba invadens
EHNEV

SEQ ID NO: 2752757 - protein, 9 aa, Entamoeba invadens
EHNNAPIDN

SEQ ID NO: 2752758 - protein, 7 aa, Entamoeba invadens
EHNTDVE

SEQ ID NO: 2752759 - protein, 11 aa, Entamoeba invadens
EHPEYQEKTAR

SEQ ID NO: 2752760 - protein, 4 aa, Entamoeba invadens
EHPK

SEQ ID NO: 2752761 - protein, 7 aa, Entamoeba invadens
EHPNDLN

SEQ ID NO: 2752762 - protein, 12 aa, Entamoeba invadens
EHPNDLNGKCTT

SEQ ID NO: 2752763 - protein, 5 aa, Entamoeba invadens
EHPQQ

SEQ ID NO: 2752764 - protein, 6 aa, Entamoeba invadens
EHQPAN

SEQ ID NO: 2752765 - protein, 12 aa, Entamoeba invadens
EHREKYSLRTNP

SEQ ID NO: 2752766 - protein, 23 aa, Entamoeba invadens
EHSAPLQKAKTDLKWKNDDRRQL

SEQ ID NO: 2752767 - protein, 25 aa, Entamoeba invadens
EHSDDKDSEIDEDEVARENGAEVAY

SEQ ID NO: 2752768 - protein, 7 aa, Entamoeba invadens
EHSEWDE

SEQ ID NO: 2752769 - protein, 6 aa, Entamoeba invadens
EHSNDI

SEQ ID NO: 2752770 - protein, 5 aa, Entamoeba invadens
EHSPV

SEQ ID NO: 2752771 - protein, 5 aa, Entamoeba invadens
EHSSL

SEQ ID NO: 2752772 - protein, 8 aa, Entamoeba invadens
EHSTKTEA

SEQ ID NO: 2752773 - protein, 6 aa, Entamoeba invadens
EHTATE

SEQ ID NO: 2752774 - protein, 4 aa, Entamoeba invadens
EHTD

SEQ ID NO: 2752775 - protein, 5 aa, Entamoeba invadens
EHTLT

SEQ ID NO: 2752776 - protein, 5 aa, Entamoeba invadens
EHTSG

SEQ ID NO: 2752777 - protein, 5 aa, Entamoeba invadens
EHVAS

SEQ ID NO: 2752778 - protein, 7 aa, Entamoeba invadens
EHVSEGE

SEQ ID NO: 2752779 - protein, 17 aa, Entamoeba invadens
EHYDKPCKDAECEKCTG

SEQ ID NO: 2752780 - protein, 8 aa, Entamoeba invadens
EHYKKEAD

SEQ ID NO: 2752781 - protein, 7 aa, Entamoeba invadens
EHYKKPA

SEQ ID NO: 2752782 - protein, 9 aa, Entamoeba invadens
EHYKKPADI

SEQ ID NO: 2752783 - protein, 5 aa, Entamoeba invadens
EHYKS

SEQ ID NO: 2752784 - protein, 15 aa, Entamoeba invadens
EHYRSGNLKTMEQGV

SEQ ID NO: 2752785 - protein, 11 aa, Entamoeba invadens
EIASGKRPNIS

SEQ ID NO: 2752786 - protein, 11 aa, Entamoeba invadens
EICDGTPSNVV

SEQ ID NO: 2752787 - protein, 7 aa, Entamoeba invadens
EIDDEAD

SEQ ID NO: 2752788 - protein, 9 aa, Entamoeba invadens
EIDENGLEE

SEQ ID NO: 2752789 - protein, 5 aa, Entamoeba invadens
EIDGE

SEQ ID NO: 2752790 - protein, 4 aa, Entamoeba invadens
EIDL

SEQ ID NO: 2752791 - protein, 14 aa, Entamoeba invadens
EIDNNTNCRYQNEK

SEQ ID NO: 2752792 - protein, 15 aa, Entamoeba invadens
EIDNNTNCSYQNEKG

SEQ ID NO: 2752793 - protein, 5 aa, Entamoeba invadens
EIDPN

SEQ ID NO: 2752794 - protein, 13 aa, Entamoeba invadens
EIDPNAEYCENGK

SEQ ID NO: 2752795 - protein, 26 aa, Entamoeba invadens
EIDPNAEYCENGKSTKCAAKSEMTIN

SEQ ID NO: 2752796 - protein, 4 aa, Entamoeba invadens
EIDQ

SEQ ID NO: 2752797 - protein, 6 aa, Entamoeba invadens
EIDRTE

SEQ ID NO: 2752798 - protein, 7 aa, Entamoeba invadens
EIDSTSN

SEQ ID NO: 2752799 - protein, 8 aa, Entamoeba invadens
EIDTTDAV

SEQ ID NO: 2752800 - protein, 4 aa, Entamoeba invadens
EIEE

SEQ ID NO: 2752801 - protein, 6 aa, Entamoeba invadens
EIEEQA

SEQ ID NO: 2752802 - protein, 5 aa, Entamoeba invadens
EIEGF

SEQ ID NO: 2752803 - protein, 23 aa, Entamoeba invadens
EIEKAAPSSEYEKSYELPEGSTP

SEQ ID NO: 2752804 - protein, 10 aa, Entamoeba invadens
EIEKESDSLA

SEQ ID NO: 2752805 - protein, 5 aa, Entamoeba invadens
EIEKT

SEQ ID NO: 2752806 - protein, 13 aa, Entamoeba invadens
EIEKTPNKTEIEK

SEQ ID NO: 2752807 - protein, 6 aa, Entamoeba invadens
EIENET

SEQ ID NO: 2752808 - protein, 7 aa, Entamoeba invadens
EIENKDS

SEQ ID NO: 2752809 - protein, 5 aa, Entamoeba invadens
EIENL

SEQ ID NO: 2752810 - protein, 5 aa, Entamoeba invadens
EIEPL

SEQ ID NO: 2752811 - protein, 5 aa, Entamoeba invadens
EIEQL

SEQ ID NO: 2752812 - protein, 5 aa, Entamoeba invadens
EIEQS

SEQ ID NO: 2752813 - protein, 12 aa, Entamoeba invadens
EIESGNNALTGN

SEQ ID NO: 2752814 - protein, 9 aa, Entamoeba invadens
EIETSTQPI

SEQ ID NO: 2752815 - protein, 4 aa, Entamoeba invadens
EIGD

SEQ ID NO: 2752816 - protein, 6 aa, Entamoeba invadens
EIGEEI

SEQ ID NO: 2752817 - protein, 6 aa, Entamoeba invadens
EIGEGA

SEQ ID NO: 2752818 - protein, 12 aa, Entamoeba invadens
EIGESLEKMIHS

SEQ ID NO: 2752819 - protein, 16 aa, Entamoeba invadens
EIGKSIDYSQQGRDAG

SEQ ID NO: 2752820 - protein, 5 aa, Entamoeba invadens
EIGSR

SEQ ID NO: 2752821 - protein, 4 aa, Entamoeba invadens
EIGT

SEQ ID NO: 2752822 - protein, 4 aa, Entamoeba invadens
EIIA

SEQ ID NO: 2752823 - protein, 10 aa, Entamoeba invadens
EIIRGDDGEW

SEQ ID NO: 2752824 - protein, 15 aa, Entamoeba invadens
EIKANGKLTDFGSSR

SEQ ID NO: 2752825 - protein, 4 aa, Entamoeba invadens
EIKG

SEQ ID NO: 2752826 - protein, 42 aa, Entamoeba invadens
EIKKAADEATDDKNFESKKREKVEFDDNGDMKENEETTSEQL

SEQ ID NO: 2752827 - protein, 8 aa, Entamoeba invadens
EIKNSDSD

SEQ ID NO: 2752828 - protein, 12 aa, Entamoeba invadens
EIKPTAEEVEDI

SEQ ID NO: 2752829 - protein, 5 aa, Entamoeba invadens
EIKQT

SEQ ID NO: 2752830 - protein, 12 aa, Entamoeba invadens
EIKRGGDPVEES

SEQ ID NO: 2752831 - protein, 6 aa, Entamoeba invadens
EIKSGT

SEQ ID NO: 2752832 - protein, 12 aa, Entamoeba invadens
EIKTEKKSAKGH

SEQ ID NO: 2752833 - protein, 8 aa, Entamoeba invadens
EIKTGKQN

SEQ ID NO: 2752834 - protein, 4 aa, Entamoeba invadens
EILS

SEQ ID NO: 2752835 - protein, 14 aa, Entamoeba invadens
EIMDPNTNFSYSST

SEQ ID NO: 2752836 - protein, 25 aa, Entamoeba invadens
EINDKLNRSDPSKKKKRCCNCCCEI

SEQ ID NO: 2752837 - protein, 43 aa, Entamoeba invadens
EINEKQDTTKINTSKEKKLYKTEVSGDNNLKEQTKARTNGKQL

SEQ ID NO: 2752838 - protein, 4 aa, Entamoeba invadens
EINK

SEQ ID NO: 2752839 - protein, 10 aa, Entamoeba invadens
EINKQQNHYE

SEQ ID NO: 2752840 - protein, 7 aa, Entamoeba invadens
EINNSKC

SEQ ID NO: 2752841 - protein, 23 aa, Entamoeba invadens
EINSGDKKRMEEEKSPTHSKASS

SEQ ID NO: 2752842 - protein, 4 aa, Entamoeba invadens
EINT

SEQ ID NO: 2752843 - protein, 10 aa, Entamoeba invadens
EIPDNVTSLG

SEQ ID NO: 2752844 - protein, 15 aa, Entamoeba invadens
EIPDPSKDMETQINN

SEQ ID NO: 2752845 - protein, 10 aa, Entamoeba invadens
EIPEGSDTQR

SEQ ID NO: 2752846 - protein, 5 aa, Entamoeba invadens
EIPIP

SEQ ID NO: 2752847 - protein, 4 aa, Entamoeba invadens
EIPK

SEQ ID NO: 2752848 - protein, 12 aa, Entamoeba invadens
EIPKGLEPQKGT

SEQ ID NO: 2752849 - protein, 5 aa, Entamoeba invadens
EIPKS

SEQ ID NO: 2752850 - protein, 5 aa, Entamoeba invadens
EIPNK

SEQ ID NO: 2752851 - protein, 4 aa, Entamoeba invadens
EIPP

SEQ ID NO: 2752852 - protein, 9 aa, Entamoeba invadens
EIPPKRYND

SEQ ID NO: 2752853 - protein, 9 aa, Entamoeba invadens
EIPVGKESR

SEQ ID NO: 2752854 - protein, 7 aa, Entamoeba invadens
EIQDKTA

SEQ ID NO: 2752855 - protein, 16 aa, Entamoeba invadens
EIQEENNKGVDSKKIN

SEQ ID NO: 2752856 - protein, 27 aa, Entamoeba invadens
EIQKNSNVSPPQLSQKPLKDPKKNKKL

SEQ ID NO: 2752857 - protein, 4 aa, Entamoeba invadens
EIQN

SEQ ID NO: 2752858 - protein, 16 aa, Entamoeba invadens
EIQRLDEEKMKEQTQA

SEQ ID NO: 2752859 - protein, 4 aa, Entamoeba invadens
EIQS

SEQ ID NO: 2752860 - protein, 21 aa, Entamoeba invadens
EIQSGKQVSLETSSIRQTENE

SEQ ID NO: 2752861 - protein, 4 aa, Entamoeba invadens
EIRA

SEQ ID NO: 2752862 - protein, 5 aa, Entamoeba invadens
EIRED

SEQ ID NO: 2752863 - protein, 4 aa, Entamoeba invadens
EIRG

SEQ ID NO: 2752864 - protein, 11 aa, Entamoeba invadens
EIRKKQKQDQI

SEQ ID NO: 2752865 - protein, 9 aa, Entamoeba invadens
EIRKTTSEY

SEQ ID NO: 2752866 - protein, 8 aa, Entamoeba invadens
EIRKYSES

SEQ ID NO: 2752867 - protein, 6 aa, Entamoeba invadens
EISDQS

SEQ ID NO: 2752868 - protein, 9 aa, Entamoeba invadens
EISESEKSI

SEQ ID NO: 2752869 - protein, 7 aa, Entamoeba invadens
EISQQDQ

SEQ ID NO: 2752870 - protein, 14 aa, Entamoeba invadens
EISSDSVNTKIASN

SEQ ID NO: 2752871 - protein, 16 aa, Entamoeba invadens
EISSENGCEKCQDGYY

SEQ ID NO: 2752872 - protein, 21 aa, Entamoeba invadens
EISSRLDPDEITEEKKIGEGS

SEQ ID NO: 2752873 - protein, 10 aa, Entamoeba invadens
EISSSTIDLT

SEQ ID NO: 2752874 - protein, 5 aa, Entamoeba invadens
EISTR

SEQ ID NO: 2752875 - protein, 11 aa, Entamoeba invadens
EISTSLDPDEL

SEQ ID NO: 2752876 - protein, 7 aa, Entamoeba invadens
EISTTKE

SEQ ID NO: 2752877 - protein, 7 aa, Entamoeba invadens
EITEGTK

SEQ ID NO: 2752878 - protein, 5 aa, Entamoeba invadens
EITGD

SEQ ID NO: 2752879 - protein, 5 aa, Entamoeba invadens
EITGG

SEQ ID NO: 2752880 - protein, 5 aa, Entamoeba invadens
EITGN

SEQ ID NO: 2752881 - protein, 5 aa, Entamoeba invadens
EITHS

SEQ ID NO: 2752882 - protein, 6 aa, Entamoeba invadens
EITHSK

SEQ ID NO: 2752883 - protein, 11 aa, Entamoeba invadens
EITIESEQLPK

SEQ ID NO: 2752884 - protein, 12 aa, Entamoeba invadens
EITKTFGEPELE

SEQ ID NO: 2752885 - protein, 6 aa, Entamoeba invadens
EITNGG

SEQ ID NO: 2752886 - protein, 12 aa, Entamoeba invadens
EITNNEKSIEEF

SEQ ID NO: 2752887 - protein, 8 aa, Entamoeba invadens
EITNNVGT

SEQ ID NO: 2752888 - protein, 6 aa, Entamoeba invadens
EITNTT

SEQ ID NO: 2752889 - protein, 6 aa, Entamoeba invadens
EITPDL

SEQ ID NO: 2752890 - protein, 8 aa, Entamoeba invadens
EITPGGNE

SEQ ID NO: 2752891 - protein, 6 aa, Entamoeba invadens
EITPPL

SEQ ID NO: 2752892 - protein, 9 aa, Entamoeba invadens
EITPSKKSE

SEQ ID NO: 2752893 - protein, 4 aa, Entamoeba invadens
EITQ

SEQ ID NO: 2752894 - protein, 8 aa, Entamoeba invadens
EITQNSVT

SEQ ID NO: 2752895 - protein, 5 aa, Entamoeba invadens
EITTQ

SEQ ID NO: 2752896 - protein, 7 aa, Entamoeba invadens
EITTTNH

SEQ ID NO: 2752897 - protein, 7 aa, Entamoeba invadens
EIVGTEQ

SEQ ID NO: 2752898 - protein, 8 aa, Entamoeba invadens
EIVGTEQK

SEQ ID NO: 2752899 - protein, 80 aa, Entamoeba invadens
EKAAQDAQREKEQAELEKAKAGNNKHEEKKEKEKEKNGTVDNTGTEDQSEPNGVKPQTSQQNGPTTLEKPEDQRVKNEKI

SEQ ID NO: 2752900 - protein, 10 aa, Entamoeba invadens
EKADALAKDL

SEQ ID NO: 2752901 - protein, 7 aa, Entamoeba invadens
EKADALS

SEQ ID NO: 2752902 - protein, 11 aa, Entamoeba invadens
EKAEESAKQMK

SEQ ID NO: 2752903 - protein, 10 aa, Entamoeba invadens
EKAEKEFGER

SEQ ID NO: 2752904 - protein, 20 aa, Entamoeba invadens
EKAERKDGEIGKLEKDARRD

SEQ ID NO: 2752905 - protein, 22 aa, Entamoeba invadens
EKAIQNLSKYNDKYENGKTTLQ

SEQ ID NO: 2752906 - protein, 6 aa, Entamoeba invadens
EKAKSV

SEQ ID NO: 2752907 - protein, 5 aa, Entamoeba invadens
EKALN

SEQ ID NO: 2752908 - protein, 16 aa, Entamoeba invadens
EKANRASIDNIINELA

SEQ ID NO: 2752909 - protein, 12 aa, Entamoeba invadens
EKAQLERKAAKK

SEQ ID NO: 2752910 - protein, 8 aa, Entamoeba invadens
EKAQRNFS

SEQ ID NO: 2752911 - protein, 11 aa, Entamoeba invadens
EKAQSTIEGRE

SEQ ID NO: 2752912 - protein, 7 aa, Entamoeba invadens
EKARDDF

SEQ ID NO: 2752913 - protein, 8 aa, Entamoeba invadens
EKASGTDG

SEQ ID NO: 2752914 - protein, 5 aa, Entamoeba invadens
EKASH

SEQ ID NO: 2752915 - protein, 9 aa, Entamoeba invadens
EKASSEKVG

SEQ ID NO: 2752916 - protein, 4 aa, Entamoeba invadens
EKCD

SEQ ID NO: 2752917 - protein, 13 aa, Entamoeba invadens
EKCDSGNDENGRC

SEQ ID NO: 2752918 - protein, 13 aa, Entamoeba invadens
EKCDSSSSRNCTK

SEQ ID NO: 2752919 - protein, 8 aa, Entamoeba invadens
EKCDSTGK

SEQ ID NO: 2752920 - protein, 7 aa, Entamoeba invadens
EKCEEKC

SEQ ID NO: 2752921 - protein, 11 aa, Entamoeba invadens
EKCEKNSQHGC

SEQ ID NO: 2752922 - protein, 11 aa, Entamoeba invadens
EKCEKTCGENE

SEQ ID NO: 2752923 - protein, 9 aa, Entamoeba invadens
EKCESCSSF

SEQ ID NO: 2752924 - protein, 6 aa, Entamoeba invadens
EKCETG

SEQ ID NO: 2752925 - protein, 12 aa, Entamoeba invadens
EKCETSSQHGCD

SEQ ID NO: 2752926 - protein, 10 aa, Entamoeba invadens
EKCETTESSE

SEQ ID NO: 2752927 - protein, 11 aa, Entamoeba invadens
EKCGKYSQHGC

SEQ ID NO: 2752928 - protein, 8 aa, Entamoeba invadens
EKCGVDES

SEQ ID NO: 2752929 - protein, 8 aa, Entamoeba invadens
EKCKATNG

SEQ ID NO: 2752930 - protein, 8 aa, Entamoeba invadens
EKCKSGYR

SEQ ID NO: 2752931 - protein, 6 aa, Entamoeba invadens
EKCNDN

SEQ ID NO: 2752932 - protein, 13 aa, Entamoeba invadens
EKCNDNCTTCTKH

SEQ ID NO: 2752933 - protein, 8 aa, Entamoeba invadens
EKCNTQVS

SEQ ID NO: 2752934 - protein, 14 aa, Entamoeba invadens
EKCNTVNSADKTYK

SEQ ID NO: 2752935 - protein, 10 aa, Entamoeba invadens
EKCPEGSFEY

SEQ ID NO: 2752936 - protein, 9 aa, Entamoeba invadens
EKCPKGSFE

SEQ ID NO: 2752937 - protein, 8 aa, Entamoeba invadens
EKCRRCKP

SEQ ID NO: 2752938 - protein, 4 aa, Entamoeba invadens
EKCS

SEQ ID NO: 2752939 - protein, 8 aa, Entamoeba invadens
EKCSEGCK

SEQ ID NO: 2752940 - protein, 8 aa, Entamoeba invadens
EKCSGPLT

SEQ ID NO: 2752941 - protein, 8 aa, Entamoeba invadens
EKCSQSES

SEQ ID NO: 2752942 - protein, 9 aa, Entamoeba invadens
EKCSQTQKE

SEQ ID NO: 2752943 - protein, 18 aa, Entamoeba invadens
EKCSSCTKNYSPSTDGTE

SEQ ID NO: 2752944 - protein, 6 aa, Entamoeba invadens
EKCSTD

SEQ ID NO: 2752945 - protein, 9 aa, Entamoeba invadens
EKCSTQSKK

SEQ ID NO: 2752946 - protein, 9 aa, Entamoeba invadens
EKCSTSERK

SEQ ID NO: 2752947 - protein, 9 aa, Entamoeba invadens
EKCSTSGDA

SEQ ID NO: 2752948 - protein, 7 aa, Entamoeba invadens
EKCTDCG

SEQ ID NO: 2752949 - protein, 16 aa, Entamoeba invadens
EKCTDGYALSSDGTCV

SEQ ID NO: 2752950 - protein, 15 aa, Entamoeba invadens
EKCTKCSEGFSLTSD

SEQ ID NO: 2752951 - protein, 13 aa, Entamoeba invadens
EKCTNDNNNCVPT

SEQ ID NO: 2752952 - protein, 7 aa, Entamoeba invadens
EKCTSCD

SEQ ID NO: 2752953 - protein, 12 aa, Entamoeba invadens
EKCYKTDTDNNI

SEQ ID NO: 2752954 - protein, 11 aa, Entamoeba invadens
EKDAGQPKRAE

SEQ ID NO: 2752955 - protein, 19 aa, Entamoeba invadens
EKDAMDASKLKKYTKIKER

SEQ ID NO: 2752956 - protein, 15 aa, Entamoeba invadens
EKDASDLEYRDTTGL

SEQ ID NO: 2752957 - protein, 9 aa, Entamoeba invadens
EKDATNSNC

SEQ ID NO: 2752958 - protein, 13 aa, Entamoeba invadens
EKDDFNCTSCPDS

SEQ ID NO: 2752959 - protein, 8 aa, Entamoeba invadens
EKDGLPHK

SEQ ID NO: 2752960 - protein, 7 aa, Entamoeba invadens
EKDGTVS

SEQ ID NO: 2752961 - protein, 7 aa, Entamoeba invadens
EKDIQEI

SEQ ID NO: 2752962 - protein, 15 aa, Entamoeba invadens
EKDKDGKIKKAAPQK

SEQ ID NO: 2752963 - protein, 12 aa, Entamoeba invadens
EKDKELDQAAKQ

SEQ ID NO: 2752964 - protein, 16 aa, Entamoeba invadens
EKDKVNAKLTDFGSAR

SEQ ID NO: 2752965 - protein, 5 aa, Entamoeba invadens
EKDLY

SEQ ID NO: 2752966 - protein, 8 aa, Entamoeba invadens
EKDPEKIF

SEQ ID NO: 2752967 - protein, 5 aa, Entamoeba invadens
EKDQN

SEQ ID NO: 2752968 - protein, 6 aa, Entamoeba invadens
EKDQNG

SEQ ID NO: 2752969 - protein, 12 aa, Entamoeba invadens
EKDSNAQNANFE

SEQ ID NO: 2752970 - protein, 31 aa, Entamoeba invadens
EKDSTHANKTESEFISDEPSDSTEQSSDIPS

SEQ ID NO: 2752971 - protein, 7 aa, Entamoeba invadens
EKDTQNG

SEQ ID NO: 2752972 - protein, 6 aa, Entamoeba invadens
EKDTTS

SEQ ID NO: 2752973 - protein, 13 aa, Entamoeba invadens
EKDVDLGEIISSK

SEQ ID NO: 2752974 - protein, 10 aa, Entamoeba invadens
EKDVEKGNTE

SEQ ID NO: 2752975 - protein, 9 aa, Entamoeba invadens
EKDVKNYPG

SEQ ID NO: 2752976 - protein, 8 aa, Entamoeba invadens
EKEDSPID

SEQ ID NO: 2752977 - protein, 9 aa, Entamoeba invadens
EKEEAHRKR

SEQ ID NO: 2752978 - protein, 15 aa, Entamoeba invadens
EKEEKLKKTQEKIQN

SEQ ID NO: 2752979 - protein, 19 aa, Entamoeba invadens
EKEEKSEQQKESTSSTLQT

SEQ ID NO: 2752980 - protein, 9 aa, Entamoeba invadens
EKEENNLTD

SEQ ID NO: 2752981 - protein, 7 aa, Entamoeba invadens
EKEEQRY

SEQ ID NO: 2752982 - protein, 29 aa, Entamoeba invadens
EKEEVKEKVVEKKRKKLIKEEKQKEKIPD

SEQ ID NO: 2752983 - protein, 5 aa, Entamoeba invadens
EKEFQ

SEQ ID NO: 2752984 - protein, 9 aa, Entamoeba invadens
EKEFSERYS

SEQ ID NO: 2752985 - protein, 49 aa, Entamoeba invadens
EKEGKASKTEKEEQKKRRKAEKEREKEERKQAKAEKKLKEKDQKAEKAM

SEQ ID NO: 2752986 - protein, 23 aa, Entamoeba invadens
EKEGKCEKCKDTYDTPCKQGDTE

SEQ ID NO: 2752987 - protein, 23 aa, Entamoeba invadens
EKEGKCEKCKNTYNTPCKQGDTE

SEQ ID NO: 2752988 - protein, 7 aa, Entamoeba invadens
EKEGTIG

SEQ ID NO: 2752989 - protein, 5 aa, Entamoeba invadens
EKEHY

SEQ ID NO: 2752990 - protein, 4 aa, Entamoeba invadens
EKEI

SEQ ID NO: 2752991 - protein, 5 aa, Entamoeba invadens
EKEIE

SEQ ID NO: 2752992 - protein, 17 aa, Entamoeba invadens
EKEKEESAKLKRENEEM

SEQ ID NO: 2752993 - protein, 5 aa, Entamoeba invadens
EKEKL

SEQ ID NO: 2752994 - protein, 6 aa, Entamoeba invadens
EKEKNT

SEQ ID NO: 2752995 - protein, 8 aa, Entamoeba invadens
EKEKYDEW

SEQ ID NO: 2752996 - protein, 9 aa, Entamoeba invadens
EKEMSDSEQ

SEQ ID NO: 2752997 - protein, 16 aa, Entamoeba invadens
EKENENCEQISDNGKV

SEQ ID NO: 2752998 - protein, 6 aa, Entamoeba invadens
EKENES

SEQ ID NO: 2752999 - protein, 8 aa, Entamoeba invadens
EKENHSKT

SEQ ID NO: 2753000 - protein, 9 aa, Entamoeba invadens
EKENSEDLI

SEQ ID NO: 2753001 - protein, 7 aa, Entamoeba invadens
EKEQMKR

SEQ ID NO: 2753002 - protein, 11 aa, Entamoeba invadens
EKEQNKRVNGI

SEQ ID NO: 2753003 - protein, 35 aa, Entamoeba invadens
EKERIAQEAKEREEARAETEKMREQANAAKMQEEV

SEQ ID NO: 2753004 - protein, 16 aa, Entamoeba invadens
EKERRENKAPSSTPSL

SEQ ID NO: 2753005 - protein, 10 aa, Entamoeba invadens
EKESDKGYEV

SEQ ID NO: 2753006 - protein, 8 aa, Entamoeba invadens
EKETARSE

SEQ ID NO: 2753007 - protein, 10 aa, Entamoeba invadens
EKETSGSGEM

SEQ ID NO: 2753008 - protein, 8 aa, Entamoeba invadens
EKEVQQQK

SEQ ID NO: 2753009 - protein, 20 aa, Entamoeba invadens
EKEYDQRYNEDKKKVLKTQP

SEQ ID NO: 2753010 - protein, 7 aa, Entamoeba invadens
EKEYTRN

SEQ ID NO: 2753011 - protein, 35 aa, Entamoeba invadens
EKFENSEEKRIEEKEAKIEEKGDDDTLESKSSVKD

SEQ ID NO: 2753012 - protein, 8 aa, Entamoeba invadens
EKFETNRV

SEQ ID NO: 2753013 - protein, 4 aa, Entamoeba invadens
EKFG

SEQ ID NO: 2753014 - protein, 5 aa, Entamoeba invadens
EKFGG

SEQ ID NO: 2753015 - protein, 6 aa, Entamoeba invadens
EKFPLK

SEQ ID NO: 2753016 - protein, 7 aa, Entamoeba invadens
EKFPSNI

SEQ ID NO: 2753017 - protein, 12 aa, Entamoeba invadens
EKFREEDTKKKI

SEQ ID NO: 2753018 - protein, 12 aa, Entamoeba invadens
EKFTKEKTLGHY

SEQ ID NO: 2753019 - protein, 12 aa, Entamoeba invadens
EKFTTDEKTAII

SEQ ID NO: 2753020 - protein, 13 aa, Entamoeba invadens
EKGANSSGGQRQR

SEQ ID NO: 2753021 - protein, 4 aa, Entamoeba invadens
EKGD

SEQ ID NO: 2753022 - protein, 6 aa, Entamoeba invadens
EKGDEF

SEQ ID NO: 2753023 - protein, 9 aa, Entamoeba invadens
EKGDVEETK

SEQ ID NO: 2753024 - protein, 105 aa, Entamoeba invadens
EKGETKREKDSKSSKMNDEENSKVSVTAVTTKDESVTEGESADNSETSNDSDNPTISKDTPEHNDINSNEEHMDGVRPEVAKQVEKEVTAEKTETAQETPKEEEQ

SEQ ID NO: 2753025 - protein, 7 aa, Entamoeba invadens
EKGFTTS

SEQ ID NO: 2753026 - protein, 5 aa, Entamoeba invadens
EKGGK

SEQ ID NO: 2753027 - protein, 11 aa, Entamoeba invadens
EKGGKHVTVGP

SEQ ID NO: 2753028 - protein, 7 aa, Entamoeba invadens
EKGGPLK

SEQ ID NO: 2753029 - protein, 7 aa, Entamoeba invadens
EKGGQLE

SEQ ID NO: 2753030 - protein, 13 aa, Entamoeba invadens
EKGGSCSFGPKTE

SEQ ID NO: 2753031 - protein, 6 aa, Entamoeba invadens
EKGKCN

SEQ ID NO: 2753032 - protein, 6 aa, Entamoeba invadens
EKGKSP

SEQ ID NO: 2753033 - protein, 9 aa, Entamoeba invadens
EKGKVSTDG

SEQ ID NO: 2753034 - protein, 5 aa, Entamoeba invadens
EKGNV

SEQ ID NO: 2753035 - protein, 10 aa, Entamoeba invadens
EKGNVKDSDQ

SEQ ID NO: 2753036 - protein, 7 aa, Entamoeba invadens
EKGQEKF

SEQ ID NO: 2753037 - protein, 6 aa, Entamoeba invadens
EKGQER

SEQ ID NO: 2753038 - protein, 5 aa, Entamoeba invadens
EKGQI

SEQ ID NO: 2753039 - protein, 9 aa, Entamoeba invadens
EKGQPALPV

SEQ ID NO: 2753040 - protein, 7 aa, Entamoeba invadens
EKGRRGM

SEQ ID NO: 2753041 - protein, 8 aa, Entamoeba invadens
EKGRSELA

SEQ ID NO: 2753042 - protein, 4 aa, Entamoeba invadens
EKGT

SEQ ID NO: 2753043 - protein, 5 aa, Entamoeba invadens
EKGTF

SEQ ID NO: 2753044 - protein, 10 aa, Entamoeba invadens
EKGTKGSTIT

SEQ ID NO: 2753045 - protein, 6 aa, Entamoeba invadens
EKGTKT

SEQ ID NO: 2753046 - protein, 7 aa, Entamoeba invadens
EKGTNGE

SEQ ID NO: 2753047 - protein, 32 aa, Entamoeba invadens
EKGVDKKNRSASVATKEPEKKKFKAYSPVEPT

SEQ ID NO: 2753048 - protein, 4 aa, Entamoeba invadens
EKGY

SEQ ID NO: 2753049 - protein, 5 aa, Entamoeba invadens
EKGYR

SEQ ID NO: 2753050 - protein, 7 aa, Entamoeba invadens
EKGYTIE

SEQ ID NO: 2753051 - protein, 8 aa, Entamoeba invadens
EKHEDEYD

SEQ ID NO: 2753052 - protein, 9 aa, Entamoeba invadens
EKHEPTEMK

SEQ ID NO: 2753053 - protein, 4 aa, Entamoeba invadens
EKHH

SEQ ID NO: 2753054 - protein, 9 aa, Entamoeba invadens
EKHINKNKI

SEQ ID NO: 2753055 - protein, 9 aa, Entamoeba invadens
EKHKGEFKG

SEQ ID NO: 2753056 - protein, 8 aa, Entamoeba invadens
EKHKNESV

SEQ ID NO: 2753057 - protein, 8 aa, Entamoeba invadens
EKHQKDED

SEQ ID NO: 2753058 - protein, 5 aa, Entamoeba invadens
EKIAN

SEQ ID NO: 2753059 - protein, 27 aa, Entamoeba invadens
EKIDVQKDKLDTLEDKVDNANERLDLT

SEQ ID NO: 2753060 - protein, 5 aa, Entamoeba invadens
EKIEL

SEQ ID NO: 2753061 - protein, 28 aa, Entamoeba invadens
EKIESPKEDDETEEQKRIRAREKMEKER

SEQ ID NO: 2753062 - protein, 10 aa, Entamoeba invadens
EKIETMTDNE

SEQ ID NO: 2753063 - protein, 17 aa, Entamoeba invadens
EKIGADVKEEKKNNHKY

SEQ ID NO: 2753064 - protein, 8 aa, Entamoeba invadens
EKIGKGSF

SEQ ID NO: 2753065 - protein, 6 aa, Entamoeba invadens
EKINEW

SEQ ID NO: 2753066 - protein, 24 aa, Entamoeba invadens
EKIPEESKGSEEHSESHNQQNSAS

SEQ ID NO: 2753067 - protein, 5 aa, Entamoeba invadens
EKIPQ

SEQ ID NO: 2753068 - protein, 4 aa, Entamoeba invadens
EKIR

SEQ ID NO: 2753069 - protein, 13 aa, Entamoeba invadens
EKKAETPSKREKV

SEQ ID NO: 2753070 - protein, 6 aa, Entamoeba invadens
EKKARY

SEQ ID NO: 2753071 - protein, 10 aa, Entamoeba invadens
EKKDDINNSS

SEQ ID NO: 2753072 - protein, 9 aa, Entamoeba invadens
EKKDEKRVS

SEQ ID NO: 2753073 - protein, 10 aa, Entamoeba invadens
EKKDSKEITL

SEQ ID NO: 2753074 - protein, 29 aa, Entamoeba invadens
EKKDSNLEYYSGSSCDKTVLGGSGSGFDK

SEQ ID NO: 2753075 - protein, 10 aa, Entamoeba invadens
EKKEAKKSTR

SEQ ID NO: 2753076 - protein, 16 aa, Entamoeba invadens
EKKEGTKPRSEKKRSV

SEQ ID NO: 2753077 - protein, 10 aa, Entamoeba invadens
EKKEKEANKL

SEQ ID NO: 2753078 - protein, 7 aa, Entamoeba invadens
EKKELDN

SEQ ID NO: 2753079 - protein, 7 aa, Entamoeba invadens
EKKEVEI

SEQ ID NO: 2753080 - protein, 14 aa, Entamoeba invadens
EKKFTQEQKEAFDR

SEQ ID NO: 2753081 - protein, 32 aa, Entamoeba invadens
EKKGEEKEDTEMKDVKEEKDEKEEKKGSENDI

SEQ ID NO: 2753082 - protein, 7 aa, Entamoeba invadens
EKKGGEY

SEQ ID NO: 2753083 - protein, 10 aa, Entamoeba invadens
EKKGRQRTTR

SEQ ID NO: 2753084 - protein, 8 aa, Entamoeba invadens
EKKIGEGG

SEQ ID NO: 2753085 - protein, 9 aa, Entamoeba invadens
EKKKETSLD

SEQ ID NO: 2753086 - protein, 8 aa, Entamoeba invadens
EKKLGEDS

SEQ ID NO: 2753087 - protein, 9 aa, Entamoeba invadens
EKKLGEGSF

SEQ ID NO: 2753088 - protein, 17 aa, Entamoeba invadens
EKKNSSISSDGGEETKT

SEQ ID NO: 2753089 - protein, 28 aa, Entamoeba invadens
EKKPATKKDTKKVENKKNNDFDFGSREQ

SEQ ID NO: 2753090 - protein, 6 aa, Entamoeba invadens
EKKPVM

SEQ ID NO: 2753091 - protein, 26 aa, Entamoeba invadens
EKKRNESNSEVSENDDEKSVERDTQR

SEQ ID NO: 2753092 - protein, 15 aa, Entamoeba invadens
EKKRNSATDLENIHL

SEQ ID NO: 2753093 - protein, 11 aa, Entamoeba invadens
EKKSPSKKSDV

SEQ ID NO: 2753094 - protein, 10 aa, Entamoeba invadens
EKKSVQAKRP

SEQ ID NO: 2753095 - protein, 10 aa, Entamoeba invadens
EKKTENSTKL

SEQ ID NO: 2753096 - protein, 22 aa, Entamoeba invadens
EKKTPRKSKRKTIKKSPREKWD

SEQ ID NO: 2753097 - protein, 7 aa, Entamoeba invadens
EKKTQIE

SEQ ID NO: 2753098 - protein, 4 aa, Entamoeba invadens
EKLD

SEQ ID NO: 2753099 - protein, 7 aa, Entamoeba invadens
EKLGDDN

SEQ ID NO: 2753100 - protein, 7 aa, Entamoeba invadens
EKLGSDL

SEQ ID NO: 2753101 - protein, 5 aa, Entamoeba invadens
EKLKE

SEQ ID NO: 2753102 - protein, 29 aa, Entamoeba invadens
EKLKENKEKATTHPPEEIGVEDKTKQNLV

SEQ ID NO: 2753103 - protein, 11 aa, Entamoeba invadens
EKLNGTKTINP

SEQ ID NO: 2753104 - protein, 5 aa, Entamoeba invadens
EKLQS

SEQ ID NO: 2753105 - protein, 44 aa, Entamoeba invadens
EKLRKEGYMTTSQVSTNDVSNSNNKTSIGVEESTSAAINSEEEK

SEQ ID NO: 2753106 - protein, 62 aa, Entamoeba invadens
EKLRNEKEDTEKKVEEMTTKNAELENMKTETEKELKNKNKELNDVNDKMKEMNENHKNEIEQ

SEQ ID NO: 2753107 - protein, 12 aa, Entamoeba invadens
EKLRQTGKTQMK

SEQ ID NO: 2753108 - protein, 4 aa, Entamoeba invadens
EKLS

SEQ ID NO: 2753109 - protein, 7 aa, Entamoeba invadens
EKLSEAR

SEQ ID NO: 2753110 - protein, 12 aa, Entamoeba invadens
EKLSKRQKLSMK

SEQ ID NO: 2753111 - protein, 40 aa, Entamoeba invadens
EKLTQTEEDKKKFETAAKNLQTSAKKEEKAEKEKAKQDLK

SEQ ID NO: 2753112 - protein, 6 aa, Entamoeba invadens
EKMAGR

SEQ ID NO: 2753113 - protein, 13 aa, Entamoeba invadens
EKMNNKVTGYDAQ

SEQ ID NO: 2753114 - protein, 7 aa, Entamoeba invadens
EKMPEEL

SEQ ID NO: 2753115 - protein, 38 aa, Entamoeba invadens
EKMRRYEEDISKGDDGLVSVSSSSDEEVDLTKKKENRV

SEQ ID NO: 2753116 - protein, 17 aa, Entamoeba invadens
EKMSPDNINEKLSDETQ

SEQ ID NO: 2753117 - protein, 8 aa, Entamoeba invadens
EKNCPNAD

SEQ ID NO: 2753118 - protein, 15 aa, Entamoeba invadens
EKNCRTEIGDNQRPT

SEQ ID NO: 2753119 - protein, 8 aa, Entamoeba invadens
EKNDGGDK

SEQ ID NO: 2753120 - protein, 4 aa, Entamoeba invadens
EKNE

SEQ ID NO: 2753121 - protein, 10 aa, Entamoeba invadens
EKNETRHQQD

SEQ ID NO: 2753122 - protein, 9 aa, Entamoeba invadens
EKNGKTIED

SEQ ID NO: 2753123 - protein, 7 aa, Entamoeba invadens
EKNGTVQ

SEQ ID NO: 2753124 - protein, 13 aa, Entamoeba invadens
EKNGVKSETHTCP

SEQ ID NO: 2753125 - protein, 4 aa, Entamoeba invadens
EKNI

SEQ ID NO: 2753126 - protein, 11 aa, Entamoeba invadens
EKNIETKEKPI

SEQ ID NO: 2753127 - protein, 6 aa, Entamoeba invadens
EKNIGP

SEQ ID NO: 2753128 - protein, 7 aa, Entamoeba invadens
EKNISDI

SEQ ID NO: 2753129 - protein, 7 aa, Entamoeba invadens
EKNKENK

SEQ ID NO: 2753130 - protein, 23 aa, Entamoeba invadens
EKNKTTVVSEPPPIIDLTKTMLD

SEQ ID NO: 2753131 - protein, 5 aa, Entamoeba invadens
EKNLT

SEQ ID NO: 2753132 - protein, 11 aa, Entamoeba invadens
EKNNQKKLTRS

SEQ ID NO: 2753133 - protein, 8 aa, Entamoeba invadens
EKNPTIEL

SEQ ID NO: 2753134 - protein, 7 aa, Entamoeba invadens
EKNRDTF

SEQ ID NO: 2753135 - protein, 7 aa, Entamoeba invadens
EKNRLND

SEQ ID NO: 2753136 - protein, 8 aa, Entamoeba invadens
EKNRQNDI

SEQ ID NO: 2753137 - protein, 10 aa, Entamoeba invadens
EKNRSDRCEV

SEQ ID NO: 2753138 - protein, 9 aa, Entamoeba invadens
EKNRYKQAV

SEQ ID NO: 2753139 - protein, 4 aa, Entamoeba invadens
EKNS

SEQ ID NO: 2753140 - protein, 13 aa, Entamoeba invadens
EKNSNVDPKPRNL

SEQ ID NO: 2753141 - protein, 4 aa, Entamoeba invadens
EKNT

SEQ ID NO: 2753142 - protein, 7 aa, Entamoeba invadens
EKNTKSL

SEQ ID NO: 2753143 - protein, 11 aa, Entamoeba invadens
EKNTRKSQKTI

SEQ ID NO: 2753144 - protein, 6 aa, Entamoeba invadens
EKNTTH

SEQ ID NO: 2753145 - protein, 13 aa, Entamoeba invadens
EKNTTPSIKEDHP

SEQ ID NO: 2753146 - protein, 7 aa, Entamoeba invadens
EKNYEDF

SEQ ID NO: 2753147 - protein, 7 aa, Entamoeba invadens
EKPFEKG

SEQ ID NO: 2753148 - protein, 15 aa, Entamoeba invadens
EKPHKQNTDSSNLPR

SEQ ID NO: 2753149 - protein, 4 aa, Entamoeba invadens
EKPI

SEQ ID NO: 2753150 - protein, 11 aa, Entamoeba invadens
EKPIAEGANGK

SEQ ID NO: 2753151 - protein, 5 aa, Entamoeba invadens
EKPIG

SEQ ID NO: 2753152 - protein, 10 aa, Entamoeba invadens
EKPLKKDYTI

SEQ ID NO: 2753153 - protein, 13 aa, Entamoeba invadens
EKPLKSETKMTGK

SEQ ID NO: 2753154 - protein, 8 aa, Entamoeba invadens
EKPNPEHN

SEQ ID NO: 2753155 - protein, 8 aa, Entamoeba invadens
EKPPEEYI

SEQ ID NO: 2753156 - protein, 98 aa, Entamoeba invadens
EKPPSKQRIETDQKQKIQIQNTTQNENNVLNTTNNPIETNGTTQTYNNITNPCETQVNNTQTPISVKQEEHHTSSLNETEQNLSDLSGTTPFVPDNQN

SEQ ID NO: 2753157 - protein, 6 aa, Entamoeba invadens
EKPTKV

SEQ ID NO: 2753158 - protein, 22 aa, Entamoeba invadens
EKPTPNSSISTQPTKDLNEKEK

SEQ ID NO: 2753159 - protein, 6 aa, Entamoeba invadens
EKPTTP

SEQ ID NO: 2753160 - protein, 5 aa, Entamoeba invadens
EKPYT

SEQ ID NO: 2753161 - protein, 54 aa, Entamoeba invadens
EKQEEKDVKEERPVTPVNEVTPKELKEEETREAQQVNQTQIEEQHVDKTQQPVV

SEQ ID NO: 2753162 - protein, 80 aa, Entamoeba invadens
EKQEEKDVKEERPVTPVNEVTPKELKEEETREAQQVNQTQIEEQHVDKTQQPVVKEKKKEEDRLTTQRAEQEKKEKEELE

SEQ ID NO: 2753163 - protein, 6 aa, Entamoeba invadens
EKQEGR

SEQ ID NO: 2753164 - protein, 5 aa, Entamoeba invadens
EKQEV

SEQ ID NO: 2753165 - protein, 23 aa, Entamoeba invadens
EKQGKCEKCKDTYNTPCKQGDTE

SEQ ID NO: 2753166 - protein, 7 aa, Entamoeba invadens
EKQIADK

SEQ ID NO: 2753167 - protein, 4 aa, Entamoeba invadens
EKQK

SEQ ID NO: 2753168 - protein, 9 aa, Entamoeba invadens
EKQKEVEIK

SEQ ID NO: 2753169 - protein, 11 aa, Entamoeba invadens
EKQKNTENAFS

SEQ ID NO: 2753170 - protein, 6 aa, Entamoeba invadens
EKQLGE

SEQ ID NO: 2753171 - protein, 8 aa, Entamoeba invadens
EKQLGEGS

SEQ ID NO: 2753172 - protein, 9 aa, Entamoeba invadens
EKQQSSGMI

SEQ ID NO: 2753173 - protein, 25 aa, Entamoeba invadens
EKQREVKDESSELTDKNSEKKETQR

SEQ ID NO: 2753174 - protein, 8 aa, Entamoeba invadens
EKQRTENA

SEQ ID NO: 2753175 - protein, 5 aa, Entamoeba invadens
EKQSI

SEQ ID NO: 2753176 - protein, 6 aa, Entamoeba invadens
EKQVRD

SEQ ID NO: 2753177 - protein, 21 aa, Entamoeba invadens
EKRCQQCNTTCNGNCNTETGY

SEQ ID NO: 2753178 - protein, 8 aa, Entamoeba invadens
EKRCSPCS

SEQ ID NO: 2753179 - protein, 8 aa, Entamoeba invadens
EKRCSQCD

SEQ ID NO: 2753180 - protein, 5 aa, Entamoeba invadens
EKRED

SEQ ID NO: 2753181 - protein, 46 aa, Entamoeba invadens
EKRENETEEQKKLRRDKDNLRRRNARKTKEKKEKVESKEQKEEKAV

SEQ ID NO: 2753182 - protein, 6 aa, Entamoeba invadens
EKRNDY

SEQ ID NO: 2753183 - protein, 7 aa, Entamoeba invadens
EKRQAKR

SEQ ID NO: 2753184 - protein, 12 aa, Entamoeba invadens
EKRQEKRIDPKD

SEQ ID NO: 2753185 - protein, 12 aa, Entamoeba invadens
EKRQERMRKMLE

SEQ ID NO: 2753186 - protein, 4 aa, Entamoeba invadens
EKRS

SEQ ID NO: 2753187 - protein, 8 aa, Entamoeba invadens
EKRSSKVC

SEQ ID NO: 2753188 - protein, 7 aa, Entamoeba invadens
EKRSVGG

SEQ ID NO: 2753189 - protein, 4 aa, Entamoeba invadens
EKRT

SEQ ID NO: 2753190 - protein, 7 aa, Entamoeba invadens
EKSAERD

SEQ ID NO: 2753191 - protein, 15 aa, Entamoeba invadens
EKSARVNELLAEQET

SEQ ID NO: 2753192 - protein, 8 aa, Entamoeba invadens
EKSDATSP

SEQ ID NO: 2753193 - protein, 14 aa, Entamoeba invadens
EKSDEQNAPPNEVQ

SEQ ID NO: 2753194 - protein, 5 aa, Entamoeba invadens
EKSDK

SEQ ID NO: 2753195 - protein, 9 aa, Entamoeba invadens
EKSDKCTHC

SEQ ID NO: 2753196 - protein, 9 aa, Entamoeba invadens
EKSEDLTKK

SEQ ID NO: 2753197 - protein, 7 aa, Entamoeba invadens
EKSEKDC

SEQ ID NO: 2753198 - protein, 21 aa, Entamoeba invadens
EKSEKKTETPKKEVKNTEMEE

SEQ ID NO: 2753199 - protein, 16 aa, Entamoeba invadens
EKSEMSTGDVETVSEE

SEQ ID NO: 2753200 - protein, 9 aa, Entamoeba invadens
EKSHTTQPL

SEQ ID NO: 2753201 - protein, 7 aa, Entamoeba invadens
EKSIEKE

SEQ ID NO: 2753202 - protein, 4 aa, Entamoeba invadens
EKSK

SEQ ID NO: 2753203 - protein, 6 aa, Entamoeba invadens
EKSKDY

SEQ ID NO: 2753204 - protein, 8 aa, Entamoeba invadens
EKSKRESI

SEQ ID NO: 2753205 - protein, 4 aa, Entamoeba invadens
EKSL

SEQ ID NO: 2753206 - protein, 9 aa, Entamoeba invadens
EKSNNKRNF

SEQ ID NO: 2753207 - protein, 8 aa, Entamoeba invadens
EKSNNTNV

SEQ ID NO: 2753208 - protein, 10 aa, Entamoeba invadens
EKSNSNPRTL

SEQ ID NO: 2753209 - protein, 7 aa, Entamoeba invadens
EKSPAKV

SEQ ID NO: 2753210 - protein, 10 aa, Entamoeba invadens
EKSPYKKAAD

SEQ ID NO: 2753211 - protein, 13 aa, Entamoeba invadens
EKSPYKNRFLKYK

SEQ ID NO: 2753212 - protein, 9 aa, Entamoeba invadens
EKSQQINRA

SEQ ID NO: 2753213 - protein, 9 aa, Entamoeba invadens
EKSSDKAKL

SEQ ID NO: 2753214 - protein, 14 aa, Entamoeba invadens
EKSSEENKSQSNMS

SEQ ID NO: 2753215 - protein, 5 aa, Entamoeba invadens
EKSSN

SEQ ID NO: 2753216 - protein, 7 aa, Entamoeba invadens
EKSTGTL

SEQ ID NO: 2753217 - protein, 9 aa, Entamoeba invadens
EKSTHPEER

SEQ ID NO: 2753218 - protein, 10 aa, Entamoeba invadens
EKSTPPAKRS

SEQ ID NO: 2753219 - protein, 13 aa, Entamoeba invadens
EKSTTGEENKEKV

SEQ ID NO: 2753220 - protein, 5 aa, Entamoeba invadens
EKSVE

SEQ ID NO: 2753221 - protein, 6 aa, Entamoeba invadens
EKSVTE

SEQ ID NO: 2753222 - protein, 4 aa, Entamoeba invadens
EKSY

SEQ ID NO: 2753223 - protein, 10 aa, Entamoeba invadens
EKTAFDRNAT

SEQ ID NO: 2753224 - protein, 6 aa, Entamoeba invadens
EKTAQQ

SEQ ID NO: 2753225 - protein, 9 aa, Entamoeba invadens
EKTCQPCSN

SEQ ID NO: 2753226 - protein, 8 aa, Entamoeba invadens
EKTEELED

SEQ ID NO: 2753227 - protein, 5 aa, Entamoeba invadens
EKTEL

SEQ ID NO: 2753228 - protein, 10 aa, Entamoeba invadens
EKTESGRSHH

SEQ ID NO: 2753229 - protein, 11 aa, Entamoeba invadens
EKTGGYGGNIG

SEQ ID NO: 2753230 - protein, 8 aa, Entamoeba invadens
EKTGHKDK

SEQ ID NO: 2753231 - protein, 6 aa, Entamoeba invadens
EKTHGK

SEQ ID NO: 2753232 - protein, 8 aa, Entamoeba invadens
EKTIENTH

SEQ ID NO: 2753233 - protein, 8 aa, Entamoeba invadens
EKTIYNGA

SEQ ID NO: 2753234 - protein, 6 aa, Entamoeba invadens
EKTKHN

SEQ ID NO: 2753235 - protein, 9 aa, Entamoeba invadens
EKTKYEKED

SEQ ID NO: 2753236 - protein, 12 aa, Entamoeba invadens
EKTLASKTSGCA

SEQ ID NO: 2753237 - protein, 9 aa, Entamoeba invadens
EKTLNNPGV

SEQ ID NO: 2753238 - protein, 5 aa, Entamoeba invadens
EKTMQ

SEQ ID NO: 2753239 - protein, 4 aa, Entamoeba invadens
EKTN

SEQ ID NO: 2753240 - protein, 8 aa, Entamoeba invadens
EKTNDEQA

SEQ ID NO: 2753241 - protein, 7 aa, Entamoeba invadens
EKTPLPI

SEQ ID NO: 2753242 - protein, 6 aa, Entamoeba invadens
EKTPQQ

SEQ ID NO: 2753243 - protein, 5 aa, Entamoeba invadens
EKTPT

SEQ ID NO: 2753244 - protein, 9 aa, Entamoeba invadens
EKTQGDTVI

SEQ ID NO: 2753245 - protein, 8 aa, Entamoeba invadens
EKTQQKFV

SEQ ID NO: 2753246 - protein, 10 aa, Entamoeba invadens
EKTQSRCGSF

SEQ ID NO: 2753247 - protein, 4 aa, Entamoeba invadens
EKTR

SEQ ID NO: 2753248 - protein, 12 aa, Entamoeba invadens
EKTRKLDELLVD

SEQ ID NO: 2753249 - protein, 10 aa, Entamoeba invadens
EKTRTPKGIQ

SEQ ID NO: 2753250 - protein, 5 aa, Entamoeba invadens
EKTSE

SEQ ID NO: 2753251 - protein, 9 aa, Entamoeba invadens
EKTSGNCST

SEQ ID NO: 2753252 - protein, 9 aa, Entamoeba invadens
EKTSGNCTT

SEQ ID NO: 2753253 - protein, 16 aa, Entamoeba invadens
EKTSKSPTDINSAAKS

SEQ ID NO: 2753254 - protein, 11 aa, Entamoeba invadens
EKTSNNQMKLE

SEQ ID NO: 2753255 - protein, 8 aa, Entamoeba invadens
EKTSTEIE

SEQ ID NO: 2753256 - protein, 4 aa, Entamoeba invadens
EKTT

SEQ ID NO: 2753257 - protein, 8 aa, Entamoeba invadens
EKTTGNNY

SEQ ID NO: 2753258 - protein, 7 aa, Entamoeba invadens
EKTTQKM

SEQ ID NO: 2753259 - protein, 7 aa, Entamoeba invadens
EKTTRID

SEQ ID NO: 2753260 - protein, 20 aa, Entamoeba invadens
EKTVTPEKTPSPAPPKNDDD

SEQ ID NO: 2753261 - protein, 11 aa, Entamoeba invadens
EKVAPGTTQFE

SEQ ID NO: 2753262 - protein, 6 aa, Entamoeba invadens
EKVDNE

SEQ ID NO: 2753263 - protein, 14 aa, Entamoeba invadens
EKVENSKSKIEKVE

SEQ ID NO: 2753264 - protein, 18 aa, Entamoeba invadens
EKVEPATTEEVKSIKTKL

SEQ ID NO: 2753265 - protein, 6 aa, Entamoeba invadens
EKVGFD

SEQ ID NO: 2753266 - protein, 26 aa, Entamoeba invadens
EKVGTESAIKSTPTTPPQIPSQQDVK

SEQ ID NO: 2753267 - protein, 4 aa, Entamoeba invadens
EKVK

SEQ ID NO: 2753268 - protein, 5 aa, Entamoeba invadens
EKVNE

SEQ ID NO: 2753269 - protein, 4 aa, Entamoeba invadens
EKVQ

SEQ ID NO: 2753270 - protein, 6 aa, Entamoeba invadens
EKVQHP

SEQ ID NO: 2753271 - protein, 7 aa, Entamoeba invadens
EKVQKQA

SEQ ID NO: 2753272 - protein, 13 aa, Entamoeba invadens
EKVSAKLTDFGSA

SEQ ID NO: 2753273 - protein, 15 aa, Entamoeba invadens
EKVSAKLTDFGSSRN

SEQ ID NO: 2753274 - protein, 7 aa, Entamoeba invadens
EKVSGHK

SEQ ID NO: 2753275 - protein, 10 aa, Entamoeba invadens
EKVSKSVELR

SEQ ID NO: 2753276 - protein, 24 aa, Entamoeba invadens
EKVTPLPAAPSGSDNAYILFYRLV

SEQ ID NO: 2753277 - protein, 14 aa, Entamoeba invadens
EKWTNSDEKKMENL

SEQ ID NO: 2753278 - protein, 7 aa, Entamoeba invadens
EKYATGN

SEQ ID NO: 2753279 - protein, 9 aa, Entamoeba invadens
EKYEDPTQT

SEQ ID NO: 2753280 - protein, 7 aa, Entamoeba invadens
EKYETLN

SEQ ID NO: 2753281 - protein, 8 aa, Entamoeba invadens
EKYGASDC

SEQ ID NO: 2753282 - protein, 9 aa, Entamoeba invadens
EKYGENNPI

SEQ ID NO: 2753283 - protein, 7 aa, Entamoeba invadens
EKYGGES

SEQ ID NO: 2753284 - protein, 8 aa, Entamoeba invadens
EKYKETSD

SEQ ID NO: 2753285 - protein, 7 aa, Entamoeba invadens
EKYKKAA

SEQ ID NO: 2753286 - protein, 4 aa, Entamoeba invadens
EKYN

SEQ ID NO: 2753287 - protein, 5 aa, Entamoeba invadens
EKYNK

SEQ ID NO: 2753288 - protein, 8 aa, Entamoeba invadens
EKYNSDGK

SEQ ID NO: 2753289 - protein, 4 aa, Entamoeba invadens
EKYP

SEQ ID NO: 2753290 - protein, 9 aa, Entamoeba invadens
EKYPEKTGR

SEQ ID NO: 2753291 - protein, 6 aa, Entamoeba invadens
EKYQLP

SEQ ID NO: 2753292 - protein, 7 aa, Entamoeba invadens
EKYQMPS

SEQ ID NO: 2753293 - protein, 7 aa, Entamoeba invadens
EKYQNYR

SEQ ID NO: 2753294 - protein, 8 aa, Entamoeba invadens
EKYQTPAD

SEQ ID NO: 2753295 - protein, 6 aa, Entamoeba invadens
EKYRMP

SEQ ID NO: 2753296 - protein, 9 aa, Entamoeba invadens
EKYRSADEK

SEQ ID NO: 2753297 - protein, 11 aa, Entamoeba invadens
EKYSNSSNNVT

SEQ ID NO: 2753298 - protein, 9 aa, Entamoeba invadens
EKYSTSTSC

SEQ ID NO: 2753299 - protein, 8 aa, Entamoeba invadens
EKYTKSAD

SEQ ID NO: 2753300 - protein, 7 aa, Entamoeba invadens
EKYTMSS

SEQ ID NO: 2753301 - protein, 9 aa, Entamoeba invadens
EKYTNPELC

SEQ ID NO: 2753302 - protein, 16 aa, Entamoeba invadens
EKYTQEQTSPSYEEIT

SEQ ID NO: 2753303 - protein, 7 aa, Entamoeba invadens
EKYTSNK

SEQ ID NO: 2753304 - protein, 4 aa, Entamoeba invadens
EKYV

SEQ ID NO: 2753305 - protein, 19 aa, Entamoeba invadens
EKYYKDTKRAELQRKRHRT

SEQ ID NO: 2753306 - protein, 14 aa, Entamoeba invadens
ELAESEEACSASGQ

SEQ ID NO: 2753307 - protein, 5 aa, Entamoeba invadens
ELAKK

SEQ ID NO: 2753308 - protein, 22 aa, Entamoeba invadens
ELCENGKVTKCDSSSKMDTNGM

SEQ ID NO: 2753309 - protein, 8 aa, Entamoeba invadens
ELDDEGKV

SEQ ID NO: 2753310 - protein, 5 aa, Entamoeba invadens
ELDEM

SEQ ID NO: 2753311 - protein, 10 aa, Entamoeba invadens
ELDGESNLKQ

SEQ ID NO: 2753312 - protein, 23 aa, Entamoeba invadens
ELDKDDSMNSDNNDSINSNNSES

SEQ ID NO: 2753313 - protein, 7 aa, Entamoeba invadens
ELDKEVR

SEQ ID NO: 2753314 - protein, 12 aa, Entamoeba invadens
ELEEEKKLGEGS

SEQ ID NO: 2753315 - protein, 8 aa, Entamoeba invadens
ELEEKTPI

SEQ ID NO: 2753316 - protein, 5 aa, Entamoeba invadens
ELEES

SEQ ID NO: 2753317 - protein, 12 aa, Entamoeba invadens
ELEESAPGKKKA

SEQ ID NO: 2753318 - protein, 6 aa, Entamoeba invadens
ELEGRT

SEQ ID NO: 2753319 - protein, 11 aa, Entamoeba invadens
ELEKDSGCPNS

SEQ ID NO: 2753320 - protein, 19 aa, Entamoeba invadens
ELEKNPEKSVDDVEDKLNE

SEQ ID NO: 2753321 - protein, 9 aa, Entamoeba invadens
ELEKQAKGL

SEQ ID NO: 2753322 - protein, 6 aa, Entamoeba invadens
ELEKTT

SEQ ID NO: 2753323 - protein, 7 aa, Entamoeba invadens
ELERSPE

SEQ ID NO: 2753324 - protein, 6 aa, Entamoeba invadens
ELESHQ

SEQ ID NO: 2753325 - protein, 7 aa, Entamoeba invadens
ELFGQST

SEQ ID NO: 2753326 - protein, 20 aa, Entamoeba invadens
ELGRLDSSEALRGAPDKQPQ

SEQ ID NO: 2753327 - protein, 9 aa, Entamoeba invadens
ELHPKSSPT

SEQ ID NO: 2753328 - protein, 23 aa, Entamoeba invadens
ELKDTKEIAKEKHKGKPSPTTRV

SEQ ID NO: 2753329 - protein, 12 aa, Entamoeba invadens
ELKDTKKIGEGT

SEQ ID NO: 2753330 - protein, 5 aa, Entamoeba invadens
ELKED

SEQ ID NO: 2753331 - protein, 5 aa, Entamoeba invadens
ELKEE

SEQ ID NO: 2753332 - protein, 12 aa, Entamoeba invadens
ELKEENKLGEGS

SEQ ID NO: 2753333 - protein, 6 aa, Entamoeba invadens
ELKEEY

SEQ ID NO: 2753334 - protein, 15 aa, Entamoeba invadens
ELKEGLEKQNEENLK

SEQ ID NO: 2753335 - protein, 12 aa, Entamoeba invadens
ELKEKNKIGEGS

SEQ ID NO: 2753336 - protein, 6 aa, Entamoeba invadens
ELKETA

SEQ ID NO: 2753337 - protein, 7 aa, Entamoeba invadens
ELKGKTV

SEQ ID NO: 2753338 - protein, 11 aa, Entamoeba invadens
ELKKSDLASSQ

SEQ ID NO: 2753339 - protein, 4 aa, Entamoeba invadens
ELKL

SEQ ID NO: 2753340 - protein, 12 aa, Entamoeba invadens
ELKPADKCNSTS

SEQ ID NO: 2753341 - protein, 4 aa, Entamoeba invadens
ELKQ

SEQ ID NO: 2753342 - protein, 18 aa, Entamoeba invadens
ELKQNTEKVNNKGITSCQ

SEQ ID NO: 2753343 - protein, 5 aa, Entamoeba invadens
ELKSG

SEQ ID NO: 2753344 - protein, 15 aa, Entamoeba invadens
ELKSSHAKEQCTEEK

SEQ ID NO: 2753345 - protein, 8 aa, Entamoeba invadens
ELKTKRPS

SEQ ID NO: 2753346 - protein, 10 aa, Entamoeba invadens
ELKTSAAVNG

SEQ ID NO: 2753347 - protein, 8 aa, Entamoeba invadens
ELKTTGTS

SEQ ID NO: 2753348 - protein, 25 aa, Entamoeba invadens
ELLQQQEAKRKEIQRRRDALKSDSI

SEQ ID NO: 2753349 - protein, 12 aa, Entamoeba invadens
ELMEPKPDEILK

SEQ ID NO: 2753350 - protein, 14 aa, Entamoeba invadens
ELNEAKKGTEKNLN

SEQ ID NO: 2753351 - protein, 12 aa, Entamoeba invadens
ELNEENKIGEGS

SEQ ID NO: 2753352 - protein, 12 aa, Entamoeba invadens
ELNNHKPTNAEY

SEQ ID NO: 2753353 - protein, 4 aa, Entamoeba invadens
ELNT

SEQ ID NO: 2753354 - protein, 10 aa, Entamoeba invadens
ELNVTEDEKC

SEQ ID NO: 2753355 - protein, 7 aa, Entamoeba invadens
ELPEDLR

SEQ ID NO: 2753356 - protein, 7 aa, Entamoeba invadens
ELPETGD

SEQ ID NO: 2753357 - protein, 9 aa, Entamoeba invadens
ELPKGKNRD

SEQ ID NO: 2753358 - protein, 7 aa, Entamoeba invadens
ELPPDVD

SEQ ID NO: 2753359 - protein, 7 aa, Entamoeba invadens
ELPPPAG

SEQ ID NO: 2753360 - protein, 11 aa, Entamoeba invadens
ELPPPAGSGNV

SEQ ID NO: 2753361 - protein, 26 aa, Entamoeba invadens
ELPQNQDTRSKKYKEQNFKQTDEKID

SEQ ID NO: 2753362 - protein, 9 aa, Entamoeba invadens
ELQDESESL

SEQ ID NO: 2753363 - protein, 4 aa, Entamoeba invadens
ELQE

SEQ ID NO: 2753364 - protein, 12 aa, Entamoeba invadens
ELQEEKKLGAGS

SEQ ID NO: 2753365 - protein, 12 aa, Entamoeba invadens
ELQETKQIGEGS

SEQ ID NO: 2753366 - protein, 11 aa, Entamoeba invadens
ELQPLGEEYGQ

SEQ ID NO: 2753367 - protein, 34 aa, Entamoeba invadens
ELQPQTIESSQRVSSESSPRRAQSLEPEKINTDQ

SEQ ID NO: 2753368 - protein, 8 aa, Entamoeba invadens
ELRADNDY

SEQ ID NO: 2753369 - protein, 10 aa, Entamoeba invadens
ELRNSDLAEA

SEQ ID NO: 2753370 - protein, 4 aa, Entamoeba invadens
ELSE

SEQ ID NO: 2753371 - protein, 8 aa, Entamoeba invadens
ELSEEEEM

SEQ ID NO: 2753372 - protein, 8 aa, Entamoeba invadens
ELSESERN

SEQ ID NO: 2753373 - protein, 4 aa, Entamoeba invadens
ELSG

SEQ ID NO: 2753374 - protein, 5 aa, Entamoeba invadens
ELSKH

SEQ ID NO: 2753375 - protein, 11 aa, Entamoeba invadens
ELSKSPKPKSM

SEQ ID NO: 2753376 - protein, 7 aa, Entamoeba invadens
ELSLEGN

SEQ ID NO: 2753377 - protein, 4 aa, Entamoeba invadens
ELSN

SEQ ID NO: 2753378 - protein, 6 aa, Entamoeba invadens
ELSNGE

SEQ ID NO: 2753379 - protein, 5 aa, Entamoeba invadens
ELSQD

SEQ ID NO: 2753380 - protein, 4 aa, Entamoeba invadens
ELSS

SEQ ID NO: 2753381 - protein, 5 aa, Entamoeba invadens
ELSSN

SEQ ID NO: 2753382 - protein, 13 aa, Entamoeba invadens
ELSSNSKINLSGN

SEQ ID NO: 2753383 - protein, 10 aa, Entamoeba invadens
ELSSSTIDLE

SEQ ID NO: 2753384 - protein, 4 aa, Entamoeba invadens
ELST

SEQ ID NO: 2753385 - protein, 11 aa, Entamoeba invadens
ELTDDSNRTQT

SEQ ID NO: 2753386 - protein, 11 aa, Entamoeba invadens
ELTDNKKEEEV

SEQ ID NO: 2753387 - protein, 4 aa, Entamoeba invadens
ELTE

SEQ ID NO: 2753388 - protein, 12 aa, Entamoeba invadens
ELTEDEKLGEGS

SEQ ID NO: 2753389 - protein, 12 aa, Entamoeba invadens
ELTEGKKLGQGS

SEQ ID NO: 2753390 - protein, 11 aa, Entamoeba invadens
ELTEKEGEEKG

SEQ ID NO: 2753391 - protein, 7 aa, Entamoeba invadens
ELTEPAR

SEQ ID NO: 2753392 - protein, 6 aa, Entamoeba invadens
ELTGNS

SEQ ID NO: 2753393 - protein, 8 aa, Entamoeba invadens
ELTKDRPK

SEQ ID NO: 2753394 - protein, 6 aa, Entamoeba invadens
ELTKNK

SEQ ID NO: 2753395 - protein, 11 aa, Entamoeba invadens
ELTQDNPSQRG

SEQ ID NO: 2753396 - protein, 6 aa, Entamoeba invadens
ELTTAS

SEQ ID NO: 2753397 - protein, 6 aa, Entamoeba invadens
ELTTKE

SEQ ID NO: 2753398 - protein, 8 aa, Entamoeba invadens
ELTTTNNQ

SEQ ID NO: 2753399 - protein, 10 aa, Entamoeba invadens
ELYKNEDGKW

SEQ ID NO: 2753400 - protein, 4 aa, Entamoeba invadens
ELYR

SEQ ID NO: 2753401 - protein, 13 aa, Entamoeba invadens
EMDEENTEGDSQV

SEQ ID NO: 2753402 - protein, 4 aa, Entamoeba invadens
EMDN

SEQ ID NO: 2753403 - protein, 7 aa, Entamoeba invadens
EMDTTTT

SEQ ID NO: 2753404 - protein, 19 aa, Entamoeba invadens
EMEKQNKEENMEVEPAPSN

SEQ ID NO: 2753405 - protein, 13 aa, Entamoeba invadens
EMENETTSTTEED

SEQ ID NO: 2753406 - protein, 19 aa, Entamoeba invadens
EMERQKKEEEIKVEPAPSN

SEQ ID NO: 2753407 - protein, 6 aa, Entamoeba invadens
EMESKE

SEQ ID NO: 2753408 - protein, 9 aa, Entamoeba invadens
EMGKPNQYT

SEQ ID NO: 2753409 - protein, 5 aa, Entamoeba invadens
EMGLT

SEQ ID NO: 2753410 - protein, 10 aa, Entamoeba invadens
EMGTDEDKIR

SEQ ID NO: 2753411 - protein, 12 aa, Entamoeba invadens
EMKKKAEELQRT

SEQ ID NO: 2753412 - protein, 11 aa, Entamoeba invadens
EMKRESKSFEA

SEQ ID NO: 2753413 - protein, 4 aa, Entamoeba invadens
EMNA

SEQ ID NO: 2753414 - protein, 13 aa, Entamoeba invadens
EMNEENTEGDSQV

SEQ ID NO: 2753415 - protein, 5 aa, Entamoeba invadens
EMNEK

SEQ ID NO: 2753416 - protein, 5 aa, Entamoeba invadens
EMNEN

SEQ ID NO: 2753417 - protein, 10 aa, Entamoeba invadens
EMNENSQLTI

SEQ ID NO: 2753418 - protein, 9 aa, Entamoeba invadens
EMNKSGALA

SEQ ID NO: 2753419 - protein, 8 aa, Entamoeba invadens
EMNQQSEV

SEQ ID NO: 2753420 - protein, 11 aa, Entamoeba invadens
EMNSNSTEKSV

SEQ ID NO: 2753421 - protein, 4 aa, Entamoeba invadens
EMPV

SEQ ID NO: 2753422 - protein, 13 aa, Entamoeba invadens
EMQEDVKYAKSNK

SEQ ID NO: 2753423 - protein, 7 aa, Entamoeba invadens
EMSGCTT

SEQ ID NO: 2753424 - protein, 13 aa, Entamoeba invadens
EMSGKSQMSIGGN

SEQ ID NO: 2753425 - protein, 11 aa, Entamoeba invadens
EMSTRLDPDEL

SEQ ID NO: 2753426 - protein, 5 aa, Entamoeba invadens
EMSVE

SEQ ID NO: 2753427 - protein, 8 aa, Entamoeba invadens
EMTKDETY

SEQ ID NO: 2753428 - protein, 6 aa, Entamoeba invadens
EMTNYQ

SEQ ID NO: 2753429 - protein, 7 aa, Entamoeba invadens
EMTYSTA

SEQ ID NO: 2753430 - protein, 11 aa, Entamoeba invadens
EMTYSTAGSLS

SEQ ID NO: 2753431 - protein, 14 aa, Entamoeba invadens
EMTYSTGGSPSCQQ

SEQ ID NO: 2753432 - protein, 5 aa, Entamoeba invadens
ENAAN

SEQ ID NO: 2753433 - protein, 29 aa, Entamoeba invadens
ENADSKPLKKKEKKDKRKKGDLKEVKPQE

SEQ ID NO: 2753434 - protein, 8 aa, Entamoeba invadens
ENAEDSKC

SEQ ID NO: 2753435 - protein, 6 aa, Entamoeba invadens
ENAEGI

SEQ ID NO: 2753436 - protein, 26 aa, Entamoeba invadens
ENAENNKCAKCSDNKIPSEDGASCID

SEQ ID NO: 2753437 - protein, 14 aa, Entamoeba invadens
ENAFQSDLSGSGNN

SEQ ID NO: 2753438 - protein, 4 aa, Entamoeba invadens
ENAG

SEQ ID NO: 2753439 - protein, 44 aa, Entamoeba invadens
ENAIQSDEIQHGETQESHSETSEQREVHKDEKGMFADEEKEEGT

SEQ ID NO: 2753440 - protein, 7 aa, Entamoeba invadens
ENAMETH

SEQ ID NO: 2753441 - protein, 4 aa, Entamoeba invadens
ENAQ

SEQ ID NO: 2753442 - protein, 7 aa, Entamoeba invadens
ENAQMEE

SEQ ID NO: 2753443 - protein, 7 aa, Entamoeba invadens
ENARLSV

SEQ ID NO: 2753444 - protein, 5 aa, Entamoeba invadens
ENART

SEQ ID NO: 2753445 - protein, 6 aa, Entamoeba invadens
ENASRR

SEQ ID NO: 2753446 - protein, 4 aa, Entamoeba invadens
ENAT

SEQ ID NO: 2753447 - protein, 6 aa, Entamoeba invadens
ENATKG

SEQ ID NO: 2753448 - protein, 7 aa, Entamoeba invadens
ENATLES

SEQ ID NO: 2753449 - protein, 21 aa, Entamoeba invadens
ENCDENCESTEFCSSQNGCTK

SEQ ID NO: 2753450 - protein, 25 aa, Entamoeba invadens
ENCEEAKDSKCTRCKGSHEPSTEGD

SEQ ID NO: 2753451 - protein, 5 aa, Entamoeba invadens
ENCEN

SEQ ID NO: 2753452 - protein, 7 aa, Entamoeba invadens
ENCKTGK

SEQ ID NO: 2753453 - protein, 13 aa, Entamoeba invadens
ENCNSCDSKNKNC

SEQ ID NO: 2753454 - protein, 9 aa, Entamoeba invadens
ENCNTCSES

SEQ ID NO: 2753455 - protein, 7 aa, Entamoeba invadens
ENCNTKD

SEQ ID NO: 2753456 - protein, 4 aa, Entamoeba invadens
ENCS

SEQ ID NO: 2753457 - protein, 7 aa, Entamoeba invadens
ENCSSCD

SEQ ID NO: 2753458 - protein, 7 aa, Entamoeba invadens
ENCTKTD

SEQ ID NO: 2753459 - protein, 6 aa, Entamoeba invadens
ENCTQS

SEQ ID NO: 2753460 - protein, 12 aa, Entamoeba invadens
ENDCQRAQQNLE

SEQ ID NO: 2753461 - protein, 4 aa, Entamoeba invadens
ENDD

SEQ ID NO: 2753462 - protein, 8 aa, Entamoeba invadens
ENDDQIDS

SEQ ID NO: 2753463 - protein, 7 aa, Entamoeba invadens
ENDEGKQ

SEQ ID NO: 2753464 - protein, 7 aa, Entamoeba invadens
ENDEKQY

SEQ ID NO: 2753465 - protein, 6 aa, Entamoeba invadens
ENDEMD

SEQ ID NO: 2753466 - protein, 8 aa, Entamoeba invadens
ENDKKSEI

SEQ ID NO: 2753467 - protein, 15 aa, Entamoeba invadens
ENDKVNAKLTDFGSA

SEQ ID NO: 2753468 - protein, 6 aa, Entamoeba invadens
ENDNEL

SEQ ID NO: 2753469 - protein, 9 aa, Entamoeba invadens
ENDNPDSGV

SEQ ID NO: 2753470 - protein, 5 aa, Entamoeba invadens
ENDSY

SEQ ID NO: 2753471 - protein, 4 aa, Entamoeba invadens
ENDT

SEQ ID NO: 2753472 - protein, 10 aa, Entamoeba invadens
ENDVQNTTSV

SEQ ID NO: 2753473 - protein, 5 aa, Entamoeba invadens
ENECK

SEQ ID NO: 2753474 - protein, 12 aa, Entamoeba invadens
ENEDQKEVQPNN

SEQ ID NO: 2753475 - protein, 6 aa, Entamoeba invadens
ENEEIS

SEQ ID NO: 2753476 - protein, 54 aa, Entamoeba invadens
ENEGTPKVETCERPKGVTNEVSDIKTSIREKCSQQENNTLSSQNTLRSFGPRTK

SEQ ID NO: 2753477 - protein, 4 aa, Entamoeba invadens
ENEI

SEQ ID NO: 2753478 - protein, 15 aa, Entamoeba invadens
ENEKNSSSENVDESA

SEQ ID NO: 2753479 - protein, 28 aa, Entamoeba invadens
ENEKQISVNENTPLQDMKNESKEEKAPL

SEQ ID NO: 2753480 - protein, 14 aa, Entamoeba invadens
ENEKTGESVSISTG

SEQ ID NO: 2753481 - protein, 17 aa, Entamoeba invadens
ENEKTSVKISGDSGTGF

SEQ ID NO: 2753482 - protein, 8 aa, Entamoeba invadens
ENEKVNAK

SEQ ID NO: 2753483 - protein, 4 aa, Entamoeba invadens
ENEL

SEQ ID NO: 2753484 - protein, 27 aa, Entamoeba invadens
ENENLKTESESIREKQLESERQSEKEV

SEQ ID NO: 2753485 - protein, 8 aa, Entamoeba invadens
ENENYDEQ

SEQ ID NO: 2753486 - protein, 23 aa, Entamoeba invadens
ENEPTKRSSLENVKYELETLFNY

SEQ ID NO: 2753487 - protein, 7 aa, Entamoeba invadens
ENERYAR

SEQ ID NO: 2753488 - protein, 6 aa, Entamoeba invadens
ENESIT

SEQ ID NO: 2753489 - protein, 56 aa, Entamoeba invadens
ENESNTSEEKDDHNEKSENTIEKQHNTTVIPPHDNLDEGLNDHNSSQNGLPTKDST

SEQ ID NO: 2753490 - protein, 6 aa, Entamoeba invadens
ENETKC

SEQ ID NO: 2753491 - protein, 12 aa, Entamoeba invadens
ENETLDSSTDQN

SEQ ID NO: 2753492 - protein, 6 aa, Entamoeba invadens
ENETSE

SEQ ID NO: 2753493 - protein, 9 aa, Entamoeba invadens
ENETSTKNC

SEQ ID NO: 2753494 - protein, 14 aa, Entamoeba invadens
ENETSTKNCTESVS

SEQ ID NO: 2753495 - protein, 7 aa, Entamoeba invadens
ENETYDF

SEQ ID NO: 2753496 - protein, 13 aa, Entamoeba invadens
ENEVKDENGNCSS

SEQ ID NO: 2753497 - protein, 11 aa, Entamoeba invadens
ENEVPTVSGFS

SEQ ID NO: 2753498 - protein, 4 aa, Entamoeba invadens
ENFK

SEQ ID NO: 2753499 - protein, 5 aa, Entamoeba invadens
ENGAA

SEQ ID NO: 2753500 - protein, 5 aa, Entamoeba invadens
ENGAV

SEQ ID NO: 2753501 - protein, 14 aa, Entamoeba invadens
ENGCDSKTGNCKTC

SEQ ID NO: 2753502 - protein, 4 aa, Entamoeba invadens
ENGD

SEQ ID NO: 2753503 - protein, 7 aa, Entamoeba invadens
ENGDNRM

SEQ ID NO: 2753504 - protein, 9 aa, Entamoeba invadens
ENGDYPNSA

SEQ ID NO: 2753505 - protein, 4 aa, Entamoeba invadens
ENGE

SEQ ID NO: 2753506 - protein, 8 aa, Entamoeba invadens
ENGENFSL

SEQ ID NO: 2753507 - protein, 5 aa, Entamoeba invadens
ENGER

SEQ ID NO: 2753508 - protein, 14 aa, Entamoeba invadens
ENGESHSKCESCAD

SEQ ID NO: 2753509 - protein, 6 aa, Entamoeba invadens
ENGETL

SEQ ID NO: 2753510 - protein, 16 aa, Entamoeba invadens
ENGEWDPKGSDGINRG

SEQ ID NO: 2753511 - protein, 10 aa, Entamoeba invadens
ENGFKNNQEI

SEQ ID NO: 2753512 - protein, 21 aa, Entamoeba invadens
ENGGTLTNGKCTKDPNCARSS

SEQ ID NO: 2753513 - protein, 4 aa, Entamoeba invadens
ENGI

SEQ ID NO: 2753514 - protein, 40 aa, Entamoeba invadens
ENGITQEGKVLKGSEESVDSKEVAKESTPLPSPDEKLTPE

SEQ ID NO: 2753515 - protein, 17 aa, Entamoeba invadens
ENGKATKCDSSSQMDTN

SEQ ID NO: 2753516 - protein, 20 aa, Entamoeba invadens
ENGKITKCDNSSQMNTNGKC

SEQ ID NO: 2753517 - protein, 13 aa, Entamoeba invadens
ENGKLTKCENNSF

SEQ ID NO: 2753518 - protein, 9 aa, Entamoeba invadens
ENGKRCEQC

SEQ ID NO: 2753519 - protein, 11 aa, Entamoeba invadens
ENGKYYGSTGG

SEQ ID NO: 2753520 - protein, 5 aa, Entamoeba invadens
ENGLN

SEQ ID NO: 2753521 - protein, 9 aa, Entamoeba invadens
ENGMPPKYQ

SEQ ID NO: 2753522 - protein, 8 aa, Entamoeba invadens
ENGMTNNK

SEQ ID NO: 2753523 - protein, 11 aa, Entamoeba invadens
ENGNKKCEKCK

SEQ ID NO: 2753524 - protein, 11 aa, Entamoeba invadens
ENGNKKCEKCN

SEQ ID NO: 2753525 - protein, 10 aa, Entamoeba invadens
ENGNKTYKKE

SEQ ID NO: 2753526 - protein, 5 aa, Entamoeba invadens
ENGRC

SEQ ID NO: 2753527 - protein, 6 aa, Entamoeba invadens
ENGSCS

SEQ ID NO: 2753528 - protein, 16 aa, Entamoeba invadens
ENGSFAPNKNDLKKQP

SEQ ID NO: 2753529 - protein, 14 aa, Entamoeba invadens
ENGSITTDTINSTD

SEQ ID NO: 2753530 - protein, 10 aa, Entamoeba invadens
ENGTENEGRT

SEQ ID NO: 2753531 - protein, 9 aa, Entamoeba invadens
ENGTFDSTL

SEQ ID NO: 2753532 - protein, 19 aa, Entamoeba invadens
ENGTKHASNNKDDISRKRS

SEQ ID NO: 2753533 - protein, 5 aa, Entamoeba invadens
ENGTY

SEQ ID NO: 2753534 - protein, 5 aa, Entamoeba invadens
ENGVG

SEQ ID NO: 2753535 - protein, 5 aa, Entamoeba invadens
ENGYF

SEQ ID NO: 2753536 - protein, 6 aa, Entamoeba invadens
ENHNNK

SEQ ID NO: 2753537 - protein, 6 aa, Entamoeba invadens
ENHRPE

SEQ ID NO: 2753538 - protein, 35 aa, Entamoeba invadens
ENHSQVSENTTTKTNEELKDKSSKDSTGAKEAEDI

SEQ ID NO: 2753539 - protein, 6 aa, Entamoeba invadens
ENIESG

SEQ ID NO: 2753540 - protein, 13 aa, Entamoeba invadens
ENIGDTSSSEEEV

SEQ ID NO: 2753541 - protein, 5 aa, Entamoeba invadens
ENIGT

SEQ ID NO: 2753542 - protein, 14 aa, Entamoeba invadens
ENINFPGSLSDSET

SEQ ID NO: 2753543 - protein, 5 aa, Entamoeba invadens
ENINS

SEQ ID NO: 2753544 - protein, 7 aa, Entamoeba invadens
ENIRSGQ

SEQ ID NO: 2753545 - protein, 4 aa, Entamoeba invadens
ENKA

SEQ ID NO: 2753546 - protein, 17 aa, Entamoeba invadens
ENKARKYKEQITNKQGG

SEQ ID NO: 2753547 - protein, 8 aa, Entamoeba invadens
ENKCSNCS

SEQ ID NO: 2753548 - protein, 6 aa, Entamoeba invadens
ENKDAK

SEQ ID NO: 2753549 - protein, 14 aa, Entamoeba invadens
ENKDTNCHKYSKTT

SEQ ID NO: 2753550 - protein, 6 aa, Entamoeba invadens
ENKDVT

SEQ ID NO: 2753551 - protein, 4 aa, Entamoeba invadens
ENKE

SEQ ID NO: 2753552 - protein, 6 aa, Entamoeba invadens
ENKKEI

SEQ ID NO: 2753553 - protein, 9 aa, Entamoeba invadens
ENKKGEVYD

SEQ ID NO: 2753554 - protein, 8 aa, Entamoeba invadens
ENKKGMKP

SEQ ID NO: 2753555 - protein, 32 aa, Entamoeba invadens
ENKKKKKDFDSFNDSENTTSEMDRSAEEVDSE

SEQ ID NO: 2753556 - protein, 5 aa, Entamoeba invadens
ENKKL

SEQ ID NO: 2753557 - protein, 10 aa, Entamoeba invadens
ENKKNTCSKC

SEQ ID NO: 2753558 - protein, 5 aa, Entamoeba invadens
ENKMK

SEQ ID NO: 2753559 - protein, 7 aa, Entamoeba invadens
ENKNDNY

SEQ ID NO: 2753560 - protein, 8 aa, Entamoeba invadens
ENKNKEHI

SEQ ID NO: 2753561 - protein, 9 aa, Entamoeba invadens
ENKNKPKLV

SEQ ID NO: 2753562 - protein, 8 aa, Entamoeba invadens
ENKNVQNS

SEQ ID NO: 2753563 - protein, 9 aa, Entamoeba invadens
ENKNVQNSE

SEQ ID NO: 2753564 - protein, 7 aa, Entamoeba invadens
ENKREEY

SEQ ID NO: 2753565 - protein, 4 aa, Entamoeba invadens
ENKT

SEQ ID NO: 2753566 - protein, 6 aa, Entamoeba invadens
ENKTKY

SEQ ID NO: 2753567 - protein, 6 aa, Entamoeba invadens
ENKTTV

SEQ ID NO: 2753568 - protein, 5 aa, Entamoeba invadens
ENKTV

SEQ ID NO: 2753569 - protein, 12 aa, Entamoeba invadens
ENKTYTTTSPYT

SEQ ID NO: 2753570 - protein, 5 aa, Entamoeba invadens
ENLAP

SEQ ID NO: 2753571 - protein, 10 aa, Entamoeba invadens
ENLIPKDTEV

SEQ ID NO: 2753572 - protein, 17 aa, Entamoeba invadens
ENLKSSPSTPRTPNQEY

SEQ ID NO: 2753573 - protein, 5 aa, Entamoeba invadens
ENLSE

SEQ ID NO: 2753574 - protein, 5 aa, Entamoeba invadens
ENLVS

SEQ ID NO: 2753575 - protein, 14 aa, Entamoeba invadens
ENNANNEIPVNKET

SEQ ID NO: 2753576 - protein, 6 aa, Entamoeba invadens
ENNCEK

SEQ ID NO: 2753577 - protein, 9 aa, Entamoeba invadens
ENNCKTCST

SEQ ID NO: 2753578 - protein, 8 aa, Entamoeba invadens
ENNDVSCN

SEQ ID NO: 2753579 - protein, 7 aa, Entamoeba invadens
ENNEGVS

SEQ ID NO: 2753580 - protein, 6 aa, Entamoeba invadens
ENNEKM

SEQ ID NO: 2753581 - protein, 7 aa, Entamoeba invadens
ENNENNE

SEQ ID NO: 2753582 - protein, 6 aa, Entamoeba invadens
ENNEVG

SEQ ID NO: 2753583 - protein, 8 aa, Entamoeba invadens
ENNGFSTG

SEQ ID NO: 2753584 - protein, 11 aa, Entamoeba invadens
ENNGNQYESED

SEQ ID NO: 2753585 - protein, 9 aa, Entamoeba invadens
ENNGSQNIE

SEQ ID NO: 2753586 - protein, 11 aa, Entamoeba invadens
ENNKKPSNDGL

SEQ ID NO: 2753587 - protein, 10 aa, Entamoeba invadens
ENNNLREGTT

SEQ ID NO: 2753588 - protein, 7 aa, Entamoeba invadens
ENNNTND

SEQ ID NO: 2753589 - protein, 4 aa, Entamoeba invadens
ENNP

SEQ ID NO: 2753590 - protein, 5 aa, Entamoeba invadens
ENNPH

SEQ ID NO: 2753591 - protein, 6 aa, Entamoeba invadens
ENNRIS

SEQ ID NO: 2753592 - protein, 7 aa, Entamoeba invadens
ENNSNSS

SEQ ID NO: 2753593 - protein, 8 aa, Entamoeba invadens
ENNTDYEL

SEQ ID NO: 2753594 - protein, 5 aa, Entamoeba invadens
ENNTF

SEQ ID NO: 2753595 - protein, 6 aa, Entamoeba invadens
ENNTNY

SEQ ID NO: 2753596 - protein, 7 aa, Entamoeba invadens
ENNTSVT

SEQ ID NO: 2753597 - protein, 9 aa, Entamoeba invadens
ENNTVEQQS

SEQ ID NO: 2753598 - protein, 4 aa, Entamoeba invadens
ENNV

SEQ ID NO: 2753599 - protein, 7 aa, Entamoeba invadens
ENNYPST

SEQ ID NO: 2753600 - protein, 7 aa, Entamoeba invadens
ENNYTSC

SEQ ID NO: 2753601 - protein, 9 aa, Entamoeba invadens
ENPAIGPSV

SEQ ID NO: 2753602 - protein, 5 aa, Entamoeba invadens
ENPDN

SEQ ID NO: 2753603 - protein, 5 aa, Entamoeba invadens
ENPFF

SEQ ID NO: 2753604 - protein, 4 aa, Entamoeba invadens
ENPI

SEQ ID NO: 2753605 - protein, 8 aa, Entamoeba invadens
ENPIAEGA

SEQ ID NO: 2753606 - protein, 6 aa, Entamoeba invadens
ENPIAS

SEQ ID NO: 2753607 - protein, 5 aa, Entamoeba invadens
ENPLR

SEQ ID NO: 2753608 - protein, 7 aa, Entamoeba invadens
ENPNEGV

SEQ ID NO: 2753609 - protein, 6 aa, Entamoeba invadens
ENPPNA

SEQ ID NO: 2753610 - protein, 7 aa, Entamoeba invadens
ENPQDRV

SEQ ID NO: 2753611 - protein, 7 aa, Entamoeba invadens
ENPQLNR

SEQ ID NO: 2753612 - protein, 7 aa, Entamoeba invadens
ENPQMGE

SEQ ID NO: 2753613 - protein, 10 aa, Entamoeba invadens
ENPREVTKSE

SEQ ID NO: 2753614 - protein, 5 aa, Entamoeba invadens
ENPVE

SEQ ID NO: 2753615 - protein, 15 aa, Entamoeba invadens
ENQCIKDGQTPCSGD

SEQ ID NO: 2753616 - protein, 15 aa, Entamoeba invadens
ENQCQKCNEKCSTCT

SEQ ID NO: 2753617 - protein, 7 aa, Entamoeba invadens
ENQEKTY

SEQ ID NO: 2753618 - protein, 4 aa, Entamoeba invadens
ENQI

SEQ ID NO: 2753619 - protein, 6 aa, Entamoeba invadens
ENQINS

SEQ ID NO: 2753620 - protein, 4 aa, Entamoeba invadens
ENQK

SEQ ID NO: 2753621 - protein, 8 aa, Entamoeba invadens
ENQKCTKC

SEQ ID NO: 2753622 - protein, 9 aa, Entamoeba invadens
ENQKETISC

SEQ ID NO: 2753623 - protein, 7 aa, Entamoeba invadens
ENQKRQV

SEQ ID NO: 2753624 - protein, 9 aa, Entamoeba invadens
ENQNEPNIG

SEQ ID NO: 2753625 - protein, 36 aa, Entamoeba invadens
ENQNVKKQTENIKEIKENAEAVDKKVQEADDTSKHI

SEQ ID NO: 2753626 - protein, 6 aa, Entamoeba invadens
ENQPIQ

SEQ ID NO: 2753627 - protein, 7 aa, Entamoeba invadens
ENQQQVN

SEQ ID NO: 2753628 - protein, 6 aa, Entamoeba invadens
ENQRHT

SEQ ID NO: 2753629 - protein, 9 aa, Entamoeba invadens
ENQTEDYTL

SEQ ID NO: 2753630 - protein, 14 aa, Entamoeba invadens
ENRDDTEPTNAKYV

SEQ ID NO: 2753631 - protein, 6 aa, Entamoeba invadens
ENREEC

SEQ ID NO: 2753632 - protein, 14 aa, Entamoeba invadens
ENREEDNEVGQANG

SEQ ID NO: 2753633 - protein, 7 aa, Entamoeba invadens
ENREGEF

SEQ ID NO: 2753634 - protein, 7 aa, Entamoeba invadens
ENREGIG

SEQ ID NO: 2753635 - protein, 16 aa, Entamoeba invadens
ENREKSPNELAKGAED

SEQ ID NO: 2753636 - protein, 18 aa, Entamoeba invadens
ENRENITANEIEKTQADV

SEQ ID NO: 2753637 - protein, 6 aa, Entamoeba invadens
ENRENL

SEQ ID NO: 2753638 - protein, 9 aa, Entamoeba invadens
ENRFRETGT

SEQ ID NO: 2753639 - protein, 9 aa, Entamoeba invadens
ENRKPVPGK

SEQ ID NO: 2753640 - protein, 11 aa, Entamoeba invadens
ENRNKKCEKCK

SEQ ID NO: 2753641 - protein, 5 aa, Entamoeba invadens
ENRQQ

SEQ ID NO: 2753642 - protein, 4 aa, Entamoeba invadens
ENRS

SEQ ID NO: 2753643 - protein, 8 aa, Entamoeba invadens
ENRTTDSV

SEQ ID NO: 2753644 - protein, 5 aa, Entamoeba invadens
ENSAG

SEQ ID NO: 2753645 - protein, 6 aa, Entamoeba invadens
ENSAKI

SEQ ID NO: 2753646 - protein, 10 aa, Entamoeba invadens
ENSDDLETTH

SEQ ID NO: 2753647 - protein, 5 aa, Entamoeba invadens
ENSDI

SEQ ID NO: 2753648 - protein, 8 aa, Entamoeba invadens
ENSEISKL

SEQ ID NO: 2753649 - protein, 11 aa, Entamoeba invadens
ENSEKTDLDTA

SEQ ID NO: 2753650 - protein, 9 aa, Entamoeba invadens
ENSENKNED

SEQ ID NO: 2753651 - protein, 7 aa, Entamoeba invadens
ENSGSQI

SEQ ID NO: 2753652 - protein, 7 aa, Entamoeba invadens
ENSGSVI

SEQ ID NO: 2753653 - protein, 7 aa, Entamoeba invadens
ENSGTID

SEQ ID NO: 2753654 - protein, 6 aa, Entamoeba invadens
ENSGTY

SEQ ID NO: 2753655 - protein, 7 aa, Entamoeba invadens
ENSGYDV

SEQ ID NO: 2753656 - protein, 9 aa, Entamoeba invadens
ENSHPTVEE

SEQ ID NO: 2753657 - protein, 12 aa, Entamoeba invadens
ENSHRNTNTGEC

SEQ ID NO: 2753658 - protein, 5 aa, Entamoeba invadens
ENSKR

SEQ ID NO: 2753659 - protein, 5 aa, Entamoeba invadens
ENSLE

SEQ ID NO: 2753660 - protein, 4 aa, Entamoeba invadens
ENSM

SEQ ID NO: 2753661 - protein, 15 aa, Entamoeba invadens
ENSNNQNKKPNNSTN

SEQ ID NO: 2753662 - protein, 7 aa, Entamoeba invadens
ENSPGCT

SEQ ID NO: 2753663 - protein, 5 aa, Entamoeba invadens
ENSPV

SEQ ID NO: 2753664 - protein, 9 aa, Entamoeba invadens
ENSPVNCKP

SEQ ID NO: 2753665 - protein, 9 aa, Entamoeba invadens
ENSQNKYTA

SEQ ID NO: 2753666 - protein, 21 aa, Entamoeba invadens
ENSSKLDYDEINEEKQIGRGT

SEQ ID NO: 2753667 - protein, 24 aa, Entamoeba invadens
ENSSQTLQQSTTSLDTEKQLISGN

SEQ ID NO: 2753668 - protein, 12 aa, Entamoeba invadens
ENSSVNFQKSST

SEQ ID NO: 2753669 - protein, 5 aa, Entamoeba invadens
ENSTI

SEQ ID NO: 2753670 - protein, 7 aa, Entamoeba invadens
ENSTKLN

SEQ ID NO: 2753671 - protein, 7 aa, Entamoeba invadens
ENSTLTS

SEQ ID NO: 2753672 - protein, 5 aa, Entamoeba invadens
ENSTP

SEQ ID NO: 2753673 - protein, 6 aa, Entamoeba invadens
ENSTQI

SEQ ID NO: 2753674 - protein, 6 aa, Entamoeba invadens
ENSTTC

SEQ ID NO: 2753675 - protein, 4 aa, Entamoeba invadens
ENSY

SEQ ID NO: 2753676 - protein, 5 aa, Entamoeba invadens
ENTAP

SEQ ID NO: 2753677 - protein, 21 aa, Entamoeba invadens
ENTDKVIENSQCPKTSTGESW

SEQ ID NO: 2753678 - protein, 7 aa, Entamoeba invadens
ENTDNYE

SEQ ID NO: 2753679 - protein, 18 aa, Entamoeba invadens
ENTDRSDKTENSEKVETH

SEQ ID NO: 2753680 - protein, 9 aa, Entamoeba invadens
ENTDTRTQV

SEQ ID NO: 2753681 - protein, 14 aa, Entamoeba invadens
ENTEDTPIDVDAET

SEQ ID NO: 2753682 - protein, 11 aa, Entamoeba invadens
ENTEENAKEID

SEQ ID NO: 2753683 - protein, 15 aa, Entamoeba invadens
ENTENCTSCDSNGIC

SEQ ID NO: 2753684 - protein, 7 aa, Entamoeba invadens
ENTGGGF

SEQ ID NO: 2753685 - protein, 8 aa, Entamoeba invadens
ENTGSKTH

SEQ ID NO: 2753686 - protein, 5 aa, Entamoeba invadens
ENTIQ

SEQ ID NO: 2753687 - protein, 8 aa, Entamoeba invadens
ENTISSGV

SEQ ID NO: 2753688 - protein, 10 aa, Entamoeba invadens
ENTISTTKKD

SEQ ID NO: 2753689 - protein, 16 aa, Entamoeba invadens
ENTKAKCTKCTTSTDY

SEQ ID NO: 2753690 - protein, 5 aa, Entamoeba invadens
ENTKD

SEQ ID NO: 2753691 - protein, 7 aa, Entamoeba invadens
ENTKEVV

SEQ ID NO: 2753692 - protein, 8 aa, Entamoeba invadens
ENTKRPYI

SEQ ID NO: 2753693 - protein, 17 aa, Entamoeba invadens
ENTKTTKCTKCTTSTDY

SEQ ID NO: 2753694 - protein, 11 aa, Entamoeba invadens
ENTKYPNKEVK

SEQ ID NO: 2753695 - protein, 6 aa, Entamoeba invadens
ENTLDT

SEQ ID NO: 2753696 - protein, 4 aa, Entamoeba invadens
ENTM

SEQ ID NO: 2753697 - protein, 4 aa, Entamoeba invadens
ENTP

SEQ ID NO: 2753698 - protein, 5 aa, Entamoeba invadens
ENTPT

SEQ ID NO: 2753699 - protein, 9 aa, Entamoeba invadens
ENTPTPGTS

SEQ ID NO: 2753700 - protein, 4 aa, Entamoeba invadens
ENTR

SEQ ID NO: 2753701 - protein, 5 aa, Entamoeba invadens
ENTRH

SEQ ID NO: 2753702 - protein, 5 aa, Entamoeba invadens
ENTST

SEQ ID NO: 2753703 - protein, 11 aa, Entamoeba invadens
ENTSTAPSSQF

SEQ ID NO: 2753704 - protein, 4 aa, Entamoeba invadens
ENTT

SEQ ID NO: 2753705 - protein, 16 aa, Entamoeba invadens
ENTTAKCTKCTTSTDY

SEQ ID NO: 2753706 - protein, 7 aa, Entamoeba invadens
ENTTDVE

SEQ ID NO: 2753707 - protein, 6 aa, Entamoeba invadens
ENTTSF

SEQ ID NO: 2753708 - protein, 4 aa, Entamoeba invadens
ENTV

SEQ ID NO: 2753709 - protein, 7 aa, Entamoeba invadens
ENVDGFE

SEQ ID NO: 2753710 - protein, 16 aa, Entamoeba invadens
ENVDNDNSSSSVATGC

SEQ ID NO: 2753711 - protein, 7 aa, Entamoeba invadens
ENVEGTS

SEQ ID NO: 2753712 - protein, 6 aa, Entamoeba invadens
ENVGEE

SEQ ID NO: 2753713 - protein, 6 aa, Entamoeba invadens
ENVGQR

SEQ ID NO: 2753714 - protein, 6 aa, Entamoeba invadens
ENVKDS

SEQ ID NO: 2753715 - protein, 7 aa, Entamoeba invadens
ENVPDKD

SEQ ID NO: 2753716 - protein, 4 aa, Entamoeba invadens
ENVQ

SEQ ID NO: 2753717 - protein, 7 aa, Entamoeba invadens
ENVQDEL

SEQ ID NO: 2753718 - protein, 6 aa, Entamoeba invadens
ENVQNG

SEQ ID NO: 2753719 - protein, 4 aa, Entamoeba invadens
ENVR

SEQ ID NO: 2753720 - protein, 4 aa, Entamoeba invadens
ENVS

SEQ ID NO: 2753721 - protein, 5 aa, Entamoeba invadens
ENVSI

SEQ ID NO: 2753722 - protein, 5 aa, Entamoeba invadens
ENVTE

SEQ ID NO: 2753723 - protein, 12 aa, Entamoeba invadens
ENVTNEEDNIYE

SEQ ID NO: 2753724 - protein, 6 aa, Entamoeba invadens
ENVVNE

SEQ ID NO: 2753725 - protein, 4 aa, Entamoeba invadens
ENWD

SEQ ID NO: 2753726 - protein, 4 aa, Entamoeba invadens
ENYA

SEQ ID NO: 2753727 - protein, 11 aa, Entamoeba invadens
ENYDQDNSCQH

SEQ ID NO: 2753728 - protein, 4 aa, Entamoeba invadens
ENYE

SEQ ID NO: 2753729 - protein, 11 aa, Entamoeba invadens
ENYEPVPASKD

SEQ ID NO: 2753730 - protein, 15 aa, Entamoeba invadens
ENYKGKGPLNEPEKS

SEQ ID NO: 2753731 - protein, 16 aa, Entamoeba invadens
ENYPQTIPLRDRKKKI

SEQ ID NO: 2753732 - protein, 13 aa, Entamoeba invadens
ENYQLSDGSCYRT

SEQ ID NO: 2753733 - protein, 4 aa, Entamoeba invadens
ENYR

SEQ ID NO: 2753734 - protein, 6 aa, Entamoeba invadens
EPAEKV

SEQ ID NO: 2753735 - protein, 5 aa, Entamoeba invadens
EPAES

SEQ ID NO: 2753736 - protein, 10 aa, Entamoeba invadens
EPAPNSSEPC

SEQ ID NO: 2753737 - protein, 4 aa, Entamoeba invadens
EPCH

SEQ ID NO: 2753738 - protein, 4 aa, Entamoeba invadens
EPDN

SEQ ID NO: 2753739 - protein, 6 aa, Entamoeba invadens
EPDYKK

SEQ ID NO: 2753740 - protein, 4 aa, Entamoeba invadens
EPEC

SEQ ID NO: 2753741 - protein, 6 aa, Entamoeba invadens
EPEEEK

SEQ ID NO: 2753742 - protein, 8 aa, Entamoeba invadens
EPEFDNDN

SEQ ID NO: 2753743 - protein, 5 aa, Entamoeba invadens
EPEKL

SEQ ID NO: 2753744 - protein, 11 aa, Entamoeba invadens
EPEKLRKRNEH

SEQ ID NO: 2753745 - protein, 10 aa, Entamoeba invadens
EPEKNIESTK

SEQ ID NO: 2753746 - protein, 34 aa, Entamoeba invadens
EPEPDPETSSGTEPSHSSESSIDSKDNNNDSDTP

SEQ ID NO: 2753747 - protein, 6 aa, Entamoeba invadens
EPESTF

SEQ ID NO: 2753748 - protein, 6 aa, Entamoeba invadens
EPFDGD

SEQ ID NO: 2753749 - protein, 50 aa, Entamoeba invadens
EPFDPSISENDTSDELTSCSEISDDMSEKSEKSERGGQRVSGEKDKTKLK

SEQ ID NO: 2753750 - protein, 4 aa, Entamoeba invadens
EPFT

SEQ ID NO: 2753751 - protein, 5 aa, Entamoeba invadens
EPGIN

SEQ ID NO: 2753752 - protein, 15 aa, Entamoeba invadens
EPGNVINDDSTQIDL

SEQ ID NO: 2753753 - protein, 15 aa, Entamoeba invadens
EPGTYQDLTGQTECK

SEQ ID NO: 2753754 - protein, 4 aa, Entamoeba invadens
EPGV

SEQ ID NO: 2753755 - protein, 5 aa, Entamoeba invadens
EPGYY

SEQ ID NO: 2753756 - protein, 17 aa, Entamoeba invadens
EPIENKDSTDIPVDQET

SEQ ID NO: 2753757 - protein, 14 aa, Entamoeba invadens
EPIGDIDDEKRQSL

SEQ ID NO: 2753758 - protein, 5 aa, Entamoeba invadens
EPIKN

SEQ ID NO: 2753759 - protein, 9 aa, Entamoeba invadens
EPISTQATK

SEQ ID NO: 2753760 - protein, 9 aa, Entamoeba invadens
EPKDKKKKK

SEQ ID NO: 2753761 - protein, 6 aa, Entamoeba invadens
EPKDRI

SEQ ID NO: 2753762 - protein, 8 aa, Entamoeba invadens
EPKERPTM

SEQ ID NO: 2753763 - protein, 5 aa, Entamoeba invadens
EPKGR

SEQ ID NO: 2753764 - protein, 6 aa, Entamoeba invadens
EPKGRT

SEQ ID NO: 2753765 - protein, 4 aa, Entamoeba invadens
EPKK

SEQ ID NO: 2753766 - protein, 5 aa, Entamoeba invadens
EPKNN

SEQ ID NO: 2753767 - protein, 19 aa, Entamoeba invadens
EPKVKEEAPKPKVVDEKEK

SEQ ID NO: 2753768 - protein, 6 aa, Entamoeba invadens
EPKYYQ

SEQ ID NO: 2753769 - protein, 6 aa, Entamoeba invadens
EPLGNP

SEQ ID NO: 2753770 - protein, 9 aa, Entamoeba invadens
EPLGTDQNV

SEQ ID NO: 2753771 - protein, 5 aa, Entamoeba invadens
EPLPE

SEQ ID NO: 2753772 - protein, 5 aa, Entamoeba invadens
EPNEF

SEQ ID NO: 2753773 - protein, 8 aa, Entamoeba invadens
EPNETGTF

SEQ ID NO: 2753774 - protein, 4 aa, Entamoeba invadens
EPNG

SEQ ID NO: 2753775 - protein, 7 aa, Entamoeba invadens
EPNIGGD

SEQ ID NO: 2753776 - protein, 12 aa, Entamoeba invadens
EPNNGVLGPKKA

SEQ ID NO: 2753777 - protein, 11 aa, Entamoeba invadens
EPNNPVPSSEY

SEQ ID NO: 2753778 - protein, 5 aa, Entamoeba invadens
EPNYE

SEQ ID NO: 2753779 - protein, 9 aa, Entamoeba invadens
EPPEGTLAY

SEQ ID NO: 2753780 - protein, 14 aa, Entamoeba invadens
EPPGMGQSQDEYGH

SEQ ID NO: 2753781 - protein, 13 aa, Entamoeba invadens
EPPKGTLANEANS

SEQ ID NO: 2753782 - protein, 7 aa, Entamoeba invadens
EPPPEDS

SEQ ID NO: 2753783 - protein, 8 aa, Entamoeba invadens
EPPPHYDY

SEQ ID NO: 2753784 - protein, 4 aa, Entamoeba invadens
EPPQ

SEQ ID NO: 2753785 - protein, 12 aa, Entamoeba invadens
EPPRYTLKSNEA

SEQ ID NO: 2753786 - protein, 9 aa, Entamoeba invadens
EPQERPPIE

SEQ ID NO: 2753787 - protein, 12 aa, Entamoeba invadens
EPQMNQPPMGVD

SEQ ID NO: 2753788 - protein, 4 aa, Entamoeba invadens
EPQQ

SEQ ID NO: 2753789 - protein, 7 aa, Entamoeba invadens
EPQSKSC

SEQ ID NO: 2753790 - protein, 7 aa, Entamoeba invadens
EPQTCTE

SEQ ID NO: 2753791 - protein, 8 aa, Entamoeba invadens
EPSDTETL

SEQ ID NO: 2753792 - protein, 10 aa, Entamoeba invadens
EPSEDGTYCE

SEQ ID NO: 2753793 - protein, 6 aa, Entamoeba invadens
EPSMGI

SEQ ID NO: 2753794 - protein, 11 aa, Entamoeba invadens
EPSNNNRDGGS

SEQ ID NO: 2753795 - protein, 5 aa, Entamoeba invadens
EPSQL

SEQ ID NO: 2753796 - protein, 8 aa, Entamoeba invadens
EPSQTSTA

SEQ ID NO: 2753797 - protein, 10 aa, Entamoeba invadens
EPSSIHETTY

SEQ ID NO: 2753798 - protein, 4 aa, Entamoeba invadens
EPST

SEQ ID NO: 2753799 - protein, 4 aa, Entamoeba invadens
EPTA

SEQ ID NO: 2753800 - protein, 7 aa, Entamoeba invadens
EPTGGTS

SEQ ID NO: 2753801 - protein, 5 aa, Entamoeba invadens
EPTGR

SEQ ID NO: 2753802 - protein, 8 aa, Entamoeba invadens
EPTKPYTY

SEQ ID NO: 2753803 - protein, 5 aa, Entamoeba invadens
EPTRY

SEQ ID NO: 2753804 - protein, 7 aa, Entamoeba invadens
EPTSNTP

SEQ ID NO: 2753805 - protein, 11 aa, Entamoeba invadens
EPTTENSTKLD

SEQ ID NO: 2753806 - protein, 12 aa, Entamoeba invadens
EPTTLPTETELN

SEQ ID NO: 2753807 - protein, 14 aa, Entamoeba invadens
EPTTLPTKESPINE

SEQ ID NO: 2753808 - protein, 15 aa, Entamoeba invadens
EPTTNCTTCKDTNRF

SEQ ID NO: 2753809 - protein, 13 aa, Entamoeba invadens
EPVDEKDDIGGWP

SEQ ID NO: 2753810 - protein, 5 aa, Entamoeba invadens
EPVDG

SEQ ID NO: 2753811 - protein, 6 aa, Entamoeba invadens
EPVKGK

SEQ ID NO: 2753812 - protein, 18 aa, Entamoeba invadens
EPVTPPSPAGKLAGEFTP

SEQ ID NO: 2753813 - protein, 18 aa, Entamoeba invadens
EPVTPPSPAGKMAGEFTP

SEQ ID NO: 2753814 - protein, 6 aa, Entamoeba invadens
EPWKDT

SEQ ID NO: 2753815 - protein, 4 aa, Entamoeba invadens
EPYA

SEQ ID NO: 2753816 - protein, 4 aa, Entamoeba invadens
EPYN

SEQ ID NO: 2753817 - protein, 5 aa, Entamoeba invadens
EPYND

SEQ ID NO: 2753818 - protein, 4 aa, Entamoeba invadens
EPYP

SEQ ID NO: 2753819 - protein, 5 aa, Entamoeba invadens
EPYPK

SEQ ID NO: 2753820 - protein, 6 aa, Entamoeba invadens
EPYPKE

SEQ ID NO: 2753821 - protein, 6 aa, Entamoeba invadens
EPYPKN

SEQ ID NO: 2753822 - protein, 6 aa, Entamoeba invadens
EPYRKE

SEQ ID NO: 2753823 - protein, 5 aa, Entamoeba invadens
EPYSE

SEQ ID NO: 2753824 - protein, 6 aa, Entamoeba invadens
EPYSKD

SEQ ID NO: 2753825 - protein, 7 aa, Entamoeba invadens
EQADADR

SEQ ID NO: 2753826 - protein, 9 aa, Entamoeba invadens
EQADNLRKN

SEQ ID NO: 2753827 - protein, 6 aa, Entamoeba invadens
EQANTV

SEQ ID NO: 2753828 - protein, 23 aa, Entamoeba invadens
EQAPQQEKHNTTNKENCTTNEYV

SEQ ID NO: 2753829 - protein, 4 aa, Entamoeba invadens
EQAT

SEQ ID NO: 2753830 - protein, 4 aa, Entamoeba invadens
EQAV

SEQ ID NO: 2753831 - protein, 4 aa, Entamoeba invadens
EQAY

SEQ ID NO: 2753832 - protein, 11 aa, Entamoeba invadens
EQCAPEYDNDN

SEQ ID NO: 2753833 - protein, 23 aa, Entamoeba invadens
EQCRDGGMGDGDECPAEAEGCSP

SEQ ID NO: 2753834 - protein, 8 aa, Entamoeba invadens
EQCSSNIE

SEQ ID NO: 2753835 - protein, 15 aa, Entamoeba invadens
EQCSTTNNKCSRCEP

SEQ ID NO: 2753836 - protein, 6 aa, Entamoeba invadens
EQCTNC

SEQ ID NO: 2753837 - protein, 11 aa, Entamoeba invadens
EQDDINETSFN

SEQ ID NO: 2753838 - protein, 4 aa, Entamoeba invadens
EQDE

SEQ ID NO: 2753839 - protein, 11 aa, Entamoeba invadens
EQDKKERITIE

SEQ ID NO: 2753840 - protein, 24 aa, Entamoeba invadens
EQDLDNKTTCRSQKEINSTCQAGI

SEQ ID NO: 2753841 - protein, 5 aa, Entamoeba invadens
EQDPI

SEQ ID NO: 2753842 - protein, 8 aa, Entamoeba invadens
EQDPQKRC

SEQ ID NO: 2753843 - protein, 7 aa, Entamoeba invadens
EQDSAPK

SEQ ID NO: 2753844 - protein, 7 aa, Entamoeba invadens
EQDTFAD

SEQ ID NO: 2753845 - protein, 7 aa, Entamoeba invadens
EQECPKG

SEQ ID NO: 2753846 - protein, 5 aa, Entamoeba invadens
EQEDL

SEQ ID NO: 2753847 - protein, 18 aa, Entamoeba invadens
EQEERQARKQKEADTNRA

SEQ ID NO: 2753848 - protein, 6 aa, Entamoeba invadens
EQEESF

SEQ ID NO: 2753849 - protein, 6 aa, Entamoeba invadens
EQEGRL

SEQ ID NO: 2753850 - protein, 10 aa, Entamoeba invadens
EQEKNKRMTI

SEQ ID NO: 2753851 - protein, 5 aa, Entamoeba invadens
EQEMS

SEQ ID NO: 2753852 - protein, 11 aa, Entamoeba invadens
EQEPKISYSQN

SEQ ID NO: 2753853 - protein, 9 aa, Entamoeba invadens
EQEVKNSVQ

SEQ ID NO: 2753854 - protein, 5 aa, Entamoeba invadens
EQFPA

SEQ ID NO: 2753855 - protein, 7 aa, Entamoeba invadens
EQGCKHP

SEQ ID NO: 2753856 - protein, 6 aa, Entamoeba invadens
EQGGSS

SEQ ID NO: 2753857 - protein, 7 aa, Entamoeba invadens
EQGKNWE

SEQ ID NO: 2753858 - protein, 9 aa, Entamoeba invadens
EQGSYSHEA

SEQ ID NO: 2753859 - protein, 9 aa, Entamoeba invadens
EQHKATRGL

SEQ ID NO: 2753860 - protein, 5 aa, Entamoeba invadens
EQHTK

SEQ ID NO: 2753861 - protein, 13 aa, Entamoeba invadens
EQIEEDKKKERNE

SEQ ID NO: 2753862 - protein, 14 aa, Entamoeba invadens
EQIEEDKKKERNET

SEQ ID NO: 2753863 - protein, 6 aa, Entamoeba invadens
EQIEIT

SEQ ID NO: 2753864 - protein, 12 aa, Entamoeba invadens
EQIEKSSDSNQL

SEQ ID NO: 2753865 - protein, 15 aa, Entamoeba invadens
EQIGRDVDAKTNEVK

SEQ ID NO: 2753866 - protein, 17 aa, Entamoeba invadens
EQITSEKDGLTQQNTQV

SEQ ID NO: 2753867 - protein, 16 aa, Entamoeba invadens
EQKDEKAQEEIDKGEI

SEQ ID NO: 2753868 - protein, 11 aa, Entamoeba invadens
EQKDNTYSNQL

SEQ ID NO: 2753869 - protein, 13 aa, Entamoeba invadens
EQKEKKDKKKKNL

SEQ ID NO: 2753870 - protein, 10 aa, Entamoeba invadens
EQKESEKVYS

SEQ ID NO: 2753871 - protein, 17 aa, Entamoeba invadens
EQKKGTTKISGDITYAS

SEQ ID NO: 2753872 - protein, 5 aa, Entamoeba invadens
EQKKM

SEQ ID NO: 2753873 - protein, 6 aa, Entamoeba invadens
EQKNGK

SEQ ID NO: 2753874 - protein, 7 aa, Entamoeba invadens
EQKREGV

SEQ ID NO: 2753875 - protein, 10 aa, Entamoeba invadens
EQKSNEQVTE

SEQ ID NO: 2753876 - protein, 6 aa, Entamoeba invadens
EQKVDS

SEQ ID NO: 2753877 - protein, 23 aa, Entamoeba invadens
EQKYTSTCKGKELEKTWTSEEGV

SEQ ID NO: 2753878 - protein, 20 aa, Entamoeba invadens
EQLDSESRFIDSEDENSGVA

SEQ ID NO: 2753879 - protein, 9 aa, Entamoeba invadens
EQLEKEDNV

SEQ ID NO: 2753880 - protein, 8 aa, Entamoeba invadens
EQLGSPSH

SEQ ID NO: 2753881 - protein, 5 aa, Entamoeba invadens
EQLHT

SEQ ID NO: 2753882 - protein, 12 aa, Entamoeba invadens
EQLNENCKNGAI

SEQ ID NO: 2753883 - protein, 4 aa, Entamoeba invadens
EQLS

SEQ ID NO: 2753884 - protein, 9 aa, Entamoeba invadens
EQLTSSDDG

SEQ ID NO: 2753885 - protein, 13 aa, Entamoeba invadens
EQMEKENQTQKDT

SEQ ID NO: 2753886 - protein, 9 aa, Entamoeba invadens
EQNAEPPKV

SEQ ID NO: 2753887 - protein, 10 aa, Entamoeba invadens
EQNCEKSSVS

SEQ ID NO: 2753888 - protein, 5 aa, Entamoeba invadens
EQNEK

SEQ ID NO: 2753889 - protein, 10 aa, Entamoeba invadens
EQNESTEKVK

SEQ ID NO: 2753890 - protein, 12 aa, Entamoeba invadens
EQNGAIKRQEMS

SEQ ID NO: 2753891 - protein, 13 aa, Entamoeba invadens
EQNISKNIPNNSE

SEQ ID NO: 2753892 - protein, 8 aa, Entamoeba invadens
EQNKENQK

SEQ ID NO: 2753893 - protein, 7 aa, Entamoeba invadens
EQNNDTK

SEQ ID NO: 2753894 - protein, 11 aa, Entamoeba invadens
EQNNETCYTPD

SEQ ID NO: 2753895 - protein, 8 aa, Entamoeba invadens
EQNNKNVQ

SEQ ID NO: 2753896 - protein, 19 aa, Entamoeba invadens
EQNNTKNEEKMKEKEHEID

SEQ ID NO: 2753897 - protein, 13 aa, Entamoeba invadens
EQNSGGDTPTTCS

SEQ ID NO: 2753898 - protein, 13 aa, Entamoeba invadens
EQNSNYKGTFQTE

SEQ ID NO: 2753899 - protein, 37 aa, Entamoeba invadens
EQNTEMTDEPTNITKRAKNTKSYGKIEENVSVDGDDV

SEQ ID NO: 2753900 - protein, 9 aa, Entamoeba invadens
EQNTETSDA

SEQ ID NO: 2753901 - protein, 7 aa, Entamoeba invadens
EQNTKSK

SEQ ID NO: 2753902 - protein, 6 aa, Entamoeba invadens
EQNTTV

SEQ ID NO: 2753903 - protein, 10 aa, Entamoeba invadens
EQNYIRKNPQ

SEQ ID NO: 2753904 - protein, 7 aa, Entamoeba invadens
EQPANMS

SEQ ID NO: 2753905 - protein, 7 aa, Entamoeba invadens
EQPIAEG

SEQ ID NO: 2753906 - protein, 9 aa, Entamoeba invadens
EQPKILPNN

SEQ ID NO: 2753907 - protein, 7 aa, Entamoeba invadens
EQPKSGM

SEQ ID NO: 2753908 - protein, 7 aa, Entamoeba invadens
EQPNKDT

SEQ ID NO: 2753909 - protein, 7 aa, Entamoeba invadens
EQPPDDE

SEQ ID NO: 2753910 - protein, 8 aa, Entamoeba invadens
EQPPVGAG

SEQ ID NO: 2753911 - protein, 18 aa, Entamoeba invadens
EQQCSTTTSGTCTKCEDG

SEQ ID NO: 2753912 - protein, 5 aa, Entamoeba invadens
EQQDG

SEQ ID NO: 2753913 - protein, 4 aa, Entamoeba invadens
EQQE

SEQ ID NO: 2753914 - protein, 5 aa, Entamoeba invadens
EQQGV

SEQ ID NO: 2753915 - protein, 12 aa, Entamoeba invadens
EQQGVLSDEPTT

SEQ ID NO: 2753916 - protein, 9 aa, Entamoeba invadens
EQQNATSFS

SEQ ID NO: 2753917 - protein, 7 aa, Entamoeba invadens
EQQNKRI

SEQ ID NO: 2753918 - protein, 9 aa, Entamoeba invadens
EQQNNSTLK

SEQ ID NO: 2753919 - protein, 4 aa, Entamoeba invadens
EQQP

SEQ ID NO: 2753920 - protein, 7 aa, Entamoeba invadens
EQRDTTD

SEQ ID NO: 2753921 - protein, 7 aa, Entamoeba invadens
EQREEKV

SEQ ID NO: 2753922 - protein, 5 aa, Entamoeba invadens
EQREQ

SEQ ID NO: 2753923 - protein, 6 aa, Entamoeba invadens
EQRKDL

SEQ ID NO: 2753924 - protein, 6 aa, Entamoeba invadens
EQRPDT

SEQ ID NO: 2753925 - protein, 4 aa, Entamoeba invadens
EQRS

SEQ ID NO: 2753926 - protein, 5 aa, Entamoeba invadens
EQSCP

SEQ ID NO: 2753927 - protein, 4 aa, Entamoeba invadens
EQSF

SEQ ID NO: 2753928 - protein, 11 aa, Entamoeba invadens
EQSGCSKCNNN

SEQ ID NO: 2753929 - protein, 19 aa, Entamoeba invadens
EQSISSHQSGDDDDGLNGG

SEQ ID NO: 2753930 - protein, 19 aa, Entamoeba invadens
EQSKPEIKPPESPNSEEEF

SEQ ID NO: 2753931 - protein, 4 aa, Entamoeba invadens
EQSN

SEQ ID NO: 2753932 - protein, 11 aa, Entamoeba invadens
EQSNAPHPTRH

SEQ ID NO: 2753933 - protein, 8 aa, Entamoeba invadens
EQSSCTGD

SEQ ID NO: 2753934 - protein, 16 aa, Entamoeba invadens
EQSTPRQMKEDISGLQ

SEQ ID NO: 2753935 - protein, 7 aa, Entamoeba invadens
EQSTTFT

SEQ ID NO: 2753936 - protein, 10 aa, Entamoeba invadens
EQSVQSQPYF

SEQ ID NO: 2753937 - protein, 12 aa, Entamoeba invadens
EQSYDGKGEFDY

SEQ ID NO: 2753938 - protein, 11 aa, Entamoeba invadens
EQTASHARLGE

SEQ ID NO: 2753939 - protein, 7 aa, Entamoeba invadens
EQTATES

SEQ ID NO: 2753940 - protein, 8 aa, Entamoeba invadens
EQTDDEKI

SEQ ID NO: 2753941 - protein, 7 aa, Entamoeba invadens
EQTDGLR

SEQ ID NO: 2753942 - protein, 8 aa, Entamoeba invadens
EQTEGKTQ

SEQ ID NO: 2753943 - protein, 6 aa, Entamoeba invadens
EQTESG

SEQ ID NO: 2753944 - protein, 7 aa, Entamoeba invadens
EQTKETA

SEQ ID NO: 2753945 - protein, 10 aa, Entamoeba invadens
EQTKFPSRED

SEQ ID NO: 2753946 - protein, 10 aa, Entamoeba invadens
EQTKLPSRED

SEQ ID NO: 2753947 - protein, 7 aa, Entamoeba invadens
EQTNVNE

SEQ ID NO: 2753948 - protein, 12 aa, Entamoeba invadens
EQTPNYDNLNSS

SEQ ID NO: 2753949 - protein, 36 aa, Entamoeba invadens
EQTPSFDVQDTSPVSDSETSLLQQSSDEKKSETKHI

SEQ ID NO: 2753950 - protein, 14 aa, Entamoeba invadens
EQTQDGDTTTSDSS

SEQ ID NO: 2753951 - protein, 14 aa, Entamoeba invadens
EQTRIGRDDKITLR

SEQ ID NO: 2753952 - protein, 13 aa, Entamoeba invadens
EQTRSGQGEGEPG

SEQ ID NO: 2753953 - protein, 14 aa, Entamoeba invadens
EQTSQNSEVLNEEA

SEQ ID NO: 2753954 - protein, 16 aa, Entamoeba invadens
EQTTAPVPLSKTPNIH

SEQ ID NO: 2753955 - protein, 7 aa, Entamoeba invadens
EQTTKID

SEQ ID NO: 2753956 - protein, 9 aa, Entamoeba invadens
EQTTTYDDQ

SEQ ID NO: 2753957 - protein, 12 aa, Entamoeba invadens
EQTVEDYATQYS

SEQ ID NO: 2753958 - protein, 10 aa, Entamoeba invadens
EQVAQEGLDN

SEQ ID NO: 2753959 - protein, 13 aa, Entamoeba invadens
EQVEPNGNEDGKC

SEQ ID NO: 2753960 - protein, 7 aa, Entamoeba invadens
EQYNSYD

SEQ ID NO: 2753961 - protein, 16 aa, Entamoeba invadens
EQYTQYSAYQQQPMEQ

SEQ ID NO: 2753962 - protein, 9 aa, Entamoeba invadens
ERADGKYVT

SEQ ID NO: 2753963 - protein, 11 aa, Entamoeba invadens
ERADRTNFNSE

SEQ ID NO: 2753964 - protein, 32 aa, Entamoeba invadens
ERAGTTELPPVEKEERGQNVDSKTEKNTPNDE

SEQ ID NO: 2753965 - protein, 6 aa, Entamoeba invadens
ERAGTY

SEQ ID NO: 2753966 - protein, 6 aa, Entamoeba invadens
ERAPET

SEQ ID NO: 2753967 - protein, 7 aa, Entamoeba invadens
ERAPLPL

SEQ ID NO: 2753968 - protein, 12 aa, Entamoeba invadens
ERAREDSRGECT

SEQ ID NO: 2753969 - protein, 7 aa, Entamoeba invadens
ERARPEG

SEQ ID NO: 2753970 - protein, 9 aa, Entamoeba invadens
ERARSTAPS

SEQ ID NO: 2753971 - protein, 6 aa, Entamoeba invadens
ERCDNT

SEQ ID NO: 2753972 - protein, 7 aa, Entamoeba invadens
ERCDRNK

SEQ ID NO: 2753973 - protein, 7 aa, Entamoeba invadens
ERCDRTK

SEQ ID NO: 2753974 - protein, 4 aa, Entamoeba invadens
ERCG

SEQ ID NO: 2753975 - protein, 21 aa, Entamoeba invadens
ERCGNGKLDEGEECDGNSNGC

SEQ ID NO: 2753976 - protein, 17 aa, Entamoeba invadens
ERCTQTNCEKCEDSVYT

SEQ ID NO: 2753977 - protein, 6 aa, Entamoeba invadens
ERDAVH

SEQ ID NO: 2753978 - protein, 10 aa, Entamoeba invadens
ERDETRAEGR

SEQ ID NO: 2753979 - protein, 7 aa, Entamoeba invadens
ERDGCEN

SEQ ID NO: 2753980 - protein, 9 aa, Entamoeba invadens
ERDKQTKSL

SEQ ID NO: 2753981 - protein, 8 aa, Entamoeba invadens
ERDNKCDE

SEQ ID NO: 2753982 - protein, 15 aa, Entamoeba invadens
ERDQCDPTNSEVEDV

SEQ ID NO: 2753983 - protein, 22 aa, Entamoeba invadens
ERDRTPDGDDTICDDSDTTDDY

SEQ ID NO: 2753984 - protein, 8 aa, Entamoeba invadens
ERDSDNRK

SEQ ID NO: 2753985 - protein, 11 aa, Entamoeba invadens
EREEKQKNSDY

SEQ ID NO: 2753986 - protein, 7 aa, Entamoeba invadens
ERENPNG

SEQ ID NO: 2753987 - protein, 8 aa, Entamoeba invadens
EREPGASH

SEQ ID NO: 2753988 - protein, 9 aa, Entamoeba invadens
ERETGVPTP

SEQ ID NO: 2753989 - protein, 7 aa, Entamoeba invadens
ERETSCN

SEQ ID NO: 2753990 - protein, 8 aa, Entamoeba invadens
ERETTGSI

SEQ ID NO: 2753991 - protein, 6 aa, Entamoeba invadens
ERFGES

SEQ ID NO: 2753992 - protein, 5 aa, Entamoeba invadens
ERFPT

SEQ ID NO: 2753993 - protein, 7 aa, Entamoeba invadens
ERGDADP

SEQ ID NO: 2753994 - protein, 11 aa, Entamoeba invadens
ERGEKMKSKGC

SEQ ID NO: 2753995 - protein, 5 aa, Entamoeba invadens
ERGET

SEQ ID NO: 2753996 - protein, 10 aa, Entamoeba invadens
ERGGTTEYLG

SEQ ID NO: 2753997 - protein, 8 aa, Entamoeba invadens
ERGISSND

SEQ ID NO: 2753998 - protein, 7 aa, Entamoeba invadens
ERGKDAE

SEQ ID NO: 2753999 - protein, 11 aa, Entamoeba invadens
ERGKITSKASL

SEQ ID NO: 2754000 - protein, 7 aa, Entamoeba invadens
ERGRETM

SEQ ID NO: 2754001 - protein, 4 aa, Entamoeba invadens
ERHG

SEQ ID NO: 2754002 - protein, 4 aa, Entamoeba invadens
ERIE

SEQ ID NO: 2754003 - protein, 15 aa, Entamoeba invadens
ERIEKEQKTLKTSNR

SEQ ID NO: 2754004 - protein, 13 aa, Entamoeba invadens
ERIGTKPCGCGEK

SEQ ID NO: 2754005 - protein, 13 aa, Entamoeba invadens
ERIGTRAFGSTKI

SEQ ID NO: 2754006 - protein, 14 aa, Entamoeba invadens
ERIKKKKESEQRLE

SEQ ID NO: 2754007 - protein, 7 aa, Entamoeba invadens
ERKAEIE

SEQ ID NO: 2754008 - protein, 11 aa, Entamoeba invadens
ERKAQAPIPQQ

SEQ ID NO: 2754009 - protein, 5 aa, Entamoeba invadens
ERKDL

SEQ ID NO: 2754010 - protein, 7 aa, Entamoeba invadens
ERKEDGC

SEQ ID NO: 2754011 - protein, 10 aa, Entamoeba invadens
ERKKKGISSI

SEQ ID NO: 2754012 - protein, 8 aa, Entamoeba invadens
ERKLGEGS

SEQ ID NO: 2754013 - protein, 16 aa, Entamoeba invadens
ERKNHKRGSCGCHAKD

SEQ ID NO: 2754014 - protein, 6 aa, Entamoeba invadens
ERKNII

SEQ ID NO: 2754015 - protein, 7 aa, Entamoeba invadens
ERKNRPL

SEQ ID NO: 2754016 - protein, 9 aa, Entamoeba invadens
ERKQQDEQV

SEQ ID NO: 2754017 - protein, 4 aa, Entamoeba invadens
ERKR

SEQ ID NO: 2754018 - protein, 9 aa, Entamoeba invadens
ERKSDGSEL

SEQ ID NO: 2754019 - protein, 5 aa, Entamoeba invadens
ERKTE

SEQ ID NO: 2754020 - protein, 6 aa, Entamoeba invadens
ERLEQN

SEQ ID NO: 2754021 - protein, 14 aa, Entamoeba invadens
ERLNSEKQKNQNIM

SEQ ID NO: 2754022 - protein, 10 aa, Entamoeba invadens
ERLNTDSNYY

SEQ ID NO: 2754023 - protein, 12 aa, Entamoeba invadens
ERLNTDSNYYTG

SEQ ID NO: 2754024 - protein, 8 aa, Entamoeba invadens
ERLPPGKN

SEQ ID NO: 2754025 - protein, 8 aa, Entamoeba invadens
ERNDVEEK

SEQ ID NO: 2754026 - protein, 15 aa, Entamoeba invadens
ERNECASDSACASVS

SEQ ID NO: 2754027 - protein, 6 aa, Entamoeba invadens
ERNGDG

SEQ ID NO: 2754028 - protein, 7 aa, Entamoeba invadens
ERNKDKY

SEQ ID NO: 2754029 - protein, 10 aa, Entamoeba invadens
ERNNGGEMNQ

SEQ ID NO: 2754030 - protein, 7 aa, Entamoeba invadens
ERNNSST

SEQ ID NO: 2754031 - protein, 8 aa, Entamoeba invadens
ERNNTNGV

SEQ ID NO: 2754032 - protein, 5 aa, Entamoeba invadens
ERNRE

SEQ ID NO: 2754033 - protein, 7 aa, Entamoeba invadens
ERNRQQQ

SEQ ID NO: 2754034 - protein, 4 aa, Entamoeba invadens
ERNS

SEQ ID NO: 2754035 - protein, 6 aa, Entamoeba invadens
ERNSPF

SEQ ID NO: 2754036 - protein, 8 aa, Entamoeba invadens
ERPFSNGW

SEQ ID NO: 2754037 - protein, 6 aa, Entamoeba invadens
ERPSHA

SEQ ID NO: 2754038 - protein, 6 aa, Entamoeba invadens
ERPTVT

SEQ ID NO: 2754039 - protein, 9 aa, Entamoeba invadens
ERQDGNENI

SEQ ID NO: 2754040 - protein, 9 aa, Entamoeba invadens
ERQENERKQ

SEQ ID NO: 2754041 - protein, 5 aa, Entamoeba invadens
ERQNK

SEQ ID NO: 2754042 - protein, 7 aa, Entamoeba invadens
ERRGEKV

SEQ ID NO: 2754043 - protein, 5 aa, Entamoeba invadens
ERRGQ

SEQ ID NO: 2754044 - protein, 12 aa, Entamoeba invadens
ERRKMSGPNKNR

SEQ ID NO: 2754045 - protein, 5 aa, Entamoeba invadens
ERRNK

SEQ ID NO: 2754046 - protein, 12 aa, Entamoeba invadens
ERRQKRHRKEAE

SEQ ID NO: 2754047 - protein, 4 aa, Entamoeba invadens
ERRT

SEQ ID NO: 2754048 - protein, 6 aa, Entamoeba invadens
ERSANL

SEQ ID NO: 2754049 - protein, 4 aa, Entamoeba invadens
ERSG

SEQ ID NO: 2754050 - protein, 14 aa, Entamoeba invadens
ERSGEDIYGETSDP

SEQ ID NO: 2754051 - protein, 15 aa, Entamoeba invadens
ERSKAVKKEIESNLS

SEQ ID NO: 2754052 - protein, 11 aa, Entamoeba invadens
ERSLGEDSTRL

SEQ ID NO: 2754053 - protein, 5 aa, Entamoeba invadens
ERSLS

SEQ ID NO: 2754054 - protein, 14 aa, Entamoeba invadens
ERSRVEKELTTNTF

SEQ ID NO: 2754055 - protein, 8 aa, Entamoeba invadens
ERSRYGLN

SEQ ID NO: 2754056 - protein, 7 aa, Entamoeba invadens
ERSSLMP

SEQ ID NO: 2754057 - protein, 5 aa, Entamoeba invadens
ERSTL

SEQ ID NO: 2754058 - protein, 19 aa, Entamoeba invadens
ERTAGTSTIRGKTSYASQT

SEQ ID NO: 2754059 - protein, 6 aa, Entamoeba invadens
ERTKLT

SEQ ID NO: 2754060 - protein, 5 aa, Entamoeba invadens
ERTLD

SEQ ID NO: 2754061 - protein, 18 aa, Entamoeba invadens
ERTLNDSHPKLTQPPTKV

SEQ ID NO: 2754062 - protein, 4 aa, Entamoeba invadens
ERTN

SEQ ID NO: 2754063 - protein, 7 aa, Entamoeba invadens
ERTNGKC

SEQ ID NO: 2754064 - protein, 6 aa, Entamoeba invadens
ERTNNP

SEQ ID NO: 2754065 - protein, 18 aa, Entamoeba invadens
ERTQKTVKIQNKGENEEY

SEQ ID NO: 2754066 - protein, 5 aa, Entamoeba invadens
ERTSG

SEQ ID NO: 2754067 - protein, 6 aa, Entamoeba invadens
ERTSNV

SEQ ID NO: 2754068 - protein, 7 aa, Entamoeba invadens
ERTTLSK

SEQ ID NO: 2754069 - protein, 10 aa, Entamoeba invadens
ERVDDGEHTF

SEQ ID NO: 2754070 - protein, 6 aa, Entamoeba invadens
ERVDEI

SEQ ID NO: 2754071 - protein, 9 aa, Entamoeba invadens
ERVKNDEVK

SEQ ID NO: 2754072 - protein, 4 aa, Entamoeba invadens
ERVN

SEQ ID NO: 2754073 - protein, 4 aa, Entamoeba invadens
ERVP

SEQ ID NO: 2754074 - protein, 9 aa, Entamoeba invadens
ERVPSSIGK

SEQ ID NO: 2754075 - protein, 9 aa, Entamoeba invadens
ERYDPETSF

SEQ ID NO: 2754076 - protein, 6 aa, Entamoeba invadens
ERYDSS

SEQ ID NO: 2754077 - protein, 4 aa, Entamoeba invadens
ERYG

SEQ ID NO: 2754078 - protein, 7 aa, Entamoeba invadens
ERYGKND

SEQ ID NO: 2754079 - protein, 5 aa, Entamoeba invadens
ERYNE

SEQ ID NO: 2754080 - protein, 17 aa, Entamoeba invadens
ESADNKCSRCDDKYKLS

SEQ ID NO: 2754081 - protein, 9 aa, Entamoeba invadens
ESADSENPY

SEQ ID NO: 2754082 - protein, 8 aa, Entamoeba invadens
ESADYGDL

SEQ ID NO: 2754083 - protein, 4 aa, Entamoeba invadens
ESAF

SEQ ID NO: 2754084 - protein, 7 aa, Entamoeba invadens
ESAKQTR

SEQ ID NO: 2754085 - protein, 17 aa, Entamoeba invadens
ESANNKCSKCDDKYKLS

SEQ ID NO: 2754086 - protein, 30 aa, Entamoeba invadens
ESARNDVEKLKSEIEKTKRDGELLKTEKEK

SEQ ID NO: 2754087 - protein, 6 aa, Entamoeba invadens
ESATKC

SEQ ID NO: 2754088 - protein, 8 aa, Entamoeba invadens
ESATTEAT

SEQ ID NO: 2754089 - protein, 8 aa, Entamoeba invadens
ESCANQGM

SEQ ID NO: 2754090 - protein, 6 aa, Entamoeba invadens
ESCDKS

SEQ ID NO: 2754091 - protein, 18 aa, Entamoeba invadens
ESCGGKCDTTSGHCTGCN

SEQ ID NO: 2754092 - protein, 13 aa, Entamoeba invadens
ESCGPVSNTVPGD

SEQ ID NO: 2754093 - protein, 13 aa, Entamoeba invadens
ESCGSCEETYTKM

SEQ ID NO: 2754094 - protein, 13 aa, Entamoeba invadens
ESCNDKSSEEEWN

SEQ ID NO: 2754095 - protein, 8 aa, Entamoeba invadens
ESCNTKTL

SEQ ID NO: 2754096 - protein, 9 aa, Entamoeba invadens
ESCSRRSLP

SEQ ID NO: 2754097 - protein, 20 aa, Entamoeba invadens
ESCSSSTSSCGGFKGTCKNS

SEQ ID NO: 2754098 - protein, 14 aa, Entamoeba invadens
ESCTNCNGANGECT

SEQ ID NO: 2754099 - protein, 4 aa, Entamoeba invadens
ESCV

SEQ ID NO: 2754100 - protein, 10 aa, Entamoeba invadens
ESDDQKQNEI

SEQ ID NO: 2754101 - protein, 6 aa, Entamoeba invadens
ESDENF

SEQ ID NO: 2754102 - protein, 29 aa, Entamoeba invadens
ESDEPSPLPLPSNPVISNDENLSTPDNTP

SEQ ID NO: 2754103 - protein, 4 aa, Entamoeba invadens
ESDF

SEQ ID NO: 2754104 - protein, 6 aa, Entamoeba invadens
ESDGIG

SEQ ID NO: 2754105 - protein, 9 aa, Entamoeba invadens
ESDKLGEGS

SEQ ID NO: 2754106 - protein, 5 aa, Entamoeba invadens
ESDKM

SEQ ID NO: 2754107 - protein, 5 aa, Entamoeba invadens
ESDND

SEQ ID NO: 2754108 - protein, 8 aa, Entamoeba invadens
ESDNVDTI

SEQ ID NO: 2754109 - protein, 10 aa, Entamoeba invadens
ESDRSNCQYR

SEQ ID NO: 2754110 - protein, 9 aa, Entamoeba invadens
ESDRTVIPQ

SEQ ID NO: 2754111 - protein, 6 aa, Entamoeba invadens
ESDSFG

SEQ ID NO: 2754112 - protein, 14 aa, Entamoeba invadens
ESDSISSPEATVQK

SEQ ID NO: 2754113 - protein, 8 aa, Entamoeba invadens
ESDTISQT

SEQ ID NO: 2754114 - protein, 10 aa, Entamoeba invadens
ESDTITQTIS

SEQ ID NO: 2754115 - protein, 23 aa, Entamoeba invadens
ESDTPNLTETPLESPSESDSKKA

SEQ ID NO: 2754116 - protein, 12 aa, Entamoeba invadens
ESDTSSDISKNY

SEQ ID NO: 2754117 - protein, 15 aa, Entamoeba invadens
ESDTTVSHISKSSPF

SEQ ID NO: 2754118 - protein, 8 aa, Entamoeba invadens
ESDYNNEV

SEQ ID NO: 2754119 - protein, 6 aa, Entamoeba invadens
ESDYVS

SEQ ID NO: 2754120 - protein, 9 aa, Entamoeba invadens
ESEADKRIK

SEQ ID NO: 2754121 - protein, 23 aa, Entamoeba invadens
ESEASTALDPDELHKENKLGEGG

SEQ ID NO: 2754122 - protein, 14 aa, Entamoeba invadens
ESEDINTQNGSSEI

SEQ ID NO: 2754123 - protein, 14 aa, Entamoeba invadens
ESEEEKKGEKDEFI

SEQ ID NO: 2754124 - protein, 42 aa, Entamoeba invadens
ESEEHEEEQNIQEEKKNEEIKKKMEEKNVNMNEKENGITKEE

SEQ ID NO: 2754125 - protein, 6 aa, Entamoeba invadens
ESEELD

SEQ ID NO: 2754126 - protein, 24 aa, Entamoeba invadens
ESEGGERENQNEDVDDQQKINEHN

SEQ ID NO: 2754127 - protein, 4 aa, Entamoeba invadens
ESEI

SEQ ID NO: 2754128 - protein, 5 aa, Entamoeba invadens
ESEIG

SEQ ID NO: 2754129 - protein, 7 aa, Entamoeba invadens
ESEISPE

SEQ ID NO: 2754130 - protein, 11 aa, Entamoeba invadens
ESEITVDTPNI

SEQ ID NO: 2754131 - protein, 4 aa, Entamoeba invadens
ESEK

SEQ ID NO: 2754132 - protein, 10 aa, Entamoeba invadens
ESEKSFQIEN

SEQ ID NO: 2754133 - protein, 18 aa, Entamoeba invadens
ESEKSGEVWSEDGKSIGR

SEQ ID NO: 2754134 - protein, 10 aa, Entamoeba invadens
ESEKSSNLDA

SEQ ID NO: 2754135 - protein, 8 aa, Entamoeba invadens
ESEKSYTK

SEQ ID NO: 2754136 - protein, 6 aa, Entamoeba invadens
ESENES

SEQ ID NO: 2754137 - protein, 5 aa, Entamoeba invadens
ESENG

SEQ ID NO: 2754138 - protein, 23 aa, Entamoeba invadens
ESENLNGDCSTITTESSIIGSAT

SEQ ID NO: 2754139 - protein, 7 aa, Entamoeba invadens
ESENVTV

SEQ ID NO: 2754140 - protein, 8 aa, Entamoeba invadens
ESEQDGLS

SEQ ID NO: 2754141 - protein, 10 aa, Entamoeba invadens
ESEQSNPTYT

SEQ ID NO: 2754142 - protein, 9 aa, Entamoeba invadens
ESERGWIGE

SEQ ID NO: 2754143 - protein, 5 aa, Entamoeba invadens
ESERS

SEQ ID NO: 2754144 - protein, 7 aa, Entamoeba invadens
ESESDAV

SEQ ID NO: 2754145 - protein, 6 aa, Entamoeba invadens
ESESFA

SEQ ID NO: 2754146 - protein, 11 aa, Entamoeba invadens
ESESPVVPDSS

SEQ ID NO: 2754147 - protein, 9 aa, Entamoeba invadens
ESETKISKQ

SEQ ID NO: 2754148 - protein, 8 aa, Entamoeba invadens
ESETLSNQ

SEQ ID NO: 2754149 - protein, 6 aa, Entamoeba invadens
ESETVE

SEQ ID NO: 2754150 - protein, 7 aa, Entamoeba invadens
ESEVQNG

SEQ ID NO: 2754151 - protein, 8 aa, Entamoeba invadens
ESEVSTRL

SEQ ID NO: 2754152 - protein, 6 aa, Entamoeba invadens
ESEYQH

SEQ ID NO: 2754153 - protein, 8 aa, Entamoeba invadens
ESFDKSPN

SEQ ID NO: 2754154 - protein, 6 aa, Entamoeba invadens
ESFDPN

SEQ ID NO: 2754155 - protein, 6 aa, Entamoeba invadens
ESFDTK

SEQ ID NO: 2754156 - protein, 12 aa, Entamoeba invadens
ESFENSENYPNP

SEQ ID NO: 2754157 - protein, 6 aa, Entamoeba invadens
ESFKGS

SEQ ID NO: 2754158 - protein, 13 aa, Entamoeba invadens
ESFNQSKSAPINQ

SEQ ID NO: 2754159 - protein, 4 aa, Entamoeba invadens
ESFS

SEQ ID NO: 2754160 - protein, 5 aa, Entamoeba invadens
ESFST

SEQ ID NO: 2754161 - protein, 11 aa, Entamoeba invadens
ESFTTEEKTAI

SEQ ID NO: 2754162 - protein, 7 aa, Entamoeba invadens
ESGAGLS

SEQ ID NO: 2754163 - protein, 8 aa, Entamoeba invadens
ESGCGKST

SEQ ID NO: 2754164 - protein, 7 aa, Entamoeba invadens
ESGDHSQ

SEQ ID NO: 2754165 - protein, 5 aa, Entamoeba invadens
ESGDI

SEQ ID NO: 2754166 - protein, 10 aa, Entamoeba invadens
ESGECTSCQS

SEQ ID NO: 2754167 - protein, 10 aa, Entamoeba invadens
ESGECTTCQS

SEQ ID NO: 2754168 - protein, 9 aa, Entamoeba invadens
ESGEEANTK

SEQ ID NO: 2754169 - protein, 6 aa, Entamoeba invadens
ESGEIP

SEQ ID NO: 2754170 - protein, 12 aa, Entamoeba invadens
ESGEIPVERESR

SEQ ID NO: 2754171 - protein, 9 aa, Entamoeba invadens
ESGEKEEKE

SEQ ID NO: 2754172 - protein, 15 aa, Entamoeba invadens
ESGESDSNCENCGDT

SEQ ID NO: 2754173 - protein, 8 aa, Entamoeba invadens
ESGIKETM

SEQ ID NO: 2754174 - protein, 6 aa, Entamoeba invadens
ESGKED

SEQ ID NO: 2754175 - protein, 6 aa, Entamoeba invadens
ESGKEE

SEQ ID NO: 2754176 - protein, 7 aa, Entamoeba invadens
ESGLSSK

SEQ ID NO: 2754177 - protein, 6 aa, Entamoeba invadens
ESGQTI

SEQ ID NO: 2754178 - protein, 12 aa, Entamoeba invadens
ESGQYANAATNS

SEQ ID NO: 2754179 - protein, 15 aa, Entamoeba invadens
ESGRSQMENDQLPEV

SEQ ID NO: 2754180 - protein, 17 aa, Entamoeba invadens
ESGRVKTGFEEKRPRNC

SEQ ID NO: 2754181 - protein, 6 aa, Entamoeba invadens
ESGSNI

SEQ ID NO: 2754182 - protein, 6 aa, Entamoeba invadens
ESGTHE

SEQ ID NO: 2754183 - protein, 6 aa, Entamoeba invadens
ESGTHQ

SEQ ID NO: 2754184 - protein, 5 aa, Entamoeba invadens
ESGTK

SEQ ID NO: 2754185 - protein, 5 aa, Entamoeba invadens
ESGTL

SEQ ID NO: 2754186 - protein, 9 aa, Entamoeba invadens
ESGTPYSDK

SEQ ID NO: 2754187 - protein, 8 aa, Entamoeba invadens
ESGTSCTK

SEQ ID NO: 2754188 - protein, 5 aa, Entamoeba invadens
ESGVC

SEQ ID NO: 2754189 - protein, 12 aa, Entamoeba invadens
ESGYCSSCTSGY

SEQ ID NO: 2754190 - protein, 7 aa, Entamoeba invadens
ESGYYRG

SEQ ID NO: 2754191 - protein, 13 aa, Entamoeba invadens
ESHENYNMNNEKN

SEQ ID NO: 2754192 - protein, 7 aa, Entamoeba invadens
ESHKPDF

SEQ ID NO: 2754193 - protein, 7 aa, Entamoeba invadens
ESHPTAA

SEQ ID NO: 2754194 - protein, 7 aa, Entamoeba invadens
ESHRKGF

SEQ ID NO: 2754195 - protein, 5 aa, Entamoeba invadens
ESIDM

SEQ ID NO: 2754196 - protein, 7 aa, Entamoeba invadens
ESIESKY

SEQ ID NO: 2754197 - protein, 11 aa, Entamoeba invadens
ESINEAEKMKD

SEQ ID NO: 2754198 - protein, 7 aa, Entamoeba invadens
ESINGQI

SEQ ID NO: 2754199 - protein, 8 aa, Entamoeba invadens
ESIPADSS

SEQ ID NO: 2754200 - protein, 22 aa, Entamoeba invadens
ESIPKHAQEALESTSEGSLSSF

SEQ ID NO: 2754201 - protein, 6 aa, Entamoeba invadens
ESIQTS

SEQ ID NO: 2754202 - protein, 18 aa, Entamoeba invadens
ESISDDEFSTKVSRVTTD

SEQ ID NO: 2754203 - protein, 8 aa, Entamoeba invadens
ESISETNP

SEQ ID NO: 2754204 - protein, 6 aa, Entamoeba invadens
ESITDS

SEQ ID NO: 2754205 - protein, 8 aa, Entamoeba invadens
ESITNSEK

SEQ ID NO: 2754206 - protein, 5 aa, Entamoeba invadens
ESIYN

SEQ ID NO: 2754207 - protein, 7 aa, Entamoeba invadens
ESKDTNI

SEQ ID NO: 2754208 - protein, 5 aa, Entamoeba invadens
ESKEA

SEQ ID NO: 2754209 - protein, 10 aa, Entamoeba invadens
ESKEKKQVRR

SEQ ID NO: 2754210 - protein, 8 aa, Entamoeba invadens
ESKESNSG

SEQ ID NO: 2754211 - protein, 8 aa, Entamoeba invadens
ESKESSLN

SEQ ID NO: 2754212 - protein, 7 aa, Entamoeba invadens
ESKGSWS

SEQ ID NO: 2754213 - protein, 15 aa, Entamoeba invadens
ESKIRNDKTNKSESL

SEQ ID NO: 2754214 - protein, 9 aa, Entamoeba invadens
ESKKKTMSA

SEQ ID NO: 2754215 - protein, 4 aa, Entamoeba invadens
ESKN

SEQ ID NO: 2754216 - protein, 11 aa, Entamoeba invadens
ESKNEEKRKEL

SEQ ID NO: 2754217 - protein, 11 aa, Entamoeba invadens
ESKNNGNNNYY

SEQ ID NO: 2754218 - protein, 6 aa, Entamoeba invadens
ESKPIS

SEQ ID NO: 2754219 - protein, 13 aa, Entamoeba invadens
ESKPISEASSQQK

SEQ ID NO: 2754220 - protein, 5 aa, Entamoeba invadens
ESKPY

SEQ ID NO: 2754221 - protein, 5 aa, Entamoeba invadens
ESKQM

SEQ ID NO: 2754222 - protein, 7 aa, Entamoeba invadens
ESKRMDT

SEQ ID NO: 2754223 - protein, 9 aa, Entamoeba invadens
ESKRTIDAS

SEQ ID NO: 2754224 - protein, 8 aa, Entamoeba invadens
ESKRVSTT

SEQ ID NO: 2754225 - protein, 4 aa, Entamoeba invadens
ESKS

SEQ ID NO: 2754226 - protein, 6 aa, Entamoeba invadens
ESKTCQ

SEQ ID NO: 2754227 - protein, 5 aa, Entamoeba invadens
ESKTF

SEQ ID NO: 2754228 - protein, 6 aa, Entamoeba invadens
ESKTIK

SEQ ID NO: 2754229 - protein, 9 aa, Entamoeba invadens
ESKTKKYNK

SEQ ID NO: 2754230 - protein, 9 aa, Entamoeba invadens
ESKTPKRLS

SEQ ID NO: 2754231 - protein, 9 aa, Entamoeba invadens
ESKVPHLEE

SEQ ID NO: 2754232 - protein, 11 aa, Entamoeba invadens
ESKYSTSEKNF

SEQ ID NO: 2754233 - protein, 11 aa, Entamoeba invadens
ESLAQKYSDYY

SEQ ID NO: 2754234 - protein, 8 aa, Entamoeba invadens
ESLENPRK

SEQ ID NO: 2754235 - protein, 10 aa, Entamoeba invadens
ESLESAVEEE

SEQ ID NO: 2754236 - protein, 7 aa, Entamoeba invadens
ESLGEEA

SEQ ID NO: 2754237 - protein, 5 aa, Entamoeba invadens
ESLKQ

SEQ ID NO: 2754238 - protein, 4 aa, Entamoeba invadens
ESLP

SEQ ID NO: 2754239 - protein, 9 aa, Entamoeba invadens
ESLPGGDSY

SEQ ID NO: 2754240 - protein, 8 aa, Entamoeba invadens
ESLPSTRC

SEQ ID NO: 2754241 - protein, 14 aa, Entamoeba invadens
ESLTDYYSNSDNVK

SEQ ID NO: 2754242 - protein, 6 aa, Entamoeba invadens
ESMSEI

SEQ ID NO: 2754243 - protein, 6 aa, Entamoeba invadens
ESMTEQ

SEQ ID NO: 2754244 - protein, 6 aa, Entamoeba invadens
ESNCVG

SEQ ID NO: 2754245 - protein, 5 aa, Entamoeba invadens
ESNEV

SEQ ID NO: 2754246 - protein, 14 aa, Entamoeba invadens
ESNGNGMCSTRNGD

SEQ ID NO: 2754247 - protein, 4 aa, Entamoeba invadens
ESNH

SEQ ID NO: 2754248 - protein, 17 aa, Entamoeba invadens
ESNINSAGTQHAAPSSQ

SEQ ID NO: 2754249 - protein, 13 aa, Entamoeba invadens
ESNKYCKENGLPQ

SEQ ID NO: 2754250 - protein, 5 aa, Entamoeba invadens
ESNLL

SEQ ID NO: 2754251 - protein, 5 aa, Entamoeba invadens
ESNNN

SEQ ID NO: 2754252 - protein, 10 aa, Entamoeba invadens
ESNNTKFAKT

SEQ ID NO: 2754253 - protein, 9 aa, Entamoeba invadens
ESNPTNETR

SEQ ID NO: 2754254 - protein, 5 aa, Entamoeba invadens
ESNSD

SEQ ID NO: 2754255 - protein, 7 aa, Entamoeba invadens
ESNSSKV

SEQ ID NO: 2754256 - protein, 5 aa, Entamoeba invadens
ESNTE

SEQ ID NO: 2754257 - protein, 6 aa, Entamoeba invadens
ESNTTL

SEQ ID NO: 2754258 - protein, 24 aa, Entamoeba invadens
ESNVNKKRLNPHSMTESSNKATAH

SEQ ID NO: 2754259 - protein, 7 aa, Entamoeba invadens
ESNYNYL

SEQ ID NO: 2754260 - protein, 4 aa, Entamoeba invadens
ESPD

SEQ ID NO: 2754261 - protein, 7 aa, Entamoeba invadens
ESPEAQK

SEQ ID NO: 2754262 - protein, 9 aa, Entamoeba invadens
ESPENRPTF

SEQ ID NO: 2754263 - protein, 7 aa, Entamoeba invadens
ESPFNQS

SEQ ID NO: 2754264 - protein, 7 aa, Entamoeba invadens
ESPITSD

SEQ ID NO: 2754265 - protein, 5 aa, Entamoeba invadens
ESPKF

SEQ ID NO: 2754266 - protein, 33 aa, Entamoeba invadens
ESPKTTPRTTRTPKRQNPTKGKRLTESKGLSDS

SEQ ID NO: 2754267 - protein, 8 aa, Entamoeba invadens
ESPLSTIS

SEQ ID NO: 2754268 - protein, 5 aa, Entamoeba invadens
ESPMT

SEQ ID NO: 2754269 - protein, 24 aa, Entamoeba invadens
ESPRTRQRRQTDGEKTQGQMTPRG

SEQ ID NO: 2754270 - protein, 6 aa, Entamoeba invadens
ESPSKT

SEQ ID NO: 2754271 - protein, 5 aa, Entamoeba invadens
ESPSS

SEQ ID NO: 2754272 - protein, 17 aa, Entamoeba invadens
ESPSVSETPPPKTPLVN

SEQ ID NO: 2754273 - protein, 6 aa, Entamoeba invadens
ESPVSS

SEQ ID NO: 2754274 - protein, 6 aa, Entamoeba invadens
ESPYEQ

SEQ ID NO: 2754275 - protein, 9 aa, Entamoeba invadens
ESQETNRDL

SEQ ID NO: 2754276 - protein, 4 aa, Entamoeba invadens
ESQI

SEQ ID NO: 2754277 - protein, 8 aa, Entamoeba invadens
ESQNNGLT

SEQ ID NO: 2754278 - protein, 10 aa, Entamoeba invadens
ESQNNGSTVG

SEQ ID NO: 2754279 - protein, 13 aa, Entamoeba invadens
ESQTPRISEDNTH

SEQ ID NO: 2754280 - protein, 35 aa, Entamoeba invadens
ESQTQCTKCGNNQYVQADGSCGDTCPEKHRKGDGI

SEQ ID NO: 2754281 - protein, 4 aa, Entamoeba invadens
ESRE

SEQ ID NO: 2754282 - protein, 10 aa, Entamoeba invadens
ESREEETYQQ

SEQ ID NO: 2754283 - protein, 11 aa, Entamoeba invadens
ESRFRQKQQTY

SEQ ID NO: 2754284 - protein, 8 aa, Entamoeba invadens
ESRGATAT

SEQ ID NO: 2754285 - protein, 7 aa, Entamoeba invadens
ESRPGVE

SEQ ID NO: 2754286 - protein, 13 aa, Entamoeba invadens
ESRRSVAGQDASD

SEQ ID NO: 2754287 - protein, 9 aa, Entamoeba invadens
ESSAKQDIS

SEQ ID NO: 2754288 - protein, 7 aa, Entamoeba invadens
ESSDTNI

SEQ ID NO: 2754289 - protein, 7 aa, Entamoeba invadens
ESSEDQA

SEQ ID NO: 2754290 - protein, 8 aa, Entamoeba invadens
ESSEFNNR

SEQ ID NO: 2754291 - protein, 8 aa, Entamoeba invadens
ESSEGCGS

SEQ ID NO: 2754292 - protein, 12 aa, Entamoeba invadens
ESSEKGKPPNEH

SEQ ID NO: 2754293 - protein, 11 aa, Entamoeba invadens
ESSEKRYEESC

SEQ ID NO: 2754294 - protein, 10 aa, Entamoeba invadens
ESSENSMTTQ

SEQ ID NO: 2754295 - protein, 7 aa, Entamoeba invadens
ESSERSN

SEQ ID NO: 2754296 - protein, 18 aa, Entamoeba invadens
ESSEVRKKRSVKETVSES

SEQ ID NO: 2754297 - protein, 11 aa, Entamoeba invadens
ESSGERKCNTC

SEQ ID NO: 2754298 - protein, 5 aa, Entamoeba invadens
ESSGH

SEQ ID NO: 2754299 - protein, 7 aa, Entamoeba invadens
ESSGTSC

SEQ ID NO: 2754300 - protein, 9 aa, Entamoeba invadens
ESSGTSCNS

SEQ ID NO: 2754301 - protein, 6 aa, Entamoeba invadens
ESSITT

SEQ ID NO: 2754302 - protein, 4 aa, Entamoeba invadens
ESSK

SEQ ID NO: 2754303 - protein, 9 aa, Entamoeba invadens
ESSKDGSVC

SEQ ID NO: 2754304 - protein, 8 aa, Entamoeba invadens
ESSKKYNT

SEQ ID NO: 2754305 - protein, 13 aa, Entamoeba invadens
ESSKRRVENTKKA

SEQ ID NO: 2754306 - protein, 13 aa, Entamoeba invadens
ESSLSRGTSSTTN

SEQ ID NO: 2754307 - protein, 8 aa, Entamoeba invadens
ESSLTAEA

SEQ ID NO: 2754308 - protein, 14 aa, Entamoeba invadens
ESSNETKKYRGSVY

SEQ ID NO: 2754309 - protein, 13 aa, Entamoeba invadens
ESSNLSCDKSTGY

SEQ ID NO: 2754310 - protein, 5 aa, Entamoeba invadens
ESSNY

SEQ ID NO: 2754311 - protein, 9 aa, Entamoeba invadens
ESSPPRTEE

SEQ ID NO: 2754312 - protein, 5 aa, Entamoeba invadens
ESSQD

SEQ ID NO: 2754313 - protein, 12 aa, Entamoeba invadens
ESSRRFKTNKEM

SEQ ID NO: 2754314 - protein, 10 aa, Entamoeba invadens
ESSSQFKTSA

SEQ ID NO: 2754315 - protein, 9 aa, Entamoeba invadens
ESSSTDQVT

SEQ ID NO: 2754316 - protein, 7 aa, Entamoeba invadens
ESSSTSR

SEQ ID NO: 2754317 - protein, 10 aa, Entamoeba invadens
ESSTKQKREM

SEQ ID NO: 2754318 - protein, 8 aa, Entamoeba invadens
ESSTPLKD

SEQ ID NO: 2754319 - protein, 6 aa, Entamoeba invadens
ESSVNF

SEQ ID NO: 2754320 - protein, 14 aa, Entamoeba invadens
ESSYLSKKDNHKEF

SEQ ID NO: 2754321 - protein, 4 aa, Entamoeba invadens
ESTD

SEQ ID NO: 2754322 - protein, 26 aa, Entamoeba invadens
ESTEKVKSLPSSLISSPRNRSDEVSR

SEQ ID NO: 2754323 - protein, 7 aa, Entamoeba invadens
ESTERIK

SEQ ID NO: 2754324 - protein, 6 aa, Entamoeba invadens
ESTESF

SEQ ID NO: 2754325 - protein, 6 aa, Entamoeba invadens
ESTFET

SEQ ID NO: 2754326 - protein, 4 aa, Entamoeba invadens
ESTG

SEQ ID NO: 2754327 - protein, 7 aa, Entamoeba invadens
ESTIQKE

SEQ ID NO: 2754328 - protein, 8 aa, Entamoeba invadens
ESTITEIE

SEQ ID NO: 2754329 - protein, 7 aa, Entamoeba invadens
ESTKPED

SEQ ID NO: 2754330 - protein, 10 aa, Entamoeba invadens
ESTKPVSPYY

SEQ ID NO: 2754331 - protein, 10 aa, Entamoeba invadens
ESTKQCESCD

SEQ ID NO: 2754332 - protein, 13 aa, Entamoeba invadens
ESTKQIRKQPNHP

SEQ ID NO: 2754333 - protein, 10 aa, Entamoeba invadens
ESTLDDGQSQ

SEQ ID NO: 2754334 - protein, 4 aa, Entamoeba invadens
ESTN

SEQ ID NO: 2754335 - protein, 8 aa, Entamoeba invadens
ESTNDVEE

SEQ ID NO: 2754336 - protein, 6 aa, Entamoeba invadens
ESTNRC

SEQ ID NO: 2754337 - protein, 6 aa, Entamoeba invadens
ESTPFS

SEQ ID NO: 2754338 - protein, 8 aa, Entamoeba invadens
ESTPSISK

SEQ ID NO: 2754339 - protein, 7 aa, Entamoeba invadens
ESTPYYQ

SEQ ID NO: 2754340 - protein, 4 aa, Entamoeba invadens
ESTQ

SEQ ID NO: 2754341 - protein, 8 aa, Entamoeba invadens
ESTQEGYH

SEQ ID NO: 2754342 - protein, 6 aa, Entamoeba invadens
ESTQSK

SEQ ID NO: 2754343 - protein, 12 aa, Entamoeba invadens
ESTTAAITTGTT

SEQ ID NO: 2754344 - protein, 15 aa, Entamoeba invadens
ESTTAKCTKCTASTD

SEQ ID NO: 2754345 - protein, 16 aa, Entamoeba invadens
ESTTAKCTKCTTSTDY

SEQ ID NO: 2754346 - protein, 9 aa, Entamoeba invadens
ESTTKEELT

SEQ ID NO: 2754347 - protein, 10 aa, Entamoeba invadens
ESTTQSYTKH

SEQ ID NO: 2754348 - protein, 7 aa, Entamoeba invadens
ESTTRRI

SEQ ID NO: 2754349 - protein, 11 aa, Entamoeba invadens
ESTTTTKCKPT

SEQ ID NO: 2754350 - protein, 4 aa, Entamoeba invadens
ESTV

SEQ ID NO: 2754351 - protein, 6 aa, Entamoeba invadens
ESTYDS

SEQ ID NO: 2754352 - protein, 6 aa, Entamoeba invadens
ESVAVT

SEQ ID NO: 2754353 - protein, 13 aa, Entamoeba invadens
ESVEKMETEVKTM

SEQ ID NO: 2754354 - protein, 7 aa, Entamoeba invadens
ESVEQNN

SEQ ID NO: 2754355 - protein, 11 aa, Entamoeba invadens
ESVESSVSPSN

SEQ ID NO: 2754356 - protein, 8 aa, Entamoeba invadens
ESVGGNTL

SEQ ID NO: 2754357 - protein, 7 aa, Entamoeba invadens
ESVIPTT

SEQ ID NO: 2754358 - protein, 12 aa, Entamoeba invadens
ESVNKSVGESIT

SEQ ID NO: 2754359 - protein, 7 aa, Entamoeba invadens
ESVQEKA

SEQ ID NO: 2754360 - protein, 5 aa, Entamoeba invadens
ESVQN

SEQ ID NO: 2754361 - protein, 9 aa, Entamoeba invadens
ESVRKDIEK

SEQ ID NO: 2754362 - protein, 6 aa, Entamoeba invadens
ESVTSM

SEQ ID NO: 2754363 - protein, 6 aa, Entamoeba invadens
ESVTST

SEQ ID NO: 2754364 - protein, 9 aa, Entamoeba invadens
ESVTTNAGE

SEQ ID NO: 2754365 - protein, 6 aa, Entamoeba invadens
ESWRPQ

SEQ ID NO: 2754366 - protein, 6 aa, Entamoeba invadens
ESYAEN

SEQ ID NO: 2754367 - protein, 9 aa, Entamoeba invadens
ESYEEVDKT

SEQ ID NO: 2754368 - protein, 9 aa, Entamoeba invadens
ESYETPCND

SEQ ID NO: 2754369 - protein, 4 aa, Entamoeba invadens
ESYG

SEQ ID NO: 2754370 - protein, 7 aa, Entamoeba invadens
ESYGGDD

SEQ ID NO: 2754371 - protein, 8 aa, Entamoeba invadens
ESYGGPDC

SEQ ID NO: 2754372 - protein, 5 aa, Entamoeba invadens
ESYGY

SEQ ID NO: 2754373 - protein, 11 aa, Entamoeba invadens
ESYKATEDEPI

SEQ ID NO: 2754374 - protein, 10 aa, Entamoeba invadens
ESYKGEENNK

SEQ ID NO: 2754375 - protein, 5 aa, Entamoeba invadens
ESYKK

SEQ ID NO: 2754376 - protein, 10 aa, Entamoeba invadens
ESYLNDEYSQ

SEQ ID NO: 2754377 - protein, 5 aa, Entamoeba invadens
ESYQT

SEQ ID NO: 2754378 - protein, 14 aa, Entamoeba invadens
ESYSFSETSIENKR

SEQ ID NO: 2754379 - protein, 6 aa, Entamoeba invadens
ESYVEN

SEQ ID NO: 2754380 - protein, 12 aa, Entamoeba invadens
ESYVPTTSDPFK

SEQ ID NO: 2754381 - protein, 11 aa, Entamoeba invadens
ETADKNYNYAS

SEQ ID NO: 2754382 - protein, 15 aa, Entamoeba invadens
ETAESGDEVKDNTNC

SEQ ID NO: 2754383 - protein, 8 aa, Entamoeba invadens
ETAKAEYS

SEQ ID NO: 2754384 - protein, 5 aa, Entamoeba invadens
ETAKE

SEQ ID NO: 2754385 - protein, 13 aa, Entamoeba invadens
ETANETKVAVSQT

SEQ ID NO: 2754386 - protein, 23 aa, Entamoeba invadens
ETAQRNKELESQTSKLCEETKEE

SEQ ID NO: 2754387 - protein, 7 aa, Entamoeba invadens
ETARENC

SEQ ID NO: 2754388 - protein, 7 aa, Entamoeba invadens
ETARQYA

SEQ ID NO: 2754389 - protein, 7 aa, Entamoeba invadens
ETASEAA

SEQ ID NO: 2754390 - protein, 8 aa, Entamoeba invadens
ETASPTCE

SEQ ID NO: 2754391 - protein, 48 aa, Entamoeba invadens
ETAVTKEGKMVEDSKDEDDTKKMLGSGDEEDECDGDKVEGEEDEYDDD

SEQ ID NO: 2754392 - protein, 9 aa, Entamoeba invadens
ETCDQTNGN

SEQ ID NO: 2754393 - protein, 5 aa, Entamoeba invadens
ETCDT

SEQ ID NO: 2754394 - protein, 8 aa, Entamoeba invadens
ETCEAERA

SEQ ID NO: 2754395 - protein, 5 aa, Entamoeba invadens
ETCES

SEQ ID NO: 2754396 - protein, 8 aa, Entamoeba invadens
ETCGGECN

SEQ ID NO: 2754397 - protein, 9 aa, Entamoeba invadens
ETCGGKCDT

SEQ ID NO: 2754398 - protein, 9 aa, Entamoeba invadens
ETCGNGQLD

SEQ ID NO: 2754399 - protein, 6 aa, Entamoeba invadens
ETCGNN

SEQ ID NO: 2754400 - protein, 18 aa, Entamoeba invadens
ETCKKHDQSGCKECNNDL

SEQ ID NO: 2754401 - protein, 11 aa, Entamoeba invadens
ETCNDKKNCYT

SEQ ID NO: 2754402 - protein, 5 aa, Entamoeba invadens
ETCNK

SEQ ID NO: 2754403 - protein, 7 aa, Entamoeba invadens
ETCNNNN

SEQ ID NO: 2754404 - protein, 10 aa, Entamoeba invadens
ETCNSGTECT

SEQ ID NO: 2754405 - protein, 6 aa, Entamoeba invadens
ETCNSN

SEQ ID NO: 2754406 - protein, 7 aa, Entamoeba invadens
ETCNSNC

SEQ ID NO: 2754407 - protein, 7 aa, Entamoeba invadens
ETCNSSC

SEQ ID NO: 2754408 - protein, 6 aa, Entamoeba invadens
ETCNTT

SEQ ID NO: 2754409 - protein, 13 aa, Entamoeba invadens
ETCPNSNYTINGE

SEQ ID NO: 2754410 - protein, 14 aa, Entamoeba invadens
ETCQTCDKKSSKCV

SEQ ID NO: 2754411 - protein, 13 aa, Entamoeba invadens
ETCQTCDKTSSKC

SEQ ID NO: 2754412 - protein, 5 aa, Entamoeba invadens
ETCSE

SEQ ID NO: 2754413 - protein, 7 aa, Entamoeba invadens
ETCSETF

SEQ ID NO: 2754414 - protein, 7 aa, Entamoeba invadens
ETCSGPL

SEQ ID NO: 2754415 - protein, 8 aa, Entamoeba invadens
ETCSGPLD

SEQ ID NO: 2754416 - protein, 6 aa, Entamoeba invadens
ETCSSC

SEQ ID NO: 2754417 - protein, 11 aa, Entamoeba invadens
ETCSSSGVCST

SEQ ID NO: 2754418 - protein, 9 aa, Entamoeba invadens
ETCSSTSAR

SEQ ID NO: 2754419 - protein, 7 aa, Entamoeba invadens
ETDAKPL

SEQ ID NO: 2754420 - protein, 9 aa, Entamoeba invadens
ETDATSSTY

SEQ ID NO: 2754421 - protein, 4 aa, Entamoeba invadens
ETDD

SEQ ID NO: 2754422 - protein, 8 aa, Entamoeba invadens
ETDDESAK

SEQ ID NO: 2754423 - protein, 9 aa, Entamoeba invadens
ETDDLNEVD

SEQ ID NO: 2754424 - protein, 9 aa, Entamoeba invadens
ETDDPNFQK

SEQ ID NO: 2754425 - protein, 9 aa, Entamoeba invadens
ETDDYDKQF

SEQ ID NO: 2754426 - protein, 8 aa, Entamoeba invadens
ETDESDIG

SEQ ID NO: 2754427 - protein, 8 aa, Entamoeba invadens
ETDGPTDF

SEQ ID NO: 2754428 - protein, 6 aa, Entamoeba invadens
ETDGQQ

SEQ ID NO: 2754429 - protein, 9 aa, Entamoeba invadens
ETDKGRETL

SEQ ID NO: 2754430 - protein, 4 aa, Entamoeba invadens
ETDQ

SEQ ID NO: 2754431 - protein, 9 aa, Entamoeba invadens
ETDTEKGIC

SEQ ID NO: 2754432 - protein, 5 aa, Entamoeba invadens
ETEAY

SEQ ID NO: 2754433 - protein, 5 aa, Entamoeba invadens
ETECS

SEQ ID NO: 2754434 - protein, 8 aa, Entamoeba invadens
ETEDGTLS

SEQ ID NO: 2754435 - protein, 15 aa, Entamoeba invadens
ETEDGVEKEYEECSN

SEQ ID NO: 2754436 - protein, 4 aa, Entamoeba invadens
ETEE

SEQ ID NO: 2754437 - protein, 12 aa, Entamoeba invadens
ETEECEKCTTSG

SEQ ID NO: 2754438 - protein, 7 aa, Entamoeba invadens
ETEEIEK

SEQ ID NO: 2754439 - protein, 8 aa, Entamoeba invadens
ETEENGQT

SEQ ID NO: 2754440 - protein, 9 aa, Entamoeba invadens
ETEETTKKK

SEQ ID NO: 2754441 - protein, 22 aa, Entamoeba invadens
ETEHTGVPKNFANATNDPEIDQ

SEQ ID NO: 2754442 - protein, 12 aa, Entamoeba invadens
ETEKGSGKCEEC

SEQ ID NO: 2754443 - protein, 18 aa, Entamoeba invadens
ETEKPNEVITSENTTSQC

SEQ ID NO: 2754444 - protein, 6 aa, Entamoeba invadens
ETEKTK

SEQ ID NO: 2754445 - protein, 5 aa, Entamoeba invadens
ETENG

SEQ ID NO: 2754446 - protein, 5 aa, Entamoeba invadens
ETENS

SEQ ID NO: 2754447 - protein, 50 aa, Entamoeba invadens
ETENVGSEIDTIDQTEAKLKREKTRRMTSADKSELRQRSVSMSSDYSTTF

SEQ ID NO: 2754448 - protein, 5 aa, Entamoeba invadens
ETEPT

SEQ ID NO: 2754449 - protein, 5 aa, Entamoeba invadens
ETERT

SEQ ID NO: 2754450 - protein, 6 aa, Entamoeba invadens
ETESSI

SEQ ID NO: 2754451 - protein, 21 aa, Entamoeba invadens
ETESVGSECSEENAEESDNGT

SEQ ID NO: 2754452 - protein, 10 aa, Entamoeba invadens
ETESVNTTPI

SEQ ID NO: 2754453 - protein, 23 aa, Entamoeba invadens
ETETTSADEITSETQKTYTPVPK

SEQ ID NO: 2754454 - protein, 12 aa, Entamoeba invadens
ETEVSSLTGAGY

SEQ ID NO: 2754455 - protein, 10 aa, Entamoeba invadens
ETFEKDNTVE

SEQ ID NO: 2754456 - protein, 10 aa, Entamoeba invadens
ETFETDPESA

SEQ ID NO: 2754457 - protein, 12 aa, Entamoeba invadens
ETFKEQNGMCTS

SEQ ID NO: 2754458 - protein, 10 aa, Entamoeba invadens
ETFKNKEGVE

SEQ ID NO: 2754459 - protein, 12 aa, Entamoeba invadens
ETFKPNSEGGQC

SEQ ID NO: 2754460 - protein, 7 aa, Entamoeba invadens
ETFNEEN

SEQ ID NO: 2754461 - protein, 4 aa, Entamoeba invadens
ETFS

SEQ ID NO: 2754462 - protein, 7 aa, Entamoeba invadens
ETFSKEE

SEQ ID NO: 2754463 - protein, 12 aa, Entamoeba invadens
ETFSTEDKATMQ

SEQ ID NO: 2754464 - protein, 11 aa, Entamoeba invadens
ETFSTTGDGCY

SEQ ID NO: 2754465 - protein, 6 aa, Entamoeba invadens
ETGATK

SEQ ID NO: 2754466 - protein, 4 aa, Entamoeba invadens
ETGC

SEQ ID NO: 2754467 - protein, 9 aa, Entamoeba invadens
ETGDEDSVN

SEQ ID NO: 2754468 - protein, 8 aa, Entamoeba invadens
ETGEGTSL

SEQ ID NO: 2754469 - protein, 10 aa, Entamoeba invadens
ETGEMNGTVP

SEQ ID NO: 2754470 - protein, 6 aa, Entamoeba invadens
ETGEVE

SEQ ID NO: 2754471 - protein, 10 aa, Entamoeba invadens
ETGGLEPNRE

SEQ ID NO: 2754472 - protein, 4 aa, Entamoeba invadens
ETGI

SEQ ID NO: 2754473 - protein, 4 aa, Entamoeba invadens
ETGK

SEQ ID NO: 2754474 - protein, 7 aa, Entamoeba invadens
ETGKEEI

SEQ ID NO: 2754475 - protein, 6 aa, Entamoeba invadens
ETGKHT

SEQ ID NO: 2754476 - protein, 10 aa, Entamoeba invadens
ETGKKDIDGK

SEQ ID NO: 2754477 - protein, 12 aa, Entamoeba invadens
ETGKLTKKTEVQ

SEQ ID NO: 2754478 - protein, 7 aa, Entamoeba invadens
ETGMRGR

SEQ ID NO: 2754479 - protein, 14 aa, Entamoeba invadens
ETGNEEEKRIEKNG

SEQ ID NO: 2754480 - protein, 6 aa, Entamoeba invadens
ETGNVT

SEQ ID NO: 2754481 - protein, 6 aa, Entamoeba invadens
ETGSDG

SEQ ID NO: 2754482 - protein, 8 aa, Entamoeba invadens
ETGTGKTT

SEQ ID NO: 2754483 - protein, 9 aa, Entamoeba invadens
ETGTGKTTM

SEQ ID NO: 2754484 - protein, 9 aa, Entamoeba invadens
ETHKPTEIS

SEQ ID NO: 2754485 - protein, 17 aa, Entamoeba invadens
ETHTDEQKNSTTTSQNY

SEQ ID NO: 2754486 - protein, 13 aa, Entamoeba invadens
ETIEDTTATTVEY

SEQ ID NO: 2754487 - protein, 6 aa, Entamoeba invadens
ETIEGN

SEQ ID NO: 2754488 - protein, 5 aa, Entamoeba invadens
ETIEL

SEQ ID NO: 2754489 - protein, 4 aa, Entamoeba invadens
ETIG

SEQ ID NO: 2754490 - protein, 8 aa, Entamoeba invadens
ETINEDGS

SEQ ID NO: 2754491 - protein, 7 aa, Entamoeba invadens
ETINSGE

SEQ ID NO: 2754492 - protein, 9 aa, Entamoeba invadens
ETINTSNGR

SEQ ID NO: 2754493 - protein, 7 aa, Entamoeba invadens
ETIPEQQ

SEQ ID NO: 2754494 - protein, 9 aa, Entamoeba invadens
ETISEECDS

SEQ ID NO: 2754495 - protein, 6 aa, Entamoeba invadens
ETISSS

SEQ ID NO: 2754496 - protein, 24 aa, Entamoeba invadens
ETITSTGKCTSGDKCKYTATTADK

SEQ ID NO: 2754497 - protein, 16 aa, Entamoeba invadens
ETITTANCGETADNCK

SEQ ID NO: 2754498 - protein, 16 aa, Entamoeba invadens
ETITTANCGETTNNCK

SEQ ID NO: 2754499 - protein, 11 aa, Entamoeba invadens
ETIVGEEKDPQ

SEQ ID NO: 2754500 - protein, 18 aa, Entamoeba invadens
ETKAENKQKIKEAQEAVQ

SEQ ID NO: 2754501 - protein, 6 aa, Entamoeba invadens
ETKDEE

SEQ ID NO: 2754502 - protein, 5 aa, Entamoeba invadens
ETKEI

SEQ ID NO: 2754503 - protein, 5 aa, Entamoeba invadens
ETKFP

SEQ ID NO: 2754504 - protein, 10 aa, Entamoeba invadens
ETKGDFKGRK

SEQ ID NO: 2754505 - protein, 8 aa, Entamoeba invadens
ETKIGEGS

SEQ ID NO: 2754506 - protein, 9 aa, Entamoeba invadens
ETKKADRNV

SEQ ID NO: 2754507 - protein, 6 aa, Entamoeba invadens
ETKKGK

SEQ ID NO: 2754508 - protein, 9 aa, Entamoeba invadens
ETKKLGEGS

SEQ ID NO: 2754509 - protein, 9 aa, Entamoeba invadens
ETKKNGDIA

SEQ ID NO: 2754510 - protein, 8 aa, Entamoeba invadens
ETKLGEGS

SEQ ID NO: 2754511 - protein, 7 aa, Entamoeba invadens
ETKLNNM

SEQ ID NO: 2754512 - protein, 10 aa, Entamoeba invadens
ETKPSNMAKA

SEQ ID NO: 2754513 - protein, 22 aa, Entamoeba invadens
ETKQLQSAKGVKIKRSSIERNT

SEQ ID NO: 2754514 - protein, 5 aa, Entamoeba invadens
ETKQQ

SEQ ID NO: 2754515 - protein, 9 aa, Entamoeba invadens
ETKQVQSTS

SEQ ID NO: 2754516 - protein, 4 aa, Entamoeba invadens
ETKR

SEQ ID NO: 2754517 - protein, 6 aa, Entamoeba invadens
ETKRLS

SEQ ID NO: 2754518 - protein, 8 aa, Entamoeba invadens
ETKSEISN

SEQ ID NO: 2754519 - protein, 5 aa, Entamoeba invadens
ETKSF

SEQ ID NO: 2754520 - protein, 8 aa, Entamoeba invadens
ETKSFSWP

SEQ ID NO: 2754521 - protein, 10 aa, Entamoeba invadens
ETKSGVEREA

SEQ ID NO: 2754522 - protein, 9 aa, Entamoeba invadens
ETKSSGGCL

SEQ ID NO: 2754523 - protein, 9 aa, Entamoeba invadens
ETKTCKKGN

SEQ ID NO: 2754524 - protein, 9 aa, Entamoeba invadens
ETKTELTTR

SEQ ID NO: 2754525 - protein, 10 aa, Entamoeba invadens
ETKTGKKEVS

SEQ ID NO: 2754526 - protein, 13 aa, Entamoeba invadens
ETKTNENKKKKAR

SEQ ID NO: 2754527 - protein, 6 aa, Entamoeba invadens
ETKTTE

SEQ ID NO: 2754528 - protein, 11 aa, Entamoeba invadens
ETKTVDGKEVS

SEQ ID NO: 2754529 - protein, 5 aa, Entamoeba invadens
ETKVE

SEQ ID NO: 2754530 - protein, 7 aa, Entamoeba invadens
ETLDIPK

SEQ ID NO: 2754531 - protein, 4 aa, Entamoeba invadens
ETLE

SEQ ID NO: 2754532 - protein, 12 aa, Entamoeba invadens
ETLEKANSAIQR

SEQ ID NO: 2754533 - protein, 5 aa, Entamoeba invadens
ETLEQ

SEQ ID NO: 2754534 - protein, 5 aa, Entamoeba invadens
ETLKN

SEQ ID NO: 2754535 - protein, 12 aa, Entamoeba invadens
ETLNQEKETLNQ

SEQ ID NO: 2754536 - protein, 8 aa, Entamoeba invadens
ETLQDTDP

SEQ ID NO: 2754537 - protein, 8 aa, Entamoeba invadens
ETLSDHKS

SEQ ID NO: 2754538 - protein, 6 aa, Entamoeba invadens
ETLSGE

SEQ ID NO: 2754539 - protein, 5 aa, Entamoeba invadens
ETLTD

SEQ ID NO: 2754540 - protein, 9 aa, Entamoeba invadens
ETLTNTSSV

SEQ ID NO: 2754541 - protein, 5 aa, Entamoeba invadens
ETLTT

SEQ ID NO: 2754542 - protein, 9 aa, Entamoeba invadens
ETLVGEGGF

SEQ ID NO: 2754543 - protein, 5 aa, Entamoeba invadens
ETMER

SEQ ID NO: 2754544 - protein, 4 aa, Entamoeba invadens
ETMN

SEQ ID NO: 2754545 - protein, 5 aa, Entamoeba invadens
ETMNK

SEQ ID NO: 2754546 - protein, 4 aa, Entamoeba invadens
ETMS

SEQ ID NO: 2754547 - protein, 15 aa, Entamoeba invadens
ETNATTKDMKKSDET

SEQ ID NO: 2754548 - protein, 5 aa, Entamoeba invadens
ETNDA

SEQ ID NO: 2754549 - protein, 21 aa, Entamoeba invadens
ETNDYNGTCEDDSQCDKKVNN

SEQ ID NO: 2754550 - protein, 5 aa, Entamoeba invadens
ETNEQ

SEQ ID NO: 2754551 - protein, 17 aa, Entamoeba invadens
ETNETSSLSTQSSGQFY

SEQ ID NO: 2754552 - protein, 14 aa, Entamoeba invadens
ETNHPMPTQQPPMP

SEQ ID NO: 2754553 - protein, 9 aa, Entamoeba invadens
ETNIIEKGD

SEQ ID NO: 2754554 - protein, 9 aa, Entamoeba invadens
ETNKLVGTQ

SEQ ID NO: 2754555 - protein, 9 aa, Entamoeba invadens
ETNKTLGQQ

SEQ ID NO: 2754556 - protein, 8 aa, Entamoeba invadens
ETNKYQHG

SEQ ID NO: 2754557 - protein, 14 aa, Entamoeba invadens
ETNNCNNPNDENGK

SEQ ID NO: 2754558 - protein, 6 aa, Entamoeba invadens
ETNNKC

SEQ ID NO: 2754559 - protein, 5 aa, Entamoeba invadens
ETNNL

SEQ ID NO: 2754560 - protein, 5 aa, Entamoeba invadens
ETNNN

SEQ ID NO: 2754561 - protein, 12 aa, Entamoeba invadens
ETNNPDKCSQDC

SEQ ID NO: 2754562 - protein, 4 aa, Entamoeba invadens
ETNP

SEQ ID NO: 2754563 - protein, 6 aa, Entamoeba invadens
ETNPPE

SEQ ID NO: 2754564 - protein, 5 aa, Entamoeba invadens
ETNSN

SEQ ID NO: 2754565 - protein, 7 aa, Entamoeba invadens
ETNTDVL

SEQ ID NO: 2754566 - protein, 7 aa, Entamoeba invadens
ETNTSGA

SEQ ID NO: 2754567 - protein, 10 aa, Entamoeba invadens
ETNTSKPSVI

SEQ ID NO: 2754568 - protein, 4 aa, Entamoeba invadens
ETNV

SEQ ID NO: 2754569 - protein, 5 aa, Entamoeba invadens
ETNVS

SEQ ID NO: 2754570 - protein, 7 aa, Entamoeba invadens
ETNYERV

SEQ ID NO: 2754571 - protein, 16 aa, Entamoeba invadens
ETNYKTANNECKPQSD

SEQ ID NO: 2754572 - protein, 16 aa, Entamoeba invadens
ETNYQTTDGNCLPQSS

SEQ ID NO: 2754573 - protein, 12 aa, Entamoeba invadens
ETPCEKTTGKCS

SEQ ID NO: 2754574 - protein, 4 aa, Entamoeba invadens
ETPF

SEQ ID NO: 2754575 - protein, 5 aa, Entamoeba invadens
ETPIE

SEQ ID NO: 2754576 - protein, 37 aa, Entamoeba invadens
ETPIGDKENTSKKSESFEEENTHFAEDKGLLNSVVID

SEQ ID NO: 2754577 - protein, 5 aa, Entamoeba invadens
ETPIT

SEQ ID NO: 2754578 - protein, 4 aa, Entamoeba invadens
ETPL

SEQ ID NO: 2754579 - protein, 6 aa, Entamoeba invadens
ETPNDT

SEQ ID NO: 2754580 - protein, 5 aa, Entamoeba invadens
ETPSG

SEQ ID NO: 2754581 - protein, 12 aa, Entamoeba invadens
ETPYPASADQYN

SEQ ID NO: 2754582 - protein, 6 aa, Entamoeba invadens
ETQDHP

SEQ ID NO: 2754583 - protein, 11 aa, Entamoeba invadens
ETQGAKKVQIT

SEQ ID NO: 2754584 - protein, 11 aa, Entamoeba invadens
ETQIESCSSYT

SEQ ID NO: 2754585 - protein, 6 aa, Entamoeba invadens
ETQIPD

SEQ ID NO: 2754586 - protein, 7 aa, Entamoeba invadens
ETQMSTR

SEQ ID NO: 2754587 - protein, 9 aa, Entamoeba invadens
ETQNATSFA

SEQ ID NO: 2754588 - protein, 5 aa, Entamoeba invadens
ETQPH

SEQ ID NO: 2754589 - protein, 5 aa, Entamoeba invadens
ETQPY

SEQ ID NO: 2754590 - protein, 14 aa, Entamoeba invadens
ETQRGTEKEINIDA

SEQ ID NO: 2754591 - protein, 9 aa, Entamoeba invadens
ETQSETFGK

SEQ ID NO: 2754592 - protein, 10 aa, Entamoeba invadens
ETQSTNCTSC

SEQ ID NO: 2754593 - protein, 4 aa, Entamoeba invadens
ETQT

SEQ ID NO: 2754594 - protein, 18 aa, Entamoeba invadens
ETQTKPEEKIPQKEEKVV

SEQ ID NO: 2754595 - protein, 6 aa, Entamoeba invadens
ETQTMS

SEQ ID NO: 2754596 - protein, 5 aa, Entamoeba invadens
ETRAD

SEQ ID NO: 2754597 - protein, 9 aa, Entamoeba invadens
ETREPETEK

SEQ ID NO: 2754598 - protein, 8 aa, Entamoeba invadens
ETRKIADE

SEQ ID NO: 2754599 - protein, 14 aa, Entamoeba invadens
ETRKTKPKTTEKVE

SEQ ID NO: 2754600 - protein, 5 aa, Entamoeba invadens
ETRPK

SEQ ID NO: 2754601 - protein, 8 aa, Entamoeba invadens
ETSAKNRI

SEQ ID NO: 2754602 - protein, 11 aa, Entamoeba invadens
ETSCSETQNTY

SEQ ID NO: 2754603 - protein, 10 aa, Entamoeba invadens
ETSCSTTQNT

SEQ ID NO: 2754604 - protein, 11 aa, Entamoeba invadens
ETSDAKKEFNT

SEQ ID NO: 2754605 - protein, 21 aa, Entamoeba invadens
ETSDAKRMTQENENKQRKVKK

SEQ ID NO: 2754606 - protein, 10 aa, Entamoeba invadens
ETSDENGRVD

SEQ ID NO: 2754607 - protein, 5 aa, Entamoeba invadens
ETSEF

SEQ ID NO: 2754608 - protein, 7 aa, Entamoeba invadens
ETSENTF

SEQ ID NO: 2754609 - protein, 21 aa, Entamoeba invadens
ETSENTKPEQPKVSNEERQRV

SEQ ID NO: 2754610 - protein, 7 aa, Entamoeba invadens
ETSEQEK

SEQ ID NO: 2754611 - protein, 9 aa, Entamoeba invadens
ETSETPSNT

SEQ ID NO: 2754612 - protein, 6 aa, Entamoeba invadens
ETSGNW

SEQ ID NO: 2754613 - protein, 10 aa, Entamoeba invadens
ETSISSNDLP

SEQ ID NO: 2754614 - protein, 5 aa, Entamoeba invadens
ETSIT

SEQ ID NO: 2754615 - protein, 17 aa, Entamoeba invadens
ETSKQSNETSKNKVDDL

SEQ ID NO: 2754616 - protein, 6 aa, Entamoeba invadens
ETSKSE

SEQ ID NO: 2754617 - protein, 8 aa, Entamoeba invadens
ETSLEEHS

SEQ ID NO: 2754618 - protein, 8 aa, Entamoeba invadens
ETSLSKQS

SEQ ID NO: 2754619 - protein, 5 aa, Entamoeba invadens
ETSND

SEQ ID NO: 2754620 - protein, 7 aa, Entamoeba invadens
ETSNENC

SEQ ID NO: 2754621 - protein, 5 aa, Entamoeba invadens
ETSNK

SEQ ID NO: 2754622 - protein, 14 aa, Entamoeba invadens
ETSNKTLAEYEKRD

SEQ ID NO: 2754623 - protein, 4 aa, Entamoeba invadens
ETSP

SEQ ID NO: 2754624 - protein, 14 aa, Entamoeba invadens
ETSPDSDGSDYKPY

SEQ ID NO: 2754625 - protein, 6 aa, Entamoeba invadens
ETSQGT

SEQ ID NO: 2754626 - protein, 11 aa, Entamoeba invadens
ETSQLKNVKED

SEQ ID NO: 2754627 - protein, 6 aa, Entamoeba invadens
ETSQYT

SEQ ID NO: 2754628 - protein, 5 aa, Entamoeba invadens
ETSSD

SEQ ID NO: 2754629 - protein, 8 aa, Entamoeba invadens
ETSSDPQM

SEQ ID NO: 2754630 - protein, 10 aa, Entamoeba invadens
ETSSLEESNR

SEQ ID NO: 2754631 - protein, 10 aa, Entamoeba invadens
ETSSRAFQQN

SEQ ID NO: 2754632 - protein, 5 aa, Entamoeba invadens
ETSSV

SEQ ID NO: 2754633 - protein, 5 aa, Entamoeba invadens
ETSTG

SEQ ID NO: 2754634 - protein, 6 aa, Entamoeba invadens
ETSTGL

SEQ ID NO: 2754635 - protein, 10 aa, Entamoeba invadens
ETSTQVSTKL

SEQ ID NO: 2754636 - protein, 13 aa, Entamoeba invadens
ETSVQEVSQDTFG

SEQ ID NO: 2754637 - protein, 8 aa, Entamoeba invadens
ETTAPNKI

SEQ ID NO: 2754638 - protein, 5 aa, Entamoeba invadens
ETTCT

SEQ ID NO: 2754639 - protein, 10 aa, Entamoeba invadens
ETTETCSPCE

SEQ ID NO: 2754640 - protein, 6 aa, Entamoeba invadens
ETTINN

SEQ ID NO: 2754641 - protein, 5 aa, Entamoeba invadens
ETTIQ

SEQ ID NO: 2754642 - protein, 12 aa, Entamoeba invadens
ETTKMNSKEKVT

SEQ ID NO: 2754643 - protein, 7 aa, Entamoeba invadens
ETTKQAD

SEQ ID NO: 2754644 - protein, 9 aa, Entamoeba invadens
ETTLESNRL

SEQ ID NO: 2754645 - protein, 11 aa, Entamoeba invadens
ETTLQNNTEIS

SEQ ID NO: 2754646 - protein, 10 aa, Entamoeba invadens
ETTNCTSTTP

SEQ ID NO: 2754647 - protein, 10 aa, Entamoeba invadens
ETTNRISADE

SEQ ID NO: 2754648 - protein, 8 aa, Entamoeba invadens
ETTNRKEM

SEQ ID NO: 2754649 - protein, 4 aa, Entamoeba invadens
ETTP

SEQ ID NO: 2754650 - protein, 10 aa, Entamoeba invadens
ETTPANEQVL

SEQ ID NO: 2754651 - protein, 7 aa, Entamoeba invadens
ETTPQDV

SEQ ID NO: 2754652 - protein, 11 aa, Entamoeba invadens
ETTQGEGTSTN

SEQ ID NO: 2754653 - protein, 11 aa, Entamoeba invadens
ETTQNGCAKCS

SEQ ID NO: 2754654 - protein, 13 aa, Entamoeba invadens
ETTQNGCSKCSDG

SEQ ID NO: 2754655 - protein, 4 aa, Entamoeba invadens
ETTR

SEQ ID NO: 2754656 - protein, 17 aa, Entamoeba invadens
ETTRSNIENIERQADRV

SEQ ID NO: 2754657 - protein, 18 aa, Entamoeba invadens
ETTSSGGWNDPNDPSGFR

SEQ ID NO: 2754658 - protein, 5 aa, Entamoeba invadens
ETTSY

SEQ ID NO: 2754659 - protein, 12 aa, Entamoeba invadens
ETTTATTQDNYP

SEQ ID NO: 2754660 - protein, 9 aa, Entamoeba invadens
ETTTGSSAI

SEQ ID NO: 2754661 - protein, 11 aa, Entamoeba invadens
ETTTKNSTKLD

SEQ ID NO: 2754662 - protein, 10 aa, Entamoeba invadens
ETTTSLTEEQ

SEQ ID NO: 2754663 - protein, 6 aa, Entamoeba invadens
ETTTSS

SEQ ID NO: 2754664 - protein, 11 aa, Entamoeba invadens
ETTTVQSTKLN

SEQ ID NO: 2754665 - protein, 8 aa, Entamoeba invadens
ETTYKPEK

SEQ ID NO: 2754666 - protein, 4 aa, Entamoeba invadens
ETVE

SEQ ID NO: 2754667 - protein, 6 aa, Entamoeba invadens
ETVEQK

SEQ ID NO: 2754668 - protein, 4 aa, Entamoeba invadens
ETVH

SEQ ID NO: 2754669 - protein, 5 aa, Entamoeba invadens
ETVKG

SEQ ID NO: 2754670 - protein, 5 aa, Entamoeba invadens
ETVPD

SEQ ID NO: 2754671 - protein, 5 aa, Entamoeba invadens
ETVPN

SEQ ID NO: 2754672 - protein, 17 aa, Entamoeba invadens
ETVQQNEKTKIKTKGKE

SEQ ID NO: 2754673 - protein, 16 aa, Entamoeba invadens
ETVSQLRKKRNKAANK

SEQ ID NO: 2754674 - protein, 4 aa, Entamoeba invadens
ETVT

SEQ ID NO: 2754675 - protein, 12 aa, Entamoeba invadens
ETVTISEDKNKV

SEQ ID NO: 2754676 - protein, 11 aa, Entamoeba invadens
ETWNNSDQKYM

SEQ ID NO: 2754677 - protein, 5 aa, Entamoeba invadens
ETWPQ

SEQ ID NO: 2754678 - protein, 12 aa, Entamoeba invadens
ETWTKEDQDRFD

SEQ ID NO: 2754679 - protein, 5 aa, Entamoeba invadens
ETYAT

SEQ ID NO: 2754680 - protein, 8 aa, Entamoeba invadens
ETYCDTND

SEQ ID NO: 2754681 - protein, 7 aa, Entamoeba invadens
ETYDPRI

SEQ ID NO: 2754682 - protein, 4 aa, Entamoeba invadens
ETYS

SEQ ID NO: 2754683 - protein, 6 aa, Entamoeba invadens
ETYSNN

SEQ ID NO: 2754684 - protein, 17 aa, Entamoeba invadens
EVAAHSGLDDGVSQEKI

SEQ ID NO: 2754685 - protein, 4 aa, Entamoeba invadens
EVAK

SEQ ID NO: 2754686 - protein, 10 aa, Entamoeba invadens
EVANSDISLS

SEQ ID NO: 2754687 - protein, 8 aa, Entamoeba invadens
EVANTTRG

SEQ ID NO: 2754688 - protein, 15 aa, Entamoeba invadens
EVDAAQKARERKEKR

SEQ ID NO: 2754689 - protein, 7 aa, Entamoeba invadens
EVDDDSN

SEQ ID NO: 2754690 - protein, 4 aa, Entamoeba invadens
EVDE

SEQ ID NO: 2754691 - protein, 5 aa, Entamoeba invadens
EVDWK

SEQ ID NO: 2754692 - protein, 5 aa, Entamoeba invadens
EVEEK

SEQ ID NO: 2754693 - protein, 18 aa, Entamoeba invadens
EVEEPDDDEQDQQEEEVD

SEQ ID NO: 2754694 - protein, 12 aa, Entamoeba invadens
EVEHNEESMEEF

SEQ ID NO: 2754695 - protein, 11 aa, Entamoeba invadens
EVENNEESMEE

SEQ ID NO: 2754696 - protein, 45 aa, Entamoeba invadens
EVENQKAVTNKVATMSEKETAEQPESSATTVTQEPTTDDKDHPKS

SEQ ID NO: 2754697 - protein, 9 aa, Entamoeba invadens
EVETETQAT

SEQ ID NO: 2754698 - protein, 10 aa, Entamoeba invadens
EVGEQNPELP

SEQ ID NO: 2754699 - protein, 5 aa, Entamoeba invadens
EVGES

SEQ ID NO: 2754700 - protein, 19 aa, Entamoeba invadens
EVGESSVRKPMNQTSANAL

SEQ ID NO: 2754701 - protein, 40 aa, Entamoeba invadens
EVGGKKRKINEKVENEKKQKAKERRKRQEEKERKEKELQK

SEQ ID NO: 2754702 - protein, 8 aa, Entamoeba invadens
EVGNEKSY

SEQ ID NO: 2754703 - protein, 14 aa, Entamoeba invadens
EVGTGCKVTEKDYT

SEQ ID NO: 2754704 - protein, 6 aa, Entamoeba invadens
EVHDSH

SEQ ID NO: 2754705 - protein, 7 aa, Entamoeba invadens
EVHNKGE

SEQ ID NO: 2754706 - protein, 11 aa, Entamoeba invadens
EVHSTNEQRGM

SEQ ID NO: 2754707 - protein, 10 aa, Entamoeba invadens
EVKDSNGNCT

SEQ ID NO: 2754708 - protein, 22 aa, Entamoeba invadens
EVKEKKEEEDPEKEHLKKEEEK

SEQ ID NO: 2754709 - protein, 5 aa, Entamoeba invadens
EVKGN

SEQ ID NO: 2754710 - protein, 15 aa, Entamoeba invadens
EVKKEEKKIQVDKTT

SEQ ID NO: 2754711 - protein, 10 aa, Entamoeba invadens
EVKKQSKKVD

SEQ ID NO: 2754712 - protein, 7 aa, Entamoeba invadens
EVKNGSN

SEQ ID NO: 2754713 - protein, 11 aa, Entamoeba invadens
EVKNNKTSMAE

SEQ ID NO: 2754714 - protein, 9 aa, Entamoeba invadens
EVKNPKRTI

SEQ ID NO: 2754715 - protein, 16 aa, Entamoeba invadens
EVKPVENKKDDKIKIT

SEQ ID NO: 2754716 - protein, 7 aa, Entamoeba invadens
EVKSNGY

SEQ ID NO: 2754717 - protein, 9 aa, Entamoeba invadens
EVKTNSKCN

SEQ ID NO: 2754718 - protein, 6 aa, Entamoeba invadens
EVKTSI

SEQ ID NO: 2754719 - protein, 6 aa, Entamoeba invadens
EVNENT

SEQ ID NO: 2754720 - protein, 9 aa, Entamoeba invadens
EVNKAKVKS

SEQ ID NO: 2754721 - protein, 7 aa, Entamoeba invadens
EVNPKTV

SEQ ID NO: 2754722 - protein, 5 aa, Entamoeba invadens
EVPDE

SEQ ID NO: 2754723 - protein, 5 aa, Entamoeba invadens
EVPEN

SEQ ID NO: 2754724 - protein, 5 aa, Entamoeba invadens
EVPET

SEQ ID NO: 2754725 - protein, 12 aa, Entamoeba invadens
EVPKKFKGEPSL

SEQ ID NO: 2754726 - protein, 13 aa, Entamoeba invadens
EVPKQGEAEEVDE

SEQ ID NO: 2754727 - protein, 11 aa, Entamoeba invadens
EVPKTLPSDPL

SEQ ID NO: 2754728 - protein, 4 aa, Entamoeba invadens
EVPS

SEQ ID NO: 2754729 - protein, 9 aa, Entamoeba invadens
EVPSPPEKF

SEQ ID NO: 2754730 - protein, 23 aa, Entamoeba invadens
EVPSTQTFTTTADASFDSYQNTR

SEQ ID NO: 2754731 - protein, 16 aa, Entamoeba invadens
EVPTEPEKAEAKPVGE

SEQ ID NO: 2754732 - protein, 6 aa, Entamoeba invadens
EVPTTN

SEQ ID NO: 2754733 - protein, 8 aa, Entamoeba invadens
EVQGPTEI

SEQ ID NO: 2754734 - protein, 11 aa, Entamoeba invadens
EVQRELSKGYK

SEQ ID NO: 2754735 - protein, 5 aa, Entamoeba invadens
EVRTP

SEQ ID NO: 2754736 - protein, 7 aa, Entamoeba invadens
EVSDSPE

SEQ ID NO: 2754737 - protein, 8 aa, Entamoeba invadens
EVSEEEYD

SEQ ID NO: 2754738 - protein, 5 aa, Entamoeba invadens
EVSGN

SEQ ID NO: 2754739 - protein, 4 aa, Entamoeba invadens
EVSK

SEQ ID NO: 2754740 - protein, 5 aa, Entamoeba invadens
EVSNE

SEQ ID NO: 2754741 - protein, 9 aa, Entamoeba invadens
EVSNENKFE

SEQ ID NO: 2754742 - protein, 7 aa, Entamoeba invadens
EVSNGNK

SEQ ID NO: 2754743 - protein, 14 aa, Entamoeba invadens
EVSRRSCSQSIPTQ

SEQ ID NO: 2754744 - protein, 7 aa, Entamoeba invadens
EVSSPYS

SEQ ID NO: 2754745 - protein, 6 aa, Entamoeba invadens
EVSSTF

SEQ ID NO: 2754746 - protein, 4 aa, Entamoeba invadens
EVTA

SEQ ID NO: 2754747 - protein, 5 aa, Entamoeba invadens
EVTEE

SEQ ID NO: 2754748 - protein, 5 aa, Entamoeba invadens
EVTEG

SEQ ID NO: 2754749 - protein, 5 aa, Entamoeba invadens
EVTER

SEQ ID NO: 2754750 - protein, 12 aa, Entamoeba invadens
EVTKQTGDLKEQ

SEQ ID NO: 2754751 - protein, 8 aa, Entamoeba invadens
EVTLSESE

SEQ ID NO: 2754752 - protein, 4 aa, Entamoeba invadens
EVTN

SEQ ID NO: 2754753 - protein, 8 aa, Entamoeba invadens
EVTNRGGH

SEQ ID NO: 2754754 - protein, 7 aa, Entamoeba invadens
EVTPSAN

SEQ ID NO: 2754755 - protein, 8 aa, Entamoeba invadens
EVTPTVDK

SEQ ID NO: 2754756 - protein, 8 aa, Entamoeba invadens
EVTQNGCS

SEQ ID NO: 2754757 - protein, 5 aa, Entamoeba invadens
EVTST

SEQ ID NO: 2754758 - protein, 7 aa, Entamoeba invadens
EVYNAKE

SEQ ID NO: 2754759 - protein, 6 aa, Entamoeba invadens
EVYPNN

SEQ ID NO: 2754760 - protein, 5 aa, Entamoeba invadens
EWAND

SEQ ID NO: 2754761 - protein, 11 aa, Entamoeba invadens
EWETEKKDSRW

SEQ ID NO: 2754762 - protein, 8 aa, Entamoeba invadens
EYDESEQM

SEQ ID NO: 2754763 - protein, 9 aa, Entamoeba invadens
EYDKPPKAT

SEQ ID NO: 2754764 - protein, 14 aa, Entamoeba invadens
EYDKSTPTKQSKRR

SEQ ID NO: 2754765 - protein, 6 aa, Entamoeba invadens
EYDKTN

SEQ ID NO: 2754766 - protein, 8 aa, Entamoeba invadens
EYDKYPNT

SEQ ID NO: 2754767 - protein, 4 aa, Entamoeba invadens
EYDS

SEQ ID NO: 2754768 - protein, 15 aa, Entamoeba invadens
EYEKDNNTTLPQDQE

SEQ ID NO: 2754769 - protein, 6 aa, Entamoeba invadens
EYEKQQ

SEQ ID NO: 2754770 - protein, 12 aa, Entamoeba invadens
EYFQNENGAFNV

SEQ ID NO: 2754771 - protein, 17 aa, Entamoeba invadens
EYGDDDDYEDEDVKDVI

SEQ ID NO: 2754772 - protein, 18 aa, Entamoeba invadens
EYGNTTKIVNPETNPTLV

SEQ ID NO: 2754773 - protein, 4 aa, Entamoeba invadens
EYGS

SEQ ID NO: 2754774 - protein, 12 aa, Entamoeba invadens
EYGSVSKTTCQK

SEQ ID NO: 2754775 - protein, 4 aa, Entamoeba invadens
EYGV

SEQ ID NO: 2754776 - protein, 5 aa, Entamoeba invadens
EYIEQ

SEQ ID NO: 2754777 - protein, 6 aa, Entamoeba invadens
EYIRND

SEQ ID NO: 2754778 - protein, 13 aa, Entamoeba invadens
EYKADDPNRNVAQ

SEQ ID NO: 2754779 - protein, 17 aa, Entamoeba invadens
EYKDGNNNCEKCATKNA

SEQ ID NO: 2754780 - protein, 23 aa, Entamoeba invadens
EYKEVRRKSMRDEREERGEERIK

SEQ ID NO: 2754781 - protein, 4 aa, Entamoeba invadens
EYKK

SEQ ID NO: 2754782 - protein, 8 aa, Entamoeba invadens
EYKLGEGS

SEQ ID NO: 2754783 - protein, 9 aa, Entamoeba invadens
EYKNEEDSC

SEQ ID NO: 2754784 - protein, 18 aa, Entamoeba invadens
EYKNGNNNCEKCETKNSL

SEQ ID NO: 2754785 - protein, 8 aa, Entamoeba invadens
EYKNHAQD

SEQ ID NO: 2754786 - protein, 8 aa, Entamoeba invadens
EYKPTSGI

SEQ ID NO: 2754787 - protein, 8 aa, Entamoeba invadens
EYLDNNNS

SEQ ID NO: 2754788 - protein, 5 aa, Entamoeba invadens
EYNED

SEQ ID NO: 2754789 - protein, 7 aa, Entamoeba invadens
EYNEKKL

SEQ ID NO: 2754790 - protein, 7 aa, Entamoeba invadens
EYNEQRR

SEQ ID NO: 2754791 - protein, 10 aa, Entamoeba invadens
EYNGTAESYP

SEQ ID NO: 2754792 - protein, 8 aa, Entamoeba invadens
EYNKNFPD

SEQ ID NO: 2754793 - protein, 17 aa, Entamoeba invadens
EYNNDSFSQNDCDTFST

SEQ ID NO: 2754794 - protein, 12 aa, Entamoeba invadens
EYNTNFKDSNTA

SEQ ID NO: 2754795 - protein, 9 aa, Entamoeba invadens
EYPAAEGTV

SEQ ID NO: 2754796 - protein, 4 aa, Entamoeba invadens
EYPG

SEQ ID NO: 2754797 - protein, 7 aa, Entamoeba invadens
EYPGGES

SEQ ID NO: 2754798 - protein, 10 aa, Entamoeba invadens
EYPPKCESCS

SEQ ID NO: 2754799 - protein, 9 aa, Entamoeba invadens
EYPPQCESC

SEQ ID NO: 2754800 - protein, 6 aa, Entamoeba invadens
EYPPSP

SEQ ID NO: 2754801 - protein, 8 aa, Entamoeba invadens
EYQDQSGS

SEQ ID NO: 2754802 - protein, 8 aa, Entamoeba invadens
EYQSPSYK

SEQ ID NO: 2754803 - protein, 17 aa, Entamoeba invadens
EYRDIQEKNRVISEEKV

SEQ ID NO: 2754804 - protein, 11 aa, Entamoeba invadens
EYRDTVAKETQ

SEQ ID NO: 2754805 - protein, 4 aa, Entamoeba invadens
EYRG

SEQ ID NO: 2754806 - protein, 7 aa, Entamoeba invadens
EYRNNRS

SEQ ID NO: 2754807 - protein, 6 aa, Entamoeba invadens
EYSAEN

SEQ ID NO: 2754808 - protein, 5 aa, Entamoeba invadens
EYSDT

SEQ ID NO: 2754809 - protein, 4 aa, Entamoeba invadens
EYSF

SEQ ID NO: 2754810 - protein, 10 aa, Entamoeba invadens
EYSNGNDYDS

SEQ ID NO: 2754811 - protein, 7 aa, Entamoeba invadens
EYSNSYD

SEQ ID NO: 2754812 - protein, 10 aa, Entamoeba invadens
EYSTSMSDLA

SEQ ID NO: 2754813 - protein, 10 aa, Entamoeba invadens
EYSTTENKSC

SEQ ID NO: 2754814 - protein, 9 aa, Entamoeba invadens
EYSYDKNGQ

SEQ ID NO: 2754815 - protein, 4 aa, Entamoeba invadens
EYTF

SEQ ID NO: 2754816 - protein, 6 aa, Entamoeba invadens
EYTGSY

SEQ ID NO: 2754817 - protein, 5 aa, Entamoeba invadens
EYTIN

SEQ ID NO: 2754818 - protein, 6 aa, Entamoeba invadens
EYTPQQ

SEQ ID NO: 2754819 - protein, 10 aa, Entamoeba invadens
EYTQEDKEYA

SEQ ID NO: 2754820 - protein, 6 aa, Entamoeba invadens
EYVGGD

SEQ ID NO: 2754821 - protein, 7 aa, Entamoeba invadens
EYYKKGA

SEQ ID NO: 2754822 - protein, 10 aa, Entamoeba invadens
EYYPDADGNC

SEQ ID NO: 2754823 - protein, 15 aa, Entamoeba invadens
EYYSKGTGSVSSVGV

SEQ ID NO: 2754824 - protein, 10 aa, Entamoeba invadens
FADENSPLAF

SEQ ID NO: 2754825 - protein, 4 aa, Entamoeba invadens
FADN

SEQ ID NO: 2754826 - protein, 11 aa, Entamoeba invadens
FAEKGADIDNP

SEQ ID NO: 2754827 - protein, 6 aa, Entamoeba invadens
FAGCGS

SEQ ID NO: 2754828 - protein, 8 aa, Entamoeba invadens
FAGPETKI

SEQ ID NO: 2754829 - protein, 11 aa, Entamoeba invadens
FAGRPRPNQFS

SEQ ID NO: 2754830 - protein, 13 aa, Entamoeba invadens
FAGTSKGTLGGSS

SEQ ID NO: 2754831 - protein, 9 aa, Entamoeba invadens
FAKNEKESY

SEQ ID NO: 2754832 - protein, 4 aa, Entamoeba invadens
FANA

SEQ ID NO: 2754833 - protein, 4 aa, Entamoeba invadens
FANR

SEQ ID NO: 2754834 - protein, 45 aa, Entamoeba invadens
FANSQRSDSDSSSKKRKSMKNSKITSKNTETTTTSQQESEEPTPR

SEQ ID NO: 2754835 - protein, 4 aa, Entamoeba invadens
FAPE

SEQ ID NO: 2754836 - protein, 6 aa, Entamoeba invadens
FAPNTV

SEQ ID NO: 2754837 - protein, 6 aa, Entamoeba invadens
FAPTEV

SEQ ID NO: 2754838 - protein, 9 aa, Entamoeba invadens
FASAEQITP

SEQ ID NO: 2754839 - protein, 8 aa, Entamoeba invadens
FASKEAHS

SEQ ID NO: 2754840 - protein, 5 aa, Entamoeba invadens
FASNG

SEQ ID NO: 2754841 - protein, 8 aa, Entamoeba invadens
FASPDERW

SEQ ID NO: 2754842 - protein, 7 aa, Entamoeba invadens
FASPENN

SEQ ID NO: 2754843 - protein, 13 aa, Entamoeba invadens
FASSNSLTNNGGA

SEQ ID NO: 2754844 - protein, 8 aa, Entamoeba invadens
FASSSSDS

SEQ ID NO: 2754845 - protein, 8 aa, Entamoeba invadens
FASTKDKE

SEQ ID NO: 2754846 - protein, 10 aa, Entamoeba invadens
FATIGGSQQV

SEQ ID NO: 2754847 - protein, 18 aa, Entamoeba invadens
FATKRTEKMQKQINELYR

SEQ ID NO: 2754848 - protein, 8 aa, Entamoeba invadens
FATNRSIS

SEQ ID NO: 2754849 - protein, 16 aa, Entamoeba invadens
FATPRTSISSKVSQTL

SEQ ID NO: 2754850 - protein, 9 aa, Entamoeba invadens
FATPSPYDH

SEQ ID NO: 2754851 - protein, 14 aa, Entamoeba invadens
FATTPRRKTGPNVP

SEQ ID NO: 2754852 - protein, 28 aa, Entamoeba invadens
FDAGNSPTAVVTQDDTQMPEVTDPLKSL

SEQ ID NO: 2754853 - protein, 15 aa, Entamoeba invadens
FDAQETPKNENNIST

SEQ ID NO: 2754854 - protein, 10 aa, Entamoeba invadens
FDAQTDNTTF

SEQ ID NO: 2754855 - protein, 13 aa, Entamoeba invadens
FDDDVKGKSIDTI

SEQ ID NO: 2754856 - protein, 8 aa, Entamoeba invadens
FDDNNIGN

SEQ ID NO: 2754857 - protein, 4 aa, Entamoeba invadens
FDDS

SEQ ID NO: 2754858 - protein, 5 aa, Entamoeba invadens
FDDSY

SEQ ID NO: 2754859 - protein, 14 aa, Entamoeba invadens
FDEKAKKMKGTPAK

SEQ ID NO: 2754860 - protein, 24 aa, Entamoeba invadens
FDENNKLKTDTKTATETSCQIRNN

SEQ ID NO: 2754861 - protein, 24 aa, Entamoeba invadens
FDEQRDDMANEQNVNEVGDSPELK

SEQ ID NO: 2754862 - protein, 4 aa, Entamoeba invadens
FDES

SEQ ID NO: 2754863 - protein, 6 aa, Entamoeba invadens
FDESDD

SEQ ID NO: 2754864 - protein, 19 aa, Entamoeba invadens
FDESKKNIDANREDNYISS

SEQ ID NO: 2754865 - protein, 41 aa, Entamoeba invadens
FDESQQCEEIEGKTIDDSELDTISNVSEADEEDSETTEKVE

SEQ ID NO: 2754866 - protein, 6 aa, Entamoeba invadens
FDETDI

SEQ ID NO: 2754867 - protein, 12 aa, Entamoeba invadens
FDEWTNEQQKHF

SEQ ID NO: 2754868 - protein, 4 aa, Entamoeba invadens
FDGG

SEQ ID NO: 2754869 - protein, 9 aa, Entamoeba invadens
FDGNDDDSS

SEQ ID NO: 2754870 - protein, 7 aa, Entamoeba invadens
FDGSDDV

SEQ ID NO: 2754871 - protein, 8 aa, Entamoeba invadens
FDGSSCQK

SEQ ID NO: 2754872 - protein, 12 aa, Entamoeba invadens
FDKDSSNETQPL

SEQ ID NO: 2754873 - protein, 11 aa, Entamoeba invadens
FDKEAQTTKDQ

SEQ ID NO: 2754874 - protein, 5 aa, Entamoeba invadens
FDKES

SEQ ID NO: 2754875 - protein, 6 aa, Entamoeba invadens
FDKKTE

SEQ ID NO: 2754876 - protein, 20 aa, Entamoeba invadens
FDKKTNTNLLGNNSTETGCS

SEQ ID NO: 2754877 - protein, 9 aa, Entamoeba invadens
FDLTSSTKK

SEQ ID NO: 2754878 - protein, 5 aa, Entamoeba invadens
FDNDD

SEQ ID NO: 2754879 - protein, 17 aa, Entamoeba invadens
FDNDLENDNQSELPVGV

SEQ ID NO: 2754880 - protein, 4 aa, Entamoeba invadens
FDNN

SEQ ID NO: 2754881 - protein, 13 aa, Entamoeba invadens
FDNTNDGNAVDEF

SEQ ID NO: 2754882 - protein, 11 aa, Entamoeba invadens
FDNTTGTPKCV

SEQ ID NO: 2754883 - protein, 11 aa, Entamoeba invadens
FDNTTGTPSCV

SEQ ID NO: 2754884 - protein, 14 aa, Entamoeba invadens
FDNWTNDDAKQMEK

SEQ ID NO: 2754885 - protein, 7 aa, Entamoeba invadens
FDPEKYR

SEQ ID NO: 2754886 - protein, 9 aa, Entamoeba invadens
FDPKGISKN

SEQ ID NO: 2754887 - protein, 12 aa, Entamoeba invadens
FDPNRYAGYADQ

SEQ ID NO: 2754888 - protein, 7 aa, Entamoeba invadens
FDPPKYL

SEQ ID NO: 2754889 - protein, 5 aa, Entamoeba invadens
FDPSN

SEQ ID NO: 2754890 - protein, 9 aa, Entamoeba invadens
FDQPGIQKQ

SEQ ID NO: 2754891 - protein, 9 aa, Entamoeba invadens
FDQPPQTEK

SEQ ID NO: 2754892 - protein, 7 aa, Entamoeba invadens
FDQQETV

SEQ ID NO: 2754893 - protein, 11 aa, Entamoeba invadens
FDQSSNYDFTS

SEQ ID NO: 2754894 - protein, 9 aa, Entamoeba invadens
FDRKSNTEV

SEQ ID NO: 2754895 - protein, 8 aa, Entamoeba invadens
FDRNTEKT

SEQ ID NO: 2754896 - protein, 7 aa, Entamoeba invadens
FDSDKDV

SEQ ID NO: 2754897 - protein, 6 aa, Entamoeba invadens
FDSDRK

SEQ ID NO: 2754898 - protein, 11 aa, Entamoeba invadens
FDSEKNRNRTQ

SEQ ID NO: 2754899 - protein, 34 aa, Entamoeba invadens
FDSESSENVEENSEKVRKESTDKARNKTKNRSVL

SEQ ID NO: 2754900 - protein, 5 aa, Entamoeba invadens
FDSNP

SEQ ID NO: 2754901 - protein, 7 aa, Entamoeba invadens
FDSNTFN

SEQ ID NO: 2754902 - protein, 10 aa, Entamoeba invadens
FDSPEKLLNN

SEQ ID NO: 2754903 - protein, 12 aa, Entamoeba invadens
FDSQKKNAIKNA

SEQ ID NO: 2754904 - protein, 9 aa, Entamoeba invadens
FDSQTGVCE

SEQ ID NO: 2754905 - protein, 15 aa, Entamoeba invadens
FDSRAAAKEQAESVG

SEQ ID NO: 2754906 - protein, 8 aa, Entamoeba invadens
FDSRNKDT

SEQ ID NO: 2754907 - protein, 14 aa, Entamoeba invadens
FDSWTQEDQKTIEK

SEQ ID NO: 2754908 - protein, 15 aa, Entamoeba invadens
FDTAENSCEKCNSTC

SEQ ID NO: 2754909 - protein, 5 aa, Entamoeba invadens
FDTEE

SEQ ID NO: 2754910 - protein, 9 aa, Entamoeba invadens
FDTSTNTFS

SEQ ID NO: 2754911 - protein, 14 aa, Entamoeba invadens
FDTWTNDNQQQMEK

SEQ ID NO: 2754912 - protein, 21 aa, Entamoeba invadens
FDTYESDLATANSSLTEREEK

SEQ ID NO: 2754913 - protein, 15 aa, Entamoeba invadens
FDVEKSSNHSTKDLD

SEQ ID NO: 2754914 - protein, 5 aa, Entamoeba invadens
FEAGS

SEQ ID NO: 2754915 - protein, 8 aa, Entamoeba invadens
FEAGSVDL

SEQ ID NO: 2754916 - protein, 11 aa, Entamoeba invadens
FECTQSSKNDD

SEQ ID NO: 2754917 - protein, 10 aa, Entamoeba invadens
FEDDPPQPED

SEQ ID NO: 2754918 - protein, 9 aa, Entamoeba invadens
FEDDSEKFR

SEQ ID NO: 2754919 - protein, 10 aa, Entamoeba invadens
FEDEHENEIN

SEQ ID NO: 2754920 - protein, 6 aa, Entamoeba invadens
FEDGLA

SEQ ID NO: 2754921 - protein, 7 aa, Entamoeba invadens
FEDGSEA

SEQ ID NO: 2754922 - protein, 7 aa, Entamoeba invadens
FEDNTTL

SEQ ID NO: 2754923 - protein, 5 aa, Entamoeba invadens
FEDPT

SEQ ID NO: 2754924 - protein, 88 aa, Entamoeba invadens
FEDTLSESSSYSSSESATSSSCTSSSECSSDEEEKEEKRVGSTNKEPKETQKETPKETSLPKTETVENNTKRPSPKEFESDEDIEKIR

SEQ ID NO: 2754925 - protein, 17 aa, Entamoeba invadens
FEEDEEDDKNEKTKKTR

SEQ ID NO: 2754926 - protein, 5 aa, Entamoeba invadens
FEEDK

SEQ ID NO: 2754927 - protein, 8 aa, Entamoeba invadens
FEEECDSG

SEQ ID NO: 2754928 - protein, 6 aa, Entamoeba invadens
FEEEEV

SEQ ID NO: 2754929 - protein, 11 aa, Entamoeba invadens
FEEKEELSETG

SEQ ID NO: 2754930 - protein, 6 aa, Entamoeba invadens
FEENEK

SEQ ID NO: 2754931 - protein, 8 aa, Entamoeba invadens
FEENKNDS

SEQ ID NO: 2754932 - protein, 7 aa, Entamoeba invadens
FEENNNF

SEQ ID NO: 2754933 - protein, 7 aa, Entamoeba invadens
FEEPSEK

SEQ ID NO: 2754934 - protein, 7 aa, Entamoeba invadens
FEERPSF

SEQ ID NO: 2754935 - protein, 33 aa, Entamoeba invadens
FEERSGELKELSSSQILDNEKKTAPEQKISSQA

SEQ ID NO: 2754936 - protein, 4 aa, Entamoeba invadens
FEET

SEQ ID NO: 2754937 - protein, 10 aa, Entamoeba invadens
FEETEKCSTC

SEQ ID NO: 2754938 - protein, 5 aa, Entamoeba invadens
FEGAT

SEQ ID NO: 2754939 - protein, 6 aa, Entamoeba invadens
FEGATK

SEQ ID NO: 2754940 - protein, 7 aa, Entamoeba invadens
FEGATSL

SEQ ID NO: 2754941 - protein, 4 aa, Entamoeba invadens
FEGC

SEQ ID NO: 2754942 - protein, 7 aa, Entamoeba invadens
FEGDGSE

SEQ ID NO: 2754943 - protein, 4 aa, Entamoeba invadens
FEGE

SEQ ID NO: 2754944 - protein, 8 aa, Entamoeba invadens
FEGETGLH

SEQ ID NO: 2754945 - protein, 13 aa, Entamoeba invadens
FEGKCTNGECLPN

SEQ ID NO: 2754946 - protein, 11 aa, Entamoeba invadens
FEGKSDVEVEA

SEQ ID NO: 2754947 - protein, 4 aa, Entamoeba invadens
FEGL

SEQ ID NO: 2754948 - protein, 6 aa, Entamoeba invadens
FEGNDG

SEQ ID NO: 2754949 - protein, 7 aa, Entamoeba invadens
FEGNTEM

SEQ ID NO: 2754950 - protein, 6 aa, Entamoeba invadens
FEGQKN

SEQ ID NO: 2754951 - protein, 6 aa, Entamoeba invadens
FEGSIG

SEQ ID NO: 2754952 - protein, 8 aa, Entamoeba invadens
FEKAREGE

SEQ ID NO: 2754953 - protein, 9 aa, Entamoeba invadens
FEKGKTTAI

SEQ ID NO: 2754954 - protein, 4 aa, Entamoeba invadens
FEKP

SEQ ID NO: 2754955 - protein, 16 aa, Entamoeba invadens
FEKSDNSQHTNHSEKF

SEQ ID NO: 2754956 - protein, 6 aa, Entamoeba invadens
FEKYEG

SEQ ID NO: 2754957 - protein, 4 aa, Entamoeba invadens
FEMG

SEQ ID NO: 2754958 - protein, 6 aa, Entamoeba invadens
FEMNGN

SEQ ID NO: 2754959 - protein, 17 aa, Entamoeba invadens
FENATRQNVLPQPPHPI

SEQ ID NO: 2754960 - protein, 4 aa, Entamoeba invadens
FEND

SEQ ID NO: 2754961 - protein, 6 aa, Entamoeba invadens
FENEAK

SEQ ID NO: 2754962 - protein, 8 aa, Entamoeba invadens
FENEENGT

SEQ ID NO: 2754963 - protein, 11 aa, Entamoeba invadens
FENENDTQKEI

SEQ ID NO: 2754964 - protein, 10 aa, Entamoeba invadens
FENETNSDLN

SEQ ID NO: 2754965 - protein, 5 aa, Entamoeba invadens
FENGK

SEQ ID NO: 2754966 - protein, 20 aa, Entamoeba invadens
FENPDSTNPNREIKVGQESR

SEQ ID NO: 2754967 - protein, 4 aa, Entamoeba invadens
FENS

SEQ ID NO: 2754968 - protein, 6 aa, Entamoeba invadens
FENSGI

SEQ ID NO: 2754969 - protein, 6 aa, Entamoeba invadens
FENSNS

SEQ ID NO: 2754970 - protein, 15 aa, Entamoeba invadens
FENTAKAMKGATDGV

SEQ ID NO: 2754971 - protein, 16 aa, Entamoeba invadens
FENTAKAMKGATDGVS

SEQ ID NO: 2754972 - protein, 5 aa, Entamoeba invadens
FENTK

SEQ ID NO: 2754973 - protein, 5 aa, Entamoeba invadens
FENTT

SEQ ID NO: 2754974 - protein, 12 aa, Entamoeba invadens
FENWTPEDNKSI

SEQ ID NO: 2754975 - protein, 8 aa, Entamoeba invadens
FEPAKGKV

SEQ ID NO: 2754976 - protein, 6 aa, Entamoeba invadens
FEPASV

SEQ ID NO: 2754977 - protein, 12 aa, Entamoeba invadens
FEPDKKRPGSCT

SEQ ID NO: 2754978 - protein, 4 aa, Entamoeba invadens
FEPI

SEQ ID NO: 2754979 - protein, 7 aa, Entamoeba invadens
FEPKGGE

SEQ ID NO: 2754980 - protein, 29 aa, Entamoeba invadens
FEPKKEEQKVETKTEEKIAESPKQETLPK

SEQ ID NO: 2754981 - protein, 9 aa, Entamoeba invadens
FEQHDDNDD

SEQ ID NO: 2754982 - protein, 4 aa, Entamoeba invadens
FEQK

SEQ ID NO: 2754983 - protein, 6 aa, Entamoeba invadens
FERSSN

SEQ ID NO: 2754984 - protein, 5 aa, Entamoeba invadens
FERTS

SEQ ID NO: 2754985 - protein, 13 aa, Entamoeba invadens
FESDSTDEDQEYY

SEQ ID NO: 2754986 - protein, 10 aa, Entamoeba invadens
FESDTNCGIA

SEQ ID NO: 2754987 - protein, 7 aa, Entamoeba invadens
FESEKDN

SEQ ID NO: 2754988 - protein, 8 aa, Entamoeba invadens
FESEYTDY

SEQ ID NO: 2754989 - protein, 11 aa, Entamoeba invadens
FESGTKNCKLK

SEQ ID NO: 2754990 - protein, 4 aa, Entamoeba invadens
FESN

SEQ ID NO: 2754991 - protein, 11 aa, Entamoeba invadens
FESNHSKEVAV

SEQ ID NO: 2754992 - protein, 4 aa, Entamoeba invadens
FESS

SEQ ID NO: 2754993 - protein, 6 aa, Entamoeba invadens
FESTGL

SEQ ID NO: 2754994 - protein, 10 aa, Entamoeba invadens
FETAASSTYL

SEQ ID NO: 2754995 - protein, 6 aa, Entamoeba invadens
FETEAK

SEQ ID NO: 2754996 - protein, 9 aa, Entamoeba invadens
FETEENTPL

SEQ ID NO: 2754997 - protein, 8 aa, Entamoeba invadens
FETEKTPM

SEQ ID NO: 2754998 - protein, 14 aa, Entamoeba invadens
FETFTQQDQTEMNK

SEQ ID NO: 2754999 - protein, 6 aa, Entamoeba invadens
FETGTF

SEQ ID NO: 2755000 - protein, 4 aa, Entamoeba invadens
FETN

SEQ ID NO: 2755001 - protein, 9 aa, Entamoeba invadens
FETNEFNTE

SEQ ID NO: 2755002 - protein, 7 aa, Entamoeba invadens
FETPDTS

SEQ ID NO: 2755003 - protein, 11 aa, Entamoeba invadens
FETPTKSQISF

SEQ ID NO: 2755004 - protein, 5 aa, Entamoeba invadens
FETQP

SEQ ID NO: 2755005 - protein, 9 aa, Entamoeba invadens
FETSKNENT

SEQ ID NO: 2755006 - protein, 5 aa, Entamoeba invadens
FETTQ

SEQ ID NO: 2755007 - protein, 14 aa, Entamoeba invadens
FETWNNSDQRNMDK

SEQ ID NO: 2755008 - protein, 15 aa, Entamoeba invadens
FETWNNSDQRNMDKL

SEQ ID NO: 2755009 - protein, 6 aa, Entamoeba invadens
FEYNNT

SEQ ID NO: 2755010 - protein, 13 aa, Entamoeba invadens
FEYNNTSCKSGHF

SEQ ID NO: 2755011 - protein, 4 aa, Entamoeba invadens
FFKE

SEQ ID NO: 2755012 - protein, 13 aa, Entamoeba invadens
FGAEKVKDPSVLT

SEQ ID NO: 2755013 - protein, 5 aa, Entamoeba invadens
FGAPN

SEQ ID NO: 2755014 - protein, 7 aa, Entamoeba invadens
FGATTGK

SEQ ID NO: 2755015 - protein, 6 aa, Entamoeba invadens
FGDEDD

SEQ ID NO: 2755016 - protein, 20 aa, Entamoeba invadens
FGDTSKNTQLDKSNHRIKSA

SEQ ID NO: 2755017 - protein, 4 aa, Entamoeba invadens
FGED

SEQ ID NO: 2755018 - protein, 18 aa, Entamoeba invadens
FGEESNENNEIDVDKETR

SEQ ID NO: 2755019 - protein, 14 aa, Entamoeba invadens
FGEEVPTNKTESAS

SEQ ID NO: 2755020 - protein, 18 aa, Entamoeba invadens
FGEGSKTYSGSKKDAKMN

SEQ ID NO: 2755021 - protein, 6 aa, Entamoeba invadens
FGEKEG

SEQ ID NO: 2755022 - protein, 9 aa, Entamoeba invadens
FGETDNVED

SEQ ID NO: 2755023 - protein, 10 aa, Entamoeba invadens
FGEVPPTCEG

SEQ ID NO: 2755024 - protein, 19 aa, Entamoeba invadens
FGGEKEANENNEISVEQET

SEQ ID NO: 2755025 - protein, 11 aa, Entamoeba invadens
FGGGDVRKNTE

SEQ ID NO: 2755026 - protein, 4 aa, Entamoeba invadens
FGGK

SEQ ID NO: 2755027 - protein, 4 aa, Entamoeba invadens
FGGN

SEQ ID NO: 2755028 - protein, 9 aa, Entamoeba invadens
FGGNCQSGI

SEQ ID NO: 2755029 - protein, 6 aa, Entamoeba invadens
FGGNTV

SEQ ID NO: 2755030 - protein, 4 aa, Entamoeba invadens
FGGQ

SEQ ID NO: 2755031 - protein, 69 aa, Entamoeba invadens
FGGSGEVKKEKKSASEKVVKAEAPKRGNTTSKISQWNGQEKKSTTEKKVSSPQPKRGGVAKLTGMYENM

SEQ ID NO: 2755032 - protein, 10 aa, Entamoeba invadens
FGGTEETFNS

SEQ ID NO: 2755033 - protein, 8 aa, Entamoeba invadens
FGGTVTTP

SEQ ID NO: 2755034 - protein, 10 aa, Entamoeba invadens
FGHNKTPDPV

SEQ ID NO: 2755035 - protein, 8 aa, Entamoeba invadens
FGKADKDI

SEQ ID NO: 2755036 - protein, 10 aa, Entamoeba invadens
FGKDKKKKTA

SEQ ID NO: 2755037 - protein, 8 aa, Entamoeba invadens
FGKDSTVA

SEQ ID NO: 2755038 - protein, 7 aa, Entamoeba invadens
FGKDTKS

SEQ ID NO: 2755039 - protein, 33 aa, Entamoeba invadens
FGKKEVEGEHKEENQQSEMKDETQNSENVKVKD

SEQ ID NO: 2755040 - protein, 5 aa, Entamoeba invadens
FGKKV

SEQ ID NO: 2755041 - protein, 6 aa, Entamoeba invadens
FGKPQS

SEQ ID NO: 2755042 - protein, 14 aa, Entamoeba invadens
FGKSGKMVFKALGP

SEQ ID NO: 2755043 - protein, 5 aa, Entamoeba invadens
FGKTE

SEQ ID NO: 2755044 - protein, 4 aa, Entamoeba invadens
FGLS

SEQ ID NO: 2755045 - protein, 14 aa, Entamoeba invadens
FGNDDTPSNINETR

SEQ ID NO: 2755046 - protein, 9 aa, Entamoeba invadens
FGNDENATE

SEQ ID NO: 2755047 - protein, 5 aa, Entamoeba invadens
FGNDN

SEQ ID NO: 2755048 - protein, 13 aa, Entamoeba invadens
FGNDTKLTAIGDT

SEQ ID NO: 2755049 - protein, 9 aa, Entamoeba invadens
FGNETEATN

SEQ ID NO: 2755050 - protein, 14 aa, Entamoeba invadens
FGNETKLTSINDTR

SEQ ID NO: 2755051 - protein, 10 aa, Entamoeba invadens
FGNGKADYLR

SEQ ID NO: 2755052 - protein, 10 aa, Entamoeba invadens
FGNGSQATKI

SEQ ID NO: 2755053 - protein, 7 aa, Entamoeba invadens
FGNGTTL

SEQ ID NO: 2755054 - protein, 9 aa, Entamoeba invadens
FGNKAFKST

SEQ ID NO: 2755055 - protein, 10 aa, Entamoeba invadens
FGNKETSTSI

SEQ ID NO: 2755056 - protein, 13 aa, Entamoeba invadens
FGNKNKLTSIGDT

SEQ ID NO: 2755057 - protein, 16 aa, Entamoeba invadens
FGNKTSATNINDTRYE

SEQ ID NO: 2755058 - protein, 9 aa, Entamoeba invadens
FGNPNSATA

SEQ ID NO: 2755059 - protein, 6 aa, Entamoeba invadens
FGNPQD

SEQ ID NO: 2755060 - protein, 4 aa, Entamoeba invadens
FGNS

SEQ ID NO: 2755061 - protein, 20 aa, Entamoeba invadens
FGNSPMCKSQSGLSEQKPLL

SEQ ID NO: 2755062 - protein, 6 aa, Entamoeba invadens
FGNSQE

SEQ ID NO: 2755063 - protein, 4 aa, Entamoeba invadens
FGPL

SEQ ID NO: 2755064 - protein, 14 aa, Entamoeba invadens
FGPNNDNCNSCDNN

SEQ ID NO: 2755065 - protein, 5 aa, Entamoeba invadens
FGQDI

SEQ ID NO: 2755066 - protein, 19 aa, Entamoeba invadens
FGQKAKDLSSEIEQLKKEE

SEQ ID NO: 2755067 - protein, 11 aa, Entamoeba invadens
FGQKVSNGYVK

SEQ ID NO: 2755068 - protein, 10 aa, Entamoeba invadens
FGQTKSCENA

SEQ ID NO: 2755069 - protein, 7 aa, Entamoeba invadens
FGRRGEP

SEQ ID NO: 2755070 - protein, 12 aa, Entamoeba invadens
FGRSEQYDTFPS

SEQ ID NO: 2755071 - protein, 8 aa, Entamoeba invadens
FGSAQSKE

SEQ ID NO: 2755072 - protein, 5 aa, Entamoeba invadens
FGSAR

SEQ ID NO: 2755073 - protein, 6 aa, Entamoeba invadens
FGSDNE

SEQ ID NO: 2755074 - protein, 11 aa, Entamoeba invadens
FGSEKGPVPVG

SEQ ID NO: 2755075 - protein, 6 aa, Entamoeba invadens
FGSENG

SEQ ID NO: 2755076 - protein, 6 aa, Entamoeba invadens
FGSPDF

SEQ ID NO: 2755077 - protein, 5 aa, Entamoeba invadens
FGSPE

SEQ ID NO: 2755078 - protein, 4 aa, Entamoeba invadens
FGSS

SEQ ID NO: 2755079 - protein, 8 aa, Entamoeba invadens
FGSSSNVT

SEQ ID NO: 2755080 - protein, 16 aa, Entamoeba invadens
FGSSTKCTSCEEGEYL

SEQ ID NO: 2755081 - protein, 5 aa, Entamoeba invadens
FGSTQ

SEQ ID NO: 2755082 - protein, 4 aa, Entamoeba invadens
FGTD

SEQ ID NO: 2755083 - protein, 17 aa, Entamoeba invadens
FGTGNEAQQAKKRGSAY

SEQ ID NO: 2755084 - protein, 7 aa, Entamoeba invadens
FGTQWGD

SEQ ID NO: 2755085 - protein, 9 aa, Entamoeba invadens
FGTSPDVKN

SEQ ID NO: 2755086 - protein, 7 aa, Entamoeba invadens
FGTSRFT

SEQ ID NO: 2755087 - protein, 17 aa, Entamoeba invadens
FGTSRIKRNKDKGLGTP

SEQ ID NO: 2755088 - protein, 6 aa, Entamoeba invadens
FGTSRT

SEQ ID NO: 2755089 - protein, 7 aa, Entamoeba invadens
FGTTKKY

SEQ ID NO: 2755090 - protein, 6 aa, Entamoeba invadens
FGTTSR

SEQ ID NO: 2755091 - protein, 6 aa, Entamoeba invadens
FGTTTD

SEQ ID NO: 2755092 - protein, 4 aa, Entamoeba invadens
FGYD

SEQ ID NO: 2755093 - protein, 7 aa, Entamoeba invadens
FGYQTST

SEQ ID NO: 2755094 - protein, 7 aa, Entamoeba invadens
FHDPKQS

SEQ ID NO: 2755095 - protein, 8 aa, Entamoeba invadens
FHKPSDVG

SEQ ID NO: 2755096 - protein, 7 aa, Entamoeba invadens
FHTSNEK

SEQ ID NO: 2755097 - protein, 5 aa, Entamoeba invadens
FIESS

SEQ ID NO: 2755098 - protein, 6 aa, Entamoeba invadens
FIESSG

SEQ ID NO: 2755099 - protein, 8 aa, Entamoeba invadens
FIESSGKK

SEQ ID NO: 2755100 - protein, 6 aa, Entamoeba invadens
FIESSQ

SEQ ID NO: 2755101 - protein, 14 aa, Entamoeba invadens
FISDGSMQKEFDSD

SEQ ID NO: 2755102 - protein, 9 aa, Entamoeba invadens
FKAEDGECL

SEQ ID NO: 2755103 - protein, 8 aa, Entamoeba invadens
FKAGDYSQ

SEQ ID NO: 2755104 - protein, 6 aa, Entamoeba invadens
FKASDS

SEQ ID NO: 2755105 - protein, 5 aa, Entamoeba invadens
FKATG

SEQ ID NO: 2755106 - protein, 13 aa, Entamoeba invadens
FKDQAREFGQTPS

SEQ ID NO: 2755107 - protein, 9 aa, Entamoeba invadens
FKDQNGNCL

SEQ ID NO: 2755108 - protein, 11 aa, Entamoeba invadens
FKDSQSTGDEE

SEQ ID NO: 2755109 - protein, 7 aa, Entamoeba invadens
FKDTNTA

SEQ ID NO: 2755110 - protein, 6 aa, Entamoeba invadens
FKDTQL

SEQ ID NO: 2755111 - protein, 12 aa, Entamoeba invadens
FKDTTSDSTRKC

SEQ ID NO: 2755112 - protein, 14 aa, Entamoeba invadens
FKEDEKNCTECPTN

SEQ ID NO: 2755113 - protein, 14 aa, Entamoeba invadens
FKEDEKNCTECPTT

SEQ ID NO: 2755114 - protein, 7 aa, Entamoeba invadens
FKEEESR

SEQ ID NO: 2755115 - protein, 4 aa, Entamoeba invadens
FKEI

SEQ ID NO: 2755116 - protein, 12 aa, Entamoeba invadens
FKENANQTQECE

SEQ ID NO: 2755117 - protein, 5 aa, Entamoeba invadens
FKENG

SEQ ID NO: 2755118 - protein, 10 aa, Entamoeba invadens
FKENSQKAND

SEQ ID NO: 2755119 - protein, 6 aa, Entamoeba invadens
FKEQNE

SEQ ID NO: 2755120 - protein, 4 aa, Entamoeba invadens
FKFN

SEQ ID NO: 2755121 - protein, 9 aa, Entamoeba invadens
FKGAKQSNY

SEQ ID NO: 2755122 - protein, 4 aa, Entamoeba invadens
FKGC

SEQ ID NO: 2755123 - protein, 11 aa, Entamoeba invadens
FKGTSLSSLTL

SEQ ID NO: 2755124 - protein, 7 aa, Entamoeba invadens
FKGVTDT

SEQ ID NO: 2755125 - protein, 9 aa, Entamoeba invadens
FKGVTDTGI

SEQ ID NO: 2755126 - protein, 10 aa, Entamoeba invadens
FKGYDPHASV

SEQ ID NO: 2755127 - protein, 6 aa, Entamoeba invadens
FKIESS

SEQ ID NO: 2755128 - protein, 21 aa, Entamoeba invadens
FKKAEKSECQTRNNKGCQRCP

SEQ ID NO: 2755129 - protein, 8 aa, Entamoeba invadens
FKKGELPY

SEQ ID NO: 2755130 - protein, 12 aa, Entamoeba invadens
FKKGPAQKSKGV

SEQ ID NO: 2755131 - protein, 11 aa, Entamoeba invadens
FKKNESEAIVS

SEQ ID NO: 2755132 - protein, 5 aa, Entamoeba invadens
FKKSD

SEQ ID NO: 2755133 - protein, 19 aa, Entamoeba invadens
FKKSTNGTCANTACGNGKI

SEQ ID NO: 2755134 - protein, 9 aa, Entamoeba invadens
FKNECTSCA

SEQ ID NO: 2755135 - protein, 12 aa, Entamoeba invadens
FKNENSTKCNKK

SEQ ID NO: 2755136 - protein, 4 aa, Entamoeba invadens
FKNG

SEQ ID NO: 2755137 - protein, 10 aa, Entamoeba invadens
FKNGDEKYNT

SEQ ID NO: 2755138 - protein, 15 aa, Entamoeba invadens
FKNNTKIESQNIYTN

SEQ ID NO: 2755139 - protein, 16 aa, Entamoeba invadens
FKNNTKIESQNIYTNG

SEQ ID NO: 2755140 - protein, 6 aa, Entamoeba invadens
FKNNTV

SEQ ID NO: 2755141 - protein, 8 aa, Entamoeba invadens
FKNPTVKE

SEQ ID NO: 2755142 - protein, 5 aa, Entamoeba invadens
FKNQN

SEQ ID NO: 2755143 - protein, 4 aa, Entamoeba invadens
FKNS

SEQ ID NO: 2755144 - protein, 8 aa, Entamoeba invadens
FKNSTNLR

SEQ ID NO: 2755145 - protein, 8 aa, Entamoeba invadens
FKNTESSC

SEQ ID NO: 2755146 - protein, 5 aa, Entamoeba invadens
FKNTK

SEQ ID NO: 2755147 - protein, 9 aa, Entamoeba invadens
FKNTTKHTI

SEQ ID NO: 2755148 - protein, 18 aa, Entamoeba invadens
FKPDEDDIGYPEEEVRDD

SEQ ID NO: 2755149 - protein, 9 aa, Entamoeba invadens
FKPIKSPRI

SEQ ID NO: 2755150 - protein, 8 aa, Entamoeba invadens
FKPKNEDQ

SEQ ID NO: 2755151 - protein, 9 aa, Entamoeba invadens
FKPNETDTF

SEQ ID NO: 2755152 - protein, 6 aa, Entamoeba invadens
FKPNYS

SEQ ID NO: 2755153 - protein, 6 aa, Entamoeba invadens
FKPQNS

SEQ ID NO: 2755154 - protein, 8 aa, Entamoeba invadens
FKPSNRVQ

SEQ ID NO: 2755155 - protein, 9 aa, Entamoeba invadens
FKPSPPKYS

SEQ ID NO: 2755156 - protein, 10 aa, Entamoeba invadens
FKPTSPKLNA

SEQ ID NO: 2755157 - protein, 12 aa, Entamoeba invadens
FKQNPDSKTNCI

SEQ ID NO: 2755158 - protein, 11 aa, Entamoeba invadens
FKQSYKNTNMK

SEQ ID NO: 2755159 - protein, 9 aa, Entamoeba invadens
FKQTDSNKF

SEQ ID NO: 2755160 - protein, 14 aa, Entamoeba invadens
FKQVTTQNTGNKEC

SEQ ID NO: 2755161 - protein, 7 aa, Entamoeba invadens
FKRNNNT

SEQ ID NO: 2755162 - protein, 12 aa, Entamoeba invadens
FKRSNSKKSPIY

SEQ ID NO: 2755163 - protein, 5 aa, Entamoeba invadens
FKRSQ

SEQ ID NO: 2755164 - protein, 7 aa, Entamoeba invadens
FKRTKNR

SEQ ID NO: 2755165 - protein, 11 aa, Entamoeba invadens
FKSDEKKIYDE

SEQ ID NO: 2755166 - protein, 11 aa, Entamoeba invadens
FKSGAATSIGK

SEQ ID NO: 2755167 - protein, 5 aa, Entamoeba invadens
FKSGD

SEQ ID NO: 2755168 - protein, 10 aa, Entamoeba invadens
FKSGTTTCTM

SEQ ID NO: 2755169 - protein, 8 aa, Entamoeba invadens
FKSNAPIT

SEQ ID NO: 2755170 - protein, 11 aa, Entamoeba invadens
FKSNGDCNECD

SEQ ID NO: 2755171 - protein, 6 aa, Entamoeba invadens
FKSSRN

SEQ ID NO: 2755172 - protein, 7 aa, Entamoeba invadens
FKSSTTA

SEQ ID NO: 2755173 - protein, 10 aa, Entamoeba invadens
FKSTNSPKVG

SEQ ID NO: 2755174 - protein, 18 aa, Entamoeba invadens
FKSTSKSQNIKSENTEKT

SEQ ID NO: 2755175 - protein, 11 aa, Entamoeba invadens
FKTDNESKCVK

SEQ ID NO: 2755176 - protein, 10 aa, Entamoeba invadens
FKTEEERSKI

SEQ ID NO: 2755177 - protein, 19 aa, Entamoeba invadens
FKTEKKQEEMEKDAVASAE

SEQ ID NO: 2755178 - protein, 9 aa, Entamoeba invadens
FKTNAEKYN

SEQ ID NO: 2755179 - protein, 10 aa, Entamoeba invadens
FKTNKEKYNE

SEQ ID NO: 2755180 - protein, 7 aa, Entamoeba invadens
FKTPKNV

SEQ ID NO: 2755181 - protein, 11 aa, Entamoeba invadens
FKTPKTCEKCT

SEQ ID NO: 2755182 - protein, 18 aa, Entamoeba invadens
FKTSNTSVPKTNPPTAEK

SEQ ID NO: 2755183 - protein, 8 aa, Entamoeba invadens
FKTSQTND

SEQ ID NO: 2755184 - protein, 15 aa, Entamoeba invadens
FKTSSNQNMTGEPYR

SEQ ID NO: 2755185 - protein, 16 aa, Entamoeba invadens
FKTSYNKKDITCGSTL

SEQ ID NO: 2755186 - protein, 4 aa, Entamoeba invadens
FKTT

SEQ ID NO: 2755187 - protein, 6 aa, Entamoeba invadens
FKTTKG

SEQ ID NO: 2755188 - protein, 7 aa, Entamoeba invadens
FKTTKGV

SEQ ID NO: 2755189 - protein, 6 aa, Entamoeba invadens
FKTVEE

SEQ ID NO: 2755190 - protein, 10 aa, Entamoeba invadens
FKYKTNTKKV

SEQ ID NO: 2755191 - protein, 12 aa, Entamoeba invadens
FLDEKNSGYDYS

SEQ ID NO: 2755192 - protein, 6 aa, Entamoeba invadens
FLDESN

SEQ ID NO: 2755193 - protein, 5 aa, Entamoeba invadens
FLGKS

SEQ ID NO: 2755194 - protein, 6 aa, Entamoeba invadens
FLGNPR

SEQ ID NO: 2755195 - protein, 11 aa, Entamoeba invadens
FLPNPDSRDPN

SEQ ID NO: 2755196 - protein, 11 aa, Entamoeba invadens
FLQPEEKTGIE

SEQ ID NO: 2755197 - protein, 4 aa, Entamoeba invadens
FNAS

SEQ ID NO: 2755198 - protein, 8 aa, Entamoeba invadens
FNATQTSF

SEQ ID NO: 2755199 - protein, 5 aa, Entamoeba invadens
FNDEE

SEQ ID NO: 2755200 - protein, 8 aa, Entamoeba invadens
FNDKSTRG

SEQ ID NO: 2755201 - protein, 9 aa, Entamoeba invadens
FNDTKRAEL

SEQ ID NO: 2755202 - protein, 20 aa, Entamoeba invadens
FNDTRKSKKAFAVTKSGSVA

SEQ ID NO: 2755203 - protein, 5 aa, Entamoeba invadens
FNEAK

SEQ ID NO: 2755204 - protein, 4 aa, Entamoeba invadens
FNED

SEQ ID NO: 2755205 - protein, 17 aa, Entamoeba invadens
FNEGSEEDGIDVKKETT

SEQ ID NO: 2755206 - protein, 4 aa, Entamoeba invadens
FNEN

SEQ ID NO: 2755207 - protein, 13 aa, Entamoeba invadens
FNENAGLSLPSKR

SEQ ID NO: 2755208 - protein, 8 aa, Entamoeba invadens
FNENDDGT

SEQ ID NO: 2755209 - protein, 8 aa, Entamoeba invadens
FNENGSCT

SEQ ID NO: 2755210 - protein, 5 aa, Entamoeba invadens
FNEPK

SEQ ID NO: 2755211 - protein, 6 aa, Entamoeba invadens
FNEPKG

SEQ ID NO: 2755212 - protein, 5 aa, Entamoeba invadens
FNEPR

SEQ ID NO: 2755213 - protein, 10 aa, Entamoeba invadens
FNEQNIEETE

SEQ ID NO: 2755214 - protein, 4 aa, Entamoeba invadens
FNES

SEQ ID NO: 2755215 - protein, 10 aa, Entamoeba invadens
FNETDGSCAR

SEQ ID NO: 2755216 - protein, 6 aa, Entamoeba invadens
FNETGK

SEQ ID NO: 2755217 - protein, 9 aa, Entamoeba invadens
FNGDTSTQT

SEQ ID NO: 2755218 - protein, 7 aa, Entamoeba invadens
FNGGSYS

SEQ ID NO: 2755219 - protein, 9 aa, Entamoeba invadens
FNGKDSETI

SEQ ID NO: 2755220 - protein, 15 aa, Entamoeba invadens
FNGKLNTSKTCKKCD

SEQ ID NO: 2755221 - protein, 8 aa, Entamoeba invadens
FNGKRTIE

SEQ ID NO: 2755222 - protein, 24 aa, Entamoeba invadens
FNGNEKEHHEDSKTTKVENKENFF

SEQ ID NO: 2755223 - protein, 4 aa, Entamoeba invadens
FNGS

SEQ ID NO: 2755224 - protein, 6 aa, Entamoeba invadens
FNGSAN

SEQ ID NO: 2755225 - protein, 5 aa, Entamoeba invadens
FNGSL

SEQ ID NO: 2755226 - protein, 8 aa, Entamoeba invadens
FNGTKHSV

SEQ ID NO: 2755227 - protein, 6 aa, Entamoeba invadens
FNGVPA

SEQ ID NO: 2755228 - protein, 10 aa, Entamoeba invadens
FNHQRSNRIR

SEQ ID NO: 2755229 - protein, 17 aa, Entamoeba invadens
FNIPQQSQNDMQTQNEI

SEQ ID NO: 2755230 - protein, 4 aa, Entamoeba invadens
FNKE

SEQ ID NO: 2755231 - protein, 4 aa, Entamoeba invadens
FNKG

SEQ ID NO: 2755232 - protein, 16 aa, Entamoeba invadens
FNKPSESGDSCFSTTN

SEQ ID NO: 2755233 - protein, 17 aa, Entamoeba invadens
FNKTTSKYNKYNINNKS

SEQ ID NO: 2755234 - protein, 9 aa, Entamoeba invadens
FNKTTVKSC

SEQ ID NO: 2755235 - protein, 9 aa, Entamoeba invadens
FNLPDGKEI

SEQ ID NO: 2755236 - protein, 18 aa, Entamoeba invadens
FNNQNKNLKSTAQIVTST

SEQ ID NO: 2755237 - protein, 9 aa, Entamoeba invadens
FNNTQQSKL

SEQ ID NO: 2755238 - protein, 10 aa, Entamoeba invadens
FNPDLSTKHN

SEQ ID NO: 2755239 - protein, 4 aa, Entamoeba invadens
FNPE

SEQ ID NO: 2755240 - protein, 9 aa, Entamoeba invadens
FNPQETENH

SEQ ID NO: 2755241 - protein, 9 aa, Entamoeba invadens
FNPSEDTYG

SEQ ID NO: 2755242 - protein, 6 aa, Entamoeba invadens
FNPSGS

SEQ ID NO: 2755243 - protein, 4 aa, Entamoeba invadens
FNSG

SEQ ID NO: 2755244 - protein, 5 aa, Entamoeba invadens
FNSPS

SEQ ID NO: 2755245 - protein, 9 aa, Entamoeba invadens
FNSPTGIVP

SEQ ID NO: 2755246 - protein, 19 aa, Entamoeba invadens
FNSSTNRFTLSEKKGRGIK

SEQ ID NO: 2755247 - protein, 7 aa, Entamoeba invadens
FNSSTRW

SEQ ID NO: 2755248 - protein, 14 aa, Entamoeba invadens
FNSSTVKSCDYENS

SEQ ID NO: 2755249 - protein, 10 aa, Entamoeba invadens
FNSTDGTCAR

SEQ ID NO: 2755250 - protein, 5 aa, Entamoeba invadens
FNSTG

SEQ ID NO: 2755251 - protein, 4 aa, Entamoeba invadens
FNSY

SEQ ID NO: 2755252 - protein, 8 aa, Entamoeba invadens
FNTDKNAG

SEQ ID NO: 2755253 - protein, 4 aa, Entamoeba invadens
FNTE

SEQ ID NO: 2755254 - protein, 13 aa, Entamoeba invadens
FNTERDGKDNHCY

SEQ ID NO: 2755255 - protein, 18 aa, Entamoeba invadens
FNTKEDDHKEEKQTLYSS

SEQ ID NO: 2755256 - protein, 5 aa, Entamoeba invadens
FNTNE

SEQ ID NO: 2755257 - protein, 4 aa, Entamoeba invadens
FNTP

SEQ ID NO: 2755258 - protein, 11 aa, Entamoeba invadens
FNTPTTSYKKY

SEQ ID NO: 2755259 - protein, 6 aa, Entamoeba invadens
FNYASQ

SEQ ID NO: 2755260 - protein, 4 aa, Entamoeba invadens
FNYP

SEQ ID NO: 2755261 - protein, 6 aa, Entamoeba invadens
FNYTGE

SEQ ID NO: 2755262 - protein, 16 aa, Entamoeba invadens
FPADSSGCYTPTDNQA

SEQ ID NO: 2755263 - protein, 5 aa, Entamoeba invadens
FPANT

SEQ ID NO: 2755264 - protein, 11 aa, Entamoeba invadens
FPAPDEVAPQV

SEQ ID NO: 2755265 - protein, 4 aa, Entamoeba invadens
FPDA

SEQ ID NO: 2755266 - protein, 9 aa, Entamoeba invadens
FPDDEKQEI

SEQ ID NO: 2755267 - protein, 12 aa, Entamoeba invadens
FPDEESKRKMHN

SEQ ID NO: 2755268 - protein, 9 aa, Entamoeba invadens
FPDENDDIK

SEQ ID NO: 2755269 - protein, 12 aa, Entamoeba invadens
FPDRDLSNVTGT

SEQ ID NO: 2755270 - protein, 5 aa, Entamoeba invadens
FPDSE

SEQ ID NO: 2755271 - protein, 6 aa, Entamoeba invadens
FPENEV

SEQ ID NO: 2755272 - protein, 5 aa, Entamoeba invadens
FPETN

SEQ ID NO: 2755273 - protein, 4 aa, Entamoeba invadens
FPFP

SEQ ID NO: 2755274 - protein, 7 aa, Entamoeba invadens
FPGSDTK

SEQ ID NO: 2755275 - protein, 4 aa, Entamoeba invadens
FPKD

SEQ ID NO: 2755276 - protein, 56 aa, Entamoeba invadens
FPKEESLGKEYKQVPEEEMDNNKEKDGQSPKIDTEKENIKEEQDVAFSGKPSPFVE

SEQ ID NO: 2755277 - protein, 6 aa, Entamoeba invadens
FPKNEV

SEQ ID NO: 2755278 - protein, 15 aa, Entamoeba invadens
FPKNSADKNVRRDKE

SEQ ID NO: 2755279 - protein, 6 aa, Entamoeba invadens
FPKSEY

SEQ ID NO: 2755280 - protein, 6 aa, Entamoeba invadens
FPKTDP

SEQ ID NO: 2755281 - protein, 9 aa, Entamoeba invadens
FPLEGDEQM

SEQ ID NO: 2755282 - protein, 5 aa, Entamoeba invadens
FPMSS

SEQ ID NO: 2755283 - protein, 4 aa, Entamoeba invadens
FPND

SEQ ID NO: 2755284 - protein, 8 aa, Entamoeba invadens
FPNGETAF

SEQ ID NO: 2755285 - protein, 7 aa, Entamoeba invadens
FPNKSNL

SEQ ID NO: 2755286 - protein, 8 aa, Entamoeba invadens
FPNNQTEI

SEQ ID NO: 2755287 - protein, 10 aa, Entamoeba invadens
FPNTIPSGSL

SEQ ID NO: 2755288 - protein, 6 aa, Entamoeba invadens
FPPKEN

SEQ ID NO: 2755289 - protein, 12 aa, Entamoeba invadens
FPPQINSYSGNP

SEQ ID NO: 2755290 - protein, 4 aa, Entamoeba invadens
FPPT

SEQ ID NO: 2755291 - protein, 26 aa, Entamoeba invadens
FPQKPKSGKNEKSRKDKPKKKFTRSK

SEQ ID NO: 2755292 - protein, 4 aa, Entamoeba invadens
FPQN

SEQ ID NO: 2755293 - protein, 6 aa, Entamoeba invadens
FPQNEY

SEQ ID NO: 2755294 - protein, 4 aa, Entamoeba invadens
FPQS

SEQ ID NO: 2755295 - protein, 4 aa, Entamoeba invadens
FPSE

SEQ ID NO: 2755296 - protein, 8 aa, Entamoeba invadens
FPSETTTK

SEQ ID NO: 2755297 - protein, 4 aa, Entamoeba invadens
FPSF

SEQ ID NO: 2755298 - protein, 5 aa, Entamoeba invadens
FPSGD

SEQ ID NO: 2755299 - protein, 6 aa, Entamoeba invadens
FPSGGL

SEQ ID NO: 2755300 - protein, 7 aa, Entamoeba invadens
FPSGHSS

SEQ ID NO: 2755301 - protein, 8 aa, Entamoeba invadens
FPSGHSST

SEQ ID NO: 2755302 - protein, 8 aa, Entamoeba invadens
FPSGSETL

SEQ ID NO: 2755303 - protein, 9 aa, Entamoeba invadens
FPSHSSTPQ

SEQ ID NO: 2755304 - protein, 4 aa, Entamoeba invadens
FPSN

SEQ ID NO: 2755305 - protein, 20 aa, Entamoeba invadens
FPSPIKTKSFASSGSEDRPI

SEQ ID NO: 2755306 - protein, 9 aa, Entamoeba invadens
FPSRNDYNK

SEQ ID NO: 2755307 - protein, 4 aa, Entamoeba invadens
FPSS

SEQ ID NO: 2755308 - protein, 5 aa, Entamoeba invadens
FPTGD

SEQ ID NO: 2755309 - protein, 9 aa, Entamoeba invadens
FPTGNNTTR

SEQ ID NO: 2755310 - protein, 8 aa, Entamoeba invadens
FPTKTQPH

SEQ ID NO: 2755311 - protein, 16 aa, Entamoeba invadens
FPTSPNRNPNFTQPTY

SEQ ID NO: 2755312 - protein, 4 aa, Entamoeba invadens
FPVV

SEQ ID NO: 2755313 - protein, 7 aa, Entamoeba invadens
FQASNNA

SEQ ID NO: 2755314 - protein, 21 aa, Entamoeba invadens
FQCSSQGKCVTQDNTNSRNQG

SEQ ID NO: 2755315 - protein, 4 aa, Entamoeba invadens
FQEQ

SEQ ID NO: 2755316 - protein, 9 aa, Entamoeba invadens
FQGKQSEIK

SEQ ID NO: 2755317 - protein, 8 aa, Entamoeba invadens
FQGSGNLD

SEQ ID NO: 2755318 - protein, 6 aa, Entamoeba invadens
FQKDEK

SEQ ID NO: 2755319 - protein, 11 aa, Entamoeba invadens
FQKSTNNSTTI

SEQ ID NO: 2755320 - protein, 4 aa, Entamoeba invadens
FQLP

SEQ ID NO: 2755321 - protein, 4 aa, Entamoeba invadens
FQNC

SEQ ID NO: 2755322 - protein, 4 aa, Entamoeba invadens
FQND

SEQ ID NO: 2755323 - protein, 7 aa, Entamoeba invadens
FQNSEES

SEQ ID NO: 2755324 - protein, 5 aa, Entamoeba invadens
FQPGP

SEQ ID NO: 2755325 - protein, 9 aa, Entamoeba invadens
FQQDTSCTD

SEQ ID NO: 2755326 - protein, 9 aa, Entamoeba invadens
FQRSSPKAN

SEQ ID NO: 2755327 - protein, 12 aa, Entamoeba invadens
FQSETSRECRPY

SEQ ID NO: 2755328 - protein, 9 aa, Entamoeba invadens
FQSGSPDEV

SEQ ID NO: 2755329 - protein, 7 aa, Entamoeba invadens
FQSSSVD

SEQ ID NO: 2755330 - protein, 11 aa, Entamoeba invadens
FQSSTTKSMKK

SEQ ID NO: 2755331 - protein, 22 aa, Entamoeba invadens
FQSSTTKSMKKSSSFAVTSDTK

SEQ ID NO: 2755332 - protein, 5 aa, Entamoeba invadens
FQSTG

SEQ ID NO: 2755333 - protein, 6 aa, Entamoeba invadens
FQTDGE

SEQ ID NO: 2755334 - protein, 5 aa, Entamoeba invadens
FQTEE

SEQ ID NO: 2755335 - protein, 10 aa, Entamoeba invadens
FQTGNEATLE

SEQ ID NO: 2755336 - protein, 5 aa, Entamoeba invadens
FQTKS

SEQ ID NO: 2755337 - protein, 4 aa, Entamoeba invadens
FQTN

SEQ ID NO: 2755338 - protein, 10 aa, Entamoeba invadens
FQTTTSTTSL

SEQ ID NO: 2755339 - protein, 4 aa, Entamoeba invadens
FRDK

SEQ ID NO: 2755340 - protein, 11 aa, Entamoeba invadens
FREEENKEAET

SEQ ID NO: 2755341 - protein, 6 aa, Entamoeba invadens
FREKNS

SEQ ID NO: 2755342 - protein, 10 aa, Entamoeba invadens
FREQEEKEAE

SEQ ID NO: 2755343 - protein, 10 aa, Entamoeba invadens
FRGDDDPKTG

SEQ ID NO: 2755344 - protein, 4 aa, Entamoeba invadens
FRGK

SEQ ID NO: 2755345 - protein, 5 aa, Entamoeba invadens
FRGKE

SEQ ID NO: 2755346 - protein, 4 aa, Entamoeba invadens
FRGQ

SEQ ID NO: 2755347 - protein, 5 aa, Entamoeba invadens
FRGSD

SEQ ID NO: 2755348 - protein, 17 aa, Entamoeba invadens
FRGSPNQFELPNFDFFD

SEQ ID NO: 2755349 - protein, 6 aa, Entamoeba invadens
FRGTTQ

SEQ ID NO: 2755350 - protein, 15 aa, Entamoeba invadens
FRKKEQENKIKFKLF

SEQ ID NO: 2755351 - protein, 18 aa, Entamoeba invadens
FRKSTRRSTRRTRRPRSY

SEQ ID NO: 2755352 - protein, 4 aa, Entamoeba invadens
FRND

SEQ ID NO: 2755353 - protein, 9 aa, Entamoeba invadens
FRNEAGKCE

SEQ ID NO: 2755354 - protein, 9 aa, Entamoeba invadens
FRNENGKCE

SEQ ID NO: 2755355 - protein, 7 aa, Entamoeba invadens
FRNGTSC

SEQ ID NO: 2755356 - protein, 5 aa, Entamoeba invadens
FRNKP

SEQ ID NO: 2755357 - protein, 6 aa, Entamoeba invadens
FRNSGL

SEQ ID NO: 2755358 - protein, 7 aa, Entamoeba invadens
FRPDPIT

SEQ ID NO: 2755359 - protein, 11 aa, Entamoeba invadens
FRPEKKQKTQV

SEQ ID NO: 2755360 - protein, 10 aa, Entamoeba invadens
FRPENEVKPR

SEQ ID NO: 2755361 - protein, 8 aa, Entamoeba invadens
FRPETPCG

SEQ ID NO: 2755362 - protein, 6 aa, Entamoeba invadens
FRPPRS

SEQ ID NO: 2755363 - protein, 5 aa, Entamoeba invadens
FRQKN

SEQ ID NO: 2755364 - protein, 4 aa, Entamoeba invadens
FRSE

SEQ ID NO: 2755365 - protein, 10 aa, Entamoeba invadens
FRSGSPETFC

SEQ ID NO: 2755366 - protein, 4 aa, Entamoeba invadens
FRSN

SEQ ID NO: 2755367 - protein, 10 aa, Entamoeba invadens
FRTEPELPKG

SEQ ID NO: 2755368 - protein, 5 aa, Entamoeba invadens
FRTNE

SEQ ID NO: 2755369 - protein, 10 aa, Entamoeba invadens
FRTPNNNTKL

SEQ ID NO: 2755370 - protein, 6 aa, Entamoeba invadens
FSAENC

SEQ ID NO: 2755371 - protein, 13 aa, Entamoeba invadens
FSASSEENNRNSF

SEQ ID NO: 2755372 - protein, 8 aa, Entamoeba invadens
FSASSQIC

SEQ ID NO: 2755373 - protein, 11 aa, Entamoeba invadens
FSDEKPNSETF

SEQ ID NO: 2755374 - protein, 10 aa, Entamoeba invadens
FSDKETDKKC

SEQ ID NO: 2755375 - protein, 12 aa, Entamoeba invadens
FSDNTNNDGLSC

SEQ ID NO: 2755376 - protein, 6 aa, Entamoeba invadens
FSDPES

SEQ ID NO: 2755377 - protein, 5 aa, Entamoeba invadens
FSDPN

SEQ ID NO: 2755378 - protein, 10 aa, Entamoeba invadens
FSDQAGSSTC

SEQ ID NO: 2755379 - protein, 5 aa, Entamoeba invadens
FSDSA

SEQ ID NO: 2755380 - protein, 9 aa, Entamoeba invadens
FSDTKENEI

SEQ ID NO: 2755381 - protein, 10 aa, Entamoeba invadens
FSDTQKTHYA

SEQ ID NO: 2755382 - protein, 8 aa, Entamoeba invadens
FSDTQRDD

SEQ ID NO: 2755383 - protein, 6 aa, Entamoeba invadens
FSDYTG

SEQ ID NO: 2755384 - protein, 5 aa, Entamoeba invadens
FSEGK

SEQ ID NO: 2755385 - protein, 10 aa, Entamoeba invadens
FSEKSSALLS

SEQ ID NO: 2755386 - protein, 6 aa, Entamoeba invadens
FSENKE

SEQ ID NO: 2755387 - protein, 4 aa, Entamoeba invadens
FSEP

SEQ ID NO: 2755388 - protein, 20 aa, Entamoeba invadens
FSEQNKKKSPQNLTNSQEFD

SEQ ID NO: 2755389 - protein, 4 aa, Entamoeba invadens
FSES

SEQ ID NO: 2755390 - protein, 5 aa, Entamoeba invadens
FSESG

SEQ ID NO: 2755391 - protein, 10 aa, Entamoeba invadens
FSESSSLEAE

SEQ ID NO: 2755392 - protein, 7 aa, Entamoeba invadens
FSESTGC

SEQ ID NO: 2755393 - protein, 4 aa, Entamoeba invadens
FSET

SEQ ID NO: 2755394 - protein, 6 aa, Entamoeba invadens
FSETTC

SEQ ID NO: 2755395 - protein, 12 aa, Entamoeba invadens
FSFGGGNGVSSL

SEQ ID NO: 2755396 - protein, 7 aa, Entamoeba invadens
FSGDTGK

SEQ ID NO: 2755397 - protein, 8 aa, Entamoeba invadens
FSGKSDTT

SEQ ID NO: 2755398 - protein, 4 aa, Entamoeba invadens
FSGS

SEQ ID NO: 2755399 - protein, 6 aa, Entamoeba invadens
FSGSAK

SEQ ID NO: 2755400 - protein, 8 aa, Entamoeba invadens
FSGSSSYT

SEQ ID NO: 2755401 - protein, 8 aa, Entamoeba invadens
FSGTGKGV

SEQ ID NO: 2755402 - protein, 6 aa, Entamoeba invadens
FSGTKC

SEQ ID NO: 2755403 - protein, 6 aa, Entamoeba invadens
FSGTNS

SEQ ID NO: 2755404 - protein, 53 aa, Entamoeba invadens
FSINSGSSSCSTCNAGSYSNKGASTCNSCPGGYYSQSSGSASCKACAGGTYSN

SEQ ID NO: 2755405 - protein, 10 aa, Entamoeba invadens
FSINSKSQVT

SEQ ID NO: 2755406 - protein, 4 aa, Entamoeba invadens
FSIR

SEQ ID NO: 2755407 - protein, 11 aa, Entamoeba invadens
FSKKQETASLD

SEQ ID NO: 2755408 - protein, 10 aa, Entamoeba invadens
FSKKTQSETC

SEQ ID NO: 2755409 - protein, 6 aa, Entamoeba invadens
FSKPET

SEQ ID NO: 2755410 - protein, 11 aa, Entamoeba invadens
FSKSGASSCTQ

SEQ ID NO: 2755411 - protein, 11 aa, Entamoeba invadens
FSKSNGTGVFG

SEQ ID NO: 2755412 - protein, 12 aa, Entamoeba invadens
FSNEKDITTETQ

SEQ ID NO: 2755413 - protein, 4 aa, Entamoeba invadens
FSNG

SEQ ID NO: 2755414 - protein, 9 aa, Entamoeba invadens
FSNGGTQSC

SEQ ID NO: 2755415 - protein, 9 aa, Entamoeba invadens
FSNGGTSSC

SEQ ID NO: 2755416 - protein, 8 aa, Entamoeba invadens
FSNGTQNP

SEQ ID NO: 2755417 - protein, 6 aa, Entamoeba invadens
FSNNGK

SEQ ID NO: 2755418 - protein, 8 aa, Entamoeba invadens
FSNPNSTE

SEQ ID NO: 2755419 - protein, 8 aa, Entamoeba invadens
FSNPNSTS

SEQ ID NO: 2755420 - protein, 6 aa, Entamoeba invadens
FSNPQG

SEQ ID NO: 2755421 - protein, 9 aa, Entamoeba invadens
FSNQNSTSC

SEQ ID NO: 2755422 - protein, 6 aa, Entamoeba invadens
FSNSKS

SEQ ID NO: 2755423 - protein, 27 aa, Entamoeba invadens
FSNTIDSNKLKSDNKYTSIEYNSSNKC

SEQ ID NO: 2755424 - protein, 6 aa, Entamoeba invadens
FSNTRY

SEQ ID NO: 2755425 - protein, 6 aa, Entamoeba invadens
FSPDNY

SEQ ID NO: 2755426 - protein, 19 aa, Entamoeba invadens
FSPDSPSFNDCENSSSTPS

SEQ ID NO: 2755427 - protein, 6 aa, Entamoeba invadens
FSPGGI

SEQ ID NO: 2755428 - protein, 5 aa, Entamoeba invadens
FSPGP

SEQ ID NO: 2755429 - protein, 7 aa, Entamoeba invadens
FSPKIDP

SEQ ID NO: 2755430 - protein, 9 aa, Entamoeba invadens
FSPKSNKFS

SEQ ID NO: 2755431 - protein, 6 aa, Entamoeba invadens
FSPPAL

SEQ ID NO: 2755432 - protein, 10 aa, Entamoeba invadens
FSPPTYHGGS

SEQ ID NO: 2755433 - protein, 8 aa, Entamoeba invadens
FSPQNGDC

SEQ ID NO: 2755434 - protein, 12 aa, Entamoeba invadens
FSPSRGTVKKRE

SEQ ID NO: 2755435 - protein, 5 aa, Entamoeba invadens
FSQDG

SEQ ID NO: 2755436 - protein, 7 aa, Entamoeba invadens
FSQGEGD

SEQ ID NO: 2755437 - protein, 4 aa, Entamoeba invadens
FSQQ

SEQ ID NO: 2755438 - protein, 10 aa, Entamoeba invadens
FSQSIQPQKQ

SEQ ID NO: 2755439 - protein, 6 aa, Entamoeba invadens
FSRGTE

SEQ ID NO: 2755440 - protein, 29 aa, Entamoeba invadens
FSRKSQTLRHSETAKIELTPKQKLPEYPP

SEQ ID NO: 2755441 - protein, 13 aa, Entamoeba invadens
FSRNDKYTKTDGI

SEQ ID NO: 2755442 - protein, 4 aa, Entamoeba invadens
FSRP

SEQ ID NO: 2755443 - protein, 9 aa, Entamoeba invadens
FSSDPSELH

SEQ ID NO: 2755444 - protein, 8 aa, Entamoeba invadens
FSSEEGSL

SEQ ID NO: 2755445 - protein, 15 aa, Entamoeba invadens
FSSENTEEIKVNEKA

SEQ ID NO: 2755446 - protein, 5 aa, Entamoeba invadens
FSSEQ

SEQ ID NO: 2755447 - protein, 5 aa, Entamoeba invadens
FSSER

SEQ ID NO: 2755448 - protein, 10 aa, Entamoeba invadens
FSSGGQNEFA

SEQ ID NO: 2755449 - protein, 5 aa, Entamoeba invadens
FSSGS

SEQ ID NO: 2755450 - protein, 10 aa, Entamoeba invadens
FSSKESNYKY

SEQ ID NO: 2755451 - protein, 10 aa, Entamoeba invadens
FSSKGDNYKY

SEQ ID NO: 2755452 - protein, 6 aa, Entamoeba invadens
FSSNGC

SEQ ID NO: 2755453 - protein, 11 aa, Entamoeba invadens
FSSNTNDESYT

SEQ ID NO: 2755454 - protein, 8 aa, Entamoeba invadens
FSSRKGDD

SEQ ID NO: 2755455 - protein, 9 aa, Entamoeba invadens
FSSSDSNKK

SEQ ID NO: 2755456 - protein, 8 aa, Entamoeba invadens
FSSSPKSL

SEQ ID NO: 2755457 - protein, 9 aa, Entamoeba invadens
FSSSPKSLQ

SEQ ID NO: 2755458 - protein, 9 aa, Entamoeba invadens
FSSSPKSLR

SEQ ID NO: 2755459 - protein, 28 aa, Entamoeba invadens
FSSSPKSSQCDQCADGTYANTPGSTNCK

SEQ ID NO: 2755460 - protein, 5 aa, Entamoeba invadens
FSSTS

SEQ ID NO: 2755461 - protein, 14 aa, Entamoeba invadens
FSTADEKVCSASTT

SEQ ID NO: 2755462 - protein, 9 aa, Entamoeba invadens
FSTAEQLES

SEQ ID NO: 2755463 - protein, 4 aa, Entamoeba invadens
FSTC

SEQ ID NO: 2755464 - protein, 6 aa, Entamoeba invadens
FSTDEV

SEQ ID NO: 2755465 - protein, 9 aa, Entamoeba invadens
FSTDNKQNY

SEQ ID NO: 2755466 - protein, 4 aa, Entamoeba invadens
FSTE

SEQ ID NO: 2755467 - protein, 9 aa, Entamoeba invadens
FSTEANDVD

SEQ ID NO: 2755468 - protein, 11 aa, Entamoeba invadens
FSTGGTSYCSS

SEQ ID NO: 2755469 - protein, 7 aa, Entamoeba invadens
FSTGHPK

SEQ ID NO: 2755470 - protein, 13 aa, Entamoeba invadens
FSTKATSDNYDDL

SEQ ID NO: 2755471 - protein, 24 aa, Entamoeba invadens
FSTKGSSTCTKCDAGTYSSLSGAS

SEQ ID NO: 2755472 - protein, 5 aa, Entamoeba invadens
FSTKI

SEQ ID NO: 2755473 - protein, 9 aa, Entamoeba invadens
FSTKNEQRF

SEQ ID NO: 2755474 - protein, 10 aa, Entamoeba invadens
FSTNDKKEVD

SEQ ID NO: 2755475 - protein, 6 aa, Entamoeba invadens
FSTPRV

SEQ ID NO: 2755476 - protein, 8 aa, Entamoeba invadens
FSTQESVK

SEQ ID NO: 2755477 - protein, 19 aa, Entamoeba invadens
FSTRNSSIYTHNSDKPVTI

SEQ ID NO: 2755478 - protein, 12 aa, Entamoeba invadens
FSTSTKCTSCDS

SEQ ID NO: 2755479 - protein, 4 aa, Entamoeba invadens
FSTT

SEQ ID NO: 2755480 - protein, 18 aa, Entamoeba invadens
FSTYTAGSITLSGNTTLY

SEQ ID NO: 2755481 - protein, 6 aa, Entamoeba invadens
FTANKP

SEQ ID NO: 2755482 - protein, 8 aa, Entamoeba invadens
FTANNNKC

SEQ ID NO: 2755483 - protein, 13 aa, Entamoeba invadens
FTARSDAKLSYEN

SEQ ID NO: 2755484 - protein, 19 aa, Entamoeba invadens
FTATSSNTGNCTTPKIESV

SEQ ID NO: 2755485 - protein, 5 aa, Entamoeba invadens
FTDER

SEQ ID NO: 2755486 - protein, 10 aa, Entamoeba invadens
FTDESGPIPV

SEQ ID NO: 2755487 - protein, 11 aa, Entamoeba invadens
FTDEVTDYKGR

SEQ ID NO: 2755488 - protein, 5 aa, Entamoeba invadens
FTDGK

SEQ ID NO: 2755489 - protein, 6 aa, Entamoeba invadens
FTDGTG

SEQ ID NO: 2755490 - protein, 4 aa, Entamoeba invadens
FTDN

SEQ ID NO: 2755491 - protein, 5 aa, Entamoeba invadens
FTDNT

SEQ ID NO: 2755492 - protein, 13 aa, Entamoeba invadens
FTDSNGKDNCETC

SEQ ID NO: 2755493 - protein, 14 aa, Entamoeba invadens
FTDSNGKDNCETCG

SEQ ID NO: 2755494 - protein, 10 aa, Entamoeba invadens
FTEDSPVDSQ

SEQ ID NO: 2755495 - protein, 7 aa, Entamoeba invadens
FTEESSR

SEQ ID NO: 2755496 - protein, 7 aa, Entamoeba invadens
FTEGSNG

SEQ ID NO: 2755497 - protein, 11 aa, Entamoeba invadens
FTENPNPNSSI

SEQ ID NO: 2755498 - protein, 10 aa, Entamoeba invadens
FTEQASENDR

SEQ ID NO: 2755499 - protein, 8 aa, Entamoeba invadens
FTERETSK

SEQ ID NO: 2755500 - protein, 4 aa, Entamoeba invadens
FTES

SEQ ID NO: 2755501 - protein, 15 aa, Entamoeba invadens
FTESTKNETSQLKSG

SEQ ID NO: 2755502 - protein, 19 aa, Entamoeba invadens
FTESTQNILGDSSYDDLGI

SEQ ID NO: 2755503 - protein, 4 aa, Entamoeba invadens
FTEV

SEQ ID NO: 2755504 - protein, 5 aa, Entamoeba invadens
FTEVN

SEQ ID NO: 2755505 - protein, 10 aa, Entamoeba invadens
FTGDTTIEEP

SEQ ID NO: 2755506 - protein, 5 aa, Entamoeba invadens
FTGGK

SEQ ID NO: 2755507 - protein, 4 aa, Entamoeba invadens
FTGQ

SEQ ID NO: 2755508 - protein, 4 aa, Entamoeba invadens
FTGS

SEQ ID NO: 2755509 - protein, 7 aa, Entamoeba invadens
FTGSTPI

SEQ ID NO: 2755510 - protein, 8 aa, Entamoeba invadens
FTHSTPDS

SEQ ID NO: 2755511 - protein, 9 aa, Entamoeba invadens
FTKEAGNDV

SEQ ID NO: 2755512 - protein, 6 aa, Entamoeba invadens
FTKGAP

SEQ ID NO: 2755513 - protein, 9 aa, Entamoeba invadens
FTKKEYNPN

SEQ ID NO: 2755514 - protein, 10 aa, Entamoeba invadens
FTKNDRKKFG

SEQ ID NO: 2755515 - protein, 10 aa, Entamoeba invadens
FTKPASDNKI

SEQ ID NO: 2755516 - protein, 17 aa, Entamoeba invadens
FTKPASDNQTCDSCSTA

SEQ ID NO: 2755517 - protein, 17 aa, Entamoeba invadens
FTKPSSDTQTCDSCSTA

SEQ ID NO: 2755518 - protein, 10 aa, Entamoeba invadens
FTKPVSDNQI

SEQ ID NO: 2755519 - protein, 6 aa, Entamoeba invadens
FTKQDT

SEQ ID NO: 2755520 - protein, 9 aa, Entamoeba invadens
FTKQNGQEI

SEQ ID NO: 2755521 - protein, 7 aa, Entamoeba invadens
FTKRDET

SEQ ID NO: 2755522 - protein, 5 aa, Entamoeba invadens
FTKRK

SEQ ID NO: 2755523 - protein, 10 aa, Entamoeba invadens
FTKRSSSDGW

SEQ ID NO: 2755524 - protein, 18 aa, Entamoeba invadens
FTKSANKSEEKNYTELKE

SEQ ID NO: 2755525 - protein, 5 aa, Entamoeba invadens
FTKSE

SEQ ID NO: 2755526 - protein, 18 aa, Entamoeba invadens
FTNAPIKTKGAAQITGSK

SEQ ID NO: 2755527 - protein, 7 aa, Entamoeba invadens
FTNASEC

SEQ ID NO: 2755528 - protein, 7 aa, Entamoeba invadens
FTNPEEV

SEQ ID NO: 2755529 - protein, 9 aa, Entamoeba invadens
FTNPTLDTP

SEQ ID NO: 2755530 - protein, 11 aa, Entamoeba invadens
FTNSKGSPAYM

SEQ ID NO: 2755531 - protein, 4 aa, Entamoeba invadens
FTNV

SEQ ID NO: 2755532 - protein, 5 aa, Entamoeba invadens
FTPDV

SEQ ID NO: 2755533 - protein, 5 aa, Entamoeba invadens
FTPER

SEQ ID NO: 2755534 - protein, 6 aa, Entamoeba invadens
FTPGVS

SEQ ID NO: 2755535 - protein, 6 aa, Entamoeba invadens
FTPKPY

SEQ ID NO: 2755536 - protein, 5 aa, Entamoeba invadens
FTPPA

SEQ ID NO: 2755537 - protein, 8 aa, Entamoeba invadens
FTPPDPND

SEQ ID NO: 2755538 - protein, 16 aa, Entamoeba invadens
FTPPKGSLSETANNKY

SEQ ID NO: 2755539 - protein, 5 aa, Entamoeba invadens
FTPPQ

SEQ ID NO: 2755540 - protein, 8 aa, Entamoeba invadens
FTPPSSYA

SEQ ID NO: 2755541 - protein, 6 aa, Entamoeba invadens
FTPSKK

SEQ ID NO: 2755542 - protein, 11 aa, Entamoeba invadens
FTQAESEKFQN

SEQ ID NO: 2755543 - protein, 9 aa, Entamoeba invadens
FTQKEEEKF

SEQ ID NO: 2755544 - protein, 5 aa, Entamoeba invadens
FTQNP

SEQ ID NO: 2755545 - protein, 12 aa, Entamoeba invadens
FTRNEKDKIINE

SEQ ID NO: 2755546 - protein, 4 aa, Entamoeba invadens
FTRT

SEQ ID NO: 2755547 - protein, 4 aa, Entamoeba invadens
FTSA

SEQ ID NO: 2755548 - protein, 5 aa, Entamoeba invadens
FTSCE

SEQ ID NO: 2755549 - protein, 11 aa, Entamoeba invadens
FTSEKGNEGVY

SEQ ID NO: 2755550 - protein, 9 aa, Entamoeba invadens
FTSGSTTKC

SEQ ID NO: 2755551 - protein, 5 aa, Entamoeba invadens
FTSKK

SEQ ID NO: 2755552 - protein, 28 aa, Entamoeba invadens
FTSKKRQSLTQANNNHRRAYAPKQKTKS

SEQ ID NO: 2755553 - protein, 8 aa, Entamoeba invadens
FTSKTNEK

SEQ ID NO: 2755554 - protein, 9 aa, Entamoeba invadens
FTSKTNEKY

SEQ ID NO: 2755555 - protein, 4 aa, Entamoeba invadens
FTSN

SEQ ID NO: 2755556 - protein, 6 aa, Entamoeba invadens
FTSNDI

SEQ ID NO: 2755557 - protein, 5 aa, Entamoeba invadens
FTSQR

SEQ ID NO: 2755558 - protein, 9 aa, Entamoeba invadens
FTSSDSKKS

SEQ ID NO: 2755559 - protein, 6 aa, Entamoeba invadens
FTSSEM

SEQ ID NO: 2755560 - protein, 7 aa, Entamoeba invadens
FTSSGKR

SEQ ID NO: 2755561 - protein, 16 aa, Entamoeba invadens
FTSSGKRLPIPTSVPE

SEQ ID NO: 2755562 - protein, 9 aa, Entamoeba invadens
FTSSPSGQL

SEQ ID NO: 2755563 - protein, 7 aa, Entamoeba invadens
FTSTNNF

SEQ ID NO: 2755564 - protein, 4 aa, Entamoeba invadens
FTTE

SEQ ID NO: 2755565 - protein, 10 aa, Entamoeba invadens
FTTEIAGGKE

SEQ ID NO: 2755566 - protein, 7 aa, Entamoeba invadens
FTTKEDD

SEQ ID NO: 2755567 - protein, 6 aa, Entamoeba invadens
FTTPQT

SEQ ID NO: 2755568 - protein, 7 aa, Entamoeba invadens
FTTRNTS

SEQ ID NO: 2755569 - protein, 7 aa, Entamoeba invadens
FTTSGKR

SEQ ID NO: 2755570 - protein, 7 aa, Entamoeba invadens
FTTSPQK

SEQ ID NO: 2755571 - protein, 6 aa, Entamoeba invadens
FTTTEK

SEQ ID NO: 2755572 - protein, 14 aa, Entamoeba invadens
FTTTNTTCKRCPDN

SEQ ID NO: 2755573 - protein, 21 aa, Entamoeba invadens
FTTTTKLSKKEMRKTTDTYKT

SEQ ID NO: 2755574 - protein, 12 aa, Entamoeba invadens
FTVEDTNSRFKE

SEQ ID NO: 2755575 - protein, 10 aa, Entamoeba invadens
FTVGTDNTCH

SEQ ID NO: 2755576 - protein, 5 aa, Entamoeba invadens
FTVSK

SEQ ID NO: 2755577 - protein, 9 aa, Entamoeba invadens
FVESTKEVD

SEQ ID NO: 2755578 - protein, 6 aa, Entamoeba invadens
FVGEKG

SEQ ID NO: 2755579 - protein, 5 aa, Entamoeba invadens
FVGER

SEQ ID NO: 2755580 - protein, 9 aa, Entamoeba invadens
FVNNNGKCQ

SEQ ID NO: 2755581 - protein, 4 aa, Entamoeba invadens
FVNQ

SEQ ID NO: 2755582 - protein, 10 aa, Entamoeba invadens
FVPSDDKTQC

SEQ ID NO: 2755583 - protein, 8 aa, Entamoeba invadens
FVRKDTKD

SEQ ID NO: 2755584 - protein, 5 aa, Entamoeba invadens
FVSDG

SEQ ID NO: 2755585 - protein, 12 aa, Entamoeba invadens
FVSSGSCESPTL

SEQ ID NO: 2755586 - protein, 18 aa, Entamoeba invadens
FVSSSKTTIVDGNSVSSE

SEQ ID NO: 2755587 - protein, 26 aa, Entamoeba invadens
FYDETKKKSGIEENREIERKKYSSAF

SEQ ID NO: 2755588 - protein, 12 aa, Entamoeba invadens
FYGKGSEKTPYS

SEQ ID NO: 2755589 - protein, 4 aa, Entamoeba invadens
FYHT

SEQ ID NO: 2755590 - protein, 6 aa, Entamoeba invadens
FYKTGT

SEQ ID NO: 2755591 - protein, 5 aa, Entamoeba invadens
FYNET

SEQ ID NO: 2755592 - protein, 24 aa, Entamoeba invadens
FYNETEKTCQKCPKGTYSLTPGSA

SEQ ID NO: 2755593 - protein, 15 aa, Entamoeba invadens
FYNKPDSEFYGENKE

SEQ ID NO: 2755594 - protein, 8 aa, Entamoeba invadens
FYNSQEGG

SEQ ID NO: 2755595 - protein, 6 aa, Entamoeba invadens
FYNTNN

SEQ ID NO: 2755596 - protein, 15 aa, Entamoeba invadens
FYNTTKKKCENNGIG

SEQ ID NO: 2755597 - protein, 6 aa, Entamoeba invadens
FYPDSN

SEQ ID NO: 2755598 - protein, 21 aa, Entamoeba invadens
FYPESKTCSKCDSSCSDCTSL

SEQ ID NO: 2755599 - protein, 5 aa, Entamoeba invadens
FYPNA

SEQ ID NO: 2755600 - protein, 9 aa, Entamoeba invadens
FYPNDNGKC

SEQ ID NO: 2755601 - protein, 6 aa, Entamoeba invadens
FYPNDS

SEQ ID NO: 2755602 - protein, 7 aa, Entamoeba invadens
FYPNESG

SEQ ID NO: 2755603 - protein, 16 aa, Entamoeba invadens
FYPNSSGKCSSSIENC

SEQ ID NO: 2755604 - protein, 7 aa, Entamoeba invadens
FYPNTST

SEQ ID NO: 2755605 - protein, 6 aa, Entamoeba invadens
FYQNDT

SEQ ID NO: 2755606 - protein, 7 aa, Entamoeba invadens
FYQNDTN

SEQ ID NO: 2755607 - protein, 28 aa, Entamoeba invadens
FYQNKDGQNACKQCNSSCTSCSKNEGKC

SEQ ID NO: 2755608 - protein, 12 aa, Entamoeba invadens
FYQSDTKNIEGK

SEQ ID NO: 2755609 - protein, 12 aa, Entamoeba invadens
FYQSDTNNIEGK

SEQ ID NO: 2755610 - protein, 11 aa, Entamoeba invadens
FYSDKKSSTCT

SEQ ID NO: 2755611 - protein, 23 aa, Entamoeba invadens
FYSEGNKPYCTPCGEGTTSSDDH

SEQ ID NO: 2755612 - protein, 5 aa, Entamoeba invadens
FYSKS

SEQ ID NO: 2755613 - protein, 25 aa, Entamoeba invadens
FYSNEGATACTKCETGSVSITGSSS

SEQ ID NO: 2755614 - protein, 7 aa, Entamoeba invadens
FYSNEGY

SEQ ID NO: 2755615 - protein, 4 aa, Entamoeba invadens
FYSS

SEQ ID NO: 2755616 - protein, 10 aa, Entamoeba invadens
FYSTEGSSNC

SEQ ID NO: 2755617 - protein, 7 aa, Entamoeba invadens
FYSTEKS

SEQ ID NO: 2755618 - protein, 10 aa, Entamoeba invadens
FYSTETNTCE

SEQ ID NO: 2755619 - protein, 10 aa, Entamoeba invadens
FYSTKGSSKC

SEQ ID NO: 2755620 - protein, 9 aa, Entamoeba invadens
FYSTSGSST

SEQ ID NO: 2755621 - protein, 8 aa, Entamoeba invadens
FYSTTKSS

SEQ ID NO: 2755622 - protein, 5 aa, Entamoeba invadens
FYTEN

SEQ ID NO: 2755623 - protein, 17 aa, Entamoeba invadens
GAAGGVGKGFTEKLAKE

SEQ ID NO: 2755624 - protein, 5 aa, Entamoeba invadens
GAASD

SEQ ID NO: 2755625 - protein, 9 aa, Entamoeba invadens
GACDGSNGI

SEQ ID NO: 2755626 - protein, 5 aa, Entamoeba invadens
GACTQ

SEQ ID NO: 2755627 - protein, 7 aa, Entamoeba invadens
GADEEYG

SEQ ID NO: 2755628 - protein, 9 aa, Entamoeba invadens
GADGETQRW

SEQ ID NO: 2755629 - protein, 27 aa, Entamoeba invadens
GADGTPDQHTLEPVEPETDSNKEEEVM

SEQ ID NO: 2755630 - protein, 10 aa, Entamoeba invadens
GADGVNYSSC

SEQ ID NO: 2755631 - protein, 5 aa, Entamoeba invadens
GADIN

SEQ ID NO: 2755632 - protein, 10 aa, Entamoeba invadens
GADKTAYNYE

SEQ ID NO: 2755633 - protein, 5 aa, Entamoeba invadens
GADNV

SEQ ID NO: 2755634 - protein, 6 aa, Entamoeba invadens
GADSAI

SEQ ID NO: 2755635 - protein, 9 aa, Entamoeba invadens
GADSDFEIT

SEQ ID NO: 2755636 - protein, 5 aa, Entamoeba invadens
GADSI

SEQ ID NO: 2755637 - protein, 9 aa, Entamoeba invadens
GADSTFSKN

SEQ ID NO: 2755638 - protein, 4 aa, Entamoeba invadens
GAEE

SEQ ID NO: 2755639 - protein, 7 aa, Entamoeba invadens
GAEGAQY

SEQ ID NO: 2755640 - protein, 11 aa, Entamoeba invadens
GAEMKNPDEKL

SEQ ID NO: 2755641 - protein, 10 aa, Entamoeba invadens
GAENKSPKMK

SEQ ID NO: 2755642 - protein, 23 aa, Entamoeba invadens
GAEPCYSKDKDKKCIKDGTTTKC

SEQ ID NO: 2755643 - protein, 5 aa, Entamoeba invadens
GAESF

SEQ ID NO: 2755644 - protein, 9 aa, Entamoeba invadens
GAESHAGQT

SEQ ID NO: 2755645 - protein, 6 aa, Entamoeba invadens
GAESSV

SEQ ID NO: 2755646 - protein, 7 aa, Entamoeba invadens
GAETPSR

SEQ ID NO: 2755647 - protein, 11 aa, Entamoeba invadens
GAGDNSISDGR

SEQ ID NO: 2755648 - protein, 9 aa, Entamoeba invadens
GAGEDENVH

SEQ ID NO: 2755649 - protein, 8 aa, Entamoeba invadens
GAGSVSEA

SEQ ID NO: 2755650 - protein, 25 aa, Entamoeba invadens
GAGTINSFTSKSDATVTFNKGGNLN

SEQ ID NO: 2755651 - protein, 14 aa, Entamoeba invadens
GAGTRMDNQVQKTN

SEQ ID NO: 2755652 - protein, 9 aa, Entamoeba invadens
GAIAEETIG

SEQ ID NO: 2755653 - protein, 5 aa, Entamoeba invadens
GAIPA

SEQ ID NO: 2755654 - protein, 7 aa, Entamoeba invadens
GAKIGEK

SEQ ID NO: 2755655 - protein, 7 aa, Entamoeba invadens
GAKNEQT

SEQ ID NO: 2755656 - protein, 10 aa, Entamoeba invadens
GAKSGVNEVA

SEQ ID NO: 2755657 - protein, 8 aa, Entamoeba invadens
GAKYTSAG

SEQ ID NO: 2755658 - protein, 8 aa, Entamoeba invadens
GALAGTQN

SEQ ID NO: 2755659 - protein, 12 aa, Entamoeba invadens
GALGEEDSLEGQ

SEQ ID NO: 2755660 - protein, 14 aa, Entamoeba invadens
GALGTTKEGTSVIA

SEQ ID NO: 2755661 - protein, 4 aa, Entamoeba invadens
GALT

SEQ ID NO: 2755662 - protein, 4 aa, Entamoeba invadens
GALY

SEQ ID NO: 2755663 - protein, 8 aa, Entamoeba invadens
GANDDPGT

SEQ ID NO: 2755664 - protein, 6 aa, Entamoeba invadens
GANYGW

SEQ ID NO: 2755665 - protein, 5 aa, Entamoeba invadens
GAPEI

SEQ ID NO: 2755666 - protein, 17 aa, Entamoeba invadens
GAPKNKDKAMKRITKNT

SEQ ID NO: 2755667 - protein, 7 aa, Entamoeba invadens
GAPSGYN

SEQ ID NO: 2755668 - protein, 8 aa, Entamoeba invadens
GAPTEKKT

SEQ ID NO: 2755669 - protein, 9 aa, Entamoeba invadens
GAQSSGKST

SEQ ID NO: 2755670 - protein, 6 aa, Entamoeba invadens
GAQTDG

SEQ ID NO: 2755671 - protein, 8 aa, Entamoeba invadens
GARGDQCD

SEQ ID NO: 2755672 - protein, 15 aa, Entamoeba invadens
GARPTNNAKVPLQEY

SEQ ID NO: 2755673 - protein, 9 aa, Entamoeba invadens
GARREGGRE

SEQ ID NO: 2755674 - protein, 35 aa, Entamoeba invadens
GARTLSKKEKEAAAKAKEEEARKKEEEKQKKREEK

SEQ ID NO: 2755675 - protein, 9 aa, Entamoeba invadens
GASATNDQN

SEQ ID NO: 2755676 - protein, 12 aa, Entamoeba invadens
GASFDSETSKKT

SEQ ID NO: 2755677 - protein, 4 aa, Entamoeba invadens
GASG

SEQ ID NO: 2755678 - protein, 9 aa, Entamoeba invadens
GASGLKESY

SEQ ID NO: 2755679 - protein, 6 aa, Entamoeba invadens
GASGMN

SEQ ID NO: 2755680 - protein, 11 aa, Entamoeba invadens
GASGSGKSTGI

SEQ ID NO: 2755681 - protein, 5 aa, Entamoeba invadens
GASHD

SEQ ID NO: 2755682 - protein, 8 aa, Entamoeba invadens
GASKINAN

SEQ ID NO: 2755683 - protein, 8 aa, Entamoeba invadens
GASLTSSN

SEQ ID NO: 2755684 - protein, 5 aa, Entamoeba invadens
GASNQ

SEQ ID NO: 2755685 - protein, 16 aa, Entamoeba invadens
GASRASSSSESGSTGS

SEQ ID NO: 2755686 - protein, 6 aa, Entamoeba invadens
GASTNV

SEQ ID NO: 2755687 - protein, 7 aa, Entamoeba invadens
GASTSKN

SEQ ID NO: 2755688 - protein, 8 aa, Entamoeba invadens
GASWGEKG

SEQ ID NO: 2755689 - protein, 26 aa, Entamoeba invadens
GASWSSKRDSLAGNISPLANSGASGI

SEQ ID NO: 2755690 - protein, 10 aa, Entamoeba invadens
GATEAPSDEV

SEQ ID NO: 2755691 - protein, 5 aa, Entamoeba invadens
GATIN

SEQ ID NO: 2755692 - protein, 8 aa, Entamoeba invadens
GATNEGPF

SEQ ID NO: 2755693 - protein, 7 aa, Entamoeba invadens
GATNKSM

SEQ ID NO: 2755694 - protein, 9 aa, Entamoeba invadens
GATQPTVRS

SEQ ID NO: 2755695 - protein, 4 aa, Entamoeba invadens
GATR

SEQ ID NO: 2755696 - protein, 8 aa, Entamoeba invadens
GATSGVGK

SEQ ID NO: 2755697 - protein, 10 aa, Entamoeba invadens
GATSSQITCD

SEQ ID NO: 2755698 - protein, 4 aa, Entamoeba invadens
GATT

SEQ ID NO: 2755699 - protein, 8 aa, Entamoeba invadens
GATVESKL

SEQ ID NO: 2755700 - protein, 4 aa, Entamoeba invadens
GAVG

SEQ ID NO: 2755701 - protein, 26 aa, Entamoeba invadens
GAVTEAAKFKGQNEEGIIGNKTPRQS

SEQ ID NO: 2755702 - protein, 11 aa, Entamoeba invadens
GAYDNDPRFTQ

SEQ ID NO: 2755703 - protein, 7 aa, Entamoeba invadens
GAYGTEQ

SEQ ID NO: 2755704 - protein, 7 aa, Entamoeba invadens
GAYTDEK

SEQ ID NO: 2755705 - protein, 7 aa, Entamoeba invadens
GCAGNYS

SEQ ID NO: 2755706 - protein, 11 aa, Entamoeba invadens
GCAKANGMSCP

SEQ ID NO: 2755707 - protein, 4 aa, Entamoeba invadens
GCAQ

SEQ ID NO: 2755708 - protein, 13 aa, Entamoeba invadens
GCAQCDDKDSCSV

SEQ ID NO: 2755709 - protein, 5 aa, Entamoeba invadens
GCARC

SEQ ID NO: 2755710 - protein, 8 aa, Entamoeba invadens
GCATSTDD

SEQ ID NO: 2755711 - protein, 8 aa, Entamoeba invadens
GCCGGDPK

SEQ ID NO: 2755712 - protein, 12 aa, Entamoeba invadens
GCDGDKTGKCPH

SEQ ID NO: 2755713 - protein, 7 aa, Entamoeba invadens
GCDTTGK

SEQ ID NO: 2755714 - protein, 5 aa, Entamoeba invadens
GCEGC

SEQ ID NO: 2755715 - protein, 6 aa, Entamoeba invadens
GCEKCT

SEQ ID NO: 2755716 - protein, 8 aa, Entamoeba invadens
GCENRNAS

SEQ ID NO: 2755717 - protein, 13 aa, Entamoeba invadens
GCEQCDNSTHCTT

SEQ ID NO: 2755718 - protein, 7 aa, Entamoeba invadens
GCERQIE

SEQ ID NO: 2755719 - protein, 5 aa, Entamoeba invadens
GCESC

SEQ ID NO: 2755720 - protein, 10 aa, Entamoeba invadens
GCESGYEPFS

SEQ ID NO: 2755721 - protein, 12 aa, Entamoeba invadens
GCESSDNEYNHN

SEQ ID NO: 2755722 - protein, 7 aa, Entamoeba invadens
GCETCSP

SEQ ID NO: 2755723 - protein, 12 aa, Entamoeba invadens
GCGDKGCSRENK

SEQ ID NO: 2755724 - protein, 7 aa, Entamoeba invadens
GCGDSMN

SEQ ID NO: 2755725 - protein, 5 aa, Entamoeba invadens
GCGGG

SEQ ID NO: 2755726 - protein, 9 aa, Entamoeba invadens
GCGKSGGVR

SEQ ID NO: 2755727 - protein, 6 aa, Entamoeba invadens
GCGPNY

SEQ ID NO: 2755728 - protein, 9 aa, Entamoeba invadens
GCGSSPPRS

SEQ ID NO: 2755729 - protein, 19 aa, Entamoeba invadens
GCINNNGKCVESDKNSEVI

SEQ ID NO: 2755730 - protein, 7 aa, Entamoeba invadens
GCIQSSN

SEQ ID NO: 2755731 - protein, 19 aa, Entamoeba invadens
GCKDISTTGEELSTTRRFG

SEQ ID NO: 2755732 - protein, 32 aa, Entamoeba invadens
GCKECANDLSGEGLKKTGYYVPPGKQECEECE

SEQ ID NO: 2755733 - protein, 6 aa, Entamoeba invadens
GCKEGT

SEQ ID NO: 2755734 - protein, 8 aa, Entamoeba invadens
GCKQCPKN

SEQ ID NO: 2755735 - protein, 12 aa, Entamoeba invadens
GCKYQNSTKGKN

SEQ ID NO: 2755736 - protein, 8 aa, Entamoeba invadens
GCNKNTGI

SEQ ID NO: 2755737 - protein, 13 aa, Entamoeba invadens
GCNNTDCGTSTTT

SEQ ID NO: 2755738 - protein, 4 aa, Entamoeba invadens
GCNP

SEQ ID NO: 2755739 - protein, 8 aa, Entamoeba invadens
GCNSSDGA

SEQ ID NO: 2755740 - protein, 5 aa, Entamoeba invadens
GCPEE

SEQ ID NO: 2755741 - protein, 6 aa, Entamoeba invadens
GCPPSY

SEQ ID NO: 2755742 - protein, 5 aa, Entamoeba invadens
GCQEC

SEQ ID NO: 2755743 - protein, 4 aa, Entamoeba invadens
GCQH

SEQ ID NO: 2755744 - protein, 5 aa, Entamoeba invadens
GCQHC

SEQ ID NO: 2755745 - protein, 7 aa, Entamoeba invadens
GCQQCQD

SEQ ID NO: 2755746 - protein, 18 aa, Entamoeba invadens
GCQQTTRCQNPSNTTMSS

SEQ ID NO: 2755747 - protein, 5 aa, Entamoeba invadens
GCQSC

SEQ ID NO: 2755748 - protein, 5 aa, Entamoeba invadens
GCREP

SEQ ID NO: 2755749 - protein, 10 aa, Entamoeba invadens
GCSACGNGKV

SEQ ID NO: 2755750 - protein, 10 aa, Entamoeba invadens
GCSDGYDNDT

SEQ ID NO: 2755751 - protein, 8 aa, Entamoeba invadens
GCSDKSDF

SEQ ID NO: 2755752 - protein, 6 aa, Entamoeba invadens
GCSDLD

SEQ ID NO: 2755753 - protein, 5 aa, Entamoeba invadens
GCSEC

SEQ ID NO: 2755754 - protein, 5 aa, Entamoeba invadens
GCSHC

SEQ ID NO: 2755755 - protein, 9 aa, Entamoeba invadens
GCSSCTTTS

SEQ ID NO: 2755756 - protein, 5 aa, Entamoeba invadens
GCSSE

SEQ ID NO: 2755757 - protein, 6 aa, Entamoeba invadens
GCSSVD

SEQ ID NO: 2755758 - protein, 12 aa, Entamoeba invadens
GCSTCTNGTNCQ

SEQ ID NO: 2755759 - protein, 13 aa, Entamoeba invadens
GCSTCTNGTNCQY

SEQ ID NO: 2755760 - protein, 14 aa, Entamoeba invadens
GCSTCTNGTNCQYT

SEQ ID NO: 2755761 - protein, 4 aa, Entamoeba invadens
GCTD

SEQ ID NO: 2755762 - protein, 12 aa, Entamoeba invadens
GCTECKPKYYKN

SEQ ID NO: 2755763 - protein, 12 aa, Entamoeba invadens
GCTEGPKTKYNA

SEQ ID NO: 2755764 - protein, 6 aa, Entamoeba invadens
GCTIST

SEQ ID NO: 2755765 - protein, 6 aa, Entamoeba invadens
GCTKPD

SEQ ID NO: 2755766 - protein, 4 aa, Entamoeba invadens
GCTN

SEQ ID NO: 2755767 - protein, 6 aa, Entamoeba invadens
GCTQNG

SEQ ID NO: 2755768 - protein, 8 aa, Entamoeba invadens
GCTQYSGG

SEQ ID NO: 2755769 - protein, 15 aa, Entamoeba invadens
GCTSCTQNACNSCSD

SEQ ID NO: 2755770 - protein, 6 aa, Entamoeba invadens
GCTSPD

SEQ ID NO: 2755771 - protein, 4 aa, Entamoeba invadens
GCTT

SEQ ID NO: 2755772 - protein, 4 aa, Entamoeba invadens
GCVE

SEQ ID NO: 2755773 - protein, 6 aa, Entamoeba invadens
GCVSND

SEQ ID NO: 2755774 - protein, 10 aa, Entamoeba invadens
GCVSNDNECA

SEQ ID NO: 2755775 - protein, 12 aa, Entamoeba invadens
GCVSNDNECAIQ

SEQ ID NO: 2755776 - protein, 5 aa, Entamoeba invadens
GDAAV

SEQ ID NO: 2755777 - protein, 10 aa, Entamoeba invadens
GDAEEQKQTN

SEQ ID NO: 2755778 - protein, 10 aa, Entamoeba invadens
GDANALGPEE

SEQ ID NO: 2755779 - protein, 6 aa, Entamoeba invadens
GDAPRY

SEQ ID NO: 2755780 - protein, 5 aa, Entamoeba invadens
GDASE

SEQ ID NO: 2755781 - protein, 6 aa, Entamoeba invadens
GDATKN

SEQ ID NO: 2755782 - protein, 10 aa, Entamoeba invadens
GDAYDKDNSC

SEQ ID NO: 2755783 - protein, 6 aa, Entamoeba invadens
GDCIPQ

SEQ ID NO: 2755784 - protein, 9 aa, Entamoeba invadens
GDCKTSSCK

SEQ ID NO: 2755785 - protein, 5 aa, Entamoeba invadens
GDCLE

SEQ ID NO: 2755786 - protein, 21 aa, Entamoeba invadens
GDCVSTKQCQAPSIKTQSSCD

SEQ ID NO: 2755787 - protein, 9 aa, Entamoeba invadens
GDDADSNKC

SEQ ID NO: 2755788 - protein, 19 aa, Entamoeba invadens
GDDCRPCETGSNSGDGVTD

SEQ ID NO: 2755789 - protein, 5 aa, Entamoeba invadens
GDDDW

SEQ ID NO: 2755790 - protein, 5 aa, Entamoeba invadens
GDDEV

SEQ ID NO: 2755791 - protein, 9 aa, Entamoeba invadens
GDDKKTANK

SEQ ID NO: 2755792 - protein, 4 aa, Entamoeba invadens
GDDM

SEQ ID NO: 2755793 - protein, 8 aa, Entamoeba invadens
GDDNAENI

SEQ ID NO: 2755794 - protein, 26 aa, Entamoeba invadens
GDECDPTDSKIDSDTLPPKNYSKGCA

SEQ ID NO: 2755795 - protein, 4 aa, Entamoeba invadens
GDEE

SEQ ID NO: 2755796 - protein, 8 aa, Entamoeba invadens
GDEERNKK

SEQ ID NO: 2755797 - protein, 8 aa, Entamoeba invadens
GDEHPDKT

SEQ ID NO: 2755798 - protein, 6 aa, Entamoeba invadens
GDEHVE

SEQ ID NO: 2755799 - protein, 8 aa, Entamoeba invadens
GDEISVNE

SEQ ID NO: 2755800 - protein, 5 aa, Entamoeba invadens
GDEIT

SEQ ID NO: 2755801 - protein, 14 aa, Entamoeba invadens
GDEKGYELAKTDDK

SEQ ID NO: 2755802 - protein, 9 aa, Entamoeba invadens
GDEKQTRKI

SEQ ID NO: 2755803 - protein, 5 aa, Entamoeba invadens
GDEMT

SEQ ID NO: 2755804 - protein, 7 aa, Entamoeba invadens
GDENEPF

SEQ ID NO: 2755805 - protein, 4 aa, Entamoeba invadens
GDFN

SEQ ID NO: 2755806 - protein, 13 aa, Entamoeba invadens
GDFSVGGNAVDRA

SEQ ID NO: 2755807 - protein, 6 aa, Entamoeba invadens
GDGAND

SEQ ID NO: 2755808 - protein, 7 aa, Entamoeba invadens
GDGANDV

SEQ ID NO: 2755809 - protein, 6 aa, Entamoeba invadens
GDGCRK

SEQ ID NO: 2755810 - protein, 9 aa, Entamoeba invadens
GDGECNSST

SEQ ID NO: 2755811 - protein, 7 aa, Entamoeba invadens
GDGGNDI

SEQ ID NO: 2755812 - protein, 4 aa, Entamoeba invadens
GDGH

SEQ ID NO: 2755813 - protein, 8 aa, Entamoeba invadens
GDGKWDGY

SEQ ID NO: 2755814 - protein, 5 aa, Entamoeba invadens
GDGKY

SEQ ID NO: 2755815 - protein, 5 aa, Entamoeba invadens
GDGNK

SEQ ID NO: 2755816 - protein, 6 aa, Entamoeba invadens
GDGRKG

SEQ ID NO: 2755817 - protein, 8 aa, Entamoeba invadens
GDGSTYLE

SEQ ID NO: 2755818 - protein, 15 aa, Entamoeba invadens
GDGTYASTTGSTSCK

SEQ ID NO: 2755819 - protein, 4 aa, Entamoeba invadens
GDGV

SEQ ID NO: 2755820 - protein, 13 aa, Entamoeba invadens
GDGVNDAPAIKSA

SEQ ID NO: 2755821 - protein, 14 aa, Entamoeba invadens
GDGYGEIKDTTPNW

SEQ ID NO: 2755822 - protein, 7 aa, Entamoeba invadens
GDGYSVS

SEQ ID NO: 2755823 - protein, 7 aa, Entamoeba invadens
GDGYYKE

SEQ ID NO: 2755824 - protein, 4 aa, Entamoeba invadens
GDHI

SEQ ID NO: 2755825 - protein, 4 aa, Entamoeba invadens
GDHL

SEQ ID NO: 2755826 - protein, 10 aa, Entamoeba invadens
GDHPKTAGAI

SEQ ID NO: 2755827 - protein, 8 aa, Entamoeba invadens
GDIAPKSL

SEQ ID NO: 2755828 - protein, 5 aa, Entamoeba invadens
GDIDE

SEQ ID NO: 2755829 - protein, 11 aa, Entamoeba invadens
GDIKDDEQQAL

SEQ ID NO: 2755830 - protein, 4 aa, Entamoeba invadens
GDIN

SEQ ID NO: 2755831 - protein, 5 aa, Entamoeba invadens
GDIPT

SEQ ID NO: 2755832 - protein, 4 aa, Entamoeba invadens
GDIQ

SEQ ID NO: 2755833 - protein, 4 aa, Entamoeba invadens
GDIS

SEQ ID NO: 2755834 - protein, 5 aa, Entamoeba invadens
GDITL

SEQ ID NO: 2755835 - protein, 5 aa, Entamoeba invadens
GDITP

SEQ ID NO: 2755836 - protein, 7 aa, Entamoeba invadens
GDITTDR

SEQ ID NO: 2755837 - protein, 13 aa, Entamoeba invadens
GDKDIQGDIQPNF

SEQ ID NO: 2755838 - protein, 8 aa, Entamoeba invadens
GDKDTKCE

SEQ ID NO: 2755839 - protein, 9 aa, Entamoeba invadens
GDKEETGIA

SEQ ID NO: 2755840 - protein, 11 aa, Entamoeba invadens
GDKEPRETHQN

SEQ ID NO: 2755841 - protein, 9 aa, Entamoeba invadens
GDKEYSQNT

SEQ ID NO: 2755842 - protein, 6 aa, Entamoeba invadens
GDKGAG

SEQ ID NO: 2755843 - protein, 6 aa, Entamoeba invadens
GDKGKC

SEQ ID NO: 2755844 - protein, 6 aa, Entamoeba invadens
GDKGNC

SEQ ID NO: 2755845 - protein, 9 aa, Entamoeba invadens
GDKIKTALN

SEQ ID NO: 2755846 - protein, 11 aa, Entamoeba invadens
GDKNADNDMDV

SEQ ID NO: 2755847 - protein, 6 aa, Entamoeba invadens
GDKPDT

SEQ ID NO: 2755848 - protein, 4 aa, Entamoeba invadens
GDKR

SEQ ID NO: 2755849 - protein, 12 aa, Entamoeba invadens
GDKTKTNSSTCK

SEQ ID NO: 2755850 - protein, 10 aa, Entamoeba invadens
GDKTMDEKHR

SEQ ID NO: 2755851 - protein, 17 aa, Entamoeba invadens
GDKTTQESESDSQCEKV

SEQ ID NO: 2755852 - protein, 14 aa, Entamoeba invadens
GDKVPSEDGASCID

SEQ ID NO: 2755853 - protein, 14 aa, Entamoeba invadens
GDLDGGYAYSYGTT

SEQ ID NO: 2755854 - protein, 13 aa, Entamoeba invadens
GDLERNDDGSNHG

SEQ ID NO: 2755855 - protein, 12 aa, Entamoeba invadens
GDLGGKYTTQFD

SEQ ID NO: 2755856 - protein, 4 aa, Entamoeba invadens
GDLS

SEQ ID NO: 2755857 - protein, 4 aa, Entamoeba invadens
GDLT

SEQ ID NO: 2755858 - protein, 15 aa, Entamoeba invadens
GDMKKQSDESINYGD

SEQ ID NO: 2755859 - protein, 8 aa, Entamoeba invadens
GDNAFENT

SEQ ID NO: 2755860 - protein, 20 aa, Entamoeba invadens
GDNCDDCHNEANCKKCSDEY

SEQ ID NO: 2755861 - protein, 25 aa, Entamoeba invadens
GDNCTSCSSNGNCNSCNSNENESNR

SEQ ID NO: 2755862 - protein, 6 aa, Entamoeba invadens
GDNDIT

SEQ ID NO: 2755863 - protein, 8 aa, Entamoeba invadens
GDNEDAGF

SEQ ID NO: 2755864 - protein, 9 aa, Entamoeba invadens
GDNEENQIP

SEQ ID NO: 2755865 - protein, 20 aa, Entamoeba invadens
GDNESGLEDSINSSSNGSMK

SEQ ID NO: 2755866 - protein, 13 aa, Entamoeba invadens
GDNMTRDENNPSN

SEQ ID NO: 2755867 - protein, 5 aa, Entamoeba invadens
GDNNI

SEQ ID NO: 2755868 - protein, 8 aa, Entamoeba invadens
GDNSTLSN

SEQ ID NO: 2755869 - protein, 4 aa, Entamoeba invadens
GDNT

SEQ ID NO: 2755870 - protein, 11 aa, Entamoeba invadens
GDNVNTGKSIA

SEQ ID NO: 2755871 - protein, 7 aa, Entamoeba invadens
GDNWGEN

SEQ ID NO: 2755872 - protein, 7 aa, Entamoeba invadens
GDPEGDI

SEQ ID NO: 2755873 - protein, 6 aa, Entamoeba invadens
GDPEGK

SEQ ID NO: 2755874 - protein, 5 aa, Entamoeba invadens
GDPHS

SEQ ID NO: 2755875 - protein, 8 aa, Entamoeba invadens
GDPNIEYE

SEQ ID NO: 2755876 - protein, 9 aa, Entamoeba invadens
GDPRLDKDD

SEQ ID NO: 2755877 - protein, 5 aa, Entamoeba invadens
GDPRY

SEQ ID NO: 2755878 - protein, 5 aa, Entamoeba invadens
GDPTF

SEQ ID NO: 2755879 - protein, 6 aa, Entamoeba invadens
GDPTPL

SEQ ID NO: 2755880 - protein, 5 aa, Entamoeba invadens
GDQIG

SEQ ID NO: 2755881 - protein, 5 aa, Entamoeba invadens
GDQKE

SEQ ID NO: 2755882 - protein, 15 aa, Entamoeba invadens
GDQNIYRKDTNYGTI

SEQ ID NO: 2755883 - protein, 15 aa, Entamoeba invadens
GDQSLDGYIENGESK

SEQ ID NO: 2755884 - protein, 4 aa, Entamoeba invadens
GDQY

SEQ ID NO: 2755885 - protein, 14 aa, Entamoeba invadens
GDRGAQISGGQKQR

SEQ ID NO: 2755886 - protein, 14 aa, Entamoeba invadens
GDRGSQLSGGQKQR

SEQ ID NO: 2755887 - protein, 14 aa, Entamoeba invadens
GDRGSQMSGGQKQR

SEQ ID NO: 2755888 - protein, 9 aa, Entamoeba invadens
GDRNGVNST

SEQ ID NO: 2755889 - protein, 7 aa, Entamoeba invadens
GDRNNRV

SEQ ID NO: 2755890 - protein, 8 aa, Entamoeba invadens
GDRTEETL

SEQ ID NO: 2755891 - protein, 24 aa, Entamoeba invadens
GDSEETNKDKKDVKKETKSVVSLS

SEQ ID NO: 2755892 - protein, 16 aa, Entamoeba invadens
GDSFDNDVKLAALGNG

SEQ ID NO: 2755893 - protein, 9 aa, Entamoeba invadens
GDSGKFTKE

SEQ ID NO: 2755894 - protein, 10 aa, Entamoeba invadens
GDSGTGKTSL

SEQ ID NO: 2755895 - protein, 12 aa, Entamoeba invadens
GDSHQDPKLSAG

SEQ ID NO: 2755896 - protein, 6 aa, Entamoeba invadens
GDSKCS

SEQ ID NO: 2755897 - protein, 7 aa, Entamoeba invadens
GDSKTNL

SEQ ID NO: 2755898 - protein, 9 aa, Entamoeba invadens
GDSPSPIPT

SEQ ID NO: 2755899 - protein, 8 aa, Entamoeba invadens
GDSSVGKT

SEQ ID NO: 2755900 - protein, 11 aa, Entamoeba invadens
GDSTYGCDESS

SEQ ID NO: 2755901 - protein, 15 aa, Entamoeba invadens
GDSTYSPSPKSTTVD

SEQ ID NO: 2755902 - protein, 7 aa, Entamoeba invadens
GDTCNDA

SEQ ID NO: 2755903 - protein, 18 aa, Entamoeba invadens
GDTCTNWDETKTEDITLD

SEQ ID NO: 2755904 - protein, 4 aa, Entamoeba invadens
GDTE

SEQ ID NO: 2755905 - protein, 11 aa, Entamoeba invadens
GDTEPRTTHPN

SEQ ID NO: 2755906 - protein, 9 aa, Entamoeba invadens
GDTGEISAE

SEQ ID NO: 2755907 - protein, 8 aa, Entamoeba invadens
GDTPTDNI

SEQ ID NO: 2755908 - protein, 8 aa, Entamoeba invadens
GDTQRNYR

SEQ ID NO: 2755909 - protein, 4 aa, Entamoeba invadens
GDTR

SEQ ID NO: 2755910 - protein, 6 aa, Entamoeba invadens
GDTSQL

SEQ ID NO: 2755911 - protein, 6 aa, Entamoeba invadens
GDTSSA

SEQ ID NO: 2755912 - protein, 9 aa, Entamoeba invadens
GDTTCSKEK

SEQ ID NO: 2755913 - protein, 8 aa, Entamoeba invadens
GDVDNTES

SEQ ID NO: 2755914 - protein, 8 aa, Entamoeba invadens
GDVEGTRN

SEQ ID NO: 2755915 - protein, 5 aa, Entamoeba invadens
GDVET

SEQ ID NO: 2755916 - protein, 7 aa, Entamoeba invadens
GDVNARR

SEQ ID NO: 2755917 - protein, 5 aa, Entamoeba invadens
GDVRG

SEQ ID NO: 2755918 - protein, 9 aa, Entamoeba invadens
GDVSKSVSE

SEQ ID NO: 2755919 - protein, 5 aa, Entamoeba invadens
GDWGT

SEQ ID NO: 2755920 - protein, 4 aa, Entamoeba invadens
GDYC

SEQ ID NO: 2755921 - protein, 7 aa, Entamoeba invadens
GDYDDNE

SEQ ID NO: 2755922 - protein, 12 aa, Entamoeba invadens
GDYDKEKTEERL

SEQ ID NO: 2755923 - protein, 10 aa, Entamoeba invadens
GDYDNGTSFV

SEQ ID NO: 2755924 - protein, 5 aa, Entamoeba invadens
GDYHS

SEQ ID NO: 2755925 - protein, 4 aa, Entamoeba invadens
GDYK

SEQ ID NO: 2755926 - protein, 9 aa, Entamoeba invadens
GDYNNDAYP

SEQ ID NO: 2755927 - protein, 5 aa, Entamoeba invadens
GDYSK

SEQ ID NO: 2755928 - protein, 11 aa, Entamoeba invadens
GDYSTQCESCD

SEQ ID NO: 2755929 - protein, 5 aa, Entamoeba invadens
GEAAE

SEQ ID NO: 2755930 - protein, 8 aa, Entamoeba invadens
GEAEKRMK

SEQ ID NO: 2755931 - protein, 10 aa, Entamoeba invadens
GEAHGGPTDW

SEQ ID NO: 2755932 - protein, 4 aa, Entamoeba invadens
GEAP

SEQ ID NO: 2755933 - protein, 14 aa, Entamoeba invadens
GEAVTSLKTNPYAI

SEQ ID NO: 2755934 - protein, 4 aa, Entamoeba invadens
GECD

SEQ ID NO: 2755935 - protein, 13 aa, Entamoeba invadens
GECEECDSTKGFY

SEQ ID NO: 2755936 - protein, 7 aa, Entamoeba invadens
GECEKCD

SEQ ID NO: 2755937 - protein, 17 aa, Entamoeba invadens
GECENTNCENPNDLNGK

SEQ ID NO: 2755938 - protein, 12 aa, Entamoeba invadens
GECETYDNTNTK

SEQ ID NO: 2755939 - protein, 7 aa, Entamoeba invadens
GECGEWT

SEQ ID NO: 2755940 - protein, 4 aa, Entamoeba invadens
GECI

SEQ ID NO: 2755941 - protein, 8 aa, Entamoeba invadens
GECKPCSS

SEQ ID NO: 2755942 - protein, 5 aa, Entamoeba invadens
GECKS

SEQ ID NO: 2755943 - protein, 9 aa, Entamoeba invadens
GECKTCDTN

SEQ ID NO: 2755944 - protein, 12 aa, Entamoeba invadens
GECKTEYDNDRS

SEQ ID NO: 2755945 - protein, 14 aa, Entamoeba invadens
GECKTEYDNDRSCN

SEQ ID NO: 2755946 - protein, 16 aa, Entamoeba invadens
GECNTVNGKCNTCANN

SEQ ID NO: 2755947 - protein, 6 aa, Entamoeba invadens
GECQSC

SEQ ID NO: 2755948 - protein, 9 aa, Entamoeba invadens
GECQTKDSL

SEQ ID NO: 2755949 - protein, 8 aa, Entamoeba invadens
GECSDGDY

SEQ ID NO: 2755950 - protein, 8 aa, Entamoeba invadens
GECSQCNS

SEQ ID NO: 2755951 - protein, 16 aa, Entamoeba invadens
GECSSCEAGKTNVNGE

SEQ ID NO: 2755952 - protein, 6 aa, Entamoeba invadens
GECSTT

SEQ ID NO: 2755953 - protein, 6 aa, Entamoeba invadens
GECTSY

SEQ ID NO: 2755954 - protein, 8 aa, Entamoeba invadens
GECVKSDI

SEQ ID NO: 2755955 - protein, 6 aa, Entamoeba invadens
GECVNT

SEQ ID NO: 2755956 - protein, 37 aa, Entamoeba invadens
GECYKKRNEVTPPKPEKSEDSEDYSKQPNSEEEINTN

SEQ ID NO: 2755957 - protein, 13 aa, Entamoeba invadens
GECYSNTECEYND

SEQ ID NO: 2755958 - protein, 8 aa, Entamoeba invadens
GEDEKRAS

SEQ ID NO: 2755959 - protein, 6 aa, Entamoeba invadens
GEDFQS

SEQ ID NO: 2755960 - protein, 8 aa, Entamoeba invadens
GEDGEEWK

SEQ ID NO: 2755961 - protein, 5 aa, Entamoeba invadens
GEDKY

SEQ ID NO: 2755962 - protein, 8 aa, Entamoeba invadens
GEDNFNGA

SEQ ID NO: 2755963 - protein, 5 aa, Entamoeba invadens
GEDNS

SEQ ID NO: 2755964 - protein, 9 aa, Entamoeba invadens
GEDQWAGGY

SEQ ID NO: 2755965 - protein, 5 aa, Entamoeba invadens
GEDSV

SEQ ID NO: 2755966 - protein, 11 aa, Entamoeba invadens
GEECDGGQGCK

SEQ ID NO: 2755967 - protein, 7 aa, Entamoeba invadens
GEECQCK

SEQ ID NO: 2755968 - protein, 10 aa, Entamoeba invadens
GEEDENTHDY

SEQ ID NO: 2755969 - protein, 5 aa, Entamoeba invadens
GEEED

SEQ ID NO: 2755970 - protein, 7 aa, Entamoeba invadens
GEEEETM

SEQ ID NO: 2755971 - protein, 4 aa, Entamoeba invadens
GEEG

SEQ ID NO: 2755972 - protein, 5 aa, Entamoeba invadens
GEEKA

SEQ ID NO: 2755973 - protein, 6 aa, Entamoeba invadens
GEEKSF

SEQ ID NO: 2755974 - protein, 4 aa, Entamoeba invadens
GEEL

SEQ ID NO: 2755975 - protein, 7 aa, Entamoeba invadens
GEELPNY

SEQ ID NO: 2755976 - protein, 7 aa, Entamoeba invadens
GEENELE

SEQ ID NO: 2755977 - protein, 6 aa, Entamoeba invadens
GEENKA

SEQ ID NO: 2755978 - protein, 16 aa, Entamoeba invadens
GEENKDFEETTKYYVF

SEQ ID NO: 2755979 - protein, 8 aa, Entamoeba invadens
GEEPNIDT

SEQ ID NO: 2755980 - protein, 8 aa, Entamoeba invadens
GEEQTIND

SEQ ID NO: 2755981 - protein, 7 aa, Entamoeba invadens
GEEQTVP

SEQ ID NO: 2755982 - protein, 6 aa, Entamoeba invadens
GEEREV

SEQ ID NO: 2755983 - protein, 4 aa, Entamoeba invadens
GEES

SEQ ID NO: 2755984 - protein, 5 aa, Entamoeba invadens
GEETG

SEQ ID NO: 2755985 - protein, 6 aa, Entamoeba invadens
GEETKL

SEQ ID NO: 2755986 - protein, 7 aa, Entamoeba invadens
GEETRQC

SEQ ID NO: 2755987 - protein, 4 aa, Entamoeba invadens
GEEV

SEQ ID NO: 2755988 - protein, 12 aa, Entamoeba invadens
GEEVSSQERATA

SEQ ID NO: 2755989 - protein, 4 aa, Entamoeba invadens
GEEY

SEQ ID NO: 2755990 - protein, 4 aa, Entamoeba invadens
GEFE

SEQ ID NO: 2755991 - protein, 4 aa, Entamoeba invadens
GEFN

SEQ ID NO: 2755992 - protein, 4 aa, Entamoeba invadens
GEFP

SEQ ID NO: 2755993 - protein, 5 aa, Entamoeba invadens
GEFPG

SEQ ID NO: 2755994 - protein, 4 aa, Entamoeba invadens
GEGC

SEQ ID NO: 2755995 - protein, 4 aa, Entamoeba invadens
GEGG

SEQ ID NO: 2755996 - protein, 6 aa, Entamoeba invadens
GEGGEL

SEQ ID NO: 2755997 - protein, 18 aa, Entamoeba invadens
GEGIESDCNKCKSGYSWG

SEQ ID NO: 2755998 - protein, 14 aa, Entamoeba invadens
GEGNPYYHPAPTTA

SEQ ID NO: 2755999 - protein, 4 aa, Entamoeba invadens
GEGT

SEQ ID NO: 2756000 - protein, 7 aa, Entamoeba invadens
GEHPDVS

SEQ ID NO: 2756001 - protein, 7 aa, Entamoeba invadens
GEHSGRY

SEQ ID NO: 2756002 - protein, 9 aa, Entamoeba invadens
GEIDTNEKE

SEQ ID NO: 2756003 - protein, 10 aa, Entamoeba invadens
GEIETPEDGN

SEQ ID NO: 2756004 - protein, 5 aa, Entamoeba invadens
GEIND

SEQ ID NO: 2756005 - protein, 13 aa, Entamoeba invadens
GEIQEKAKKLVED

SEQ ID NO: 2756006 - protein, 4 aa, Entamoeba invadens
GEIR

SEQ ID NO: 2756007 - protein, 18 aa, Entamoeba invadens
GEISGNEVTIKGTEASTR

SEQ ID NO: 2756008 - protein, 9 aa, Entamoeba invadens
GEISTPRRA

SEQ ID NO: 2756009 - protein, 22 aa, Entamoeba invadens
GEKCKKCNDGYSLDAGGVSCSK

SEQ ID NO: 2756010 - protein, 9 aa, Entamoeba invadens
GEKDDQVQQ

SEQ ID NO: 2756011 - protein, 36 aa, Entamoeba invadens
GEKDYKPILDESSSSTEESEEAKEPVNDEENNTGSE

SEQ ID NO: 2756012 - protein, 16 aa, Entamoeba invadens
GEKECNRVTTDSANEQ

SEQ ID NO: 2756013 - protein, 11 aa, Entamoeba invadens
GEKEPRTTYPN

SEQ ID NO: 2756014 - protein, 7 aa, Entamoeba invadens
GEKFTED

SEQ ID NO: 2756015 - protein, 15 aa, Entamoeba invadens
GEKGERQMSHKGSVP

SEQ ID NO: 2756016 - protein, 24 aa, Entamoeba invadens
GEKIDEQNDPNSETPVTEEQKRTV

SEQ ID NO: 2756017 - protein, 6 aa, Entamoeba invadens
GEKIGK

SEQ ID NO: 2756018 - protein, 9 aa, Entamoeba invadens
GEKISESSS

SEQ ID NO: 2756019 - protein, 4 aa, Entamoeba invadens
GEKN

SEQ ID NO: 2756020 - protein, 7 aa, Entamoeba invadens
GEKNERV

SEQ ID NO: 2756021 - protein, 21 aa, Entamoeba invadens
GEKRCQQCDTTCSGNCYTDTG

SEQ ID NO: 2756022 - protein, 15 aa, Entamoeba invadens
GEKRCQQCNTTCNGN

SEQ ID NO: 2756023 - protein, 5 aa, Entamoeba invadens
GEKST

SEQ ID NO: 2756024 - protein, 16 aa, Entamoeba invadens
GEKSTKELPFKSDDPM

SEQ ID NO: 2756025 - protein, 26 aa, Entamoeba invadens
GEKTKENLEKELKSDPKKAHGSSTLE

SEQ ID NO: 2756026 - protein, 6 aa, Entamoeba invadens
GEKVKG

SEQ ID NO: 2756027 - protein, 4 aa, Entamoeba invadens
GEKY

SEQ ID NO: 2756028 - protein, 5 aa, Entamoeba invadens
GEKYK

SEQ ID NO: 2756029 - protein, 9 aa, Entamoeba invadens
GEKYTTSAD

SEQ ID NO: 2756030 - protein, 12 aa, Entamoeba invadens
GELDGSSDTKFT

SEQ ID NO: 2756031 - protein, 10 aa, Entamoeba invadens
GELDTNCDTC

SEQ ID NO: 2756032 - protein, 15 aa, Entamoeba invadens
GELEKKRSKFETCDE

SEQ ID NO: 2756033 - protein, 14 aa, Entamoeba invadens
GELQKQKKVPHKVA

SEQ ID NO: 2756034 - protein, 20 aa, Entamoeba invadens
GELTARISSDVQQIEDGMSS

SEQ ID NO: 2756035 - protein, 5 aa, Entamoeba invadens
GEMGE

SEQ ID NO: 2756036 - protein, 50 aa, Entamoeba invadens
GEMKESVSDLQKRITDKGLTKKDEKSDKSVEKQGEKSDKVESKDESEFLD

SEQ ID NO: 2756037 - protein, 8 aa, Entamoeba invadens
GEMKRTNK

SEQ ID NO: 2756038 - protein, 5 aa, Entamoeba invadens
GEMPS

SEQ ID NO: 2756039 - protein, 28 aa, Entamoeba invadens
GEMTYSTAGSPSCQQCDSKCDGCDATNG

SEQ ID NO: 2756040 - protein, 6 aa, Entamoeba invadens
GEMYPT

SEQ ID NO: 2756041 - protein, 5 aa, Entamoeba invadens
GENAS

SEQ ID NO: 2756042 - protein, 12 aa, Entamoeba invadens
GENCTNCKSNTS

SEQ ID NO: 2756043 - protein, 18 aa, Entamoeba invadens
GENDEKARVAQDASLSLE

SEQ ID NO: 2756044 - protein, 10 aa, Entamoeba invadens
GENDPNGARG

SEQ ID NO: 2756045 - protein, 6 aa, Entamoeba invadens
GENDRI

SEQ ID NO: 2756046 - protein, 4 aa, Entamoeba invadens
GENG

SEQ ID NO: 2756047 - protein, 8 aa, Entamoeba invadens
GENGKNNK

SEQ ID NO: 2756048 - protein, 4 aa, Entamoeba invadens
GENI

SEQ ID NO: 2756049 - protein, 8 aa, Entamoeba invadens
GENNRYQL

SEQ ID NO: 2756050 - protein, 5 aa, Entamoeba invadens
GENNT

SEQ ID NO: 2756051 - protein, 6 aa, Entamoeba invadens
GENSAL

SEQ ID NO: 2756052 - protein, 9 aa, Entamoeba invadens
GENSFEDTG

SEQ ID NO: 2756053 - protein, 14 aa, Entamoeba invadens
GENTNEIPIDKETR

SEQ ID NO: 2756054 - protein, 17 aa, Entamoeba invadens
GENTTTTVSAETTSTDA

SEQ ID NO: 2756055 - protein, 4 aa, Entamoeba invadens
GENV

SEQ ID NO: 2756056 - protein, 11 aa, Entamoeba invadens
GENYENVTTRD

SEQ ID NO: 2756057 - protein, 8 aa, Entamoeba invadens
GENYRQPA

SEQ ID NO: 2756058 - protein, 7 aa, Entamoeba invadens
GEPCDGG

SEQ ID NO: 2756059 - protein, 19 aa, Entamoeba invadens
GEPSDDELSRESQDDEKDP

SEQ ID NO: 2756060 - protein, 8 aa, Entamoeba invadens
GEPSFDET

SEQ ID NO: 2756061 - protein, 7 aa, Entamoeba invadens
GEPTDGY

SEQ ID NO: 2756062 - protein, 9 aa, Entamoeba invadens
GEPYRKNIT

SEQ ID NO: 2756063 - protein, 6 aa, Entamoeba invadens
GEPYSK

SEQ ID NO: 2756064 - protein, 38 aa, Entamoeba invadens
GEQCDGGEGCNDGCQCDTENGYSYQDGKCSKDTSTSEL

SEQ ID NO: 2756065 - protein, 12 aa, Entamoeba invadens
GEQFTDSEGNID

SEQ ID NO: 2756066 - protein, 8 aa, Entamoeba invadens
GEQGEVKL

SEQ ID NO: 2756067 - protein, 8 aa, Entamoeba invadens
GEQHTSSL

SEQ ID NO: 2756068 - protein, 8 aa, Entamoeba invadens
GEQNAPTR

SEQ ID NO: 2756069 - protein, 11 aa, Entamoeba invadens
GEQNDGTNVVT

SEQ ID NO: 2756070 - protein, 6 aa, Entamoeba invadens
GEQNEI

SEQ ID NO: 2756071 - protein, 16 aa, Entamoeba invadens
GEQPESLDDPTPRNSH

SEQ ID NO: 2756072 - protein, 6 aa, Entamoeba invadens
GEQPKD

SEQ ID NO: 2756073 - protein, 4 aa, Entamoeba invadens
GEQQ

SEQ ID NO: 2756074 - protein, 6 aa, Entamoeba invadens
GEQSVR

SEQ ID NO: 2756075 - protein, 5 aa, Entamoeba invadens
GEQTL

SEQ ID NO: 2756076 - protein, 4 aa, Entamoeba invadens
GEQY

SEQ ID NO: 2756077 - protein, 14 aa, Entamoeba invadens
GERCRGGYADGPLD

SEQ ID NO: 2756078 - protein, 14 aa, Entamoeba invadens
GERGAALSGGQKQR

SEQ ID NO: 2756079 - protein, 14 aa, Entamoeba invadens
GERGAQLSGGQKQR

SEQ ID NO: 2756080 - protein, 14 aa, Entamoeba invadens
GERGGQLSGGQKQR

SEQ ID NO: 2756081 - protein, 14 aa, Entamoeba invadens
GERGTSLSGGQKQR

SEQ ID NO: 2756082 - protein, 4 aa, Entamoeba invadens
GERK

SEQ ID NO: 2756083 - protein, 4 aa, Entamoeba invadens
GERL

SEQ ID NO: 2756084 - protein, 8 aa, Entamoeba invadens
GESCQERN

SEQ ID NO: 2756085 - protein, 7 aa, Entamoeba invadens
GESCTKN

SEQ ID NO: 2756086 - protein, 6 aa, Entamoeba invadens
GESDIN

SEQ ID NO: 2756087 - protein, 9 aa, Entamoeba invadens
GESDKGELS

SEQ ID NO: 2756088 - protein, 9 aa, Entamoeba invadens
GESDTSNVS

SEQ ID NO: 2756089 - protein, 13 aa, Entamoeba invadens
GESEFNNQEHEEK

SEQ ID NO: 2756090 - protein, 6 aa, Entamoeba invadens
GESENR

SEQ ID NO: 2756091 - protein, 16 aa, Entamoeba invadens
GESGCDEDCQCSDGYT

SEQ ID NO: 2756092 - protein, 9 aa, Entamoeba invadens
GESGCGKST

SEQ ID NO: 2756093 - protein, 8 aa, Entamoeba invadens
GESKENCV

SEQ ID NO: 2756094 - protein, 5 aa, Entamoeba invadens
GESKN

SEQ ID NO: 2756095 - protein, 5 aa, Entamoeba invadens
GESKS

SEQ ID NO: 2756096 - protein, 9 aa, Entamoeba invadens
GESKYYNNK

SEQ ID NO: 2756097 - protein, 7 aa, Entamoeba invadens
GESPVDS

SEQ ID NO: 2756098 - protein, 8 aa, Entamoeba invadens
GESPYRRA

SEQ ID NO: 2756099 - protein, 10 aa, Entamoeba invadens
GESREVDDQS

SEQ ID NO: 2756100 - protein, 29 aa, Entamoeba invadens
GESRPKECPNGMTDNYKEPNDGSESGTSL

SEQ ID NO: 2756101 - protein, 8 aa, Entamoeba invadens
GESSDELD

SEQ ID NO: 2756102 - protein, 9 aa, Entamoeba invadens
GESYDQAKI

SEQ ID NO: 2756103 - protein, 11 aa, Entamoeba invadens
GETAANSGYGK

SEQ ID NO: 2756104 - protein, 5 aa, Entamoeba invadens
GETAF

SEQ ID NO: 2756105 - protein, 10 aa, Entamoeba invadens
GETDKTSGLP

SEQ ID NO: 2756106 - protein, 6 aa, Entamoeba invadens
GETDRD

SEQ ID NO: 2756107 - protein, 7 aa, Entamoeba invadens
GETEDSA

SEQ ID NO: 2756108 - protein, 6 aa, Entamoeba invadens
GETGPL

SEQ ID NO: 2756109 - protein, 7 aa, Entamoeba invadens
GETISCD

SEQ ID NO: 2756110 - protein, 6 aa, Entamoeba invadens
GETNCT

SEQ ID NO: 2756111 - protein, 7 aa, Entamoeba invadens
GETPYSS

SEQ ID NO: 2756112 - protein, 4 aa, Entamoeba invadens
GETS

SEQ ID NO: 2756113 - protein, 7 aa, Entamoeba invadens
GETSRDV

SEQ ID NO: 2756114 - protein, 6 aa, Entamoeba invadens
GETTCS

SEQ ID NO: 2756115 - protein, 5 aa, Entamoeba invadens
GETTT

SEQ ID NO: 2756116 - protein, 5 aa, Entamoeba invadens
GETVP

SEQ ID NO: 2756117 - protein, 13 aa, Entamoeba invadens
GEVEDVSTQCNLT

SEQ ID NO: 2756118 - protein, 6 aa, Entamoeba invadens
GEVKTE

SEQ ID NO: 2756119 - protein, 12 aa, Entamoeba invadens
GEVKTGTKSCTK

SEQ ID NO: 2756120 - protein, 6 aa, Entamoeba invadens
GEVLSN

SEQ ID NO: 2756121 - protein, 4 aa, Entamoeba invadens
GEVS

SEQ ID NO: 2756122 - protein, 9 aa, Entamoeba invadens
GEVTKEGRK

SEQ ID NO: 2756123 - protein, 10 aa, Entamoeba invadens
GEVTSTLSPV

SEQ ID NO: 2756124 - protein, 7 aa, Entamoeba invadens
GEVYTEE

SEQ ID NO: 2756125 - protein, 5 aa, Entamoeba invadens
GEYIS

SEQ ID NO: 2756126 - protein, 10 aa, Entamoeba invadens
GEYITNPETL

SEQ ID NO: 2756127 - protein, 6 aa, Entamoeba invadens
GEYNGE

SEQ ID NO: 2756128 - protein, 4 aa, Entamoeba invadens
GEYP

SEQ ID NO: 2756129 - protein, 21 aa, Entamoeba invadens
GEYPLSSSIASEDAKPNNRGR

SEQ ID NO: 2756130 - protein, 21 aa, Entamoeba invadens
GEYPLSSTITAESSTKSTRGK

SEQ ID NO: 2756131 - protein, 5 aa, Entamoeba invadens
GFAQE

SEQ ID NO: 2756132 - protein, 4 aa, Entamoeba invadens
GFDN

SEQ ID NO: 2756133 - protein, 5 aa, Entamoeba invadens
GFDSG

SEQ ID NO: 2756134 - protein, 9 aa, Entamoeba invadens
GFDSVDDEG

SEQ ID NO: 2756135 - protein, 4 aa, Entamoeba invadens
GFDT

SEQ ID NO: 2756136 - protein, 5 aa, Entamoeba invadens
GFDVK

SEQ ID NO: 2756137 - protein, 16 aa, Entamoeba invadens
GFEADSTGCYTPTDNQ

SEQ ID NO: 2756138 - protein, 4 aa, Entamoeba invadens
GFEG

SEQ ID NO: 2756139 - protein, 10 aa, Entamoeba invadens
GFEGESNQYT

SEQ ID NO: 2756140 - protein, 10 aa, Entamoeba invadens
GFENQAEDMT

SEQ ID NO: 2756141 - protein, 13 aa, Entamoeba invadens
GFEPTSEKKCKAK

SEQ ID NO: 2756142 - protein, 8 aa, Entamoeba invadens
GFEPTSER

SEQ ID NO: 2756143 - protein, 4 aa, Entamoeba invadens
GFES

SEQ ID NO: 2756144 - protein, 6 aa, Entamoeba invadens
GFESDT

SEQ ID NO: 2756145 - protein, 10 aa, Entamoeba invadens
GFETAEPKRK

SEQ ID NO: 2756146 - protein, 10 aa, Entamoeba invadens
GFGKDDSLGG

SEQ ID NO: 2756147 - protein, 10 aa, Entamoeba invadens
GFGKPERTHH

SEQ ID NO: 2756148 - protein, 4 aa, Entamoeba invadens
GFGS

SEQ ID NO: 2756149 - protein, 11 aa, Entamoeba invadens
GFGSSNSKNLK

SEQ ID NO: 2756150 - protein, 6 aa, Entamoeba invadens
GFGTDP

SEQ ID NO: 2756151 - protein, 12 aa, Entamoeba invadens
GFGTEEADNYVK

SEQ ID NO: 2756152 - protein, 7 aa, Entamoeba invadens
GFGTRST

SEQ ID NO: 2756153 - protein, 5 aa, Entamoeba invadens
GFGYG

SEQ ID NO: 2756154 - protein, 8 aa, Entamoeba invadens
GFKDNTQI

SEQ ID NO: 2756155 - protein, 8 aa, Entamoeba invadens
GFKGNTKI

SEQ ID NO: 2756156 - protein, 18 aa, Entamoeba invadens
GFKGNTKITSVKYTPKGE

SEQ ID NO: 2756157 - protein, 16 aa, Entamoeba invadens
GFKPTCASDGKTRANL

SEQ ID NO: 2756158 - protein, 5 aa, Entamoeba invadens
GFNDE

SEQ ID NO: 2756159 - protein, 7 aa, Entamoeba invadens
GFNGRDN

SEQ ID NO: 2756160 - protein, 11 aa, Entamoeba invadens
GFNGTFKTDKT

SEQ ID NO: 2756161 - protein, 7 aa, Entamoeba invadens
GFNNQKY

SEQ ID NO: 2756162 - protein, 4 aa, Entamoeba invadens
GFNP

SEQ ID NO: 2756163 - protein, 5 aa, Entamoeba invadens
GFPER

SEQ ID NO: 2756164 - protein, 7 aa, Entamoeba invadens
GFPQSPD

SEQ ID NO: 2756165 - protein, 6 aa, Entamoeba invadens
GFPSTG

SEQ ID NO: 2756166 - protein, 7 aa, Entamoeba invadens
GFPTQSY

SEQ ID NO: 2756167 - protein, 22 aa, Entamoeba invadens
GFPVPPKTYVSKKKEEAVTPET

SEQ ID NO: 2756168 - protein, 5 aa, Entamoeba invadens
GFQGD

SEQ ID NO: 2756169 - protein, 8 aa, Entamoeba invadens
GFRDGESS

SEQ ID NO: 2756170 - protein, 11 aa, Entamoeba invadens
GFRTTRKNIQK

SEQ ID NO: 2756171 - protein, 15 aa, Entamoeba invadens
GFSEETKNAINHPNS

SEQ ID NO: 2756172 - protein, 5 aa, Entamoeba invadens
GFSNE

SEQ ID NO: 2756173 - protein, 12 aa, Entamoeba invadens
GFSQDASSPNNC

SEQ ID NO: 2756174 - protein, 37 aa, Entamoeba invadens
GFSRESKEKLKEGSMSPISQPVSPRSVKSSCSEELPE

SEQ ID NO: 2756175 - protein, 8 aa, Entamoeba invadens
GFSSNGNF

SEQ ID NO: 2756176 - protein, 22 aa, Entamoeba invadens
GFSTNAKRRVRDKGKNAEEFSG

SEQ ID NO: 2756177 - protein, 7 aa, Entamoeba invadens
GFSTTKK

SEQ ID NO: 2756178 - protein, 7 aa, Entamoeba invadens
GFTENGE

SEQ ID NO: 2756179 - protein, 16 aa, Entamoeba invadens
GFTQTTENKCVKDEKC

SEQ ID NO: 2756180 - protein, 5 aa, Entamoeba invadens
GFVPQ

SEQ ID NO: 2756181 - protein, 10 aa, Entamoeba invadens
GFYPNKSGTC

SEQ ID NO: 2756182 - protein, 5 aa, Entamoeba invadens
GFYPS

SEQ ID NO: 2756183 - protein, 4 aa, Entamoeba invadens
GFYS

SEQ ID NO: 2756184 - protein, 9 aa, Entamoeba invadens
GFYSAEKTC

SEQ ID NO: 2756185 - protein, 6 aa, Entamoeba invadens
GFYTNG

SEQ ID NO: 2756186 - protein, 26 aa, Entamoeba invadens
GGAAQLLDPKTKKSRIPRQKEYYKED

SEQ ID NO: 2756187 - protein, 5 aa, Entamoeba invadens
GGADK

SEQ ID NO: 2756188 - protein, 6 aa, Entamoeba invadens
GGAEPL

SEQ ID NO: 2756189 - protein, 27 aa, Entamoeba invadens
GGAQRSVPTYRNYQNQRAEQAMENSEE

SEQ ID NO: 2756190 - protein, 6 aa, Entamoeba invadens
GGATTG

SEQ ID NO: 2756191 - protein, 6 aa, Entamoeba invadens
GGCATC

SEQ ID NO: 2756192 - protein, 6 aa, Entamoeba invadens
GGCEES

SEQ ID NO: 2756193 - protein, 6 aa, Entamoeba invadens
GGCEKS

SEQ ID NO: 2756194 - protein, 7 aa, Entamoeba invadens
GGCISND

SEQ ID NO: 2756195 - protein, 10 aa, Entamoeba invadens
GGCNGPERTN

SEQ ID NO: 2756196 - protein, 8 aa, Entamoeba invadens
GGCNNSTG

SEQ ID NO: 2756197 - protein, 6 aa, Entamoeba invadens
GGCTKC

SEQ ID NO: 2756198 - protein, 15 aa, Entamoeba invadens
GGDAPTPRSQQENSL

SEQ ID NO: 2756199 - protein, 7 aa, Entamoeba invadens
GGDDDSC

SEQ ID NO: 2756200 - protein, 9 aa, Entamoeba invadens
GGDGCRENC

SEQ ID NO: 2756201 - protein, 19 aa, Entamoeba invadens
GGDGYTKRFAKESASTIGS

SEQ ID NO: 2756202 - protein, 5 aa, Entamoeba invadens
GGDKR

SEQ ID NO: 2756203 - protein, 10 aa, Entamoeba invadens
GGDNSTFVSH

SEQ ID NO: 2756204 - protein, 7 aa, Entamoeba invadens
GGDSSQF

SEQ ID NO: 2756205 - protein, 6 aa, Entamoeba invadens
GGDSTV

SEQ ID NO: 2756206 - protein, 5 aa, Entamoeba invadens
GGDTS

SEQ ID NO: 2756207 - protein, 8 aa, Entamoeba invadens
GGDTVKTF

SEQ ID NO: 2756208 - protein, 5 aa, Entamoeba invadens
GGDVN

SEQ ID NO: 2756209 - protein, 9 aa, Entamoeba invadens
GGDVPPETL

SEQ ID NO: 2756210 - protein, 8 aa, Entamoeba invadens
GGDVSNTF

SEQ ID NO: 2756211 - protein, 18 aa, Entamoeba invadens
GGECRQCDNNCNNCSTIE

SEQ ID NO: 2756212 - protein, 4 aa, Entamoeba invadens
GGEI

SEQ ID NO: 2756213 - protein, 8 aa, Entamoeba invadens
GGEKARFG

SEQ ID NO: 2756214 - protein, 17 aa, Entamoeba invadens
GGEKQCDKCDEGYFPSG

SEQ ID NO: 2756215 - protein, 20 aa, Entamoeba invadens
GGELPKGKKLETLKQQSEFS

SEQ ID NO: 2756216 - protein, 8 aa, Entamoeba invadens
GGEPVGPF

SEQ ID NO: 2756217 - protein, 4 aa, Entamoeba invadens
GGEQ

SEQ ID NO: 2756218 - protein, 4 aa, Entamoeba invadens
GGES

SEQ ID NO: 2756219 - protein, 13 aa, Entamoeba invadens
GGESSNAEDQRAS

SEQ ID NO: 2756220 - protein, 5 aa, Entamoeba invadens
GGEWG

SEQ ID NO: 2756221 - protein, 5 aa, Entamoeba invadens
GGFAR

SEQ ID NO: 2756222 - protein, 9 aa, Entamoeba invadens
GGGDGSLSN

SEQ ID NO: 2756223 - protein, 12 aa, Entamoeba invadens
GGGGGSCHSGVK

SEQ ID NO: 2756224 - protein, 12 aa, Entamoeba invadens
GGGGTSCEKCSS

SEQ ID NO: 2756225 - protein, 6 aa, Entamoeba invadens
GGGIRD

SEQ ID NO: 2756226 - protein, 11 aa, Entamoeba invadens
GGGKTPYSRAN

SEQ ID NO: 2756227 - protein, 5 aa, Entamoeba invadens
GGGLG

SEQ ID NO: 2756228 - protein, 5 aa, Entamoeba invadens
GGGMG

SEQ ID NO: 2756229 - protein, 14 aa, Entamoeba invadens
GGGQYQPSSGSSKC

SEQ ID NO: 2756230 - protein, 7 aa, Entamoeba invadens
GGGVGGK

SEQ ID NO: 2756231 - protein, 4 aa, Entamoeba invadens
GGGY

SEQ ID NO: 2756232 - protein, 7 aa, Entamoeba invadens
GGGYADL

SEQ ID NO: 2756233 - protein, 10 aa, Entamoeba invadens
GGGYGDLESN

SEQ ID NO: 2756234 - protein, 5 aa, Entamoeba invadens
GGGYV

SEQ ID NO: 2756235 - protein, 11 aa, Entamoeba invadens
GGHFNTTTQQC

SEQ ID NO: 2756236 - protein, 13 aa, Entamoeba invadens
GGHLGWEEKGKGI

SEQ ID NO: 2756237 - protein, 12 aa, Entamoeba invadens
GGHSNKKALDDL

SEQ ID NO: 2756238 - protein, 9 aa, Entamoeba invadens
GGIENTNST

SEQ ID NO: 2756239 - protein, 4 aa, Entamoeba invadens
GGIV

SEQ ID NO: 2756240 - protein, 4 aa, Entamoeba invadens
GGKC

SEQ ID NO: 2756241 - protein, 10 aa, Entamoeba invadens
GGKCDGETGY

SEQ ID NO: 2756242 - protein, 11 aa, Entamoeba invadens
GGKCDPTNGRC

SEQ ID NO: 2756243 - protein, 14 aa, Entamoeba invadens
GGKCDTTNGHCTGC

SEQ ID NO: 2756244 - protein, 9 aa, Entamoeba invadens
GGKGKYETS

SEQ ID NO: 2756245 - protein, 6 aa, Entamoeba invadens
GGKLPE

SEQ ID NO: 2756246 - protein, 15 aa, Entamoeba invadens
GGKLSESEVSERENL

SEQ ID NO: 2756247 - protein, 5 aa, Entamoeba invadens
GGKMD

SEQ ID NO: 2756248 - protein, 8 aa, Entamoeba invadens
GGKRVKDE

SEQ ID NO: 2756249 - protein, 8 aa, Entamoeba invadens
GGKSATTI

SEQ ID NO: 2756250 - protein, 5 aa, Entamoeba invadens
GGKTI

SEQ ID NO: 2756251 - protein, 7 aa, Entamoeba invadens
GGKTTDW

SEQ ID NO: 2756252 - protein, 8 aa, Entamoeba invadens
GGKYNKIE

SEQ ID NO: 2756253 - protein, 4 aa, Entamoeba invadens
GGLD

SEQ ID NO: 2756254 - protein, 14 aa, Entamoeba invadens
GGLHEIESKGSFGK

SEQ ID NO: 2756255 - protein, 9 aa, Entamoeba invadens
GGLKDEKPI

SEQ ID NO: 2756256 - protein, 13 aa, Entamoeba invadens
GGLKTGSTLKGSQ

SEQ ID NO: 2756257 - protein, 27 aa, Entamoeba invadens
GGLRDKTAEETNTKEDIDTQQKEQINV

SEQ ID NO: 2756258 - protein, 8 aa, Entamoeba invadens
GGLSEQST

SEQ ID NO: 2756259 - protein, 5 aa, Entamoeba invadens
GGLTM

SEQ ID NO: 2756260 - protein, 12 aa, Entamoeba invadens
GGLTPDAKTQLR

SEQ ID NO: 2756261 - protein, 14 aa, Entamoeba invadens
GGLTPTEKNENLPG

SEQ ID NO: 2756262 - protein, 7 aa, Entamoeba invadens
GGMKGPS

SEQ ID NO: 2756263 - protein, 9 aa, Entamoeba invadens
GGNCDGTTG

SEQ ID NO: 2756264 - protein, 8 aa, Entamoeba invadens
GGNDTGEV

SEQ ID NO: 2756265 - protein, 10 aa, Entamoeba invadens
GGNKDGISPG

SEQ ID NO: 2756266 - protein, 14 aa, Entamoeba invadens
GGNLYDESDCNHDS

SEQ ID NO: 2756267 - protein, 7 aa, Entamoeba invadens
GGNTEIP

SEQ ID NO: 2756268 - protein, 8 aa, Entamoeba invadens
GGNTNIPD

SEQ ID NO: 2756269 - protein, 7 aa, Entamoeba invadens
GGNTNPE

SEQ ID NO: 2756270 - protein, 4 aa, Entamoeba invadens
GGPC

SEQ ID NO: 2756271 - protein, 6 aa, Entamoeba invadens
GGPFEG

SEQ ID NO: 2756272 - protein, 6 aa, Entamoeba invadens
GGPFGY

SEQ ID NO: 2756273 - protein, 8 aa, Entamoeba invadens
GGPIGTDT

SEQ ID NO: 2756274 - protein, 7 aa, Entamoeba invadens
GGQCDGQ

SEQ ID NO: 2756275 - protein, 6 aa, Entamoeba invadens
GGQCNT

SEQ ID NO: 2756276 - protein, 5 aa, Entamoeba invadens
GGQLV

SEQ ID NO: 2756277 - protein, 14 aa, Entamoeba invadens
GGQNLRDSKPETQY

SEQ ID NO: 2756278 - protein, 9 aa, Entamoeba invadens
GGQPRNEKD

SEQ ID NO: 2756279 - protein, 10 aa, Entamoeba invadens
GGQTRQEKEL

SEQ ID NO: 2756280 - protein, 6 aa, Entamoeba invadens
GGRCES

SEQ ID NO: 2756281 - protein, 7 aa, Entamoeba invadens
GGRDVEV

SEQ ID NO: 2756282 - protein, 10 aa, Entamoeba invadens
GGRGIYPENT

SEQ ID NO: 2756283 - protein, 10 aa, Entamoeba invadens
GGRGLRPENT

SEQ ID NO: 2756284 - protein, 8 aa, Entamoeba invadens
GGRKDPNN

SEQ ID NO: 2756285 - protein, 5 aa, Entamoeba invadens
GGRKV

SEQ ID NO: 2756286 - protein, 9 aa, Entamoeba invadens
GGSCDTNTG

SEQ ID NO: 2756287 - protein, 8 aa, Entamoeba invadens
GGSEPLNI

SEQ ID NO: 2756288 - protein, 9 aa, Entamoeba invadens
GGSGAGKST

SEQ ID NO: 2756289 - protein, 10 aa, Entamoeba invadens
GGSGGMPSYE

SEQ ID NO: 2756290 - protein, 6 aa, Entamoeba invadens
GGSGQC

SEQ ID NO: 2756291 - protein, 7 aa, Entamoeba invadens
GGSIKID

SEQ ID NO: 2756292 - protein, 12 aa, Entamoeba invadens
GGSIKIDNTKID

SEQ ID NO: 2756293 - protein, 6 aa, Entamoeba invadens
GGSLAI

SEQ ID NO: 2756294 - protein, 11 aa, Entamoeba invadens
GGSLSSKNKLT

SEQ ID NO: 2756295 - protein, 7 aa, Entamoeba invadens
GGSNNAC

SEQ ID NO: 2756296 - protein, 21 aa, Entamoeba invadens
GGSNTECNTCKTGYYSQGTNT

SEQ ID NO: 2756297 - protein, 6 aa, Entamoeba invadens
GGSNVT

SEQ ID NO: 2756298 - protein, 7 aa, Entamoeba invadens
GGSPNKR

SEQ ID NO: 2756299 - protein, 7 aa, Entamoeba invadens
GGSRESY

SEQ ID NO: 2756300 - protein, 6 aa, Entamoeba invadens
GGSRFG

SEQ ID NO: 2756301 - protein, 6 aa, Entamoeba invadens
GGSSSY

SEQ ID NO: 2756302 - protein, 7 aa, Entamoeba invadens
GGSTEGW

SEQ ID NO: 2756303 - protein, 25 aa, Entamoeba invadens
GGSTPSFIDSENKKVCNTVNKPGSV

SEQ ID NO: 2756304 - protein, 4 aa, Entamoeba invadens
GGTA

SEQ ID NO: 2756305 - protein, 10 aa, Entamoeba invadens
GGTASCSKCP

SEQ ID NO: 2756306 - protein, 6 aa, Entamoeba invadens
GGTDTN

SEQ ID NO: 2756307 - protein, 4 aa, Entamoeba invadens
GGTE

SEQ ID NO: 2756308 - protein, 18 aa, Entamoeba invadens
GGTFSNSATSSSCSSCSA

SEQ ID NO: 2756309 - protein, 9 aa, Entamoeba invadens
GGTGTGLST

SEQ ID NO: 2756310 - protein, 4 aa, Entamoeba invadens
GGTI

SEQ ID NO: 2756311 - protein, 5 aa, Entamoeba invadens
GGTIA

SEQ ID NO: 2756312 - protein, 5 aa, Entamoeba invadens
GGTIS

SEQ ID NO: 2756313 - protein, 4 aa, Entamoeba invadens
GGTL

SEQ ID NO: 2756314 - protein, 7 aa, Entamoeba invadens
GGTPTIT

SEQ ID NO: 2756315 - protein, 8 aa, Entamoeba invadens
GGTRLGDE

SEQ ID NO: 2756316 - protein, 5 aa, Entamoeba invadens
GGTTE

SEQ ID NO: 2756317 - protein, 7 aa, Entamoeba invadens
GGTTEIK

SEQ ID NO: 2756318 - protein, 10 aa, Entamoeba invadens
GGTTKIPKDT

SEQ ID NO: 2756319 - protein, 11 aa, Entamoeba invadens
GGTYNGNTGNS

SEQ ID NO: 2756320 - protein, 10 aa, Entamoeba invadens
GGVCDTTNGT

SEQ ID NO: 2756321 - protein, 5 aa, Entamoeba invadens
GGVCS

SEQ ID NO: 2756322 - protein, 6 aa, Entamoeba invadens
GGVDNV

SEQ ID NO: 2756323 - protein, 7 aa, Entamoeba invadens
GGVDTAD

SEQ ID NO: 2756324 - protein, 6 aa, Entamoeba invadens
GGVRNC

SEQ ID NO: 2756325 - protein, 4 aa, Entamoeba invadens
GGVT

SEQ ID NO: 2756326 - protein, 5 aa, Entamoeba invadens
GGYPL

SEQ ID NO: 2756327 - protein, 5 aa, Entamoeba invadens
GGYSG

SEQ ID NO: 2756328 - protein, 9 aa, Entamoeba invadens
GGYSKYVQS

SEQ ID NO: 2756329 - protein, 10 aa, Entamoeba invadens
GGYSKYVQSP

SEQ ID NO: 2756330 - protein, 9 aa, Entamoeba invadens
GGYSYDQQG

SEQ ID NO: 2756331 - protein, 14 aa, Entamoeba invadens
GGYTITNPSLLPKK

SEQ ID NO: 2756332 - protein, 23 aa, Entamoeba invadens
GGYTKTSKGMCTTSTQCNSTSNE

SEQ ID NO: 2756333 - protein, 10 aa, Entamoeba invadens
GHAHEENTHG

SEQ ID NO: 2756334 - protein, 5 aa, Entamoeba invadens
GHCQN

SEQ ID NO: 2756335 - protein, 4 aa, Entamoeba invadens
GHFP

SEQ ID NO: 2756336 - protein, 42 aa, Entamoeba invadens
GHFTSSEGSTSCNACATGTHASTEGSSTCENCESGQYTNVTG

SEQ ID NO: 2756337 - protein, 15 aa, Entamoeba invadens
GHGKSSGLPNTAKTY

SEQ ID NO: 2756338 - protein, 15 aa, Entamoeba invadens
GHGQSSGIEGAPRTY

SEQ ID NO: 2756339 - protein, 4 aa, Entamoeba invadens
GHGS

SEQ ID NO: 2756340 - protein, 12 aa, Entamoeba invadens
GHITTDSNCSDC

SEQ ID NO: 2756341 - protein, 4 aa, Entamoeba invadens
GHKI

SEQ ID NO: 2756342 - protein, 5 aa, Entamoeba invadens
GHPQK

SEQ ID NO: 2756343 - protein, 4 aa, Entamoeba invadens
GHRV

SEQ ID NO: 2756344 - protein, 23 aa, Entamoeba invadens
GHSHGEKHSHSEKKSKKAEEKEM

SEQ ID NO: 2756345 - protein, 17 aa, Entamoeba invadens
GHSTEDSESSESATKAK

SEQ ID NO: 2756346 - protein, 7 aa, Entamoeba invadens
GHSTSVK

SEQ ID NO: 2756347 - protein, 5 aa, Entamoeba invadens
GHTHN

SEQ ID NO: 2756348 - protein, 10 aa, Entamoeba invadens
GHTNSSQKRN

SEQ ID NO: 2756349 - protein, 6 aa, Entamoeba invadens
GHTTLP

SEQ ID NO: 2756350 - protein, 7 aa, Entamoeba invadens
GHYNNQN

SEQ ID NO: 2756351 - protein, 10 aa, Entamoeba invadens
GHYQNKEGQN

SEQ ID NO: 2756352 - protein, 7 aa, Entamoeba invadens
GHYRDET

SEQ ID NO: 2756353 - protein, 5 aa, Entamoeba invadens
GIAEI

SEQ ID NO: 2756354 - protein, 9 aa, Entamoeba invadens
GIAESTTKV

SEQ ID NO: 2756355 - protein, 9 aa, Entamoeba invadens
GIASETISN

SEQ ID NO: 2756356 - protein, 18 aa, Entamoeba invadens
GIASLGESSFEGSSISSI

SEQ ID NO: 2756357 - protein, 9 aa, Entamoeba invadens
GIASSEEDI

SEQ ID NO: 2756358 - protein, 8 aa, Entamoeba invadens
GIDDAKEK

SEQ ID NO: 2756359 - protein, 16 aa, Entamoeba invadens
GIDEDAERELTKAANS

SEQ ID NO: 2756360 - protein, 9 aa, Entamoeba invadens
GIDGGQSLE

SEQ ID NO: 2756361 - protein, 8 aa, Entamoeba invadens
GIDKSKDV

SEQ ID NO: 2756362 - protein, 7 aa, Entamoeba invadens
GIDTSDM

SEQ ID NO: 2756363 - protein, 8 aa, Entamoeba invadens
GIDTSSLR

SEQ ID NO: 2756364 - protein, 6 aa, Entamoeba invadens
GIEEPG

SEQ ID NO: 2756365 - protein, 11 aa, Entamoeba invadens
GIEGIEKGSTS

SEQ ID NO: 2756366 - protein, 11 aa, Entamoeba invadens
GIEKKQLQDQL

SEQ ID NO: 2756367 - protein, 5 aa, Entamoeba invadens
GIEPY

SEQ ID NO: 2756368 - protein, 5 aa, Entamoeba invadens
GIGSP

SEQ ID NO: 2756369 - protein, 8 aa, Entamoeba invadens
GIGTPAYM

SEQ ID NO: 2756370 - protein, 12 aa, Entamoeba invadens
GIGTPKYMAPEN

SEQ ID NO: 2756371 - protein, 7 aa, Entamoeba invadens
GIGTPNY

SEQ ID NO: 2756372 - protein, 8 aa, Entamoeba invadens
GIGTPTYM

SEQ ID NO: 2756373 - protein, 6 aa, Entamoeba invadens
GIGTPV

SEQ ID NO: 2756374 - protein, 7 aa, Entamoeba invadens
GIGTPVS

SEQ ID NO: 2756375 - protein, 4 aa, Entamoeba invadens
GIGV

SEQ ID NO: 2756376 - protein, 6 aa, Entamoeba invadens
GIKDET

SEQ ID NO: 2756377 - protein, 9 aa, Entamoeba invadens
GIKEEGEEC

SEQ ID NO: 2756378 - protein, 5 aa, Entamoeba invadens
GIKET

SEQ ID NO: 2756379 - protein, 5 aa, Entamoeba invadens
GIKNN

SEQ ID NO: 2756380 - protein, 15 aa, Entamoeba invadens
GIKQAKSSFEGERTN

SEQ ID NO: 2756381 - protein, 6 aa, Entamoeba invadens
GIKRKH

SEQ ID NO: 2756382 - protein, 6 aa, Entamoeba invadens
GIKTGT

SEQ ID NO: 2756383 - protein, 10 aa, Entamoeba invadens
GINENNKQGD

SEQ ID NO: 2756384 - protein, 5 aa, Entamoeba invadens
GINPD

SEQ ID NO: 2756385 - protein, 4 aa, Entamoeba invadens
GINQ

SEQ ID NO: 2756386 - protein, 6 aa, Entamoeba invadens
GINREF

SEQ ID NO: 2756387 - protein, 9 aa, Entamoeba invadens
GIPGDAESY

SEQ ID NO: 2756388 - protein, 6 aa, Entamoeba invadens
GIPPLN

SEQ ID NO: 2756389 - protein, 6 aa, Entamoeba invadens
GIPSEN

SEQ ID NO: 2756390 - protein, 4 aa, Entamoeba invadens
GIPT

SEQ ID NO: 2756391 - protein, 11 aa, Entamoeba invadens
GIPTESTSSQL

SEQ ID NO: 2756392 - protein, 5 aa, Entamoeba invadens
GIPVN

SEQ ID NO: 2756393 - protein, 5 aa, Entamoeba invadens
GIPYT

SEQ ID NO: 2756394 - protein, 5 aa, Entamoeba invadens
GIQDE

SEQ ID NO: 2756395 - protein, 6 aa, Entamoeba invadens
GIQNEK

SEQ ID NO: 2756396 - protein, 7 aa, Entamoeba invadens
GIRQTDN

SEQ ID NO: 2756397 - protein, 8 aa, Entamoeba invadens
GISDSGID

SEQ ID NO: 2756398 - protein, 15 aa, Entamoeba invadens
GISREFTASTDFDKK

SEQ ID NO: 2756399 - protein, 14 aa, Entamoeba invadens
GISSEEYYGQSPQI

SEQ ID NO: 2756400 - protein, 17 aa, Entamoeba invadens
GISTGQDMSAAHTADYS

SEQ ID NO: 2756401 - protein, 6 aa, Entamoeba invadens
GISVDN

SEQ ID NO: 2756402 - protein, 7 aa, Entamoeba invadens
GITAQSS

SEQ ID NO: 2756403 - protein, 4 aa, Entamoeba invadens
GITI

SEQ ID NO: 2756404 - protein, 5 aa, Entamoeba invadens
GITNN

SEQ ID NO: 2756405 - protein, 10 aa, Entamoeba invadens
GITPNKYSDE

SEQ ID NO: 2756406 - protein, 5 aa, Entamoeba invadens
GITPP

SEQ ID NO: 2756407 - protein, 9 aa, Entamoeba invadens
GITPSKKIT

SEQ ID NO: 2756408 - protein, 7 aa, Entamoeba invadens
GITRKTA

SEQ ID NO: 2756409 - protein, 7 aa, Entamoeba invadens
GITSQGN

SEQ ID NO: 2756410 - protein, 11 aa, Entamoeba invadens
GITSSYCSTTE

SEQ ID NO: 2756411 - protein, 7 aa, Entamoeba invadens
GITTNGS

SEQ ID NO: 2756412 - protein, 9 aa, Entamoeba invadens
GITTSTTSS

SEQ ID NO: 2756413 - protein, 5 aa, Entamoeba invadens
GIVEP

SEQ ID NO: 2756414 - protein, 5 aa, Entamoeba invadens
GIVSN

SEQ ID NO: 2756415 - protein, 4 aa, Entamoeba invadens
GIYS

SEQ ID NO: 2756416 - protein, 8 aa, Entamoeba invadens
GKAAPQEF

SEQ ID NO: 2756417 - protein, 9 aa, Entamoeba invadens
GKADNTGDC

SEQ ID NO: 2756418 - protein, 9 aa, Entamoeba invadens
GKAEETLEA

SEQ ID NO: 2756419 - protein, 5 aa, Entamoeba invadens
GKAEI

SEQ ID NO: 2756420 - protein, 4 aa, Entamoeba invadens
GKAI

SEQ ID NO: 2756421 - protein, 8 aa, Entamoeba invadens
GKAIEDTA

SEQ ID NO: 2756422 - protein, 9 aa, Entamoeba invadens
GKAKKSARA

SEQ ID NO: 2756423 - protein, 5 aa, Entamoeba invadens
GKALE

SEQ ID NO: 2756424 - protein, 8 aa, Entamoeba invadens
GKAQGAAK

SEQ ID NO: 2756425 - protein, 8 aa, Entamoeba invadens
GKCAEKFE

SEQ ID NO: 2756426 - protein, 9 aa, Entamoeba invadens
GKCASKTEN

SEQ ID NO: 2756427 - protein, 4 aa, Entamoeba invadens
GKCD

SEQ ID NO: 2756428 - protein, 6 aa, Entamoeba invadens
GKCDAG

SEQ ID NO: 2756429 - protein, 13 aa, Entamoeba invadens
GKCDPTDGHCTGC

SEQ ID NO: 2756430 - protein, 10 aa, Entamoeba invadens
GKCDPTNGNC

SEQ ID NO: 2756431 - protein, 7 aa, Entamoeba invadens
GKCDQHN

SEQ ID NO: 2756432 - protein, 9 aa, Entamoeba invadens
GKCDSDAGK

SEQ ID NO: 2756433 - protein, 13 aa, Entamoeba invadens
GKCDSTDGHCTGC

SEQ ID NO: 2756434 - protein, 13 aa, Entamoeba invadens
GKCDTTNGHCTGC

SEQ ID NO: 2756435 - protein, 14 aa, Entamoeba invadens
GKCEEVDNTIKDHT

SEQ ID NO: 2756436 - protein, 9 aa, Entamoeba invadens
GKCEPQQNC

SEQ ID NO: 2756437 - protein, 8 aa, Entamoeba invadens
GKCEQDEK

SEQ ID NO: 2756438 - protein, 9 aa, Entamoeba invadens
GKCESCSTR

SEQ ID NO: 2756439 - protein, 18 aa, Entamoeba invadens
GKCETGMKVTETKKCETV

SEQ ID NO: 2756440 - protein, 12 aa, Entamoeba invadens
GKCETYDNTNTK

SEQ ID NO: 2756441 - protein, 8 aa, Entamoeba invadens
GKCGDSVA

SEQ ID NO: 2756442 - protein, 7 aa, Entamoeba invadens
GKCGTSV

SEQ ID NO: 2756443 - protein, 15 aa, Entamoeba invadens
GKCKETDSNSYSKSN

SEQ ID NO: 2756444 - protein, 19 aa, Entamoeba invadens
GKCKPCDSSCGGSCDTTNG

SEQ ID NO: 2756445 - protein, 11 aa, Entamoeba invadens
GKCKSATECTE

SEQ ID NO: 2756446 - protein, 30 aa, Entamoeba invadens
GKCKSATECTECTTDNLQPDKTCKKDCPEA

SEQ ID NO: 2756447 - protein, 21 aa, Entamoeba invadens
GKCKSTQNCNSPSSLSPASCD

SEQ ID NO: 2756448 - protein, 6 aa, Entamoeba invadens
GKCNGA

SEQ ID NO: 2756449 - protein, 10 aa, Entamoeba invadens
GKCNNGGSPF

SEQ ID NO: 2756450 - protein, 7 aa, Entamoeba invadens
GKCNNGL

SEQ ID NO: 2756451 - protein, 8 aa, Entamoeba invadens
GKCPKIEN

SEQ ID NO: 2756452 - protein, 4 aa, Entamoeba invadens
GKCQ

SEQ ID NO: 2756453 - protein, 21 aa, Entamoeba invadens
GKCQSGTECPNGYSKDTTGKK

SEQ ID NO: 2756454 - protein, 28 aa, Entamoeba invadens
GKCQSGTECPNGYSKDTTGKKCIKCIHF

SEQ ID NO: 2756455 - protein, 6 aa, Entamoeba invadens
GKCSEC

SEQ ID NO: 2756456 - protein, 21 aa, Entamoeba invadens
GKCSGCKTTNCENCEGGKCKR

SEQ ID NO: 2756457 - protein, 7 aa, Entamoeba invadens
GKCSGCS

SEQ ID NO: 2756458 - protein, 6 aa, Entamoeba invadens
GKCSLS

SEQ ID NO: 2756459 - protein, 8 aa, Entamoeba invadens
GKCSPQES

SEQ ID NO: 2756460 - protein, 9 aa, Entamoeba invadens
GKCSQTANE

SEQ ID NO: 2756461 - protein, 9 aa, Entamoeba invadens
GKCSSREKK

SEQ ID NO: 2756462 - protein, 16 aa, Entamoeba invadens
GKCTSKGELNCENSNQ

SEQ ID NO: 2756463 - protein, 8 aa, Entamoeba invadens
GKCTSKNQ

SEQ ID NO: 2756464 - protein, 21 aa, Entamoeba invadens
GKCTSQKECTKCSKGNLIKDK

SEQ ID NO: 2756465 - protein, 4 aa, Entamoeba invadens
GKCV

SEQ ID NO: 2756466 - protein, 7 aa, Entamoeba invadens
GKCVEDT

SEQ ID NO: 2756467 - protein, 12 aa, Entamoeba invadens
GKCVKEDKSMCD

SEQ ID NO: 2756468 - protein, 7 aa, Entamoeba invadens
GKCVPSS

SEQ ID NO: 2756469 - protein, 8 aa, Entamoeba invadens
GKCVSTDS

SEQ ID NO: 2756470 - protein, 14 aa, Entamoeba invadens
GKCVTATECPSGYY

SEQ ID NO: 2756471 - protein, 31 aa, Entamoeba invadens
GKCVTATECPSGYYKDKTAAATCKKCKTGSN

SEQ ID NO: 2756472 - protein, 21 aa, Entamoeba invadens
GKCVTATECPSGYYKDTTATA

SEQ ID NO: 2756473 - protein, 31 aa, Entamoeba invadens
GKCVTSTECPSGYYKDTTATASCKKCKTGSN

SEQ ID NO: 2756474 - protein, 4 aa, Entamoeba invadens
GKCY

SEQ ID NO: 2756475 - protein, 11 aa, Entamoeba invadens
GKDAKEEFQKY

SEQ ID NO: 2756476 - protein, 9 aa, Entamoeba invadens
GKDEEDNRE

SEQ ID NO: 2756477 - protein, 10 aa, Entamoeba invadens
GKDFKTPENS

SEQ ID NO: 2756478 - protein, 7 aa, Entamoeba invadens
GKDFPDL

SEQ ID NO: 2756479 - protein, 8 aa, Entamoeba invadens
GKDFPDVE

SEQ ID NO: 2756480 - protein, 8 aa, Entamoeba invadens
GKDGAEEI

SEQ ID NO: 2756481 - protein, 6 aa, Entamoeba invadens
GKDGEH

SEQ ID NO: 2756482 - protein, 7 aa, Entamoeba invadens
GKDGHSD

SEQ ID NO: 2756483 - protein, 9 aa, Entamoeba invadens
GKDGTGRSV

SEQ ID NO: 2756484 - protein, 6 aa, Entamoeba invadens
GKDHNI

SEQ ID NO: 2756485 - protein, 4 aa, Entamoeba invadens
GKDL

SEQ ID NO: 2756486 - protein, 7 aa, Entamoeba invadens
GKDMKES

SEQ ID NO: 2756487 - protein, 10 aa, Entamoeba invadens
GKDNPKSAVV

SEQ ID NO: 2756488 - protein, 5 aa, Entamoeba invadens
GKDPE

SEQ ID NO: 2756489 - protein, 7 aa, Entamoeba invadens
GKDPIQL

SEQ ID NO: 2756490 - protein, 7 aa, Entamoeba invadens
GKDPNHK

SEQ ID NO: 2756491 - protein, 9 aa, Entamoeba invadens
GKDQASNGL

SEQ ID NO: 2756492 - protein, 10 aa, Entamoeba invadens
GKDQCEKNSV

SEQ ID NO: 2756493 - protein, 9 aa, Entamoeba invadens
GKDRNNRSN

SEQ ID NO: 2756494 - protein, 9 aa, Entamoeba invadens
GKDSAKVVS

SEQ ID NO: 2756495 - protein, 23 aa, Entamoeba invadens
GKDSCSKCKNGYTLNKTSGKCNG

SEQ ID NO: 2756496 - protein, 8 aa, Entamoeba invadens
GKDTNGNE

SEQ ID NO: 2756497 - protein, 8 aa, Entamoeba invadens
GKEATQQQ

SEQ ID NO: 2756498 - protein, 4 aa, Entamoeba invadens
GKEC

SEQ ID NO: 2756499 - protein, 6 aa, Entamoeba invadens
GKEDNE

SEQ ID NO: 2756500 - protein, 19 aa, Entamoeba invadens
GKEETKETKNVKSEEDTDN

SEQ ID NO: 2756501 - protein, 10 aa, Entamoeba invadens
GKEGNQAAVS

SEQ ID NO: 2756502 - protein, 5 aa, Entamoeba invadens
GKEGP

SEQ ID NO: 2756503 - protein, 13 aa, Entamoeba invadens
GKEGSQAARSADY

SEQ ID NO: 2756504 - protein, 12 aa, Entamoeba invadens
GKEGTQAARASD

SEQ ID NO: 2756505 - protein, 6 aa, Entamoeba invadens
GKEGTS

SEQ ID NO: 2756506 - protein, 7 aa, Entamoeba invadens
GKEITEN

SEQ ID NO: 2756507 - protein, 4 aa, Entamoeba invadens
GKEK

SEQ ID NO: 2756508 - protein, 7 aa, Entamoeba invadens
GKEKHVK

SEQ ID NO: 2756509 - protein, 6 aa, Entamoeba invadens
GKEKLG

SEQ ID NO: 2756510 - protein, 9 aa, Entamoeba invadens
GKELNTTTI

SEQ ID NO: 2756511 - protein, 5 aa, Entamoeba invadens
GKEND

SEQ ID NO: 2756512 - protein, 7 aa, Entamoeba invadens
GKENGKE

SEQ ID NO: 2756513 - protein, 5 aa, Entamoeba invadens
GKENM

SEQ ID NO: 2756514 - protein, 6 aa, Entamoeba invadens
GKENPY

SEQ ID NO: 2756515 - protein, 4 aa, Entamoeba invadens
GKES

SEQ ID NO: 2756516 - protein, 21 aa, Entamoeba invadens
GKESKLEMAREESSHKMGVTE

SEQ ID NO: 2756517 - protein, 13 aa, Entamoeba invadens
GKETKQKLNSNRH

SEQ ID NO: 2756518 - protein, 7 aa, Entamoeba invadens
GKETPNN

SEQ ID NO: 2756519 - protein, 17 aa, Entamoeba invadens
GKETRSSMNRNDQRNVK

SEQ ID NO: 2756520 - protein, 10 aa, Entamoeba invadens
GKEVTPSTAF

SEQ ID NO: 2756521 - protein, 5 aa, Entamoeba invadens
GKEYG

SEQ ID NO: 2756522 - protein, 5 aa, Entamoeba invadens
GKFDN

SEQ ID NO: 2756523 - protein, 6 aa, Entamoeba invadens
GKFDTT

SEQ ID NO: 2756524 - protein, 12 aa, Entamoeba invadens
GKFEEYSNNQCT

SEQ ID NO: 2756525 - protein, 9 aa, Entamoeba invadens
GKFGTSPNC

SEQ ID NO: 2756526 - protein, 8 aa, Entamoeba invadens
GKFISDTT

SEQ ID NO: 2756527 - protein, 7 aa, Entamoeba invadens
GKFQSIT

SEQ ID NO: 2756528 - protein, 6 aa, Entamoeba invadens
GKGAQN

SEQ ID NO: 2756529 - protein, 10 aa, Entamoeba invadens
GKGEDPAPYV

SEQ ID NO: 2756530 - protein, 7 aa, Entamoeba invadens
GKGEMES

SEQ ID NO: 2756531 - protein, 11 aa, Entamoeba invadens
GKGESSTGDHA

SEQ ID NO: 2756532 - protein, 6 aa, Entamoeba invadens
GKGEYS

SEQ ID NO: 2756533 - protein, 4 aa, Entamoeba invadens
GKGF

SEQ ID NO: 2756534 - protein, 8 aa, Entamoeba invadens
GKGFPSSH

SEQ ID NO: 2756535 - protein, 4 aa, Entamoeba invadens
GKGG

SEQ ID NO: 2756536 - protein, 12 aa, Entamoeba invadens
GKGGFGQTTKEV

SEQ ID NO: 2756537 - protein, 12 aa, Entamoeba invadens
GKGGSHNGSPGT

SEQ ID NO: 2756538 - protein, 12 aa, Entamoeba invadens
GKGGSSNSTAGT

SEQ ID NO: 2756539 - protein, 12 aa, Entamoeba invadens
GKGGSSNTSSGT

SEQ ID NO: 2756540 - protein, 7 aa, Entamoeba invadens
GKGNSDL

SEQ ID NO: 2756541 - protein, 8 aa, Entamoeba invadens
GKGQLKDK

SEQ ID NO: 2756542 - protein, 9 aa, Entamoeba invadens
GKGSTKSER

SEQ ID NO: 2756543 - protein, 4 aa, Entamoeba invadens
GKGT

SEQ ID NO: 2756544 - protein, 12 aa, Entamoeba invadens
GKGTASDAAQEQ

SEQ ID NO: 2756545 - protein, 8 aa, Entamoeba invadens
GKGTEATA

SEQ ID NO: 2756546 - protein, 8 aa, Entamoeba invadens
GKGTHLTT

SEQ ID NO: 2756547 - protein, 7 aa, Entamoeba invadens
GKGTPEL

SEQ ID NO: 2756548 - protein, 4 aa, Entamoeba invadens
GKGV

SEQ ID NO: 2756549 - protein, 6 aa, Entamoeba invadens
GKGVDI

SEQ ID NO: 2756550 - protein, 9 aa, Entamoeba invadens
GKHIPTGMQ

SEQ ID NO: 2756551 - protein, 4 aa, Entamoeba invadens
GKHK

SEQ ID NO: 2756552 - protein, 4 aa, Entamoeba invadens
GKHL

SEQ ID NO: 2756553 - protein, 14 aa, Entamoeba invadens
GKHLEKKENMTKEQ

SEQ ID NO: 2756554 - protein, 14 aa, Entamoeba invadens
GKIAETTSEQAETS

SEQ ID NO: 2756555 - protein, 10 aa, Entamoeba invadens
GKIDKTEEKV

SEQ ID NO: 2756556 - protein, 17 aa, Entamoeba invadens
GKIDKVENPMPGKPKIV

SEQ ID NO: 2756557 - protein, 4 aa, Entamoeba invadens
GKIE

SEQ ID NO: 2756558 - protein, 12 aa, Entamoeba invadens
GKIKSSILRKIL

SEQ ID NO: 2756559 - protein, 7 aa, Entamoeba invadens
GKIPCDE

SEQ ID NO: 2756560 - protein, 7 aa, Entamoeba invadens
GKIPEKE

SEQ ID NO: 2756561 - protein, 6 aa, Entamoeba invadens
GKIPQG

SEQ ID NO: 2756562 - protein, 8 aa, Entamoeba invadens
GKISSSAQ

SEQ ID NO: 2756563 - protein, 9 aa, Entamoeba invadens
GKKALNKER

SEQ ID NO: 2756564 - protein, 7 aa, Entamoeba invadens
GKKCDPC

SEQ ID NO: 2756565 - protein, 8 aa, Entamoeba invadens
GKKEAGDL

SEQ ID NO: 2756566 - protein, 9 aa, Entamoeba invadens
GKKESSEVS

SEQ ID NO: 2756567 - protein, 9 aa, Entamoeba invadens
GKKGPAGRK

SEQ ID NO: 2756568 - protein, 8 aa, Entamoeba invadens
GKKIGEGA

SEQ ID NO: 2756569 - protein, 13 aa, Entamoeba invadens
GKKISIDGSAENV

SEQ ID NO: 2756570 - protein, 10 aa, Entamoeba invadens
GKKKDRSTLK

SEQ ID NO: 2756571 - protein, 9 aa, Entamoeba invadens
GKKKSEAIA

SEQ ID NO: 2756572 - protein, 7 aa, Entamoeba invadens
GKKKSFE

SEQ ID NO: 2756573 - protein, 9 aa, Entamoeba invadens
GKKLGEIPK

SEQ ID NO: 2756574 - protein, 7 aa, Entamoeba invadens
GKKLTTA

SEQ ID NO: 2756575 - protein, 7 aa, Entamoeba invadens
GKKNSVG

SEQ ID NO: 2756576 - protein, 11 aa, Entamoeba invadens
GKKPSDDGLSC

SEQ ID NO: 2756577 - protein, 23 aa, Entamoeba invadens
GKKPSPVTNTLPSQTVAEQKTTV

SEQ ID NO: 2756578 - protein, 10 aa, Entamoeba invadens
GKKPSYDGLS

SEQ ID NO: 2756579 - protein, 18 aa, Entamoeba invadens
GKKTLQLKQQENKEKLKN

SEQ ID NO: 2756580 - protein, 5 aa, Entamoeba invadens
GKKTR

SEQ ID NO: 2756581 - protein, 6 aa, Entamoeba invadens
GKKTTS

SEQ ID NO: 2756582 - protein, 17 aa, Entamoeba invadens
GKKVDKCEGKTTSQGVP

SEQ ID NO: 2756583 - protein, 10 aa, Entamoeba invadens
GKKYRKDGKR

SEQ ID NO: 2756584 - protein, 12 aa, Entamoeba invadens
GKLCQSNTTLSN

SEQ ID NO: 2756585 - protein, 6 aa, Entamoeba invadens
GKLDVP

SEQ ID NO: 2756586 - protein, 4 aa, Entamoeba invadens
GKLE

SEQ ID NO: 2756587 - protein, 19 aa, Entamoeba invadens
GKLEESKPVDLERNTSEKL

SEQ ID NO: 2756588 - protein, 6 aa, Entamoeba invadens
GKLNEN

SEQ ID NO: 2756589 - protein, 8 aa, Entamoeba invadens
GKLNPNTF

SEQ ID NO: 2756590 - protein, 7 aa, Entamoeba invadens
GKLNTTQ

SEQ ID NO: 2756591 - protein, 4 aa, Entamoeba invadens
GKLS

SEQ ID NO: 2756592 - protein, 12 aa, Entamoeba invadens
GKLTDFGASRNI

SEQ ID NO: 2756593 - protein, 8 aa, Entamoeba invadens
GKMPRAGH

SEQ ID NO: 2756594 - protein, 5 aa, Entamoeba invadens
GKNDV

SEQ ID NO: 2756595 - protein, 5 aa, Entamoeba invadens
GKNEL

SEQ ID NO: 2756596 - protein, 9 aa, Entamoeba invadens
GKNENQREI

SEQ ID NO: 2756597 - protein, 10 aa, Entamoeba invadens
GKNGESAMKE

SEQ ID NO: 2756598 - protein, 6 aa, Entamoeba invadens
GKNLET

SEQ ID NO: 2756599 - protein, 5 aa, Entamoeba invadens
GKNPV

SEQ ID NO: 2756600 - protein, 5 aa, Entamoeba invadens
GKNSE

SEQ ID NO: 2756601 - protein, 9 aa, Entamoeba invadens
GKNSMQNTK

SEQ ID NO: 2756602 - protein, 4 aa, Entamoeba invadens
GKNT

SEQ ID NO: 2756603 - protein, 23 aa, Entamoeba invadens
GKNTKQALNSSLPRNKQSAINKK

SEQ ID NO: 2756604 - protein, 21 aa, Entamoeba invadens
GKNTKQAMNSSIPQNKNSGLN

SEQ ID NO: 2756605 - protein, 9 aa, Entamoeba invadens
GKNTQKERM

SEQ ID NO: 2756606 - protein, 17 aa, Entamoeba invadens
GKNVLPQNTGYYSTFES

SEQ ID NO: 2756607 - protein, 8 aa, Entamoeba invadens
GKNYKPQN

SEQ ID NO: 2756608 - protein, 19 aa, Entamoeba invadens
GKPFPTTKLEKRPPVEEEK

SEQ ID NO: 2756609 - protein, 9 aa, Entamoeba invadens
GKPGYGSPF

SEQ ID NO: 2756610 - protein, 6 aa, Entamoeba invadens
GKPISL

SEQ ID NO: 2756611 - protein, 9 aa, Entamoeba invadens
GKPSESITI

SEQ ID NO: 2756612 - protein, 7 aa, Entamoeba invadens
GKPSGER

SEQ ID NO: 2756613 - protein, 21 aa, Entamoeba invadens
GKPSYNNSSDSQESSESTDIP

SEQ ID NO: 2756614 - protein, 12 aa, Entamoeba invadens
GKPTGGFSDSEV

SEQ ID NO: 2756615 - protein, 5 aa, Entamoeba invadens
GKPTQ

SEQ ID NO: 2756616 - protein, 6 aa, Entamoeba invadens
GKQEGK

SEQ ID NO: 2756617 - protein, 4 aa, Entamoeba invadens
GKQF

SEQ ID NO: 2756618 - protein, 21 aa, Entamoeba invadens
GKQFSCDTQEAKSPMKTSYTT

SEQ ID NO: 2756619 - protein, 13 aa, Entamoeba invadens
GKQLQKHENMTNS

SEQ ID NO: 2756620 - protein, 5 aa, Entamoeba invadens
GKQLS

SEQ ID NO: 2756621 - protein, 16 aa, Entamoeba invadens
GKQPKDDGLSCKDKPN

SEQ ID NO: 2756622 - protein, 9 aa, Entamoeba invadens
GKQTSRFRA

SEQ ID NO: 2756623 - protein, 4 aa, Entamoeba invadens
GKQV

SEQ ID NO: 2756624 - protein, 7 aa, Entamoeba invadens
GKQYEKS

SEQ ID NO: 2756625 - protein, 5 aa, Entamoeba invadens
GKRCP

SEQ ID NO: 2756626 - protein, 5 aa, Entamoeba invadens
GKRGK

SEQ ID NO: 2756627 - protein, 8 aa, Entamoeba invadens
GKRGKQDM

SEQ ID NO: 2756628 - protein, 8 aa, Entamoeba invadens
GKRHEGED

SEQ ID NO: 2756629 - protein, 11 aa, Entamoeba invadens
GKRIEQPKQIK

SEQ ID NO: 2756630 - protein, 14 aa, Entamoeba invadens
GKRKKGGEKKVKPV

SEQ ID NO: 2756631 - protein, 12 aa, Entamoeba invadens
GKRLARPEKMDT

SEQ ID NO: 2756632 - protein, 6 aa, Entamoeba invadens
GKRLEE

SEQ ID NO: 2756633 - protein, 8 aa, Entamoeba invadens
GKRLEKPE

SEQ ID NO: 2756634 - protein, 11 aa, Entamoeba invadens
GKRLEKPENVT

SEQ ID NO: 2756635 - protein, 12 aa, Entamoeba invadens
GKRLERKENIPE

SEQ ID NO: 2756636 - protein, 10 aa, Entamoeba invadens
GKRLERPDKM

SEQ ID NO: 2756637 - protein, 9 aa, Entamoeba invadens
GKRLERPQN

SEQ ID NO: 2756638 - protein, 14 aa, Entamoeba invadens
GKRLKRRKKHSRNI

SEQ ID NO: 2756639 - protein, 12 aa, Entamoeba invadens
GKRLPKPENVSD

SEQ ID NO: 2756640 - protein, 9 aa, Entamoeba invadens
GKRLPKPHK

SEQ ID NO: 2756641 - protein, 7 aa, Entamoeba invadens
GKRLPLD

SEQ ID NO: 2756642 - protein, 12 aa, Entamoeba invadens
GKRLQRKDNIPE

SEQ ID NO: 2756643 - protein, 5 aa, Entamoeba invadens
GKRLS

SEQ ID NO: 2756644 - protein, 10 aa, Entamoeba invadens
GKRPETSELD

SEQ ID NO: 2756645 - protein, 20 aa, Entamoeba invadens
GKRPNKPSNLNDNTYTIVND

SEQ ID NO: 2756646 - protein, 10 aa, Entamoeba invadens
GKRPNTEMLT

SEQ ID NO: 2756647 - protein, 11 aa, Entamoeba invadens
GKRPPFEENEN

SEQ ID NO: 2756648 - protein, 10 aa, Entamoeba invadens
GKRPPQDDIP

SEQ ID NO: 2756649 - protein, 11 aa, Entamoeba invadens
GKRQGKPSCVS

SEQ ID NO: 2756650 - protein, 8 aa, Entamoeba invadens
GKRQNKMS

SEQ ID NO: 2756651 - protein, 9 aa, Entamoeba invadens
GKRSEFGIG

SEQ ID NO: 2756652 - protein, 9 aa, Entamoeba invadens
GKRVENINN

SEQ ID NO: 2756653 - protein, 11 aa, Entamoeba invadens
GKRVENVNNIP

SEQ ID NO: 2756654 - protein, 5 aa, Entamoeba invadens
GKRYG

SEQ ID NO: 2756655 - protein, 10 aa, Entamoeba invadens
GKRYTENNGV

SEQ ID NO: 2756656 - protein, 4 aa, Entamoeba invadens
GKSA

SEQ ID NO: 2756657 - protein, 13 aa, Entamoeba invadens
GKSAKRKPSFKTE

SEQ ID NO: 2756658 - protein, 5 aa, Entamoeba invadens
GKSCV

SEQ ID NO: 2756659 - protein, 7 aa, Entamoeba invadens
GKSDESL

SEQ ID NO: 2756660 - protein, 8 aa, Entamoeba invadens
GKSGCGKT

SEQ ID NO: 2756661 - protein, 17 aa, Entamoeba invadens
GKSGDNQISFDGKTPLN

SEQ ID NO: 2756662 - protein, 8 aa, Entamoeba invadens
GKSGNRVN

SEQ ID NO: 2756663 - protein, 20 aa, Entamoeba invadens
GKSGRSEDSLSNSSSMSSFT

SEQ ID NO: 2756664 - protein, 8 aa, Entamoeba invadens
GKSKEESI

SEQ ID NO: 2756665 - protein, 10 aa, Entamoeba invadens
GKSKTEPSGL

SEQ ID NO: 2756666 - protein, 8 aa, Entamoeba invadens
GKSMGEPL

SEQ ID NO: 2756667 - protein, 6 aa, Entamoeba invadens
GKSPLL

SEQ ID NO: 2756668 - protein, 6 aa, Entamoeba invadens
GKSPRI

SEQ ID NO: 2756669 - protein, 8 aa, Entamoeba invadens
GKSREVRG

SEQ ID NO: 2756670 - protein, 4 aa, Entamoeba invadens
GKSS

SEQ ID NO: 2756671 - protein, 7 aa, Entamoeba invadens
GKSTFET

SEQ ID NO: 2756672 - protein, 10 aa, Entamoeba invadens
GKSYPYRGTG

SEQ ID NO: 2756673 - protein, 5 aa, Entamoeba invadens
GKSYV

SEQ ID NO: 2756674 - protein, 11 aa, Entamoeba invadens
GKTASQRTNRL

SEQ ID NO: 2756675 - protein, 7 aa, Entamoeba invadens
GKTATEC

SEQ ID NO: 2756676 - protein, 4 aa, Entamoeba invadens
GKTC

SEQ ID NO: 2756677 - protein, 17 aa, Entamoeba invadens
GKTFSETDCNHDAEKNG

SEQ ID NO: 2756678 - protein, 10 aa, Entamoeba invadens
GKTGGDSSYC

SEQ ID NO: 2756679 - protein, 7 aa, Entamoeba invadens
GKTGTFY

SEQ ID NO: 2756680 - protein, 18 aa, Entamoeba invadens
GKTKESLSQDKPRPTPLQ

SEQ ID NO: 2756681 - protein, 10 aa, Entamoeba invadens
GKTLTGNSNL

SEQ ID NO: 2756682 - protein, 5 aa, Entamoeba invadens
GKTNV

SEQ ID NO: 2756683 - protein, 5 aa, Entamoeba invadens
GKTPI

SEQ ID NO: 2756684 - protein, 6 aa, Entamoeba invadens
GKTPKG

SEQ ID NO: 2756685 - protein, 8 aa, Entamoeba invadens
GKTPNFTA

SEQ ID NO: 2756686 - protein, 4 aa, Entamoeba invadens
GKTQ

SEQ ID NO: 2756687 - protein, 7 aa, Entamoeba invadens
GKTQEEF

SEQ ID NO: 2756688 - protein, 11 aa, Entamoeba invadens
GKTQVSADTSV

SEQ ID NO: 2756689 - protein, 10 aa, Entamoeba invadens
GKTSEVGSRE

SEQ ID NO: 2756690 - protein, 9 aa, Entamoeba invadens
GKTSGYRNI

SEQ ID NO: 2756691 - protein, 10 aa, Entamoeba invadens
GKTSYSSTLT

SEQ ID NO: 2756692 - protein, 6 aa, Entamoeba invadens
GKTTAD

SEQ ID NO: 2756693 - protein, 7 aa, Entamoeba invadens
GKTTYEN

SEQ ID NO: 2756694 - protein, 7 aa, Entamoeba invadens
GKTYGDG

SEQ ID NO: 2756695 - protein, 11 aa, Entamoeba invadens
GKTYKTERKRI

SEQ ID NO: 2756696 - protein, 6 aa, Entamoeba invadens
GKTYST

SEQ ID NO: 2756697 - protein, 6 aa, Entamoeba invadens
GKVDNN

SEQ ID NO: 2756698 - protein, 9 aa, Entamoeba invadens
GKVDQNSSS

SEQ ID NO: 2756699 - protein, 12 aa, Entamoeba invadens
GKVESSLKVDSD

SEQ ID NO: 2756700 - protein, 12 aa, Entamoeba invadens
GKVHATDVSNAA

SEQ ID NO: 2756701 - protein, 6 aa, Entamoeba invadens
GKVKVT

SEQ ID NO: 2756702 - protein, 7 aa, Entamoeba invadens
GKVSDKD

SEQ ID NO: 2756703 - protein, 7 aa, Entamoeba invadens
GKVSEGA

SEQ ID NO: 2756704 - protein, 22 aa, Entamoeba invadens
GKVSESKKYPLTNTKTYNDEKN

SEQ ID NO: 2756705 - protein, 17 aa, Entamoeba invadens
GKVTDTTSLDTKVESSQ

SEQ ID NO: 2756706 - protein, 8 aa, Entamoeba invadens
GKVTPSFS

SEQ ID NO: 2756707 - protein, 13 aa, Entamoeba invadens
GKVTRADFPTESA

SEQ ID NO: 2756708 - protein, 33 aa, Entamoeba invadens
GKVTSDDVQEESAAQKSSREEDLPHQRSNEKRG

SEQ ID NO: 2756709 - protein, 9 aa, Entamoeba invadens
GKVYNTKDG

SEQ ID NO: 2756710 - protein, 13 aa, Entamoeba invadens
GKWGMGASETNNN

SEQ ID NO: 2756711 - protein, 6 aa, Entamoeba invadens
GKWSQN

SEQ ID NO: 2756712 - protein, 12 aa, Entamoeba invadens
GKYAPNNSSSSC

SEQ ID NO: 2756713 - protein, 35 aa, Entamoeba invadens
GKYASSSGSSSCSSCGAGTYSGSGASSCTKCSAGY

SEQ ID NO: 2756714 - protein, 6 aa, Entamoeba invadens
GKYDGH

SEQ ID NO: 2756715 - protein, 9 aa, Entamoeba invadens
GKYKNNGQC

SEQ ID NO: 2756716 - protein, 6 aa, Entamoeba invadens
GKYLDN

SEQ ID NO: 2756717 - protein, 7 aa, Entamoeba invadens
GKYLDQG

SEQ ID NO: 2756718 - protein, 5 aa, Entamoeba invadens
GKYLT

SEQ ID NO: 2756719 - protein, 7 aa, Entamoeba invadens
GKYLTQK

SEQ ID NO: 2756720 - protein, 8 aa, Entamoeba invadens
GKYMTTKG

SEQ ID NO: 2756721 - protein, 13 aa, Entamoeba invadens
GKYNGTDKLTSTT

SEQ ID NO: 2756722 - protein, 10 aa, Entamoeba invadens
GKYPNPSSPF

SEQ ID NO: 2756723 - protein, 8 aa, Entamoeba invadens
GKYPSNNI

SEQ ID NO: 2756724 - protein, 9 aa, Entamoeba invadens
GKYRYNSDK

SEQ ID NO: 2756725 - protein, 4 aa, Entamoeba invadens
GKYS

SEQ ID NO: 2756726 - protein, 9 aa, Entamoeba invadens
GKYSLENAQ

SEQ ID NO: 2756727 - protein, 28 aa, Entamoeba invadens
GKYSSSGSSSCTSCSAGTYSSTSGSPSC

SEQ ID NO: 2756728 - protein, 29 aa, Entamoeba invadens
GKYSSSYGSTSCSTCPAGTFSSSGSSSCS

SEQ ID NO: 2756729 - protein, 8 aa, Entamoeba invadens
GKYTNHRQ

SEQ ID NO: 2756730 - protein, 4 aa, Entamoeba invadens
GKYY

SEQ ID NO: 2756731 - protein, 10 aa, Entamoeba invadens
GLAGKNSYIQ

SEQ ID NO: 2756732 - protein, 18 aa, Entamoeba invadens
GLCEEPTDNCLEKKSTEC

SEQ ID NO: 2756733 - protein, 7 aa, Entamoeba invadens
GLCSNTS

SEQ ID NO: 2756734 - protein, 4 aa, Entamoeba invadens
GLDG

SEQ ID NO: 2756735 - protein, 9 aa, Entamoeba invadens
GLDKEGKPQ

SEQ ID NO: 2756736 - protein, 27 aa, Entamoeba invadens
GLDNNGKCEQCSDGYYSPGKTSSCSSC

SEQ ID NO: 2756737 - protein, 17 aa, Entamoeba invadens
GLDSINQDGTYGRTNKY

SEQ ID NO: 2756738 - protein, 5 aa, Entamoeba invadens
GLDSS

SEQ ID NO: 2756739 - protein, 6 aa, Entamoeba invadens
GLDSSK

SEQ ID NO: 2756740 - protein, 9 aa, Entamoeba invadens
GLEDETSHL

SEQ ID NO: 2756741 - protein, 11 aa, Entamoeba invadens
GLEKEAGIPDE

SEQ ID NO: 2756742 - protein, 11 aa, Entamoeba invadens
GLENMSNKTAA

SEQ ID NO: 2756743 - protein, 4 aa, Entamoeba invadens
GLES

SEQ ID NO: 2756744 - protein, 7 aa, Entamoeba invadens
GLGGDAV

SEQ ID NO: 2756745 - protein, 10 aa, Entamoeba invadens
GLGNTSGSFE

SEQ ID NO: 2756746 - protein, 8 aa, Entamoeba invadens
GLGPQDVQ

SEQ ID NO: 2756747 - protein, 9 aa, Entamoeba invadens
GLGSNNKGF

SEQ ID NO: 2756748 - protein, 6 aa, Entamoeba invadens
GLGTPI

SEQ ID NO: 2756749 - protein, 6 aa, Entamoeba invadens
GLGTTG

SEQ ID NO: 2756750 - protein, 4 aa, Entamoeba invadens
GLHD

SEQ ID NO: 2756751 - protein, 18 aa, Entamoeba invadens
GLHTTGGDGFVTKTEDEN

SEQ ID NO: 2756752 - protein, 9 aa, Entamoeba invadens
GLKENTTPY

SEQ ID NO: 2756753 - protein, 11 aa, Entamoeba invadens
GLKSTTEEDGI

SEQ ID NO: 2756754 - protein, 12 aa, Entamoeba invadens
GLLPQSQSDCQS

SEQ ID NO: 2756755 - protein, 4 aa, Entamoeba invadens
GLND

SEQ ID NO: 2756756 - protein, 4 aa, Entamoeba invadens
GLNG

SEQ ID NO: 2756757 - protein, 5 aa, Entamoeba invadens
GLNGN

SEQ ID NO: 2756758 - protein, 4 aa, Entamoeba invadens
GLNN

SEQ ID NO: 2756759 - protein, 8 aa, Entamoeba invadens
GLNNGKQS

SEQ ID NO: 2756760 - protein, 5 aa, Entamoeba invadens
GLNNN

SEQ ID NO: 2756761 - protein, 7 aa, Entamoeba invadens
GLNRSER

SEQ ID NO: 2756762 - protein, 9 aa, Entamoeba invadens
GLPEAYKSL

SEQ ID NO: 2756763 - protein, 5 aa, Entamoeba invadens
GLPED

SEQ ID NO: 2756764 - protein, 10 aa, Entamoeba invadens
GLPGKDNINA

SEQ ID NO: 2756765 - protein, 8 aa, Entamoeba invadens
GLPLKTPK

SEQ ID NO: 2756766 - protein, 26 aa, Entamoeba invadens
GLPTLEKPQDENTDRQTQKAKGDKIS

SEQ ID NO: 2756767 - protein, 7 aa, Entamoeba invadens
GLPTSKL

SEQ ID NO: 2756768 - protein, 7 aa, Entamoeba invadens
GLQEKGG

SEQ ID NO: 2756769 - protein, 17 aa, Entamoeba invadens
GLRPDLDEIDERTRNIT

SEQ ID NO: 2756770 - protein, 11 aa, Entamoeba invadens
GLRPNTTSGKC

SEQ ID NO: 2756771 - protein, 11 aa, Entamoeba invadens
GLRPSQPENVK

SEQ ID NO: 2756772 - protein, 11 aa, Entamoeba invadens
GLRTGKTAPFI

SEQ ID NO: 2756773 - protein, 22 aa, Entamoeba invadens
GLRVDQSDMTGESDAIKKTAEN

SEQ ID NO: 2756774 - protein, 10 aa, Entamoeba invadens
GLSAASGKVG

SEQ ID NO: 2756775 - protein, 10 aa, Entamoeba invadens
GLSASSGKIG

SEQ ID NO: 2756776 - protein, 10 aa, Entamoeba invadens
GLSASSGKMG

SEQ ID NO: 2756777 - protein, 18 aa, Entamoeba invadens
GLSAYAGNALEGENEGVH

SEQ ID NO: 2756778 - protein, 5 aa, Entamoeba invadens
GLSET

SEQ ID NO: 2756779 - protein, 10 aa, Entamoeba invadens
GLSGNTPISV

SEQ ID NO: 2756780 - protein, 4 aa, Entamoeba invadens
GLSP

SEQ ID NO: 2756781 - protein, 5 aa, Entamoeba invadens
GLSPK

SEQ ID NO: 2756782 - protein, 7 aa, Entamoeba invadens
GLSPTGR

SEQ ID NO: 2756783 - protein, 11 aa, Entamoeba invadens
GLSQKETNISN

SEQ ID NO: 2756784 - protein, 12 aa, Entamoeba invadens
GLSRSSDGKPQF

SEQ ID NO: 2756785 - protein, 5 aa, Entamoeba invadens
GLSSG

SEQ ID NO: 2756786 - protein, 9 aa, Entamoeba invadens
GLSSKSDLK

SEQ ID NO: 2756787 - protein, 8 aa, Entamoeba invadens
GLSSSGKC

SEQ ID NO: 2756788 - protein, 4 aa, Entamoeba invadens
GLST

SEQ ID NO: 2756789 - protein, 7 aa, Entamoeba invadens
GLSTGET

SEQ ID NO: 2756790 - protein, 19 aa, Entamoeba invadens
GLSYSTSKIGLSRTSSSIL

SEQ ID NO: 2756791 - protein, 26 aa, Entamoeba invadens
GLTTTKDELVAENEKLKKDSAENVQK

SEQ ID NO: 2756792 - protein, 9 aa, Entamoeba invadens
GLVPEKKDQ

SEQ ID NO: 2756793 - protein, 12 aa, Entamoeba invadens
GLYENNGKCTSM

SEQ ID NO: 2756794 - protein, 5 aa, Entamoeba invadens
GMDEP

SEQ ID NO: 2756795 - protein, 8 aa, Entamoeba invadens
GMDETNDS

SEQ ID NO: 2756796 - protein, 11 aa, Entamoeba invadens
GMENPSTATRY

SEQ ID NO: 2756797 - protein, 6 aa, Entamoeba invadens
GMGLPD

SEQ ID NO: 2756798 - protein, 18 aa, Entamoeba invadens
GMGRGKNAGSWQHSYEGG

SEQ ID NO: 2756799 - protein, 5 aa, Entamoeba invadens
GMKCD

SEQ ID NO: 2756800 - protein, 11 aa, Entamoeba invadens
GMKNPSDDGLS

SEQ ID NO: 2756801 - protein, 10 aa, Entamoeba invadens
GMNDSKQVET

SEQ ID NO: 2756802 - protein, 5 aa, Entamoeba invadens
GMNNK

SEQ ID NO: 2756803 - protein, 11 aa, Entamoeba invadens
GMRKPSDNGLS

SEQ ID NO: 2756804 - protein, 5 aa, Entamoeba invadens
GMRNS

SEQ ID NO: 2756805 - protein, 9 aa, Entamoeba invadens
GMSDTNTNI

SEQ ID NO: 2756806 - protein, 5 aa, Entamoeba invadens
GMSEQ

SEQ ID NO: 2756807 - protein, 13 aa, Entamoeba invadens
GMSEQQGEGHRHS

SEQ ID NO: 2756808 - protein, 7 aa, Entamoeba invadens
GMSQKQT

SEQ ID NO: 2756809 - protein, 32 aa, Entamoeba invadens
GMSSTGLGGAGMSNTGLAGTGMSNSGLAGTGM

SEQ ID NO: 2756810 - protein, 17 aa, Entamoeba invadens
GMSTSAGIPDFRSPKTG

SEQ ID NO: 2756811 - protein, 9 aa, Entamoeba invadens
GMTSDRPDI

SEQ ID NO: 2756812 - protein, 11 aa, Entamoeba invadens
GMTTGGKCKDI

SEQ ID NO: 2756813 - protein, 11 aa, Entamoeba invadens
GMYPDESTKTC

SEQ ID NO: 2756814 - protein, 28 aa, Entamoeba invadens
GMYPDETNKTCTSCSSTCDGYCSQTTGY

SEQ ID NO: 2756815 - protein, 8 aa, Entamoeba invadens
GMYPDTSI

SEQ ID NO: 2756816 - protein, 6 aa, Entamoeba invadens
GMYPGN

SEQ ID NO: 2756817 - protein, 8 aa, Entamoeba invadens
GMYPSDST

SEQ ID NO: 2756818 - protein, 9 aa, Entamoeba invadens
GNADSTQNS

SEQ ID NO: 2756819 - protein, 9 aa, Entamoeba invadens
GNAEQCTKC

SEQ ID NO: 2756820 - protein, 16 aa, Entamoeba invadens
GNANEYTFNPDSQTTI

SEQ ID NO: 2756821 - protein, 15 aa, Entamoeba invadens
GNANNYNSEYVEEDS

SEQ ID NO: 2756822 - protein, 18 aa, Entamoeba invadens
GNAQHEREMKEKTREWPT

SEQ ID NO: 2756823 - protein, 8 aa, Entamoeba invadens
GNASDPTN

SEQ ID NO: 2756824 - protein, 12 aa, Entamoeba invadens
GNASSYDFQSET

SEQ ID NO: 2756825 - protein, 8 aa, Entamoeba invadens
GNATDPIS

SEQ ID NO: 2756826 - protein, 9 aa, Entamoeba invadens
GNATNATAI

SEQ ID NO: 2756827 - protein, 5 aa, Entamoeba invadens
GNATT

SEQ ID NO: 2756828 - protein, 8 aa, Entamoeba invadens
GNCAPCDE

SEQ ID NO: 2756829 - protein, 8 aa, Entamoeba invadens
GNCDTTNG

SEQ ID NO: 2756830 - protein, 12 aa, Entamoeba invadens
GNCETKTEASIP

SEQ ID NO: 2756831 - protein, 13 aa, Entamoeba invadens
GNCGGGSGSGDGL

SEQ ID NO: 2756832 - protein, 21 aa, Entamoeba invadens
GNCIQNSGDNAQYKCKETTQH

SEQ ID NO: 2756833 - protein, 5 aa, Entamoeba invadens
GNCKK

SEQ ID NO: 2756834 - protein, 21 aa, Entamoeba invadens
GNCMQNNGDNTQYKCKETTQH

SEQ ID NO: 2756835 - protein, 15 aa, Entamoeba invadens
GNCPSNCEKCNNSTS

SEQ ID NO: 2756836 - protein, 20 aa, Entamoeba invadens
GNCQKCDSTCGNSCDGTSGY

SEQ ID NO: 2756837 - protein, 12 aa, Entamoeba invadens
GNCQQSTGCTEC

SEQ ID NO: 2756838 - protein, 9 aa, Entamoeba invadens
GNCRQGSDY

SEQ ID NO: 2756839 - protein, 4 aa, Entamoeba invadens
GNCS

SEQ ID NO: 2756840 - protein, 9 aa, Entamoeba invadens
GNCTQKSTV

SEQ ID NO: 2756841 - protein, 6 aa, Entamoeba invadens
GNCVSE

SEQ ID NO: 2756842 - protein, 18 aa, Entamoeba invadens
GNCVTTPSTCKSSQSGYC

SEQ ID NO: 2756843 - protein, 17 aa, Entamoeba invadens
GNDCKPCEGEVNSYDGV

SEQ ID NO: 2756844 - protein, 9 aa, Entamoeba invadens
GNDCQHAQQ

SEQ ID NO: 2756845 - protein, 9 aa, Entamoeba invadens
GNDHRPKGT

SEQ ID NO: 2756846 - protein, 6 aa, Entamoeba invadens
GNDKPY

SEQ ID NO: 2756847 - protein, 8 aa, Entamoeba invadens
GNDKSSCY

SEQ ID NO: 2756848 - protein, 4 aa, Entamoeba invadens
GNDL

SEQ ID NO: 2756849 - protein, 9 aa, Entamoeba invadens
GNDNTSGII

SEQ ID NO: 2756850 - protein, 6 aa, Entamoeba invadens
GNDPLS

SEQ ID NO: 2756851 - protein, 4 aa, Entamoeba invadens
GNDR

SEQ ID NO: 2756852 - protein, 5 aa, Entamoeba invadens
GNDSF

SEQ ID NO: 2756853 - protein, 5 aa, Entamoeba invadens
GNDSI

SEQ ID NO: 2756854 - protein, 6 aa, Entamoeba invadens
GNDTCS

SEQ ID NO: 2756855 - protein, 6 aa, Entamoeba invadens
GNDTTQ

SEQ ID NO: 2756856 - protein, 8 aa, Entamoeba invadens
GNECKKCD

SEQ ID NO: 2756857 - protein, 12 aa, Entamoeba invadens
GNECQSSQQNME

SEQ ID NO: 2756858 - protein, 8 aa, Entamoeba invadens
GNEDWPPK

SEQ ID NO: 2756859 - protein, 5 aa, Entamoeba invadens
GNEEI

SEQ ID NO: 2756860 - protein, 6 aa, Entamoeba invadens
GNEGIS

SEQ ID NO: 2756861 - protein, 7 aa, Entamoeba invadens
GNEIGNH

SEQ ID NO: 2756862 - protein, 6 aa, Entamoeba invadens
GNEIQN

SEQ ID NO: 2756863 - protein, 5 aa, Entamoeba invadens
GNEKA

SEQ ID NO: 2756864 - protein, 8 aa, Entamoeba invadens
GNEKEHRQ

SEQ ID NO: 2756865 - protein, 9 aa, Entamoeba invadens
GNENFSYST

SEQ ID NO: 2756866 - protein, 5 aa, Entamoeba invadens
GNENN

SEQ ID NO: 2756867 - protein, 8 aa, Entamoeba invadens
GNENNQNY

SEQ ID NO: 2756868 - protein, 7 aa, Entamoeba invadens
GNEPYDD

SEQ ID NO: 2756869 - protein, 9 aa, Entamoeba invadens
GNEQKATEI

SEQ ID NO: 2756870 - protein, 4 aa, Entamoeba invadens
GNER

SEQ ID NO: 2756871 - protein, 13 aa, Entamoeba invadens
GNESYAGGESKNI

SEQ ID NO: 2756872 - protein, 12 aa, Entamoeba invadens
GNETKATEIQDT

SEQ ID NO: 2756873 - protein, 13 aa, Entamoeba invadens
GNETKPTDVGDTR

SEQ ID NO: 2756874 - protein, 7 aa, Entamoeba invadens
GNETSFT

SEQ ID NO: 2756875 - protein, 5 aa, Entamoeba invadens
GNETW

SEQ ID NO: 2756876 - protein, 4 aa, Entamoeba invadens
GNEV

SEQ ID NO: 2756877 - protein, 5 aa, Entamoeba invadens
GNEVI

SEQ ID NO: 2756878 - protein, 13 aa, Entamoeba invadens
GNFESSPNSEGKC

SEQ ID NO: 2756879 - protein, 4 aa, Entamoeba invadens
GNFG

SEQ ID NO: 2756880 - protein, 6 aa, Entamoeba invadens
GNFKSE

SEQ ID NO: 2756881 - protein, 9 aa, Entamoeba invadens
GNFNSGAYK

SEQ ID NO: 2756882 - protein, 6 aa, Entamoeba invadens
GNFPKT

SEQ ID NO: 2756883 - protein, 8 aa, Entamoeba invadens
GNFSREER

SEQ ID NO: 2756884 - protein, 4 aa, Entamoeba invadens
GNGA

SEQ ID NO: 2756885 - protein, 7 aa, Entamoeba invadens
GNGDHPI

SEQ ID NO: 2756886 - protein, 5 aa, Entamoeba invadens
GNGEI

SEQ ID NO: 2756887 - protein, 24 aa, Entamoeba invadens
GNGEINGTCKPLQTTSKCSHYGPT

SEQ ID NO: 2756888 - protein, 8 aa, Entamoeba invadens
GNGEYGFP

SEQ ID NO: 2756889 - protein, 11 aa, Entamoeba invadens
GNGGELSDNQT

SEQ ID NO: 2756890 - protein, 8 aa, Entamoeba invadens
GNGGKNKL

SEQ ID NO: 2756891 - protein, 17 aa, Entamoeba invadens
GNGIRDDTEDCDGGEYC

SEQ ID NO: 2756892 - protein, 12 aa, Entamoeba invadens
GNGITTTGNCEE

SEQ ID NO: 2756893 - protein, 14 aa, Entamoeba invadens
GNGITTTGNCEESN

SEQ ID NO: 2756894 - protein, 15 aa, Entamoeba invadens
GNGITTTGNCEESSY

SEQ ID NO: 2756895 - protein, 17 aa, Entamoeba invadens
GNGKIDGNEECDSGEGC

SEQ ID NO: 2756896 - protein, 17 aa, Entamoeba invadens
GNGKRDGGEECDNSTNC

SEQ ID NO: 2756897 - protein, 8 aa, Entamoeba invadens
GNGKTTVD

SEQ ID NO: 2756898 - protein, 14 aa, Entamoeba invadens
GNGNKTVSLEDNSS

SEQ ID NO: 2756899 - protein, 16 aa, Entamoeba invadens
GNGQIDEGEECDGGDN

SEQ ID NO: 2756900 - protein, 5 aa, Entamoeba invadens
GNGQY

SEQ ID NO: 2756901 - protein, 7 aa, Entamoeba invadens
GNGSQVE

SEQ ID NO: 2756902 - protein, 11 aa, Entamoeba invadens
GNGTEATEIND

SEQ ID NO: 2756903 - protein, 7 aa, Entamoeba invadens
GNGTQFE

SEQ ID NO: 2756904 - protein, 4 aa, Entamoeba invadens
GNGV

SEQ ID NO: 2756905 - protein, 9 aa, Entamoeba invadens
GNGVAKLNK

SEQ ID NO: 2756906 - protein, 7 aa, Entamoeba invadens
GNHEDPD

SEQ ID NO: 2756907 - protein, 8 aa, Entamoeba invadens
GNHETKSM

SEQ ID NO: 2756908 - protein, 8 aa, Entamoeba invadens
GNHETTDV

SEQ ID NO: 2756909 - protein, 5 aa, Entamoeba invadens
GNHLT

SEQ ID NO: 2756910 - protein, 15 aa, Entamoeba invadens
GNIGPNDECYASNEG

SEQ ID NO: 2756911 - protein, 5 aa, Entamoeba invadens
GNIKP

SEQ ID NO: 2756912 - protein, 5 aa, Entamoeba invadens
GNINS

SEQ ID NO: 2756913 - protein, 6 aa, Entamoeba invadens
GNIPTR

SEQ ID NO: 2756914 - protein, 4 aa, Entamoeba invadens
GNIQ

SEQ ID NO: 2756915 - protein, 30 aa, Entamoeba invadens
GNISSSEGSTSCTPCGDATVPNKDQTQCER

SEQ ID NO: 2756916 - protein, 7 aa, Entamoeba invadens
GNITDDE

SEQ ID NO: 2756917 - protein, 13 aa, Entamoeba invadens
GNITNSDNDGCQC

SEQ ID NO: 2756918 - protein, 15 aa, Entamoeba invadens
GNKAFKQAGFESTSE

SEQ ID NO: 2756919 - protein, 9 aa, Entamoeba invadens
GNKATHNYI

SEQ ID NO: 2756920 - protein, 7 aa, Entamoeba invadens
GNKENGY

SEQ ID NO: 2756921 - protein, 18 aa, Entamoeba invadens
GNKHLDEGEECDSDIGSG

SEQ ID NO: 2756922 - protein, 16 aa, Entamoeba invadens
GNKKWDKGEECDGGDG

SEQ ID NO: 2756923 - protein, 16 aa, Entamoeba invadens
GNKKWEKGEECDGGDG

SEQ ID NO: 2756924 - protein, 9 aa, Entamoeba invadens
GNKMTEDTK

SEQ ID NO: 2756925 - protein, 10 aa, Entamoeba invadens
GNKMTEDTKK

SEQ ID NO: 2756926 - protein, 6 aa, Entamoeba invadens
GNKQNG

SEQ ID NO: 2756927 - protein, 14 aa, Entamoeba invadens
GNKQVDGDEECDSG

SEQ ID NO: 2756928 - protein, 15 aa, Entamoeba invadens
GNKRIDGDEECDSGD

SEQ ID NO: 2756929 - protein, 17 aa, Entamoeba invadens
GNKSPNKLDKPEKSSPK

SEQ ID NO: 2756930 - protein, 12 aa, Entamoeba invadens
GNKTERLKRFLA

SEQ ID NO: 2756931 - protein, 13 aa, Entamoeba invadens
GNLKHKNSNITPQ

SEQ ID NO: 2756932 - protein, 5 aa, Entamoeba invadens
GNLPP

SEQ ID NO: 2756933 - protein, 4 aa, Entamoeba invadens
GNMA

SEQ ID NO: 2756934 - protein, 5 aa, Entamoeba invadens
GNMET

SEQ ID NO: 2756935 - protein, 4 aa, Entamoeba invadens
GNNA

SEQ ID NO: 2756936 - protein, 6 aa, Entamoeba invadens
GNNAST

SEQ ID NO: 2756937 - protein, 5 aa, Entamoeba invadens
GNNCK

SEQ ID NO: 2756938 - protein, 6 aa, Entamoeba invadens
GNNDTL

SEQ ID NO: 2756939 - protein, 9 aa, Entamoeba invadens
GNNGGKQIT

SEQ ID NO: 2756940 - protein, 7 aa, Entamoeba invadens
GNNHEIS

SEQ ID NO: 2756941 - protein, 4 aa, Entamoeba invadens
GNNK

SEQ ID NO: 2756942 - protein, 6 aa, Entamoeba invadens
GNNKCS

SEQ ID NO: 2756943 - protein, 26 aa, Entamoeba invadens
GNNKLSADKTKCTTSCAAGEYESGNN

SEQ ID NO: 2756944 - protein, 5 aa, Entamoeba invadens
GNNKT

SEQ ID NO: 2756945 - protein, 14 aa, Entamoeba invadens
GNNKVDPGEQCDGT

SEQ ID NO: 2756946 - protein, 11 aa, Entamoeba invadens
GNNNLNGFRTS

SEQ ID NO: 2756947 - protein, 19 aa, Entamoeba invadens
GNNRSKKTEEVIKETPESI

SEQ ID NO: 2756948 - protein, 13 aa, Entamoeba invadens
GNNSLSSRDRKRY

SEQ ID NO: 2756949 - protein, 21 aa, Entamoeba invadens
GNNWADGFNNSKCSTSSTPTS

SEQ ID NO: 2756950 - protein, 10 aa, Entamoeba invadens
GNPEEKTSVK

SEQ ID NO: 2756951 - protein, 11 aa, Entamoeba invadens
GNPENISSKEN

SEQ ID NO: 2756952 - protein, 4 aa, Entamoeba invadens
GNPI

SEQ ID NO: 2756953 - protein, 7 aa, Entamoeba invadens
GNPIKKE

SEQ ID NO: 2756954 - protein, 7 aa, Entamoeba invadens
GNPKNGS

SEQ ID NO: 2756955 - protein, 5 aa, Entamoeba invadens
GNPMN

SEQ ID NO: 2756956 - protein, 7 aa, Entamoeba invadens
GNPNIGT

SEQ ID NO: 2756957 - protein, 4 aa, Entamoeba invadens
GNQI

SEQ ID NO: 2756958 - protein, 14 aa, Entamoeba invadens
GNQLPNSKYKENED

SEQ ID NO: 2756959 - protein, 7 aa, Entamoeba invadens
GNQSVEL

SEQ ID NO: 2756960 - protein, 5 aa, Entamoeba invadens
GNQVQ

SEQ ID NO: 2756961 - protein, 5 aa, Entamoeba invadens
GNQYG

SEQ ID NO: 2756962 - protein, 10 aa, Entamoeba invadens
GNREFPKKRG

SEQ ID NO: 2756963 - protein, 10 aa, Entamoeba invadens
GNRESKPDGM

SEQ ID NO: 2756964 - protein, 13 aa, Entamoeba invadens
GNRIQKPGDLSDE

SEQ ID NO: 2756965 - protein, 13 aa, Entamoeba invadens
GNRIQKPSDLSDE

SEQ ID NO: 2756966 - protein, 4 aa, Entamoeba invadens
GNRK

SEQ ID NO: 2756967 - protein, 16 aa, Entamoeba invadens
GNRKWDEGEECDGGDG

SEQ ID NO: 2756968 - protein, 6 aa, Entamoeba invadens
GNRLKK

SEQ ID NO: 2756969 - protein, 11 aa, Entamoeba invadens
GNRLPKPANVS

SEQ ID NO: 2756970 - protein, 11 aa, Entamoeba invadens
GNRLPKPDNVT

SEQ ID NO: 2756971 - protein, 9 aa, Entamoeba invadens
GNRPPYREG

SEQ ID NO: 2756972 - protein, 12 aa, Entamoeba invadens
GNRREKPENISG

SEQ ID NO: 2756973 - protein, 10 aa, Entamoeba invadens
GNRRLQPKDM

SEQ ID NO: 2756974 - protein, 5 aa, Entamoeba invadens
GNRTE

SEQ ID NO: 2756975 - protein, 8 aa, Entamoeba invadens
GNRTEEKQ

SEQ ID NO: 2756976 - protein, 5 aa, Entamoeba invadens
GNSAG

SEQ ID NO: 2756977 - protein, 14 aa, Entamoeba invadens
GNSDCTGSHKDMET

SEQ ID NO: 2756978 - protein, 6 aa, Entamoeba invadens
GNSDEN

SEQ ID NO: 2756979 - protein, 10 aa, Entamoeba invadens
GNSEKEESAN

SEQ ID NO: 2756980 - protein, 10 aa, Entamoeba invadens
GNSFDKCESC

SEQ ID NO: 2756981 - protein, 4 aa, Entamoeba invadens
GNSH

SEQ ID NO: 2756982 - protein, 9 aa, Entamoeba invadens
GNSKLKIES

SEQ ID NO: 2756983 - protein, 5 aa, Entamoeba invadens
GNSNE

SEQ ID NO: 2756984 - protein, 11 aa, Entamoeba invadens
GNSNNKCDNCA

SEQ ID NO: 2756985 - protein, 4 aa, Entamoeba invadens
GNSS

SEQ ID NO: 2756986 - protein, 15 aa, Entamoeba invadens
GNSSAIIPSKTTITT

SEQ ID NO: 2756987 - protein, 9 aa, Entamoeba invadens
GNSSFNSTG

SEQ ID NO: 2756988 - protein, 7 aa, Entamoeba invadens
GNSSIGK

SEQ ID NO: 2756989 - protein, 8 aa, Entamoeba invadens
GNSSLEMN

SEQ ID NO: 2756990 - protein, 7 aa, Entamoeba invadens
GNSSLGL

SEQ ID NO: 2756991 - protein, 8 aa, Entamoeba invadens
GNSSLIPP

SEQ ID NO: 2756992 - protein, 6 aa, Entamoeba invadens
GNSSSC

SEQ ID NO: 2756993 - protein, 14 aa, Entamoeba invadens
GNSSSLTAVADTRY

SEQ ID NO: 2756994 - protein, 9 aa, Entamoeba invadens
GNSSTKCLS

SEQ ID NO: 2756995 - protein, 11 aa, Entamoeba invadens
GNSTCNSCANP

SEQ ID NO: 2756996 - protein, 15 aa, Entamoeba invadens
GNSTIDFPNPINNER

SEQ ID NO: 2756997 - protein, 24 aa, Entamoeba invadens
GNSTNSSTLKLETKTTLSTNNLSL

SEQ ID NO: 2756998 - protein, 11 aa, Entamoeba invadens
GNSYNKCNNCA

SEQ ID NO: 2756999 - protein, 7 aa, Entamoeba invadens
GNTDPQL

SEQ ID NO: 2757000 - protein, 10 aa, Entamoeba invadens
GNTDSRCSAN

SEQ ID NO: 2757001 - protein, 8 aa, Entamoeba invadens
GNTETQYV

SEQ ID NO: 2757002 - protein, 26 aa, Entamoeba invadens
GNTFKETLNSSYQHYGSPNIGGNDEI

SEQ ID NO: 2757003 - protein, 7 aa, Entamoeba invadens
GNTGGDV

SEQ ID NO: 2757004 - protein, 8 aa, Entamoeba invadens
GNTGKEKL

SEQ ID NO: 2757005 - protein, 6 aa, Entamoeba invadens
GNTISS

SEQ ID NO: 2757006 - protein, 12 aa, Entamoeba invadens
GNTKQVCKRGDK

SEQ ID NO: 2757007 - protein, 8 aa, Entamoeba invadens
GNTLNDTT

SEQ ID NO: 2757008 - protein, 8 aa, Entamoeba invadens
GNTLQKTG

SEQ ID NO: 2757009 - protein, 5 aa, Entamoeba invadens
GNTNG

SEQ ID NO: 2757010 - protein, 6 aa, Entamoeba invadens
GNTNKN

SEQ ID NO: 2757011 - protein, 7 aa, Entamoeba invadens
GNTPNIY

SEQ ID NO: 2757012 - protein, 8 aa, Entamoeba invadens
GNTPTDLT

SEQ ID NO: 2757013 - protein, 11 aa, Entamoeba invadens
GNTSPNSNGLC

SEQ ID NO: 2757014 - protein, 7 aa, Entamoeba invadens
GNTSSAS

SEQ ID NO: 2757015 - protein, 7 aa, Entamoeba invadens
GNTSSSS

SEQ ID NO: 2757016 - protein, 8 aa, Entamoeba invadens
GNTSSSSV

SEQ ID NO: 2757017 - protein, 8 aa, Entamoeba invadens
GNTTSKSM

SEQ ID NO: 2757018 - protein, 5 aa, Entamoeba invadens
GNTVT

SEQ ID NO: 2757019 - protein, 4 aa, Entamoeba invadens
GNTY

SEQ ID NO: 2757020 - protein, 9 aa, Entamoeba invadens
GNVDSTQNS

SEQ ID NO: 2757021 - protein, 6 aa, Entamoeba invadens
GNVEIN

SEQ ID NO: 2757022 - protein, 6 aa, Entamoeba invadens
GNVETN

SEQ ID NO: 2757023 - protein, 16 aa, Entamoeba invadens
GNVGKEAGEGKEVRNS

SEQ ID NO: 2757024 - protein, 4 aa, Entamoeba invadens
GNVN

SEQ ID NO: 2757025 - protein, 9 aa, Entamoeba invadens
GNVQTEIDG

SEQ ID NO: 2757026 - protein, 7 aa, Entamoeba invadens
GNVRPLN

SEQ ID NO: 2757027 - protein, 8 aa, Entamoeba invadens
GNVSEPNV

SEQ ID NO: 2757028 - protein, 9 aa, Entamoeba invadens
GNVSGSSRL

SEQ ID NO: 2757029 - protein, 5 aa, Entamoeba invadens
GNYGA

SEQ ID NO: 2757030 - protein, 9 aa, Entamoeba invadens
GNYIPKDAS

SEQ ID NO: 2757031 - protein, 5 aa, Entamoeba invadens
GNYKG

SEQ ID NO: 2757032 - protein, 7 aa, Entamoeba invadens
GNYLNEN

SEQ ID NO: 2757033 - protein, 9 aa, Entamoeba invadens
GNYPENKTC

SEQ ID NO: 2757034 - protein, 5 aa, Entamoeba invadens
GNYPL

SEQ ID NO: 2757035 - protein, 22 aa, Entamoeba invadens
GNYQEYRTPLPLNGQTSYQTYP

SEQ ID NO: 2757036 - protein, 4 aa, Entamoeba invadens
GNYR

SEQ ID NO: 2757037 - protein, 7 aa, Entamoeba invadens
GNYRDAT

SEQ ID NO: 2757038 - protein, 6 aa, Entamoeba invadens
GNYSKG

SEQ ID NO: 2757039 - protein, 12 aa, Entamoeba invadens
GNYSTGGTGSCK

SEQ ID NO: 2757040 - protein, 6 aa, Entamoeba invadens
GNYSVP

SEQ ID NO: 2757041 - protein, 7 aa, Entamoeba invadens
GNYTEKY

SEQ ID NO: 2757042 - protein, 8 aa, Entamoeba invadens
GPCTPDGK

SEQ ID NO: 2757043 - protein, 9 aa, Entamoeba invadens
GPDRQTTPI

SEQ ID NO: 2757044 - protein, 4 aa, Entamoeba invadens
GPED

SEQ ID NO: 2757045 - protein, 8 aa, Entamoeba invadens
GPEKACQT

SEQ ID NO: 2757046 - protein, 8 aa, Entamoeba invadens
GPESENLG

SEQ ID NO: 2757047 - protein, 7 aa, Entamoeba invadens
GPETNTV

SEQ ID NO: 2757048 - protein, 13 aa, Entamoeba invadens
GPFESTENNSRTM

SEQ ID NO: 2757049 - protein, 4 aa, Entamoeba invadens
GPFG

SEQ ID NO: 2757050 - protein, 4 aa, Entamoeba invadens
GPFT

SEQ ID NO: 2757051 - protein, 6 aa, Entamoeba invadens
GPHPSL

SEQ ID NO: 2757052 - protein, 5 aa, Entamoeba invadens
GPHSN

SEQ ID NO: 2757053 - protein, 8 aa, Entamoeba invadens
GPIESSPF

SEQ ID NO: 2757054 - protein, 5 aa, Entamoeba invadens
GPIPD

SEQ ID NO: 2757055 - protein, 13 aa, Entamoeba invadens
GPIVKESKNKEIG

SEQ ID NO: 2757056 - protein, 12 aa, Entamoeba invadens
GPKDTDSDHRQG

SEQ ID NO: 2757057 - protein, 13 aa, Entamoeba invadens
GPKDTDSDPRQGL

SEQ ID NO: 2757058 - protein, 12 aa, Entamoeba invadens
GPKNCTRPINSE

SEQ ID NO: 2757059 - protein, 6 aa, Entamoeba invadens
GPKPIL

SEQ ID NO: 2757060 - protein, 4 aa, Entamoeba invadens
GPKQ

SEQ ID NO: 2757061 - protein, 4 aa, Entamoeba invadens
GPKR

SEQ ID NO: 2757062 - protein, 5 aa, Entamoeba invadens
GPLKE

SEQ ID NO: 2757063 - protein, 4 aa, Entamoeba invadens
GPNE

SEQ ID NO: 2757064 - protein, 4 aa, Entamoeba invadens
GPNL

SEQ ID NO: 2757065 - protein, 7 aa, Entamoeba invadens
GPNNNTC

SEQ ID NO: 2757066 - protein, 8 aa, Entamoeba invadens
GPNRCKRC

SEQ ID NO: 2757067 - protein, 9 aa, Entamoeba invadens
GPNSCEDNE

SEQ ID NO: 2757068 - protein, 10 aa, Entamoeba invadens
GPNSYQCSTC

SEQ ID NO: 2757069 - protein, 7 aa, Entamoeba invadens
GPNTTTY

SEQ ID NO: 2757070 - protein, 5 aa, Entamoeba invadens
GPPQL

SEQ ID NO: 2757071 - protein, 6 aa, Entamoeba invadens
GPQNLE

SEQ ID NO: 2757072 - protein, 9 aa, Entamoeba invadens
GPQNSGKST

SEQ ID NO: 2757073 - protein, 4 aa, Entamoeba invadens
GPQT

SEQ ID NO: 2757074 - protein, 5 aa, Entamoeba invadens
GPQTT

SEQ ID NO: 2757075 - protein, 11 aa, Entamoeba invadens
GPSDNDDTKPI

SEQ ID NO: 2757076 - protein, 6 aa, Entamoeba invadens
GPSEQK

SEQ ID NO: 2757077 - protein, 8 aa, Entamoeba invadens
GPSGCGKS

SEQ ID NO: 2757078 - protein, 6 aa, Entamoeba invadens
GPSNTI

SEQ ID NO: 2757079 - protein, 4 aa, Entamoeba invadens
GPSQ

SEQ ID NO: 2757080 - protein, 6 aa, Entamoeba invadens
GPSQSQ

SEQ ID NO: 2757081 - protein, 6 aa, Entamoeba invadens
GPSTMS

SEQ ID NO: 2757082 - protein, 7 aa, Entamoeba invadens
GPTESGV

SEQ ID NO: 2757083 - protein, 6 aa, Entamoeba invadens
GPTIKK

SEQ ID NO: 2757084 - protein, 18 aa, Entamoeba invadens
GPTISGGYTTEDIEEEFK

SEQ ID NO: 2757085 - protein, 5 aa, Entamoeba invadens
GPTKT

SEQ ID NO: 2757086 - protein, 8 aa, Entamoeba invadens
GPTNGECN

SEQ ID NO: 2757087 - protein, 5 aa, Entamoeba invadens
GPTQK

SEQ ID NO: 2757088 - protein, 5 aa, Entamoeba invadens
GPTQV

SEQ ID NO: 2757089 - protein, 9 aa, Entamoeba invadens
GPTSAGKTS

SEQ ID NO: 2757090 - protein, 5 aa, Entamoeba invadens
GPYRT

SEQ ID NO: 2757091 - protein, 8 aa, Entamoeba invadens
GQAPSSVI

SEQ ID NO: 2757092 - protein, 9 aa, Entamoeba invadens
GQCDATTGY

SEQ ID NO: 2757093 - protein, 5 aa, Entamoeba invadens
GQCDT

SEQ ID NO: 2757094 - protein, 8 aa, Entamoeba invadens
GQCKSKDD

SEQ ID NO: 2757095 - protein, 7 aa, Entamoeba invadens
GQCTTNK

SEQ ID NO: 2757096 - protein, 5 aa, Entamoeba invadens
GQCYN

SEQ ID NO: 2757097 - protein, 13 aa, Entamoeba invadens
GQDDTHNNTTQLN

SEQ ID NO: 2757098 - protein, 10 aa, Entamoeba invadens
GQDQKELDDP

SEQ ID NO: 2757099 - protein, 9 aa, Entamoeba invadens
GQDSSGSIS

SEQ ID NO: 2757100 - protein, 19 aa, Entamoeba invadens
GQDTTVTPSLQTTKNTSML

SEQ ID NO: 2757101 - protein, 4 aa, Entamoeba invadens
GQEP

SEQ ID NO: 2757102 - protein, 9 aa, Entamoeba invadens
GQEPFKDSG

SEQ ID NO: 2757103 - protein, 4 aa, Entamoeba invadens
GQFA

SEQ ID NO: 2757104 - protein, 10 aa, Entamoeba invadens
GQFQNKNDTI

SEQ ID NO: 2757105 - protein, 7 aa, Entamoeba invadens
GQGHGPN

SEQ ID NO: 2757106 - protein, 7 aa, Entamoeba invadens
GQGICGT

SEQ ID NO: 2757107 - protein, 6 aa, Entamoeba invadens
GQGKSD

SEQ ID NO: 2757108 - protein, 9 aa, Entamoeba invadens
GQGKTSNVY

SEQ ID NO: 2757109 - protein, 4 aa, Entamoeba invadens
GQGN

SEQ ID NO: 2757110 - protein, 10 aa, Entamoeba invadens
GQGNTEDEEI

SEQ ID NO: 2757111 - protein, 6 aa, Entamoeba invadens
GQGTLT

SEQ ID NO: 2757112 - protein, 23 aa, Entamoeba invadens
GQHTKTTGRRGRTVGVSRTKAPS

SEQ ID NO: 2757113 - protein, 7 aa, Entamoeba invadens
GQHTYSR

SEQ ID NO: 2757114 - protein, 5 aa, Entamoeba invadens
GQITT

SEQ ID NO: 2757115 - protein, 40 aa, Entamoeba invadens
GQKDPLFESDEKEFDGIASGEKKKEDNENDEDCEEEERKK

SEQ ID NO: 2757116 - protein, 9 aa, Entamoeba invadens
GQKGNDRID

SEQ ID NO: 2757117 - protein, 6 aa, Entamoeba invadens
GQKGTY

SEQ ID NO: 2757118 - protein, 34 aa, Entamoeba invadens
GQKSKHKEIGKKEGKLKAKEKISKKDEKKRRKSV

SEQ ID NO: 2757119 - protein, 10 aa, Entamoeba invadens
GQKVSDGYVK

SEQ ID NO: 2757120 - protein, 10 aa, Entamoeba invadens
GQKYKTPSDI

SEQ ID NO: 2757121 - protein, 9 aa, Entamoeba invadens
GQKYTSKTD

SEQ ID NO: 2757122 - protein, 9 aa, Entamoeba invadens
GQLDEGEEC

SEQ ID NO: 2757123 - protein, 4 aa, Entamoeba invadens
GQLG

SEQ ID NO: 2757124 - protein, 10 aa, Entamoeba invadens
GQMKSQNHYQ

SEQ ID NO: 2757125 - protein, 8 aa, Entamoeba invadens
GQNDSCAG

SEQ ID NO: 2757126 - protein, 6 aa, Entamoeba invadens
GQNGIG

SEQ ID NO: 2757127 - protein, 5 aa, Entamoeba invadens
GQNKT

SEQ ID NO: 2757128 - protein, 18 aa, Entamoeba invadens
GQNPDERCEIKTVINLLE

SEQ ID NO: 2757129 - protein, 8 aa, Entamoeba invadens
GQNPEERI

SEQ ID NO: 2757130 - protein, 10 aa, Entamoeba invadens
GQNPQNRPRM

SEQ ID NO: 2757131 - protein, 22 aa, Entamoeba invadens
GQNPRERCSSSEVVEQLKLYLG

SEQ ID NO: 2757132 - protein, 6 aa, Entamoeba invadens
GQNSII

SEQ ID NO: 2757133 - protein, 7 aa, Entamoeba invadens
GQPGTDL

SEQ ID NO: 2757134 - protein, 6 aa, Entamoeba invadens
GQPTGM

SEQ ID NO: 2757135 - protein, 11 aa, Entamoeba invadens
GQQATGKEATN

SEQ ID NO: 2757136 - protein, 6 aa, Entamoeba invadens
GQQEQP

SEQ ID NO: 2757137 - protein, 5 aa, Entamoeba invadens
GQRCP

SEQ ID NO: 2757138 - protein, 15 aa, Entamoeba invadens
GQRDNFNKDLKNVED

SEQ ID NO: 2757139 - protein, 6 aa, Entamoeba invadens
GQRDSF

SEQ ID NO: 2757140 - protein, 15 aa, Entamoeba invadens
GQRGAQISGGQKQRI

SEQ ID NO: 2757141 - protein, 7 aa, Entamoeba invadens
GQRKYRA

SEQ ID NO: 2757142 - protein, 10 aa, Entamoeba invadens
GQRLENRENI

SEQ ID NO: 2757143 - protein, 7 aa, Entamoeba invadens
GQRLPKL

SEQ ID NO: 2757144 - protein, 14 aa, Entamoeba invadens
GQRNGATAINDTRY

SEQ ID NO: 2757145 - protein, 6 aa, Entamoeba invadens
GQRRPY

SEQ ID NO: 2757146 - protein, 5 aa, Entamoeba invadens
GQRTK

SEQ ID NO: 2757147 - protein, 5 aa, Entamoeba invadens
GQRVQ

SEQ ID NO: 2757148 - protein, 8 aa, Entamoeba invadens
GQRYTEKA

SEQ ID NO: 2757149 - protein, 5 aa, Entamoeba invadens
GQSDL

SEQ ID NO: 2757150 - protein, 9 aa, Entamoeba invadens
GQSKSGKDF

SEQ ID NO: 2757151 - protein, 7 aa, Entamoeba invadens
GQSPERT

SEQ ID NO: 2757152 - protein, 5 aa, Entamoeba invadens
GQSPH

SEQ ID NO: 2757153 - protein, 10 aa, Entamoeba invadens
GQSPSSVIQG

SEQ ID NO: 2757154 - protein, 5 aa, Entamoeba invadens
GQSYI

SEQ ID NO: 2757155 - protein, 32 aa, Entamoeba invadens
GQTESGITHTESPNPIQGTTQNYQANETQIGQ

SEQ ID NO: 2757156 - protein, 4 aa, Entamoeba invadens
GQTK

SEQ ID NO: 2757157 - protein, 5 aa, Entamoeba invadens
GQTKV

SEQ ID NO: 2757158 - protein, 16 aa, Entamoeba invadens
GQTNNSSPCALNTPAT

SEQ ID NO: 2757159 - protein, 7 aa, Entamoeba invadens
GQTPEKL

SEQ ID NO: 2757160 - protein, 4 aa, Entamoeba invadens
GQTQ

SEQ ID NO: 2757161 - protein, 8 aa, Entamoeba invadens
GQTTNDKI

SEQ ID NO: 2757162 - protein, 12 aa, Entamoeba invadens
GQTTNEKRKKLR

SEQ ID NO: 2757163 - protein, 11 aa, Entamoeba invadens
GQTVNKTNEIQ

SEQ ID NO: 2757164 - protein, 9 aa, Entamoeba invadens
GQVENSTHL

SEQ ID NO: 2757165 - protein, 7 aa, Entamoeba invadens
GQYEYGG

SEQ ID NO: 2757166 - protein, 15 aa, Entamoeba invadens
GQYLTTENTCDSCGA

SEQ ID NO: 2757167 - protein, 9 aa, Entamoeba invadens
GQYSQELAS

SEQ ID NO: 2757168 - protein, 6 aa, Entamoeba invadens
GRAQGS

SEQ ID NO: 2757169 - protein, 18 aa, Entamoeba invadens
GRCNDGQYFNTQSKSCKS

SEQ ID NO: 2757170 - protein, 6 aa, Entamoeba invadens
GRCPEG

SEQ ID NO: 2757171 - protein, 7 aa, Entamoeba invadens
GRCSQNV

SEQ ID NO: 2757172 - protein, 13 aa, Entamoeba invadens
GRCSSDSNCNSCK

SEQ ID NO: 2757173 - protein, 13 aa, Entamoeba invadens
GRCSSESNCNSCE

SEQ ID NO: 2757174 - protein, 4 aa, Entamoeba invadens
GRDR

SEQ ID NO: 2757175 - protein, 11 aa, Entamoeba invadens
GRDTEDNYAYR

SEQ ID NO: 2757176 - protein, 6 aa, Entamoeba invadens
GREEPY

SEQ ID NO: 2757177 - protein, 5 aa, Entamoeba invadens
GRENG

SEQ ID NO: 2757178 - protein, 5 aa, Entamoeba invadens
GRESI

SEQ ID NO: 2757179 - protein, 10 aa, Entamoeba invadens
GRESKQSNTC

SEQ ID NO: 2757180 - protein, 6 aa, Entamoeba invadens
GRETTR

SEQ ID NO: 2757181 - protein, 5 aa, Entamoeba invadens
GRFPS

SEQ ID NO: 2757182 - protein, 9 aa, Entamoeba invadens
GRFSDKNGI

SEQ ID NO: 2757183 - protein, 4 aa, Entamoeba invadens
GRGC

SEQ ID NO: 2757184 - protein, 7 aa, Entamoeba invadens
GRGETLD

SEQ ID NO: 2757185 - protein, 4 aa, Entamoeba invadens
GRGK

SEQ ID NO: 2757186 - protein, 9 aa, Entamoeba invadens
GRGKTNEAM

SEQ ID NO: 2757187 - protein, 8 aa, Entamoeba invadens
GRGNYNSS

SEQ ID NO: 2757188 - protein, 5 aa, Entamoeba invadens
GRGPI

SEQ ID NO: 2757189 - protein, 7 aa, Entamoeba invadens
GRGPSSC

SEQ ID NO: 2757190 - protein, 4 aa, Entamoeba invadens
GRGR

SEQ ID NO: 2757191 - protein, 5 aa, Entamoeba invadens
GRGSA

SEQ ID NO: 2757192 - protein, 12 aa, Entamoeba invadens
GRGTYSSSGSAY

SEQ ID NO: 2757193 - protein, 12 aa, Entamoeba invadens
GRHEPSTDGDEC

SEQ ID NO: 2757194 - protein, 7 aa, Entamoeba invadens
GRIDSES

SEQ ID NO: 2757195 - protein, 6 aa, Entamoeba invadens
GRIDSK

SEQ ID NO: 2757196 - protein, 8 aa, Entamoeba invadens
GRIPTSVS

SEQ ID NO: 2757197 - protein, 8 aa, Entamoeba invadens
GRIPTTSG

SEQ ID NO: 2757198 - protein, 15 aa, Entamoeba invadens
GRKGKEMKSEGKVDD

SEQ ID NO: 2757199 - protein, 7 aa, Entamoeba invadens
GRKGNLS

SEQ ID NO: 2757200 - protein, 7 aa, Entamoeba invadens
GRKGNLT

SEQ ID NO: 2757201 - protein, 5 aa, Entamoeba invadens
GRKNK

SEQ ID NO: 2757202 - protein, 6 aa, Entamoeba invadens
GRKSEM

SEQ ID NO: 2757203 - protein, 6 aa, Entamoeba invadens
GRKVNR

SEQ ID NO: 2757204 - protein, 9 aa, Entamoeba invadens
GRLDPNEEC

SEQ ID NO: 2757205 - protein, 10 aa, Entamoeba invadens
GRLETAKNSM

SEQ ID NO: 2757206 - protein, 12 aa, Entamoeba invadens
GRLQSRRSSTKL

SEQ ID NO: 2757207 - protein, 12 aa, Entamoeba invadens
GRLQSTKAALEL

SEQ ID NO: 2757208 - protein, 4 aa, Entamoeba invadens
GRMS

SEQ ID NO: 2757209 - protein, 9 aa, Entamoeba invadens
GRNASSGVK

SEQ ID NO: 2757210 - protein, 16 aa, Entamoeba invadens
GRNDRSFAPPLVGPTE

SEQ ID NO: 2757211 - protein, 10 aa, Entamoeba invadens
GRNETSCDEN

SEQ ID NO: 2757212 - protein, 10 aa, Entamoeba invadens
GRNGCKKCED

SEQ ID NO: 2757213 - protein, 13 aa, Entamoeba invadens
GRNSETNESIPQR

SEQ ID NO: 2757214 - protein, 5 aa, Entamoeba invadens
GRPEK

SEQ ID NO: 2757215 - protein, 10 aa, Entamoeba invadens
GRPHRQSYKT

SEQ ID NO: 2757216 - protein, 12 aa, Entamoeba invadens
GRPRALNEDNVD

SEQ ID NO: 2757217 - protein, 6 aa, Entamoeba invadens
GRPRPN

SEQ ID NO: 2757218 - protein, 23 aa, Entamoeba invadens
GRRGNLTLDDTNPVPKNQNIEKE

SEQ ID NO: 2757219 - protein, 9 aa, Entamoeba invadens
GRRYSGNPT

SEQ ID NO: 2757220 - protein, 10 aa, Entamoeba invadens
GRSAPTARNM

SEQ ID NO: 2757221 - protein, 5 aa, Entamoeba invadens
GRSFP

SEQ ID NO: 2757222 - protein, 5 aa, Entamoeba invadens
GRSPR

SEQ ID NO: 2757223 - protein, 4 aa, Entamoeba invadens
GRSR

SEQ ID NO: 2757224 - protein, 7 aa, Entamoeba invadens
GRSYNDL

SEQ ID NO: 2757225 - protein, 12 aa, Entamoeba invadens
GRTENSKKATIT

SEQ ID NO: 2757226 - protein, 6 aa, Entamoeba invadens
GRTERI

SEQ ID NO: 2757227 - protein, 5 aa, Entamoeba invadens
GRTEV

SEQ ID NO: 2757228 - protein, 9 aa, Entamoeba invadens
GRTGSGKSS

SEQ ID NO: 2757229 - protein, 6 aa, Entamoeba invadens
GRTIRD

SEQ ID NO: 2757230 - protein, 12 aa, Entamoeba invadens
GRTNDNTTCGNE

SEQ ID NO: 2757231 - protein, 8 aa, Entamoeba invadens
GRTTEIPD

SEQ ID NO: 2757232 - protein, 5 aa, Entamoeba invadens
GRTVS

SEQ ID NO: 2757233 - protein, 4 aa, Entamoeba invadens
GRTY

SEQ ID NO: 2757234 - protein, 8 aa, Entamoeba invadens
GRVPKNFT

SEQ ID NO: 2757235 - protein, 9 aa, Entamoeba invadens
GRVQRTPKT

SEQ ID NO: 2757236 - protein, 4 aa, Entamoeba invadens
GRWK

SEQ ID NO: 2757237 - protein, 7 aa, Entamoeba invadens
GRYGASN

SEQ ID NO: 2757238 - protein, 11 aa, Entamoeba invadens
GRYGGGPNSAA

SEQ ID NO: 2757239 - protein, 5 aa, Entamoeba invadens
GRYLN

SEQ ID NO: 2757240 - protein, 4 aa, Entamoeba invadens
GRYY

SEQ ID NO: 2757241 - protein, 4 aa, Entamoeba invadens
GSAC

SEQ ID NO: 2757242 - protein, 10 aa, Entamoeba invadens
GSADDETRPP

SEQ ID NO: 2757243 - protein, 17 aa, Entamoeba invadens
GSANNKCSKCDDNYKLS

SEQ ID NO: 2757244 - protein, 7 aa, Entamoeba invadens
GSAPSDV

SEQ ID NO: 2757245 - protein, 20 aa, Entamoeba invadens
GSATLSAQSGVSIESSTGTL

SEQ ID NO: 2757246 - protein, 8 aa, Entamoeba invadens
GSATTGRF

SEQ ID NO: 2757247 - protein, 8 aa, Entamoeba invadens
GSATTQHT

SEQ ID NO: 2757248 - protein, 4 aa, Entamoeba invadens
GSCG

SEQ ID NO: 2757249 - protein, 5 aa, Entamoeba invadens
GSCGN

SEQ ID NO: 2757250 - protein, 7 aa, Entamoeba invadens
GSCISQE

SEQ ID NO: 2757251 - protein, 25 aa, Entamoeba invadens
GSCKTTNQLKRDENASDGCNIKTTK

SEQ ID NO: 2757252 - protein, 9 aa, Entamoeba invadens
GSCNKCENN

SEQ ID NO: 2757253 - protein, 4 aa, Entamoeba invadens
GSCQ

SEQ ID NO: 2757254 - protein, 5 aa, Entamoeba invadens
GSCQS

SEQ ID NO: 2757255 - protein, 4 aa, Entamoeba invadens
GSCR

SEQ ID NO: 2757256 - protein, 11 aa, Entamoeba invadens
GSCSGDTTVSG

SEQ ID NO: 2757257 - protein, 14 aa, Entamoeba invadens
GSCSGTTGACTGCS

SEQ ID NO: 2757258 - protein, 12 aa, Entamoeba invadens
GSCSKCPDNYMT

SEQ ID NO: 2757259 - protein, 6 aa, Entamoeba invadens
GSCTEC

SEQ ID NO: 2757260 - protein, 9 aa, Entamoeba invadens
GSCTECNST

SEQ ID NO: 2757261 - protein, 6 aa, Entamoeba invadens
GSCTKD

SEQ ID NO: 2757262 - protein, 10 aa, Entamoeba invadens
GSCTSSEPNK

SEQ ID NO: 2757263 - protein, 6 aa, Entamoeba invadens
GSCTTS

SEQ ID NO: 2757264 - protein, 11 aa, Entamoeba invadens
GSCVENSQITS

SEQ ID NO: 2757265 - protein, 16 aa, Entamoeba invadens
GSDAVRGEKSGNNNYW

SEQ ID NO: 2757266 - protein, 17 aa, Entamoeba invadens
GSDAVRGEKSGNNNYWK

SEQ ID NO: 2757267 - protein, 6 aa, Entamoeba invadens
GSDCQS

SEQ ID NO: 2757268 - protein, 23 aa, Entamoeba invadens
GSDCQSNVSNANIRKTTKPKRNA

SEQ ID NO: 2757269 - protein, 32 aa, Entamoeba invadens
GSDDPNTQHREPENQHTSQQPSQQYQNTTALL

SEQ ID NO: 2757270 - protein, 4 aa, Entamoeba invadens
GSDE

SEQ ID NO: 2757271 - protein, 5 aa, Entamoeba invadens
GSDEI

SEQ ID NO: 2757272 - protein, 7 aa, Entamoeba invadens
GSDEMVS

SEQ ID NO: 2757273 - protein, 22 aa, Entamoeba invadens
GSDEVDSSYAKVNDSDDERHLD

SEQ ID NO: 2757274 - protein, 6 aa, Entamoeba invadens
GSDGAQ

SEQ ID NO: 2757275 - protein, 10 aa, Entamoeba invadens
GSDGCKENCE

SEQ ID NO: 2757276 - protein, 8 aa, Entamoeba invadens
GSDGCREN

SEQ ID NO: 2757277 - protein, 13 aa, Entamoeba invadens
GSDGTKFEVGGEE

SEQ ID NO: 2757278 - protein, 4 aa, Entamoeba invadens
GSDI

SEQ ID NO: 2757279 - protein, 8 aa, Entamoeba invadens
GSDKVKKS

SEQ ID NO: 2757280 - protein, 6 aa, Entamoeba invadens
GSDLQT

SEQ ID NO: 2757281 - protein, 5 aa, Entamoeba invadens
GSDLS

SEQ ID NO: 2757282 - protein, 8 aa, Entamoeba invadens
GSDNETLE

SEQ ID NO: 2757283 - protein, 8 aa, Entamoeba invadens
GSDQCVEK

SEQ ID NO: 2757284 - protein, 6 aa, Entamoeba invadens
GSDQTK

SEQ ID NO: 2757285 - protein, 4 aa, Entamoeba invadens
GSDS

SEQ ID NO: 2757286 - protein, 5 aa, Entamoeba invadens
GSDSF

SEQ ID NO: 2757287 - protein, 10 aa, Entamoeba invadens
GSDTCGTCES

SEQ ID NO: 2757288 - protein, 14 aa, Entamoeba invadens
GSDTTGATRGKEIG

SEQ ID NO: 2757289 - protein, 4 aa, Entamoeba invadens
GSDV

SEQ ID NO: 2757290 - protein, 9 aa, Entamoeba invadens
GSDVPYDTV

SEQ ID NO: 2757291 - protein, 8 aa, Entamoeba invadens
GSDVSDNC

SEQ ID NO: 2757292 - protein, 9 aa, Entamoeba invadens
GSDVSDNCS

SEQ ID NO: 2757293 - protein, 21 aa, Entamoeba invadens
GSECSKNDENCETYKEGSDPL

SEQ ID NO: 2757294 - protein, 9 aa, Entamoeba invadens
GSEEDKDAY

SEQ ID NO: 2757295 - protein, 9 aa, Entamoeba invadens
GSEENVERI

SEQ ID NO: 2757296 - protein, 5 aa, Entamoeba invadens
GSEGC

SEQ ID NO: 2757297 - protein, 7 aa, Entamoeba invadens
GSEITDE

SEQ ID NO: 2757298 - protein, 4 aa, Entamoeba invadens
GSEK

SEQ ID NO: 2757299 - protein, 5 aa, Entamoeba invadens
GSENA

SEQ ID NO: 2757300 - protein, 7 aa, Entamoeba invadens
GSENPIK

SEQ ID NO: 2757301 - protein, 6 aa, Entamoeba invadens
GSERKE

SEQ ID NO: 2757302 - protein, 16 aa, Entamoeba invadens
GSETIKNAGCEESDEQ

SEQ ID NO: 2757303 - protein, 9 aa, Entamoeba invadens
GSETKIRAK

SEQ ID NO: 2757304 - protein, 6 aa, Entamoeba invadens
GSETTT

SEQ ID NO: 2757305 - protein, 5 aa, Entamoeba invadens
GSETY

SEQ ID NO: 2757306 - protein, 5 aa, Entamoeba invadens
GSEYN

SEQ ID NO: 2757307 - protein, 6 aa, Entamoeba invadens
GSEYYK

SEQ ID NO: 2757308 - protein, 13 aa, Entamoeba invadens
GSFDSEKTVTLNE

SEQ ID NO: 2757309 - protein, 4 aa, Entamoeba invadens
GSFE

SEQ ID NO: 2757310 - protein, 8 aa, Entamoeba invadens
GSFEDKSN

SEQ ID NO: 2757311 - protein, 6 aa, Entamoeba invadens
GSFEQT

SEQ ID NO: 2757312 - protein, 4 aa, Entamoeba invadens
GSFG

SEQ ID NO: 2757313 - protein, 9 aa, Entamoeba invadens
GSFQSDGSM

SEQ ID NO: 2757314 - protein, 6 aa, Entamoeba invadens
GSFSDS

SEQ ID NO: 2757315 - protein, 8 aa, Entamoeba invadens
GSFSEGSD

SEQ ID NO: 2757316 - protein, 6 aa, Entamoeba invadens
GSFSQK

SEQ ID NO: 2757317 - protein, 31 aa, Entamoeba invadens
GSFSSSNASLSCTECESGSYANTEASNKCTK

SEQ ID NO: 2757318 - protein, 4 aa, Entamoeba invadens
GSGA

SEQ ID NO: 2757319 - protein, 8 aa, Entamoeba invadens
GSGCKPCG

SEQ ID NO: 2757320 - protein, 6 aa, Entamoeba invadens
GSGCSP

SEQ ID NO: 2757321 - protein, 9 aa, Entamoeba invadens
GSGEAIGTE

SEQ ID NO: 2757322 - protein, 11 aa, Entamoeba invadens
GSGGSKNITAG

SEQ ID NO: 2757323 - protein, 9 aa, Entamoeba invadens
GSGGYSSTT

SEQ ID NO: 2757324 - protein, 9 aa, Entamoeba invadens
GSGIDRSIT

SEQ ID NO: 2757325 - protein, 14 aa, Entamoeba invadens
GSGKRTLSGKSHTI

SEQ ID NO: 2757326 - protein, 7 aa, Entamoeba invadens
GSGNVEG

SEQ ID NO: 2757327 - protein, 5 aa, Entamoeba invadens
GSGSC

SEQ ID NO: 2757328 - protein, 7 aa, Entamoeba invadens
GSGSYGN

SEQ ID NO: 2757329 - protein, 6 aa, Entamoeba invadens
GSGVEV

SEQ ID NO: 2757330 - protein, 5 aa, Entamoeba invadens
GSGVP

SEQ ID NO: 2757331 - protein, 14 aa, Entamoeba invadens
GSGWEQETATQKST

SEQ ID NO: 2757332 - protein, 11 aa, Entamoeba invadens
GSGYYSTVEEG

SEQ ID NO: 2757333 - protein, 11 aa, Entamoeba invadens
GSHAQEDPLPM

SEQ ID NO: 2757334 - protein, 6 aa, Entamoeba invadens
GSIDGN

SEQ ID NO: 2757335 - protein, 6 aa, Entamoeba invadens
GSIETY

SEQ ID NO: 2757336 - protein, 9 aa, Entamoeba invadens
GSIGPNEEC

SEQ ID NO: 2757337 - protein, 9 aa, Entamoeba invadens
GSIKLTKDG

SEQ ID NO: 2757338 - protein, 33 aa, Entamoeba invadens
GSINIQKQSDNDKIEKGGMNKLTGSKNNGTKSD

SEQ ID NO: 2757339 - protein, 11 aa, Entamoeba invadens
GSIPNTSSSSC

SEQ ID NO: 2757340 - protein, 7 aa, Entamoeba invadens
GSIPTSL

SEQ ID NO: 2757341 - protein, 5 aa, Entamoeba invadens
GSIQT

SEQ ID NO: 2757342 - protein, 4 aa, Entamoeba invadens
GSIS

SEQ ID NO: 2757343 - protein, 13 aa, Entamoeba invadens
GSISKKQKSKQHL

SEQ ID NO: 2757344 - protein, 6 aa, Entamoeba invadens
GSISKN

SEQ ID NO: 2757345 - protein, 9 aa, Entamoeba invadens
GSISTQPNS

SEQ ID NO: 2757346 - protein, 4 aa, Entamoeba invadens
GSIT

SEQ ID NO: 2757347 - protein, 22 aa, Entamoeba invadens
GSITVNAQSSITVNAQSNTPCK

SEQ ID NO: 2757348 - protein, 13 aa, Entamoeba invadens
GSKASVGSKPQGQ

SEQ ID NO: 2757349 - protein, 14 aa, Entamoeba invadens
GSKFTTSDTANPIL

SEQ ID NO: 2757350 - protein, 16 aa, Entamoeba invadens
GSKGYSNRKEEPHNPL

SEQ ID NO: 2757351 - protein, 7 aa, Entamoeba invadens
GSKKNSL

SEQ ID NO: 2757352 - protein, 16 aa, Entamoeba invadens
GSKKSEENFGKKGKAL

SEQ ID NO: 2757353 - protein, 15 aa, Entamoeba invadens
GSKLSGTTCTRITEA

SEQ ID NO: 2757354 - protein, 6 aa, Entamoeba invadens
GSKTEV

SEQ ID NO: 2757355 - protein, 10 aa, Entamoeba invadens
GSKTTEKCDT

SEQ ID NO: 2757356 - protein, 16 aa, Entamoeba invadens
GSKTYTTEFSGKYSSS

SEQ ID NO: 2757357 - protein, 15 aa, Entamoeba invadens
GSLDGDIKKPLPNEV

SEQ ID NO: 2757358 - protein, 5 aa, Entamoeba invadens
GSLDH

SEQ ID NO: 2757359 - protein, 6 aa, Entamoeba invadens
GSLKIG

SEQ ID NO: 2757360 - protein, 4 aa, Entamoeba invadens
GSLM

SEQ ID NO: 2757361 - protein, 14 aa, Entamoeba invadens
GSLNVKGESTRLSV

SEQ ID NO: 2757362 - protein, 13 aa, Entamoeba invadens
GSLPPEIKNKCSQ

SEQ ID NO: 2757363 - protein, 5 aa, Entamoeba invadens
GSLQA

SEQ ID NO: 2757364 - protein, 9 aa, Entamoeba invadens
GSMGNDGKN

SEQ ID NO: 2757365 - protein, 4 aa, Entamoeba invadens
GSNC

SEQ ID NO: 2757366 - protein, 13 aa, Entamoeba invadens
GSNCTEWDTNNEC

SEQ ID NO: 2757367 - protein, 15 aa, Entamoeba invadens
GSNDDIEEDLPIEKE

SEQ ID NO: 2757368 - protein, 5 aa, Entamoeba invadens
GSNGL

SEQ ID NO: 2757369 - protein, 14 aa, Entamoeba invadens
GSNGNCTSCKSGNY

SEQ ID NO: 2757370 - protein, 10 aa, Entamoeba invadens
GSNIGKDAKP

SEQ ID NO: 2757371 - protein, 5 aa, Entamoeba invadens
GSNKE

SEQ ID NO: 2757372 - protein, 4 aa, Entamoeba invadens
GSNQ

SEQ ID NO: 2757373 - protein, 5 aa, Entamoeba invadens
GSNQY

SEQ ID NO: 2757374 - protein, 7 aa, Entamoeba invadens
GSNSDWH

SEQ ID NO: 2757375 - protein, 7 aa, Entamoeba invadens
GSNSPYY

SEQ ID NO: 2757376 - protein, 13 aa, Entamoeba invadens
GSNSSSKACGNYG

SEQ ID NO: 2757377 - protein, 7 aa, Entamoeba invadens
GSNTCED

SEQ ID NO: 2757378 - protein, 5 aa, Entamoeba invadens
GSNTL

SEQ ID NO: 2757379 - protein, 5 aa, Entamoeba invadens
GSNYN

SEQ ID NO: 2757380 - protein, 7 aa, Entamoeba invadens
GSPCENR

SEQ ID NO: 2757381 - protein, 4 aa, Entamoeba invadens
GSPI

SEQ ID NO: 2757382 - protein, 6 aa, Entamoeba invadens
GSPIQT

SEQ ID NO: 2757383 - protein, 6 aa, Entamoeba invadens
GSPKGF

SEQ ID NO: 2757384 - protein, 5 aa, Entamoeba invadens
GSPPL

SEQ ID NO: 2757385 - protein, 8 aa, Entamoeba invadens
GSPTSGER

SEQ ID NO: 2757386 - protein, 6 aa, Entamoeba invadens
GSPVSL

SEQ ID NO: 2757387 - protein, 7 aa, Entamoeba invadens
GSQEELN

SEQ ID NO: 2757388 - protein, 14 aa, Entamoeba invadens
GSQLKSKHLTNKHS

SEQ ID NO: 2757389 - protein, 5 aa, Entamoeba invadens
GSQLT

SEQ ID NO: 2757390 - protein, 5 aa, Entamoeba invadens
GSQPG

SEQ ID NO: 2757391 - protein, 7 aa, Entamoeba invadens
GSQTISS

SEQ ID NO: 2757392 - protein, 5 aa, Entamoeba invadens
GSRAF

SEQ ID NO: 2757393 - protein, 10 aa, Entamoeba invadens
GSREAQDNIK

SEQ ID NO: 2757394 - protein, 4 aa, Entamoeba invadens
GSRG

SEQ ID NO: 2757395 - protein, 7 aa, Entamoeba invadens
GSRGVLE

SEQ ID NO: 2757396 - protein, 8 aa, Entamoeba invadens
GSRKSGKS

SEQ ID NO: 2757397 - protein, 12 aa, Entamoeba invadens
GSRNGNQKNKTY

SEQ ID NO: 2757398 - protein, 8 aa, Entamoeba invadens
GSRNGVNS

SEQ ID NO: 2757399 - protein, 6 aa, Entamoeba invadens
GSRVPA

SEQ ID NO: 2757400 - protein, 9 aa, Entamoeba invadens
GSSALNGKC

SEQ ID NO: 2757401 - protein, 19 aa, Entamoeba invadens
GSSALSESLHNSKDGKYET

SEQ ID NO: 2757402 - protein, 5 aa, Entamoeba invadens
GSSCD

SEQ ID NO: 2757403 - protein, 8 aa, Entamoeba invadens
GSSDEVGK

SEQ ID NO: 2757404 - protein, 6 aa, Entamoeba invadens
GSSDVP

SEQ ID NO: 2757405 - protein, 16 aa, Entamoeba invadens
GSSECDRPSTGTTDYE

SEQ ID NO: 2757406 - protein, 15 aa, Entamoeba invadens
GSSFGKKTQVNDTAC

SEQ ID NO: 2757407 - protein, 7 aa, Entamoeba invadens
GSSFGQD

SEQ ID NO: 2757408 - protein, 8 aa, Entamoeba invadens
GSSGAVYD

SEQ ID NO: 2757409 - protein, 9 aa, Entamoeba invadens
GSSGCGKST

SEQ ID NO: 2757410 - protein, 43 aa, Entamoeba invadens
GSSGCTPCAAGTYSSISGSSSCNPCNAGSYSNEGAKTCTGCPG

SEQ ID NO: 2757411 - protein, 11 aa, Entamoeba invadens
GSSISDYSKQK

SEQ ID NO: 2757412 - protein, 19 aa, Entamoeba invadens
GSSLELEGTYSETKVESSE

SEQ ID NO: 2757413 - protein, 8 aa, Entamoeba invadens
GSSNNDSG

SEQ ID NO: 2757414 - protein, 9 aa, Entamoeba invadens
GSSQVDESR

SEQ ID NO: 2757415 - protein, 12 aa, Entamoeba invadens
GSSRTPPSKENR

SEQ ID NO: 2757416 - protein, 9 aa, Entamoeba invadens
GSSSIEMST

SEQ ID NO: 2757417 - protein, 17 aa, Entamoeba invadens
GSSSITETTKAKANDYG

SEQ ID NO: 2757418 - protein, 15 aa, Entamoeba invadens
GSSTCKPKSQKCSDG

SEQ ID NO: 2757419 - protein, 9 aa, Entamoeba invadens
GSSTCKSCA

SEQ ID NO: 2757420 - protein, 26 aa, Entamoeba invadens
GSSTCSNCSAGSYSSSSGSSSCTRCE

SEQ ID NO: 2757421 - protein, 7 aa, Entamoeba invadens
GSSTDIA

SEQ ID NO: 2757422 - protein, 7 aa, Entamoeba invadens
GSSTLRG

SEQ ID NO: 2757423 - protein, 9 aa, Entamoeba invadens
GSSTSECTA

SEQ ID NO: 2757424 - protein, 4 aa, Entamoeba invadens
GSSV

SEQ ID NO: 2757425 - protein, 9 aa, Entamoeba invadens
GSSVEGSDQ

SEQ ID NO: 2757426 - protein, 8 aa, Entamoeba invadens
GSSYLEGA

SEQ ID NO: 2757427 - protein, 6 aa, Entamoeba invadens
GSTCKP

SEQ ID NO: 2757428 - protein, 20 aa, Entamoeba invadens
GSTGALTVNTQTEITGTSES

SEQ ID NO: 2757429 - protein, 10 aa, Entamoeba invadens
GSTGCRQTQT

SEQ ID NO: 2757430 - protein, 6 aa, Entamoeba invadens
GSTIFG

SEQ ID NO: 2757431 - protein, 9 aa, Entamoeba invadens
GSTLKQPPF

SEQ ID NO: 2757432 - protein, 5 aa, Entamoeba invadens
GSTLQ

SEQ ID NO: 2757433 - protein, 11 aa, Entamoeba invadens
GSTPSSTPYGY

SEQ ID NO: 2757434 - protein, 7 aa, Entamoeba invadens
GSTPTTI

SEQ ID NO: 2757435 - protein, 4 aa, Entamoeba invadens
GSTQ

SEQ ID NO: 2757436 - protein, 9 aa, Entamoeba invadens
GSTQQSTRI

SEQ ID NO: 2757437 - protein, 5 aa, Entamoeba invadens
GSTRI

SEQ ID NO: 2757438 - protein, 8 aa, Entamoeba invadens
GSTRTPPC

SEQ ID NO: 2757439 - protein, 15 aa, Entamoeba invadens
GSTSAEPSKEEKYNI

SEQ ID NO: 2757440 - protein, 15 aa, Entamoeba invadens
GSTSDEQKLEKISQT

SEQ ID NO: 2757441 - protein, 12 aa, Entamoeba invadens
GSTSLSSSAPLK

SEQ ID NO: 2757442 - protein, 5 aa, Entamoeba invadens
GSTSY

SEQ ID NO: 2757443 - protein, 4 aa, Entamoeba invadens
GSTT

SEQ ID NO: 2757444 - protein, 7 aa, Entamoeba invadens
GSTTDSG

SEQ ID NO: 2757445 - protein, 5 aa, Entamoeba invadens
GSTTF

SEQ ID NO: 2757446 - protein, 5 aa, Entamoeba invadens
GSTTI

SEQ ID NO: 2757447 - protein, 7 aa, Entamoeba invadens
GSTTQPN

SEQ ID NO: 2757448 - protein, 8 aa, Entamoeba invadens
GSTTTCEN

SEQ ID NO: 2757449 - protein, 9 aa, Entamoeba invadens
GSTTTCESC

SEQ ID NO: 2757450 - protein, 4 aa, Entamoeba invadens
GSTV

SEQ ID NO: 2757451 - protein, 5 aa, Entamoeba invadens
GSTYF

SEQ ID NO: 2757452 - protein, 6 aa, Entamoeba invadens
GSTYQA

SEQ ID NO: 2757453 - protein, 9 aa, Entamoeba invadens
GSVANRQRL

SEQ ID NO: 2757454 - protein, 4 aa, Entamoeba invadens
GSVD

SEQ ID NO: 2757455 - protein, 7 aa, Entamoeba invadens
GSVEEVK

SEQ ID NO: 2757456 - protein, 9 aa, Entamoeba invadens
GSVFSEGNS

SEQ ID NO: 2757457 - protein, 4 aa, Entamoeba invadens
GSVG

SEQ ID NO: 2757458 - protein, 4 aa, Entamoeba invadens
GSVI

SEQ ID NO: 2757459 - protein, 4 aa, Entamoeba invadens
GSVP

SEQ ID NO: 2757460 - protein, 9 aa, Entamoeba invadens
GSVPTHKRT

SEQ ID NO: 2757461 - protein, 6 aa, Entamoeba invadens
GSVTGT

SEQ ID NO: 2757462 - protein, 8 aa, Entamoeba invadens
GSVTVPNT

SEQ ID NO: 2757463 - protein, 12 aa, Entamoeba invadens
GSYEGEDRRNCN

SEQ ID NO: 2757464 - protein, 7 aa, Entamoeba invadens
GSYETVN

SEQ ID NO: 2757465 - protein, 7 aa, Entamoeba invadens
GSYGGDD

SEQ ID NO: 2757466 - protein, 20 aa, Entamoeba invadens
GSYGRMDPELGGEKQFEASG

SEQ ID NO: 2757467 - protein, 16 aa, Entamoeba invadens
GSYISNSKTSSKTSIT

SEQ ID NO: 2757468 - protein, 9 aa, Entamoeba invadens
GSYKDKYKA

SEQ ID NO: 2757469 - protein, 9 aa, Entamoeba invadens
GSYNPTVGQ

SEQ ID NO: 2757470 - protein, 10 aa, Entamoeba invadens
GSYQNTTTTC

SEQ ID NO: 2757471 - protein, 5 aa, Entamoeba invadens
GSYRS

SEQ ID NO: 2757472 - protein, 7 aa, Entamoeba invadens
GSYSFGG

SEQ ID NO: 2757473 - protein, 9 aa, Entamoeba invadens
GSYSGGSVK

SEQ ID NO: 2757474 - protein, 9 aa, Entamoeba invadens
GSYSLGGAS

SEQ ID NO: 2757475 - protein, 7 aa, Entamoeba invadens
GSYSQEG

SEQ ID NO: 2757476 - protein, 6 aa, Entamoeba invadens
GSYTEF

SEQ ID NO: 2757477 - protein, 9 aa, Entamoeba invadens
GTAAPTTVY

SEQ ID NO: 2757478 - protein, 8 aa, Entamoeba invadens
GTAEKDDI

SEQ ID NO: 2757479 - protein, 4 aa, Entamoeba invadens
GTAF

SEQ ID NO: 2757480 - protein, 8 aa, Entamoeba invadens
GTAGNATE

SEQ ID NO: 2757481 - protein, 8 aa, Entamoeba invadens
GTAKIYSE

SEQ ID NO: 2757482 - protein, 4 aa, Entamoeba invadens
GTAL

SEQ ID NO: 2757483 - protein, 5 aa, Entamoeba invadens
GTANL

SEQ ID NO: 2757484 - protein, 7 aa, Entamoeba invadens
GTASSEI

SEQ ID NO: 2757485 - protein, 7 aa, Entamoeba invadens
GTATYDV

SEQ ID NO: 2757486 - protein, 8 aa, Entamoeba invadens
GTCAESGI

SEQ ID NO: 2757487 - protein, 13 aa, Entamoeba invadens
GTCDKTCKIGKTN

SEQ ID NO: 2757488 - protein, 18 aa, Entamoeba invadens
GTCDKTCKTGKADKESMR

SEQ ID NO: 2757489 - protein, 12 aa, Entamoeba invadens
GTCDNKCNTQNG

SEQ ID NO: 2757490 - protein, 5 aa, Entamoeba invadens
GTCDP

SEQ ID NO: 2757491 - protein, 4 aa, Entamoeba invadens
GTCE

SEQ ID NO: 2757492 - protein, 19 aa, Entamoeba invadens
GTCEGAGKYIDNDNACQNC

SEQ ID NO: 2757493 - protein, 11 aa, Entamoeba invadens
GTCEKSYSDPN

SEQ ID NO: 2757494 - protein, 14 aa, Entamoeba invadens
GTCESYGECSQCNS

SEQ ID NO: 2757495 - protein, 19 aa, Entamoeba invadens
GTCETNNNNNVCTPLSGST

SEQ ID NO: 2757496 - protein, 4 aa, Entamoeba invadens
GTCK

SEQ ID NO: 2757497 - protein, 12 aa, Entamoeba invadens
GTCKKNEEGCSI

SEQ ID NO: 2757498 - protein, 10 aa, Entamoeba invadens
GTCKSGGELA

SEQ ID NO: 2757499 - protein, 29 aa, Entamoeba invadens
GTCLKSPNEAYKCNEAATTETDCISSGQN

SEQ ID NO: 2757500 - protein, 4 aa, Entamoeba invadens
GTCN

SEQ ID NO: 2757501 - protein, 7 aa, Entamoeba invadens
GTCNEPD

SEQ ID NO: 2757502 - protein, 7 aa, Entamoeba invadens
GTCNGKD

SEQ ID NO: 2757503 - protein, 10 aa, Entamoeba invadens
GTCQDTSPLN

SEQ ID NO: 2757504 - protein, 4 aa, Entamoeba invadens
GTCR

SEQ ID NO: 2757505 - protein, 16 aa, Entamoeba invadens
GTCSKTCKTGKADKDK

SEQ ID NO: 2757506 - protein, 9 aa, Entamoeba invadens
GTCSPTQGG

SEQ ID NO: 2757507 - protein, 17 aa, Entamoeba invadens
GTCSSCPSKYQTTGVDE

SEQ ID NO: 2757508 - protein, 13 aa, Entamoeba invadens
GTCTDSKQQYCSS

SEQ ID NO: 2757509 - protein, 6 aa, Entamoeba invadens
GTCTEI

SEQ ID NO: 2757510 - protein, 8 aa, Entamoeba invadens
GTCTPRTL

SEQ ID NO: 2757511 - protein, 9 aa, Entamoeba invadens
GTDDGELLA

SEQ ID NO: 2757512 - protein, 10 aa, Entamoeba invadens
GTDDGVEGRP

SEQ ID NO: 2757513 - protein, 9 aa, Entamoeba invadens
GTDETNGTQ

SEQ ID NO: 2757514 - protein, 15 aa, Entamoeba invadens
GTDGSSREDDYSFER

SEQ ID NO: 2757515 - protein, 7 aa, Entamoeba invadens
GTDKELP

SEQ ID NO: 2757516 - protein, 37 aa, Entamoeba invadens
GTDSNQHSDEHHEDQKSISPQPNVDEQLKQQTQQKDV

SEQ ID NO: 2757517 - protein, 5 aa, Entamoeba invadens
GTDSY

SEQ ID NO: 2757518 - protein, 7 aa, Entamoeba invadens
GTDTNPD

SEQ ID NO: 2757519 - protein, 8 aa, Entamoeba invadens
GTDVAKQA

SEQ ID NO: 2757520 - protein, 7 aa, Entamoeba invadens
GTDVAKR

SEQ ID NO: 2757521 - protein, 9 aa, Entamoeba invadens
GTDVQTKEE

SEQ ID NO: 2757522 - protein, 8 aa, Entamoeba invadens
GTDVSDNC

SEQ ID NO: 2757523 - protein, 12 aa, Entamoeba invadens
GTDVTVDTSSID

SEQ ID NO: 2757524 - protein, 5 aa, Entamoeba invadens
GTEAN

SEQ ID NO: 2757525 - protein, 10 aa, Entamoeba invadens
GTECEKDSND

SEQ ID NO: 2757526 - protein, 5 aa, Entamoeba invadens
GTEDK

SEQ ID NO: 2757527 - protein, 4 aa, Entamoeba invadens
GTEE

SEQ ID NO: 2757528 - protein, 8 aa, Entamoeba invadens
GTEEAHEY

SEQ ID NO: 2757529 - protein, 4 aa, Entamoeba invadens
GTEK

SEQ ID NO: 2757530 - protein, 10 aa, Entamoeba invadens
GTEKPNDETT

SEQ ID NO: 2757531 - protein, 9 aa, Entamoeba invadens
GTEKPTPSL

SEQ ID NO: 2757532 - protein, 10 aa, Entamoeba invadens
GTEKPTPSLL

SEQ ID NO: 2757533 - protein, 6 aa, Entamoeba invadens
GTEKQC

SEQ ID NO: 2757534 - protein, 4 aa, Entamoeba invadens
GTEL

SEQ ID NO: 2757535 - protein, 15 aa, Entamoeba invadens
GTEMENTPDSGSMFE

SEQ ID NO: 2757536 - protein, 13 aa, Entamoeba invadens
GTENAVTDVGETR

SEQ ID NO: 2757537 - protein, 8 aa, Entamoeba invadens
GTEPSGEE

SEQ ID NO: 2757538 - protein, 7 aa, Entamoeba invadens
GTESPTR

SEQ ID NO: 2757539 - protein, 8 aa, Entamoeba invadens
GTFANSSS

SEQ ID NO: 2757540 - protein, 7 aa, Entamoeba invadens
GTFKEQN

SEQ ID NO: 2757541 - protein, 17 aa, Entamoeba invadens
GTFQSGNSCYPCGGDNS

SEQ ID NO: 2757542 - protein, 13 aa, Entamoeba invadens
GTFSAAKASSCTS

SEQ ID NO: 2757543 - protein, 13 aa, Entamoeba invadens
GTFSKEKYEKCTE

SEQ ID NO: 2757544 - protein, 21 aa, Entamoeba invadens
GTFSNAGATKCTSCGTNTCSF

SEQ ID NO: 2757545 - protein, 6 aa, Entamoeba invadens
GTFSSS

SEQ ID NO: 2757546 - protein, 5 aa, Entamoeba invadens
GTFTG

SEQ ID NO: 2757547 - protein, 12 aa, Entamoeba invadens
GTGACPETQGVT

SEQ ID NO: 2757548 - protein, 6 aa, Entamoeba invadens
GTGCQS

SEQ ID NO: 2757549 - protein, 5 aa, Entamoeba invadens
GTGEA

SEQ ID NO: 2757550 - protein, 8 aa, Entamoeba invadens
GTGEDPMS

SEQ ID NO: 2757551 - protein, 47 aa, Entamoeba invadens
GTGKGQGMTTKGRSTKGTTHDRRSKKSKKGLSKGGPSKGSGSLSNQD

SEQ ID NO: 2757552 - protein, 9 aa, Entamoeba invadens
GTGPSQSGV

SEQ ID NO: 2757553 - protein, 7 aa, Entamoeba invadens
GTGQYGS

SEQ ID NO: 2757554 - protein, 15 aa, Entamoeba invadens
GTGTQRTVSVDSAKI

SEQ ID NO: 2757555 - protein, 5 aa, Entamoeba invadens
GTGYN

SEQ ID NO: 2757556 - protein, 14 aa, Entamoeba invadens
GTGYNTTKTKRVDE

SEQ ID NO: 2757557 - protein, 16 aa, Entamoeba invadens
GTHCGYDGKAPDNQSP

SEQ ID NO: 2757558 - protein, 16 aa, Entamoeba invadens
GTHCGYDGKVPDNESP

SEQ ID NO: 2757559 - protein, 4 aa, Entamoeba invadens
GTHF

SEQ ID NO: 2757560 - protein, 8 aa, Entamoeba invadens
GTHSISQS

SEQ ID NO: 2757561 - protein, 5 aa, Entamoeba invadens
GTHSY

SEQ ID NO: 2757562 - protein, 13 aa, Entamoeba invadens
GTHSYGTKCDDCE

SEQ ID NO: 2757563 - protein, 8 aa, Entamoeba invadens
GTIAPGTQ

SEQ ID NO: 2757564 - protein, 24 aa, Entamoeba invadens
GTIDDNSNSYEGSTSTDCANGEVT

SEQ ID NO: 2757565 - protein, 10 aa, Entamoeba invadens
GTIKPGESAD

SEQ ID NO: 2757566 - protein, 8 aa, Entamoeba invadens
GTIKPKES

SEQ ID NO: 2757567 - protein, 5 aa, Entamoeba invadens
GTIQN

SEQ ID NO: 2757568 - protein, 8 aa, Entamoeba invadens
GTIRSGEE

SEQ ID NO: 2757569 - protein, 5 aa, Entamoeba invadens
GTITN

SEQ ID NO: 2757570 - protein, 8 aa, Entamoeba invadens
GTIVTDGT

SEQ ID NO: 2757571 - protein, 15 aa, Entamoeba invadens
GTKAAHLKSASFSSY

SEQ ID NO: 2757572 - protein, 15 aa, Entamoeba invadens
GTKATHLKSASFSSY

SEQ ID NO: 2757573 - protein, 4 aa, Entamoeba invadens
GTKC

SEQ ID NO: 2757574 - protein, 9 aa, Entamoeba invadens
GTKESEVNI

SEQ ID NO: 2757575 - protein, 9 aa, Entamoeba invadens
GTKESEVNV

SEQ ID NO: 2757576 - protein, 10 aa, Entamoeba invadens
GTKESEVNVS

SEQ ID NO: 2757577 - protein, 52 aa, Entamoeba invadens
GTKGFTKNSTVESSSRNLTKNATKNMTKNNTTNNSSMTTRDKTAVEKQMDKK

SEQ ID NO: 2757578 - protein, 9 aa, Entamoeba invadens
GTKGMSKKT

SEQ ID NO: 2757579 - protein, 5 aa, Entamoeba invadens
GTKGS

SEQ ID NO: 2757580 - protein, 10 aa, Entamoeba invadens
GTKGVNSKCE

SEQ ID NO: 2757581 - protein, 5 aa, Entamoeba invadens
GTKMN

SEQ ID NO: 2757582 - protein, 15 aa, Entamoeba invadens
GTKNECDSNKYEGSC

SEQ ID NO: 2757583 - protein, 9 aa, Entamoeba invadens
GTKNLGTSV

SEQ ID NO: 2757584 - protein, 6 aa, Entamoeba invadens
GTKPSD

SEQ ID NO: 2757585 - protein, 9 aa, Entamoeba invadens
GTKQCDSDC

SEQ ID NO: 2757586 - protein, 7 aa, Entamoeba invadens
GTKSNKM

SEQ ID NO: 2757587 - protein, 8 aa, Entamoeba invadens
GTKSQYDT

SEQ ID NO: 2757588 - protein, 10 aa, Entamoeba invadens
GTKSSDMFSP

SEQ ID NO: 2757589 - protein, 8 aa, Entamoeba invadens
GTKSYNKS

SEQ ID NO: 2757590 - protein, 4 aa, Entamoeba invadens
GTLC

SEQ ID NO: 2757591 - protein, 12 aa, Entamoeba invadens
GTLGYSSQRTLT

SEQ ID NO: 2757592 - protein, 9 aa, Entamoeba invadens
GTLKPSTAV

SEQ ID NO: 2757593 - protein, 14 aa, Entamoeba invadens
GTLNPKKFRKSNNY

SEQ ID NO: 2757594 - protein, 4 aa, Entamoeba invadens
GTLT

SEQ ID NO: 2757595 - protein, 14 aa, Entamoeba invadens
GTLTQNSTCKQNSI

SEQ ID NO: 2757596 - protein, 9 aa, Entamoeba invadens
GTMANQTTN

SEQ ID NO: 2757597 - protein, 30 aa, Entamoeba invadens
GTMANQTTNKCDTCKAGTYAGEGSSECKSC

SEQ ID NO: 2757598 - protein, 6 aa, Entamoeba invadens
GTNASG

SEQ ID NO: 2757599 - protein, 9 aa, Entamoeba invadens
GTNDPNDCF

SEQ ID NO: 2757600 - protein, 6 aa, Entamoeba invadens
GTNFPT

SEQ ID NO: 2757601 - protein, 9 aa, Entamoeba invadens
GTNKKRCLT

SEQ ID NO: 2757602 - protein, 9 aa, Entamoeba invadens
GTNKTRSSV

SEQ ID NO: 2757603 - protein, 5 aa, Entamoeba invadens
GTNLA

SEQ ID NO: 2757604 - protein, 6 aa, Entamoeba invadens
GTNNEF

SEQ ID NO: 2757605 - protein, 8 aa, Entamoeba invadens
GTNPATNK

SEQ ID NO: 2757606 - protein, 15 aa, Entamoeba invadens
GTNSLKDEECDSGVN

SEQ ID NO: 2757607 - protein, 14 aa, Entamoeba invadens
GTNSLTAEKATGIE

SEQ ID NO: 2757608 - protein, 6 aa, Entamoeba invadens
GTNSNE

SEQ ID NO: 2757609 - protein, 8 aa, Entamoeba invadens
GTNSPYYS

SEQ ID NO: 2757610 - protein, 9 aa, Entamoeba invadens
GTNTKTPVT

SEQ ID NO: 2757611 - protein, 5 aa, Entamoeba invadens
GTNTP

SEQ ID NO: 2757612 - protein, 5 aa, Entamoeba invadens
GTNVT

SEQ ID NO: 2757613 - protein, 4 aa, Entamoeba invadens
GTNY

SEQ ID NO: 2757614 - protein, 5 aa, Entamoeba invadens
GTPAY

SEQ ID NO: 2757615 - protein, 6 aa, Entamoeba invadens
GTPAYM

SEQ ID NO: 2757616 - protein, 15 aa, Entamoeba invadens
GTPCDQLEDGKAYTV

SEQ ID NO: 2757617 - protein, 18 aa, Entamoeba invadens
GTPDELSTETVKEPIMPH

SEQ ID NO: 2757618 - protein, 7 aa, Entamoeba invadens
GTPESPC

SEQ ID NO: 2757619 - protein, 6 aa, Entamoeba invadens
GTPNLR

SEQ ID NO: 2757620 - protein, 8 aa, Entamoeba invadens
GTPPSEDA

SEQ ID NO: 2757621 - protein, 7 aa, Entamoeba invadens
GTPSERP

SEQ ID NO: 2757622 - protein, 5 aa, Entamoeba invadens
GTPSF

SEQ ID NO: 2757623 - protein, 5 aa, Entamoeba invadens
GTPVA

SEQ ID NO: 2757624 - protein, 5 aa, Entamoeba invadens
GTPYW

SEQ ID NO: 2757625 - protein, 11 aa, Entamoeba invadens
GTQGGTKPTLL

SEQ ID NO: 2757626 - protein, 6 aa, Entamoeba invadens
GTQKER

SEQ ID NO: 2757627 - protein, 5 aa, Entamoeba invadens
GTQLD

SEQ ID NO: 2757628 - protein, 5 aa, Entamoeba invadens
GTQNR

SEQ ID NO: 2757629 - protein, 28 aa, Entamoeba invadens
GTQQQQQPAQAQTQENKNVEQNSMPAPT

SEQ ID NO: 2757630 - protein, 6 aa, Entamoeba invadens
GTQRGV

SEQ ID NO: 2757631 - protein, 6 aa, Entamoeba invadens
GTQSGI

SEQ ID NO: 2757632 - protein, 12 aa, Entamoeba invadens
GTQSSGSGSPDF

SEQ ID NO: 2757633 - protein, 8 aa, Entamoeba invadens
GTQSYNKS

SEQ ID NO: 2757634 - protein, 16 aa, Entamoeba invadens
GTQSYSVDSAEEMKDE

SEQ ID NO: 2757635 - protein, 6 aa, Entamoeba invadens
GTQTGC

SEQ ID NO: 2757636 - protein, 9 aa, Entamoeba invadens
GTQTGIKPE

SEQ ID NO: 2757637 - protein, 9 aa, Entamoeba invadens
GTRAKPERI

SEQ ID NO: 2757638 - protein, 15 aa, Entamoeba invadens
GTRDEEDNKRKEEIS

SEQ ID NO: 2757639 - protein, 8 aa, Entamoeba invadens
GTRDENKC

SEQ ID NO: 2757640 - protein, 13 aa, Entamoeba invadens
GTRKSEDYIEEAE

SEQ ID NO: 2757641 - protein, 8 aa, Entamoeba invadens
GTRQTETK

SEQ ID NO: 2757642 - protein, 9 aa, Entamoeba invadens
GTRRHEESY

SEQ ID NO: 2757643 - protein, 22 aa, Entamoeba invadens
GTRSCVSERTTDNCDQMSKAND

SEQ ID NO: 2757644 - protein, 13 aa, Entamoeba invadens
GTRSKQKNDCCKR

SEQ ID NO: 2757645 - protein, 9 aa, Entamoeba invadens
GTRTGDTTK

SEQ ID NO: 2757646 - protein, 14 aa, Entamoeba invadens
GTRVSYSQYNSKAV

SEQ ID NO: 2757647 - protein, 11 aa, Entamoeba invadens
GTSCAKQVGQA

SEQ ID NO: 2757648 - protein, 5 aa, Entamoeba invadens
GTSKA

SEQ ID NO: 2757649 - protein, 7 aa, Entamoeba invadens
GTSPSNC

SEQ ID NO: 2757650 - protein, 7 aa, Entamoeba invadens
GTSQKVA

SEQ ID NO: 2757651 - protein, 4 aa, Entamoeba invadens
GTSR

SEQ ID NO: 2757652 - protein, 22 aa, Entamoeba invadens
GTSRFTKKSIKNREDKGLGTPI

SEQ ID NO: 2757653 - protein, 22 aa, Entamoeba invadens
GTSRFTKKSIKSGEDKGLGTPI

SEQ ID NO: 2757654 - protein, 34 aa, Entamoeba invadens
GTSRFTKKSLKKGEEKGLGTPIYGSPESFRDEYT

SEQ ID NO: 2757655 - protein, 21 aa, Entamoeba invadens
GTSRFTKKSMKKGEEKGLGTP

SEQ ID NO: 2757656 - protein, 21 aa, Entamoeba invadens
GTSRFTKKTIKNNEDRGLGTP

SEQ ID NO: 2757657 - protein, 21 aa, Entamoeba invadens
GTSRFTKKTIKNQDDKGLGTP

SEQ ID NO: 2757658 - protein, 22 aa, Entamoeba invadens
GTSRFTKKTSKNIDDKGLGTPV

SEQ ID NO: 2757659 - protein, 19 aa, Entamoeba invadens
GTSRFTKTTQTNEKGLGTP

SEQ ID NO: 2757660 - protein, 18 aa, Entamoeba invadens
GTSRITKKKTEQDRGLGT

SEQ ID NO: 2757661 - protein, 7 aa, Entamoeba invadens
GTSSGEI

SEQ ID NO: 2757662 - protein, 6 aa, Entamoeba invadens
GTSSMY

SEQ ID NO: 2757663 - protein, 11 aa, Entamoeba invadens
GTSSRYKGRPP

SEQ ID NO: 2757664 - protein, 6 aa, Entamoeba invadens
GTSTIH

SEQ ID NO: 2757665 - protein, 5 aa, Entamoeba invadens
GTSTN

SEQ ID NO: 2757666 - protein, 6 aa, Entamoeba invadens
GTSTNL

SEQ ID NO: 2757667 - protein, 9 aa, Entamoeba invadens
GTSTPESII

SEQ ID NO: 2757668 - protein, 10 aa, Entamoeba invadens
GTSVPVPDGY

SEQ ID NO: 2757669 - protein, 5 aa, Entamoeba invadens
GTSVT

SEQ ID NO: 2757670 - protein, 4 aa, Entamoeba invadens
GTSW

SEQ ID NO: 2757671 - protein, 9 aa, Entamoeba invadens
GTTANGEEV

SEQ ID NO: 2757672 - protein, 13 aa, Entamoeba invadens
GTTCPQRTPPNQM

SEQ ID NO: 2757673 - protein, 12 aa, Entamoeba invadens
GTTCQSCSNTLT

SEQ ID NO: 2757674 - protein, 23 aa, Entamoeba invadens
GTTCTKCKTGCSACDDATTCTAC

SEQ ID NO: 2757675 - protein, 8 aa, Entamoeba invadens
GTTCTKCN

SEQ ID NO: 2757676 - protein, 9 aa, Entamoeba invadens
GTTGNCTRC

SEQ ID NO: 2757677 - protein, 8 aa, Entamoeba invadens
GTTGTAIS

SEQ ID NO: 2757678 - protein, 4 aa, Entamoeba invadens
GTTI

SEQ ID NO: 2757679 - protein, 6 aa, Entamoeba invadens
GTTITA

SEQ ID NO: 2757680 - protein, 6 aa, Entamoeba invadens
GTTITT

SEQ ID NO: 2757681 - protein, 10 aa, Entamoeba invadens
GTTKLPKDTF

SEQ ID NO: 2757682 - protein, 7 aa, Entamoeba invadens
GTTKYAK

SEQ ID NO: 2757683 - protein, 11 aa, Entamoeba invadens
GTTLREENDDP

SEQ ID NO: 2757684 - protein, 4 aa, Entamoeba invadens
GTTN

SEQ ID NO: 2757685 - protein, 6 aa, Entamoeba invadens
GTTNCI

SEQ ID NO: 2757686 - protein, 8 aa, Entamoeba invadens
GTTSEDVG

SEQ ID NO: 2757687 - protein, 11 aa, Entamoeba invadens
GTTSSYCSTTE

SEQ ID NO: 2757688 - protein, 5 aa, Entamoeba invadens
GTTTN

SEQ ID NO: 2757689 - protein, 9 aa, Entamoeba invadens
GTTVGTELD

SEQ ID NO: 2757690 - protein, 9 aa, Entamoeba invadens
GTVEKDSRS

SEQ ID NO: 2757691 - protein, 17 aa, Entamoeba invadens
GTVGKESKPGKEARNSG

SEQ ID NO: 2757692 - protein, 8 aa, Entamoeba invadens
GTVPADTN

SEQ ID NO: 2757693 - protein, 9 aa, Entamoeba invadens
GTVRKDESL

SEQ ID NO: 2757694 - protein, 7 aa, Entamoeba invadens
GTVRPKE

SEQ ID NO: 2757695 - protein, 5 aa, Entamoeba invadens
GTVSC

SEQ ID NO: 2757696 - protein, 5 aa, Entamoeba invadens
GTVSG

SEQ ID NO: 2757697 - protein, 7 aa, Entamoeba invadens
GTVSNTK

SEQ ID NO: 2757698 - protein, 6 aa, Entamoeba invadens
GTVSVG

SEQ ID NO: 2757699 - protein, 14 aa, Entamoeba invadens
GTVTDDKGVTKPSC

SEQ ID NO: 2757700 - protein, 4 aa, Entamoeba invadens
GTVY

SEQ ID NO: 2757701 - protein, 19 aa, Entamoeba invadens
GTYAEDGKWGMGASETNNN

SEQ ID NO: 2757702 - protein, 8 aa, Entamoeba invadens
GTYAGEGF

SEQ ID NO: 2757703 - protein, 27 aa, Entamoeba invadens
GTYANSTNNKCQHCEDKTYQSNEGQTF

SEQ ID NO: 2757704 - protein, 19 aa, Entamoeba invadens
GTYARDGKWGMGASETNNN

SEQ ID NO: 2757705 - protein, 11 aa, Entamoeba invadens
GTYASTPGSTN

SEQ ID NO: 2757706 - protein, 23 aa, Entamoeba invadens
GTYATNGAATCSNCPAGSYSLDG

SEQ ID NO: 2757707 - protein, 5 aa, Entamoeba invadens
GTYEG

SEQ ID NO: 2757708 - protein, 4 aa, Entamoeba invadens
GTYF

SEQ ID NO: 2757709 - protein, 8 aa, Entamoeba invadens
GTYKKTEI

SEQ ID NO: 2757710 - protein, 10 aa, Entamoeba invadens
GTYKKTETAC

SEQ ID NO: 2757711 - protein, 10 aa, Entamoeba invadens
GTYKNTETSC

SEQ ID NO: 2757712 - protein, 6 aa, Entamoeba invadens
GTYKST

SEQ ID NO: 2757713 - protein, 6 aa, Entamoeba invadens
GTYLNK

SEQ ID NO: 2757714 - protein, 23 aa, Entamoeba invadens
GTYLTKQNTCNSCGTSNAVCTTQ

SEQ ID NO: 2757715 - protein, 23 aa, Entamoeba invadens
GTYLTNQNTCDSCGGSNAVCSTQ

SEQ ID NO: 2757716 - protein, 14 aa, Entamoeba invadens
GTYLTNQNTCDSCV

SEQ ID NO: 2757717 - protein, 4 aa, Entamoeba invadens
GTYN

SEQ ID NO: 2757718 - protein, 22 aa, Entamoeba invadens
GTYNSQNGSTCKECPNNTYSGI

SEQ ID NO: 2757719 - protein, 5 aa, Entamoeba invadens
GTYPL

SEQ ID NO: 2757720 - protein, 12 aa, Entamoeba invadens
GTYQNETGQSEC

SEQ ID NO: 2757721 - protein, 6 aa, Entamoeba invadens
GTYQNG

SEQ ID NO: 2757722 - protein, 10 aa, Entamoeba invadens
GTYQNSTEGT

SEQ ID NO: 2757723 - protein, 6 aa, Entamoeba invadens
GTYQSG

SEQ ID NO: 2757724 - protein, 9 aa, Entamoeba invadens
GTYRKGNSC

SEQ ID NO: 2757725 - protein, 4 aa, Entamoeba invadens
GTYS

SEQ ID NO: 2757726 - protein, 14 aa, Entamoeba invadens
GTYSAEGAANCTNC

SEQ ID NO: 2757727 - protein, 9 aa, Entamoeba invadens
GTYSAEGAS

SEQ ID NO: 2757728 - protein, 11 aa, Entamoeba invadens
GTYSASGSSSC

SEQ ID NO: 2757729 - protein, 25 aa, Entamoeba invadens
GTYSDKDGATQCETCPPRTYSEYGA

SEQ ID NO: 2757730 - protein, 27 aa, Entamoeba invadens
GTYSEHNATSCTSCGDDTYSKEGATRC

SEQ ID NO: 2757731 - protein, 28 aa, Entamoeba invadens
GTYSEQNATSCTSCGDGTYSKEGATSCT

SEQ ID NO: 2757732 - protein, 5 aa, Entamoeba invadens
GTYSI

SEQ ID NO: 2757733 - protein, 43 aa, Entamoeba invadens
GTYSKANSSKCTNCSAGYYSSASAASCTSCKNGYYNPSTGQST

SEQ ID NO: 2757734 - protein, 8 aa, Entamoeba invadens
GTYSKGKF

SEQ ID NO: 2757735 - protein, 15 aa, Entamoeba invadens
GTYSLDGASSCDQCP

SEQ ID NO: 2757736 - protein, 9 aa, Entamoeba invadens
GTYSLNQST

SEQ ID NO: 2757737 - protein, 17 aa, Entamoeba invadens
GTYSLPKSSSCTSCSEG

SEQ ID NO: 2757738 - protein, 8 aa, Entamoeba invadens
GTYSLTGS

SEQ ID NO: 2757739 - protein, 25 aa, Entamoeba invadens
GTYSNAGASGCSNCGQGSYSNEGSS

SEQ ID NO: 2757740 - protein, 9 aa, Entamoeba invadens
GTYSNERST

SEQ ID NO: 2757741 - protein, 12 aa, Entamoeba invadens
GTYSNGDEKEVC

SEQ ID NO: 2757742 - protein, 11 aa, Entamoeba invadens
GTYSNGDKKEF

SEQ ID NO: 2757743 - protein, 11 aa, Entamoeba invadens
GTYSNSDGTSC

SEQ ID NO: 2757744 - protein, 30 aa, Entamoeba invadens
GTYSNTGSTSCSDCEGGTYSNEGSSTCTNC

SEQ ID NO: 2757745 - protein, 10 aa, Entamoeba invadens
GTYSPGSDDS

SEQ ID NO: 2757746 - protein, 61 aa, Entamoeba invadens
GTYSSGGSTTSCTSCSAGTYSYSGASQCSKCPAGYYSSSRGSASCSQCSAGTYNSFSGSTS

SEQ ID NO: 2757747 - protein, 83 aa, Entamoeba invadens
GTYSSGGTPTSCTSCSAGTYSATGSSSCAKCSAGTYSISGSSGCNKCNPGTYNSFSGSVSCSSCSAGYYSNSGASSCNSCGAG

SEQ ID NO: 2757748 - protein, 11 aa, Entamoeba invadens
GTYSSGGTTTS

SEQ ID NO: 2757749 - protein, 12 aa, Entamoeba invadens
GTYSSGGTTTSC

SEQ ID NO: 2757750 - protein, 31 aa, Entamoeba invadens
GTYSSGSAKTACTSCTAGTYSKSNSSECTNC

SEQ ID NO: 2757751 - protein, 12 aa, Entamoeba invadens
GTYSSLKGSSSC

SEQ ID NO: 2757752 - protein, 27 aa, Entamoeba invadens
GTYSSSGASSCTKCPAGYYSSSGSTSC

SEQ ID NO: 2757753 - protein, 27 aa, Entamoeba invadens
GTYSSSGASSCTKCPAGYYSSTSGSFT

SEQ ID NO: 2757754 - protein, 10 aa, Entamoeba invadens
GTYSSSGSSI

SEQ ID NO: 2757755 - protein, 13 aa, Entamoeba invadens
GTYSSSPKSLRCD

SEQ ID NO: 2757756 - protein, 13 aa, Entamoeba invadens
GTYSSSQKSLKCD

SEQ ID NO: 2757757 - protein, 12 aa, Entamoeba invadens
GTYSSSSGSTTC

SEQ ID NO: 2757758 - protein, 28 aa, Entamoeba invadens
GTYSSSYGSTSCSNCAAGTYSASGASSC

SEQ ID NO: 2757759 - protein, 15 aa, Entamoeba invadens
GTYSSTGASSCTKCS

SEQ ID NO: 2757760 - protein, 10 aa, Entamoeba invadens
GTYSTDGASN

SEQ ID NO: 2757761 - protein, 5 aa, Entamoeba invadens
GTYSY

SEQ ID NO: 2757762 - protein, 11 aa, Entamoeba invadens
GTYTNTQGSQI

SEQ ID NO: 2757763 - protein, 8 aa, Entamoeba invadens
GTYTPNTG

SEQ ID NO: 2757764 - protein, 4 aa, Entamoeba invadens
GVAE

SEQ ID NO: 2757765 - protein, 13 aa, Entamoeba invadens
GVAGDQQSSLYGH

SEQ ID NO: 2757766 - protein, 4 aa, Entamoeba invadens
GVAN

SEQ ID NO: 2757767 - protein, 8 aa, Entamoeba invadens
GVCESTPS

SEQ ID NO: 2757768 - protein, 13 aa, Entamoeba invadens
GVCSTCKSGYTLK

SEQ ID NO: 2757769 - protein, 10 aa, Entamoeba invadens
GVDDDQDCTK

SEQ ID NO: 2757770 - protein, 13 aa, Entamoeba invadens
GVDENGNCANHVE

SEQ ID NO: 2757771 - protein, 9 aa, Entamoeba invadens
GVDGDCEAK

SEQ ID NO: 2757772 - protein, 4 aa, Entamoeba invadens
GVDN

SEQ ID NO: 2757773 - protein, 5 aa, Entamoeba invadens
GVDRA

SEQ ID NO: 2757774 - protein, 7 aa, Entamoeba invadens
GVDTKNL

SEQ ID NO: 2757775 - protein, 4 aa, Entamoeba invadens
GVDV

SEQ ID NO: 2757776 - protein, 6 aa, Entamoeba invadens
GVEEYT

SEQ ID NO: 2757777 - protein, 7 aa, Entamoeba invadens
GVEGEQD

SEQ ID NO: 2757778 - protein, 4 aa, Entamoeba invadens
GVEI

SEQ ID NO: 2757779 - protein, 13 aa, Entamoeba invadens
GVEIGESNTRELA

SEQ ID NO: 2757780 - protein, 9 aa, Entamoeba invadens
GVEKCSKRC

SEQ ID NO: 2757781 - protein, 6 aa, Entamoeba invadens
GVETES

SEQ ID NO: 2757782 - protein, 11 aa, Entamoeba invadens
GVEVRTESTII

SEQ ID NO: 2757783 - protein, 6 aa, Entamoeba invadens
GVGERL

SEQ ID NO: 2757784 - protein, 9 aa, Entamoeba invadens
GVGESGTIE

SEQ ID NO: 2757785 - protein, 6 aa, Entamoeba invadens
GVGGQY

SEQ ID NO: 2757786 - protein, 4 aa, Entamoeba invadens
GVGK

SEQ ID NO: 2757787 - protein, 6 aa, Entamoeba invadens
GVGNSR

SEQ ID NO: 2757788 - protein, 11 aa, Entamoeba invadens
GVGRGASYSPY

SEQ ID NO: 2757789 - protein, 10 aa, Entamoeba invadens
GVGSTRYAIE

SEQ ID NO: 2757790 - protein, 6 aa, Entamoeba invadens
GVGTPA

SEQ ID NO: 2757791 - protein, 8 aa, Entamoeba invadens
GVGTPNYM

SEQ ID NO: 2757792 - protein, 11 aa, Entamoeba invadens
GVGTPTYTAPE

SEQ ID NO: 2757793 - protein, 6 aa, Entamoeba invadens
GVGTPV

SEQ ID NO: 2757794 - protein, 12 aa, Entamoeba invadens
GVHRGAEETFDV

SEQ ID NO: 2757795 - protein, 5 aa, Entamoeba invadens
GVKDR

SEQ ID NO: 2757796 - protein, 15 aa, Entamoeba invadens
GVKEKNKTYNSIKSI

SEQ ID NO: 2757797 - protein, 7 aa, Entamoeba invadens
GVKESDQ

SEQ ID NO: 2757798 - protein, 11 aa, Entamoeba invadens
GVKSDTETREV

SEQ ID NO: 2757799 - protein, 8 aa, Entamoeba invadens
GVKSSPGI

SEQ ID NO: 2757800 - protein, 11 aa, Entamoeba invadens
GVLNSAQDEFN

SEQ ID NO: 2757801 - protein, 15 aa, Entamoeba invadens
GVNAPKKADFIGSDG

SEQ ID NO: 2757802 - protein, 7 aa, Entamoeba invadens
GVNGNCS

SEQ ID NO: 2757803 - protein, 6 aa, Entamoeba invadens
GVNKPI

SEQ ID NO: 2757804 - protein, 8 aa, Entamoeba invadens
GVNLTESQ

SEQ ID NO: 2757805 - protein, 11 aa, Entamoeba invadens
GVNPSLDENNY

SEQ ID NO: 2757806 - protein, 6 aa, Entamoeba invadens
GVNTIT

SEQ ID NO: 2757807 - protein, 5 aa, Entamoeba invadens
GVNTQ

SEQ ID NO: 2757808 - protein, 5 aa, Entamoeba invadens
GVNYE

SEQ ID NO: 2757809 - protein, 5 aa, Entamoeba invadens
GVPDY

SEQ ID NO: 2757810 - protein, 16 aa, Entamoeba invadens
GVPKQNLNVKNEENED

SEQ ID NO: 2757811 - protein, 4 aa, Entamoeba invadens
GVPQ

SEQ ID NO: 2757812 - protein, 6 aa, Entamoeba invadens
GVPTPM

SEQ ID NO: 2757813 - protein, 5 aa, Entamoeba invadens
GVQPV

SEQ ID NO: 2757814 - protein, 4 aa, Entamoeba invadens
GVRG

SEQ ID NO: 2757815 - protein, 7 aa, Entamoeba invadens
GVRGTRG

SEQ ID NO: 2757816 - protein, 5 aa, Entamoeba invadens
GVRTS

SEQ ID NO: 2757817 - protein, 12 aa, Entamoeba invadens
GVSDDEKMNEFD

SEQ ID NO: 2757818 - protein, 5 aa, Entamoeba invadens
GVSDT

SEQ ID NO: 2757819 - protein, 6 aa, Entamoeba invadens
GVSGLG

SEQ ID NO: 2757820 - protein, 8 aa, Entamoeba invadens
GVSHSTCE

SEQ ID NO: 2757821 - protein, 10 aa, Entamoeba invadens
GVSLTKSDCD

SEQ ID NO: 2757822 - protein, 18 aa, Entamoeba invadens
GVSNEDENDQRNKEKNTL

SEQ ID NO: 2757823 - protein, 6 aa, Entamoeba invadens
GVSNGI

SEQ ID NO: 2757824 - protein, 4 aa, Entamoeba invadens
GVSP

SEQ ID NO: 2757825 - protein, 6 aa, Entamoeba invadens
GVSPPG

SEQ ID NO: 2757826 - protein, 9 aa, Entamoeba invadens
GVSQKSKAT

SEQ ID NO: 2757827 - protein, 5 aa, Entamoeba invadens
GVSSN

SEQ ID NO: 2757828 - protein, 15 aa, Entamoeba invadens
GVSSYRNSQEDGVQP

SEQ ID NO: 2757829 - protein, 8 aa, Entamoeba invadens
GVSTEKVE

SEQ ID NO: 2757830 - protein, 15 aa, Entamoeba invadens
GVSTGDGAPSIKGVS

SEQ ID NO: 2757831 - protein, 12 aa, Entamoeba invadens
GVSTGNGAPSII

SEQ ID NO: 2757832 - protein, 6 aa, Entamoeba invadens
GVTDDG

SEQ ID NO: 2757833 - protein, 10 aa, Entamoeba invadens
GVTDGSCSRC

SEQ ID NO: 2757834 - protein, 15 aa, Entamoeba invadens
GVTEEGNHGGDTVRE

SEQ ID NO: 2757835 - protein, 28 aa, Entamoeba invadens
GVTESKCQMRDNKGCQRCNDGYYDENNE

SEQ ID NO: 2757836 - protein, 5 aa, Entamoeba invadens
GVTKI

SEQ ID NO: 2757837 - protein, 8 aa, Entamoeba invadens
GVTNPDQL

SEQ ID NO: 2757838 - protein, 12 aa, Entamoeba invadens
GVTNQSTRIATT

SEQ ID NO: 2757839 - protein, 8 aa, Entamoeba invadens
GVTPPSKK

SEQ ID NO: 2757840 - protein, 9 aa, Entamoeba invadens
GVTQQTTRI

SEQ ID NO: 2757841 - protein, 5 aa, Entamoeba invadens
GVTSQ

SEQ ID NO: 2757842 - protein, 26 aa, Entamoeba invadens
GVVADGPEISTSHDNDTYPMEKTTKE

SEQ ID NO: 2757843 - protein, 6 aa, Entamoeba invadens
GVVENG

SEQ ID NO: 2757844 - protein, 5 aa, Entamoeba invadens
GVVPN

SEQ ID NO: 2757845 - protein, 6 aa, Entamoeba invadens
GWDRTS

SEQ ID NO: 2757846 - protein, 6 aa, Entamoeba invadens
GWGPGV

SEQ ID NO: 2757847 - protein, 7 aa, Entamoeba invadens
GWNSNTK

SEQ ID NO: 2757848 - protein, 7 aa, Entamoeba invadens
GWRPSPV

SEQ ID NO: 2757849 - protein, 4 aa, Entamoeba invadens
GWSV

SEQ ID NO: 2757850 - protein, 4 aa, Entamoeba invadens
GYAL

SEQ ID NO: 2757851 - protein, 12 aa, Entamoeba invadens
GYANFKTSAPID

SEQ ID NO: 2757852 - protein, 13 aa, Entamoeba invadens
GYAPTSDRTSCKA

SEQ ID NO: 2757853 - protein, 4 aa, Entamoeba invadens
GYAS

SEQ ID NO: 2757854 - protein, 17 aa, Entamoeba invadens
GYCSSCEDGFKTKENKC

SEQ ID NO: 2757855 - protein, 9 aa, Entamoeba invadens
GYCSTDEGK

SEQ ID NO: 2757856 - protein, 9 aa, Entamoeba invadens
GYDDPQCTS

SEQ ID NO: 2757857 - protein, 7 aa, Entamoeba invadens
GYDNDNS

SEQ ID NO: 2757858 - protein, 5 aa, Entamoeba invadens
GYDSN

SEQ ID NO: 2757859 - protein, 7 aa, Entamoeba invadens
GYDSTEP

SEQ ID NO: 2757860 - protein, 9 aa, Entamoeba invadens
GYDTSSFNE

SEQ ID NO: 2757861 - protein, 4 aa, Entamoeba invadens
GYEN

SEQ ID NO: 2757862 - protein, 7 aa, Entamoeba invadens
GYENDGS

SEQ ID NO: 2757863 - protein, 11 aa, Entamoeba invadens
GYENEQIGAET

SEQ ID NO: 2757864 - protein, 11 aa, Entamoeba invadens
GYEPSEDGQSC

SEQ ID NO: 2757865 - protein, 9 aa, Entamoeba invadens
GYERQNGQC

SEQ ID NO: 2757866 - protein, 18 aa, Entamoeba invadens
GYETQEFDTTCHKSKSNV

SEQ ID NO: 2757867 - protein, 34 aa, Entamoeba invadens
GYFGDDSRTTQDHSLEEDETSKGTIKKQQMTEEN

SEQ ID NO: 2757868 - protein, 9 aa, Entamoeba invadens
GYFPQSDGR

SEQ ID NO: 2757869 - protein, 4 aa, Entamoeba invadens
GYGF

SEQ ID NO: 2757870 - protein, 7 aa, Entamoeba invadens
GYGFNSG

SEQ ID NO: 2757871 - protein, 6 aa, Entamoeba invadens
GYGGSN

SEQ ID NO: 2757872 - protein, 13 aa, Entamoeba invadens
GYGKDMAETYAKN

SEQ ID NO: 2757873 - protein, 8 aa, Entamoeba invadens
GYGKNSNV

SEQ ID NO: 2757874 - protein, 4 aa, Entamoeba invadens
GYGL

SEQ ID NO: 2757875 - protein, 16 aa, Entamoeba invadens
GYGNDESGQCKPCESG

SEQ ID NO: 2757876 - protein, 5 aa, Entamoeba invadens
GYGNN

SEQ ID NO: 2757877 - protein, 10 aa, Entamoeba invadens
GYGPDGPWTE

SEQ ID NO: 2757878 - protein, 5 aa, Entamoeba invadens
GYGTK

SEQ ID NO: 2757879 - protein, 5 aa, Entamoeba invadens
GYGYE

SEQ ID NO: 2757880 - protein, 12 aa, Entamoeba invadens
GYGYSNGECTPC

SEQ ID NO: 2757881 - protein, 6 aa, Entamoeba invadens
GYHPND

SEQ ID NO: 2757882 - protein, 13 aa, Entamoeba invadens
GYHQTDAKNVEDK

SEQ ID NO: 2757883 - protein, 17 aa, Entamoeba invadens
GYHTTFNTDGNTANCED

SEQ ID NO: 2757884 - protein, 7 aa, Entamoeba invadens
GYHTTNN

SEQ ID NO: 2757885 - protein, 7 aa, Entamoeba invadens
GYHYNNS

SEQ ID NO: 2757886 - protein, 9 aa, Entamoeba invadens
GYIQTDSNI

SEQ ID NO: 2757887 - protein, 4 aa, Entamoeba invadens
GYIR

SEQ ID NO: 2757888 - protein, 13 aa, Entamoeba invadens
GYIRDNDQCVKKG

SEQ ID NO: 2757889 - protein, 9 aa, Entamoeba invadens
GYISTATTS

SEQ ID NO: 2757890 - protein, 12 aa, Entamoeba invadens
GYITNSNNCQKC

SEQ ID NO: 2757891 - protein, 10 aa, Entamoeba invadens
GYKAEKKRRC

SEQ ID NO: 2757892 - protein, 12 aa, Entamoeba invadens
GYKGGECDGGNI

SEQ ID NO: 2757893 - protein, 19 aa, Entamoeba invadens
GYKRSTDGTSCDKCDESCE

SEQ ID NO: 2757894 - protein, 4 aa, Entamoeba invadens
GYKT

SEQ ID NO: 2757895 - protein, 11 aa, Entamoeba invadens
GYKTFKPNVTI

SEQ ID NO: 2757896 - protein, 23 aa, Entamoeba invadens
GYKTISSPNNGERYFGTDSPKKF

SEQ ID NO: 2757897 - protein, 12 aa, Entamoeba invadens
GYLQRSDERYKT

SEQ ID NO: 2757898 - protein, 7 aa, Entamoeba invadens
GYLSNTT

SEQ ID NO: 2757899 - protein, 10 aa, Entamoeba invadens
GYMRSSDGKQ

SEQ ID NO: 2757900 - protein, 12 aa, Entamoeba invadens
GYMRSSDGKQCV

SEQ ID NO: 2757901 - protein, 11 aa, Entamoeba invadens
GYMRSSDGSTC

SEQ ID NO: 2757902 - protein, 9 aa, Entamoeba invadens
GYNADGRGK

SEQ ID NO: 2757903 - protein, 8 aa, Entamoeba invadens
GYNAYNGS

SEQ ID NO: 2757904 - protein, 9 aa, Entamoeba invadens
GYNDTQCTS

SEQ ID NO: 2757905 - protein, 10 aa, Entamoeba invadens
GYNENKKEPE

SEQ ID NO: 2757906 - protein, 17 aa, Entamoeba invadens
GYNKPSESGDSCIQTTN

SEQ ID NO: 2757907 - protein, 22 aa, Entamoeba invadens
GYNNSQSSINSNCKNHPSTGYF

SEQ ID NO: 2757908 - protein, 25 aa, Entamoeba invadens
GYNPNKSEEDKKAAIERETFGKEKG

SEQ ID NO: 2757909 - protein, 6 aa, Entamoeba invadens
GYPKEF

SEQ ID NO: 2757910 - protein, 11 aa, Entamoeba invadens
GYQANQTSEKC

SEQ ID NO: 2757911 - protein, 5 aa, Entamoeba invadens
GYQKD

SEQ ID NO: 2757912 - protein, 5 aa, Entamoeba invadens
GYQKG

SEQ ID NO: 2757913 - protein, 4 aa, Entamoeba invadens
GYQL

SEQ ID NO: 2757914 - protein, 7 aa, Entamoeba invadens
GYQLSGG

SEQ ID NO: 2757915 - protein, 9 aa, Entamoeba invadens
GYQNESGKT

SEQ ID NO: 2757916 - protein, 8 aa, Entamoeba invadens
GYQPNENG

SEQ ID NO: 2757917 - protein, 7 aa, Entamoeba invadens
GYRNVDG

SEQ ID NO: 2757918 - protein, 13 aa, Entamoeba invadens
GYRPRGNGKCYDS

SEQ ID NO: 2757919 - protein, 7 aa, Entamoeba invadens
GYRSFSD

SEQ ID NO: 2757920 - protein, 4 aa, Entamoeba invadens
GYSE

SEQ ID NO: 2757921 - protein, 9 aa, Entamoeba invadens
GYSEYTNTS

SEQ ID NO: 2757922 - protein, 13 aa, Entamoeba invadens
GYSFDDKGSCQYN

SEQ ID NO: 2757923 - protein, 5 aa, Entamoeba invadens
GYSFG

SEQ ID NO: 2757924 - protein, 11 aa, Entamoeba invadens
GYSGEKDGKSV

SEQ ID NO: 2757925 - protein, 4 aa, Entamoeba invadens
GYSL

SEQ ID NO: 2757926 - protein, 7 aa, Entamoeba invadens
GYSNVKE

SEQ ID NO: 2757927 - protein, 7 aa, Entamoeba invadens
GYSPQLV

SEQ ID NO: 2757928 - protein, 7 aa, Entamoeba invadens
GYSPRGY

SEQ ID NO: 2757929 - protein, 12 aa, Entamoeba invadens
GYSRNDDSSINN

SEQ ID NO: 2757930 - protein, 11 aa, Entamoeba invadens
GYSTSDNVGHT

SEQ ID NO: 2757931 - protein, 8 aa, Entamoeba invadens
GYSTTSGT

SEQ ID NO: 2757932 - protein, 6 aa, Entamoeba invadens
GYTDPY

SEQ ID NO: 2757933 - protein, 13 aa, Entamoeba invadens
GYTFNSTDGTCAR

SEQ ID NO: 2757934 - protein, 17 aa, Entamoeba invadens
GYTKPVSDNQTCDSCST

SEQ ID NO: 2757935 - protein, 16 aa, Entamoeba invadens
GYTKTVSDNQTCDSCS

SEQ ID NO: 2757936 - protein, 4 aa, Entamoeba invadens
GYTL

SEQ ID NO: 2757937 - protein, 8 aa, Entamoeba invadens
GYTLENEE

SEQ ID NO: 2757938 - protein, 8 aa, Entamoeba invadens
GYTLENGG

SEQ ID NO: 2757939 - protein, 4 aa, Entamoeba invadens
GYTN

SEQ ID NO: 2757940 - protein, 9 aa, Entamoeba invadens
GYTNTPSGY

SEQ ID NO: 2757941 - protein, 14 aa, Entamoeba invadens
GYTPLNKDTSTNCV

SEQ ID NO: 2757942 - protein, 10 aa, Entamoeba invadens
GYTPSDTGLE

SEQ ID NO: 2757943 - protein, 12 aa, Entamoeba invadens
GYTPTTTSSCER

SEQ ID NO: 2757944 - protein, 9 aa, Entamoeba invadens
GYTRRGGKY

SEQ ID NO: 2757945 - protein, 13 aa, Entamoeba invadens
GYVEATTASEGCT

SEQ ID NO: 2757946 - protein, 12 aa, Entamoeba invadens
GYVKNEKEQCES

SEQ ID NO: 2757947 - protein, 11 aa, Entamoeba invadens
GYVNNSTNCQK

SEQ ID NO: 2757948 - protein, 9 aa, Entamoeba invadens
GYVPYNPTQ

SEQ ID NO: 2757949 - protein, 7 aa, Entamoeba invadens
GYVQEQG

SEQ ID NO: 2757950 - protein, 5 aa, Entamoeba invadens
GYVQT

SEQ ID NO: 2757951 - protein, 4 aa, Entamoeba invadens
GYYA

SEQ ID NO: 2757952 - protein, 10 aa, Entamoeba invadens
GYYANSSVSS

SEQ ID NO: 2757953 - protein, 13 aa, Entamoeba invadens
GYYATNSGCKPCQ

SEQ ID NO: 2757954 - protein, 6 aa, Entamoeba invadens
GYYEDS

SEQ ID NO: 2757955 - protein, 29 aa, Entamoeba invadens
GYYGDRNNKCNKCNTKCTECTTNSEKCQS

SEQ ID NO: 2757956 - protein, 4 aa, Entamoeba invadens
GYYK

SEQ ID NO: 2757957 - protein, 14 aa, Entamoeba invadens
GYYKASNGECKRNT

SEQ ID NO: 2757958 - protein, 5 aa, Entamoeba invadens
GYYKD

SEQ ID NO: 2757959 - protein, 12 aa, Entamoeba invadens
GYYKDKNDCVSC

SEQ ID NO: 2757960 - protein, 7 aa, Entamoeba invadens
GYYKENK

SEQ ID NO: 2757961 - protein, 8 aa, Entamoeba invadens
GYYKNNEN

SEQ ID NO: 2757962 - protein, 8 aa, Entamoeba invadens
GYYKSEGE

SEQ ID NO: 2757963 - protein, 14 aa, Entamoeba invadens
GYYKTEKDCKECDG

SEQ ID NO: 2757964 - protein, 4 aa, Entamoeba invadens
GYYP

SEQ ID NO: 2757965 - protein, 8 aa, Entamoeba invadens
GYYPASDG

SEQ ID NO: 2757966 - protein, 10 aa, Entamoeba invadens
GYYPDADGNC

SEQ ID NO: 2757967 - protein, 6 aa, Entamoeba invadens
GYYPDN

SEQ ID NO: 2757968 - protein, 8 aa, Entamoeba invadens
GYYPDPST

SEQ ID NO: 2757969 - protein, 7 aa, Entamoeba invadens
GYYPDQS

SEQ ID NO: 2757970 - protein, 8 aa, Entamoeba invadens
GYYPDSNG

SEQ ID NO: 2757971 - protein, 9 aa, Entamoeba invadens
GYYPDSNGK

SEQ ID NO: 2757972 - protein, 5 aa, Entamoeba invadens
GYYPG

SEQ ID NO: 2757973 - protein, 9 aa, Entamoeba invadens
GYYPGSNGT

SEQ ID NO: 2757974 - protein, 10 aa, Entamoeba invadens
GYYPKNDGDF

SEQ ID NO: 2757975 - protein, 10 aa, Entamoeba invadens
GYYPKSDDDF

SEQ ID NO: 2757976 - protein, 11 aa, Entamoeba invadens
GYYPKTSDDFK

SEQ ID NO: 2757977 - protein, 9 aa, Entamoeba invadens
GYYPNENTK

SEQ ID NO: 2757978 - protein, 8 aa, Entamoeba invadens
GYYPNGSG

SEQ ID NO: 2757979 - protein, 6 aa, Entamoeba invadens
GYYPNL

SEQ ID NO: 2757980 - protein, 5 aa, Entamoeba invadens
GYYPS

SEQ ID NO: 2757981 - protein, 11 aa, Entamoeba invadens
GYYPSKTTGNC

SEQ ID NO: 2757982 - protein, 25 aa, Entamoeba invadens
GYYPSQYTEKCEPCSTTCESDGCNT

SEQ ID NO: 2757983 - protein, 10 aa, Entamoeba invadens
GYYPSSNSNC

SEQ ID NO: 2757984 - protein, 11 aa, Entamoeba invadens
GYYPSSTNSNC

SEQ ID NO: 2757985 - protein, 9 aa, Entamoeba invadens
GYYPSTTYP

SEQ ID NO: 2757986 - protein, 5 aa, Entamoeba invadens
GYYPV

SEQ ID NO: 2757987 - protein, 6 aa, Entamoeba invadens
GYYPYT

SEQ ID NO: 2757988 - protein, 6 aa, Entamoeba invadens
GYYQDS

SEQ ID NO: 2757989 - protein, 6 aa, Entamoeba invadens
GYYQGD

SEQ ID NO: 2757990 - protein, 6 aa, Entamoeba invadens
GYYQKD

SEQ ID NO: 2757991 - protein, 9 aa, Entamoeba invadens
GYYQPNAES

SEQ ID NO: 2757992 - protein, 13 aa, Entamoeba invadens
GYYQTDAKNVEDK

SEQ ID NO: 2757993 - protein, 5 aa, Entamoeba invadens
GYYRE

SEQ ID NO: 2757994 - protein, 8 aa, Entamoeba invadens
GYYREKSD

SEQ ID NO: 2757995 - protein, 5 aa, Entamoeba invadens
GYYRS

SEQ ID NO: 2757996 - protein, 8 aa, Entamoeba invadens
GYYRSGDG

SEQ ID NO: 2757997 - protein, 18 aa, Entamoeba invadens
GYYSDKGASTCTSCTGGY

SEQ ID NO: 2757998 - protein, 12 aa, Entamoeba invadens
GYYSEGGTTSCS

SEQ ID NO: 2757999 - protein, 78 aa, Entamoeba invadens
GYYSGSGASSCTKCNPGYYASSAGSSSCTNCNPGKYASSYGSASCSTCSAGTYSGTGASSCTKCSAGYYSGSGASSCS

SEQ ID NO: 2758000 - protein, 40 aa, Entamoeba invadens
GYYSGSGVSTCTQCPTGKYSSSTGSSTCSSCASGTYADTL

SEQ ID NO: 2758001 - protein, 10 aa, Entamoeba invadens
GYYSNENSNW

SEQ ID NO: 2758002 - protein, 12 aa, Entamoeba invadens
GYYSNSGDQTCT

SEQ ID NO: 2758003 - protein, 26 aa, Entamoeba invadens
GYYSNSGSSKCTECAAGTRSELPTTS

SEQ ID NO: 2758004 - protein, 10 aa, Entamoeba invadens
GYYSNTGASV

SEQ ID NO: 2758005 - protein, 12 aa, Entamoeba invadens
GYYSPEGSSSCS

SEQ ID NO: 2758006 - protein, 8 aa, Entamoeba invadens
GYYSTAGL

SEQ ID NO: 2758007 - protein, 9 aa, Entamoeba invadens
GYYSTEGSS

SEQ ID NO: 2758008 - protein, 8 aa, Entamoeba invadens
GYYSTNNE

SEQ ID NO: 2758009 - protein, 34 aa, Entamoeba invadens
GYYSTQGATSCPTCEGGYYSKEGSSSCTKCPGGY

SEQ ID NO: 2758010 - protein, 6 aa, Entamoeba invadens
GYYTAE

SEQ ID NO: 2758011 - protein, 26 aa, Entamoeba invadens
GYYTDKENKCSKCNTKCTECTENSEK

SEQ ID NO: 2758012 - protein, 13 aa, Entamoeba invadens
GYYTTNQSTKCEK

SEQ ID NO: 2758013 - protein, 4 aa, Entamoeba invadens
HAAL

SEQ ID NO: 2758014 - protein, 5 aa, Entamoeba invadens
HADSK

SEQ ID NO: 2758015 - protein, 22 aa, Entamoeba invadens
HAGEQNPALDSLKKSVKRQKPL

SEQ ID NO: 2758016 - protein, 9 aa, Entamoeba invadens
HAPDDSGKF

SEQ ID NO: 2758017 - protein, 9 aa, Entamoeba invadens
HAQNDTEGA

SEQ ID NO: 2758018 - protein, 9 aa, Entamoeba invadens
HARKKDNTI

SEQ ID NO: 2758019 - protein, 5 aa, Entamoeba invadens
HASEI

SEQ ID NO: 2758020 - protein, 9 aa, Entamoeba invadens
HASSYEELA

SEQ ID NO: 2758021 - protein, 9 aa, Entamoeba invadens
HATANNTDI

SEQ ID NO: 2758022 - protein, 5 aa, Entamoeba invadens
HATDN

SEQ ID NO: 2758023 - protein, 8 aa, Entamoeba invadens
HATMTSSD

SEQ ID NO: 2758024 - protein, 4 aa, Entamoeba invadens
HATQ

SEQ ID NO: 2758025 - protein, 25 aa, Entamoeba invadens
HCDTTTTCSECNKNSFKNSSGECLT

SEQ ID NO: 2758026 - protein, 6 aa, Entamoeba invadens
HCEQYK

SEQ ID NO: 2758027 - protein, 4 aa, Entamoeba invadens
HCGK

SEQ ID NO: 2758028 - protein, 18 aa, Entamoeba invadens
HCKESDGNSCTKCTRGYT

SEQ ID NO: 2758029 - protein, 6 aa, Entamoeba invadens
HCQNTS

SEQ ID NO: 2758030 - protein, 11 aa, Entamoeba invadens
HCSSQGKEFEV

SEQ ID NO: 2758031 - protein, 5 aa, Entamoeba invadens
HCTNA

SEQ ID NO: 2758032 - protein, 11 aa, Entamoeba invadens
HCTNCTSATDC

SEQ ID NO: 2758033 - protein, 33 aa, Entamoeba invadens
HDAFSSEKLSEDLEDKKHANISPDKVTVPPLPT

SEQ ID NO: 2758034 - protein, 5 aa, Entamoeba invadens
HDCGG

SEQ ID NO: 2758035 - protein, 4 aa, Entamoeba invadens
HDCT

SEQ ID NO: 2758036 - protein, 12 aa, Entamoeba invadens
HDDDGDGKCQTC

SEQ ID NO: 2758037 - protein, 14 aa, Entamoeba invadens
HDDGSFDLKNGQSF

SEQ ID NO: 2758038 - protein, 6 aa, Entamoeba invadens
HDDPKQ

SEQ ID NO: 2758039 - protein, 8 aa, Entamoeba invadens
HDEDAKQL

SEQ ID NO: 2758040 - protein, 11 aa, Entamoeba invadens
HDEEECDLGEN

SEQ ID NO: 2758041 - protein, 13 aa, Entamoeba invadens
HDEGSFDLENGQS

SEQ ID NO: 2758042 - protein, 13 aa, Entamoeba invadens
HDEPSFKNTPTEF

SEQ ID NO: 2758043 - protein, 6 aa, Entamoeba invadens
HDETDF

SEQ ID NO: 2758044 - protein, 4 aa, Entamoeba invadens
HDGR

SEQ ID NO: 2758045 - protein, 5 aa, Entamoeba invadens
HDIET

SEQ ID NO: 2758046 - protein, 7 aa, Entamoeba invadens
HDKCGNG

SEQ ID NO: 2758047 - protein, 8 aa, Entamoeba invadens
HDMPNDKP

SEQ ID NO: 2758048 - protein, 5 aa, Entamoeba invadens
HDNSN

SEQ ID NO: 2758049 - protein, 12 aa, Entamoeba invadens
HDPKKRPTASEV

SEQ ID NO: 2758050 - protein, 10 aa, Entamoeba invadens
HDPTKRPGFD

SEQ ID NO: 2758051 - protein, 6 aa, Entamoeba invadens
HDRPNF

SEQ ID NO: 2758052 - protein, 8 aa, Entamoeba invadens
HDTDDPQD

SEQ ID NO: 2758053 - protein, 7 aa, Entamoeba invadens
HDTDENY

SEQ ID NO: 2758054 - protein, 18 aa, Entamoeba invadens
HDTLANDEQADKVEKLST

SEQ ID NO: 2758055 - protein, 4 aa, Entamoeba invadens
HDTR

SEQ ID NO: 2758056 - protein, 6 aa, Entamoeba invadens
HDTSEV

SEQ ID NO: 2758057 - protein, 8 aa, Entamoeba invadens
HDTTPKIQ

SEQ ID NO: 2758058 - protein, 8 aa, Entamoeba invadens
HDVDQNTV

SEQ ID NO: 2758059 - protein, 4 aa, Entamoeba invadens
HDYE

SEQ ID NO: 2758060 - protein, 9 aa, Entamoeba invadens
HEAGRSYRT

SEQ ID NO: 2758061 - protein, 18 aa, Entamoeba invadens
HECTDDYKPTPDRKKCTK

SEQ ID NO: 2758062 - protein, 8 aa, Entamoeba invadens
HEDAKASS

SEQ ID NO: 2758063 - protein, 10 aa, Entamoeba invadens
HEDNAKDEQG

SEQ ID NO: 2758064 - protein, 7 aa, Entamoeba invadens
HEDQNTV

SEQ ID NO: 2758065 - protein, 37 aa, Entamoeba invadens
HEDSTKVEKNELNTDAEQKSLTNEKSQVDTKEIPQTT

SEQ ID NO: 2758066 - protein, 4 aa, Entamoeba invadens
HEEE

SEQ ID NO: 2758067 - protein, 10 aa, Entamoeba invadens
HEEEEEGNKG

SEQ ID NO: 2758068 - protein, 6 aa, Entamoeba invadens
HEESVD

SEQ ID NO: 2758069 - protein, 4 aa, Entamoeba invadens
HEEV

SEQ ID NO: 2758070 - protein, 5 aa, Entamoeba invadens
HEEVL

SEQ ID NO: 2758071 - protein, 8 aa, Entamoeba invadens
HEFADKKS

SEQ ID NO: 2758072 - protein, 11 aa, Entamoeba invadens
HEGDEKATKYQ

SEQ ID NO: 2758073 - protein, 9 aa, Entamoeba invadens
HEGEDEKSL

SEQ ID NO: 2758074 - protein, 6 aa, Entamoeba invadens
HEGHDS

SEQ ID NO: 2758075 - protein, 7 aa, Entamoeba invadens
HEGSPTH

SEQ ID NO: 2758076 - protein, 14 aa, Entamoeba invadens
HEITRAKELTSSLT

SEQ ID NO: 2758077 - protein, 14 aa, Entamoeba invadens
HEKGYGSCSTREGK

SEQ ID NO: 2758078 - protein, 5 aa, Entamoeba invadens
HEKPE

SEQ ID NO: 2758079 - protein, 19 aa, Entamoeba invadens
HEKSLKNETKSETREETSW

SEQ ID NO: 2758080 - protein, 14 aa, Entamoeba invadens
HEKTTDDCESCDEQ

SEQ ID NO: 2758081 - protein, 6 aa, Entamoeba invadens
HEKYTR

SEQ ID NO: 2758082 - protein, 7 aa, Entamoeba invadens
HENDKNF

SEQ ID NO: 2758083 - protein, 18 aa, Entamoeba invadens
HENGISSVETAALDGETS

SEQ ID NO: 2758084 - protein, 9 aa, Entamoeba invadens
HENKERPTI

SEQ ID NO: 2758085 - protein, 18 aa, Entamoeba invadens
HENKERPTISKVLDALKV

SEQ ID NO: 2758086 - protein, 5 aa, Entamoeba invadens
HENKN

SEQ ID NO: 2758087 - protein, 18 aa, Entamoeba invadens
HENKQRPTIIKKLRSNDF

SEQ ID NO: 2758088 - protein, 17 aa, Entamoeba invadens
HENQQNELNTNHPVEGD

SEQ ID NO: 2758089 - protein, 24 aa, Entamoeba invadens
HENSSTFNRNHPSVDITSSNGFLQ

SEQ ID NO: 2758090 - protein, 20 aa, Entamoeba invadens
HEPGDRPPIEDVIKQIKALI

SEQ ID NO: 2758091 - protein, 9 aa, Entamoeba invadens
HEPKEIGGV

SEQ ID NO: 2758092 - protein, 6 aa, Entamoeba invadens
HEPPKC

SEQ ID NO: 2758093 - protein, 8 aa, Entamoeba invadens
HEPSDAGD

SEQ ID NO: 2758094 - protein, 9 aa, Entamoeba invadens
HEPSDAGDY

SEQ ID NO: 2758095 - protein, 10 aa, Entamoeba invadens
HEPSEDGESC

SEQ ID NO: 2758096 - protein, 4 aa, Entamoeba invadens
HEQG

SEQ ID NO: 2758097 - protein, 5 aa, Entamoeba invadens
HERMT

SEQ ID NO: 2758098 - protein, 17 aa, Entamoeba invadens
HERSEKKKRYEKYQEEM

SEQ ID NO: 2758099 - protein, 5 aa, Entamoeba invadens
HERTV

SEQ ID NO: 2758100 - protein, 7 aa, Entamoeba invadens
HESEGLP

SEQ ID NO: 2758101 - protein, 10 aa, Entamoeba invadens
HESKKRKTTW

SEQ ID NO: 2758102 - protein, 4 aa, Entamoeba invadens
HESP

SEQ ID NO: 2758103 - protein, 8 aa, Entamoeba invadens
HESSGNGV

SEQ ID NO: 2758104 - protein, 5 aa, Entamoeba invadens
HETME

SEQ ID NO: 2758105 - protein, 10 aa, Entamoeba invadens
HETSDKTQIE

SEQ ID NO: 2758106 - protein, 13 aa, Entamoeba invadens
HETSDTNKVAEQI

SEQ ID NO: 2758107 - protein, 10 aa, Entamoeba invadens
HETTDPAQVP

SEQ ID NO: 2758108 - protein, 6 aa, Entamoeba invadens
HEVEGK

SEQ ID NO: 2758109 - protein, 8 aa, Entamoeba invadens
HEYTTADD

SEQ ID NO: 2758110 - protein, 5 aa, Entamoeba invadens
HFKPS

SEQ ID NO: 2758111 - protein, 9 aa, Entamoeba invadens
HFPGKERTI

SEQ ID NO: 2758112 - protein, 13 aa, Entamoeba invadens
HFQKSKDDTLKSE

SEQ ID NO: 2758113 - protein, 10 aa, Entamoeba invadens
HFSNGTTCQK

SEQ ID NO: 2758114 - protein, 8 aa, Entamoeba invadens
HGADTTQI

SEQ ID NO: 2758115 - protein, 11 aa, Entamoeba invadens
HGCDGTPFNSR

SEQ ID NO: 2758116 - protein, 5 aa, Entamoeba invadens
HGDVG

SEQ ID NO: 2758117 - protein, 5 aa, Entamoeba invadens
HGENK

SEQ ID NO: 2758118 - protein, 7 aa, Entamoeba invadens
HGERNDE

SEQ ID NO: 2758119 - protein, 9 aa, Entamoeba invadens
HGFGPDTQL

SEQ ID NO: 2758120 - protein, 10 aa, Entamoeba invadens
HGGGRDNDIT

SEQ ID NO: 2758121 - protein, 11 aa, Entamoeba invadens
HGGLGQTTEGV

SEQ ID NO: 2758122 - protein, 24 aa, Entamoeba invadens
HGGSLKSKQENSLNYSDDSFVKMP

SEQ ID NO: 2758123 - protein, 5 aa, Entamoeba invadens
HGGYG

SEQ ID NO: 2758124 - protein, 6 aa, Entamoeba invadens
HGKGNL

SEQ ID NO: 2758125 - protein, 10 aa, Entamoeba invadens
HGKSSGEPRT

SEQ ID NO: 2758126 - protein, 7 aa, Entamoeba invadens
HGNARTC

SEQ ID NO: 2758127 - protein, 9 aa, Entamoeba invadens
HGNGDEKRS

SEQ ID NO: 2758128 - protein, 7 aa, Entamoeba invadens
HGNKSTI

SEQ ID NO: 2758129 - protein, 9 aa, Entamoeba invadens
HGNQDQISN

SEQ ID NO: 2758130 - protein, 5 aa, Entamoeba invadens
HGNSE

SEQ ID NO: 2758131 - protein, 15 aa, Entamoeba invadens
HGRNSTNLDGQQGRW

SEQ ID NO: 2758132 - protein, 4 aa, Entamoeba invadens
HGRP

SEQ ID NO: 2758133 - protein, 6 aa, Entamoeba invadens
HGRPFT

SEQ ID NO: 2758134 - protein, 15 aa, Entamoeba invadens
HGSAETFQENSNYGL

SEQ ID NO: 2758135 - protein, 10 aa, Entamoeba invadens
HGSAKSPYKS

SEQ ID NO: 2758136 - protein, 10 aa, Entamoeba invadens
HGSASSNNQK

SEQ ID NO: 2758137 - protein, 7 aa, Entamoeba invadens
HGSGRSN

SEQ ID NO: 2758138 - protein, 8 aa, Entamoeba invadens
HGSSSTIK

SEQ ID NO: 2758139 - protein, 11 aa, Entamoeba invadens
HGTTQQSTRID

SEQ ID NO: 2758140 - protein, 4 aa, Entamoeba invadens
HHAS

SEQ ID NO: 2758141 - protein, 4 aa, Entamoeba invadens
HHKG

SEQ ID NO: 2758142 - protein, 7 aa, Entamoeba invadens
HHKQPNL

SEQ ID NO: 2758143 - protein, 12 aa, Entamoeba invadens
HHNGTEETELTE

SEQ ID NO: 2758144 - protein, 10 aa, Entamoeba invadens
HHNKPERTHH

SEQ ID NO: 2758145 - protein, 5 aa, Entamoeba invadens
HHPPI

SEQ ID NO: 2758146 - protein, 8 aa, Entamoeba invadens
HHPSTGII

SEQ ID NO: 2758147 - protein, 30 aa, Entamoeba invadens
HHRHSSSDSSDYSPRQRRSRWDEKPTVAPT

SEQ ID NO: 2758148 - protein, 5 aa, Entamoeba invadens
HHSDR

SEQ ID NO: 2758149 - protein, 8 aa, Entamoeba invadens
HIDPEELK

SEQ ID NO: 2758150 - protein, 14 aa, Entamoeba invadens
HIDTGRKRHDDRRK

SEQ ID NO: 2758151 - protein, 6 aa, Entamoeba invadens
HIEGAS

SEQ ID NO: 2758152 - protein, 4 aa, Entamoeba invadens
HIPS

SEQ ID NO: 2758153 - protein, 9 aa, Entamoeba invadens
HIYPNGETA

SEQ ID NO: 2758154 - protein, 10 aa, Entamoeba invadens
HKADKSVGPY

SEQ ID NO: 2758155 - protein, 12 aa, Entamoeba invadens
HKAQSTEKGLGT

SEQ ID NO: 2758156 - protein, 10 aa, Entamoeba invadens
HKASERPSFK

SEQ ID NO: 2758157 - protein, 8 aa, Entamoeba invadens
HKATEGDV

SEQ ID NO: 2758158 - protein, 4 aa, Entamoeba invadens
HKCN

SEQ ID NO: 2758159 - protein, 8 aa, Entamoeba invadens
HKCSDNCE

SEQ ID NO: 2758160 - protein, 9 aa, Entamoeba invadens
HKCSDNCEK

SEQ ID NO: 2758161 - protein, 8 aa, Entamoeba invadens
HKEDKYNR

SEQ ID NO: 2758162 - protein, 8 aa, Entamoeba invadens
HKEQRQKE

SEQ ID NO: 2758163 - protein, 15 aa, Entamoeba invadens
HKESEYQQIDDEEDE

SEQ ID NO: 2758164 - protein, 12 aa, Entamoeba invadens
HKGDKLKVGETY

SEQ ID NO: 2758165 - protein, 10 aa, Entamoeba invadens
HKGKEEFTKP

SEQ ID NO: 2758166 - protein, 10 aa, Entamoeba invadens
HKGKKSYEEN

SEQ ID NO: 2758167 - protein, 6 aa, Entamoeba invadens
HKGPDG

SEQ ID NO: 2758168 - protein, 4 aa, Entamoeba invadens
HKGV

SEQ ID NO: 2758169 - protein, 10 aa, Entamoeba invadens
HKHDDPERYE

SEQ ID NO: 2758170 - protein, 8 aa, Entamoeba invadens
HKKDKDPL

SEQ ID NO: 2758171 - protein, 8 aa, Entamoeba invadens
HKKERKKE

SEQ ID NO: 2758172 - protein, 8 aa, Entamoeba invadens
HKKESTLP

SEQ ID NO: 2758173 - protein, 8 aa, Entamoeba invadens
HKKIGEGS

SEQ ID NO: 2758174 - protein, 8 aa, Entamoeba invadens
HKKNEERK

SEQ ID NO: 2758175 - protein, 9 aa, Entamoeba invadens
HKKNKEKKK

SEQ ID NO: 2758176 - protein, 10 aa, Entamoeba invadens
HKKSDEVETR

SEQ ID NO: 2758177 - protein, 8 aa, Entamoeba invadens
HKKSEDVA

SEQ ID NO: 2758178 - protein, 8 aa, Entamoeba invadens
HKKSEEEC

SEQ ID NO: 2758179 - protein, 8 aa, Entamoeba invadens
HKKSEEVD

SEQ ID NO: 2758180 - protein, 8 aa, Entamoeba invadens
HKKSGEVN

SEQ ID NO: 2758181 - protein, 13 aa, Entamoeba invadens
HKLEQSHPSPKSM

SEQ ID NO: 2758182 - protein, 8 aa, Entamoeba invadens
HKLPSKTS

SEQ ID NO: 2758183 - protein, 8 aa, Entamoeba invadens
HKNKNDVP

SEQ ID NO: 2758184 - protein, 7 aa, Entamoeba invadens
HKNKQEK

SEQ ID NO: 2758185 - protein, 6 aa, Entamoeba invadens
HKNQSR

SEQ ID NO: 2758186 - protein, 8 aa, Entamoeba invadens
HKNSKEVN

SEQ ID NO: 2758187 - protein, 7 aa, Entamoeba invadens
HKNSNEI

SEQ ID NO: 2758188 - protein, 8 aa, Entamoeba invadens
HKNSNEID

SEQ ID NO: 2758189 - protein, 10 aa, Entamoeba invadens
HKPKNRPAFP

SEQ ID NO: 2758190 - protein, 7 aa, Entamoeba invadens
HKPNDVG

SEQ ID NO: 2758191 - protein, 9 aa, Entamoeba invadens
HKPRSRPTF

SEQ ID NO: 2758192 - protein, 8 aa, Entamoeba invadens
HKPSDAGD

SEQ ID NO: 2758193 - protein, 8 aa, Entamoeba invadens
HKPSDIGD

SEQ ID NO: 2758194 - protein, 14 aa, Entamoeba invadens
HKPSDIGDNCNKVT

SEQ ID NO: 2758195 - protein, 7 aa, Entamoeba invadens
HKPSDVG

SEQ ID NO: 2758196 - protein, 8 aa, Entamoeba invadens
HKQIEQTT

SEQ ID NO: 2758197 - protein, 7 aa, Entamoeba invadens
HKQKEMN

SEQ ID NO: 2758198 - protein, 8 aa, Entamoeba invadens
HKQKSDLS

SEQ ID NO: 2758199 - protein, 4 aa, Entamoeba invadens
HKQQ

SEQ ID NO: 2758200 - protein, 10 aa, Entamoeba invadens
HKQSEEVNTK

SEQ ID NO: 2758201 - protein, 8 aa, Entamoeba invadens
HKQSNEVN

SEQ ID NO: 2758202 - protein, 5 aa, Entamoeba invadens
HKRAP

SEQ ID NO: 2758203 - protein, 7 aa, Entamoeba invadens
HKRDSKK

SEQ ID NO: 2758204 - protein, 7 aa, Entamoeba invadens
HKRDTKK

SEQ ID NO: 2758205 - protein, 7 aa, Entamoeba invadens
HKRDTSK

SEQ ID NO: 2758206 - protein, 7 aa, Entamoeba invadens
HKRDTSN

SEQ ID NO: 2758207 - protein, 44 aa, Entamoeba invadens
HKSAHQSKRLSAKIQTTTHTTTPQEVARHSESARNLNRTAMSSK

SEQ ID NO: 2758208 - protein, 6 aa, Entamoeba invadens
HKSEID

SEQ ID NO: 2758209 - protein, 7 aa, Entamoeba invadens
HKSKKIL

SEQ ID NO: 2758210 - protein, 9 aa, Entamoeba invadens
HKSKTEYPQ

SEQ ID NO: 2758211 - protein, 9 aa, Entamoeba invadens
HKSNKNGVK

SEQ ID NO: 2758212 - protein, 8 aa, Entamoeba invadens
HKSYTNKA

SEQ ID NO: 2758213 - protein, 4 aa, Entamoeba invadens
HKTA

SEQ ID NO: 2758214 - protein, 5 aa, Entamoeba invadens
HKTNG

SEQ ID NO: 2758215 - protein, 7 aa, Entamoeba invadens
HKTSDDF

SEQ ID NO: 2758216 - protein, 7 aa, Entamoeba invadens
HKTSDEA

SEQ ID NO: 2758217 - protein, 6 aa, Entamoeba invadens
HKTSEE

SEQ ID NO: 2758218 - protein, 7 aa, Entamoeba invadens
HKTSEEI

SEQ ID NO: 2758219 - protein, 7 aa, Entamoeba invadens
HKTSEEV

SEQ ID NO: 2758220 - protein, 8 aa, Entamoeba invadens
HKTSKDID

SEQ ID NO: 2758221 - protein, 7 aa, Entamoeba invadens
HKTSKEI

SEQ ID NO: 2758222 - protein, 8 aa, Entamoeba invadens
HKTSNEVD

SEQ ID NO: 2758223 - protein, 7 aa, Entamoeba invadens
HKTSRGC

SEQ ID NO: 2758224 - protein, 8 aa, Entamoeba invadens
HKTSSEID

SEQ ID NO: 2758225 - protein, 10 aa, Entamoeba invadens
HKTSSSTKQI

SEQ ID NO: 2758226 - protein, 8 aa, Entamoeba invadens
HKTTEEVN

SEQ ID NO: 2758227 - protein, 6 aa, Entamoeba invadens
HKYHKK

SEQ ID NO: 2758228 - protein, 7 aa, Entamoeba invadens
HKYNSSI

SEQ ID NO: 2758229 - protein, 4 aa, Entamoeba invadens
HLDG

SEQ ID NO: 2758230 - protein, 4 aa, Entamoeba invadens
HLEY

SEQ ID NO: 2758231 - protein, 5 aa, Entamoeba invadens
HLQGK

SEQ ID NO: 2758232 - protein, 8 aa, Entamoeba invadens
HLREKGKK

SEQ ID NO: 2758233 - protein, 5 aa, Entamoeba invadens
HLSEK

SEQ ID NO: 2758234 - protein, 19 aa, Entamoeba invadens
HLSQGKCSQNSANCDNQNG

SEQ ID NO: 2758235 - protein, 8 aa, Entamoeba invadens
HLSTNSDA

SEQ ID NO: 2758236 - protein, 4 aa, Entamoeba invadens
HMEE

SEQ ID NO: 2758237 - protein, 6 aa, Entamoeba invadens
HMEQST

SEQ ID NO: 2758238 - protein, 6 aa, Entamoeba invadens
HMNSEE

SEQ ID NO: 2758239 - protein, 7 aa, Entamoeba invadens
HNAEKQV

SEQ ID NO: 2758240 - protein, 6 aa, Entamoeba invadens
HNASDA

SEQ ID NO: 2758241 - protein, 9 aa, Entamoeba invadens
HNCKENSVG

SEQ ID NO: 2758242 - protein, 9 aa, Entamoeba invadens
HNDQSRSCH

SEQ ID NO: 2758243 - protein, 5 aa, Entamoeba invadens
HNDSK

SEQ ID NO: 2758244 - protein, 21 aa, Entamoeba invadens
HNDYEDNDTVEIKQKSSQKLQ

SEQ ID NO: 2758245 - protein, 8 aa, Entamoeba invadens
HNEESDYK

SEQ ID NO: 2758246 - protein, 8 aa, Entamoeba invadens
HNEGSSVY

SEQ ID NO: 2758247 - protein, 11 aa, Entamoeba invadens
HNEKGCLGGGV

SEQ ID NO: 2758248 - protein, 10 aa, Entamoeba invadens
HNEKVKQMRT

SEQ ID NO: 2758249 - protein, 11 aa, Entamoeba invadens
HNENVDSDTSH

SEQ ID NO: 2758250 - protein, 5 aa, Entamoeba invadens
HNEPR

SEQ ID NO: 2758251 - protein, 28 aa, Entamoeba invadens
HNESKEKKKQQENKRRKEKMNHSQDTTT

SEQ ID NO: 2758252 - protein, 20 aa, Entamoeba invadens
HNETTNGKGKSESSEITAER

SEQ ID NO: 2758253 - protein, 11 aa, Entamoeba invadens
HNFPDCANNST

SEQ ID NO: 2758254 - protein, 5 aa, Entamoeba invadens
HNGGE

SEQ ID NO: 2758255 - protein, 9 aa, Entamoeba invadens
HNKQPEKIG

SEQ ID NO: 2758256 - protein, 25 aa, Entamoeba invadens
HNNASSETLSNNDKFRELSKSTQDV

SEQ ID NO: 2758257 - protein, 8 aa, Entamoeba invadens
HNNESGVD

SEQ ID NO: 2758258 - protein, 10 aa, Entamoeba invadens
HNNESSENRL

SEQ ID NO: 2758259 - protein, 34 aa, Entamoeba invadens
HNNETNTSSETNETTKTTLKNENGSNCIEKTTKG

SEQ ID NO: 2758260 - protein, 12 aa, Entamoeba invadens
HNNKEKVLSDQG

SEQ ID NO: 2758261 - protein, 13 aa, Entamoeba invadens
HNPEDNKGKEGLS

SEQ ID NO: 2758262 - protein, 15 aa, Entamoeba invadens
HNPKGIEYDESSNIQ

SEQ ID NO: 2758263 - protein, 10 aa, Entamoeba invadens
HNPQNNTNRN

SEQ ID NO: 2758264 - protein, 7 aa, Entamoeba invadens
HNRPTEK

SEQ ID NO: 2758265 - protein, 12 aa, Entamoeba invadens
HNSDSEERFSNN

SEQ ID NO: 2758266 - protein, 9 aa, Entamoeba invadens
HNSEKDVKL

SEQ ID NO: 2758267 - protein, 8 aa, Entamoeba invadens
HNSSNKCN

SEQ ID NO: 2758268 - protein, 9 aa, Entamoeba invadens
HNSTPTPVI

SEQ ID NO: 2758269 - protein, 4 aa, Entamoeba invadens
HNTG

SEQ ID NO: 2758270 - protein, 20 aa, Entamoeba invadens
HNTNQSKYSHAKQHKESVED

SEQ ID NO: 2758271 - protein, 7 aa, Entamoeba invadens
HNTQARG

SEQ ID NO: 2758272 - protein, 8 aa, Entamoeba invadens
HNTRNTSD

SEQ ID NO: 2758273 - protein, 7 aa, Entamoeba invadens
HNTTNTN

SEQ ID NO: 2758274 - protein, 11 aa, Entamoeba invadens
HNTTQNPGNNQ

SEQ ID NO: 2758275 - protein, 15 aa, Entamoeba invadens
HNYANPQKGCLTNSC

SEQ ID NO: 2758276 - protein, 6 aa, Entamoeba invadens
HPASGY

SEQ ID NO: 2758277 - protein, 6 aa, Entamoeba invadens
HPAYDN

SEQ ID NO: 2758278 - protein, 12 aa, Entamoeba invadens
HPDKNPSPDAQD

SEQ ID NO: 2758279 - protein, 5 aa, Entamoeba invadens
HPDKS

SEQ ID NO: 2758280 - protein, 9 aa, Entamoeba invadens
HPDPDNLTT

SEQ ID NO: 2758281 - protein, 6 aa, Entamoeba invadens
HPENVK

SEQ ID NO: 2758282 - protein, 13 aa, Entamoeba invadens
HPETHKDINTNKN

SEQ ID NO: 2758283 - protein, 6 aa, Entamoeba invadens
HPEVPK

SEQ ID NO: 2758284 - protein, 8 aa, Entamoeba invadens
HPGSDITF

SEQ ID NO: 2758285 - protein, 8 aa, Entamoeba invadens
HPKERERE

SEQ ID NO: 2758286 - protein, 4 aa, Entamoeba invadens
HPKR

SEQ ID NO: 2758287 - protein, 7 aa, Entamoeba invadens
HPKSPSL

SEQ ID NO: 2758288 - protein, 4 aa, Entamoeba invadens
HPKT

SEQ ID NO: 2758289 - protein, 5 aa, Entamoeba invadens
HPLSD

SEQ ID NO: 2758290 - protein, 4 aa, Entamoeba invadens
HPMT

SEQ ID NO: 2758291 - protein, 10 aa, Entamoeba invadens
HPNDSGDRCE

SEQ ID NO: 2758292 - protein, 12 aa, Entamoeba invadens
HPNGPLPENYSA

SEQ ID NO: 2758293 - protein, 6 aa, Entamoeba invadens
HPNNTT

SEQ ID NO: 2758294 - protein, 5 aa, Entamoeba invadens
HPNPL

SEQ ID NO: 2758295 - protein, 6 aa, Entamoeba invadens
HPPKAS

SEQ ID NO: 2758296 - protein, 7 aa, Entamoeba invadens
HPPPSPE

SEQ ID NO: 2758297 - protein, 6 aa, Entamoeba invadens
HPPQDG

SEQ ID NO: 2758298 - protein, 6 aa, Entamoeba invadens
HPQATD

SEQ ID NO: 2758299 - protein, 13 aa, Entamoeba invadens
HPSDDKKTCTSED

SEQ ID NO: 2758300 - protein, 9 aa, Entamoeba invadens
HPSDENSSF

SEQ ID NO: 2758301 - protein, 10 aa, Entamoeba invadens
HPSDNGLSCE

SEQ ID NO: 2758302 - protein, 5 aa, Entamoeba invadens
HPSQE

SEQ ID NO: 2758303 - protein, 7 aa, Entamoeba invadens
HPSTTVN

SEQ ID NO: 2758304 - protein, 16 aa, Entamoeba invadens
HPTDEKSQAEEIGYKN

SEQ ID NO: 2758305 - protein, 7 aa, Entamoeba invadens
HPTQGNI

SEQ ID NO: 2758306 - protein, 6 aa, Entamoeba invadens
HPYGEP

SEQ ID NO: 2758307 - protein, 14 aa, Entamoeba invadens
HPYHGKSSGEPRAY

SEQ ID NO: 2758308 - protein, 4 aa, Entamoeba invadens
HQAF

SEQ ID NO: 2758309 - protein, 12 aa, Entamoeba invadens
HQCDSNDNLAKK

SEQ ID NO: 2758310 - protein, 8 aa, Entamoeba invadens
HQDNKKTR

SEQ ID NO: 2758311 - protein, 7 aa, Entamoeba invadens
HQDTERM

SEQ ID NO: 2758312 - protein, 8 aa, Entamoeba invadens
HQGESTEC

SEQ ID NO: 2758313 - protein, 4 aa, Entamoeba invadens
HQKE

SEQ ID NO: 2758314 - protein, 8 aa, Entamoeba invadens
HQKEEPDS

SEQ ID NO: 2758315 - protein, 4 aa, Entamoeba invadens
HQKR

SEQ ID NO: 2758316 - protein, 8 aa, Entamoeba invadens
HQKVEKRN

SEQ ID NO: 2758317 - protein, 9 aa, Entamoeba invadens
HQNASFNSQ

SEQ ID NO: 2758318 - protein, 10 aa, Entamoeba invadens
HQNINSGSLK

SEQ ID NO: 2758319 - protein, 6 aa, Entamoeba invadens
HQNPYS

SEQ ID NO: 2758320 - protein, 7 aa, Entamoeba invadens
HQNQQEQ

SEQ ID NO: 2758321 - protein, 11 aa, Entamoeba invadens
HQNSGKCSTTE

SEQ ID NO: 2758322 - protein, 13 aa, Entamoeba invadens
HQNSGKCSTTENT

SEQ ID NO: 2758323 - protein, 18 aa, Entamoeba invadens
HQNSGKCSTTENTIKNCE

SEQ ID NO: 2758324 - protein, 6 aa, Entamoeba invadens
HQNYPQ

SEQ ID NO: 2758325 - protein, 32 aa, Entamoeba invadens
HQPTSQTTQRPETNIKPETETRDFQDPNFDDP

SEQ ID NO: 2758326 - protein, 27 aa, Entamoeba invadens
HQQPPTAKNMDPTEVPQTEPQVVPTPQ

SEQ ID NO: 2758327 - protein, 7 aa, Entamoeba invadens
HQRTTRE

SEQ ID NO: 2758328 - protein, 9 aa, Entamoeba invadens
HQSGELTSK

SEQ ID NO: 2758329 - protein, 5 aa, Entamoeba invadens
HQSHT

SEQ ID NO: 2758330 - protein, 7 aa, Entamoeba invadens
HQVPQQV

SEQ ID NO: 2758331 - protein, 23 aa, Entamoeba invadens
HREDSPKNISKSPTKSEQPTEKK

SEQ ID NO: 2758332 - protein, 22 aa, Entamoeba invadens
HREHNTPKQEEQQTNTTTQTHL

SEQ ID NO: 2758333 - protein, 12 aa, Entamoeba invadens
HREISKDIGYSS

SEQ ID NO: 2758334 - protein, 5 aa, Entamoeba invadens
HRGKL

SEQ ID NO: 2758335 - protein, 7 aa, Entamoeba invadens
HRGTEGC

SEQ ID NO: 2758336 - protein, 6 aa, Entamoeba invadens
HRGTNV

SEQ ID NO: 2758337 - protein, 11 aa, Entamoeba invadens
HRLPKTAEMSE

SEQ ID NO: 2758338 - protein, 9 aa, Entamoeba invadens
HRNEDEKGM

SEQ ID NO: 2758339 - protein, 11 aa, Entamoeba invadens
HRNMETGNCEC

SEQ ID NO: 2758340 - protein, 7 aa, Entamoeba invadens
HRNQLTT

SEQ ID NO: 2758341 - protein, 5 aa, Entamoeba invadens
HRPYK

SEQ ID NO: 2758342 - protein, 6 aa, Entamoeba invadens
HRQKST

SEQ ID NO: 2758343 - protein, 25 aa, Entamoeba invadens
HRSKKPAPDDLQQKSTTSPSTTPRH

SEQ ID NO: 2758344 - protein, 11 aa, Entamoeba invadens
HRSSVTRKEAK

SEQ ID NO: 2758345 - protein, 10 aa, Entamoeba invadens
HRYSCSKDNR

SEQ ID NO: 2758346 - protein, 8 aa, Entamoeba invadens
HSAQTPNN

SEQ ID NO: 2758347 - protein, 17 aa, Entamoeba invadens
HSCPSGLRGPSQERLSQ

SEQ ID NO: 2758348 - protein, 5 aa, Entamoeba invadens
HSDCK

SEQ ID NO: 2758349 - protein, 10 aa, Entamoeba invadens
HSDDNKPIET

SEQ ID NO: 2758350 - protein, 5 aa, Entamoeba invadens
HSDED

SEQ ID NO: 2758351 - protein, 8 aa, Entamoeba invadens
HSDNPNFT

SEQ ID NO: 2758352 - protein, 10 aa, Entamoeba invadens
HSDSTSLAPT

SEQ ID NO: 2758353 - protein, 9 aa, Entamoeba invadens
HSEPKDDSF

SEQ ID NO: 2758354 - protein, 12 aa, Entamoeba invadens
HSETPSNNSPVI

SEQ ID NO: 2758355 - protein, 5 aa, Entamoeba invadens
HSFPQ

SEQ ID NO: 2758356 - protein, 9 aa, Entamoeba invadens
HSGETMESS

SEQ ID NO: 2758357 - protein, 9 aa, Entamoeba invadens
HSGKGRSVE

SEQ ID NO: 2758358 - protein, 4 aa, Entamoeba invadens
HSGR

SEQ ID NO: 2758359 - protein, 7 aa, Entamoeba invadens
HSGRMDR

SEQ ID NO: 2758360 - protein, 7 aa, Entamoeba invadens
HSISEKD

SEQ ID NO: 2758361 - protein, 12 aa, Entamoeba invadens
HSISPSSKLTDG

SEQ ID NO: 2758362 - protein, 18 aa, Entamoeba invadens
HSKCTTCDRNKKISDDGV

SEQ ID NO: 2758363 - protein, 8 aa, Entamoeba invadens
HSKEKRTT

SEQ ID NO: 2758364 - protein, 10 aa, Entamoeba invadens
HSKHSSGGKH

SEQ ID NO: 2758365 - protein, 8 aa, Entamoeba invadens
HSKKGSYT

SEQ ID NO: 2758366 - protein, 6 aa, Entamoeba invadens
HSKNSV

SEQ ID NO: 2758367 - protein, 5 aa, Entamoeba invadens
HSKST

SEQ ID NO: 2758368 - protein, 4 aa, Entamoeba invadens
HSKT

SEQ ID NO: 2758369 - protein, 9 aa, Entamoeba invadens
HSKTGEAAR

SEQ ID NO: 2758370 - protein, 5 aa, Entamoeba invadens
HSKTT

SEQ ID NO: 2758371 - protein, 8 aa, Entamoeba invadens
HSLGSEPN

SEQ ID NO: 2758372 - protein, 9 aa, Entamoeba invadens
HSLTTKSMT

SEQ ID NO: 2758373 - protein, 7 aa, Entamoeba invadens
HSNATAL

SEQ ID NO: 2758374 - protein, 15 aa, Entamoeba invadens
HSNGERNEDIENDFE

SEQ ID NO: 2758375 - protein, 8 aa, Entamoeba invadens
HSNLENSQ

SEQ ID NO: 2758376 - protein, 10 aa, Entamoeba invadens
HSNTTTDQNP

SEQ ID NO: 2758377 - protein, 10 aa, Entamoeba invadens
HSNYSYPVPT

SEQ ID NO: 2758378 - protein, 9 aa, Entamoeba invadens
HSPKSGEKF

SEQ ID NO: 2758379 - protein, 12 aa, Entamoeba invadens
HSPSTSSKTSCD

SEQ ID NO: 2758380 - protein, 11 aa, Entamoeba invadens
HSPTDDKEYSF

SEQ ID NO: 2758381 - protein, 6 aa, Entamoeba invadens
HSQDNY

SEQ ID NO: 2758382 - protein, 4 aa, Entamoeba invadens
HSQE

SEQ ID NO: 2758383 - protein, 10 aa, Entamoeba invadens
HSQEPQKGWD

SEQ ID NO: 2758384 - protein, 11 aa, Entamoeba invadens
HSQESKKEQIE

SEQ ID NO: 2758385 - protein, 29 aa, Entamoeba invadens
HSQQERRDKKKKQNKENTEKKPKHDNENE

SEQ ID NO: 2758386 - protein, 7 aa, Entamoeba invadens
HSRKSVK

SEQ ID NO: 2758387 - protein, 8 aa, Entamoeba invadens
HSSFSYGR

SEQ ID NO: 2758388 - protein, 7 aa, Entamoeba invadens
HSSNQIT

SEQ ID NO: 2758389 - protein, 8 aa, Entamoeba invadens
HSSNSKCD

SEQ ID NO: 2758390 - protein, 6 aa, Entamoeba invadens
HSSPWQ

SEQ ID NO: 2758391 - protein, 6 aa, Entamoeba invadens
HSSRQI

SEQ ID NO: 2758392 - protein, 11 aa, Entamoeba invadens
HSSSGDLESGI

SEQ ID NO: 2758393 - protein, 9 aa, Entamoeba invadens
HSSSNVEPR

SEQ ID NO: 2758394 - protein, 16 aa, Entamoeba invadens
HSSTSNSTSSPLNSPM

SEQ ID NO: 2758395 - protein, 5 aa, Entamoeba invadens
HSTKK

SEQ ID NO: 2758396 - protein, 8 aa, Entamoeba invadens
HSTNGDVV

SEQ ID NO: 2758397 - protein, 11 aa, Entamoeba invadens
HSTNHGSSDFA

SEQ ID NO: 2758398 - protein, 7 aa, Entamoeba invadens
HSTPKAF

SEQ ID NO: 2758399 - protein, 6 aa, Entamoeba invadens
HSTQQS

SEQ ID NO: 2758400 - protein, 4 aa, Entamoeba invadens
HSTS

SEQ ID NO: 2758401 - protein, 5 aa, Entamoeba invadens
HSTTK

SEQ ID NO: 2758402 - protein, 27 aa, Entamoeba invadens
HSYEQQNVNEVYKNKRDTIESNGNSDL

SEQ ID NO: 2758403 - protein, 28 aa, Entamoeba invadens
HTADNDCVPNSCGDGVMTDQKECDGGVG

SEQ ID NO: 2758404 - protein, 7 aa, Entamoeba invadens
HTCEEST

SEQ ID NO: 2758405 - protein, 6 aa, Entamoeba invadens
HTDDIS

SEQ ID NO: 2758406 - protein, 5 aa, Entamoeba invadens
HTDDN

SEQ ID NO: 2758407 - protein, 13 aa, Entamoeba invadens
HTDEPIEMESLRD

SEQ ID NO: 2758408 - protein, 5 aa, Entamoeba invadens
HTDSR

SEQ ID NO: 2758409 - protein, 8 aa, Entamoeba invadens
HTDYKTEE

SEQ ID NO: 2758410 - protein, 4 aa, Entamoeba invadens
HTEE

SEQ ID NO: 2758411 - protein, 8 aa, Entamoeba invadens
HTEKESNY

SEQ ID NO: 2758412 - protein, 7 aa, Entamoeba invadens
HTEPEFP

SEQ ID NO: 2758413 - protein, 8 aa, Entamoeba invadens
HTESDPKI

SEQ ID NO: 2758414 - protein, 5 aa, Entamoeba invadens
HTETA

SEQ ID NO: 2758415 - protein, 7 aa, Entamoeba invadens
HTGYDSS

SEQ ID NO: 2758416 - protein, 8 aa, Entamoeba invadens
HTHSTIEK

SEQ ID NO: 2758417 - protein, 9 aa, Entamoeba invadens
HTKDAEKFS

SEQ ID NO: 2758418 - protein, 8 aa, Entamoeba invadens
HTKPCSSG

SEQ ID NO: 2758419 - protein, 12 aa, Entamoeba invadens
HTKSSHTNNTRE

SEQ ID NO: 2758420 - protein, 6 aa, Entamoeba invadens
HTLPVK

SEQ ID NO: 2758421 - protein, 4 aa, Entamoeba invadens
HTND

SEQ ID NO: 2758422 - protein, 4 aa, Entamoeba invadens
HTNF

SEQ ID NO: 2758423 - protein, 13 aa, Entamoeba invadens
HTNPDAANAECDG

SEQ ID NO: 2758424 - protein, 9 aa, Entamoeba invadens
HTNSSSNSV

SEQ ID NO: 2758425 - protein, 6 aa, Entamoeba invadens
HTPISS

SEQ ID NO: 2758426 - protein, 14 aa, Entamoeba invadens
HTPSNSLTNQYGQT

SEQ ID NO: 2758427 - protein, 6 aa, Entamoeba invadens
HTPTNR

SEQ ID NO: 2758428 - protein, 9 aa, Entamoeba invadens
HTPYTGKNT

SEQ ID NO: 2758429 - protein, 4 aa, Entamoeba invadens
HTQE

SEQ ID NO: 2758430 - protein, 15 aa, Entamoeba invadens
HTQNQKSVLDNKKFT

SEQ ID NO: 2758431 - protein, 15 aa, Entamoeba invadens
HTQPNSTQKSELETD

SEQ ID NO: 2758432 - protein, 7 aa, Entamoeba invadens
HTQPVGS

SEQ ID NO: 2758433 - protein, 5 aa, Entamoeba invadens
HTSDV

SEQ ID NO: 2758434 - protein, 4 aa, Entamoeba invadens
HTSP

SEQ ID NO: 2758435 - protein, 6 aa, Entamoeba invadens
HTSPGV

SEQ ID NO: 2758436 - protein, 6 aa, Entamoeba invadens
HTSSMN

SEQ ID NO: 2758437 - protein, 24 aa, Entamoeba invadens
HTSSSNEEIKQTPISVDSKDIVPQ

SEQ ID NO: 2758438 - protein, 7 aa, Entamoeba invadens
HTTDENL

SEQ ID NO: 2758439 - protein, 5 aa, Entamoeba invadens
HTTEI

SEQ ID NO: 2758440 - protein, 16 aa, Entamoeba invadens
HTTKSIARKEKSSPVI

SEQ ID NO: 2758441 - protein, 6 aa, Entamoeba invadens
HTTNYN

SEQ ID NO: 2758442 - protein, 8 aa, Entamoeba invadens
HTTSQDQA

SEQ ID NO: 2758443 - protein, 5 aa, Entamoeba invadens
HTVSA

SEQ ID NO: 2758444 - protein, 9 aa, Entamoeba invadens
HTYNGNASD

SEQ ID NO: 2758445 - protein, 6 aa, Entamoeba invadens
HVEEGK

SEQ ID NO: 2758446 - protein, 9 aa, Entamoeba invadens
HVKGDNKEL

SEQ ID NO: 2758447 - protein, 9 aa, Entamoeba invadens
HVKGKNKIQ

SEQ ID NO: 2758448 - protein, 7 aa, Entamoeba invadens
HVKKESE

SEQ ID NO: 2758449 - protein, 11 aa, Entamoeba invadens
HVKTKDDDDVN

SEQ ID NO: 2758450 - protein, 8 aa, Entamoeba invadens
HVQNEDPQ

SEQ ID NO: 2758451 - protein, 14 aa, Entamoeba invadens
HVSLNGDGNEPFGP

SEQ ID NO: 2758452 - protein, 7 aa, Entamoeba invadens
HVYGQPR

SEQ ID NO: 2758453 - protein, 5 aa, Entamoeba invadens
HVYSG

SEQ ID NO: 2758454 - protein, 6 aa, Entamoeba invadens
HVYSSG

SEQ ID NO: 2758455 - protein, 16 aa, Entamoeba invadens
HYDRPCEDDECRKCTG

SEQ ID NO: 2758456 - protein, 7 aa, Entamoeba invadens
HYKASAD

SEQ ID NO: 2758457 - protein, 5 aa, Entamoeba invadens
HYKKA

SEQ ID NO: 2758458 - protein, 7 aa, Entamoeba invadens
HYKKAAD

SEQ ID NO: 2758459 - protein, 4 aa, Entamoeba invadens
HYNE

SEQ ID NO: 2758460 - protein, 11 aa, Entamoeba invadens
HYNGKCKKEMP

SEQ ID NO: 2758461 - protein, 4 aa, Entamoeba invadens
HYNT

SEQ ID NO: 2758462 - protein, 12 aa, Entamoeba invadens
HYPTTSGCSNCN

SEQ ID NO: 2758463 - protein, 11 aa, Entamoeba invadens
HYTDVNGSTSC

SEQ ID NO: 2758464 - protein, 8 aa, Entamoeba invadens
HYTGEESV

SEQ ID NO: 2758465 - protein, 22 aa, Entamoeba invadens
IAAPTELADRRPLQNTEKTINM

SEQ ID NO: 2758466 - protein, 10 aa, Entamoeba invadens
IADEVSKDIS

SEQ ID NO: 2758467 - protein, 22 aa, Entamoeba invadens
IADSVDDAKIDEFRKQAKPTDI

SEQ ID NO: 2758468 - protein, 22 aa, Entamoeba invadens
IADSVDDAKLKEISSTQKPTDI

SEQ ID NO: 2758469 - protein, 6 aa, Entamoeba invadens
IAEEKS

SEQ ID NO: 2758470 - protein, 8 aa, Entamoeba invadens
IAEELGEQ

SEQ ID NO: 2758471 - protein, 5 aa, Entamoeba invadens
IAEGA

SEQ ID NO: 2758472 - protein, 8 aa, Entamoeba invadens
IAERGTHE

SEQ ID NO: 2758473 - protein, 7 aa, Entamoeba invadens
IAETSVT

SEQ ID NO: 2758474 - protein, 5 aa, Entamoeba invadens
IAGES

SEQ ID NO: 2758475 - protein, 12 aa, Entamoeba invadens
IAGRTGSGKSTL

SEQ ID NO: 2758476 - protein, 5 aa, Entamoeba invadens
IAGTA

SEQ ID NO: 2758477 - protein, 10 aa, Entamoeba invadens
IAGTTGSEAI

SEQ ID NO: 2758478 - protein, 8 aa, Entamoeba invadens
IAKKDSGC

SEQ ID NO: 2758479 - protein, 14 aa, Entamoeba invadens
IAKNDDEDDDVKAY

SEQ ID NO: 2758480 - protein, 16 aa, Entamoeba invadens
IANGPYIKSDPQHLST

SEQ ID NO: 2758481 - protein, 18 aa, Entamoeba invadens
IANGTKSTVEAEKAAVEA

SEQ ID NO: 2758482 - protein, 9 aa, Entamoeba invadens
IANPTGNTN

SEQ ID NO: 2758483 - protein, 9 aa, Entamoeba invadens
IANRVDSKT

SEQ ID NO: 2758484 - protein, 9 aa, Entamoeba invadens
IANSNVTNN

SEQ ID NO: 2758485 - protein, 15 aa, Entamoeba invadens
IANTEGTQCDKKTNY

SEQ ID NO: 2758486 - protein, 7 aa, Entamoeba invadens
IANTTKK

SEQ ID NO: 2758487 - protein, 9 aa, Entamoeba invadens
IAPNQKSPI

SEQ ID NO: 2758488 - protein, 7 aa, Entamoeba invadens
IAPNSTI

SEQ ID NO: 2758489 - protein, 9 aa, Entamoeba invadens
IAPPPQPRR

SEQ ID NO: 2758490 - protein, 7 aa, Entamoeba invadens
IAPPPRA

SEQ ID NO: 2758491 - protein, 4 aa, Entamoeba invadens
IAPQ

SEQ ID NO: 2758492 - protein, 4 aa, Entamoeba invadens
IAQK

SEQ ID NO: 2758493 - protein, 4 aa, Entamoeba invadens
IARE

SEQ ID NO: 2758494 - protein, 7 aa, Entamoeba invadens
IARKKVS

SEQ ID NO: 2758495 - protein, 17 aa, Entamoeba invadens
IARRNEKMEALLKDICV

SEQ ID NO: 2758496 - protein, 9 aa, Entamoeba invadens
IARSGEKRD

SEQ ID NO: 2758497 - protein, 4 aa, Entamoeba invadens
IASL

SEQ ID NO: 2758498 - protein, 15 aa, Entamoeba invadens
IASLGESSFEGTGID

SEQ ID NO: 2758499 - protein, 5 aa, Entamoeba invadens
IASQK

SEQ ID NO: 2758500 - protein, 29 aa, Entamoeba invadens
IATAEELEGQTDEMQGHANDFRKASTDLK

SEQ ID NO: 2758501 - protein, 29 aa, Entamoeba invadens
IATAEELQTQTEQMNENANQFRQKSNQLK

SEQ ID NO: 2758502 - protein, 6 aa, Entamoeba invadens
IATASI

SEQ ID NO: 2758503 - protein, 6 aa, Entamoeba invadens
IATGSD

SEQ ID NO: 2758504 - protein, 11 aa, Entamoeba invadens
IATNSTQYNNE

SEQ ID NO: 2758505 - protein, 8 aa, Entamoeba invadens
IATSQGYQ

SEQ ID NO: 2758506 - protein, 4 aa, Entamoeba invadens
IAVS

SEQ ID NO: 2758507 - protein, 22 aa, Entamoeba invadens
ICENGKATKCDNLSEMNTNGIC

SEQ ID NO: 2758508 - protein, 14 aa, Entamoeba invadens
ICENNTNNCKVTTL

SEQ ID NO: 2758509 - protein, 11 aa, Entamoeba invadens
ICNNNDRNNEC

SEQ ID NO: 2758510 - protein, 5 aa, Entamoeba invadens
ICSNE

SEQ ID NO: 2758511 - protein, 4 aa, Entamoeba invadens
ICTN

SEQ ID NO: 2758512 - protein, 10 aa, Entamoeba invadens
IDAEKQYQEK

SEQ ID NO: 2758513 - protein, 4 aa, Entamoeba invadens
IDAK

SEQ ID NO: 2758514 - protein, 7 aa, Entamoeba invadens
IDANDNT

SEQ ID NO: 2758515 - protein, 14 aa, Entamoeba invadens
IDATNTEGLKPSMC

SEQ ID NO: 2758516 - protein, 9 aa, Entamoeba invadens
IDDNHPQGD

SEQ ID NO: 2758517 - protein, 9 aa, Entamoeba invadens
IDDNNSGLF

SEQ ID NO: 2758518 - protein, 9 aa, Entamoeba invadens
IDDPYEAPL

SEQ ID NO: 2758519 - protein, 4 aa, Entamoeba invadens
IDDQ

SEQ ID NO: 2758520 - protein, 9 aa, Entamoeba invadens
IDDQTRLNT

SEQ ID NO: 2758521 - protein, 12 aa, Entamoeba invadens
IDDRNEDFEKKD

SEQ ID NO: 2758522 - protein, 7 aa, Entamoeba invadens
IDDSGRI

SEQ ID NO: 2758523 - protein, 17 aa, Entamoeba invadens
IDDTGDPLLPDATGAEY

SEQ ID NO: 2758524 - protein, 39 aa, Entamoeba invadens
IDDTVNDDQTTPREKEGDSDSIESEEHDSSEPKESDDFE

SEQ ID NO: 2758525 - protein, 4 aa, Entamoeba invadens
IDDY

SEQ ID NO: 2758526 - protein, 22 aa, Entamoeba invadens
IDEDEPMNLDDTQNPLSDTAIV

SEQ ID NO: 2758527 - protein, 7 aa, Entamoeba invadens
IDEIGTA

SEQ ID NO: 2758528 - protein, 12 aa, Entamoeba invadens
IDEKGSKEGETL

SEQ ID NO: 2758529 - protein, 9 aa, Entamoeba invadens
IDEKMPKDY

SEQ ID NO: 2758530 - protein, 8 aa, Entamoeba invadens
IDEKSQEV

SEQ ID NO: 2758531 - protein, 9 aa, Entamoeba invadens
IDEKSSIQS

SEQ ID NO: 2758532 - protein, 19 aa, Entamoeba invadens
IDERSEKPQKTLDPTPLQR

SEQ ID NO: 2758533 - protein, 16 aa, Entamoeba invadens
IDESSSEGKGEEIAEE

SEQ ID NO: 2758534 - protein, 5 aa, Entamoeba invadens
IDETA

SEQ ID NO: 2758535 - protein, 21 aa, Entamoeba invadens
IDETKARRLREIEKNKKRTQL

SEQ ID NO: 2758536 - protein, 9 aa, Entamoeba invadens
IDEYSNDTC

SEQ ID NO: 2758537 - protein, 14 aa, Entamoeba invadens
IDFGDTRPEINEPV

SEQ ID NO: 2758538 - protein, 14 aa, Entamoeba invadens
IDFGEKRPEIDEPC

SEQ ID NO: 2758539 - protein, 9 aa, Entamoeba invadens
IDFNSEHQE

SEQ ID NO: 2758540 - protein, 17 aa, Entamoeba invadens
IDFNSENDEIPVNTESR

SEQ ID NO: 2758541 - protein, 6 aa, Entamoeba invadens
IDGDES

SEQ ID NO: 2758542 - protein, 8 aa, Entamoeba invadens
IDGDGENE

SEQ ID NO: 2758543 - protein, 9 aa, Entamoeba invadens
IDGDTTDNK

SEQ ID NO: 2758544 - protein, 6 aa, Entamoeba invadens
IDGEIA

SEQ ID NO: 2758545 - protein, 4 aa, Entamoeba invadens
IDGG

SEQ ID NO: 2758546 - protein, 10 aa, Entamoeba invadens
IDGKEKSQFT

SEQ ID NO: 2758547 - protein, 4 aa, Entamoeba invadens
IDGN

SEQ ID NO: 2758548 - protein, 12 aa, Entamoeba invadens
IDGNDNTEGPTL

SEQ ID NO: 2758549 - protein, 7 aa, Entamoeba invadens
IDGNTRS

SEQ ID NO: 2758550 - protein, 12 aa, Entamoeba invadens
IDGRNCDACNES

SEQ ID NO: 2758551 - protein, 5 aa, Entamoeba invadens
IDGSP

SEQ ID NO: 2758552 - protein, 5 aa, Entamoeba invadens
IDGSY

SEQ ID NO: 2758553 - protein, 5 aa, Entamoeba invadens
IDGTQ

SEQ ID NO: 2758554 - protein, 9 aa, Entamoeba invadens
IDGTYSGTF

SEQ ID NO: 2758555 - protein, 12 aa, Entamoeba invadens
IDIGNDDLTAPL

SEQ ID NO: 2758556 - protein, 5 aa, Entamoeba invadens
IDITA

SEQ ID NO: 2758557 - protein, 9 aa, Entamoeba invadens
IDKENDSKL

SEQ ID NO: 2758558 - protein, 5 aa, Entamoeba invadens
IDKEQ

SEQ ID NO: 2758559 - protein, 9 aa, Entamoeba invadens
IDKGSKPKV

SEQ ID NO: 2758560 - protein, 13 aa, Entamoeba invadens
IDKISGKEETSTA

SEQ ID NO: 2758561 - protein, 10 aa, Entamoeba invadens
IDKNTTSNTI

SEQ ID NO: 2758562 - protein, 6 aa, Entamoeba invadens
IDKPSR

SEQ ID NO: 2758563 - protein, 25 aa, Entamoeba invadens
IDKREQENATLQGENERIEKDTKVL

SEQ ID NO: 2758564 - protein, 14 aa, Entamoeba invadens
IDNEGKETQKGMKT

SEQ ID NO: 2758565 - protein, 4 aa, Entamoeba invadens
IDNG

SEQ ID NO: 2758566 - protein, 6 aa, Entamoeba invadens
IDNGEL

SEQ ID NO: 2758567 - protein, 29 aa, Entamoeba invadens
IDNGKELEEIHTETQSTPESKTKPTQQVT

SEQ ID NO: 2758568 - protein, 15 aa, Entamoeba invadens
IDNKEVKAEANSYSL

SEQ ID NO: 2758569 - protein, 10 aa, Entamoeba invadens
IDNPPKLEEY

SEQ ID NO: 2758570 - protein, 5 aa, Entamoeba invadens
IDNSR

SEQ ID NO: 2758571 - protein, 5 aa, Entamoeba invadens
IDPAD

SEQ ID NO: 2758572 - protein, 5 aa, Entamoeba invadens
IDPAE

SEQ ID NO: 2758573 - protein, 9 aa, Entamoeba invadens
IDPDESKKI

SEQ ID NO: 2758574 - protein, 23 aa, Entamoeba invadens
IDPETLEPRVPDVNGTYEGPLGP

SEQ ID NO: 2758575 - protein, 9 aa, Entamoeba invadens
IDPLPPQQV

SEQ ID NO: 2758576 - protein, 10 aa, Entamoeba invadens
IDPSEEPGMD

SEQ ID NO: 2758577 - protein, 12 aa, Entamoeba invadens
IDPSEKHSIDNK

SEQ ID NO: 2758578 - protein, 4 aa, Entamoeba invadens
IDPT

SEQ ID NO: 2758579 - protein, 5 aa, Entamoeba invadens
IDPTK

SEQ ID NO: 2758580 - protein, 5 aa, Entamoeba invadens
IDQKE

SEQ ID NO: 2758581 - protein, 7 aa, Entamoeba invadens
IDQKSLD

SEQ ID NO: 2758582 - protein, 9 aa, Entamoeba invadens
IDQNSTTKI

SEQ ID NO: 2758583 - protein, 4 aa, Entamoeba invadens
IDQQ

SEQ ID NO: 2758584 - protein, 8 aa, Entamoeba invadens
IDQQERRN

SEQ ID NO: 2758585 - protein, 17 aa, Entamoeba invadens
IDQSDMTGESDAVRKTA

SEQ ID NO: 2758586 - protein, 9 aa, Entamoeba invadens
IDQSDNSLQ

SEQ ID NO: 2758587 - protein, 5 aa, Entamoeba invadens
IDQTR

SEQ ID NO: 2758588 - protein, 4 aa, Entamoeba invadens
IDRN

SEQ ID NO: 2758589 - protein, 9 aa, Entamoeba invadens
IDSEENEYH

SEQ ID NO: 2758590 - protein, 9 aa, Entamoeba invadens
IDSERVTPA

SEQ ID NO: 2758591 - protein, 8 aa, Entamoeba invadens
IDSKEQWE

SEQ ID NO: 2758592 - protein, 8 aa, Entamoeba invadens
IDSQYSAY

SEQ ID NO: 2758593 - protein, 6 aa, Entamoeba invadens
IDSSHS

SEQ ID NO: 2758594 - protein, 5 aa, Entamoeba invadens
IDSTL

SEQ ID NO: 2758595 - protein, 10 aa, Entamoeba invadens
IDSTQSVSTQ

SEQ ID NO: 2758596 - protein, 15 aa, Entamoeba invadens
IDTCTTKVKSGKETV

SEQ ID NO: 2758597 - protein, 6 aa, Entamoeba invadens
IDTDKS

SEQ ID NO: 2758598 - protein, 20 aa, Entamoeba invadens
IDTEGTCKTCTSTTECSTCN

SEQ ID NO: 2758599 - protein, 7 aa, Entamoeba invadens
IDTGKGK

SEQ ID NO: 2758600 - protein, 10 aa, Entamoeba invadens
IDTGNGTWGD

SEQ ID NO: 2758601 - protein, 11 aa, Entamoeba invadens
IDTKSPRHTKT

SEQ ID NO: 2758602 - protein, 10 aa, Entamoeba invadens
IDTNKSSKEV

SEQ ID NO: 2758603 - protein, 8 aa, Entamoeba invadens
IDTNSKNK

SEQ ID NO: 2758604 - protein, 12 aa, Entamoeba invadens
IDTNTLKQRQPQ

SEQ ID NO: 2758605 - protein, 7 aa, Entamoeba invadens
IDTPLTP

SEQ ID NO: 2758606 - protein, 7 aa, Entamoeba invadens
IDTQQGF

SEQ ID NO: 2758607 - protein, 5 aa, Entamoeba invadens
IDTRL

SEQ ID NO: 2758608 - protein, 8 aa, Entamoeba invadens
IDTSEQPV

SEQ ID NO: 2758609 - protein, 11 aa, Entamoeba invadens
IDTSHSADCLT

SEQ ID NO: 2758610 - protein, 4 aa, Entamoeba invadens
IDTT

SEQ ID NO: 2758611 - protein, 8 aa, Entamoeba invadens
IDTTARTK

SEQ ID NO: 2758612 - protein, 10 aa, Entamoeba invadens
IDTTTQQTTK

SEQ ID NO: 2758613 - protein, 4 aa, Entamoeba invadens
IDVN

SEQ ID NO: 2758614 - protein, 4 aa, Entamoeba invadens
IDVS

SEQ ID NO: 2758615 - protein, 15 aa, Entamoeba invadens
IEADIKDNKASISGV

SEQ ID NO: 2758616 - protein, 9 aa, Entamoeba invadens
IEAPGRSIE

SEQ ID NO: 2758617 - protein, 8 aa, Entamoeba invadens
IEAPGRTI

SEQ ID NO: 2758618 - protein, 9 aa, Entamoeba invadens
IEDDETDAF

SEQ ID NO: 2758619 - protein, 6 aa, Entamoeba invadens
IEDDKA

SEQ ID NO: 2758620 - protein, 6 aa, Entamoeba invadens
IEDDKS

SEQ ID NO: 2758621 - protein, 5 aa, Entamoeba invadens
IEDDQ

SEQ ID NO: 2758622 - protein, 6 aa, Entamoeba invadens
IEDDSP

SEQ ID NO: 2758623 - protein, 12 aa, Entamoeba invadens
IEDKLQENVPET

SEQ ID NO: 2758624 - protein, 5 aa, Entamoeba invadens
IEDKN

SEQ ID NO: 2758625 - protein, 5 aa, Entamoeba invadens
IEDQL

SEQ ID NO: 2758626 - protein, 11 aa, Entamoeba invadens
IEDQLQEGVPE

SEQ ID NO: 2758627 - protein, 8 aa, Entamoeba invadens
IEDTNKEI

SEQ ID NO: 2758628 - protein, 4 aa, Entamoeba invadens
IEEC

SEQ ID NO: 2758629 - protein, 43 aa, Entamoeba invadens
IEEEDEKLVKTQEKSVLSKREVKEEKKEEKIEEKRVVKEEKKV

SEQ ID NO: 2758630 - protein, 6 aa, Entamoeba invadens
IEEEEY

SEQ ID NO: 2758631 - protein, 5 aa, Entamoeba invadens
IEEES

SEQ ID NO: 2758632 - protein, 12 aa, Entamoeba invadens
IEEGEEVTVDSK

SEQ ID NO: 2758633 - protein, 6 aa, Entamoeba invadens
IEEGEK

SEQ ID NO: 2758634 - protein, 8 aa, Entamoeba invadens
IEEKKREV

SEQ ID NO: 2758635 - protein, 31 aa, Entamoeba invadens
IEEKQKKQQMEEELKDEENVNNKEKDSNGVD

SEQ ID NO: 2758636 - protein, 4 aa, Entamoeba invadens
IEEN

SEQ ID NO: 2758637 - protein, 6 aa, Entamoeba invadens
IEENEG

SEQ ID NO: 2758638 - protein, 8 aa, Entamoeba invadens
IEENKNDP

SEQ ID NO: 2758639 - protein, 16 aa, Entamoeba invadens
IEENTTTIENSKCKEC

SEQ ID NO: 2758640 - protein, 28 aa, Entamoeba invadens
IEEQKESQKKEKLDKKEKVSGDKNEIGD

SEQ ID NO: 2758641 - protein, 23 aa, Entamoeba invadens
IEERKRKAVQDELNKKKAEMHTK

SEQ ID NO: 2758642 - protein, 15 aa, Entamoeba invadens
IEERVNEEVDDDDPN

SEQ ID NO: 2758643 - protein, 5 aa, Entamoeba invadens
IEESA

SEQ ID NO: 2758644 - protein, 8 aa, Entamoeba invadens
IEESGTID

SEQ ID NO: 2758645 - protein, 30 aa, Entamoeba invadens
IEESKEESIVKSNAKSEEENSKEPSTSVEP

SEQ ID NO: 2758646 - protein, 10 aa, Entamoeba invadens
IEESKEESVV

SEQ ID NO: 2758647 - protein, 6 aa, Entamoeba invadens
IEETKY

SEQ ID NO: 2758648 - protein, 13 aa, Entamoeba invadens
IEETSAVISTEGK

SEQ ID NO: 2758649 - protein, 13 aa, Entamoeba invadens
IEFDSQPEINEPI

SEQ ID NO: 2758650 - protein, 18 aa, Entamoeba invadens
IEFEGKNDEEAIPVDRES

SEQ ID NO: 2758651 - protein, 19 aa, Entamoeba invadens
IEFEGKNYEETIPVDKESR

SEQ ID NO: 2758652 - protein, 5 aa, Entamoeba invadens
IEGDY

SEQ ID NO: 2758653 - protein, 19 aa, Entamoeba invadens
IEGEASISNSLTLSSGSLT

SEQ ID NO: 2758654 - protein, 5 aa, Entamoeba invadens
IEGGE

SEQ ID NO: 2758655 - protein, 10 aa, Entamoeba invadens
IEGLPDECGG

SEQ ID NO: 2758656 - protein, 8 aa, Entamoeba invadens
IEGRQEES

SEQ ID NO: 2758657 - protein, 6 aa, Entamoeba invadens
IEGTDG

SEQ ID NO: 2758658 - protein, 10 aa, Entamoeba invadens
IEGTNTGEPI

SEQ ID NO: 2758659 - protein, 4 aa, Entamoeba invadens
IEHN

SEQ ID NO: 2758660 - protein, 26 aa, Entamoeba invadens
IEHSNSLSEEKARKCSLENTKSVLTN

SEQ ID NO: 2758661 - protein, 4 aa, Entamoeba invadens
IEIQ

SEQ ID NO: 2758662 - protein, 4 aa, Entamoeba invadens
IEIT

SEQ ID NO: 2758663 - protein, 5 aa, Entamoeba invadens
IEITG

SEQ ID NO: 2758664 - protein, 32 aa, Entamoeba invadens
IEKDDASSTTPKTPEQSPAPSVTSEKSNEMND

SEQ ID NO: 2758665 - protein, 12 aa, Entamoeba invadens
IEKDSNILNSSE

SEQ ID NO: 2758666 - protein, 13 aa, Entamoeba invadens
IEKEEDAEGDNYI

SEQ ID NO: 2758667 - protein, 20 aa, Entamoeba invadens
IEKEKSENAEKVDTENDKKE

SEQ ID NO: 2758668 - protein, 7 aa, Entamoeba invadens
IEKHPNV

SEQ ID NO: 2758669 - protein, 5 aa, Entamoeba invadens
IEKNG

SEQ ID NO: 2758670 - protein, 41 aa, Entamoeba invadens
IEKPTKCSTNYGITESGNCESTTCKEKEKMEQNGRCSETQD

SEQ ID NO: 2758671 - protein, 7 aa, Entamoeba invadens
IEKQDEN

SEQ ID NO: 2758672 - protein, 10 aa, Entamoeba invadens
IEKQEATDAK

SEQ ID NO: 2758673 - protein, 6 aa, Entamoeba invadens
IEKQND

SEQ ID NO: 2758674 - protein, 13 aa, Entamoeba invadens
IEKREKAIEKKRE

SEQ ID NO: 2758675 - protein, 5 aa, Entamoeba invadens
IEKSV

SEQ ID NO: 2758676 - protein, 4 aa, Entamoeba invadens
IEKT

SEQ ID NO: 2758677 - protein, 9 aa, Entamoeba invadens
IEKTKTLKE

SEQ ID NO: 2758678 - protein, 12 aa, Entamoeba invadens
IEKTNSGESTSK

SEQ ID NO: 2758679 - protein, 9 aa, Entamoeba invadens
IEKTSYNPR

SEQ ID NO: 2758680 - protein, 5 aa, Entamoeba invadens
IEKTT

SEQ ID NO: 2758681 - protein, 12 aa, Entamoeba invadens
IEKVPKDAAKQF

SEQ ID NO: 2758682 - protein, 6 aa, Entamoeba invadens
IELNER

SEQ ID NO: 2758683 - protein, 5 aa, Entamoeba invadens
IELNQ

SEQ ID NO: 2758684 - protein, 12 aa, Entamoeba invadens
IELSGNSVNEIG

SEQ ID NO: 2758685 - protein, 4 aa, Entamoeba invadens
IEMK

SEQ ID NO: 2758686 - protein, 4 aa, Entamoeba invadens
IENA

SEQ ID NO: 2758687 - protein, 5 aa, Entamoeba invadens
IENAQ

SEQ ID NO: 2758688 - protein, 14 aa, Entamoeba invadens
IENDMTEKKEEPTQ

SEQ ID NO: 2758689 - protein, 5 aa, Entamoeba invadens
IENEI

SEQ ID NO: 2758690 - protein, 10 aa, Entamoeba invadens
IENEKSQNTF

SEQ ID NO: 2758691 - protein, 5 aa, Entamoeba invadens
IENES

SEQ ID NO: 2758692 - protein, 7 aa, Entamoeba invadens
IENETAE

SEQ ID NO: 2758693 - protein, 6 aa, Entamoeba invadens
IENGEK

SEQ ID NO: 2758694 - protein, 5 aa, Entamoeba invadens
IENKE

SEQ ID NO: 2758695 - protein, 6 aa, Entamoeba invadens
IENKEV

SEQ ID NO: 2758696 - protein, 12 aa, Entamoeba invadens
IENNKPLRIPKT

SEQ ID NO: 2758697 - protein, 5 aa, Entamoeba invadens
IENPQ

SEQ ID NO: 2758698 - protein, 6 aa, Entamoeba invadens
IENPSD

SEQ ID NO: 2758699 - protein, 4 aa, Entamoeba invadens
IENQ

SEQ ID NO: 2758700 - protein, 36 aa, Entamoeba invadens
IENQNVKKQTEDVEQIKKTTEQVGQSVQNASDTAKH

SEQ ID NO: 2758701 - protein, 10 aa, Entamoeba invadens
IENSDGCSLQ

SEQ ID NO: 2758702 - protein, 30 aa, Entamoeba invadens
IENTQNVDNNNAAEGTEPVVDEPEKTEKVK

SEQ ID NO: 2758703 - protein, 11 aa, Entamoeba invadens
IENTTKAVQNF

SEQ ID NO: 2758704 - protein, 12 aa, Entamoeba invadens
IEPADEKEDLKM

SEQ ID NO: 2758705 - protein, 12 aa, Entamoeba invadens
IEPFNGKGKEAR

SEQ ID NO: 2758706 - protein, 5 aa, Entamoeba invadens
IEPGQ

SEQ ID NO: 2758707 - protein, 4 aa, Entamoeba invadens
IEPI

SEQ ID NO: 2758708 - protein, 10 aa, Entamoeba invadens
IEPKGTTSEI

SEQ ID NO: 2758709 - protein, 5 aa, Entamoeba invadens
IEPKP

SEQ ID NO: 2758710 - protein, 7 aa, Entamoeba invadens
IEPKTST

SEQ ID NO: 2758711 - protein, 12 aa, Entamoeba invadens
IEPRSKHPNCKK

SEQ ID NO: 2758712 - protein, 14 aa, Entamoeba invadens
IEPSQTKTRATLKT

SEQ ID NO: 2758713 - protein, 6 aa, Entamoeba invadens
IEPTEK

SEQ ID NO: 2758714 - protein, 19 aa, Entamoeba invadens
IEPTQTKTFTTLKSEDVGC

SEQ ID NO: 2758715 - protein, 11 aa, Entamoeba invadens
IEQGSFKKTEF

SEQ ID NO: 2758716 - protein, 7 aa, Entamoeba invadens
IEQNVNN

SEQ ID NO: 2758717 - protein, 10 aa, Entamoeba invadens
IEQQSPDEFN

SEQ ID NO: 2758718 - protein, 4 aa, Entamoeba invadens
IEQS

SEQ ID NO: 2758719 - protein, 10 aa, Entamoeba invadens
IEQSGNSKIQ

SEQ ID NO: 2758720 - protein, 7 aa, Entamoeba invadens
IEQSGVV

SEQ ID NO: 2758721 - protein, 7 aa, Entamoeba invadens
IEQSSER

SEQ ID NO: 2758722 - protein, 6 aa, Entamoeba invadens
IEQTKG

SEQ ID NO: 2758723 - protein, 6 aa, Entamoeba invadens
IEQVST

SEQ ID NO: 2758724 - protein, 23 aa, Entamoeba invadens
IERASSPKFTQKKPQNSDLRDSR

SEQ ID NO: 2758725 - protein, 12 aa, Entamoeba invadens
IERKKENQNIET

SEQ ID NO: 2758726 - protein, 6 aa, Entamoeba invadens
IERNGT

SEQ ID NO: 2758727 - protein, 10 aa, Entamoeba invadens
IERNQPAPLP

SEQ ID NO: 2758728 - protein, 5 aa, Entamoeba invadens
IERST

SEQ ID NO: 2758729 - protein, 10 aa, Entamoeba invadens
IESDKNGEIV

SEQ ID NO: 2758730 - protein, 19 aa, Entamoeba invadens
IESDKTKVETTSDTNINTC

SEQ ID NO: 2758731 - protein, 15 aa, Entamoeba invadens
IESDKTKVETTSNTN

SEQ ID NO: 2758732 - protein, 6 aa, Entamoeba invadens
IESEDE

SEQ ID NO: 2758733 - protein, 8 aa, Entamoeba invadens
IESEESNN

SEQ ID NO: 2758734 - protein, 23 aa, Entamoeba invadens
IESENLKAAQKAQVRKDYAYKNN

SEQ ID NO: 2758735 - protein, 10 aa, Entamoeba invadens
IESGEIPVNE

SEQ ID NO: 2758736 - protein, 5 aa, Entamoeba invadens
IESGT

SEQ ID NO: 2758737 - protein, 9 aa, Entamoeba invadens
IESGTHEEL

SEQ ID NO: 2758738 - protein, 7 aa, Entamoeba invadens
IESGTHQ

SEQ ID NO: 2758739 - protein, 7 aa, Entamoeba invadens
IESGTRN

SEQ ID NO: 2758740 - protein, 11 aa, Entamoeba invadens
IESHKSKTKKW

SEQ ID NO: 2758741 - protein, 10 aa, Entamoeba invadens
IESPNHVENI

SEQ ID NO: 2758742 - protein, 8 aa, Entamoeba invadens
IESQGEPV

SEQ ID NO: 2758743 - protein, 7 aa, Entamoeba invadens
IESSDEI

SEQ ID NO: 2758744 - protein, 6 aa, Entamoeba invadens
IESSPK

SEQ ID NO: 2758745 - protein, 9 aa, Entamoeba invadens
IESSQTKTY

SEQ ID NO: 2758746 - protein, 7 aa, Entamoeba invadens
IESTTIN

SEQ ID NO: 2758747 - protein, 12 aa, Entamoeba invadens
IETASLKDSTNF

SEQ ID NO: 2758748 - protein, 74 aa, Entamoeba invadens
IETCQPSQIQSDKKETIQQTTTTNNTTVEKTQPLIKSTPTNPIPLENKGNEKHYKDKTSLYTPKESETKAGQVL

SEQ ID NO: 2758749 - protein, 10 aa, Entamoeba invadens
IETEQTTKLN

SEQ ID NO: 2758750 - protein, 5 aa, Entamoeba invadens
IETES

SEQ ID NO: 2758751 - protein, 6 aa, Entamoeba invadens
IETETF

SEQ ID NO: 2758752 - protein, 6 aa, Entamoeba invadens
IETIDG

SEQ ID NO: 2758753 - protein, 5 aa, Entamoeba invadens
IETKE

SEQ ID NO: 2758754 - protein, 4 aa, Entamoeba invadens
IETN

SEQ ID NO: 2758755 - protein, 13 aa, Entamoeba invadens
IETNNESQQGDTR

SEQ ID NO: 2758756 - protein, 6 aa, Entamoeba invadens
IETNSD

SEQ ID NO: 2758757 - protein, 12 aa, Entamoeba invadens
IETNTENTTKLN

SEQ ID NO: 2758758 - protein, 4 aa, Entamoeba invadens
IETQ

SEQ ID NO: 2758759 - protein, 8 aa, Entamoeba invadens
IETQKVEE

SEQ ID NO: 2758760 - protein, 22 aa, Entamoeba invadens
IETQSAPNIARSPSPGLSKIGS

SEQ ID NO: 2758761 - protein, 6 aa, Entamoeba invadens
IETSER

SEQ ID NO: 2758762 - protein, 5 aa, Entamoeba invadens
IETTE

SEQ ID NO: 2758763 - protein, 6 aa, Entamoeba invadens
IETTSN

SEQ ID NO: 2758764 - protein, 59 aa, Entamoeba invadens
IETTTQKCETQTPVVSPTTTPKEKNDGQIETRQDDKIKEQKEQLQEQTDITPVKPQTET

SEQ ID NO: 2758765 - protein, 10 aa, Entamoeba invadens
IETTTVQSTK

SEQ ID NO: 2758766 - protein, 11 aa, Entamoeba invadens
IETTTVQSTKL

SEQ ID NO: 2758767 - protein, 11 aa, Entamoeba invadens
IEYDNDNSCNQ

SEQ ID NO: 2758768 - protein, 5 aa, Entamoeba invadens
IEYET

SEQ ID NO: 2758769 - protein, 6 aa, Entamoeba invadens
IEYSPD

SEQ ID NO: 2758770 - protein, 60 aa, Entamoeba invadens
IFEESDEDQTSSSSEEKENKNDKKVEEKGNNESQQPTENKGEEKDKSKSGESTATSSSSS

SEQ ID NO: 2758771 - protein, 11 aa, Entamoeba invadens
IGAERNVPNGK

SEQ ID NO: 2758772 - protein, 5 aa, Entamoeba invadens
IGAKG

SEQ ID NO: 2758773 - protein, 5 aa, Entamoeba invadens
IGANA

SEQ ID NO: 2758774 - protein, 10 aa, Entamoeba invadens
IGAQKETGIL

SEQ ID NO: 2758775 - protein, 4 aa, Entamoeba invadens
IGDC

SEQ ID NO: 2758776 - protein, 7 aa, Entamoeba invadens
IGDDNYR

SEQ ID NO: 2758777 - protein, 7 aa, Entamoeba invadens
IGDGAND

SEQ ID NO: 2758778 - protein, 9 aa, Entamoeba invadens
IGDGANDIP

SEQ ID NO: 2758779 - protein, 8 aa, Entamoeba invadens
IGDGGNDV

SEQ ID NO: 2758780 - protein, 9 aa, Entamoeba invadens
IGDGGNDVS

SEQ ID NO: 2758781 - protein, 8 aa, Entamoeba invadens
IGDKDATD

SEQ ID NO: 2758782 - protein, 10 aa, Entamoeba invadens
IGDKNGNGNC

SEQ ID NO: 2758783 - protein, 10 aa, Entamoeba invadens
IGDPAEKAAL

SEQ ID NO: 2758784 - protein, 7 aa, Entamoeba invadens
IGDQKDC

SEQ ID NO: 2758785 - protein, 10 aa, Entamoeba invadens
IGDYPPEKLH

SEQ ID NO: 2758786 - protein, 7 aa, Entamoeba invadens
IGEESYL

SEQ ID NO: 2758787 - protein, 4 aa, Entamoeba invadens
IGEG

SEQ ID NO: 2758788 - protein, 6 aa, Entamoeba invadens
IGEGNF

SEQ ID NO: 2758789 - protein, 5 aa, Entamoeba invadens
IGEGT

SEQ ID NO: 2758790 - protein, 6 aa, Entamoeba invadens
IGEGTD

SEQ ID NO: 2758791 - protein, 13 aa, Entamoeba invadens
IGEKVQKDEDEMK

SEQ ID NO: 2758792 - protein, 7 aa, Entamoeba invadens
IGEQNPI

SEQ ID NO: 2758793 - protein, 9 aa, Entamoeba invadens
IGESGSEFR

SEQ ID NO: 2758794 - protein, 10 aa, Entamoeba invadens
IGESRSESED

SEQ ID NO: 2758795 - protein, 5 aa, Entamoeba invadens
IGEYK

SEQ ID NO: 2758796 - protein, 4 aa, Entamoeba invadens
IGGA

SEQ ID NO: 2758797 - protein, 10 aa, Entamoeba invadens
IGGDEKITQK

SEQ ID NO: 2758798 - protein, 12 aa, Entamoeba invadens
IGGDSVTTKQNV

SEQ ID NO: 2758799 - protein, 10 aa, Entamoeba invadens
IGGETTTLGA

SEQ ID NO: 2758800 - protein, 13 aa, Entamoeba invadens
IGGKSTVAQPTAM

SEQ ID NO: 2758801 - protein, 5 aa, Entamoeba invadens
IGGND

SEQ ID NO: 2758802 - protein, 11 aa, Entamoeba invadens
IGGNDAGAMPT

SEQ ID NO: 2758803 - protein, 9 aa, Entamoeba invadens
IGGNDNEDI

SEQ ID NO: 2758804 - protein, 5 aa, Entamoeba invadens
IGGNK

SEQ ID NO: 2758805 - protein, 7 aa, Entamoeba invadens
IGGQSRF

SEQ ID NO: 2758806 - protein, 6 aa, Entamoeba invadens
IGGQTL

SEQ ID NO: 2758807 - protein, 24 aa, Entamoeba invadens
IGGTSSCSKCPSNTYSLEKSSECL

SEQ ID NO: 2758808 - protein, 13 aa, Entamoeba invadens
IGKAKGRNETEKN

SEQ ID NO: 2758809 - protein, 5 aa, Entamoeba invadens
IGKGS

SEQ ID NO: 2758810 - protein, 5 aa, Entamoeba invadens
IGKGT

SEQ ID NO: 2758811 - protein, 7 aa, Entamoeba invadens
IGKKVDD

SEQ ID NO: 2758812 - protein, 6 aa, Entamoeba invadens
IGKRPK

SEQ ID NO: 2758813 - protein, 23 aa, Entamoeba invadens
IGKSVTEGFTPNTCTTKTTESRS

SEQ ID NO: 2758814 - protein, 8 aa, Entamoeba invadens
IGNDMSNE

SEQ ID NO: 2758815 - protein, 6 aa, Entamoeba invadens
IGNEGK

SEQ ID NO: 2758816 - protein, 9 aa, Entamoeba invadens
IGNKAGSQI

SEQ ID NO: 2758817 - protein, 10 aa, Entamoeba invadens
IGNKDSVGGH

SEQ ID NO: 2758818 - protein, 20 aa, Entamoeba invadens
IGNKNSVGGYKCKNGKYDRS

SEQ ID NO: 2758819 - protein, 10 aa, Entamoeba invadens
IGNKPEDDGK

SEQ ID NO: 2758820 - protein, 6 aa, Entamoeba invadens
IGNKTE

SEQ ID NO: 2758821 - protein, 8 aa, Entamoeba invadens
IGNNNECY

SEQ ID NO: 2758822 - protein, 4 aa, Entamoeba invadens
IGNS

SEQ ID NO: 2758823 - protein, 8 aa, Entamoeba invadens
IGNTEKSH

SEQ ID NO: 2758824 - protein, 14 aa, Entamoeba invadens
IGPASSPKSSSKYD

SEQ ID NO: 2758825 - protein, 12 aa, Entamoeba invadens
IGPDKDDNYAYK

SEQ ID NO: 2758826 - protein, 18 aa, Entamoeba invadens
IGPGPKSVINEVTGKLKL

SEQ ID NO: 2758827 - protein, 6 aa, Entamoeba invadens
IGPHSQ

SEQ ID NO: 2758828 - protein, 4 aa, Entamoeba invadens
IGPN

SEQ ID NO: 2758829 - protein, 4 aa, Entamoeba invadens
IGPQ

SEQ ID NO: 2758830 - protein, 4 aa, Entamoeba invadens
IGQG

SEQ ID NO: 2758831 - protein, 5 aa, Entamoeba invadens
IGQKD

SEQ ID NO: 2758832 - protein, 4 aa, Entamoeba invadens
IGQN

SEQ ID NO: 2758833 - protein, 32 aa, Entamoeba invadens
IGQQKADSISESTSPDPTNTNPAKQSGPLTQV

SEQ ID NO: 2758834 - protein, 5 aa, Entamoeba invadens
IGRAQ

SEQ ID NO: 2758835 - protein, 6 aa, Entamoeba invadens
IGRGGA

SEQ ID NO: 2758836 - protein, 12 aa, Entamoeba invadens
IGRHQTKPRGGN

SEQ ID NO: 2758837 - protein, 9 aa, Entamoeba invadens
IGRSSSSFS

SEQ ID NO: 2758838 - protein, 4 aa, Entamoeba invadens
IGRY

SEQ ID NO: 2758839 - protein, 10 aa, Entamoeba invadens
IGSAEGNGVF

SEQ ID NO: 2758840 - protein, 10 aa, Entamoeba invadens
IGSDSEESSM

SEQ ID NO: 2758841 - protein, 6 aa, Entamoeba invadens
IGSENT

SEQ ID NO: 2758842 - protein, 9 aa, Entamoeba invadens
IGSESTYRY

SEQ ID NO: 2758843 - protein, 4 aa, Entamoeba invadens
IGSG

SEQ ID NO: 2758844 - protein, 6 aa, Entamoeba invadens
IGSGAF

SEQ ID NO: 2758845 - protein, 5 aa, Entamoeba invadens
IGSGK

SEQ ID NO: 2758846 - protein, 10 aa, Entamoeba invadens
IGSGSDATFA

SEQ ID NO: 2758847 - protein, 11 aa, Entamoeba invadens
IGSIPVGQESR

SEQ ID NO: 2758848 - protein, 5 aa, Entamoeba invadens
IGSKG

SEQ ID NO: 2758849 - protein, 70 aa, Entamoeba invadens
IGSKNEKAKIEENESKEIASELSTENNDISGDGSSNLNTNDKNDKIEKYGNESMEKQITPPNDFEQSKKY

SEQ ID NO: 2758850 - protein, 12 aa, Entamoeba invadens
IGSPQQTAEEMK

SEQ ID NO: 2758851 - protein, 5 aa, Entamoeba invadens
IGSSG

SEQ ID NO: 2758852 - protein, 10 aa, Entamoeba invadens
IGSTHGQTYP

SEQ ID NO: 2758853 - protein, 6 aa, Entamoeba invadens
IGSTNS

SEQ ID NO: 2758854 - protein, 10 aa, Entamoeba invadens
IGSVTGTGTL

SEQ ID NO: 2758855 - protein, 5 aa, Entamoeba invadens
IGSYN

SEQ ID NO: 2758856 - protein, 8 aa, Entamoeba invadens
IGTAYDDA

SEQ ID NO: 2758857 - protein, 11 aa, Entamoeba invadens
IGTEDDSQKIE

SEQ ID NO: 2758858 - protein, 12 aa, Entamoeba invadens
IGTEKKDGERRI

SEQ ID NO: 2758859 - protein, 18 aa, Entamoeba invadens
IGTEKRRGVSGGEKKRVS

SEQ ID NO: 2758860 - protein, 11 aa, Entamoeba invadens
IGTMSAAESNI

SEQ ID NO: 2758861 - protein, 4 aa, Entamoeba invadens
IGTP

SEQ ID NO: 2758862 - protein, 6 aa, Entamoeba invadens
IGTSES

SEQ ID NO: 2758863 - protein, 11 aa, Entamoeba invadens
IGVDEKSKVED

SEQ ID NO: 2758864 - protein, 6 aa, Entamoeba invadens
IGYTGG

SEQ ID NO: 2758865 - protein, 24 aa, Entamoeba invadens
IHGKSFEESDLKNSECEIENTQKR

SEQ ID NO: 2758866 - protein, 12 aa, Entamoeba invadens
IHPKEEPTFYDR

SEQ ID NO: 2758867 - protein, 7 aa, Entamoeba invadens
IHPNKSG

SEQ ID NO: 2758868 - protein, 13 aa, Entamoeba invadens
IHPPHKKKKRNMN

SEQ ID NO: 2758869 - protein, 6 aa, Entamoeba invadens
IHPTAS

SEQ ID NO: 2758870 - protein, 4 aa, Entamoeba invadens
IHSQ

SEQ ID NO: 2758871 - protein, 4 aa, Entamoeba invadens
IHTE

SEQ ID NO: 2758872 - protein, 5 aa, Entamoeba invadens
IHTST

SEQ ID NO: 2758873 - protein, 5 aa, Entamoeba invadens
IHTTK

SEQ ID NO: 2758874 - protein, 10 aa, Entamoeba invadens
IIDESTQKEF

SEQ ID NO: 2758875 - protein, 9 aa, Entamoeba invadens
IIDPNSQIQ

SEQ ID NO: 2758876 - protein, 12 aa, Entamoeba invadens
IIEKSQKERDDQ

SEQ ID NO: 2758877 - protein, 7 aa, Entamoeba invadens
IINGTKA

SEQ ID NO: 2758878 - protein, 16 aa, Entamoeba invadens
IIPERDPVANSGENGG

SEQ ID NO: 2758879 - protein, 30 aa, Entamoeba invadens
IIPSQSLKPEKSEKELEEKLKQRKKGQRIE

SEQ ID NO: 2758880 - protein, 17 aa, Entamoeba invadens
IISSRDQSSCCSEPQSA

SEQ ID NO: 2758881 - protein, 11 aa, Entamoeba invadens
IITDGNTEQIP

SEQ ID NO: 2758882 - protein, 6 aa, Entamoeba invadens
IITQTT

SEQ ID NO: 2758883 - protein, 12 aa, Entamoeba invadens
IKAETQASYRLD

SEQ ID NO: 2758884 - protein, 14 aa, Entamoeba invadens
IKANGKLTDFGSSR

SEQ ID NO: 2758885 - protein, 15 aa, Entamoeba invadens
IKANGKLTDFGSSRN

SEQ ID NO: 2758886 - protein, 8 aa, Entamoeba invadens
IKAPNRIQ

SEQ ID NO: 2758887 - protein, 22 aa, Entamoeba invadens
IKAQQEKKEKYIAPGQNSGVYQ

SEQ ID NO: 2758888 - protein, 31 aa, Entamoeba invadens
IKASDQDDMEIDANDGSNSDGVAQSSSPPQM

SEQ ID NO: 2758889 - protein, 13 aa, Entamoeba invadens
IKASEEAKDHSGE

SEQ ID NO: 2758890 - protein, 27 aa, Entamoeba invadens
IKASPNNKKPVALASTKNVADYTKKDT

SEQ ID NO: 2758891 - protein, 5 aa, Entamoeba invadens
IKATA

SEQ ID NO: 2758892 - protein, 14 aa, Entamoeba invadens
IKAYSSTDDTCGNW

SEQ ID NO: 2758893 - protein, 6 aa, Entamoeba invadens
IKDERS

SEQ ID NO: 2758894 - protein, 14 aa, Entamoeba invadens
IKDGHGDEGREYRP

SEQ ID NO: 2758895 - protein, 7 aa, Entamoeba invadens
IKDGSPM

SEQ ID NO: 2758896 - protein, 9 aa, Entamoeba invadens
IKDGTTTKC

SEQ ID NO: 2758897 - protein, 14 aa, Entamoeba invadens
IKDKEGDKKCKDTL

SEQ ID NO: 2758898 - protein, 10 aa, Entamoeba invadens
IKDKERVGSK

SEQ ID NO: 2758899 - protein, 9 aa, Entamoeba invadens
IKDKKKIEE

SEQ ID NO: 2758900 - protein, 6 aa, Entamoeba invadens
IKDPNR

SEQ ID NO: 2758901 - protein, 6 aa, Entamoeba invadens
IKDQEK

SEQ ID NO: 2758902 - protein, 16 aa, Entamoeba invadens
IKDQPIQNYKQDVDNT

SEQ ID NO: 2758903 - protein, 6 aa, Entamoeba invadens
IKDQSE

SEQ ID NO: 2758904 - protein, 7 aa, Entamoeba invadens
IKDSQTR

SEQ ID NO: 2758905 - protein, 8 aa, Entamoeba invadens
IKDSTNVQ

SEQ ID NO: 2758906 - protein, 6 aa, Entamoeba invadens
IKEEDA

SEQ ID NO: 2758907 - protein, 16 aa, Entamoeba invadens
IKEEDVPQTVTNDEQD

SEQ ID NO: 2758908 - protein, 9 aa, Entamoeba invadens
IKEEEAKER

SEQ ID NO: 2758909 - protein, 7 aa, Entamoeba invadens
IKEESGK

SEQ ID NO: 2758910 - protein, 4 aa, Entamoeba invadens
IKEG

SEQ ID NO: 2758911 - protein, 19 aa, Entamoeba invadens
IKEGETKNKYALTPDNDGD

SEQ ID NO: 2758912 - protein, 16 aa, Entamoeba invadens
IKEKSKSKRASRENSA

SEQ ID NO: 2758913 - protein, 5 aa, Entamoeba invadens
IKEKT

SEQ ID NO: 2758914 - protein, 8 aa, Entamoeba invadens
IKELGKTH

SEQ ID NO: 2758915 - protein, 20 aa, Entamoeba invadens
IKENSKQNTQSSQGSQAVGT

SEQ ID NO: 2758916 - protein, 5 aa, Entamoeba invadens
IKENT

SEQ ID NO: 2758917 - protein, 14 aa, Entamoeba invadens
IKENTRRSERNYRE

SEQ ID NO: 2758918 - protein, 4 aa, Entamoeba invadens
IKEP

SEQ ID NO: 2758919 - protein, 4 aa, Entamoeba invadens
IKEQ

SEQ ID NO: 2758920 - protein, 19 aa, Entamoeba invadens
IKEQKDNEENKKEVEIDGN

SEQ ID NO: 2758921 - protein, 6 aa, Entamoeba invadens
IKEREE

SEQ ID NO: 2758922 - protein, 7 aa, Entamoeba invadens
IKERTGG

SEQ ID NO: 2758923 - protein, 8 aa, Entamoeba invadens
IKESNSIK

SEQ ID NO: 2758924 - protein, 8 aa, Entamoeba invadens
IKESNSMK

SEQ ID NO: 2758925 - protein, 15 aa, Entamoeba invadens
IKESTQESKVERSDE

SEQ ID NO: 2758926 - protein, 4 aa, Entamoeba invadens
IKET

SEQ ID NO: 2758927 - protein, 7 aa, Entamoeba invadens
IKETELN

SEQ ID NO: 2758928 - protein, 9 aa, Entamoeba invadens
IKETKKNQT

SEQ ID NO: 2758929 - protein, 9 aa, Entamoeba invadens
IKETPTKIE

SEQ ID NO: 2758930 - protein, 12 aa, Entamoeba invadens
IKGEDKGLGTPV

SEQ ID NO: 2758931 - protein, 11 aa, Entamoeba invadens
IKGGENKDSNV

SEQ ID NO: 2758932 - protein, 9 aa, Entamoeba invadens
IKGGNMKES

SEQ ID NO: 2758933 - protein, 8 aa, Entamoeba invadens
IKGGRKDT

SEQ ID NO: 2758934 - protein, 7 aa, Entamoeba invadens
IKGGSAN

SEQ ID NO: 2758935 - protein, 13 aa, Entamoeba invadens
IKGNEQTITGPTV

SEQ ID NO: 2758936 - protein, 5 aa, Entamoeba invadens
IKGNK

SEQ ID NO: 2758937 - protein, 11 aa, Entamoeba invadens
IKGSDDKKSHK

SEQ ID NO: 2758938 - protein, 9 aa, Entamoeba invadens
IKGTSKLEY

SEQ ID NO: 2758939 - protein, 9 aa, Entamoeba invadens
IKISSTKGA

SEQ ID NO: 2758940 - protein, 10 aa, Entamoeba invadens
IKITGSATFE

SEQ ID NO: 2758941 - protein, 9 aa, Entamoeba invadens
IKKDEQRSA

SEQ ID NO: 2758942 - protein, 8 aa, Entamoeba invadens
IKKENKDD

SEQ ID NO: 2758943 - protein, 10 aa, Entamoeba invadens
IKKENTQSDL

SEQ ID NO: 2758944 - protein, 15 aa, Entamoeba invadens
IKKERKRKYQQKGYT

SEQ ID NO: 2758945 - protein, 8 aa, Entamoeba invadens
IKKGDDCN

SEQ ID NO: 2758946 - protein, 13 aa, Entamoeba invadens
IKKMEDKKKRKDG

SEQ ID NO: 2758947 - protein, 24 aa, Entamoeba invadens
IKKNGRGETSSTLSLQANERGKYE

SEQ ID NO: 2758948 - protein, 7 aa, Entamoeba invadens
IKKSKNR

SEQ ID NO: 2758949 - protein, 6 aa, Entamoeba invadens
IKKTEN

SEQ ID NO: 2758950 - protein, 4 aa, Entamoeba invadens
IKLN

SEQ ID NO: 2758951 - protein, 11 aa, Entamoeba invadens
IKLSPPKRVSR

SEQ ID NO: 2758952 - protein, 4 aa, Entamoeba invadens
IKNG

SEQ ID NO: 2758953 - protein, 17 aa, Entamoeba invadens
IKNGSSGLSSGSLTNED

SEQ ID NO: 2758954 - protein, 10 aa, Entamoeba invadens
IKNKNKYTKN

SEQ ID NO: 2758955 - protein, 10 aa, Entamoeba invadens
IKNNTEKYND

SEQ ID NO: 2758956 - protein, 11 aa, Entamoeba invadens
IKNNTEKYNDI

SEQ ID NO: 2758957 - protein, 9 aa, Entamoeba invadens
IKNSKNECQ

SEQ ID NO: 2758958 - protein, 9 aa, Entamoeba invadens
IKNSNFEKD

SEQ ID NO: 2758959 - protein, 4 aa, Entamoeba invadens
IKNT

SEQ ID NO: 2758960 - protein, 8 aa, Entamoeba invadens
IKNTNHSN

SEQ ID NO: 2758961 - protein, 22 aa, Entamoeba invadens
IKPASCTDGHYKTETECNKCPT

SEQ ID NO: 2758962 - protein, 6 aa, Entamoeba invadens
IKPCTE

SEQ ID NO: 2758963 - protein, 6 aa, Entamoeba invadens
IKPDNE

SEQ ID NO: 2758964 - protein, 16 aa, Entamoeba invadens
IKPEGSDPCKSGKFEN

SEQ ID NO: 2758965 - protein, 4 aa, Entamoeba invadens
IKPG

SEQ ID NO: 2758966 - protein, 7 aa, Entamoeba invadens
IKPGESV

SEQ ID NO: 2758967 - protein, 6 aa, Entamoeba invadens
IKPKSE

SEQ ID NO: 2758968 - protein, 7 aa, Entamoeba invadens
IKPSEPV

SEQ ID NO: 2758969 - protein, 53 aa, Entamoeba invadens
IKPSKKDRAEKAEEPLQEEETTVEKKDKHSKKTKSEKLEKKKEREKTRLDKQK

SEQ ID NO: 2758970 - protein, 6 aa, Entamoeba invadens
IKPSTL

SEQ ID NO: 2758971 - protein, 9 aa, Entamoeba invadens
IKPYQNEPV

SEQ ID NO: 2758972 - protein, 12 aa, Entamoeba invadens
IKQNCKTKNRKV

SEQ ID NO: 2758973 - protein, 8 aa, Entamoeba invadens
IKQNSSFK

SEQ ID NO: 2758974 - protein, 4 aa, Entamoeba invadens
IKQP

SEQ ID NO: 2758975 - protein, 6 aa, Entamoeba invadens
IKQPNN

SEQ ID NO: 2758976 - protein, 7 aa, Entamoeba invadens
IKQSEYD

SEQ ID NO: 2758977 - protein, 6 aa, Entamoeba invadens
IKQSGF

SEQ ID NO: 2758978 - protein, 20 aa, Entamoeba invadens
IKQSINEKDKKMGKKPRFEA

SEQ ID NO: 2758979 - protein, 7 aa, Entamoeba invadens
IKQSTQL

SEQ ID NO: 2758980 - protein, 17 aa, Entamoeba invadens
IKQTSDDEVSKKEFEDE

SEQ ID NO: 2758981 - protein, 8 aa, Entamoeba invadens
IKQTSGQV

SEQ ID NO: 2758982 - protein, 4 aa, Entamoeba invadens
IKRF

SEQ ID NO: 2758983 - protein, 10 aa, Entamoeba invadens
IKRGSSDKVS

SEQ ID NO: 2758984 - protein, 6 aa, Entamoeba invadens
IKRNEY

SEQ ID NO: 2758985 - protein, 6 aa, Entamoeba invadens
IKRQHD

SEQ ID NO: 2758986 - protein, 7 aa, Entamoeba invadens
IKRREAQ

SEQ ID NO: 2758987 - protein, 12 aa, Entamoeba invadens
IKRSESSSSSSD

SEQ ID NO: 2758988 - protein, 10 aa, Entamoeba invadens
IKSDTNPKTC

SEQ ID NO: 2758989 - protein, 6 aa, Entamoeba invadens
IKSDTQ

SEQ ID NO: 2758990 - protein, 7 aa, Entamoeba invadens
IKSEGEV

SEQ ID NO: 2758991 - protein, 10 aa, Entamoeba invadens
IKSGEKPISS

SEQ ID NO: 2758992 - protein, 10 aa, Entamoeba invadens
IKSGESESDD

SEQ ID NO: 2758993 - protein, 6 aa, Entamoeba invadens
IKSGGK

SEQ ID NO: 2758994 - protein, 9 aa, Entamoeba invadens
IKSLGDEAF

SEQ ID NO: 2758995 - protein, 4 aa, Entamoeba invadens
IKSN

SEQ ID NO: 2758996 - protein, 7 aa, Entamoeba invadens
IKSNATG

SEQ ID NO: 2758997 - protein, 8 aa, Entamoeba invadens
IKSNYSTA

SEQ ID NO: 2758998 - protein, 7 aa, Entamoeba invadens
IKSPNDV

SEQ ID NO: 2758999 - protein, 6 aa, Entamoeba invadens
IKSPNE

SEQ ID NO: 2759000 - protein, 7 aa, Entamoeba invadens
IKSPQRN

SEQ ID NO: 2759001 - protein, 14 aa, Entamoeba invadens
IKSQKDFKKSIQKE

SEQ ID NO: 2759002 - protein, 9 aa, Entamoeba invadens
IKSQTVSNS

SEQ ID NO: 2759003 - protein, 14 aa, Entamoeba invadens
IKSSSSAIPELMEE

SEQ ID NO: 2759004 - protein, 9 aa, Entamoeba invadens
IKSTADSRM

SEQ ID NO: 2759005 - protein, 9 aa, Entamoeba invadens
IKSTENGTF

SEQ ID NO: 2759006 - protein, 36 aa, Entamoeba invadens
IKSTSGSAPSSMSASLSSSPSRSPPLGKSLTPPPRT

SEQ ID NO: 2759007 - protein, 8 aa, Entamoeba invadens
IKSVTSQE

SEQ ID NO: 2759008 - protein, 9 aa, Entamoeba invadens
IKTDNYKGC

SEQ ID NO: 2759009 - protein, 16 aa, Entamoeba invadens
IKTDTATTRIKKNRID

SEQ ID NO: 2759010 - protein, 4 aa, Entamoeba invadens
IKTE

SEQ ID NO: 2759011 - protein, 7 aa, Entamoeba invadens
IKTEPKV

SEQ ID NO: 2759012 - protein, 7 aa, Entamoeba invadens
IKTEPSL

SEQ ID NO: 2759013 - protein, 14 aa, Entamoeba invadens
IKTGQRTEKKKQKK

SEQ ID NO: 2759014 - protein, 5 aa, Entamoeba invadens
IKTGT

SEQ ID NO: 2759015 - protein, 8 aa, Entamoeba invadens
IKTGTEAR

SEQ ID NO: 2759016 - protein, 7 aa, Entamoeba invadens
IKTGYGN

SEQ ID NO: 2759017 - protein, 5 aa, Entamoeba invadens
IKTIE

SEQ ID NO: 2759018 - protein, 8 aa, Entamoeba invadens
IKTIGTDA

SEQ ID NO: 2759019 - protein, 6 aa, Entamoeba invadens
IKTKPQ

SEQ ID NO: 2759020 - protein, 4 aa, Entamoeba invadens
IKTN

SEQ ID NO: 2759021 - protein, 8 aa, Entamoeba invadens
IKTNEENF

SEQ ID NO: 2759022 - protein, 12 aa, Entamoeba invadens
IKTNGSSKRIDL

SEQ ID NO: 2759023 - protein, 4 aa, Entamoeba invadens
IKTP

SEQ ID NO: 2759024 - protein, 6 aa, Entamoeba invadens
IKTPEK

SEQ ID NO: 2759025 - protein, 7 aa, Entamoeba invadens
IKTPKGC

SEQ ID NO: 2759026 - protein, 8 aa, Entamoeba invadens
IKTPSSDR

SEQ ID NO: 2759027 - protein, 18 aa, Entamoeba invadens
IKTRENNKQTEKVRASEI

SEQ ID NO: 2759028 - protein, 16 aa, Entamoeba invadens
IKTSETTSTKTEIKDG

SEQ ID NO: 2759029 - protein, 18 aa, Entamoeba invadens
IKTSETTSTKTENKDGRF

SEQ ID NO: 2759030 - protein, 9 aa, Entamoeba invadens
IKTSRGCSY

SEQ ID NO: 2759031 - protein, 8 aa, Entamoeba invadens
IKTSSKTL

SEQ ID NO: 2759032 - protein, 10 aa, Entamoeba invadens
IKTTPNLPDG

SEQ ID NO: 2759033 - protein, 8 aa, Entamoeba invadens
IKTTSSAV

SEQ ID NO: 2759034 - protein, 9 aa, Entamoeba invadens
IKVTGTSGA

SEQ ID NO: 2759035 - protein, 5 aa, Entamoeba invadens
ILGPS

SEQ ID NO: 2759036 - protein, 5 aa, Entamoeba invadens
ILNNN

SEQ ID NO: 2759037 - protein, 19 aa, Entamoeba invadens
ILNNNKSCAETSHNNNSTN

SEQ ID NO: 2759038 - protein, 19 aa, Entamoeba invadens
ILNPTKAQLKDLQKDGIQS

SEQ ID NO: 2759039 - protein, 18 aa, Entamoeba invadens
ILNSQKECKTLDDSNCEI

SEQ ID NO: 2759040 - protein, 5 aa, Entamoeba invadens
ILNSS

SEQ ID NO: 2759041 - protein, 44 aa, Entamoeba invadens
ILPTKTLPKVPPPKVPSKELPKAPSKAPPKPPQKVPPKQPETHE

SEQ ID NO: 2759042 - protein, 5 aa, Entamoeba invadens
ILTDP

SEQ ID NO: 2759043 - protein, 4 aa, Entamoeba invadens
ILTN

SEQ ID NO: 2759044 - protein, 7 aa, Entamoeba invadens
INAKTEP

SEQ ID NO: 2759045 - protein, 12 aa, Entamoeba invadens
INANTEQSTRLD

SEQ ID NO: 2759046 - protein, 4 aa, Entamoeba invadens
INAS

SEQ ID NO: 2759047 - protein, 6 aa, Entamoeba invadens
INCTTQ

SEQ ID NO: 2759048 - protein, 13 aa, Entamoeba invadens
INDDTKTQVSNQI

SEQ ID NO: 2759049 - protein, 15 aa, Entamoeba invadens
INDEESTVKSVEESV

SEQ ID NO: 2759050 - protein, 11 aa, Entamoeba invadens
INDKHENEKVV

SEQ ID NO: 2759051 - protein, 7 aa, Entamoeba invadens
INDNKED

SEQ ID NO: 2759052 - protein, 9 aa, Entamoeba invadens
INDNSREYT

SEQ ID NO: 2759053 - protein, 18 aa, Entamoeba invadens
INDQPIQNYKQDVDNTKY

SEQ ID NO: 2759054 - protein, 8 aa, Entamoeba invadens
INEATNSR

SEQ ID NO: 2759055 - protein, 4 aa, Entamoeba invadens
INED

SEQ ID NO: 2759056 - protein, 6 aa, Entamoeba invadens
INEEEE

SEQ ID NO: 2759057 - protein, 8 aa, Entamoeba invadens
INEGKVGG

SEQ ID NO: 2759058 - protein, 12 aa, Entamoeba invadens
INEGNKSTFGKG

SEQ ID NO: 2759059 - protein, 14 aa, Entamoeba invadens
INEGVTDHTHNEEL

SEQ ID NO: 2759060 - protein, 5 aa, Entamoeba invadens
INEIP

SEQ ID NO: 2759061 - protein, 9 aa, Entamoeba invadens
INEKEDKFG

SEQ ID NO: 2759062 - protein, 7 aa, Entamoeba invadens
INEKKEA

SEQ ID NO: 2759063 - protein, 13 aa, Entamoeba invadens
INENEKKCNTCET

SEQ ID NO: 2759064 - protein, 12 aa, Entamoeba invadens
INENQDGSQTNQ

SEQ ID NO: 2759065 - protein, 8 aa, Entamoeba invadens
INENSSEL

SEQ ID NO: 2759066 - protein, 8 aa, Entamoeba invadens
INEPTEKK

SEQ ID NO: 2759067 - protein, 4 aa, Entamoeba invadens
INEQ

SEQ ID NO: 2759068 - protein, 7 aa, Entamoeba invadens
INESKLE

SEQ ID NO: 2759069 - protein, 12 aa, Entamoeba invadens
INESNTSVPTKL

SEQ ID NO: 2759070 - protein, 5 aa, Entamoeba invadens
INESS

SEQ ID NO: 2759071 - protein, 10 aa, Entamoeba invadens
INESTKGVRR

SEQ ID NO: 2759072 - protein, 15 aa, Entamoeba invadens
INETCETNANGCGEC

SEQ ID NO: 2759073 - protein, 10 aa, Entamoeba invadens
INETPSSESF

SEQ ID NO: 2759074 - protein, 26 aa, Entamoeba invadens
INETTKHVDADEEKKKKSKKDKTTPT

SEQ ID NO: 2759075 - protein, 5 aa, Entamoeba invadens
INGCT

SEQ ID NO: 2759076 - protein, 4 aa, Entamoeba invadens
INGD

SEQ ID NO: 2759077 - protein, 7 aa, Entamoeba invadens
INGNSCT

SEQ ID NO: 2759078 - protein, 8 aa, Entamoeba invadens
INGTNPNL

SEQ ID NO: 2759079 - protein, 11 aa, Entamoeba invadens
INHDDRGTRIH

SEQ ID NO: 2759080 - protein, 7 aa, Entamoeba invadens
INHPEPP

SEQ ID NO: 2759081 - protein, 35 aa, Entamoeba invadens
INHQSTEEVKDNKQNKANAMETETNMPPQCEEKEV

SEQ ID NO: 2759082 - protein, 4 aa, Entamoeba invadens
ININ

SEQ ID NO: 2759083 - protein, 6 aa, Entamoeba invadens
INKEGN

SEQ ID NO: 2759084 - protein, 6 aa, Entamoeba invadens
INKEKY

SEQ ID NO: 2759085 - protein, 7 aa, Entamoeba invadens
INKENSI

SEQ ID NO: 2759086 - protein, 8 aa, Entamoeba invadens
INKERVSR

SEQ ID NO: 2759087 - protein, 8 aa, Entamoeba invadens
INKESGTE

SEQ ID NO: 2759088 - protein, 5 aa, Entamoeba invadens
INKGE

SEQ ID NO: 2759089 - protein, 7 aa, Entamoeba invadens
INKGNTA

SEQ ID NO: 2759090 - protein, 4 aa, Entamoeba invadens
INKK

SEQ ID NO: 2759091 - protein, 9 aa, Entamoeba invadens
INKKAGDYL

SEQ ID NO: 2759092 - protein, 6 aa, Entamoeba invadens
INKKTD

SEQ ID NO: 2759093 - protein, 8 aa, Entamoeba invadens
INKNPLPS

SEQ ID NO: 2759094 - protein, 9 aa, Entamoeba invadens
INKQNKTVG

SEQ ID NO: 2759095 - protein, 11 aa, Entamoeba invadens
INKRTKQEFTN

SEQ ID NO: 2759096 - protein, 4 aa, Entamoeba invadens
INKT

SEQ ID NO: 2759097 - protein, 8 aa, Entamoeba invadens
INKTKKRN

SEQ ID NO: 2759098 - protein, 8 aa, Entamoeba invadens
INKTSGEV

SEQ ID NO: 2759099 - protein, 7 aa, Entamoeba invadens
INKTTAT

SEQ ID NO: 2759100 - protein, 4 aa, Entamoeba invadens
INNA

SEQ ID NO: 2759101 - protein, 6 aa, Entamoeba invadens
INNDTD

SEQ ID NO: 2759102 - protein, 6 aa, Entamoeba invadens
INNDTK

SEQ ID NO: 2759103 - protein, 7 aa, Entamoeba invadens
INNDTKL

SEQ ID NO: 2759104 - protein, 4 aa, Entamoeba invadens
INNE

SEQ ID NO: 2759105 - protein, 5 aa, Entamoeba invadens
INNEG

SEQ ID NO: 2759106 - protein, 6 aa, Entamoeba invadens
INNEGK

SEQ ID NO: 2759107 - protein, 4 aa, Entamoeba invadens
INNG

SEQ ID NO: 2759108 - protein, 8 aa, Entamoeba invadens
INNIPGDI

SEQ ID NO: 2759109 - protein, 7 aa, Entamoeba invadens
INNKEKY

SEQ ID NO: 2759110 - protein, 30 aa, Entamoeba invadens
INNKGNTSVHTNPISNSSITLPESESTKLD

SEQ ID NO: 2759111 - protein, 4 aa, Entamoeba invadens
INNN

SEQ ID NO: 2759112 - protein, 7 aa, Entamoeba invadens
INNNGNK

SEQ ID NO: 2759113 - protein, 8 aa, Entamoeba invadens
INNNNNTK

SEQ ID NO: 2759114 - protein, 7 aa, Entamoeba invadens
INNSTTI

SEQ ID NO: 2759115 - protein, 5 aa, Entamoeba invadens
INPDI

SEQ ID NO: 2759116 - protein, 11 aa, Entamoeba invadens
INPEDPTSQCG

SEQ ID NO: 2759117 - protein, 8 aa, Entamoeba invadens
INPGGKYS

SEQ ID NO: 2759118 - protein, 4 aa, Entamoeba invadens
INPI

SEQ ID NO: 2759119 - protein, 4 aa, Entamoeba invadens
INPN

SEQ ID NO: 2759120 - protein, 5 aa, Entamoeba invadens
INPRT

SEQ ID NO: 2759121 - protein, 4 aa, Entamoeba invadens
INPS

SEQ ID NO: 2759122 - protein, 7 aa, Entamoeba invadens
INPSEND

SEQ ID NO: 2759123 - protein, 41 aa, Entamoeba invadens
INPSTNDGKNSKSPLLAKQEGKGKLQPKTPIQETKEENWDD

SEQ ID NO: 2759124 - protein, 7 aa, Entamoeba invadens
INPTCST

SEQ ID NO: 2759125 - protein, 6 aa, Entamoeba invadens
INPTGV

SEQ ID NO: 2759126 - protein, 7 aa, Entamoeba invadens
INQGTTK

SEQ ID NO: 2759127 - protein, 6 aa, Entamoeba invadens
INQKAA

SEQ ID NO: 2759128 - protein, 17 aa, Entamoeba invadens
INQKEEKTPVEDQNNIQ

SEQ ID NO: 2759129 - protein, 9 aa, Entamoeba invadens
INQKPGCQE

SEQ ID NO: 2759130 - protein, 4 aa, Entamoeba invadens
INQP

SEQ ID NO: 2759131 - protein, 4 aa, Entamoeba invadens
INQR

SEQ ID NO: 2759132 - protein, 4 aa, Entamoeba invadens
INQT

SEQ ID NO: 2759133 - protein, 8 aa, Entamoeba invadens
INQTSDGS

SEQ ID NO: 2759134 - protein, 10 aa, Entamoeba invadens
INRKMTGSKM

SEQ ID NO: 2759135 - protein, 10 aa, Entamoeba invadens
INRKNSKFEM

SEQ ID NO: 2759136 - protein, 7 aa, Entamoeba invadens
INRKSGA

SEQ ID NO: 2759137 - protein, 9 aa, Entamoeba invadens
INRKTPRGR

SEQ ID NO: 2759138 - protein, 16 aa, Entamoeba invadens
INRNAEGMKNDQELTG

SEQ ID NO: 2759139 - protein, 6 aa, Entamoeba invadens
INRPRK

SEQ ID NO: 2759140 - protein, 6 aa, Entamoeba invadens
INRTGG

SEQ ID NO: 2759141 - protein, 9 aa, Entamoeba invadens
INSESNTKI

SEQ ID NO: 2759142 - protein, 5 aa, Entamoeba invadens
INSPM

SEQ ID NO: 2759143 - protein, 10 aa, Entamoeba invadens
INSQHKTNEL

SEQ ID NO: 2759144 - protein, 14 aa, Entamoeba invadens
INSQNDTEATNSSS

SEQ ID NO: 2759145 - protein, 4 aa, Entamoeba invadens
INSS

SEQ ID NO: 2759146 - protein, 5 aa, Entamoeba invadens
INSSG

SEQ ID NO: 2759147 - protein, 6 aa, Entamoeba invadens
INSSST

SEQ ID NO: 2759148 - protein, 8 aa, Entamoeba invadens
INSTEDNR

SEQ ID NO: 2759149 - protein, 7 aa, Entamoeba invadens
INSTKSF

SEQ ID NO: 2759150 - protein, 7 aa, Entamoeba invadens
INSTSNK

SEQ ID NO: 2759151 - protein, 11 aa, Entamoeba invadens
INSTVSSLPSV

SEQ ID NO: 2759152 - protein, 8 aa, Entamoeba invadens
INSVSNES

SEQ ID NO: 2759153 - protein, 6 aa, Entamoeba invadens
INTADK

SEQ ID NO: 2759154 - protein, 5 aa, Entamoeba invadens
INTAF

SEQ ID NO: 2759155 - protein, 12 aa, Entamoeba invadens
INTDNSNRECDT

SEQ ID NO: 2759156 - protein, 12 aa, Entamoeba invadens
INTEDDSQKIEF

SEQ ID NO: 2759157 - protein, 8 aa, Entamoeba invadens
INTEGNAF

SEQ ID NO: 2759158 - protein, 5 aa, Entamoeba invadens
INTES

SEQ ID NO: 2759159 - protein, 10 aa, Entamoeba invadens
INTESGLVSN

SEQ ID NO: 2759160 - protein, 4 aa, Entamoeba invadens
INTG

SEQ ID NO: 2759161 - protein, 13 aa, Entamoeba invadens
INTHQKYDEVEEE

SEQ ID NO: 2759162 - protein, 4 aa, Entamoeba invadens
INTK

SEQ ID NO: 2759163 - protein, 13 aa, Entamoeba invadens
INTKHDNSASFDN

SEQ ID NO: 2759164 - protein, 6 aa, Entamoeba invadens
INTKNG

SEQ ID NO: 2759165 - protein, 7 aa, Entamoeba invadens
INTQNTT

SEQ ID NO: 2759166 - protein, 5 aa, Entamoeba invadens
INTQT

SEQ ID NO: 2759167 - protein, 6 aa, Entamoeba invadens
INTQTS

SEQ ID NO: 2759168 - protein, 4 aa, Entamoeba invadens
INTR

SEQ ID NO: 2759169 - protein, 5 aa, Entamoeba invadens
INTSL

SEQ ID NO: 2759170 - protein, 10 aa, Entamoeba invadens
INTSSYQHTH

SEQ ID NO: 2759171 - protein, 7 aa, Entamoeba invadens
INTTART

SEQ ID NO: 2759172 - protein, 5 aa, Entamoeba invadens
INTTE

SEQ ID NO: 2759173 - protein, 17 aa, Entamoeba invadens
INVEKKNRRERSKHRHH

SEQ ID NO: 2759174 - protein, 8 aa, Entamoeba invadens
INVPSSKN

SEQ ID NO: 2759175 - protein, 5 aa, Entamoeba invadens
INWKS

SEQ ID NO: 2759176 - protein, 4 aa, Entamoeba invadens
IPAD

SEQ ID NO: 2759177 - protein, 8 aa, Entamoeba invadens
IPADERNK

SEQ ID NO: 2759178 - protein, 5 aa, Entamoeba invadens
IPAGE

SEQ ID NO: 2759179 - protein, 5 aa, Entamoeba invadens
IPAGS

SEQ ID NO: 2759180 - protein, 5 aa, Entamoeba invadens
IPATC

SEQ ID NO: 2759181 - protein, 5 aa, Entamoeba invadens
IPAYP

SEQ ID NO: 2759182 - protein, 4 aa, Entamoeba invadens
IPDD

SEQ ID NO: 2759183 - protein, 6 aa, Entamoeba invadens
IPDDDD

SEQ ID NO: 2759184 - protein, 20 aa, Entamoeba invadens
IPDDESSVPKFGDASMASPF

SEQ ID NO: 2759185 - protein, 8 aa, Entamoeba invadens
IPDENGNC

SEQ ID NO: 2759186 - protein, 4 aa, Entamoeba invadens
IPDG

SEQ ID NO: 2759187 - protein, 4 aa, Entamoeba invadens
IPDK

SEQ ID NO: 2759188 - protein, 8 aa, Entamoeba invadens
IPDPNDKL

SEQ ID NO: 2759189 - protein, 10 aa, Entamoeba invadens
IPDPNDNTSC

SEQ ID NO: 2759190 - protein, 4 aa, Entamoeba invadens
IPDQ

SEQ ID NO: 2759191 - protein, 8 aa, Entamoeba invadens
IPDTEKQV

SEQ ID NO: 2759192 - protein, 15 aa, Entamoeba invadens
IPEAEQTEARVLVSN

SEQ ID NO: 2759193 - protein, 5 aa, Entamoeba invadens
IPEDK

SEQ ID NO: 2759194 - protein, 7 aa, Entamoeba invadens
IPEDRSE

SEQ ID NO: 2759195 - protein, 6 aa, Entamoeba invadens
IPEDVD

SEQ ID NO: 2759196 - protein, 12 aa, Entamoeba invadens
IPEKDALNETEI

SEQ ID NO: 2759197 - protein, 31 aa, Entamoeba invadens
IPENDEPKEQKDKESSKLSETQNVTELTQPT

SEQ ID NO: 2759198 - protein, 5 aa, Entamoeba invadens
IPEPD

SEQ ID NO: 2759199 - protein, 5 aa, Entamoeba invadens
IPEQA

SEQ ID NO: 2759200 - protein, 9 aa, Entamoeba invadens
IPESLQTEN

SEQ ID NO: 2759201 - protein, 6 aa, Entamoeba invadens
IPEYRN

SEQ ID NO: 2759202 - protein, 11 aa, Entamoeba invadens
IPEYRNKKKKY

SEQ ID NO: 2759203 - protein, 7 aa, Entamoeba invadens
IPFGETV

SEQ ID NO: 2759204 - protein, 5 aa, Entamoeba invadens
IPFGS

SEQ ID NO: 2759205 - protein, 5 aa, Entamoeba invadens
IPGES

SEQ ID NO: 2759206 - protein, 5 aa, Entamoeba invadens
IPGNN

SEQ ID NO: 2759207 - protein, 4 aa, Entamoeba invadens
IPIN

SEQ ID NO: 2759208 - protein, 4 aa, Entamoeba invadens
IPIP

SEQ ID NO: 2759209 - protein, 5 aa, Entamoeba invadens
IPKDN

SEQ ID NO: 2759210 - protein, 4 aa, Entamoeba invadens
IPKE

SEQ ID NO: 2759211 - protein, 9 aa, Entamoeba invadens
IPKEEVPEI

SEQ ID NO: 2759212 - protein, 8 aa, Entamoeba invadens
IPKENTLN

SEQ ID NO: 2759213 - protein, 4 aa, Entamoeba invadens
IPKG

SEQ ID NO: 2759214 - protein, 6 aa, Entamoeba invadens
IPKGKA

SEQ ID NO: 2759215 - protein, 7 aa, Entamoeba invadens
IPKGLQT

SEQ ID NO: 2759216 - protein, 9 aa, Entamoeba invadens
IPKGSDKEL

SEQ ID NO: 2759217 - protein, 4 aa, Entamoeba invadens
IPKK

SEQ ID NO: 2759218 - protein, 4 aa, Entamoeba invadens
IPKP

SEQ ID NO: 2759219 - protein, 11 aa, Entamoeba invadens
IPKQSTAPTAV

SEQ ID NO: 2759220 - protein, 9 aa, Entamoeba invadens
IPKQTVTED

SEQ ID NO: 2759221 - protein, 9 aa, Entamoeba invadens
IPKSEETNC

SEQ ID NO: 2759222 - protein, 20 aa, Entamoeba invadens
IPKSKDEKNAEKYRSEETQT

SEQ ID NO: 2759223 - protein, 5 aa, Entamoeba invadens
IPKTP

SEQ ID NO: 2759224 - protein, 18 aa, Entamoeba invadens
IPMNGDPKTLQSNTEHQD

SEQ ID NO: 2759225 - protein, 4 aa, Entamoeba invadens
IPNA

SEQ ID NO: 2759226 - protein, 8 aa, Entamoeba invadens
IPNDNNNY

SEQ ID NO: 2759227 - protein, 5 aa, Entamoeba invadens
IPNDT

SEQ ID NO: 2759228 - protein, 5 aa, Entamoeba invadens
IPNEQ

SEQ ID NO: 2759229 - protein, 6 aa, Entamoeba invadens
IPNEYH

SEQ ID NO: 2759230 - protein, 5 aa, Entamoeba invadens
IPNGN

SEQ ID NO: 2759231 - protein, 4 aa, Entamoeba invadens
IPNK

SEQ ID NO: 2759232 - protein, 7 aa, Entamoeba invadens
IPNKEEV

SEQ ID NO: 2759233 - protein, 6 aa, Entamoeba invadens
IPNKEI

SEQ ID NO: 2759234 - protein, 9 aa, Entamoeba invadens
IPNNTGTSK

SEQ ID NO: 2759235 - protein, 12 aa, Entamoeba invadens
IPNNVTSIKEKS

SEQ ID NO: 2759236 - protein, 7 aa, Entamoeba invadens
IPNPKNE

SEQ ID NO: 2759237 - protein, 11 aa, Entamoeba invadens
IPNRKYSIKGN

SEQ ID NO: 2759238 - protein, 4 aa, Entamoeba invadens
IPNS

SEQ ID NO: 2759239 - protein, 6 aa, Entamoeba invadens
IPNSKT

SEQ ID NO: 2759240 - protein, 13 aa, Entamoeba invadens
IPNTAVKTTPQGN

SEQ ID NO: 2759241 - protein, 5 aa, Entamoeba invadens
IPPAT

SEQ ID NO: 2759242 - protein, 9 aa, Entamoeba invadens
IPPEKGDPI

SEQ ID NO: 2759243 - protein, 4 aa, Entamoeba invadens
IPPG

SEQ ID NO: 2759244 - protein, 6 aa, Entamoeba invadens
IPPHPK

SEQ ID NO: 2759245 - protein, 25 aa, Entamoeba invadens
IPPLDDGEKVSDRKIEDTEQIITPL

SEQ ID NO: 2759246 - protein, 17 aa, Entamoeba invadens
IPPPKEPPMLPKKSEEL

SEQ ID NO: 2759247 - protein, 7 aa, Entamoeba invadens
IPPPSST

SEQ ID NO: 2759248 - protein, 5 aa, Entamoeba invadens
IPPRV

SEQ ID NO: 2759249 - protein, 22 aa, Entamoeba invadens
IPPSEETTECEEYTSTDEKDDV

SEQ ID NO: 2759250 - protein, 42 aa, Entamoeba invadens
IPPSRVNHNPEPLQNHDNSTHQNVSDNGTEAQIRGDEETITE

SEQ ID NO: 2759251 - protein, 6 aa, Entamoeba invadens
IPPTEI

SEQ ID NO: 2759252 - protein, 9 aa, Entamoeba invadens
IPPYQMSSE

SEQ ID NO: 2759253 - protein, 11 aa, Entamoeba invadens
IPQDDESTAKF

SEQ ID NO: 2759254 - protein, 17 aa, Entamoeba invadens
IPQEKPQDVKPSITHEE

SEQ ID NO: 2759255 - protein, 19 aa, Entamoeba invadens
IPQERSNPNVSFKNTTNTI

SEQ ID NO: 2759256 - protein, 21 aa, Entamoeba invadens
IPQGEFKGDIKTAKINNGTHD

SEQ ID NO: 2759257 - protein, 14 aa, Entamoeba invadens
IPQHAKTDKTQGDV

SEQ ID NO: 2759258 - protein, 5 aa, Entamoeba invadens
IPQNK

SEQ ID NO: 2759259 - protein, 11 aa, Entamoeba invadens
IPQTPKTITTT

SEQ ID NO: 2759260 - protein, 5 aa, Entamoeba invadens
IPQTQ

SEQ ID NO: 2759261 - protein, 7 aa, Entamoeba invadens
IPQTSET

SEQ ID NO: 2759262 - protein, 24 aa, Entamoeba invadens
IPQVTENVDDKVHEDTEKSGKSDI

SEQ ID NO: 2759263 - protein, 5 aa, Entamoeba invadens
IPRRS

SEQ ID NO: 2759264 - protein, 5 aa, Entamoeba invadens
IPRTL

SEQ ID NO: 2759265 - protein, 7 aa, Entamoeba invadens
IPSARSG

SEQ ID NO: 2759266 - protein, 4 aa, Entamoeba invadens
IPSD

SEQ ID NO: 2759267 - protein, 8 aa, Entamoeba invadens
IPSDQNTL

SEQ ID NO: 2759268 - protein, 25 aa, Entamoeba invadens
IPSESKLCQSNTTLTNCEPSSLSGC

SEQ ID NO: 2759269 - protein, 6 aa, Entamoeba invadens
IPSESN

SEQ ID NO: 2759270 - protein, 8 aa, Entamoeba invadens
IPSGSSGK

SEQ ID NO: 2759271 - protein, 9 aa, Entamoeba invadens
IPSKEVERG

SEQ ID NO: 2759272 - protein, 6 aa, Entamoeba invadens
IPSNPT

SEQ ID NO: 2759273 - protein, 10 aa, Entamoeba invadens
IPSSDKENKC

SEQ ID NO: 2759274 - protein, 7 aa, Entamoeba invadens
IPSSITS

SEQ ID NO: 2759275 - protein, 11 aa, Entamoeba invadens
IPSSSQVATEG

SEQ ID NO: 2759276 - protein, 7 aa, Entamoeba invadens
IPSSVTS

SEQ ID NO: 2759277 - protein, 6 aa, Entamoeba invadens
IPTAES

SEQ ID NO: 2759278 - protein, 8 aa, Entamoeba invadens
IPTAPQVD

SEQ ID NO: 2759279 - protein, 4 aa, Entamoeba invadens
IPTD

SEQ ID NO: 2759280 - protein, 7 aa, Entamoeba invadens
IPTDTNA

SEQ ID NO: 2759281 - protein, 8 aa, Entamoeba invadens
IPTDTSRV

SEQ ID NO: 2759282 - protein, 5 aa, Entamoeba invadens
IPTDY

SEQ ID NO: 2759283 - protein, 20 aa, Entamoeba invadens
IPTNLKGRIPDAYPQITSDS

SEQ ID NO: 2759284 - protein, 12 aa, Entamoeba invadens
IPTNTTVDTNTT

SEQ ID NO: 2759285 - protein, 5 aa, Entamoeba invadens
IPTPP

SEQ ID NO: 2759286 - protein, 11 aa, Entamoeba invadens
IPTPQEKEEEV

SEQ ID NO: 2759287 - protein, 5 aa, Entamoeba invadens
IPTPT

SEQ ID NO: 2759288 - protein, 4 aa, Entamoeba invadens
IPTS

SEQ ID NO: 2759289 - protein, 13 aa, Entamoeba invadens
IPTSSVSQGEAHL

SEQ ID NO: 2759290 - protein, 9 aa, Entamoeba invadens
IPTSVTQIG

SEQ ID NO: 2759291 - protein, 16 aa, Entamoeba invadens
IPTTSQIDEKDRKFKS

SEQ ID NO: 2759292 - protein, 5 aa, Entamoeba invadens
IPTTV

SEQ ID NO: 2759293 - protein, 8 aa, Entamoeba invadens
IPVDEDTS

SEQ ID NO: 2759294 - protein, 8 aa, Entamoeba invadens
IPVESESR

SEQ ID NO: 2759295 - protein, 6 aa, Entamoeba invadens
IPVESG

SEQ ID NO: 2759296 - protein, 5 aa, Entamoeba invadens
IPVNA

SEQ ID NO: 2759297 - protein, 8 aa, Entamoeba invadens
IPVNEETP

SEQ ID NO: 2759298 - protein, 5 aa, Entamoeba invadens
IPVNT

SEQ ID NO: 2759299 - protein, 6 aa, Entamoeba invadens
IPVNTE

SEQ ID NO: 2759300 - protein, 6 aa, Entamoeba invadens
IPVPPS

SEQ ID NO: 2759301 - protein, 6 aa, Entamoeba invadens
IPYTSA

SEQ ID NO: 2759302 - protein, 5 aa, Entamoeba invadens
IQCDD

SEQ ID NO: 2759303 - protein, 10 aa, Entamoeba invadens
IQDPGRMGMG

SEQ ID NO: 2759304 - protein, 9 aa, Entamoeba invadens
IQEAKDTRL

SEQ ID NO: 2759305 - protein, 9 aa, Entamoeba invadens
IQEKRKQLE

SEQ ID NO: 2759306 - protein, 6 aa, Entamoeba invadens
IQENGA

SEQ ID NO: 2759307 - protein, 6 aa, Entamoeba invadens
IQESDC

SEQ ID NO: 2759308 - protein, 5 aa, Entamoeba invadens
IQFTN

SEQ ID NO: 2759309 - protein, 9 aa, Entamoeba invadens
IQGKDDPLA

SEQ ID NO: 2759310 - protein, 15 aa, Entamoeba invadens
IQHEKEAEKSPKLSP

SEQ ID NO: 2759311 - protein, 10 aa, Entamoeba invadens
IQKTTKKVDT

SEQ ID NO: 2759312 - protein, 6 aa, Entamoeba invadens
IQKTTT

SEQ ID NO: 2759313 - protein, 4 aa, Entamoeba invadens
IQNA

SEQ ID NO: 2759314 - protein, 7 aa, Entamoeba invadens
IQNEKKR

SEQ ID NO: 2759315 - protein, 11 aa, Entamoeba invadens
IQNERSDCTQC

SEQ ID NO: 2759316 - protein, 12 aa, Entamoeba invadens
IQNERSDCTRCR

SEQ ID NO: 2759317 - protein, 6 aa, Entamoeba invadens
IQNGPE

SEQ ID NO: 2759318 - protein, 11 aa, Entamoeba invadens
IQNGSEGPIDD

SEQ ID NO: 2759319 - protein, 5 aa, Entamoeba invadens
IQNGT

SEQ ID NO: 2759320 - protein, 4 aa, Entamoeba invadens
IQNP

SEQ ID NO: 2759321 - protein, 7 aa, Entamoeba invadens
IQNPEEF

SEQ ID NO: 2759322 - protein, 24 aa, Entamoeba invadens
IQNRKNEEEVRRSMSEQSPPTQAK

SEQ ID NO: 2759323 - protein, 5 aa, Entamoeba invadens
IQPEF

SEQ ID NO: 2759324 - protein, 7 aa, Entamoeba invadens
IQPFGEA

SEQ ID NO: 2759325 - protein, 10 aa, Entamoeba invadens
IQPKKGGIND

SEQ ID NO: 2759326 - protein, 32 aa, Entamoeba invadens
IQQEGTDESTDDEEKSAGASARPSDIGSDIEV

SEQ ID NO: 2759327 - protein, 12 aa, Entamoeba invadens
IQQKEDKKEQEE

SEQ ID NO: 2759328 - protein, 12 aa, Entamoeba invadens
IQQPTSKKTVTI

SEQ ID NO: 2759329 - protein, 4 aa, Entamoeba invadens
IQQQ

SEQ ID NO: 2759330 - protein, 9 aa, Entamoeba invadens
IQQSSPLNL

SEQ ID NO: 2759331 - protein, 4 aa, Entamoeba invadens
IQQT

SEQ ID NO: 2759332 - protein, 7 aa, Entamoeba invadens
IQRTNGL

SEQ ID NO: 2759333 - protein, 6 aa, Entamoeba invadens
IQSDSG

SEQ ID NO: 2759334 - protein, 18 aa, Entamoeba invadens
IQSGKLKTISEQEKSAIE

SEQ ID NO: 2759335 - protein, 11 aa, Entamoeba invadens
IQSKPTTTPNR

SEQ ID NO: 2759336 - protein, 8 aa, Entamoeba invadens
IQSLGDEA

SEQ ID NO: 2759337 - protein, 13 aa, Entamoeba invadens
IQSNEGGDDEFSR

SEQ ID NO: 2759338 - protein, 7 aa, Entamoeba invadens
IQSNNTM

SEQ ID NO: 2759339 - protein, 5 aa, Entamoeba invadens
IQSSG

SEQ ID NO: 2759340 - protein, 6 aa, Entamoeba invadens
IQSSNC

SEQ ID NO: 2759341 - protein, 6 aa, Entamoeba invadens
IQSTSS

SEQ ID NO: 2759342 - protein, 16 aa, Entamoeba invadens
IQTAASKTADCSNGKF

SEQ ID NO: 2759343 - protein, 5 aa, Entamoeba invadens
IQTNE

SEQ ID NO: 2759344 - protein, 5 aa, Entamoeba invadens
IQTSN

SEQ ID NO: 2759345 - protein, 5 aa, Entamoeba invadens
IQTTK

SEQ ID NO: 2759346 - protein, 11 aa, Entamoeba invadens
IQTVNNNKDFT

SEQ ID NO: 2759347 - protein, 9 aa, Entamoeba invadens
IQVTNGSDY

SEQ ID NO: 2759348 - protein, 14 aa, Entamoeba invadens
IRASPGKSSKYKMD

SEQ ID NO: 2759349 - protein, 8 aa, Entamoeba invadens
IRDKTEQI

SEQ ID NO: 2759350 - protein, 10 aa, Entamoeba invadens
IRDNKGCQRC

SEQ ID NO: 2759351 - protein, 6 aa, Entamoeba invadens
IRERGS

SEQ ID NO: 2759352 - protein, 10 aa, Entamoeba invadens
IRERSISNNL

SEQ ID NO: 2759353 - protein, 5 aa, Entamoeba invadens
IRETE

SEQ ID NO: 2759354 - protein, 4 aa, Entamoeba invadens
IRGE

SEQ ID NO: 2759355 - protein, 19 aa, Entamoeba invadens
IRGKDTFTEPERWSRKKTT

SEQ ID NO: 2759356 - protein, 4 aa, Entamoeba invadens
IRGN

SEQ ID NO: 2759357 - protein, 11 aa, Entamoeba invadens
IRGSKESEQFA

SEQ ID NO: 2759358 - protein, 8 aa, Entamoeba invadens
IRGTKTEG

SEQ ID NO: 2759359 - protein, 8 aa, Entamoeba invadens
IRGTNQKI

SEQ ID NO: 2759360 - protein, 13 aa, Entamoeba invadens
IRIDESEMTGESV

SEQ ID NO: 2759361 - protein, 11 aa, Entamoeba invadens
IRKNKEVNEIE

SEQ ID NO: 2759362 - protein, 4 aa, Entamoeba invadens
IRKP

SEQ ID NO: 2759363 - protein, 13 aa, Entamoeba invadens
IRKTTKGSDKTHL

SEQ ID NO: 2759364 - protein, 11 aa, Entamoeba invadens
IRNDTKEYQYS

SEQ ID NO: 2759365 - protein, 9 aa, Entamoeba invadens
IRNGKGIKG

SEQ ID NO: 2759366 - protein, 10 aa, Entamoeba invadens
IRNKKSIKLD

SEQ ID NO: 2759367 - protein, 16 aa, Entamoeba invadens
IRNTETSYVENSKSLK

SEQ ID NO: 2759368 - protein, 9 aa, Entamoeba invadens
IRPEFGEPQ

SEQ ID NO: 2759369 - protein, 7 aa, Entamoeba invadens
IRPKESV

SEQ ID NO: 2759370 - protein, 14 aa, Entamoeba invadens
IRPKMGAPQGDQAT

SEQ ID NO: 2759371 - protein, 7 aa, Entamoeba invadens
IRPTSRD

SEQ ID NO: 2759372 - protein, 4 aa, Entamoeba invadens
IRPV

SEQ ID NO: 2759373 - protein, 7 aa, Entamoeba invadens
IRREGED

SEQ ID NO: 2759374 - protein, 13 aa, Entamoeba invadens
IRRETTKEKNGTF

SEQ ID NO: 2759375 - protein, 9 aa, Entamoeba invadens
IRRNTEEPD

SEQ ID NO: 2759376 - protein, 8 aa, Entamoeba invadens
IRSAPTMN

SEQ ID NO: 2759377 - protein, 4 aa, Entamoeba invadens
IRSE

SEQ ID NO: 2759378 - protein, 4 aa, Entamoeba invadens
IRSI

SEQ ID NO: 2759379 - protein, 5 aa, Entamoeba invadens
IRSSE

SEQ ID NO: 2759380 - protein, 6 aa, Entamoeba invadens
IRSSPN

SEQ ID NO: 2759381 - protein, 9 aa, Entamoeba invadens
IRTPTQESA

SEQ ID NO: 2759382 - protein, 13 aa, Entamoeba invadens
IRTQTIKTSIEED

SEQ ID NO: 2759383 - protein, 18 aa, Entamoeba invadens
IRTRSALEDQHEVQRKEY

SEQ ID NO: 2759384 - protein, 11 aa, Entamoeba invadens
IRTSNGQEQFK

SEQ ID NO: 2759385 - protein, 6 aa, Entamoeba invadens
IRTTPS

SEQ ID NO: 2759386 - protein, 8 aa, Entamoeba invadens
IRTVGGNP

SEQ ID NO: 2759387 - protein, 12 aa, Entamoeba invadens
IRYDQGVDSTEW

SEQ ID NO: 2759388 - protein, 10 aa, Entamoeba invadens
ISADNTISAQ

SEQ ID NO: 2759389 - protein, 6 aa, Entamoeba invadens
ISAEDS

SEQ ID NO: 2759390 - protein, 7 aa, Entamoeba invadens
ISANEEM

SEQ ID NO: 2759391 - protein, 31 aa, Entamoeba invadens
ISANETGMEGVEKERYEQLEANKTKLPEFTP

SEQ ID NO: 2759392 - protein, 13 aa, Entamoeba invadens
ISAQSSPTSFSPR

SEQ ID NO: 2759393 - protein, 11 aa, Entamoeba invadens
ISASDNKCAQC

SEQ ID NO: 2759394 - protein, 12 aa, Entamoeba invadens
ISASNNKCTQCA

SEQ ID NO: 2759395 - protein, 6 aa, Entamoeba invadens
ISCEEC

SEQ ID NO: 2759396 - protein, 5 aa, Entamoeba invadens
ISCGK

SEQ ID NO: 2759397 - protein, 8 aa, Entamoeba invadens
ISDAMSPR

SEQ ID NO: 2759398 - protein, 6 aa, Entamoeba invadens
ISDARK

SEQ ID NO: 2759399 - protein, 8 aa, Entamoeba invadens
ISDDKQRV

SEQ ID NO: 2759400 - protein, 4 aa, Entamoeba invadens
ISDE

SEQ ID NO: 2759401 - protein, 28 aa, Entamoeba invadens
ISDFGNSRALTENSIKDSMTKALGTPSD

SEQ ID NO: 2759402 - protein, 15 aa, Entamoeba invadens
ISDGGLKKTFESAQN

SEQ ID NO: 2759403 - protein, 16 aa, Entamoeba invadens
ISDGVKPSKAKRHSDI

SEQ ID NO: 2759404 - protein, 6 aa, Entamoeba invadens
ISDKSY

SEQ ID NO: 2759405 - protein, 7 aa, Entamoeba invadens
ISDNSNI

SEQ ID NO: 2759406 - protein, 16 aa, Entamoeba invadens
ISDRNKMNKELTQGIG

SEQ ID NO: 2759407 - protein, 5 aa, Entamoeba invadens
ISDSN

SEQ ID NO: 2759408 - protein, 10 aa, Entamoeba invadens
ISDSTLNEQK

SEQ ID NO: 2759409 - protein, 4 aa, Entamoeba invadens
ISDT

SEQ ID NO: 2759410 - protein, 8 aa, Entamoeba invadens
ISDTNKVT

SEQ ID NO: 2759411 - protein, 12 aa, Entamoeba invadens
ISDTNSNIPDIE

SEQ ID NO: 2759412 - protein, 13 aa, Entamoeba invadens
ISEEEPKSKTLRY

SEQ ID NO: 2759413 - protein, 6 aa, Entamoeba invadens
ISEEMR

SEQ ID NO: 2759414 - protein, 6 aa, Entamoeba invadens
ISEENS

SEQ ID NO: 2759415 - protein, 4 aa, Entamoeba invadens
ISEG

SEQ ID NO: 2759416 - protein, 12 aa, Entamoeba invadens
ISEISNCQKTND

SEQ ID NO: 2759417 - protein, 8 aa, Entamoeba invadens
ISEKKKCT

SEQ ID NO: 2759418 - protein, 10 aa, Entamoeba invadens
ISENSPQFAN

SEQ ID NO: 2759419 - protein, 6 aa, Entamoeba invadens
ISEPDQ

SEQ ID NO: 2759420 - protein, 5 aa, Entamoeba invadens
ISESD

SEQ ID NO: 2759421 - protein, 11 aa, Entamoeba invadens
ISESGKNQECT

SEQ ID NO: 2759422 - protein, 8 aa, Entamoeba invadens
ISESKKVT

SEQ ID NO: 2759423 - protein, 14 aa, Entamoeba invadens
ISESNSKRDGTTLD

SEQ ID NO: 2759424 - protein, 4 aa, Entamoeba invadens
ISET

SEQ ID NO: 2759425 - protein, 7 aa, Entamoeba invadens
ISETEKS

SEQ ID NO: 2759426 - protein, 7 aa, Entamoeba invadens
ISETRED

SEQ ID NO: 2759427 - protein, 10 aa, Entamoeba invadens
ISETTSSASV

SEQ ID NO: 2759428 - protein, 5 aa, Entamoeba invadens
ISETV

SEQ ID NO: 2759429 - protein, 7 aa, Entamoeba invadens
ISEVKRD

SEQ ID NO: 2759430 - protein, 4 aa, Entamoeba invadens
ISEY

SEQ ID NO: 2759431 - protein, 4 aa, Entamoeba invadens
ISFG

SEQ ID NO: 2759432 - protein, 10 aa, Entamoeba invadens
ISFGEQNEEI

SEQ ID NO: 2759433 - protein, 14 aa, Entamoeba invadens
ISFGEQTKGVIDGN

SEQ ID NO: 2759434 - protein, 16 aa, Entamoeba invadens
ISFGNESDKIQIESEN

SEQ ID NO: 2759435 - protein, 8 aa, Entamoeba invadens
ISFTNSED

SEQ ID NO: 2759436 - protein, 19 aa, Entamoeba invadens
ISGANGYIRTEECDNNTNC

SEQ ID NO: 2759437 - protein, 7 aa, Entamoeba invadens
ISGDAEN

SEQ ID NO: 2759438 - protein, 7 aa, Entamoeba invadens
ISGEEGL

SEQ ID NO: 2759439 - protein, 13 aa, Entamoeba invadens
ISGEGYATCTTPY

SEQ ID NO: 2759440 - protein, 6 aa, Entamoeba invadens
ISGEKN

SEQ ID NO: 2759441 - protein, 7 aa, Entamoeba invadens
ISGEQDD

SEQ ID NO: 2759442 - protein, 12 aa, Entamoeba invadens
ISGEQTPLPSQQ

SEQ ID NO: 2759443 - protein, 25 aa, Entamoeba invadens
ISGESNKLCENNKTLKNCSKATTNG

SEQ ID NO: 2759444 - protein, 10 aa, Entamoeba invadens
ISGETTMTIK

SEQ ID NO: 2759445 - protein, 14 aa, Entamoeba invadens
ISGGSSGLNETTGL

SEQ ID NO: 2759446 - protein, 10 aa, Entamoeba invadens
ISGKCKDTLG

SEQ ID NO: 2759447 - protein, 12 aa, Entamoeba invadens
ISGKPGTANVGT

SEQ ID NO: 2759448 - protein, 9 aa, Entamoeba invadens
ISGKSPNCE

SEQ ID NO: 2759449 - protein, 7 aa, Entamoeba invadens
ISGNDSI

SEQ ID NO: 2759450 - protein, 10 aa, Entamoeba invadens
ISGPTNVTSK

SEQ ID NO: 2759451 - protein, 5 aa, Entamoeba invadens
ISGSS

SEQ ID NO: 2759452 - protein, 8 aa, Entamoeba invadens
ISGTDKEI

SEQ ID NO: 2759453 - protein, 8 aa, Entamoeba invadens
ISGYESAK

SEQ ID NO: 2759454 - protein, 12 aa, Entamoeba invadens
ISHGNTLDNQNT

SEQ ID NO: 2759455 - protein, 7 aa, Entamoeba invadens
ISIGTGP

SEQ ID NO: 2759456 - protein, 13 aa, Entamoeba invadens
ISINNSSSENAIE

SEQ ID NO: 2759457 - protein, 8 aa, Entamoeba invadens
ISIPESTF

SEQ ID NO: 2759458 - protein, 9 aa, Entamoeba invadens
ISKDTAQIS

SEQ ID NO: 2759459 - protein, 12 aa, Entamoeba invadens
ISKEEKPTTETI

SEQ ID NO: 2759460 - protein, 21 aa, Entamoeba invadens
ISKERKRNNRQNANRNDYGNE

SEQ ID NO: 2759461 - protein, 4 aa, Entamoeba invadens
ISKG

SEQ ID NO: 2759462 - protein, 4 aa, Entamoeba invadens
ISKK

SEQ ID NO: 2759463 - protein, 12 aa, Entamoeba invadens
ISKKSNKELEQY

SEQ ID NO: 2759464 - protein, 8 aa, Entamoeba invadens
ISKNSTGL

SEQ ID NO: 2759465 - protein, 9 aa, Entamoeba invadens
ISKPSEDIM

SEQ ID NO: 2759466 - protein, 5 aa, Entamoeba invadens
ISKPT

SEQ ID NO: 2759467 - protein, 6 aa, Entamoeba invadens
ISKQRE

SEQ ID NO: 2759468 - protein, 5 aa, Entamoeba invadens
ISKRG

SEQ ID NO: 2759469 - protein, 18 aa, Entamoeba invadens
ISKRQNLEERLKGKEYAK

SEQ ID NO: 2759470 - protein, 9 aa, Entamoeba invadens
ISKSDLETI

SEQ ID NO: 2759471 - protein, 7 aa, Entamoeba invadens
ISKSEMN

SEQ ID NO: 2759472 - protein, 5 aa, Entamoeba invadens
ISKSL

SEQ ID NO: 2759473 - protein, 6 aa, Entamoeba invadens
ISLNKT

SEQ ID NO: 2759474 - protein, 5 aa, Entamoeba invadens
ISLPQ

SEQ ID NO: 2759475 - protein, 18 aa, Entamoeba invadens
ISLSGGTSPNKLSGKSRL

SEQ ID NO: 2759476 - protein, 8 aa, Entamoeba invadens
ISLTNQAT

SEQ ID NO: 2759477 - protein, 7 aa, Entamoeba invadens
ISNCSSC

SEQ ID NO: 2759478 - protein, 7 aa, Entamoeba invadens
ISNDNDE

SEQ ID NO: 2759479 - protein, 15 aa, Entamoeba invadens
ISNDNNTCEVSSSKG

SEQ ID NO: 2759480 - protein, 10 aa, Entamoeba invadens
ISNDRSPNTI

SEQ ID NO: 2759481 - protein, 4 aa, Entamoeba invadens
ISNE

SEQ ID NO: 2759482 - protein, 10 aa, Entamoeba invadens
ISNENGRNED

SEQ ID NO: 2759483 - protein, 6 aa, Entamoeba invadens
ISNERK

SEQ ID NO: 2759484 - protein, 8 aa, Entamoeba invadens
ISNGGQCT

SEQ ID NO: 2759485 - protein, 9 aa, Entamoeba invadens
ISNKNGKCV

SEQ ID NO: 2759486 - protein, 7 aa, Entamoeba invadens
ISNKSRK

SEQ ID NO: 2759487 - protein, 18 aa, Entamoeba invadens
ISNKSTHIEYPSKGEAYN

SEQ ID NO: 2759488 - protein, 8 aa, Entamoeba invadens
ISNKTNQN

SEQ ID NO: 2759489 - protein, 7 aa, Entamoeba invadens
ISNLNTN

SEQ ID NO: 2759490 - protein, 6 aa, Entamoeba invadens
ISNNGD

SEQ ID NO: 2759491 - protein, 7 aa, Entamoeba invadens
ISNNSKT

SEQ ID NO: 2759492 - protein, 8 aa, Entamoeba invadens
ISNNSKTS

SEQ ID NO: 2759493 - protein, 12 aa, Entamoeba invadens
ISNNSNNSALNN

SEQ ID NO: 2759494 - protein, 5 aa, Entamoeba invadens
ISNPI

SEQ ID NO: 2759495 - protein, 8 aa, Entamoeba invadens
ISNPTHQQ

SEQ ID NO: 2759496 - protein, 42 aa, Entamoeba invadens
ISNSANSTTSFDISSEDDVDQKRVEEEPLISQKDEQKEMKLP

SEQ ID NO: 2759497 - protein, 6 aa, Entamoeba invadens
ISNSSY

SEQ ID NO: 2759498 - protein, 5 aa, Entamoeba invadens
ISNST

SEQ ID NO: 2759499 - protein, 13 aa, Entamoeba invadens
ISNSTKQGNSATR

SEQ ID NO: 2759500 - protein, 4 aa, Entamoeba invadens
ISNT

SEQ ID NO: 2759501 - protein, 7 aa, Entamoeba invadens
ISNTETM

SEQ ID NO: 2759502 - protein, 12 aa, Entamoeba invadens
ISNTTKQQIDEF

SEQ ID NO: 2759503 - protein, 6 aa, Entamoeba invadens
ISPADF

SEQ ID NO: 2759504 - protein, 6 aa, Entamoeba invadens
ISPDPE

SEQ ID NO: 2759505 - protein, 6 aa, Entamoeba invadens
ISPDQS

SEQ ID NO: 2759506 - protein, 6 aa, Entamoeba invadens
ISPEEK

SEQ ID NO: 2759507 - protein, 8 aa, Entamoeba invadens
ISPENDYK

SEQ ID NO: 2759508 - protein, 6 aa, Entamoeba invadens
ISPERK

SEQ ID NO: 2759509 - protein, 5 aa, Entamoeba invadens
ISPES

SEQ ID NO: 2759510 - protein, 6 aa, Entamoeba invadens
ISPFTK

SEQ ID NO: 2759511 - protein, 12 aa, Entamoeba invadens
ISPKNNLNENMK

SEQ ID NO: 2759512 - protein, 9 aa, Entamoeba invadens
ISPKRNEDV

SEQ ID NO: 2759513 - protein, 7 aa, Entamoeba invadens
ISPKTTL

SEQ ID NO: 2759514 - protein, 5 aa, Entamoeba invadens
ISPMT

SEQ ID NO: 2759515 - protein, 5 aa, Entamoeba invadens
ISPNV

SEQ ID NO: 2759516 - protein, 5 aa, Entamoeba invadens
ISPQG

SEQ ID NO: 2759517 - protein, 15 aa, Entamoeba invadens
ISPSLSGNGPKGYGI

SEQ ID NO: 2759518 - protein, 4 aa, Entamoeba invadens
ISPT

SEQ ID NO: 2759519 - protein, 4 aa, Entamoeba invadens
ISPW

SEQ ID NO: 2759520 - protein, 5 aa, Entamoeba invadens
ISPWT

SEQ ID NO: 2759521 - protein, 6 aa, Entamoeba invadens
ISPYDG

SEQ ID NO: 2759522 - protein, 7 aa, Entamoeba invadens
ISQAKKA

SEQ ID NO: 2759523 - protein, 7 aa, Entamoeba invadens
ISQIGAD

SEQ ID NO: 2759524 - protein, 10 aa, Entamoeba invadens
ISQKETDEMA

SEQ ID NO: 2759525 - protein, 10 aa, Entamoeba invadens
ISQKPSKESK

SEQ ID NO: 2759526 - protein, 8 aa, Entamoeba invadens
ISQNDSKI

SEQ ID NO: 2759527 - protein, 15 aa, Entamoeba invadens
ISRATENSKLQNNIG

SEQ ID NO: 2759528 - protein, 4 aa, Entamoeba invadens
ISRC

SEQ ID NO: 2759529 - protein, 10 aa, Entamoeba invadens
ISRESTAGDA

SEQ ID NO: 2759530 - protein, 4 aa, Entamoeba invadens
ISRG

SEQ ID NO: 2759531 - protein, 5 aa, Entamoeba invadens
ISRQR

SEQ ID NO: 2759532 - protein, 10 aa, Entamoeba invadens
ISSAEKRDKD

SEQ ID NO: 2759533 - protein, 22 aa, Entamoeba invadens
ISSDDSVCSKCSDGYKLSSDKL

SEQ ID NO: 2759534 - protein, 5 aa, Entamoeba invadens
ISSDN

SEQ ID NO: 2759535 - protein, 4 aa, Entamoeba invadens
ISSE

SEQ ID NO: 2759536 - protein, 20 aa, Entamoeba invadens
ISSEDENEMCTDSNDGYSEY

SEQ ID NO: 2759537 - protein, 10 aa, Entamoeba invadens
ISSEGIPDST

SEQ ID NO: 2759538 - protein, 5 aa, Entamoeba invadens
ISSGA

SEQ ID NO: 2759539 - protein, 8 aa, Entamoeba invadens
ISSGDKCM

SEQ ID NO: 2759540 - protein, 10 aa, Entamoeba invadens
ISSGKDKNIG

SEQ ID NO: 2759541 - protein, 7 aa, Entamoeba invadens
ISSGVED

SEQ ID NO: 2759542 - protein, 7 aa, Entamoeba invadens
ISSGYDE

SEQ ID NO: 2759543 - protein, 4 aa, Entamoeba invadens
ISSI

SEQ ID NO: 2759544 - protein, 5 aa, Entamoeba invadens
ISSIA

SEQ ID NO: 2759545 - protein, 15 aa, Entamoeba invadens
ISSKEDSDKYTIRTN

SEQ ID NO: 2759546 - protein, 8 aa, Entamoeba invadens
ISSKEKTM

SEQ ID NO: 2759547 - protein, 6 aa, Entamoeba invadens
ISSKNN

SEQ ID NO: 2759548 - protein, 8 aa, Entamoeba invadens
ISSKTEIN

SEQ ID NO: 2759549 - protein, 5 aa, Entamoeba invadens
ISSKY

SEQ ID NO: 2759550 - protein, 5 aa, Entamoeba invadens
ISSNK

SEQ ID NO: 2759551 - protein, 8 aa, Entamoeba invadens
ISSNNSNC

SEQ ID NO: 2759552 - protein, 8 aa, Entamoeba invadens
ISSNTQEY

SEQ ID NO: 2759553 - protein, 9 aa, Entamoeba invadens
ISSPNSDYA

SEQ ID NO: 2759554 - protein, 9 aa, Entamoeba invadens
ISSPTPNYE

SEQ ID NO: 2759555 - protein, 4 aa, Entamoeba invadens
ISSQ

SEQ ID NO: 2759556 - protein, 7 aa, Entamoeba invadens
ISSQNSV

SEQ ID NO: 2759557 - protein, 5 aa, Entamoeba invadens
ISSSD

SEQ ID NO: 2759558 - protein, 7 aa, Entamoeba invadens
ISSSDGY

SEQ ID NO: 2759559 - protein, 9 aa, Entamoeba invadens
ISSSDTTQV

SEQ ID NO: 2759560 - protein, 21 aa, Entamoeba invadens
ISSSKKQKHKMSKKTKKEEKV

SEQ ID NO: 2759561 - protein, 48 aa, Entamoeba invadens
ISSSPGVDVQKKKNAQLTKRTKKGTSPNNIDRKTKDFEEVKTEPMRER

SEQ ID NO: 2759562 - protein, 7 aa, Entamoeba invadens
ISSSTPS

SEQ ID NO: 2759563 - protein, 12 aa, Entamoeba invadens
ISSSYSKCSQCA

SEQ ID NO: 2759564 - protein, 4 aa, Entamoeba invadens
ISST

SEQ ID NO: 2759565 - protein, 6 aa, Entamoeba invadens
ISSTAN

SEQ ID NO: 2759566 - protein, 12 aa, Entamoeba invadens
ISSTLPKSVGGG

SEQ ID NO: 2759567 - protein, 8 aa, Entamoeba invadens
ISSTSNNI

SEQ ID NO: 2759568 - protein, 9 aa, Entamoeba invadens
ISSTSTNGY

SEQ ID NO: 2759569 - protein, 5 aa, Entamoeba invadens
ISSVN

SEQ ID NO: 2759570 - protein, 13 aa, Entamoeba invadens
ISSYSGQMNSTGS

SEQ ID NO: 2759571 - protein, 14 aa, Entamoeba invadens
ISTAEELEDQTREM

SEQ ID NO: 2759572 - protein, 10 aa, Entamoeba invadens
ISTAKALGAQ

SEQ ID NO: 2759573 - protein, 16 aa, Entamoeba invadens
ISTASQTGTKSAQADQ

SEQ ID NO: 2759574 - protein, 7 aa, Entamoeba invadens
ISTATDN

SEQ ID NO: 2759575 - protein, 10 aa, Entamoeba invadens
ISTENSTKLD

SEQ ID NO: 2759576 - protein, 4 aa, Entamoeba invadens
ISTF

SEQ ID NO: 2759577 - protein, 6 aa, Entamoeba invadens
ISTGDV

SEQ ID NO: 2759578 - protein, 11 aa, Entamoeba invadens
ISTGKGTCKSK

SEQ ID NO: 2759579 - protein, 10 aa, Entamoeba invadens
ISTGKRPESI

SEQ ID NO: 2759580 - protein, 5 aa, Entamoeba invadens
ISTGN

SEQ ID NO: 2759581 - protein, 5 aa, Entamoeba invadens
ISTIT

SEQ ID NO: 2759582 - protein, 6 aa, Entamoeba invadens
ISTKSD

SEQ ID NO: 2759583 - protein, 16 aa, Entamoeba invadens
ISTKTDTDKYTIRTEP

SEQ ID NO: 2759584 - protein, 7 aa, Entamoeba invadens
ISTNKPE

SEQ ID NO: 2759585 - protein, 7 aa, Entamoeba invadens
ISTNTEE

SEQ ID NO: 2759586 - protein, 11 aa, Entamoeba invadens
ISTPSASCTSA

SEQ ID NO: 2759587 - protein, 5 aa, Entamoeba invadens
ISTQN

SEQ ID NO: 2759588 - protein, 5 aa, Entamoeba invadens
ISTRI

SEQ ID NO: 2759589 - protein, 5 aa, Entamoeba invadens
ISTRK

SEQ ID NO: 2759590 - protein, 5 aa, Entamoeba invadens
ISTRN

SEQ ID NO: 2759591 - protein, 45 aa, Entamoeba invadens
ISTSHSQTIPHDSHPSKESPQKENKDKDTTKLLNTSKDEEEEDHK

SEQ ID NO: 2759592 - protein, 14 aa, Entamoeba invadens
ISTSPNTLTATDTE

SEQ ID NO: 2759593 - protein, 10 aa, Entamoeba invadens
ISTSSTPSGV

SEQ ID NO: 2759594 - protein, 8 aa, Entamoeba invadens
ISVGRTEI

SEQ ID NO: 2759595 - protein, 6 aa, Entamoeba invadens
ISVGSD

SEQ ID NO: 2759596 - protein, 13 aa, Entamoeba invadens
ISVGSDCQSTPSK

SEQ ID NO: 2759597 - protein, 13 aa, Entamoeba invadens
ISVNQKGTTKGSC

SEQ ID NO: 2759598 - protein, 11 aa, Entamoeba invadens
ISVSSDEKKRM

SEQ ID NO: 2759599 - protein, 6 aa, Entamoeba invadens
ISVSSK

SEQ ID NO: 2759600 - protein, 7 aa, Entamoeba invadens
ISVTGDG

SEQ ID NO: 2759601 - protein, 8 aa, Entamoeba invadens
ISVTNESR

SEQ ID NO: 2759602 - protein, 4 aa, Entamoeba invadens
ISYS

SEQ ID NO: 2759603 - protein, 7 aa, Entamoeba invadens
ITAASGT

SEQ ID NO: 2759604 - protein, 13 aa, Entamoeba invadens
ITAGRGRGKSAAL

SEQ ID NO: 2759605 - protein, 11 aa, Entamoeba invadens
ITALNTKTGTA

SEQ ID NO: 2759606 - protein, 9 aa, Entamoeba invadens
ITANKNTTF

SEQ ID NO: 2759607 - protein, 5 aa, Entamoeba invadens
ITANN

SEQ ID NO: 2759608 - protein, 17 aa, Entamoeba invadens
ITDDTEFTEEETQPKKG

SEQ ID NO: 2759609 - protein, 9 aa, Entamoeba invadens
ITDFGSSRN

SEQ ID NO: 2759610 - protein, 5 aa, Entamoeba invadens
ITDGE

SEQ ID NO: 2759611 - protein, 5 aa, Entamoeba invadens
ITDRP

SEQ ID NO: 2759612 - protein, 19 aa, Entamoeba invadens
ITDSNKVQVNSPNDFYKNE

SEQ ID NO: 2759613 - protein, 5 aa, Entamoeba invadens
ITDTS

SEQ ID NO: 2759614 - protein, 6 aa, Entamoeba invadens
ITDTSV

SEQ ID NO: 2759615 - protein, 5 aa, Entamoeba invadens
ITEDE

SEQ ID NO: 2759616 - protein, 12 aa, Entamoeba invadens
ITEDENINVNET

SEQ ID NO: 2759617 - protein, 5 aa, Entamoeba invadens
ITEDL

SEQ ID NO: 2759618 - protein, 8 aa, Entamoeba invadens
ITEDNGNC

SEQ ID NO: 2759619 - protein, 8 aa, Entamoeba invadens
ITEDNRNC

SEQ ID NO: 2759620 - protein, 9 aa, Entamoeba invadens
ITEEDSVSL

SEQ ID NO: 2759621 - protein, 6 aa, Entamoeba invadens
ITEEKQ

SEQ ID NO: 2759622 - protein, 4 aa, Entamoeba invadens
ITEK

SEQ ID NO: 2759623 - protein, 5 aa, Entamoeba invadens
ITEKN

SEQ ID NO: 2759624 - protein, 6 aa, Entamoeba invadens
ITENGC

SEQ ID NO: 2759625 - protein, 10 aa, Entamoeba invadens
ITENGCEKCK

SEQ ID NO: 2759626 - protein, 10 aa, Entamoeba invadens
ITENGNCEST

SEQ ID NO: 2759627 - protein, 6 aa, Entamoeba invadens
ITEPTG

SEQ ID NO: 2759628 - protein, 27 aa, Entamoeba invadens
ITESGNCASTTCKNNEEYEENGRCSIT

SEQ ID NO: 2759629 - protein, 8 aa, Entamoeba invadens
ITESYEKK

SEQ ID NO: 2759630 - protein, 17 aa, Entamoeba invadens
ITESYKDLKESDKERAR

SEQ ID NO: 2759631 - protein, 6 aa, Entamoeba invadens
ITETDD

SEQ ID NO: 2759632 - protein, 11 aa, Entamoeba invadens
ITETDGEKSAK

SEQ ID NO: 2759633 - protein, 4 aa, Entamoeba invadens
ITFD

SEQ ID NO: 2759634 - protein, 12 aa, Entamoeba invadens
ITFTPNNDSTVR

SEQ ID NO: 2759635 - protein, 6 aa, Entamoeba invadens
ITGKTD

SEQ ID NO: 2759636 - protein, 8 aa, Entamoeba invadens
ITGNDASM

SEQ ID NO: 2759637 - protein, 14 aa, Entamoeba invadens
ITGNSSGPSQIIPD

SEQ ID NO: 2759638 - protein, 8 aa, Entamoeba invadens
ITGNVTTT

SEQ ID NO: 2759639 - protein, 6 aa, Entamoeba invadens
ITGSEL

SEQ ID NO: 2759640 - protein, 21 aa, Entamoeba invadens
ITGSTSSSEIKTGKKKEYEAL

SEQ ID NO: 2759641 - protein, 5 aa, Entamoeba invadens
ITIEN

SEQ ID NO: 2759642 - protein, 13 aa, Entamoeba invadens
ITKCAAKSEMTIN

SEQ ID NO: 2759643 - protein, 8 aa, Entamoeba invadens
ITKDNRNC

SEQ ID NO: 2759644 - protein, 5 aa, Entamoeba invadens
ITKEG

SEQ ID NO: 2759645 - protein, 10 aa, Entamoeba invadens
ITKKGESIQN

SEQ ID NO: 2759646 - protein, 6 aa, Entamoeba invadens
ITKKKD

SEQ ID NO: 2759647 - protein, 13 aa, Entamoeba invadens
ITKLEDKNQKSFD

SEQ ID NO: 2759648 - protein, 9 aa, Entamoeba invadens
ITKLNPKTA

SEQ ID NO: 2759649 - protein, 9 aa, Entamoeba invadens
ITKNNKNVK

SEQ ID NO: 2759650 - protein, 4 aa, Entamoeba invadens
ITKP

SEQ ID NO: 2759651 - protein, 4 aa, Entamoeba invadens
ITKR

SEQ ID NO: 2759652 - protein, 4 aa, Entamoeba invadens
ITKS

SEQ ID NO: 2759653 - protein, 9 aa, Entamoeba invadens
ITKSGASSV

SEQ ID NO: 2759654 - protein, 12 aa, Entamoeba invadens
ITKSGSDSVKCT

SEQ ID NO: 2759655 - protein, 9 aa, Entamoeba invadens
ITKSGTLTS

SEQ ID NO: 2759656 - protein, 6 aa, Entamoeba invadens
ITKSKC

SEQ ID NO: 2759657 - protein, 6 aa, Entamoeba invadens
ITKSSD

SEQ ID NO: 2759658 - protein, 4 aa, Entamoeba invadens
ITKT

SEQ ID NO: 2759659 - protein, 26 aa, Entamoeba invadens
ITKTRLNKNGVPLTESELKATQQKLN

SEQ ID NO: 2759660 - protein, 6 aa, Entamoeba invadens
ITLKDN

SEQ ID NO: 2759661 - protein, 4 aa, Entamoeba invadens
ITMT

SEQ ID NO: 2759662 - protein, 5 aa, Entamoeba invadens
ITNEG

SEQ ID NO: 2759663 - protein, 5 aa, Entamoeba invadens
ITNES

SEQ ID NO: 2759664 - protein, 5 aa, Entamoeba invadens
ITNGD

SEQ ID NO: 2759665 - protein, 15 aa, Entamoeba invadens
ITNHQDLDGEFSQDK

SEQ ID NO: 2759666 - protein, 6 aa, Entamoeba invadens
ITNKNT

SEQ ID NO: 2759667 - protein, 8 aa, Entamoeba invadens
ITNKTKNY

SEQ ID NO: 2759668 - protein, 8 aa, Entamoeba invadens
ITNKVTED

SEQ ID NO: 2759669 - protein, 5 aa, Entamoeba invadens
ITNNN

SEQ ID NO: 2759670 - protein, 6 aa, Entamoeba invadens
ITNNNN

SEQ ID NO: 2759671 - protein, 8 aa, Entamoeba invadens
ITNPKDEF

SEQ ID NO: 2759672 - protein, 9 aa, Entamoeba invadens
ITNPTDNTK

SEQ ID NO: 2759673 - protein, 12 aa, Entamoeba invadens
ITNSQENASSGY

SEQ ID NO: 2759674 - protein, 8 aa, Entamoeba invadens
ITNSQRDF

SEQ ID NO: 2759675 - protein, 6 aa, Entamoeba invadens
ITNSTF

SEQ ID NO: 2759676 - protein, 6 aa, Entamoeba invadens
ITNTNT

SEQ ID NO: 2759677 - protein, 8 aa, Entamoeba invadens
ITNTQSTF

SEQ ID NO: 2759678 - protein, 9 aa, Entamoeba invadens
ITNTSDIEK

SEQ ID NO: 2759679 - protein, 11 aa, Entamoeba invadens
ITNTSIDEGAI

SEQ ID NO: 2759680 - protein, 12 aa, Entamoeba invadens
ITNTSNNGQTNY

SEQ ID NO: 2759681 - protein, 10 aa, Entamoeba invadens
ITNVEKKDMK

SEQ ID NO: 2759682 - protein, 10 aa, Entamoeba invadens
ITPDKANTRG

SEQ ID NO: 2759683 - protein, 11 aa, Entamoeba invadens
ITPDVTEGSLP

SEQ ID NO: 2759684 - protein, 5 aa, Entamoeba invadens
ITPEE

SEQ ID NO: 2759685 - protein, 10 aa, Entamoeba invadens
ITPESTSHFP

SEQ ID NO: 2759686 - protein, 4 aa, Entamoeba invadens
ITPK

SEQ ID NO: 2759687 - protein, 10 aa, Entamoeba invadens
ITPKEQDDDP

SEQ ID NO: 2759688 - protein, 7 aa, Entamoeba invadens
ITPKPDS

SEQ ID NO: 2759689 - protein, 14 aa, Entamoeba invadens
ITPKSATLKPSTAV

SEQ ID NO: 2759690 - protein, 15 aa, Entamoeba invadens
ITPKSATLKSSTAIP

SEQ ID NO: 2759691 - protein, 12 aa, Entamoeba invadens
ITPKTKPKPDNF

SEQ ID NO: 2759692 - protein, 12 aa, Entamoeba invadens
ITPNNATLRPGN

SEQ ID NO: 2759693 - protein, 5 aa, Entamoeba invadens
ITPPQ

SEQ ID NO: 2759694 - protein, 13 aa, Entamoeba invadens
ITPQQSGNWTKSN

SEQ ID NO: 2759695 - protein, 7 aa, Entamoeba invadens
ITPSATG

SEQ ID NO: 2759696 - protein, 16 aa, Entamoeba invadens
ITPSPPSDVKAQTKQP

SEQ ID NO: 2759697 - protein, 6 aa, Entamoeba invadens
ITPSSK

SEQ ID NO: 2759698 - protein, 35 aa, Entamoeba invadens
ITPTAKTPESGLNSTEIEMDENNEEKASIENSTDI

SEQ ID NO: 2759699 - protein, 5 aa, Entamoeba invadens
ITPTD

SEQ ID NO: 2759700 - protein, 9 aa, Entamoeba invadens
ITPTDDKTL

SEQ ID NO: 2759701 - protein, 6 aa, Entamoeba invadens
ITPTNA

SEQ ID NO: 2759702 - protein, 6 aa, Entamoeba invadens
ITPTNP

SEQ ID NO: 2759703 - protein, 8 aa, Entamoeba invadens
ITPTSKRA

SEQ ID NO: 2759704 - protein, 5 aa, Entamoeba invadens
ITQEE

SEQ ID NO: 2759705 - protein, 8 aa, Entamoeba invadens
ITQENTPI

SEQ ID NO: 2759706 - protein, 8 aa, Entamoeba invadens
ITQKGDRT

SEQ ID NO: 2759707 - protein, 5 aa, Entamoeba invadens
ITQNE

SEQ ID NO: 2759708 - protein, 12 aa, Entamoeba invadens
ITQNTGCGDPTV

SEQ ID NO: 2759709 - protein, 6 aa, Entamoeba invadens
ITQQDV

SEQ ID NO: 2759710 - protein, 7 aa, Entamoeba invadens
ITQSGNV

SEQ ID NO: 2759711 - protein, 19 aa, Entamoeba invadens
ITQSSPPTNAKTCSTMTNG

SEQ ID NO: 2759712 - protein, 8 aa, Entamoeba invadens
ITQTCSQD

SEQ ID NO: 2759713 - protein, 14 aa, Entamoeba invadens
ITQTPNRCENTAFT

SEQ ID NO: 2759714 - protein, 24 aa, Entamoeba invadens
ITQTSLTKKDTKVSQFQDKSNTVI

SEQ ID NO: 2759715 - protein, 21 aa, Entamoeba invadens
ITQTSLTKKDTKVSQLQDTSN

SEQ ID NO: 2759716 - protein, 13 aa, Entamoeba invadens
ITRGNNVDGSTTC

SEQ ID NO: 2759717 - protein, 4 aa, Entamoeba invadens
ITRK

SEQ ID NO: 2759718 - protein, 4 aa, Entamoeba invadens
ITRQ

SEQ ID NO: 2759719 - protein, 6 aa, Entamoeba invadens
ITRSES

SEQ ID NO: 2759720 - protein, 5 aa, Entamoeba invadens
ITRTK

SEQ ID NO: 2759721 - protein, 6 aa, Entamoeba invadens
ITRTND

SEQ ID NO: 2759722 - protein, 4 aa, Entamoeba invadens
ITSA

SEQ ID NO: 2759723 - protein, 13 aa, Entamoeba invadens
ITSEGESKKYSID

SEQ ID NO: 2759724 - protein, 19 aa, Entamoeba invadens
ITSELSSGKCSKCQTTSCE

SEQ ID NO: 2759725 - protein, 6 aa, Entamoeba invadens
ITSENE

SEQ ID NO: 2759726 - protein, 18 aa, Entamoeba invadens
ITSETDLFGDNGKEKGGA

SEQ ID NO: 2759727 - protein, 4 aa, Entamoeba invadens
ITSF

SEQ ID NO: 2759728 - protein, 5 aa, Entamoeba invadens
ITSGA

SEQ ID NO: 2759729 - protein, 11 aa, Entamoeba invadens
ITSHKVRGEEI

SEQ ID NO: 2759730 - protein, 4 aa, Entamoeba invadens
ITSK

SEQ ID NO: 2759731 - protein, 11 aa, Entamoeba invadens
ITSKTKSNSAG

SEQ ID NO: 2759732 - protein, 7 aa, Entamoeba invadens
ITSNNNI

SEQ ID NO: 2759733 - protein, 15 aa, Entamoeba invadens
ITSNNPLNLESNKFS

SEQ ID NO: 2759734 - protein, 4 aa, Entamoeba invadens
ITSP

SEQ ID NO: 2759735 - protein, 7 aa, Entamoeba invadens
ITSPAQL

SEQ ID NO: 2759736 - protein, 7 aa, Entamoeba invadens
ITSPNIP

SEQ ID NO: 2759737 - protein, 15 aa, Entamoeba invadens
ITSPNLNKQITTRSQ

SEQ ID NO: 2759738 - protein, 9 aa, Entamoeba invadens
ITSQASALT

SEQ ID NO: 2759739 - protein, 6 aa, Entamoeba invadens
ITSRGN

SEQ ID NO: 2759740 - protein, 12 aa, Entamoeba invadens
ITSSDSKACNLG

SEQ ID NO: 2759741 - protein, 6 aa, Entamoeba invadens
ITSSEE

SEQ ID NO: 2759742 - protein, 26 aa, Entamoeba invadens
ITSSKSDKSNEKYEQFEDKNSPKIEE

SEQ ID NO: 2759743 - protein, 12 aa, Entamoeba invadens
ITSSNSNDYSPS

SEQ ID NO: 2759744 - protein, 17 aa, Entamoeba invadens
ITSSPKTESATTTGLPG

SEQ ID NO: 2759745 - protein, 7 aa, Entamoeba invadens
ITSSTKS

SEQ ID NO: 2759746 - protein, 4 aa, Entamoeba invadens
ITST

SEQ ID NO: 2759747 - protein, 9 aa, Entamoeba invadens
ITSVTTPKT

SEQ ID NO: 2759748 - protein, 13 aa, Entamoeba invadens
ITSYPNKEKPVLT

SEQ ID NO: 2759749 - protein, 17 aa, Entamoeba invadens
ITTDNKCKRSDGSLDLN

SEQ ID NO: 2759750 - protein, 6 aa, Entamoeba invadens
ITTDQN

SEQ ID NO: 2759751 - protein, 4 aa, Entamoeba invadens
ITTE

SEQ ID NO: 2759752 - protein, 7 aa, Entamoeba invadens
ITTGECT

SEQ ID NO: 2759753 - protein, 9 aa, Entamoeba invadens
ITTNEKNEI

SEQ ID NO: 2759754 - protein, 6 aa, Entamoeba invadens
ITTNER

SEQ ID NO: 2759755 - protein, 5 aa, Entamoeba invadens
ITTNG

SEQ ID NO: 2759756 - protein, 12 aa, Entamoeba invadens
ITTNGCSSCQQG

SEQ ID NO: 2759757 - protein, 6 aa, Entamoeba invadens
ITTNGN

SEQ ID NO: 2759758 - protein, 10 aa, Entamoeba invadens
ITTNGNCSLN

SEQ ID NO: 2759759 - protein, 9 aa, Entamoeba invadens
ITTNKGDGD

SEQ ID NO: 2759760 - protein, 5 aa, Entamoeba invadens
ITTNN

SEQ ID NO: 2759761 - protein, 6 aa, Entamoeba invadens
ITTNND

SEQ ID NO: 2759762 - protein, 12 aa, Entamoeba invadens
ITTNQNKDEYKD

SEQ ID NO: 2759763 - protein, 4 aa, Entamoeba invadens
ITTP

SEQ ID NO: 2759764 - protein, 6 aa, Entamoeba invadens
ITTPEQ

SEQ ID NO: 2759765 - protein, 10 aa, Entamoeba invadens
ITTPESVTED

SEQ ID NO: 2759766 - protein, 16 aa, Entamoeba invadens
ITTPKEATQNNYRDNE

SEQ ID NO: 2759767 - protein, 5 aa, Entamoeba invadens
ITTPS

SEQ ID NO: 2759768 - protein, 22 aa, Entamoeba invadens
ITTPSPLPIHPSSTTPDSKIDS

SEQ ID NO: 2759769 - protein, 12 aa, Entamoeba invadens
ITTPVKTAPTDQ

SEQ ID NO: 2759770 - protein, 11 aa, Entamoeba invadens
ITTQSNCSISG

SEQ ID NO: 2759771 - protein, 15 aa, Entamoeba invadens
ITTQSSSEKYTIRTE

SEQ ID NO: 2759772 - protein, 20 aa, Entamoeba invadens
ITTRIDPDELKEEKKLGEGS

SEQ ID NO: 2759773 - protein, 5 aa, Entamoeba invadens
ITTSK

SEQ ID NO: 2759774 - protein, 10 aa, Entamoeba invadens
ITTSTPMTIG

SEQ ID NO: 2759775 - protein, 18 aa, Entamoeba invadens
ITTSTSTASLGINTGTYA

SEQ ID NO: 2759776 - protein, 4 aa, Entamoeba invadens
ITTT

SEQ ID NO: 2759777 - protein, 5 aa, Entamoeba invadens
ITTTE

SEQ ID NO: 2759778 - protein, 7 aa, Entamoeba invadens
ITTTEKS

SEQ ID NO: 2759779 - protein, 9 aa, Entamoeba invadens
ITTTNNEEK

SEQ ID NO: 2759780 - protein, 16 aa, Entamoeba invadens
ITVGTAPQVQTQGAPI

SEQ ID NO: 2759781 - protein, 6 aa, Entamoeba invadens
ITVNDN

SEQ ID NO: 2759782 - protein, 6 aa, Entamoeba invadens
ITVNES

SEQ ID NO: 2759783 - protein, 9 aa, Entamoeba invadens
ITVQGNETE

SEQ ID NO: 2759784 - protein, 4 aa, Entamoeba invadens
ITVS

SEQ ID NO: 2759785 - protein, 7 aa, Entamoeba invadens
ITYTSQT

SEQ ID NO: 2759786 - protein, 19 aa, Entamoeba invadens
IVGDDNKYPAEYNGTCSRE

SEQ ID NO: 2759787 - protein, 10 aa, Entamoeba invadens
IVKPPGEFIP

SEQ ID NO: 2759788 - protein, 5 aa, Entamoeba invadens
IVNEK

SEQ ID NO: 2759789 - protein, 10 aa, Entamoeba invadens
IVNEKTCNSV

SEQ ID NO: 2759790 - protein, 6 aa, Entamoeba invadens
IVPGGG

SEQ ID NO: 2759791 - protein, 9 aa, Entamoeba invadens
IVPSSKEEF

SEQ ID NO: 2759792 - protein, 5 aa, Entamoeba invadens
IVRSS

SEQ ID NO: 2759793 - protein, 15 aa, Entamoeba invadens
IVSTNAKLSDFGSSR

SEQ ID NO: 2759794 - protein, 8 aa, Entamoeba invadens
IVTTSGAT

SEQ ID NO: 2759795 - protein, 6 aa, Entamoeba invadens
IYETTG

SEQ ID NO: 2759796 - protein, 5 aa, Entamoeba invadens
IYGET

SEQ ID NO: 2759797 - protein, 38 aa, Entamoeba invadens
IYGNPDDESDGLSSDMDEHKDATKTEALSSSEGNEITP

SEQ ID NO: 2759798 - protein, 9 aa, Entamoeba invadens
IYKDTADDY

SEQ ID NO: 2759799 - protein, 25 aa, Entamoeba invadens
IYNDPIEKENHKREKEMASDQQHLQ

SEQ ID NO: 2759800 - protein, 7 aa, Entamoeba invadens
IYNNTTN

SEQ ID NO: 2759801 - protein, 12 aa, Entamoeba invadens
IYPKETTAETIQ

SEQ ID NO: 2759802 - protein, 7 aa, Entamoeba invadens
IYQRSEE

SEQ ID NO: 2759803 - protein, 9 aa, Entamoeba invadens
IYSNETEVH

SEQ ID NO: 2759804 - protein, 6 aa, Entamoeba invadens
IYSNTG

SEQ ID NO: 2759805 - protein, 8 aa, Entamoeba invadens
IYSSENGT

SEQ ID NO: 2759806 - protein, 10 aa, Entamoeba invadens
KAADEYKNNN

SEQ ID NO: 2759807 - protein, 6 aa, Entamoeba invadens
KAAGLP

SEQ ID NO: 2759808 - protein, 8 aa, Entamoeba invadens
KAALGAST

SEQ ID NO: 2759809 - protein, 13 aa, Entamoeba invadens
KAANAAKTEKKSL

SEQ ID NO: 2759810 - protein, 11 aa, Entamoeba invadens
KAARGERPPFS

SEQ ID NO: 2759811 - protein, 18 aa, Entamoeba invadens
KACASGCKTCTKADDCSA

SEQ ID NO: 2759812 - protein, 5 aa, Entamoeba invadens
KACGN

SEQ ID NO: 2759813 - protein, 12 aa, Entamoeba invadens
KACKNELKEQIN

SEQ ID NO: 2759814 - protein, 9 aa, Entamoeba invadens
KACPNAAKD

SEQ ID NO: 2759815 - protein, 11 aa, Entamoeba invadens
KADASSPETEK

SEQ ID NO: 2759816 - protein, 13 aa, Entamoeba invadens
KADDDVRTSRDQV

SEQ ID NO: 2759817 - protein, 6 aa, Entamoeba invadens
KADHEI

SEQ ID NO: 2759818 - protein, 7 aa, Entamoeba invadens
KADNANF

SEQ ID NO: 2759819 - protein, 7 aa, Entamoeba invadens
KADNIGK

SEQ ID NO: 2759820 - protein, 8 aa, Entamoeba invadens
KADQRREL

SEQ ID NO: 2759821 - protein, 5 aa, Entamoeba invadens
KADRA

SEQ ID NO: 2759822 - protein, 11 aa, Entamoeba invadens
KADRVHHDRTT

SEQ ID NO: 2759823 - protein, 13 aa, Entamoeba invadens
KADVGKDNTNVEE

SEQ ID NO: 2759824 - protein, 6 aa, Entamoeba invadens
KADYIT

SEQ ID NO: 2759825 - protein, 7 aa, Entamoeba invadens
KAEDDLS

SEQ ID NO: 2759826 - protein, 7 aa, Entamoeba invadens
KAEDSKC

SEQ ID NO: 2759827 - protein, 5 aa, Entamoeba invadens
KAEDT

SEQ ID NO: 2759828 - protein, 7 aa, Entamoeba invadens
KAEEDDH

SEQ ID NO: 2759829 - protein, 8 aa, Entamoeba invadens
KAEEEPQP

SEQ ID NO: 2759830 - protein, 15 aa, Entamoeba invadens
KAEGKTIDDISNSPK

SEQ ID NO: 2759831 - protein, 8 aa, Entamoeba invadens
KAEGKTVK

SEQ ID NO: 2759832 - protein, 5 aa, Entamoeba invadens
KAEGQ

SEQ ID NO: 2759833 - protein, 9 aa, Entamoeba invadens
KAEKGEGLG

SEQ ID NO: 2759834 - protein, 8 aa, Entamoeba invadens
KAEKGKTV

SEQ ID NO: 2759835 - protein, 14 aa, Entamoeba invadens
KAELEKSNKSWDTP

SEQ ID NO: 2759836 - protein, 12 aa, Entamoeba invadens
KAEMSDTSRRSV

SEQ ID NO: 2759837 - protein, 5 aa, Entamoeba invadens
KAENI

SEQ ID NO: 2759838 - protein, 8 aa, Entamoeba invadens
KAEPISEG

SEQ ID NO: 2759839 - protein, 9 aa, Entamoeba invadens
KAEPQPIEH

SEQ ID NO: 2759840 - protein, 9 aa, Entamoeba invadens
KAEQSQENV

SEQ ID NO: 2759841 - protein, 7 aa, Entamoeba invadens
KAESYTS

SEQ ID NO: 2759842 - protein, 6 aa, Entamoeba invadens
KAETAP

SEQ ID NO: 2759843 - protein, 14 aa, Entamoeba invadens
KAETEMSTRLDPDE

SEQ ID NO: 2759844 - protein, 7 aa, Entamoeba invadens
KAETHNG

SEQ ID NO: 2759845 - protein, 9 aa, Entamoeba invadens
KAETTSLNN

SEQ ID NO: 2759846 - protein, 13 aa, Entamoeba invadens
KAEYKGHPEEQTY

SEQ ID NO: 2759847 - protein, 6 aa, Entamoeba invadens
KAEYTK

SEQ ID NO: 2759848 - protein, 9 aa, Entamoeba invadens
KAFAEGANG

SEQ ID NO: 2759849 - protein, 16 aa, Entamoeba invadens
KAFSVTSNNEGTITQI

SEQ ID NO: 2759850 - protein, 4 aa, Entamoeba invadens
KAGA

SEQ ID NO: 2759851 - protein, 13 aa, Entamoeba invadens
KAGAATKKDMEEF

SEQ ID NO: 2759852 - protein, 12 aa, Entamoeba invadens
KAGCTEVTNTQC

SEQ ID NO: 2759853 - protein, 8 aa, Entamoeba invadens
KAGGCAES

SEQ ID NO: 2759854 - protein, 7 aa, Entamoeba invadens
KAGHKGG

SEQ ID NO: 2759855 - protein, 5 aa, Entamoeba invadens
KAGKT

SEQ ID NO: 2759856 - protein, 13 aa, Entamoeba invadens
KAGLTTTENSDDG

SEQ ID NO: 2759857 - protein, 12 aa, Entamoeba invadens
KAGNSQKAGDRK

SEQ ID NO: 2759858 - protein, 7 aa, Entamoeba invadens
KAGQTRV

SEQ ID NO: 2759859 - protein, 5 aa, Entamoeba invadens
KAGSV

SEQ ID NO: 2759860 - protein, 11 aa, Entamoeba invadens
KAGTDKDKRGV

SEQ ID NO: 2759861 - protein, 25 aa, Entamoeba invadens
KAGTKSNQNTKTCDNCQPGTYSGSM

SEQ ID NO: 2759862 - protein, 17 aa, Entamoeba invadens
KAGTYADEQGSSSCKTC

SEQ ID NO: 2759863 - protein, 11 aa, Entamoeba invadens
KAGTYSSSKSA

SEQ ID NO: 2759864 - protein, 8 aa, Entamoeba invadens
KAIEAAKK

SEQ ID NO: 2759865 - protein, 5 aa, Entamoeba invadens
KAIEE

SEQ ID NO: 2759866 - protein, 9 aa, Entamoeba invadens
KAIKEAKAF

SEQ ID NO: 2759867 - protein, 6 aa, Entamoeba invadens
KAIRKD

SEQ ID NO: 2759868 - protein, 11 aa, Entamoeba invadens
KAIVDQEYTET

SEQ ID NO: 2759869 - protein, 50 aa, Entamoeba invadens
KAKEEENKKKENELKKNSSEDAKWDSSDDSANSISDDESKLSKEVVTRTK

SEQ ID NO: 2759870 - protein, 12 aa, Entamoeba invadens
KAKEKYVTGENL

SEQ ID NO: 2759871 - protein, 9 aa, Entamoeba invadens
KAKKGEETF

SEQ ID NO: 2759872 - protein, 9 aa, Entamoeba invadens
KAKKLAPKD

SEQ ID NO: 2759873 - protein, 10 aa, Entamoeba invadens
KAKKQESKSI

SEQ ID NO: 2759874 - protein, 4 aa, Entamoeba invadens
KAKM

SEQ ID NO: 2759875 - protein, 6 aa, Entamoeba invadens
KAKNAH

SEQ ID NO: 2759876 - protein, 9 aa, Entamoeba invadens
KAKNSAKHV

SEQ ID NO: 2759877 - protein, 8 aa, Entamoeba invadens
KAKPQSVE

SEQ ID NO: 2759878 - protein, 8 aa, Entamoeba invadens
KAKPSRER

SEQ ID NO: 2759879 - protein, 83 aa, Entamoeba invadens
KAKQASKEKKETKEKKEAKNEKKKKADNAMEEESDEEKGEQESAGNPKMEEEKSKSDDESEKVKEEVAKKKHQEDKVDTAEKE

SEQ ID NO: 2759880 - protein, 7 aa, Entamoeba invadens
KAKQASP

SEQ ID NO: 2759881 - protein, 11 aa, Entamoeba invadens
KAKQEKKKFEK

SEQ ID NO: 2759882 - protein, 9 aa, Entamoeba invadens
KAKQKPKPK

SEQ ID NO: 2759883 - protein, 8 aa, Entamoeba invadens
KAKQNCGI

SEQ ID NO: 2759884 - protein, 19 aa, Entamoeba invadens
KAKRENRKAKTPQNLSYRK

SEQ ID NO: 2759885 - protein, 8 aa, Entamoeba invadens
KAKRGFSQ

SEQ ID NO: 2759886 - protein, 9 aa, Entamoeba invadens
KAKRPEGPA

SEQ ID NO: 2759887 - protein, 8 aa, Entamoeba invadens
KAKSTLGK

SEQ ID NO: 2759888 - protein, 5 aa, Entamoeba invadens
KALEN

SEQ ID NO: 2759889 - protein, 10 aa, Entamoeba invadens
KALESSQNVL

SEQ ID NO: 2759890 - protein, 9 aa, Entamoeba invadens
KALKEEDDF

SEQ ID NO: 2759891 - protein, 7 aa, Entamoeba invadens
KALKGKT

SEQ ID NO: 2759892 - protein, 14 aa, Entamoeba invadens
KALLGDSKIERDGY

SEQ ID NO: 2759893 - protein, 8 aa, Entamoeba invadens
KALNEDKH

SEQ ID NO: 2759894 - protein, 13 aa, Entamoeba invadens
KALTDEEKKSYEI

SEQ ID NO: 2759895 - protein, 7 aa, Entamoeba invadens
KAMEKKT

SEQ ID NO: 2759896 - protein, 6 aa, Entamoeba invadens
KAMKSE

SEQ ID NO: 2759897 - protein, 10 aa, Entamoeba invadens
KANAPENTKV

SEQ ID NO: 2759898 - protein, 8 aa, Entamoeba invadens
KANDKSKS

SEQ ID NO: 2759899 - protein, 6 aa, Entamoeba invadens
KANGKF

SEQ ID NO: 2759900 - protein, 8 aa, Entamoeba invadens
KANGNNFN

SEQ ID NO: 2759901 - protein, 5 aa, Entamoeba invadens
KANGV

SEQ ID NO: 2759902 - protein, 7 aa, Entamoeba invadens
KANQGKT

SEQ ID NO: 2759903 - protein, 6 aa, Entamoeba invadens
KANQVS

SEQ ID NO: 2759904 - protein, 15 aa, Entamoeba invadens
KANRGTINNIINLLT

SEQ ID NO: 2759905 - protein, 4 aa, Entamoeba invadens
KANS

SEQ ID NO: 2759906 - protein, 8 aa, Entamoeba invadens
KANSNETH

SEQ ID NO: 2759907 - protein, 14 aa, Entamoeba invadens
KANSYNLPSTAASK

SEQ ID NO: 2759908 - protein, 10 aa, Entamoeba invadens
KANTCDTKNG

SEQ ID NO: 2759909 - protein, 7 aa, Entamoeba invadens
KANTCDV

SEQ ID NO: 2759910 - protein, 16 aa, Entamoeba invadens
KANTDCSTKVDGTFEE

SEQ ID NO: 2759911 - protein, 12 aa, Entamoeba invadens
KANTFKKQSHQL

SEQ ID NO: 2759912 - protein, 5 aa, Entamoeba invadens
KANYE

SEQ ID NO: 2759913 - protein, 17 aa, Entamoeba invadens
KANYKKRAGKVQKDTPI

SEQ ID NO: 2759914 - protein, 8 aa, Entamoeba invadens
KAPEEDKG

SEQ ID NO: 2759915 - protein, 14 aa, Entamoeba invadens
KAPELHEQTPSKAS

SEQ ID NO: 2759916 - protein, 6 aa, Entamoeba invadens
KAPGHY

SEQ ID NO: 2759917 - protein, 7 aa, Entamoeba invadens
KAPKYVT

SEQ ID NO: 2759918 - protein, 11 aa, Entamoeba invadens
KAPNKQTPSIP

SEQ ID NO: 2759919 - protein, 7 aa, Entamoeba invadens
KAPPIKQ

SEQ ID NO: 2759920 - protein, 10 aa, Entamoeba invadens
KAPPKDPTSS

SEQ ID NO: 2759921 - protein, 8 aa, Entamoeba invadens
KAPQNKTQ

SEQ ID NO: 2759922 - protein, 7 aa, Entamoeba invadens
KAPRGKI

SEQ ID NO: 2759923 - protein, 20 aa, Entamoeba invadens
KAPTEDGIPNMPQADPSSLM

SEQ ID NO: 2759924 - protein, 7 aa, Entamoeba invadens
KAPTSEV

SEQ ID NO: 2759925 - protein, 8 aa, Entamoeba invadens
KAQDDQSK

SEQ ID NO: 2759926 - protein, 4 aa, Entamoeba invadens
KAQE

SEQ ID NO: 2759927 - protein, 19 aa, Entamoeba invadens
KAQGGYYPVTSSTKKCSPH

SEQ ID NO: 2759928 - protein, 6 aa, Entamoeba invadens
KAQIEA

SEQ ID NO: 2759929 - protein, 8 aa, Entamoeba invadens
KAQKHAQK

SEQ ID NO: 2759930 - protein, 8 aa, Entamoeba invadens
KAQNLTND

SEQ ID NO: 2759931 - protein, 6 aa, Entamoeba invadens
KARDNC

SEQ ID NO: 2759932 - protein, 5 aa, Entamoeba invadens
KAREF

SEQ ID NO: 2759933 - protein, 30 aa, Entamoeba invadens
KARKNGAYTSKFPHPQNYGSGAPRRNSVGK

SEQ ID NO: 2759934 - protein, 8 aa, Entamoeba invadens
KARPTQKE

SEQ ID NO: 2759935 - protein, 13 aa, Entamoeba invadens
KARPTTKTQRPTV

SEQ ID NO: 2759936 - protein, 8 aa, Entamoeba invadens
KARQEKVV

SEQ ID NO: 2759937 - protein, 9 aa, Entamoeba invadens
KARRATKTI

SEQ ID NO: 2759938 - protein, 5 aa, Entamoeba invadens
KARTK

SEQ ID NO: 2759939 - protein, 7 aa, Entamoeba invadens
KASAVYN

SEQ ID NO: 2759940 - protein, 8 aa, Entamoeba invadens
KASDSKCS

SEQ ID NO: 2759941 - protein, 8 aa, Entamoeba invadens
KASDVSER

SEQ ID NO: 2759942 - protein, 6 aa, Entamoeba invadens
KASISG

SEQ ID NO: 2759943 - protein, 6 aa, Entamoeba invadens
KASKAL

SEQ ID NO: 2759944 - protein, 16 aa, Entamoeba invadens
KASKEQKDDKKEERIE

SEQ ID NO: 2759945 - protein, 11 aa, Entamoeba invadens
KASKNRITTEE

SEQ ID NO: 2759946 - protein, 7 aa, Entamoeba invadens
KASNGND

SEQ ID NO: 2759947 - protein, 8 aa, Entamoeba invadens
KASNTPCN

SEQ ID NO: 2759948 - protein, 9 aa, Entamoeba invadens
KASSEQLNQ

SEQ ID NO: 2759949 - protein, 10 aa, Entamoeba invadens
KASSGSVDEM

SEQ ID NO: 2759950 - protein, 4 aa, Entamoeba invadens
KAST

SEQ ID NO: 2759951 - protein, 14 aa, Entamoeba invadens
KASTGYTSTTAEYN

SEQ ID NO: 2759952 - protein, 8 aa, Entamoeba invadens
KASYQHDY

SEQ ID NO: 2759953 - protein, 7 aa, Entamoeba invadens
KATDHNR

SEQ ID NO: 2759954 - protein, 10 aa, Entamoeba invadens
KATEETRRNR

SEQ ID NO: 2759955 - protein, 9 aa, Entamoeba invadens
KATGIPTEQ

SEQ ID NO: 2759956 - protein, 8 aa, Entamoeba invadens
KATKASNL

SEQ ID NO: 2759957 - protein, 9 aa, Entamoeba invadens
KATKKLDDN

SEQ ID NO: 2759958 - protein, 6 aa, Entamoeba invadens
KATKSH

SEQ ID NO: 2759959 - protein, 13 aa, Entamoeba invadens
KATKTEPCEDENC

SEQ ID NO: 2759960 - protein, 7 aa, Entamoeba invadens
KATKTGL

SEQ ID NO: 2759961 - protein, 8 aa, Entamoeba invadens
KATMSDSQ

SEQ ID NO: 2759962 - protein, 7 aa, Entamoeba invadens
KATMTTT

SEQ ID NO: 2759963 - protein, 7 aa, Entamoeba invadens
KATNGKM

SEQ ID NO: 2759964 - protein, 6 aa, Entamoeba invadens
KATQKL

SEQ ID NO: 2759965 - protein, 4 aa, Entamoeba invadens
KATR

SEQ ID NO: 2759966 - protein, 11 aa, Entamoeba invadens
KATRAGEALGQ

SEQ ID NO: 2759967 - protein, 14 aa, Entamoeba invadens
KATSKLSTRLDPDE

SEQ ID NO: 2759968 - protein, 18 aa, Entamoeba invadens
KATSKLSTRLDPDELTEE

SEQ ID NO: 2759969 - protein, 7 aa, Entamoeba invadens
KATTTIP

SEQ ID NO: 2759970 - protein, 9 aa, Entamoeba invadens
KATVEQDKK

SEQ ID NO: 2759971 - protein, 7 aa, Entamoeba invadens
KAVASDE

SEQ ID NO: 2759972 - protein, 9 aa, Entamoeba invadens
KAVEEGKDI

SEQ ID NO: 2759973 - protein, 6 aa, Entamoeba invadens
KAVENE

SEQ ID NO: 2759974 - protein, 14 aa, Entamoeba invadens
KAVSGTNNDCTSPL

SEQ ID NO: 2759975 - protein, 9 aa, Entamoeba invadens
KAVSNSKCS

SEQ ID NO: 2759976 - protein, 8 aa, Entamoeba invadens
KAVSSNRG

SEQ ID NO: 2759977 - protein, 10 aa, Entamoeba invadens
KAVVDQEYTE

SEQ ID NO: 2759978 - protein, 9 aa, Entamoeba invadens
KAYEGTNEI

SEQ ID NO: 2759979 - protein, 10 aa, Entamoeba invadens
KAYESQDCKK

SEQ ID NO: 2759980 - protein, 10 aa, Entamoeba invadens
KAYESQDCKT

SEQ ID NO: 2759981 - protein, 6 aa, Entamoeba invadens
KAYGKP

SEQ ID NO: 2759982 - protein, 11 aa, Entamoeba invadens
KAYKNAQNFNG

SEQ ID NO: 2759983 - protein, 7 aa, Entamoeba invadens
KAYNGDE

SEQ ID NO: 2759984 - protein, 13 aa, Entamoeba invadens
KCADGYRTEDGVS

SEQ ID NO: 2759985 - protein, 6 aa, Entamoeba invadens
KCAPCT

SEQ ID NO: 2759986 - protein, 9 aa, Entamoeba invadens
KCASGHCKP

SEQ ID NO: 2759987 - protein, 13 aa, Entamoeba invadens
KCATGCSKCSDAT

SEQ ID NO: 2759988 - protein, 9 aa, Entamoeba invadens
KCATRTSKC

SEQ ID NO: 2759989 - protein, 10 aa, Entamoeba invadens
KCDDCETGKI

SEQ ID NO: 2759990 - protein, 6 aa, Entamoeba invadens
KCDDNC

SEQ ID NO: 2759991 - protein, 10 aa, Entamoeba invadens
KCDDSCKSCQ

SEQ ID NO: 2759992 - protein, 16 aa, Entamoeba invadens
KCDDTCNNQCDSSTGL

SEQ ID NO: 2759993 - protein, 4 aa, Entamoeba invadens
KCDE

SEQ ID NO: 2759994 - protein, 6 aa, Entamoeba invadens
KCDEAI

SEQ ID NO: 2759995 - protein, 5 aa, Entamoeba invadens
KCDES

SEQ ID NO: 2759996 - protein, 6 aa, Entamoeba invadens
KCDFKS

SEQ ID NO: 2759997 - protein, 7 aa, Entamoeba invadens
KCDGVPN

SEQ ID NO: 2759998 - protein, 8 aa, Entamoeba invadens
KCDKCGDG

SEQ ID NO: 2759999 - protein, 13 aa, Entamoeba invadens
KCDKDKKLSDDGL

SEQ ID NO: 2760000 - protein, 8 aa, Entamoeba invadens
KCDNKYVP

SEQ ID NO: 2760001 - protein, 12 aa, Entamoeba invadens
KCDNNTSEEDRK

SEQ ID NO: 2760002 - protein, 17 aa, Entamoeba invadens
KCDNTCNNQCDSSTGYC

SEQ ID NO: 2760003 - protein, 7 aa, Entamoeba invadens
KCDNTNA

SEQ ID NO: 2760004 - protein, 14 aa, Entamoeba invadens
KCDPTTQDRYEDQC

SEQ ID NO: 2760005 - protein, 9 aa, Entamoeba invadens
KCDQSSVET

SEQ ID NO: 2760006 - protein, 5 aa, Entamoeba invadens
KCDSD

SEQ ID NO: 2760007 - protein, 6 aa, Entamoeba invadens
KCDSGY

SEQ ID NO: 2760008 - protein, 13 aa, Entamoeba invadens
KCDSKVDECQQCS

SEQ ID NO: 2760009 - protein, 6 aa, Entamoeba invadens
KCDSNC

SEQ ID NO: 2760010 - protein, 9 aa, Entamoeba invadens
KCDSPYELN

SEQ ID NO: 2760011 - protein, 7 aa, Entamoeba invadens
KCDSSTG

SEQ ID NO: 2760012 - protein, 31 aa, Entamoeba invadens
KCDTCGNGKIDIGEECDNSFKNSVGCNPSTC

SEQ ID NO: 2760013 - protein, 6 aa, Entamoeba invadens
KCDTCK

SEQ ID NO: 2760014 - protein, 16 aa, Entamoeba invadens
KCDTCSAGTYQSGGSC

SEQ ID NO: 2760015 - protein, 11 aa, Entamoeba invadens
KCDTKTEQCSQ

SEQ ID NO: 2760016 - protein, 15 aa, Entamoeba invadens
KCEDASTGKGYLATT

SEQ ID NO: 2760017 - protein, 9 aa, Entamoeba invadens
KCEECSSGC

SEQ ID NO: 2760018 - protein, 9 aa, Entamoeba invadens
KCEEGTQLK

SEQ ID NO: 2760019 - protein, 11 aa, Entamoeba invadens
KCEETSSKGCQ

SEQ ID NO: 2760020 - protein, 13 aa, Entamoeba invadens
KCEGNRKPSDDGL

SEQ ID NO: 2760021 - protein, 6 aa, Entamoeba invadens
KCEGNV

SEQ ID NO: 2760022 - protein, 12 aa, Entamoeba invadens
KCEGTGEIDTEE

SEQ ID NO: 2760023 - protein, 9 aa, Entamoeba invadens
KCEIGTTSN

SEQ ID NO: 2760024 - protein, 7 aa, Entamoeba invadens
KCEKCDD

SEQ ID NO: 2760025 - protein, 9 aa, Entamoeba invadens
KCEKCSKNF

SEQ ID NO: 2760026 - protein, 6 aa, Entamoeba invadens
KCEKQE

SEQ ID NO: 2760027 - protein, 7 aa, Entamoeba invadens
KCEKVKS

SEQ ID NO: 2760028 - protein, 9 aa, Entamoeba invadens
KCEKYSQHG

SEQ ID NO: 2760029 - protein, 12 aa, Entamoeba invadens
KCENGYYKTNGK

SEQ ID NO: 2760030 - protein, 8 aa, Entamoeba invadens
KCENNNSC

SEQ ID NO: 2760031 - protein, 7 aa, Entamoeba invadens
KCENRGD

SEQ ID NO: 2760032 - protein, 4 aa, Entamoeba invadens
KCEP

SEQ ID NO: 2760033 - protein, 15 aa, Entamoeba invadens
KCEQCTKTNPGHCAP

SEQ ID NO: 2760034 - protein, 5 aa, Entamoeba invadens
KCEQI

SEQ ID NO: 2760035 - protein, 5 aa, Entamoeba invadens
KCERC

SEQ ID NO: 2760036 - protein, 7 aa, Entamoeba invadens
KCERCPE

SEQ ID NO: 2760037 - protein, 17 aa, Entamoeba invadens
KCERDTCKCTSTDSCSE

SEQ ID NO: 2760038 - protein, 10 aa, Entamoeba invadens
KCERGYYSSQ

SEQ ID NO: 2760039 - protein, 8 aa, Entamoeba invadens
KCESCNTK

SEQ ID NO: 2760040 - protein, 7 aa, Entamoeba invadens
KCESCTP

SEQ ID NO: 2760041 - protein, 7 aa, Entamoeba invadens
KCESCTS

SEQ ID NO: 2760042 - protein, 12 aa, Entamoeba invadens
KCETCQNGGNRS

SEQ ID NO: 2760043 - protein, 13 aa, Entamoeba invadens
KCETCQNGGNRSC

SEQ ID NO: 2760044 - protein, 6 aa, Entamoeba invadens
KCETEE

SEQ ID NO: 2760045 - protein, 16 aa, Entamoeba invadens
KCETNKCKNLKDENGK

SEQ ID NO: 2760046 - protein, 13 aa, Entamoeba invadens
KCETNNNNKCIEQ

SEQ ID NO: 2760047 - protein, 7 aa, Entamoeba invadens
KCETNSY

SEQ ID NO: 2760048 - protein, 9 aa, Entamoeba invadens
KCETPDEID

SEQ ID NO: 2760049 - protein, 14 aa, Entamoeba invadens
KCETPNADTPKISQ

SEQ ID NO: 2760050 - protein, 6 aa, Entamoeba invadens
KCETRN

SEQ ID NO: 2760051 - protein, 10 aa, Entamoeba invadens
KCETTDNAVK

SEQ ID NO: 2760052 - protein, 8 aa, Entamoeba invadens
KCETYSQH

SEQ ID NO: 2760053 - protein, 5 aa, Entamoeba invadens
KCEVD

SEQ ID NO: 2760054 - protein, 4 aa, Entamoeba invadens
KCGD

SEQ ID NO: 2760055 - protein, 14 aa, Entamoeba invadens
KCGDNKKVAPDGLS

SEQ ID NO: 2760056 - protein, 5 aa, Entamoeba invadens
KCGEC

SEQ ID NO: 2760057 - protein, 5 aa, Entamoeba invadens
KCGEE

SEQ ID NO: 2760058 - protein, 7 aa, Entamoeba invadens
KCGENGC

SEQ ID NO: 2760059 - protein, 10 aa, Entamoeba invadens
KCGEPEKRGQ

SEQ ID NO: 2760060 - protein, 7 aa, Entamoeba invadens
KCGGTAI

SEQ ID NO: 2760061 - protein, 12 aa, Entamoeba invadens
KCGGTGAHSSHD

SEQ ID NO: 2760062 - protein, 6 aa, Entamoeba invadens
KCGNEN

SEQ ID NO: 2760063 - protein, 5 aa, Entamoeba invadens
KCGNG

SEQ ID NO: 2760064 - protein, 20 aa, Entamoeba invadens
KCGNGILDEGESCDSGTNCN

SEQ ID NO: 2760065 - protein, 7 aa, Entamoeba invadens
KCGNGKI

SEQ ID NO: 2760066 - protein, 6 aa, Entamoeba invadens
KCGNGM

SEQ ID NO: 2760067 - protein, 8 aa, Entamoeba invadens
KCGNRQEK

SEQ ID NO: 2760068 - protein, 6 aa, Entamoeba invadens
KCGPCT

SEQ ID NO: 2760069 - protein, 6 aa, Entamoeba invadens
KCGRGK

SEQ ID NO: 2760070 - protein, 6 aa, Entamoeba invadens
KCGSDS

SEQ ID NO: 2760071 - protein, 18 aa, Entamoeba invadens
KCHPLSESNCTSYTITNT

SEQ ID NO: 2760072 - protein, 7 aa, Entamoeba invadens
KCHQSKF

SEQ ID NO: 2760073 - protein, 5 aa, Entamoeba invadens
KCINS

SEQ ID NO: 2760074 - protein, 13 aa, Entamoeba invadens
KCIPNNSTCVSNS

SEQ ID NO: 2760075 - protein, 7 aa, Entamoeba invadens
KCIPQNS

SEQ ID NO: 2760076 - protein, 5 aa, Entamoeba invadens
KCIQK

SEQ ID NO: 2760077 - protein, 15 aa, Entamoeba invadens
KCIQNNNNCQIGDEN

SEQ ID NO: 2760078 - protein, 25 aa, Entamoeba invadens
KCIRGSDKNCVEYEEGSTSACKTCQ

SEQ ID NO: 2760079 - protein, 13 aa, Entamoeba invadens
KCKECSNNGECQS

SEQ ID NO: 2760080 - protein, 9 aa, Entamoeba invadens
KCKEDKTTC

SEQ ID NO: 2760081 - protein, 10 aa, Entamoeba invadens
KCKENCTSCD

SEQ ID NO: 2760082 - protein, 12 aa, Entamoeba invadens
KCKEPSQYQKPC

SEQ ID NO: 2760083 - protein, 13 aa, Entamoeba invadens
KCKEPSQYQKPCT

SEQ ID NO: 2760084 - protein, 8 aa, Entamoeba invadens
KCKEYNPV

SEQ ID NO: 2760085 - protein, 7 aa, Entamoeba invadens
KCKGCSD

SEQ ID NO: 2760086 - protein, 8 aa, Entamoeba invadens
KCKNMKEG

SEQ ID NO: 2760087 - protein, 15 aa, Entamoeba invadens
KCKPKDNNCQKYSKA

SEQ ID NO: 2760088 - protein, 18 aa, Entamoeba invadens
KCKQCDSKCENCTSATDC

SEQ ID NO: 2760089 - protein, 16 aa, Entamoeba invadens
KCKSAENNKCNSCETD

SEQ ID NO: 2760090 - protein, 29 aa, Entamoeba invadens
KCKSANECTECTTDNLQPDKTCKKDCPEA

SEQ ID NO: 2760091 - protein, 29 aa, Entamoeba invadens
KCKSATECTECTTDNLQPDKTCKKDCPEA

SEQ ID NO: 2760092 - protein, 29 aa, Entamoeba invadens
KCKSATECTECTTDNLQPDKTCKKNCPEA

SEQ ID NO: 2760093 - protein, 14 aa, Entamoeba invadens
KCKTCATGCSTCSD

SEQ ID NO: 2760094 - protein, 14 aa, Entamoeba invadens
KCLSNSAKCDNQNG

SEQ ID NO: 2760095 - protein, 7 aa, Entamoeba invadens
KCLSSNE

SEQ ID NO: 2760096 - protein, 4 aa, Entamoeba invadens
KCNA

SEQ ID NO: 2760097 - protein, 6 aa, Entamoeba invadens
KCNDAD

SEQ ID NO: 2760098 - protein, 4 aa, Entamoeba invadens
KCNE

SEQ ID NO: 2760099 - protein, 5 aa, Entamoeba invadens
KCNEC

SEQ ID NO: 2760100 - protein, 6 aa, Entamoeba invadens
KCNECE

SEQ ID NO: 2760101 - protein, 7 aa, Entamoeba invadens
KCNECET

SEQ ID NO: 2760102 - protein, 9 aa, Entamoeba invadens
KCNETTGNA

SEQ ID NO: 2760103 - protein, 8 aa, Entamoeba invadens
KCNGDESC

SEQ ID NO: 2760104 - protein, 8 aa, Entamoeba invadens
KCNGDNVD

SEQ ID NO: 2760105 - protein, 9 aa, Entamoeba invadens
KCNGKDQCS

SEQ ID NO: 2760106 - protein, 9 aa, Entamoeba invadens
KCNGKEQCS

SEQ ID NO: 2760107 - protein, 10 aa, Entamoeba invadens
KCNHDNGCTS

SEQ ID NO: 2760108 - protein, 5 aa, Entamoeba invadens
KCNKC

SEQ ID NO: 2760109 - protein, 6 aa, Entamoeba invadens
KCNKCP

SEQ ID NO: 2760110 - protein, 9 aa, Entamoeba invadens
KCNKCSDIE

SEQ ID NO: 2760111 - protein, 4 aa, Entamoeba invadens
KCNN

SEQ ID NO: 2760112 - protein, 6 aa, Entamoeba invadens
KCNNDN

SEQ ID NO: 2760113 - protein, 7 aa, Entamoeba invadens
KCNPCSD

SEQ ID NO: 2760114 - protein, 12 aa, Entamoeba invadens
KCNRMEKGKAMD

SEQ ID NO: 2760115 - protein, 4 aa, Entamoeba invadens
KCNS

SEQ ID NO: 2760116 - protein, 7 aa, Entamoeba invadens
KCNTKTN

SEQ ID NO: 2760117 - protein, 11 aa, Entamoeba invadens
KCNTQTGQCTA

SEQ ID NO: 2760118 - protein, 7 aa, Entamoeba invadens
KCPCSGD

SEQ ID NO: 2760119 - protein, 14 aa, Entamoeba invadens
KCPEGYMTDETNNK

SEQ ID NO: 2760120 - protein, 6 aa, Entamoeba invadens
KCPENC

SEQ ID NO: 2760121 - protein, 4 aa, Entamoeba invadens
KCPN

SEQ ID NO: 2760122 - protein, 11 aa, Entamoeba invadens
KCPRGCESCST

SEQ ID NO: 2760123 - protein, 4 aa, Entamoeba invadens
KCPS

SEQ ID NO: 2760124 - protein, 21 aa, Entamoeba invadens
KCPSKSSVNPQRTRCNESCGS

SEQ ID NO: 2760125 - protein, 29 aa, Entamoeba invadens
KCPTSAYACTKDDECDPSNSTIDSEDGKV

SEQ ID NO: 2760126 - protein, 7 aa, Entamoeba invadens
KCQDASK

SEQ ID NO: 2760127 - protein, 4 aa, Entamoeba invadens
KCQH

SEQ ID NO: 2760128 - protein, 22 aa, Entamoeba invadens
KCQSCPSGKYYNPNSKSCQSND

SEQ ID NO: 2760129 - protein, 13 aa, Entamoeba invadens
KCQSTSKCQRPSQ

SEQ ID NO: 2760130 - protein, 12 aa, Entamoeba invadens
KCQTCKDNSTTC

SEQ ID NO: 2760131 - protein, 9 aa, Entamoeba invadens
KCRDHPEGM

SEQ ID NO: 2760132 - protein, 11 aa, Entamoeba invadens
KCRGGPPLRST

SEQ ID NO: 2760133 - protein, 12 aa, Entamoeba invadens
KCRGSGKVSESI

SEQ ID NO: 2760134 - protein, 10 aa, Entamoeba invadens
KCSADKYKTL

SEQ ID NO: 2760135 - protein, 14 aa, Entamoeba invadens
KCSDANTCTNCNDG

SEQ ID NO: 2760136 - protein, 13 aa, Entamoeba invadens
KCSDATKCTECSS

SEQ ID NO: 2760137 - protein, 6 aa, Entamoeba invadens
KCSDDI

SEQ ID NO: 2760138 - protein, 18 aa, Entamoeba invadens
KCSDDNCNECDDDTNTCQ

SEQ ID NO: 2760139 - protein, 16 aa, Entamoeba invadens
KCSDGYELSSDKLECD

SEQ ID NO: 2760140 - protein, 8 aa, Entamoeba invadens
KCSDSCST

SEQ ID NO: 2760141 - protein, 8 aa, Entamoeba invadens
KCSDSSEY

SEQ ID NO: 2760142 - protein, 19 aa, Entamoeba invadens
KCSEADGEKCTKCETGYTL

SEQ ID NO: 2760143 - protein, 11 aa, Entamoeba invadens
KCSECENGYYP

SEQ ID NO: 2760144 - protein, 7 aa, Entamoeba invadens
KCSEDTN

SEQ ID NO: 2760145 - protein, 5 aa, Entamoeba invadens
KCSEL

SEQ ID NO: 2760146 - protein, 10 aa, Entamoeba invadens
KCSEPTRCTS

SEQ ID NO: 2760147 - protein, 15 aa, Entamoeba invadens
KCSFEQQDCESLADS

SEQ ID NO: 2760148 - protein, 10 aa, Entamoeba invadens
KCSGCDDGYY

SEQ ID NO: 2760149 - protein, 12 aa, Entamoeba invadens
KCSGWNKPNELG

SEQ ID NO: 2760150 - protein, 4 aa, Entamoeba invadens
KCSK

SEQ ID NO: 2760151 - protein, 8 aa, Entamoeba invadens
KCSKCDAS

SEQ ID NO: 2760152 - protein, 9 aa, Entamoeba invadens
KCSKCQTTN

SEQ ID NO: 2760153 - protein, 7 aa, Entamoeba invadens
KCSKCSD

SEQ ID NO: 2760154 - protein, 5 aa, Entamoeba invadens
KCSLD

SEQ ID NO: 2760155 - protein, 5 aa, Entamoeba invadens
KCSND

SEQ ID NO: 2760156 - protein, 5 aa, Entamoeba invadens
KCSNG

SEQ ID NO: 2760157 - protein, 9 aa, Entamoeba invadens
KCSNGDTCT

SEQ ID NO: 2760158 - protein, 11 aa, Entamoeba invadens
KCSNKETCQAC

SEQ ID NO: 2760159 - protein, 11 aa, Entamoeba invadens
KCSNKNPPAYN

SEQ ID NO: 2760160 - protein, 9 aa, Entamoeba invadens
KCSNSTSLI

SEQ ID NO: 2760161 - protein, 8 aa, Entamoeba invadens
KCSPCDSN

SEQ ID NO: 2760162 - protein, 10 aa, Entamoeba invadens
KCSPDSTRKC

SEQ ID NO: 2760163 - protein, 6 aa, Entamoeba invadens
KCSPFT

SEQ ID NO: 2760164 - protein, 5 aa, Entamoeba invadens
KCSPH

SEQ ID NO: 2760165 - protein, 6 aa, Entamoeba invadens
KCSQCD

SEQ ID NO: 2760166 - protein, 25 aa, Entamoeba invadens
KCSQGKEKCDKCESPKLLGKDSTCV

SEQ ID NO: 2760167 - protein, 6 aa, Entamoeba invadens
KCSQSE

SEQ ID NO: 2760168 - protein, 4 aa, Entamoeba invadens
KCSS

SEQ ID NO: 2760169 - protein, 11 aa, Entamoeba invadens
KCSSAKGNKCD

SEQ ID NO: 2760170 - protein, 5 aa, Entamoeba invadens
KCSSC

SEQ ID NO: 2760171 - protein, 6 aa, Entamoeba invadens
KCSSGC

SEQ ID NO: 2760172 - protein, 6 aa, Entamoeba invadens
KCSSNC

SEQ ID NO: 2760173 - protein, 13 aa, Entamoeba invadens
KCSSSCSTCNQEG

SEQ ID NO: 2760174 - protein, 6 aa, Entamoeba invadens
KCSSSS

SEQ ID NO: 2760175 - protein, 10 aa, Entamoeba invadens
KCSSSSTEIV

SEQ ID NO: 2760176 - protein, 7 aa, Entamoeba invadens
KCSSTFE

SEQ ID NO: 2760177 - protein, 8 aa, Entamoeba invadens
KCSSTGAC

SEQ ID NO: 2760178 - protein, 5 aa, Entamoeba invadens
KCSTA

SEQ ID NO: 2760179 - protein, 14 aa, Entamoeba invadens
KCSTCGTSKVARSK

SEQ ID NO: 2760180 - protein, 11 aa, Entamoeba invadens
KCSTCSSTSDH

SEQ ID NO: 2760181 - protein, 7 aa, Entamoeba invadens
KCSTGCK

SEQ ID NO: 2760182 - protein, 6 aa, Entamoeba invadens
KCSTNE

SEQ ID NO: 2760183 - protein, 12 aa, Entamoeba invadens
KCSTTDEKCTEC

SEQ ID NO: 2760184 - protein, 10 aa, Entamoeba invadens
KCSTTKSSDC

SEQ ID NO: 2760185 - protein, 5 aa, Entamoeba invadens
KCSYN

SEQ ID NO: 2760186 - protein, 7 aa, Entamoeba invadens
KCTATTD

SEQ ID NO: 2760187 - protein, 13 aa, Entamoeba invadens
KCTDASSFNPPNF

SEQ ID NO: 2760188 - protein, 22 aa, Entamoeba invadens
KCTDCSRENKGCLKADEKCETC

SEQ ID NO: 2760189 - protein, 8 aa, Entamoeba invadens
KCTECGDG

SEQ ID NO: 2760190 - protein, 11 aa, Entamoeba invadens
KCTECQSDGCY

SEQ ID NO: 2760191 - protein, 8 aa, Entamoeba invadens
KCTECSDE

SEQ ID NO: 2760192 - protein, 8 aa, Entamoeba invadens
KCTEKCKD

SEQ ID NO: 2760193 - protein, 12 aa, Entamoeba invadens
KCTGIDPNQGTA

SEQ ID NO: 2760194 - protein, 9 aa, Entamoeba invadens
KCTGNAEKC

SEQ ID NO: 2760195 - protein, 7 aa, Entamoeba invadens
KCTKCSA

SEQ ID NO: 2760196 - protein, 7 aa, Entamoeba invadens
KCTKCSQ

SEQ ID NO: 2760197 - protein, 22 aa, Entamoeba invadens
KCTKCTNGCSACTDTNTCTGCT

SEQ ID NO: 2760198 - protein, 9 aa, Entamoeba invadens
KCTKDGCSQ

SEQ ID NO: 2760199 - protein, 10 aa, Entamoeba invadens
KCTKPQNDCK

SEQ ID NO: 2760200 - protein, 12 aa, Entamoeba invadens
KCTKTKDSKCSS

SEQ ID NO: 2760201 - protein, 7 aa, Entamoeba invadens
KCTNCKD

SEQ ID NO: 2760202 - protein, 8 aa, Entamoeba invadens
KCTNCKDN

SEQ ID NO: 2760203 - protein, 5 aa, Entamoeba invadens
KCTND

SEQ ID NO: 2760204 - protein, 11 aa, Entamoeba invadens
KCTNDKDCSEC

SEQ ID NO: 2760205 - protein, 8 aa, Entamoeba invadens
KCTNGSVN

SEQ ID NO: 2760206 - protein, 8 aa, Entamoeba invadens
KCTNTDTF

SEQ ID NO: 2760207 - protein, 4 aa, Entamoeba invadens
KCTP

SEQ ID NO: 2760208 - protein, 13 aa, Entamoeba invadens
KCTPCRAGTYPSG

SEQ ID NO: 2760209 - protein, 7 aa, Entamoeba invadens
KCTQCPA

SEQ ID NO: 2760210 - protein, 4 aa, Entamoeba invadens
KCTS

SEQ ID NO: 2760211 - protein, 5 aa, Entamoeba invadens
KCTSC

SEQ ID NO: 2760212 - protein, 6 aa, Entamoeba invadens
KCTSCD

SEQ ID NO: 2760213 - protein, 6 aa, Entamoeba invadens
KCTSCN

SEQ ID NO: 2760214 - protein, 7 aa, Entamoeba invadens
KCTSCNS

SEQ ID NO: 2760215 - protein, 6 aa, Entamoeba invadens
KCTSCQ

SEQ ID NO: 2760216 - protein, 7 aa, Entamoeba invadens
KCTSCTS

SEQ ID NO: 2760217 - protein, 13 aa, Entamoeba invadens
KCTSGKPVDTPIK

SEQ ID NO: 2760218 - protein, 5 aa, Entamoeba invadens
KCTSR

SEQ ID NO: 2760219 - protein, 7 aa, Entamoeba invadens
KCTTCES

SEQ ID NO: 2760220 - protein, 7 aa, Entamoeba invadens
KCTTDSY

SEQ ID NO: 2760221 - protein, 10 aa, Entamoeba invadens
KCTTSDSCEE

SEQ ID NO: 2760222 - protein, 6 aa, Entamoeba invadens
KCTTSN

SEQ ID NO: 2760223 - protein, 8 aa, Entamoeba invadens
KCTTTQER

SEQ ID NO: 2760224 - protein, 10 aa, Entamoeba invadens
KCVKDKCPDN

SEQ ID NO: 2760225 - protein, 10 aa, Entamoeba invadens
KCVPKESQNC

SEQ ID NO: 2760226 - protein, 19 aa, Entamoeba invadens
KCVSKCKENEVYNTQTDKC

SEQ ID NO: 2760227 - protein, 13 aa, Entamoeba invadens
KCVSKSEGDAIVT

SEQ ID NO: 2760228 - protein, 8 aa, Entamoeba invadens
KCVSNSKI

SEQ ID NO: 2760229 - protein, 8 aa, Entamoeba invadens
KCVSPSDH

SEQ ID NO: 2760230 - protein, 7 aa, Entamoeba invadens
KCVSSNC

SEQ ID NO: 2760231 - protein, 10 aa, Entamoeba invadens
KCVSTSKREC

SEQ ID NO: 2760232 - protein, 6 aa, Entamoeba invadens
KCVTDT

SEQ ID NO: 2760233 - protein, 7 aa, Entamoeba invadens
KCWDDEQ

SEQ ID NO: 2760234 - protein, 12 aa, Entamoeba invadens
KCYGQNDNVSPY

SEQ ID NO: 2760235 - protein, 7 aa, Entamoeba invadens
KCYNTNQ

SEQ ID NO: 2760236 - protein, 7 aa, Entamoeba invadens
KCYPKAT

SEQ ID NO: 2760237 - protein, 6 aa, Entamoeba invadens
KCYSSA

SEQ ID NO: 2760238 - protein, 8 aa, Entamoeba invadens
KDAADTYS

SEQ ID NO: 2760239 - protein, 8 aa, Entamoeba invadens
KDAAEAKN

SEQ ID NO: 2760240 - protein, 8 aa, Entamoeba invadens
KDAATGKD

SEQ ID NO: 2760241 - protein, 7 aa, Entamoeba invadens
KDAATKK

SEQ ID NO: 2760242 - protein, 13 aa, Entamoeba invadens
KDADYRKSHQFSN

SEQ ID NO: 2760243 - protein, 4 aa, Entamoeba invadens
KDAE

SEQ ID NO: 2760244 - protein, 5 aa, Entamoeba invadens
KDAEK

SEQ ID NO: 2760245 - protein, 57 aa, Entamoeba invadens
KDAKSSSNKEHSGSTNTHTKDKSISESTEKKTETTTNTATQDESMEASMSSRAGAED

SEQ ID NO: 2760246 - protein, 12 aa, Entamoeba invadens
KDASPNCSECST

SEQ ID NO: 2760247 - protein, 22 aa, Entamoeba invadens
KDATGTVQYTTTQIKKGDGDDI

SEQ ID NO: 2760248 - protein, 7 aa, Entamoeba invadens
KDATLEP

SEQ ID NO: 2760249 - protein, 8 aa, Entamoeba invadens
KDAYNGTY

SEQ ID NO: 2760250 - protein, 8 aa, Entamoeba invadens
KDCEPTKK

SEQ ID NO: 2760251 - protein, 8 aa, Entamoeba invadens
KDCGGGVK

SEQ ID NO: 2760252 - protein, 8 aa, Entamoeba invadens
KDCNSASD

SEQ ID NO: 2760253 - protein, 12 aa, Entamoeba invadens
KDCQNNTQNSTK

SEQ ID NO: 2760254 - protein, 6 aa, Entamoeba invadens
KDCRNN

SEQ ID NO: 2760255 - protein, 7 aa, Entamoeba invadens
KDCRSGD

SEQ ID NO: 2760256 - protein, 13 aa, Entamoeba invadens
KDCSDGATCKCTT

SEQ ID NO: 2760257 - protein, 11 aa, Entamoeba invadens
KDCSSCAEGFS

SEQ ID NO: 2760258 - protein, 14 aa, Entamoeba invadens
KDCTENYDNDGACT

SEQ ID NO: 2760259 - protein, 7 aa, Entamoeba invadens
KDCTSDL

SEQ ID NO: 2760260 - protein, 5 aa, Entamoeba invadens
KDDAK

SEQ ID NO: 2760261 - protein, 14 aa, Entamoeba invadens
KDDDALLINPEDNN

SEQ ID NO: 2760262 - protein, 5 aa, Entamoeba invadens
KDDDE

SEQ ID NO: 2760263 - protein, 9 aa, Entamoeba invadens
KDDDGTVYT

SEQ ID NO: 2760264 - protein, 9 aa, Entamoeba invadens
KDDDSTKLT

SEQ ID NO: 2760265 - protein, 8 aa, Entamoeba invadens
KDDEFTTE

SEQ ID NO: 2760266 - protein, 5 aa, Entamoeba invadens
KDDEI

SEQ ID NO: 2760267 - protein, 7 aa, Entamoeba invadens
KDDEMTK

SEQ ID NO: 2760268 - protein, 10 aa, Entamoeba invadens
KDDETPTEDD

SEQ ID NO: 2760269 - protein, 8 aa, Entamoeba invadens
KDDGGQLS

SEQ ID NO: 2760270 - protein, 11 aa, Entamoeba invadens
KDDGKTQCTKC

SEQ ID NO: 2760271 - protein, 6 aa, Entamoeba invadens
KDDKDF

SEQ ID NO: 2760272 - protein, 7 aa, Entamoeba invadens
KDDKHTE

SEQ ID NO: 2760273 - protein, 6 aa, Entamoeba invadens
KDDKWL

SEQ ID NO: 2760274 - protein, 11 aa, Entamoeba invadens
KDDNGKSCKKQ

SEQ ID NO: 2760275 - protein, 5 aa, Entamoeba invadens
KDDNV

SEQ ID NO: 2760276 - protein, 11 aa, Entamoeba invadens
KDDPDDEEGNT

SEQ ID NO: 2760277 - protein, 7 aa, Entamoeba invadens
KDDPGRY

SEQ ID NO: 2760278 - protein, 9 aa, Entamoeba invadens
KDDSQNLMK

SEQ ID NO: 2760279 - protein, 9 aa, Entamoeba invadens
KDDSSGDVP

SEQ ID NO: 2760280 - protein, 13 aa, Entamoeba invadens
KDDSSGEIPPSPQ

SEQ ID NO: 2760281 - protein, 16 aa, Entamoeba invadens
KDDSSTNNPGDSPNLY

SEQ ID NO: 2760282 - protein, 6 aa, Entamoeba invadens
KDDYSL

SEQ ID NO: 2760283 - protein, 14 aa, Entamoeba invadens
KDEAENQTNLAKSD

SEQ ID NO: 2760284 - protein, 5 aa, Entamoeba invadens
KDEAQ

SEQ ID NO: 2760285 - protein, 4 aa, Entamoeba invadens
KDEE

SEQ ID NO: 2760286 - protein, 12 aa, Entamoeba invadens
KDEELVNKNVKK

SEQ ID NO: 2760287 - protein, 5 aa, Entamoeba invadens
KDEES

SEQ ID NO: 2760288 - protein, 6 aa, Entamoeba invadens
KDEESI

SEQ ID NO: 2760289 - protein, 5 aa, Entamoeba invadens
KDEET

SEQ ID NO: 2760290 - protein, 6 aa, Entamoeba invadens
KDEGEV

SEQ ID NO: 2760291 - protein, 6 aa, Entamoeba invadens
KDEIDA

SEQ ID NO: 2760292 - protein, 5 aa, Entamoeba invadens
KDEKS

SEQ ID NO: 2760293 - protein, 8 aa, Entamoeba invadens
KDEKSYGN

SEQ ID NO: 2760294 - protein, 9 aa, Entamoeba invadens
KDEKSYGTK

SEQ ID NO: 2760295 - protein, 46 aa, Entamoeba invadens
KDEKTEKLEKVETKKPEKTRMSFSGTKGDPKVDSKSEQYRKSPRSM

SEQ ID NO: 2760296 - protein, 6 aa, Entamoeba invadens
KDEKTI

SEQ ID NO: 2760297 - protein, 6 aa, Entamoeba invadens
KDEKTL

SEQ ID NO: 2760298 - protein, 10 aa, Entamoeba invadens
KDEKTPIVGR

SEQ ID NO: 2760299 - protein, 5 aa, Entamoeba invadens
KDELD

SEQ ID NO: 2760300 - protein, 10 aa, Entamoeba invadens
KDELGTSSPL

SEQ ID NO: 2760301 - protein, 15 aa, Entamoeba invadens
KDENCTTQHTKGCTR

SEQ ID NO: 2760302 - protein, 8 aa, Entamoeba invadens
KDENIATK

SEQ ID NO: 2760303 - protein, 6 aa, Entamoeba invadens
KDEPIE

SEQ ID NO: 2760304 - protein, 4 aa, Entamoeba invadens
KDEQ

SEQ ID NO: 2760305 - protein, 7 aa, Entamoeba invadens
KDERELP

SEQ ID NO: 2760306 - protein, 10 aa, Entamoeba invadens
KDERKCKTCK

SEQ ID NO: 2760307 - protein, 7 aa, Entamoeba invadens
KDESCEI

SEQ ID NO: 2760308 - protein, 9 aa, Entamoeba invadens
KDESTEFSE

SEQ ID NO: 2760309 - protein, 7 aa, Entamoeba invadens
KDEVDRG

SEQ ID NO: 2760310 - protein, 9 aa, Entamoeba invadens
KDEVGKTNA

SEQ ID NO: 2760311 - protein, 6 aa, Entamoeba invadens
KDFDKT

SEQ ID NO: 2760312 - protein, 6 aa, Entamoeba invadens
KDFESW

SEQ ID NO: 2760313 - protein, 7 aa, Entamoeba invadens
KDFPSGM

SEQ ID NO: 2760314 - protein, 5 aa, Entamoeba invadens
KDFQK

SEQ ID NO: 2760315 - protein, 6 aa, Entamoeba invadens
KDFQQQ

SEQ ID NO: 2760316 - protein, 10 aa, Entamoeba invadens
KDFTKNNVGT

SEQ ID NO: 2760317 - protein, 9 aa, Entamoeba invadens
KDGAANTTV

SEQ ID NO: 2760318 - protein, 24 aa, Entamoeba invadens
KDGCAECEDGYKPDQDSCNKDNNT

SEQ ID NO: 2760319 - protein, 10 aa, Entamoeba invadens
KDGDPTYDEN

SEQ ID NO: 2760320 - protein, 7 aa, Entamoeba invadens
KDGEFNV

SEQ ID NO: 2760321 - protein, 7 aa, Entamoeba invadens
KDGEKYK

SEQ ID NO: 2760322 - protein, 6 aa, Entamoeba invadens
KDGEYT

SEQ ID NO: 2760323 - protein, 15 aa, Entamoeba invadens
KDGEYTDVDSTCKAC

SEQ ID NO: 2760324 - protein, 21 aa, Entamoeba invadens
KDGKNNPEKQQRHHSKSERSA

SEQ ID NO: 2760325 - protein, 8 aa, Entamoeba invadens
KDGNIECK

SEQ ID NO: 2760326 - protein, 8 aa, Entamoeba invadens
KDGNPTNT

SEQ ID NO: 2760327 - protein, 10 aa, Entamoeba invadens
KDGQAKITKS

SEQ ID NO: 2760328 - protein, 14 aa, Entamoeba invadens
KDGSETPSAKLGVK

SEQ ID NO: 2760329 - protein, 6 aa, Entamoeba invadens
KDGSYS

SEQ ID NO: 2760330 - protein, 5 aa, Entamoeba invadens
KDGTL

SEQ ID NO: 2760331 - protein, 6 aa, Entamoeba invadens
KDGTLC

SEQ ID NO: 2760332 - protein, 6 aa, Entamoeba invadens
KDGVAK

SEQ ID NO: 2760333 - protein, 36 aa, Entamoeba invadens
KDGVQEKNKEPVTQKKETNQVETEPKIENKQEITNE

SEQ ID NO: 2760334 - protein, 6 aa, Entamoeba invadens
KDGYYT

SEQ ID NO: 2760335 - protein, 7 aa, Entamoeba invadens
KDHEYIP

SEQ ID NO: 2760336 - protein, 9 aa, Entamoeba invadens
KDHKNNTNV

SEQ ID NO: 2760337 - protein, 8 aa, Entamoeba invadens
KDHKSDGQ

SEQ ID NO: 2760338 - protein, 7 aa, Entamoeba invadens
KDHSSPV

SEQ ID NO: 2760339 - protein, 7 aa, Entamoeba invadens
KDHTIDP

SEQ ID NO: 2760340 - protein, 10 aa, Entamoeba invadens
KDIADEEQKA

SEQ ID NO: 2760341 - protein, 13 aa, Entamoeba invadens
KDIDDDEKGINEF

SEQ ID NO: 2760342 - protein, 15 aa, Entamoeba invadens
KDIEDEKKKMKKSNK

SEQ ID NO: 2760343 - protein, 9 aa, Entamoeba invadens
KDIESGSYT

SEQ ID NO: 2760344 - protein, 8 aa, Entamoeba invadens
KDIGHTNS

SEQ ID NO: 2760345 - protein, 8 aa, Entamoeba invadens
KDIKDGKN

SEQ ID NO: 2760346 - protein, 9 aa, Entamoeba invadens
KDINKREEC

SEQ ID NO: 2760347 - protein, 6 aa, Entamoeba invadens
KDINNI

SEQ ID NO: 2760348 - protein, 6 aa, Entamoeba invadens
KDIPEG

SEQ ID NO: 2760349 - protein, 6 aa, Entamoeba invadens
KDIPEN

SEQ ID NO: 2760350 - protein, 12 aa, Entamoeba invadens
KDITENDVPSEE

SEQ ID NO: 2760351 - protein, 12 aa, Entamoeba invadens
KDKAQANEEDFD

SEQ ID NO: 2760352 - protein, 10 aa, Entamoeba invadens
KDKCNTQTGY

SEQ ID NO: 2760353 - protein, 7 aa, Entamoeba invadens
KDKCPEN

SEQ ID NO: 2760354 - protein, 21 aa, Entamoeba invadens
KDKCSKCNDGYKLNQTTGRCD

SEQ ID NO: 2760355 - protein, 11 aa, Entamoeba invadens
KDKCVSQRKLA

SEQ ID NO: 2760356 - protein, 15 aa, Entamoeba invadens
KDKDGNDVSTHAGVN

SEQ ID NO: 2760357 - protein, 13 aa, Entamoeba invadens
KDKEGDKKCKDTL

SEQ ID NO: 2760358 - protein, 16 aa, Entamoeba invadens
KDKEGEKEKREKNMGP

SEQ ID NO: 2760359 - protein, 16 aa, Entamoeba invadens
KDKENEVFMSKDDDLF

SEQ ID NO: 2760360 - protein, 8 aa, Entamoeba invadens
KDKESVAI

SEQ ID NO: 2760361 - protein, 7 aa, Entamoeba invadens
KDKFEDN

SEQ ID NO: 2760362 - protein, 9 aa, Entamoeba invadens
KDKGDANFS

SEQ ID NO: 2760363 - protein, 8 aa, Entamoeba invadens
KDKKAATE

SEQ ID NO: 2760364 - protein, 20 aa, Entamoeba invadens
KDKKGSAKCPSKTSKCQQYK

SEQ ID NO: 2760365 - protein, 9 aa, Entamoeba invadens
KDKKLGEGS

SEQ ID NO: 2760366 - protein, 9 aa, Entamoeba invadens
KDKKSDEVD

SEQ ID NO: 2760367 - protein, 9 aa, Entamoeba invadens
KDKKTESVD

SEQ ID NO: 2760368 - protein, 5 aa, Entamoeba invadens
KDKMS

SEQ ID NO: 2760369 - protein, 15 aa, Entamoeba invadens
KDKNGDEQCSISESS

SEQ ID NO: 2760370 - protein, 8 aa, Entamoeba invadens
KDKNNTLT

SEQ ID NO: 2760371 - protein, 6 aa, Entamoeba invadens
KDKRNE

SEQ ID NO: 2760372 - protein, 8 aa, Entamoeba invadens
KDKRNTSD

SEQ ID NO: 2760373 - protein, 16 aa, Entamoeba invadens
KDKRSSERSKNSETRV

SEQ ID NO: 2760374 - protein, 8 aa, Entamoeba invadens
KDKRSVTS

SEQ ID NO: 2760375 - protein, 4 aa, Entamoeba invadens
KDKT

SEQ ID NO: 2760376 - protein, 11 aa, Entamoeba invadens
KDKTGNHNTNE

SEQ ID NO: 2760377 - protein, 11 aa, Entamoeba invadens
KDKTINTKDSV

SEQ ID NO: 2760378 - protein, 10 aa, Entamoeba invadens
KDKTKCEANC

SEQ ID NO: 2760379 - protein, 17 aa, Entamoeba invadens
KDKTYPENACKNTPRKM

SEQ ID NO: 2760380 - protein, 7 aa, Entamoeba invadens
KDKYPRT

SEQ ID NO: 2760381 - protein, 7 aa, Entamoeba invadens
KDLKTSN

SEQ ID NO: 2760382 - protein, 7 aa, Entamoeba invadens
KDLKTST

SEQ ID NO: 2760383 - protein, 14 aa, Entamoeba invadens
KDLNDAKKAMKDNI

SEQ ID NO: 2760384 - protein, 7 aa, Entamoeba invadens
KDLPDDF

SEQ ID NO: 2760385 - protein, 7 aa, Entamoeba invadens
KDLPRTE

SEQ ID NO: 2760386 - protein, 8 aa, Entamoeba invadens
KDLSDNSH

SEQ ID NO: 2760387 - protein, 5 aa, Entamoeba invadens
KDLTK

SEQ ID NO: 2760388 - protein, 5 aa, Entamoeba invadens
KDMSE

SEQ ID NO: 2760389 - protein, 5 aa, Entamoeba invadens
KDNAN

SEQ ID NO: 2760390 - protein, 5 aa, Entamoeba invadens
KDNEH

SEQ ID NO: 2760391 - protein, 19 aa, Entamoeba invadens
KDNEKKEENGRCVNSNTTC

SEQ ID NO: 2760392 - protein, 7 aa, Entamoeba invadens
KDNGDNG

SEQ ID NO: 2760393 - protein, 8 aa, Entamoeba invadens
KDNGSGCN

SEQ ID NO: 2760394 - protein, 4 aa, Entamoeba invadens
KDNK

SEQ ID NO: 2760395 - protein, 8 aa, Entamoeba invadens
KDNKDAEN

SEQ ID NO: 2760396 - protein, 7 aa, Entamoeba invadens
KDNKHAE

SEQ ID NO: 2760397 - protein, 7 aa, Entamoeba invadens
KDNKHTK

SEQ ID NO: 2760398 - protein, 6 aa, Entamoeba invadens
KDNNTL

SEQ ID NO: 2760399 - protein, 10 aa, Entamoeba invadens
KDNQDERPTI

SEQ ID NO: 2760400 - protein, 5 aa, Entamoeba invadens
KDNQT

SEQ ID NO: 2760401 - protein, 7 aa, Entamoeba invadens
KDNQYGK

SEQ ID NO: 2760402 - protein, 7 aa, Entamoeba invadens
KDNSGDT

SEQ ID NO: 2760403 - protein, 10 aa, Entamoeba invadens
KDNSNNIEEE

SEQ ID NO: 2760404 - protein, 12 aa, Entamoeba invadens
KDNSNNREEECR

SEQ ID NO: 2760405 - protein, 5 aa, Entamoeba invadens
KDNST

SEQ ID NO: 2760406 - protein, 11 aa, Entamoeba invadens
KDNSTITVSDN

SEQ ID NO: 2760407 - protein, 6 aa, Entamoeba invadens
KDNSWT

SEQ ID NO: 2760408 - protein, 4 aa, Entamoeba invadens
KDNT

SEQ ID NO: 2760409 - protein, 11 aa, Entamoeba invadens
KDNTDQMKCGP

SEQ ID NO: 2760410 - protein, 6 aa, Entamoeba invadens
KDNTGI

SEQ ID NO: 2760411 - protein, 7 aa, Entamoeba invadens
KDNTKYQ

SEQ ID NO: 2760412 - protein, 16 aa, Entamoeba invadens
KDNTRFTHTSPSQISD

SEQ ID NO: 2760413 - protein, 8 aa, Entamoeba invadens
KDNTSEVS

SEQ ID NO: 2760414 - protein, 6 aa, Entamoeba invadens
KDNTSL

SEQ ID NO: 2760415 - protein, 7 aa, Entamoeba invadens
KDNTVNI

SEQ ID NO: 2760416 - protein, 4 aa, Entamoeba invadens
KDNW

SEQ ID NO: 2760417 - protein, 7 aa, Entamoeba invadens
KDPDEYS

SEQ ID NO: 2760418 - protein, 6 aa, Entamoeba invadens
KDPDPV

SEQ ID NO: 2760419 - protein, 30 aa, Entamoeba invadens
KDPESTTETSGDINLPSSTSDFPKEYNSYK

SEQ ID NO: 2760420 - protein, 9 aa, Entamoeba invadens
KDPETRPNF

SEQ ID NO: 2760421 - protein, 7 aa, Entamoeba invadens
KDPIPEK

SEQ ID NO: 2760422 - protein, 8 aa, Entamoeba invadens
KDPISDGK

SEQ ID NO: 2760423 - protein, 9 aa, Entamoeba invadens
KDPLGQERG

SEQ ID NO: 2760424 - protein, 6 aa, Entamoeba invadens
KDPPQI

SEQ ID NO: 2760425 - protein, 5 aa, Entamoeba invadens
KDPRL

SEQ ID NO: 2760426 - protein, 4 aa, Entamoeba invadens
KDPS

SEQ ID NO: 2760427 - protein, 5 aa, Entamoeba invadens
KDPYD

SEQ ID NO: 2760428 - protein, 7 aa, Entamoeba invadens
KDPYPEE

SEQ ID NO: 2760429 - protein, 7 aa, Entamoeba invadens
KDQASRG

SEQ ID NO: 2760430 - protein, 9 aa, Entamoeba invadens
KDQDKLSNC

SEQ ID NO: 2760431 - protein, 8 aa, Entamoeba invadens
KDQDNEAI

SEQ ID NO: 2760432 - protein, 7 aa, Entamoeba invadens
KDQETYS

SEQ ID NO: 2760433 - protein, 4 aa, Entamoeba invadens
KDQF

SEQ ID NO: 2760434 - protein, 4 aa, Entamoeba invadens
KDQK

SEQ ID NO: 2760435 - protein, 8 aa, Entamoeba invadens
KDQKSLQT

SEQ ID NO: 2760436 - protein, 7 aa, Entamoeba invadens
KDQSEDM

SEQ ID NO: 2760437 - protein, 9 aa, Entamoeba invadens
KDQSGCSKC

SEQ ID NO: 2760438 - protein, 11 aa, Entamoeba invadens
KDRATSSGQKL

SEQ ID NO: 2760439 - protein, 6 aa, Entamoeba invadens
KDRCPN

SEQ ID NO: 2760440 - protein, 6 aa, Entamoeba invadens
KDRDFS

SEQ ID NO: 2760441 - protein, 6 aa, Entamoeba invadens
KDRDPY

SEQ ID NO: 2760442 - protein, 5 aa, Entamoeba invadens
KDRMP

SEQ ID NO: 2760443 - protein, 10 aa, Entamoeba invadens
KDRSPQSRPL

SEQ ID NO: 2760444 - protein, 5 aa, Entamoeba invadens
KDRTG

SEQ ID NO: 2760445 - protein, 7 aa, Entamoeba invadens
KDSASKY

SEQ ID NO: 2760446 - protein, 6 aa, Entamoeba invadens
KDSAVT

SEQ ID NO: 2760447 - protein, 22 aa, Entamoeba invadens
KDSCSKCKDGLTLNKTSGKCNG

SEQ ID NO: 2760448 - protein, 7 aa, Entamoeba invadens
KDSESPF

SEQ ID NO: 2760449 - protein, 6 aa, Entamoeba invadens
KDSGED

SEQ ID NO: 2760450 - protein, 7 aa, Entamoeba invadens
KDSHNSN

SEQ ID NO: 2760451 - protein, 9 aa, Entamoeba invadens
KDSIEKCSE

SEQ ID NO: 2760452 - protein, 7 aa, Entamoeba invadens
KDSKSIF

SEQ ID NO: 2760453 - protein, 10 aa, Entamoeba invadens
KDSNCDGSTG

SEQ ID NO: 2760454 - protein, 13 aa, Entamoeba invadens
KDSPIGYSQEEVA

SEQ ID NO: 2760455 - protein, 7 aa, Entamoeba invadens
KDSPQKE

SEQ ID NO: 2760456 - protein, 7 aa, Entamoeba invadens
KDSQTTC

SEQ ID NO: 2760457 - protein, 6 aa, Entamoeba invadens
KDSSLD

SEQ ID NO: 2760458 - protein, 7 aa, Entamoeba invadens
KDSSTSV

SEQ ID NO: 2760459 - protein, 4 aa, Entamoeba invadens
KDST

SEQ ID NO: 2760460 - protein, 7 aa, Entamoeba invadens
KDSTKGI

SEQ ID NO: 2760461 - protein, 9 aa, Entamoeba invadens
KDSTKGSCS

SEQ ID NO: 2760462 - protein, 5 aa, Entamoeba invadens
KDSTL

SEQ ID NO: 2760463 - protein, 7 aa, Entamoeba invadens
KDSTNNC

SEQ ID NO: 2760464 - protein, 7 aa, Entamoeba invadens
KDSTQFK

SEQ ID NO: 2760465 - protein, 8 aa, Entamoeba invadens
KDSTTCEK

SEQ ID NO: 2760466 - protein, 10 aa, Entamoeba invadens
KDTCDTTANV

SEQ ID NO: 2760467 - protein, 55 aa, Entamoeba invadens
KDTDFDNETDAKSGMGSARQSVGIRSKSEFGEQTPEKRESDDKVSEKMGDDEQHD

SEQ ID NO: 2760468 - protein, 10 aa, Entamoeba invadens
KDTEATLNGS

SEQ ID NO: 2760469 - protein, 8 aa, Entamoeba invadens
KDTEKTIT

SEQ ID NO: 2760470 - protein, 4 aa, Entamoeba invadens
KDTG

SEQ ID NO: 2760471 - protein, 8 aa, Entamoeba invadens
KDTGTVDI

SEQ ID NO: 2760472 - protein, 5 aa, Entamoeba invadens
KDTHM

SEQ ID NO: 2760473 - protein, 7 aa, Entamoeba invadens
KDTIPRK

SEQ ID NO: 2760474 - protein, 6 aa, Entamoeba invadens
KDTLSN

SEQ ID NO: 2760475 - protein, 5 aa, Entamoeba invadens
KDTNI

SEQ ID NO: 2760476 - protein, 6 aa, Entamoeba invadens
KDTNTA

SEQ ID NO: 2760477 - protein, 4 aa, Entamoeba invadens
KDTP

SEQ ID NO: 2760478 - protein, 4 aa, Entamoeba invadens
KDTQ

SEQ ID NO: 2760479 - protein, 6 aa, Entamoeba invadens
KDTQQL

SEQ ID NO: 2760480 - protein, 4 aa, Entamoeba invadens
KDTR

SEQ ID NO: 2760481 - protein, 9 aa, Entamoeba invadens
KDTRKPAQL

SEQ ID NO: 2760482 - protein, 8 aa, Entamoeba invadens
KDTRLSKN

SEQ ID NO: 2760483 - protein, 7 aa, Entamoeba invadens
KDTRPQL

SEQ ID NO: 2760484 - protein, 23 aa, Entamoeba invadens
KDTSCKNCTDQNKGCVDADPDCA

SEQ ID NO: 2760485 - protein, 6 aa, Entamoeba invadens
KDTSEV

SEQ ID NO: 2760486 - protein, 12 aa, Entamoeba invadens
KDTSTNNKAGRV

SEQ ID NO: 2760487 - protein, 8 aa, Entamoeba invadens
KDTSTNVP

SEQ ID NO: 2760488 - protein, 4 aa, Entamoeba invadens
KDTT

SEQ ID NO: 2760489 - protein, 7 aa, Entamoeba invadens
KDTTDEK

SEQ ID NO: 2760490 - protein, 7 aa, Entamoeba invadens
KDTTEEL

SEQ ID NO: 2760491 - protein, 7 aa, Entamoeba invadens
KDTTKIL

SEQ ID NO: 2760492 - protein, 6 aa, Entamoeba invadens
KDTTLS

SEQ ID NO: 2760493 - protein, 7 aa, Entamoeba invadens
KDTTMTG

SEQ ID NO: 2760494 - protein, 8 aa, Entamoeba invadens
KDTTVDSN

SEQ ID NO: 2760495 - protein, 8 aa, Entamoeba invadens
KDTVEKTK

SEQ ID NO: 2760496 - protein, 7 aa, Entamoeba invadens
KDTVNAK

SEQ ID NO: 2760497 - protein, 7 aa, Entamoeba invadens
KDTVTSV

SEQ ID NO: 2760498 - protein, 10 aa, Entamoeba invadens
KDTYRQTASC

SEQ ID NO: 2760499 - protein, 6 aa, Entamoeba invadens
KDTYYD

SEQ ID NO: 2760500 - protein, 23 aa, Entamoeba invadens
KDVAESGEIKMESDDVKPDQEYD

SEQ ID NO: 2760501 - protein, 14 aa, Entamoeba invadens
KDVDGCKKKTGALS

SEQ ID NO: 2760502 - protein, 7 aa, Entamoeba invadens
KDVEIQD

SEQ ID NO: 2760503 - protein, 8 aa, Entamoeba invadens
KDVENECE

SEQ ID NO: 2760504 - protein, 16 aa, Entamoeba invadens
KDVKNKSDANNQLDTK

SEQ ID NO: 2760505 - protein, 8 aa, Entamoeba invadens
KDVKQRPK

SEQ ID NO: 2760506 - protein, 30 aa, Entamoeba invadens
KDVKTKSLKTQRRLKRKSPQVEGRRTNRSL

SEQ ID NO: 2760507 - protein, 12 aa, Entamoeba invadens
KDVNTKASEAYS

SEQ ID NO: 2760508 - protein, 7 aa, Entamoeba invadens
KDVQDTH

SEQ ID NO: 2760509 - protein, 9 aa, Entamoeba invadens
KDVRKTPLP

SEQ ID NO: 2760510 - protein, 8 aa, Entamoeba invadens
KDVSEDEF

SEQ ID NO: 2760511 - protein, 14 aa, Entamoeba invadens
KDVSGDEKIKSEFE

SEQ ID NO: 2760512 - protein, 5 aa, Entamoeba invadens
KDVTD

SEQ ID NO: 2760513 - protein, 14 aa, Entamoeba invadens
KDVVRNQNKAKAEY

SEQ ID NO: 2760514 - protein, 8 aa, Entamoeba invadens
KDYAEVKD

SEQ ID NO: 2760515 - protein, 14 aa, Entamoeba invadens
KDYGKKKSEGSLPQ

SEQ ID NO: 2760516 - protein, 4 aa, Entamoeba invadens
KDYN

SEQ ID NO: 2760517 - protein, 4 aa, Entamoeba invadens
KDYP

SEQ ID NO: 2760518 - protein, 9 aa, Entamoeba invadens
KDYSNEDFA

SEQ ID NO: 2760519 - protein, 8 aa, Entamoeba invadens
KDYSTEYN

SEQ ID NO: 2760520 - protein, 20 aa, Entamoeba invadens
KEAAGSDYKIPEEDEEFKPT

SEQ ID NO: 2760521 - protein, 11 aa, Entamoeba invadens
KEADEEKKQEL

SEQ ID NO: 2760522 - protein, 8 aa, Entamoeba invadens
KEADPPLP

SEQ ID NO: 2760523 - protein, 9 aa, Entamoeba invadens
KEAGQSKCT

SEQ ID NO: 2760524 - protein, 19 aa, Entamoeba invadens
KEAKTGKEVELEQQNEDIE

SEQ ID NO: 2760525 - protein, 8 aa, Entamoeba invadens
KEANPNEK

SEQ ID NO: 2760526 - protein, 14 aa, Entamoeba invadens
KEANSQKGKSLDEF

SEQ ID NO: 2760527 - protein, 5 aa, Entamoeba invadens
KEANV

SEQ ID NO: 2760528 - protein, 7 aa, Entamoeba invadens
KEAPVGG

SEQ ID NO: 2760529 - protein, 12 aa, Entamoeba invadens
KEAQAPPPPPVK

SEQ ID NO: 2760530 - protein, 8 aa, Entamoeba invadens
KEAQGDEN

SEQ ID NO: 2760531 - protein, 5 aa, Entamoeba invadens
KEAQN

SEQ ID NO: 2760532 - protein, 14 aa, Entamoeba invadens
KEAQVSEEATKEFS

SEQ ID NO: 2760533 - protein, 14 aa, Entamoeba invadens
KEASRRMNKTDGLK

SEQ ID NO: 2760534 - protein, 12 aa, Entamoeba invadens
KEATENEINKSY

SEQ ID NO: 2760535 - protein, 6 aa, Entamoeba invadens
KEATKI

SEQ ID NO: 2760536 - protein, 9 aa, Entamoeba invadens
KECDSSCET

SEQ ID NO: 2760537 - protein, 6 aa, Entamoeba invadens
KECGDI

SEQ ID NO: 2760538 - protein, 9 aa, Entamoeba invadens
KECKKEVTC

SEQ ID NO: 2760539 - protein, 9 aa, Entamoeba invadens
KECKQESDV

SEQ ID NO: 2760540 - protein, 7 aa, Entamoeba invadens
KECNQKD

SEQ ID NO: 2760541 - protein, 10 aa, Entamoeba invadens
KECPDSQQKR

SEQ ID NO: 2760542 - protein, 12 aa, Entamoeba invadens
KECRKCEGNVEG

SEQ ID NO: 2760543 - protein, 9 aa, Entamoeba invadens
KECTSNCSY

SEQ ID NO: 2760544 - protein, 4 aa, Entamoeba invadens
KEDA

SEQ ID NO: 2760545 - protein, 7 aa, Entamoeba invadens
KEDDKTC

SEQ ID NO: 2760546 - protein, 8 aa, Entamoeba invadens
KEDDKTCS

SEQ ID NO: 2760547 - protein, 7 aa, Entamoeba invadens
KEDEDID

SEQ ID NO: 2760548 - protein, 6 aa, Entamoeba invadens
KEDEKW

SEQ ID NO: 2760549 - protein, 6 aa, Entamoeba invadens
KEDERF

SEQ ID NO: 2760550 - protein, 6 aa, Entamoeba invadens
KEDFNY

SEQ ID NO: 2760551 - protein, 16 aa, Entamoeba invadens
KEDGEILKGDDDDESC

SEQ ID NO: 2760552 - protein, 7 aa, Entamoeba invadens
KEDGSCE

SEQ ID NO: 2760553 - protein, 6 aa, Entamoeba invadens
KEDKEE

SEQ ID NO: 2760554 - protein, 6 aa, Entamoeba invadens
KEDNQN

SEQ ID NO: 2760555 - protein, 6 aa, Entamoeba invadens
KEDPIP

SEQ ID NO: 2760556 - protein, 12 aa, Entamoeba invadens
KEDQKVTDDDIS

SEQ ID NO: 2760557 - protein, 5 aa, Entamoeba invadens
KEDRI

SEQ ID NO: 2760558 - protein, 7 aa, Entamoeba invadens
KEDRITI

SEQ ID NO: 2760559 - protein, 7 aa, Entamoeba invadens
KEDRNQF

SEQ ID NO: 2760560 - protein, 7 aa, Entamoeba invadens
KEDSPKT

SEQ ID NO: 2760561 - protein, 6 aa, Entamoeba invadens
KEDSRF

SEQ ID NO: 2760562 - protein, 8 aa, Entamoeba invadens
KEDTEKLH

SEQ ID NO: 2760563 - protein, 8 aa, Entamoeba invadens
KEDTRDSV

SEQ ID NO: 2760564 - protein, 6 aa, Entamoeba invadens
KEDYSD

SEQ ID NO: 2760565 - protein, 5 aa, Entamoeba invadens
KEEAI

SEQ ID NO: 2760566 - protein, 5 aa, Entamoeba invadens
KEECA

SEQ ID NO: 2760567 - protein, 10 aa, Entamoeba invadens
KEEDAYHKCS

SEQ ID NO: 2760568 - protein, 16 aa, Entamoeba invadens
KEEDESEKELKPNDKI

SEQ ID NO: 2760569 - protein, 7 aa, Entamoeba invadens
KEEDGTV

SEQ ID NO: 2760570 - protein, 8 aa, Entamoeba invadens
KEEDNSRI

SEQ ID NO: 2760571 - protein, 12 aa, Entamoeba invadens
KEEDVVNEVSNS

SEQ ID NO: 2760572 - protein, 13 aa, Entamoeba invadens
KEEEKQKLKNDCE

SEQ ID NO: 2760573 - protein, 9 aa, Entamoeba invadens
KEEEKTPER

SEQ ID NO: 2760574 - protein, 6 aa, Entamoeba invadens
KEEEKY

SEQ ID NO: 2760575 - protein, 7 aa, Entamoeba invadens
KEEENKE

SEQ ID NO: 2760576 - protein, 9 aa, Entamoeba invadens
KEEEQNVPT

SEQ ID NO: 2760577 - protein, 9 aa, Entamoeba invadens
KEEERPDFG

SEQ ID NO: 2760578 - protein, 6 aa, Entamoeba invadens
KEEETK

SEQ ID NO: 2760579 - protein, 14 aa, Entamoeba invadens
KEEEVKKPVVTVST

SEQ ID NO: 2760580 - protein, 6 aa, Entamoeba invadens
KEEFEG

SEQ ID NO: 2760581 - protein, 9 aa, Entamoeba invadens
KEEGHYSVS

SEQ ID NO: 2760582 - protein, 18 aa, Entamoeba invadens
KEEIEENQSDEKEENNPL

SEQ ID NO: 2760583 - protein, 8 aa, Entamoeba invadens
KEEIERRS

SEQ ID NO: 2760584 - protein, 5 aa, Entamoeba invadens
KEEIN

SEQ ID NO: 2760585 - protein, 7 aa, Entamoeba invadens
KEEINQQ

SEQ ID NO: 2760586 - protein, 36 aa, Entamoeba invadens
KEEKEVNASEDNTEQKVKKAIQKNKEKKEEKNAFTE

SEQ ID NO: 2760587 - protein, 10 aa, Entamoeba invadens
KEEKKIGEGT

SEQ ID NO: 2760588 - protein, 33 aa, Entamoeba invadens
KEEKQPDQDTANDDMTTESLKTGAESDDKVQSG

SEQ ID NO: 2760589 - protein, 9 aa, Entamoeba invadens
KEEKTIKKE

SEQ ID NO: 2760590 - protein, 12 aa, Entamoeba invadens
KEEKTKAIPKSD

SEQ ID NO: 2760591 - protein, 24 aa, Entamoeba invadens
KEEKVEIKKDTQPPPLPQKTKNFE

SEQ ID NO: 2760592 - protein, 4 aa, Entamoeba invadens
KEEL

SEQ ID NO: 2760593 - protein, 27 aa, Entamoeba invadens
KEELEQQELKARKEEQMKRAGIDGGSR

SEQ ID NO: 2760594 - protein, 5 aa, Entamoeba invadens
KEELM

SEQ ID NO: 2760595 - protein, 17 aa, Entamoeba invadens
KEEMKIESKSQNNSLNG

SEQ ID NO: 2760596 - protein, 9 aa, Entamoeba invadens
KEENADNSL

SEQ ID NO: 2760597 - protein, 10 aa, Entamoeba invadens
KEENGKTVEE

SEQ ID NO: 2760598 - protein, 9 aa, Entamoeba invadens
KEENNTKMG

SEQ ID NO: 2760599 - protein, 8 aa, Entamoeba invadens
KEENQGKE

SEQ ID NO: 2760600 - protein, 10 aa, Entamoeba invadens
KEENTDVPIA

SEQ ID NO: 2760601 - protein, 7 aa, Entamoeba invadens
KEENVEY

SEQ ID NO: 2760602 - protein, 17 aa, Entamoeba invadens
KEEPEQSVISDSPSIFE

SEQ ID NO: 2760603 - protein, 6 aa, Entamoeba invadens
KEEPSS

SEQ ID NO: 2760604 - protein, 5 aa, Entamoeba invadens
KEEQG

SEQ ID NO: 2760605 - protein, 8 aa, Entamoeba invadens
KEEQGKQL

SEQ ID NO: 2760606 - protein, 5 aa, Entamoeba invadens
KEEQH

SEQ ID NO: 2760607 - protein, 9 aa, Entamoeba invadens
KEEQKDALT

SEQ ID NO: 2760608 - protein, 9 aa, Entamoeba invadens
KEEQQEAIR

SEQ ID NO: 2760609 - protein, 4 aa, Entamoeba invadens
KEER

SEQ ID NO: 2760610 - protein, 43 aa, Entamoeba invadens
KEEREKAERAEADKHKREEEEKAEQDAKEAEKKKIQEEANRLA

SEQ ID NO: 2760611 - protein, 16 aa, Entamoeba invadens
KEERFKEIKEQSNAVL

SEQ ID NO: 2760612 - protein, 4 aa, Entamoeba invadens
KEES

SEQ ID NO: 2760613 - protein, 9 aa, Entamoeba invadens
KEESREDMG

SEQ ID NO: 2760614 - protein, 5 aa, Entamoeba invadens
KEETC

SEQ ID NO: 2760615 - protein, 11 aa, Entamoeba invadens
KEEVDMEKKRG

SEQ ID NO: 2760616 - protein, 5 aa, Entamoeba invadens
KEEVK

SEQ ID NO: 2760617 - protein, 22 aa, Entamoeba invadens
KEEVSAVKSANEVPKDKPVVQE

SEQ ID NO: 2760618 - protein, 8 aa, Entamoeba invadens
KEEYEPFG

SEQ ID NO: 2760619 - protein, 9 aa, Entamoeba invadens
KEEYTPKDI

SEQ ID NO: 2760620 - protein, 13 aa, Entamoeba invadens
KEFGDEKESQKVV

SEQ ID NO: 2760621 - protein, 6 aa, Entamoeba invadens
KEFNEQ

SEQ ID NO: 2760622 - protein, 7 aa, Entamoeba invadens
KEFPTQC

SEQ ID NO: 2760623 - protein, 4 aa, Entamoeba invadens
KEFS

SEQ ID NO: 2760624 - protein, 14 aa, Entamoeba invadens
KEFTTADGKDIYNC

SEQ ID NO: 2760625 - protein, 13 aa, Entamoeba invadens
KEGCETNQKIKEF

SEQ ID NO: 2760626 - protein, 7 aa, Entamoeba invadens
KEGCNDD

SEQ ID NO: 2760627 - protein, 7 aa, Entamoeba invadens
KEGCQAA

SEQ ID NO: 2760628 - protein, 13 aa, Entamoeba invadens
KEGDCKRTSLTTT

SEQ ID NO: 2760629 - protein, 13 aa, Entamoeba invadens
KEGDEESSSNDSV

SEQ ID NO: 2760630 - protein, 9 aa, Entamoeba invadens
KEGDEINEE

SEQ ID NO: 2760631 - protein, 6 aa, Entamoeba invadens
KEGDTW

SEQ ID NO: 2760632 - protein, 9 aa, Entamoeba invadens
KEGEEKKDT

SEQ ID NO: 2760633 - protein, 6 aa, Entamoeba invadens
KEGEEL

SEQ ID NO: 2760634 - protein, 5 aa, Entamoeba invadens
KEGEI

SEQ ID NO: 2760635 - protein, 10 aa, Entamoeba invadens
KEGETPTDDD

SEQ ID NO: 2760636 - protein, 8 aa, Entamoeba invadens
KEGETQKK

SEQ ID NO: 2760637 - protein, 8 aa, Entamoeba invadens
KEGEVSNS

SEQ ID NO: 2760638 - protein, 6 aa, Entamoeba invadens
KEGFTH

SEQ ID NO: 2760639 - protein, 4 aa, Entamoeba invadens
KEGG

SEQ ID NO: 2760640 - protein, 8 aa, Entamoeba invadens
KEGGAYSH

SEQ ID NO: 2760641 - protein, 5 aa, Entamoeba invadens
KEGGD

SEQ ID NO: 2760642 - protein, 6 aa, Entamoeba invadens
KEGGFE

SEQ ID NO: 2760643 - protein, 9 aa, Entamoeba invadens
KEGGVDQTT

SEQ ID NO: 2760644 - protein, 6 aa, Entamoeba invadens
KEGHCK

SEQ ID NO: 2760645 - protein, 6 aa, Entamoeba invadens
KEGKEF

SEQ ID NO: 2760646 - protein, 5 aa, Entamoeba invadens
KEGLD

SEQ ID NO: 2760647 - protein, 7 aa, Entamoeba invadens
KEGLPEY

SEQ ID NO: 2760648 - protein, 6 aa, Entamoeba invadens
KEGNDW

SEQ ID NO: 2760649 - protein, 10 aa, Entamoeba invadens
KEGNNTEEAM

SEQ ID NO: 2760650 - protein, 9 aa, Entamoeba invadens
KEGNQAAVT

SEQ ID NO: 2760651 - protein, 6 aa, Entamoeba invadens
KEGNVE

SEQ ID NO: 2760652 - protein, 20 aa, Entamoeba invadens
KEGPKAAASCTSGKSSAGRV

SEQ ID NO: 2760653 - protein, 7 aa, Entamoeba invadens
KEGPPLP

SEQ ID NO: 2760654 - protein, 15 aa, Entamoeba invadens
KEGQKYASCESATSE

SEQ ID NO: 2760655 - protein, 7 aa, Entamoeba invadens
KEGQNGV

SEQ ID NO: 2760656 - protein, 10 aa, Entamoeba invadens
KEGQRIESHR

SEQ ID NO: 2760657 - protein, 9 aa, Entamoeba invadens
KEGRESGME

SEQ ID NO: 2760658 - protein, 5 aa, Entamoeba invadens
KEGRK

SEQ ID NO: 2760659 - protein, 6 aa, Entamoeba invadens
KEGRRV

SEQ ID NO: 2760660 - protein, 9 aa, Entamoeba invadens
KEGRSKRNI

SEQ ID NO: 2760661 - protein, 5 aa, Entamoeba invadens
KEGRV

SEQ ID NO: 2760662 - protein, 6 aa, Entamoeba invadens
KEGRVF

SEQ ID NO: 2760663 - protein, 6 aa, Entamoeba invadens
KEGSHL

SEQ ID NO: 2760664 - protein, 71 aa, Entamoeba invadens
KEGSNENSKRKSLLPQSEQTTQSVDTKNLKEDTSLSDKSEKSKSSKTSKSSKKSNKSIEESKEKSKEVKEM

SEQ ID NO: 2760665 - protein, 10 aa, Entamoeba invadens
KEGSYDSKKS

SEQ ID NO: 2760666 - protein, 13 aa, Entamoeba invadens
KEGTQAAQSSDYA

SEQ ID NO: 2760667 - protein, 11 aa, Entamoeba invadens
KEGTQAARASD

SEQ ID NO: 2760668 - protein, 12 aa, Entamoeba invadens
KEGTQAARASDY

SEQ ID NO: 2760669 - protein, 8 aa, Entamoeba invadens
KEGTVTPD

SEQ ID NO: 2760670 - protein, 7 aa, Entamoeba invadens
KEGVDEM

SEQ ID NO: 2760671 - protein, 10 aa, Entamoeba invadens
KEGVKEETIK

SEQ ID NO: 2760672 - protein, 4 aa, Entamoeba invadens
KEGY

SEQ ID NO: 2760673 - protein, 9 aa, Entamoeba invadens
KEGYEVDNE

SEQ ID NO: 2760674 - protein, 7 aa, Entamoeba invadens
KEGYGGD

SEQ ID NO: 2760675 - protein, 10 aa, Entamoeba invadens
KEHCSTCSNV

SEQ ID NO: 2760676 - protein, 9 aa, Entamoeba invadens
KEHEERNLQ

SEQ ID NO: 2760677 - protein, 7 aa, Entamoeba invadens
KEHKHNN

SEQ ID NO: 2760678 - protein, 9 aa, Entamoeba invadens
KEHKKYARR

SEQ ID NO: 2760679 - protein, 5 aa, Entamoeba invadens
KEHTS

SEQ ID NO: 2760680 - protein, 44 aa, Entamoeba invadens
KEIAENKEKATKLEGENATLKSEKEDVGKQKEAVMTEKQTLEES

SEQ ID NO: 2760681 - protein, 7 aa, Entamoeba invadens
KEIANRN

SEQ ID NO: 2760682 - protein, 10 aa, Entamoeba invadens
KEIASNASMS

SEQ ID NO: 2760683 - protein, 5 aa, Entamoeba invadens
KEIDI

SEQ ID NO: 2760684 - protein, 7 aa, Entamoeba invadens
KEIEERK

SEQ ID NO: 2760685 - protein, 7 aa, Entamoeba invadens
KEIESKL

SEQ ID NO: 2760686 - protein, 7 aa, Entamoeba invadens
KEIESTE

SEQ ID NO: 2760687 - protein, 6 aa, Entamoeba invadens
KEIETQ

SEQ ID NO: 2760688 - protein, 6 aa, Entamoeba invadens
KEIGHG

SEQ ID NO: 2760689 - protein, 11 aa, Entamoeba invadens
KEIKADPIDQD

SEQ ID NO: 2760690 - protein, 8 aa, Entamoeba invadens
KEINNSKC

SEQ ID NO: 2760691 - protein, 7 aa, Entamoeba invadens
KEIPADG

SEQ ID NO: 2760692 - protein, 8 aa, Entamoeba invadens
KEIPETGI

SEQ ID NO: 2760693 - protein, 6 aa, Entamoeba invadens
KEIPTG

SEQ ID NO: 2760694 - protein, 6 aa, Entamoeba invadens
KEIQEQ

SEQ ID NO: 2760695 - protein, 18 aa, Entamoeba invadens
KEIQFGDENENIKIERES

SEQ ID NO: 2760696 - protein, 8 aa, Entamoeba invadens
KEIQKSTT

SEQ ID NO: 2760697 - protein, 4 aa, Entamoeba invadens
KEIT

SEQ ID NO: 2760698 - protein, 7 aa, Entamoeba invadens
KEITHSK

SEQ ID NO: 2760699 - protein, 7 aa, Entamoeba invadens
KEITKNC

SEQ ID NO: 2760700 - protein, 9 aa, Entamoeba invadens
KEKAENSRL

SEQ ID NO: 2760701 - protein, 10 aa, Entamoeba invadens
KEKAKEHNQT

SEQ ID NO: 2760702 - protein, 12 aa, Entamoeba invadens
KEKAKNNLTKEG

SEQ ID NO: 2760703 - protein, 9 aa, Entamoeba invadens
KEKAMKDKG

SEQ ID NO: 2760704 - protein, 7 aa, Entamoeba invadens
KEKAPLK

SEQ ID NO: 2760705 - protein, 9 aa, Entamoeba invadens
KEKCDFKNE

SEQ ID NO: 2760706 - protein, 8 aa, Entamoeba invadens
KEKCDKCK

SEQ ID NO: 2760707 - protein, 8 aa, Entamoeba invadens
KEKCNSCT

SEQ ID NO: 2760708 - protein, 8 aa, Entamoeba invadens
KEKCPTEK

SEQ ID NO: 2760709 - protein, 16 aa, Entamoeba invadens
KEKDEKSEDKEKTDTN

SEQ ID NO: 2760710 - protein, 7 aa, Entamoeba invadens
KEKDNKY

SEQ ID NO: 2760711 - protein, 7 aa, Entamoeba invadens
KEKDVKD

SEQ ID NO: 2760712 - protein, 10 aa, Entamoeba invadens
KEKEDKEGDL

SEQ ID NO: 2760713 - protein, 6 aa, Entamoeba invadens
KEKEEI

SEQ ID NO: 2760714 - protein, 6 aa, Entamoeba invadens
KEKEEV

SEQ ID NO: 2760715 - protein, 6 aa, Entamoeba invadens
KEKEIS

SEQ ID NO: 2760716 - protein, 8 aa, Entamoeba invadens
KEKERNYT

SEQ ID NO: 2760717 - protein, 5 aa, Entamoeba invadens
KEKET

SEQ ID NO: 2760718 - protein, 10 aa, Entamoeba invadens
KEKGGDETEV

SEQ ID NO: 2760719 - protein, 12 aa, Entamoeba invadens
KEKGNEKEALSI

SEQ ID NO: 2760720 - protein, 6 aa, Entamoeba invadens
KEKHTV

SEQ ID NO: 2760721 - protein, 8 aa, Entamoeba invadens
KEKITGTY

SEQ ID NO: 2760722 - protein, 4 aa, Entamoeba invadens
KEKK

SEQ ID NO: 2760723 - protein, 5 aa, Entamoeba invadens
KEKKD

SEQ ID NO: 2760724 - protein, 15 aa, Entamoeba invadens
KEKKIADDVQKSDVE

SEQ ID NO: 2760725 - protein, 10 aa, Entamoeba invadens
KEKKKIGEGG

SEQ ID NO: 2760726 - protein, 6 aa, Entamoeba invadens
KEKKKL

SEQ ID NO: 2760727 - protein, 27 aa, Entamoeba invadens
KEKKPKLKPKPKHQEQHKEKKEEQKVE

SEQ ID NO: 2760728 - protein, 9 aa, Entamoeba invadens
KEKKTSVAQ

SEQ ID NO: 2760729 - protein, 11 aa, Entamoeba invadens
KEKLAKKNGED

SEQ ID NO: 2760730 - protein, 7 aa, Entamoeba invadens
KEKLGKI

SEQ ID NO: 2760731 - protein, 7 aa, Entamoeba invadens
KEKNATF

SEQ ID NO: 2760732 - protein, 6 aa, Entamoeba invadens
KEKNQM

SEQ ID NO: 2760733 - protein, 9 aa, Entamoeba invadens
KEKNTKTTT

SEQ ID NO: 2760734 - protein, 5 aa, Entamoeba invadens
KEKNV

SEQ ID NO: 2760735 - protein, 10 aa, Entamoeba invadens
KEKPKPKDNI

SEQ ID NO: 2760736 - protein, 6 aa, Entamoeba invadens
KEKPNY

SEQ ID NO: 2760737 - protein, 8 aa, Entamoeba invadens
KEKPYGNM

SEQ ID NO: 2760738 - protein, 11 aa, Entamoeba invadens
KEKQDSSNDSQ

SEQ ID NO: 2760739 - protein, 10 aa, Entamoeba invadens
KEKQQDVQNT

SEQ ID NO: 2760740 - protein, 29 aa, Entamoeba invadens
KEKQQDVQNTIQDKSIRNDEIKSSDEKSN

SEQ ID NO: 2760741 - protein, 25 aa, Entamoeba invadens
KEKRINEKDEEIERAKTEQRQKEEL

SEQ ID NO: 2760742 - protein, 6 aa, Entamoeba invadens
KEKRRE

SEQ ID NO: 2760743 - protein, 4 aa, Entamoeba invadens
KEKS

SEQ ID NO: 2760744 - protein, 6 aa, Entamoeba invadens
KEKSHE

SEQ ID NO: 2760745 - protein, 10 aa, Entamoeba invadens
KEKSNGDGGI

SEQ ID NO: 2760746 - protein, 7 aa, Entamoeba invadens
KEKSNKA

SEQ ID NO: 2760747 - protein, 8 aa, Entamoeba invadens
KEKSNQCV

SEQ ID NO: 2760748 - protein, 5 aa, Entamoeba invadens
KEKST

SEQ ID NO: 2760749 - protein, 4 aa, Entamoeba invadens
KEKT

SEQ ID NO: 2760750 - protein, 20 aa, Entamoeba invadens
KEKTEKDTTKTTKRRSVGSL

SEQ ID NO: 2760751 - protein, 9 aa, Entamoeba invadens
KEKTEYGQP

SEQ ID NO: 2760752 - protein, 7 aa, Entamoeba invadens
KEKTITT

SEQ ID NO: 2760753 - protein, 7 aa, Entamoeba invadens
KEKTKPI

SEQ ID NO: 2760754 - protein, 7 aa, Entamoeba invadens
KEKTPEK

SEQ ID NO: 2760755 - protein, 8 aa, Entamoeba invadens
KEKTQEGC

SEQ ID NO: 2760756 - protein, 6 aa, Entamoeba invadens
KEKTSS

SEQ ID NO: 2760757 - protein, 11 aa, Entamoeba invadens
KEKTTKQTKNS

SEQ ID NO: 2760758 - protein, 7 aa, Entamoeba invadens
KEKTYAD

SEQ ID NO: 2760759 - protein, 10 aa, Entamoeba invadens
KEKVANEKPI

SEQ ID NO: 2760760 - protein, 6 aa, Entamoeba invadens
KEKVEA

SEQ ID NO: 2760761 - protein, 15 aa, Entamoeba invadens
KEKVEQSDNGRMYSG

SEQ ID NO: 2760762 - protein, 18 aa, Entamoeba invadens
KEKVNAKISDFGTSRDIS

SEQ ID NO: 2760763 - protein, 7 aa, Entamoeba invadens
KEKYKKA

SEQ ID NO: 2760764 - protein, 9 aa, Entamoeba invadens
KEKYKKEAD

SEQ ID NO: 2760765 - protein, 10 aa, Entamoeba invadens
KEKYKKEADV

SEQ ID NO: 2760766 - protein, 9 aa, Entamoeba invadens
KEKYKKGAD

SEQ ID NO: 2760767 - protein, 9 aa, Entamoeba invadens
KEKYKKPAD

SEQ ID NO: 2760768 - protein, 10 aa, Entamoeba invadens
KEKYKKPADI

SEQ ID NO: 2760769 - protein, 10 aa, Entamoeba invadens
KEKYKKSADV

SEQ ID NO: 2760770 - protein, 6 aa, Entamoeba invadens
KEKYKM

SEQ ID NO: 2760771 - protein, 10 aa, Entamoeba invadens
KEKYKTPSDV

SEQ ID NO: 2760772 - protein, 9 aa, Entamoeba invadens
KEKYKTSSD

SEQ ID NO: 2760773 - protein, 8 aa, Entamoeba invadens
KEKYRKEA

SEQ ID NO: 2760774 - protein, 8 aa, Entamoeba invadens
KEKYTESA

SEQ ID NO: 2760775 - protein, 9 aa, Entamoeba invadens
KEKYTESAD

SEQ ID NO: 2760776 - protein, 8 aa, Entamoeba invadens
KEKYTKAA

SEQ ID NO: 2760777 - protein, 16 aa, Entamoeba invadens
KELAEKAKRKEKNDTV

SEQ ID NO: 2760778 - protein, 7 aa, Entamoeba invadens
KELAKTT

SEQ ID NO: 2760779 - protein, 5 aa, Entamoeba invadens
KELDQ

SEQ ID NO: 2760780 - protein, 6 aa, Entamoeba invadens
KELEET

SEQ ID NO: 2760781 - protein, 9 aa, Entamoeba invadens
KELEKSEAN

SEQ ID NO: 2760782 - protein, 7 aa, Entamoeba invadens
KELEKTT

SEQ ID NO: 2760783 - protein, 13 aa, Entamoeba invadens
KELKKEKDESIRS

SEQ ID NO: 2760784 - protein, 13 aa, Entamoeba invadens
KELNEEKKIGEGS

SEQ ID NO: 2760785 - protein, 5 aa, Entamoeba invadens
KELNG

SEQ ID NO: 2760786 - protein, 18 aa, Entamoeba invadens
KELPDKAKTIKKRTPDTT

SEQ ID NO: 2760787 - protein, 13 aa, Entamoeba invadens
KELQQNKNLQTFK

SEQ ID NO: 2760788 - protein, 18 aa, Entamoeba invadens
KELRENLKQNAKNETKKK

SEQ ID NO: 2760789 - protein, 5 aa, Entamoeba invadens
KELSE

SEQ ID NO: 2760790 - protein, 13 aa, Entamoeba invadens
KELSKRKNTPHND

SEQ ID NO: 2760791 - protein, 7 aa, Entamoeba invadens
KEMESAD

SEQ ID NO: 2760792 - protein, 16 aa, Entamoeba invadens
KEMETREKENTELSAN

SEQ ID NO: 2760793 - protein, 9 aa, Entamoeba invadens
KEMGDGDTG

SEQ ID NO: 2760794 - protein, 7 aa, Entamoeba invadens
KEMPQLT

SEQ ID NO: 2760795 - protein, 5 aa, Entamoeba invadens
KEMRD

SEQ ID NO: 2760796 - protein, 11 aa, Entamoeba invadens
KEMSDSGMQEL

SEQ ID NO: 2760797 - protein, 13 aa, Entamoeba invadens
KENANSKLYTKTN

SEQ ID NO: 2760798 - protein, 6 aa, Entamoeba invadens
KENCNA

SEQ ID NO: 2760799 - protein, 15 aa, Entamoeba invadens
KENDKKELPEDKELK

SEQ ID NO: 2760800 - protein, 9 aa, Entamoeba invadens
KENDNNSRQ

SEQ ID NO: 2760801 - protein, 10 aa, Entamoeba invadens
KENDPENVTK

SEQ ID NO: 2760802 - protein, 8 aa, Entamoeba invadens
KENEDFNS

SEQ ID NO: 2760803 - protein, 13 aa, Entamoeba invadens
KENEEGVKEISKP

SEQ ID NO: 2760804 - protein, 7 aa, Entamoeba invadens
KENEEPE

SEQ ID NO: 2760805 - protein, 7 aa, Entamoeba invadens
KENEERV

SEQ ID NO: 2760806 - protein, 6 aa, Entamoeba invadens
KENEES

SEQ ID NO: 2760807 - protein, 5 aa, Entamoeba invadens
KENEF

SEQ ID NO: 2760808 - protein, 6 aa, Entamoeba invadens
KENEII

SEQ ID NO: 2760809 - protein, 6 aa, Entamoeba invadens
KENEIS

SEQ ID NO: 2760810 - protein, 9 aa, Entamoeba invadens
KENEKITDF

SEQ ID NO: 2760811 - protein, 7 aa, Entamoeba invadens
KENERPL

SEQ ID NO: 2760812 - protein, 7 aa, Entamoeba invadens
KENEVRK

SEQ ID NO: 2760813 - protein, 7 aa, Entamoeba invadens
KENGNQC

SEQ ID NO: 2760814 - protein, 7 aa, Entamoeba invadens
KENGTNV

SEQ ID NO: 2760815 - protein, 9 aa, Entamoeba invadens
KENGTVRET

SEQ ID NO: 2760816 - protein, 14 aa, Entamoeba invadens
KENHNRNKKDSSFC

SEQ ID NO: 2760817 - protein, 4 aa, Entamoeba invadens
KENI

SEQ ID NO: 2760818 - protein, 5 aa, Entamoeba invadens
KENIL

SEQ ID NO: 2760819 - protein, 7 aa, Entamoeba invadens
KENINAS

SEQ ID NO: 2760820 - protein, 6 aa, Entamoeba invadens
KENKGC

SEQ ID NO: 2760821 - protein, 5 aa, Entamoeba invadens
KENKN

SEQ ID NO: 2760822 - protein, 6 aa, Entamoeba invadens
KENNEI

SEQ ID NO: 2760823 - protein, 14 aa, Entamoeba invadens
KENNRIYDVDKLQH

SEQ ID NO: 2760824 - protein, 6 aa, Entamoeba invadens
KENPEY

SEQ ID NO: 2760825 - protein, 6 aa, Entamoeba invadens
KENPVN

SEQ ID NO: 2760826 - protein, 7 aa, Entamoeba invadens
KENPYQK

SEQ ID NO: 2760827 - protein, 6 aa, Entamoeba invadens
KENQRL

SEQ ID NO: 2760828 - protein, 5 aa, Entamoeba invadens
KENRE

SEQ ID NO: 2760829 - protein, 5 aa, Entamoeba invadens
KENRI

SEQ ID NO: 2760830 - protein, 5 aa, Entamoeba invadens
KENSI

SEQ ID NO: 2760831 - protein, 11 aa, Entamoeba invadens
KENSKGTATNY

SEQ ID NO: 2760832 - protein, 8 aa, Entamoeba invadens
KENSSYYS

SEQ ID NO: 2760833 - protein, 8 aa, Entamoeba invadens
KENTEEKH

SEQ ID NO: 2760834 - protein, 7 aa, Entamoeba invadens
KENTEKY

SEQ ID NO: 2760835 - protein, 19 aa, Entamoeba invadens
KENTSKYTFNENSYNEDTE

SEQ ID NO: 2760836 - protein, 7 aa, Entamoeba invadens
KENTTKE

SEQ ID NO: 2760837 - protein, 6 aa, Entamoeba invadens
KENTVD

SEQ ID NO: 2760838 - protein, 17 aa, Entamoeba invadens
KENTVEKSDTSSSDHSN

SEQ ID NO: 2760839 - protein, 19 aa, Entamoeba invadens
KENTYLTSSKNCRNCDTSC

SEQ ID NO: 2760840 - protein, 6 aa, Entamoeba invadens
KENVDP

SEQ ID NO: 2760841 - protein, 7 aa, Entamoeba invadens
KENVKRE

SEQ ID NO: 2760842 - protein, 5 aa, Entamoeba invadens
KENVL

SEQ ID NO: 2760843 - protein, 4 aa, Entamoeba invadens
KENY

SEQ ID NO: 2760844 - protein, 8 aa, Entamoeba invadens
KENYEEND

SEQ ID NO: 2760845 - protein, 8 aa, Entamoeba invadens
KEPDYATR

SEQ ID NO: 2760846 - protein, 6 aa, Entamoeba invadens
KEPGYE

SEQ ID NO: 2760847 - protein, 9 aa, Entamoeba invadens
KEPKGRPSF

SEQ ID NO: 2760848 - protein, 18 aa, Entamoeba invadens
KEPKSIEQDQSLSTYNPV

SEQ ID NO: 2760849 - protein, 4 aa, Entamoeba invadens
KEPN

SEQ ID NO: 2760850 - protein, 6 aa, Entamoeba invadens
KEPNDL

SEQ ID NO: 2760851 - protein, 5 aa, Entamoeba invadens
KEPPV

SEQ ID NO: 2760852 - protein, 5 aa, Entamoeba invadens
KEPQF

SEQ ID NO: 2760853 - protein, 7 aa, Entamoeba invadens
KEPQKTI

SEQ ID NO: 2760854 - protein, 6 aa, Entamoeba invadens
KEPQQT

SEQ ID NO: 2760855 - protein, 5 aa, Entamoeba invadens
KEPSA

SEQ ID NO: 2760856 - protein, 7 aa, Entamoeba invadens
KEPSVEA

SEQ ID NO: 2760857 - protein, 5 aa, Entamoeba invadens
KEPTN

SEQ ID NO: 2760858 - protein, 7 aa, Entamoeba invadens
KEPTSSV

SEQ ID NO: 2760859 - protein, 5 aa, Entamoeba invadens
KEPYG

SEQ ID NO: 2760860 - protein, 7 aa, Entamoeba invadens
KEPYPDI

SEQ ID NO: 2760861 - protein, 6 aa, Entamoeba invadens
KEQDGL

SEQ ID NO: 2760862 - protein, 6 aa, Entamoeba invadens
KEQDNA

SEQ ID NO: 2760863 - protein, 11 aa, Entamoeba invadens
KEQEQKKRIAA

SEQ ID NO: 2760864 - protein, 6 aa, Entamoeba invadens
KEQHHS

SEQ ID NO: 2760865 - protein, 6 aa, Entamoeba invadens
KEQIEN

SEQ ID NO: 2760866 - protein, 9 aa, Entamoeba invadens
KEQKSQKLS

SEQ ID NO: 2760867 - protein, 15 aa, Entamoeba invadens
KEQNAINNSQESSLD

SEQ ID NO: 2760868 - protein, 8 aa, Entamoeba invadens
KEQNDDVS

SEQ ID NO: 2760869 - protein, 8 aa, Entamoeba invadens
KEQNEEVD

SEQ ID NO: 2760870 - protein, 5 aa, Entamoeba invadens
KEQPI

SEQ ID NO: 2760871 - protein, 24 aa, Entamoeba invadens
KEQPNDDQRPLQSPLESPPNKEEV

SEQ ID NO: 2760872 - protein, 6 aa, Entamoeba invadens
KEQQPT

SEQ ID NO: 2760873 - protein, 13 aa, Entamoeba invadens
KEQRDDGWVVFGK

SEQ ID NO: 2760874 - protein, 9 aa, Entamoeba invadens
KEQRLEDKK

SEQ ID NO: 2760875 - protein, 14 aa, Entamoeba invadens
KEQRTKTANPSKLS

SEQ ID NO: 2760876 - protein, 7 aa, Entamoeba invadens
KEQSGVK

SEQ ID NO: 2760877 - protein, 9 aa, Entamoeba invadens
KEQSSNEEP

SEQ ID NO: 2760878 - protein, 8 aa, Entamoeba invadens
KEQTKAEF

SEQ ID NO: 2760879 - protein, 18 aa, Entamoeba invadens
KEQYNAKKEEKRKKEECL

SEQ ID NO: 2760880 - protein, 4 aa, Entamoeba invadens
KERA

SEQ ID NO: 2760881 - protein, 11 aa, Entamoeba invadens
KERASKRNELP

SEQ ID NO: 2760882 - protein, 14 aa, Entamoeba invadens
KERAWGDEDSGEYR

SEQ ID NO: 2760883 - protein, 7 aa, Entamoeba invadens
KERDRES

SEQ ID NO: 2760884 - protein, 6 aa, Entamoeba invadens
KERETI

SEQ ID NO: 2760885 - protein, 9 aa, Entamoeba invadens
KERKEAKKV

SEQ ID NO: 2760886 - protein, 7 aa, Entamoeba invadens
KERKKSG

SEQ ID NO: 2760887 - protein, 5 aa, Entamoeba invadens
KERKM

SEQ ID NO: 2760888 - protein, 7 aa, Entamoeba invadens
KERKRGG

SEQ ID NO: 2760889 - protein, 6 aa, Entamoeba invadens
KERLGL

SEQ ID NO: 2760890 - protein, 13 aa, Entamoeba invadens
KERMDEEKSWNDF

SEQ ID NO: 2760891 - protein, 5 aa, Entamoeba invadens
KERNF

SEQ ID NO: 2760892 - protein, 5 aa, Entamoeba invadens
KERQD

SEQ ID NO: 2760893 - protein, 10 aa, Entamoeba invadens
KERQQEDGSF

SEQ ID NO: 2760894 - protein, 5 aa, Entamoeba invadens
KERRM

SEQ ID NO: 2760895 - protein, 6 aa, Entamoeba invadens
KERRRL

SEQ ID NO: 2760896 - protein, 6 aa, Entamoeba invadens
KERRRM

SEQ ID NO: 2760897 - protein, 26 aa, Entamoeba invadens
KERSKVEMRKSTKGEDKEKKEEKTQM

SEQ ID NO: 2760898 - protein, 9 aa, Entamoeba invadens
KERSTTSWS

SEQ ID NO: 2760899 - protein, 6 aa, Entamoeba invadens
KERTID

SEQ ID NO: 2760900 - protein, 14 aa, Entamoeba invadens
KERVTSLLKRDGDE

SEQ ID NO: 2760901 - protein, 8 aa, Entamoeba invadens
KESADPAI

SEQ ID NO: 2760902 - protein, 9 aa, Entamoeba invadens
KESAKRDAT

SEQ ID NO: 2760903 - protein, 7 aa, Entamoeba invadens
KESASLF

SEQ ID NO: 2760904 - protein, 6 aa, Entamoeba invadens
KESCQN

SEQ ID NO: 2760905 - protein, 8 aa, Entamoeba invadens
KESCRPCG

SEQ ID NO: 2760906 - protein, 6 aa, Entamoeba invadens
KESDRI

SEQ ID NO: 2760907 - protein, 7 aa, Entamoeba invadens
KESEEKM

SEQ ID NO: 2760908 - protein, 7 aa, Entamoeba invadens
KESEEKY

SEQ ID NO: 2760909 - protein, 12 aa, Entamoeba invadens
KESEKDERGEEK

SEQ ID NO: 2760910 - protein, 10 aa, Entamoeba invadens
KESEMKGTLE

SEQ ID NO: 2760911 - protein, 5 aa, Entamoeba invadens
KESES

SEQ ID NO: 2760912 - protein, 19 aa, Entamoeba invadens
KESFEDEAPVVPPETEPKL

SEQ ID NO: 2760913 - protein, 20 aa, Entamoeba invadens
KESFEDETPVVPPETESELP

SEQ ID NO: 2760914 - protein, 6 aa, Entamoeba invadens
KESFSS

SEQ ID NO: 2760915 - protein, 7 aa, Entamoeba invadens
KESGETL

SEQ ID NO: 2760916 - protein, 5 aa, Entamoeba invadens
KESGH

SEQ ID NO: 2760917 - protein, 9 aa, Entamoeba invadens
KESGSSQAD

SEQ ID NO: 2760918 - protein, 5 aa, Entamoeba invadens
KESHE

SEQ ID NO: 2760919 - protein, 8 aa, Entamoeba invadens
KESHFDNT

SEQ ID NO: 2760920 - protein, 14 aa, Entamoeba invadens
KESIESSKLDEFSS

SEQ ID NO: 2760921 - protein, 17 aa, Entamoeba invadens
KESIGDDREPTDAKESV

SEQ ID NO: 2760922 - protein, 10 aa, Entamoeba invadens
KESKEKYSLR

SEQ ID NO: 2760923 - protein, 8 aa, Entamoeba invadens
KESKTDID

SEQ ID NO: 2760924 - protein, 4 aa, Entamoeba invadens
KESL

SEQ ID NO: 2760925 - protein, 11 aa, Entamoeba invadens
KESNDNEFEKE

SEQ ID NO: 2760926 - protein, 7 aa, Entamoeba invadens
KESNGNV

SEQ ID NO: 2760927 - protein, 9 aa, Entamoeba invadens
KESNSFREE

SEQ ID NO: 2760928 - protein, 9 aa, Entamoeba invadens
KESNSTSKE

SEQ ID NO: 2760929 - protein, 9 aa, Entamoeba invadens
KESPEEMNP

SEQ ID NO: 2760930 - protein, 6 aa, Entamoeba invadens
KESPIE

SEQ ID NO: 2760931 - protein, 10 aa, Entamoeba invadens
KESQKKSPSL

SEQ ID NO: 2760932 - protein, 4 aa, Entamoeba invadens
KESR

SEQ ID NO: 2760933 - protein, 5 aa, Entamoeba invadens
KESRA

SEQ ID NO: 2760934 - protein, 10 aa, Entamoeba invadens
KESSENSSVN

SEQ ID NO: 2760935 - protein, 9 aa, Entamoeba invadens
KESTDTQEN

SEQ ID NO: 2760936 - protein, 22 aa, Entamoeba invadens
KESTKKKKKCGVEQTSPSTLQG

SEQ ID NO: 2760937 - protein, 11 aa, Entamoeba invadens
KESTSDEKGKM

SEQ ID NO: 2760938 - protein, 7 aa, Entamoeba invadens
KESTTNI

SEQ ID NO: 2760939 - protein, 6 aa, Entamoeba invadens
KESVTV

SEQ ID NO: 2760940 - protein, 15 aa, Entamoeba invadens
KESYKKAGKEVPPNA

SEQ ID NO: 2760941 - protein, 14 aa, Entamoeba invadens
KESYNSCATRPFET

SEQ ID NO: 2760942 - protein, 7 aa, Entamoeba invadens
KESYTTI

SEQ ID NO: 2760943 - protein, 4 aa, Entamoeba invadens
KETE

SEQ ID NO: 2760944 - protein, 17 aa, Entamoeba invadens
KETEEDVPTQPFRSPAP

SEQ ID NO: 2760945 - protein, 6 aa, Entamoeba invadens
KETEGN

SEQ ID NO: 2760946 - protein, 8 aa, Entamoeba invadens
KETESTLR

SEQ ID NO: 2760947 - protein, 8 aa, Entamoeba invadens
KETGEKKV

SEQ ID NO: 2760948 - protein, 17 aa, Entamoeba invadens
KETGNKKVTLTRNTKEI

SEQ ID NO: 2760949 - protein, 9 aa, Entamoeba invadens
KETGQCEAC

SEQ ID NO: 2760950 - protein, 4 aa, Entamoeba invadens
KETH

SEQ ID NO: 2760951 - protein, 29 aa, Entamoeba invadens
KETKCTKCSETYGENCETCNSKRCSKCTK

SEQ ID NO: 2760952 - protein, 36 aa, Entamoeba invadens
KETKCTKCSETYGENCETCNSKRCSKCTKGVLDSNG

SEQ ID NO: 2760953 - protein, 13 aa, Entamoeba invadens
KETKGEIGYEGGA

SEQ ID NO: 2760954 - protein, 16 aa, Entamoeba invadens
KETKTRTTHDENEDID

SEQ ID NO: 2760955 - protein, 6 aa, Entamoeba invadens
KETKVY

SEQ ID NO: 2760956 - protein, 6 aa, Entamoeba invadens
KETLAD

SEQ ID NO: 2760957 - protein, 5 aa, Entamoeba invadens
KETLD

SEQ ID NO: 2760958 - protein, 4 aa, Entamoeba invadens
KETN

SEQ ID NO: 2760959 - protein, 13 aa, Entamoeba invadens
KETNHDDKNQKIE

SEQ ID NO: 2760960 - protein, 9 aa, Entamoeba invadens
KETNYEKES

SEQ ID NO: 2760961 - protein, 7 aa, Entamoeba invadens
KETPSRI

SEQ ID NO: 2760962 - protein, 12 aa, Entamoeba invadens
KETQGNNLSSEQ

SEQ ID NO: 2760963 - protein, 6 aa, Entamoeba invadens
KETSER

SEQ ID NO: 2760964 - protein, 6 aa, Entamoeba invadens
KETSVS

SEQ ID NO: 2760965 - protein, 6 aa, Entamoeba invadens
KETSYK

SEQ ID NO: 2760966 - protein, 19 aa, Entamoeba invadens
KETTCTKCSETYGENCKTC

SEQ ID NO: 2760967 - protein, 9 aa, Entamoeba invadens
KETTDGTQV

SEQ ID NO: 2760968 - protein, 5 aa, Entamoeba invadens
KETTI

SEQ ID NO: 2760969 - protein, 12 aa, Entamoeba invadens
KETTKTPTPTYN

SEQ ID NO: 2760970 - protein, 8 aa, Entamoeba invadens
KETTKTSN

SEQ ID NO: 2760971 - protein, 9 aa, Entamoeba invadens
KETTQSKCS

SEQ ID NO: 2760972 - protein, 6 aa, Entamoeba invadens
KETTSE

SEQ ID NO: 2760973 - protein, 4 aa, Entamoeba invadens
KETV

SEQ ID NO: 2760974 - protein, 6 aa, Entamoeba invadens
KETVEG

SEQ ID NO: 2760975 - protein, 11 aa, Entamoeba invadens
KETVPKNFKGE

SEQ ID NO: 2760976 - protein, 11 aa, Entamoeba invadens
KETYDTPCTDK

SEQ ID NO: 2760977 - protein, 5 aa, Entamoeba invadens
KETYR

SEQ ID NO: 2760978 - protein, 52 aa, Entamoeba invadens
KEVAEKPNEEPQEGRKSIESKGSIDLKKSASSEDTNVSSSASSLRIGGEGSD

SEQ ID NO: 2760979 - protein, 9 aa, Entamoeba invadens
KEVDSPKYF

SEQ ID NO: 2760980 - protein, 6 aa, Entamoeba invadens
KEVDSR

SEQ ID NO: 2760981 - protein, 12 aa, Entamoeba invadens
KEVEEGEIDEFT

SEQ ID NO: 2760982 - protein, 8 aa, Entamoeba invadens
KEVEKTTT

SEQ ID NO: 2760983 - protein, 12 aa, Entamoeba invadens
KEVGDPTETSDG

SEQ ID NO: 2760984 - protein, 7 aa, Entamoeba invadens
KEVGPQT

SEQ ID NO: 2760985 - protein, 14 aa, Entamoeba invadens
KEVGQTKSSLKEFE

SEQ ID NO: 2760986 - protein, 6 aa, Entamoeba invadens
KEVIGT

SEQ ID NO: 2760987 - protein, 4 aa, Entamoeba invadens
KEVK

SEQ ID NO: 2760988 - protein, 9 aa, Entamoeba invadens
KEVKESKCT

SEQ ID NO: 2760989 - protein, 6 aa, Entamoeba invadens
KEVNEN

SEQ ID NO: 2760990 - protein, 5 aa, Entamoeba invadens
KEVSG

SEQ ID NO: 2760991 - protein, 6 aa, Entamoeba invadens
KEVSNE

SEQ ID NO: 2760992 - protein, 7 aa, Entamoeba invadens
KEVSNEK

SEQ ID NO: 2760993 - protein, 8 aa, Entamoeba invadens
KEVSRQDM

SEQ ID NO: 2760994 - protein, 7 aa, Entamoeba invadens
KEVTVSG

SEQ ID NO: 2760995 - protein, 7 aa, Entamoeba invadens
KEWEETI

SEQ ID NO: 2760996 - protein, 5 aa, Entamoeba invadens
KEWQS

SEQ ID NO: 2760997 - protein, 11 aa, Entamoeba invadens
KEYDGSGPAIP

SEQ ID NO: 2760998 - protein, 6 aa, Entamoeba invadens
KEYDTD

SEQ ID NO: 2760999 - protein, 5 aa, Entamoeba invadens
KEYKT

SEQ ID NO: 2761000 - protein, 11 aa, Entamoeba invadens
KEYNKNYPDKH

SEQ ID NO: 2761001 - protein, 4 aa, Entamoeba invadens
KEYP

SEQ ID NO: 2761002 - protein, 8 aa, Entamoeba invadens
KEYPDESY

SEQ ID NO: 2761003 - protein, 13 aa, Entamoeba invadens
KEYSEGGTSPCTP

SEQ ID NO: 2761004 - protein, 7 aa, Entamoeba invadens
KEYTEDE

SEQ ID NO: 2761005 - protein, 15 aa, Entamoeba invadens
KEYTPSQSKKQNRVH

SEQ ID NO: 2761006 - protein, 6 aa, Entamoeba invadens
KEYTSV

SEQ ID NO: 2761007 - protein, 7 aa, Entamoeba invadens
KEYTTSN

SEQ ID NO: 2761008 - protein, 18 aa, Entamoeba invadens
KEYVNGKRAPYIKEETGI

SEQ ID NO: 2761009 - protein, 14 aa, Entamoeba invadens
KEYVQGKRAPFTST

SEQ ID NO: 2761010 - protein, 7 aa, Entamoeba invadens
KFANTNG

SEQ ID NO: 2761011 - protein, 7 aa, Entamoeba invadens
KFASNGK

SEQ ID NO: 2761012 - protein, 11 aa, Entamoeba invadens
KFDDNCKNSAI

SEQ ID NO: 2761013 - protein, 6 aa, Entamoeba invadens
KFDDNK

SEQ ID NO: 2761014 - protein, 6 aa, Entamoeba invadens
KFDENK

SEQ ID NO: 2761015 - protein, 6 aa, Entamoeba invadens
KFDETK

SEQ ID NO: 2761016 - protein, 10 aa, Entamoeba invadens
KFDTDKKVKC

SEQ ID NO: 2761017 - protein, 7 aa, Entamoeba invadens
KFEEAKS

SEQ ID NO: 2761018 - protein, 18 aa, Entamoeba invadens
KFEGENDEEAIPVDKESR

SEQ ID NO: 2761019 - protein, 18 aa, Entamoeba invadens
KFEGENDEETIPVDKESR

SEQ ID NO: 2761020 - protein, 13 aa, Entamoeba invadens
KFESYKKTNNYKN

SEQ ID NO: 2761021 - protein, 5 aa, Entamoeba invadens
KFETP

SEQ ID NO: 2761022 - protein, 4 aa, Entamoeba invadens
KFEV

SEQ ID NO: 2761023 - protein, 9 aa, Entamoeba invadens
KFGERSHAS

SEQ ID NO: 2761024 - protein, 18 aa, Entamoeba invadens
KFGGDSSAFSSSSLSSGS

SEQ ID NO: 2761025 - protein, 12 aa, Entamoeba invadens
KFGNYSKNTTRA

SEQ ID NO: 2761026 - protein, 11 aa, Entamoeba invadens
KFGQTKSCENA

SEQ ID NO: 2761027 - protein, 11 aa, Entamoeba invadens
KFGQTKSCGNA

SEQ ID NO: 2761028 - protein, 7 aa, Entamoeba invadens
KFKDKTK

SEQ ID NO: 2761029 - protein, 8 aa, Entamoeba invadens
KFKEPSPF

SEQ ID NO: 2761030 - protein, 7 aa, Entamoeba invadens
KFKGNKV

SEQ ID NO: 2761031 - protein, 6 aa, Entamoeba invadens
KFKQTG

SEQ ID NO: 2761032 - protein, 7 aa, Entamoeba invadens
KFKRGDD

SEQ ID NO: 2761033 - protein, 8 aa, Entamoeba invadens
KFKRQNKD

SEQ ID NO: 2761034 - protein, 7 aa, Entamoeba invadens
KFKTGAD

SEQ ID NO: 2761035 - protein, 4 aa, Entamoeba invadens
KFLS

SEQ ID NO: 2761036 - protein, 9 aa, Entamoeba invadens
KFNLKGNNN

SEQ ID NO: 2761037 - protein, 6 aa, Entamoeba invadens
KFNNYS

SEQ ID NO: 2761038 - protein, 10 aa, Entamoeba invadens
KFNRREETNT

SEQ ID NO: 2761039 - protein, 6 aa, Entamoeba invadens
KFNTNN

SEQ ID NO: 2761040 - protein, 10 aa, Entamoeba invadens
KFPDSIETGQ

SEQ ID NO: 2761041 - protein, 6 aa, Entamoeba invadens
KFPKTL

SEQ ID NO: 2761042 - protein, 5 aa, Entamoeba invadens
KFPSR

SEQ ID NO: 2761043 - protein, 6 aa, Entamoeba invadens
KFQGRT

SEQ ID NO: 2761044 - protein, 5 aa, Entamoeba invadens
KFQKQ

SEQ ID NO: 2761045 - protein, 7 aa, Entamoeba invadens
KFQSGDS

SEQ ID NO: 2761046 - protein, 21 aa, Entamoeba invadens
KFREDSSSKQEKENVINNDPL

SEQ ID NO: 2761047 - protein, 8 aa, Entamoeba invadens
KFRESGCP

SEQ ID NO: 2761048 - protein, 6 aa, Entamoeba invadens
KFRGDD

SEQ ID NO: 2761049 - protein, 6 aa, Entamoeba invadens
KFRGND

SEQ ID NO: 2761050 - protein, 7 aa, Entamoeba invadens
KFSELQD

SEQ ID NO: 2761051 - protein, 8 aa, Entamoeba invadens
KFSGEKPK

SEQ ID NO: 2761052 - protein, 6 aa, Entamoeba invadens
KFSIET

SEQ ID NO: 2761053 - protein, 7 aa, Entamoeba invadens
KFSKAPN

SEQ ID NO: 2761054 - protein, 4 aa, Entamoeba invadens
KFSN

SEQ ID NO: 2761055 - protein, 5 aa, Entamoeba invadens
KFSNT

SEQ ID NO: 2761056 - protein, 9 aa, Entamoeba invadens
KFSQSDQKD

SEQ ID NO: 2761057 - protein, 5 aa, Entamoeba invadens
KFTQE

SEQ ID NO: 2761058 - protein, 18 aa, Entamoeba invadens
KFTSNDCTGTAKDTKVKY

SEQ ID NO: 2761059 - protein, 10 aa, Entamoeba invadens
KFYPEQNTNQ

SEQ ID NO: 2761060 - protein, 7 aa, Entamoeba invadens
KGACTTD

SEQ ID NO: 2761061 - protein, 5 aa, Entamoeba invadens
KGADL

SEQ ID NO: 2761062 - protein, 7 aa, Entamoeba invadens
KGADSAI

SEQ ID NO: 2761063 - protein, 5 aa, Entamoeba invadens
KGAEF

SEQ ID NO: 2761064 - protein, 10 aa, Entamoeba invadens
KGAFTNTKKL

SEQ ID NO: 2761065 - protein, 20 aa, Entamoeba invadens
KGAKLTSTGACKCTDGTYLK

SEQ ID NO: 2761066 - protein, 12 aa, Entamoeba invadens
KGANLSGGQRQR

SEQ ID NO: 2761067 - protein, 13 aa, Entamoeba invadens
KGANLSGGQRQRI

SEQ ID NO: 2761068 - protein, 11 aa, Entamoeba invadens
KGANPNAENCM

SEQ ID NO: 2761069 - protein, 7 aa, Entamoeba invadens
KGATQVE

SEQ ID NO: 2761070 - protein, 13 aa, Entamoeba invadens
KGAYDKADFSDDG

SEQ ID NO: 2761071 - protein, 10 aa, Entamoeba invadens
KGCEPTCGSC

SEQ ID NO: 2761072 - protein, 5 aa, Entamoeba invadens
KGCER

SEQ ID NO: 2761073 - protein, 17 aa, Entamoeba invadens
KGCGTNQELDTNGNCCP

SEQ ID NO: 2761074 - protein, 5 aa, Entamoeba invadens
KGCQR

SEQ ID NO: 2761075 - protein, 8 aa, Entamoeba invadens
KGCRPNTI

SEQ ID NO: 2761076 - protein, 22 aa, Entamoeba invadens
KGCSRCDSTCSTCSGGSSNQCT

SEQ ID NO: 2761077 - protein, 4 aa, Entamoeba invadens
KGCT

SEQ ID NO: 2761078 - protein, 7 aa, Entamoeba invadens
KGCTTCN

SEQ ID NO: 2761079 - protein, 8 aa, Entamoeba invadens
KGCVEGND

SEQ ID NO: 2761080 - protein, 8 aa, Entamoeba invadens
KGDANKME

SEQ ID NO: 2761081 - protein, 18 aa, Entamoeba invadens
KGDCKGDTSAPAKKLEQA

SEQ ID NO: 2761082 - protein, 10 aa, Entamoeba invadens
KGDCQDSTNN

SEQ ID NO: 2761083 - protein, 8 aa, Entamoeba invadens
KGDEMEYE

SEQ ID NO: 2761084 - protein, 5 aa, Entamoeba invadens
KGDEV

SEQ ID NO: 2761085 - protein, 7 aa, Entamoeba invadens
KGDGERY

SEQ ID NO: 2761086 - protein, 5 aa, Entamoeba invadens
KGDHP

SEQ ID NO: 2761087 - protein, 6 aa, Entamoeba invadens
KGDIQY

SEQ ID NO: 2761088 - protein, 7 aa, Entamoeba invadens
KGDKFSK

SEQ ID NO: 2761089 - protein, 8 aa, Entamoeba invadens
KGDKTTTR

SEQ ID NO: 2761090 - protein, 7 aa, Entamoeba invadens
KGDKTVR

SEQ ID NO: 2761091 - protein, 13 aa, Entamoeba invadens
KGDNNPVDDRGLY

SEQ ID NO: 2761092 - protein, 5 aa, Entamoeba invadens
KGDPF

SEQ ID NO: 2761093 - protein, 8 aa, Entamoeba invadens
KGDPFEEK

SEQ ID NO: 2761094 - protein, 5 aa, Entamoeba invadens
KGDSR

SEQ ID NO: 2761095 - protein, 4 aa, Entamoeba invadens
KGDV

SEQ ID NO: 2761096 - protein, 8 aa, Entamoeba invadens
KGDYSSRQ

SEQ ID NO: 2761097 - protein, 7 aa, Entamoeba invadens
KGEACES

SEQ ID NO: 2761098 - protein, 5 aa, Entamoeba invadens
KGEAF

SEQ ID NO: 2761099 - protein, 5 aa, Entamoeba invadens
KGEAI

SEQ ID NO: 2761100 - protein, 5 aa, Entamoeba invadens
KGEDF

SEQ ID NO: 2761101 - protein, 7 aa, Entamoeba invadens
KGEDRVV

SEQ ID NO: 2761102 - protein, 7 aa, Entamoeba invadens
KGEDSVR

SEQ ID NO: 2761103 - protein, 4 aa, Entamoeba invadens
KGEG

SEQ ID NO: 2761104 - protein, 6 aa, Entamoeba invadens
KGEGCI

SEQ ID NO: 2761105 - protein, 12 aa, Entamoeba invadens
KGEITNKNNNGC

SEQ ID NO: 2761106 - protein, 12 aa, Entamoeba invadens
KGEKPKVDEEIT

SEQ ID NO: 2761107 - protein, 6 aa, Entamoeba invadens
KGEKSE

SEQ ID NO: 2761108 - protein, 17 aa, Entamoeba invadens
KGEKSIAETLKSTKQEE

SEQ ID NO: 2761109 - protein, 6 aa, Entamoeba invadens
KGEMSS

SEQ ID NO: 2761110 - protein, 5 aa, Entamoeba invadens
KGEQM

SEQ ID NO: 2761111 - protein, 8 aa, Entamoeba invadens
KGEQYSTN

SEQ ID NO: 2761112 - protein, 8 aa, Entamoeba invadens
KGERCNGK

SEQ ID NO: 2761113 - protein, 4 aa, Entamoeba invadens
KGET

SEQ ID NO: 2761114 - protein, 11 aa, Entamoeba invadens
KGETEISTRID

SEQ ID NO: 2761115 - protein, 10 aa, Entamoeba invadens
KGETSYKPDA

SEQ ID NO: 2761116 - protein, 5 aa, Entamoeba invadens
KGETV

SEQ ID NO: 2761117 - protein, 8 aa, Entamoeba invadens
KGEVRSES

SEQ ID NO: 2761118 - protein, 5 aa, Entamoeba invadens
KGEYP

SEQ ID NO: 2761119 - protein, 5 aa, Entamoeba invadens
KGFLN

SEQ ID NO: 2761120 - protein, 5 aa, Entamoeba invadens
KGFTD

SEQ ID NO: 2761121 - protein, 12 aa, Entamoeba invadens
KGGDWDRRNRRR

SEQ ID NO: 2761122 - protein, 8 aa, Entamoeba invadens
KGGEGTET

SEQ ID NO: 2761123 - protein, 8 aa, Entamoeba invadens
KGGEIGST

SEQ ID NO: 2761124 - protein, 8 aa, Entamoeba invadens
KGGEKVSR

SEQ ID NO: 2761125 - protein, 11 aa, Entamoeba invadens
KGGENKDSYDY

SEQ ID NO: 2761126 - protein, 7 aa, Entamoeba invadens
KGGGKQP

SEQ ID NO: 2761127 - protein, 7 aa, Entamoeba invadens
KGGKREK

SEQ ID NO: 2761128 - protein, 6 aa, Entamoeba invadens
KGGKTN

SEQ ID NO: 2761129 - protein, 11 aa, Entamoeba invadens
KGGNCSENFDD

SEQ ID NO: 2761130 - protein, 10 aa, Entamoeba invadens
KGGNFRNNES

SEQ ID NO: 2761131 - protein, 5 aa, Entamoeba invadens
KGGNV

SEQ ID NO: 2761132 - protein, 18 aa, Entamoeba invadens
KGGNVTVETCGEESQFDT

SEQ ID NO: 2761133 - protein, 9 aa, Entamoeba invadens
KGGQECQPC

SEQ ID NO: 2761134 - protein, 12 aa, Entamoeba invadens
KGGQYANAATNG

SEQ ID NO: 2761135 - protein, 4 aa, Entamoeba invadens
KGGR

SEQ ID NO: 2761136 - protein, 8 aa, Entamoeba invadens
KGGRFSSK

SEQ ID NO: 2761137 - protein, 13 aa, Entamoeba invadens
KGGRRPKTPNMSD

SEQ ID NO: 2761138 - protein, 5 aa, Entamoeba invadens
KGGSS

SEQ ID NO: 2761139 - protein, 10 aa, Entamoeba invadens
KGGVESEVYN

SEQ ID NO: 2761140 - protein, 8 aa, Entamoeba invadens
KGGVTQQQ

SEQ ID NO: 2761141 - protein, 5 aa, Entamoeba invadens
KGGYY

SEQ ID NO: 2761142 - protein, 9 aa, Entamoeba invadens
KGHKQQDAQ

SEQ ID NO: 2761143 - protein, 4 aa, Entamoeba invadens
KGHL

SEQ ID NO: 2761144 - protein, 24 aa, Entamoeba invadens
KGHNPSITTKSVYNTNNNITPKEF

SEQ ID NO: 2761145 - protein, 25 aa, Entamoeba invadens
KGIDGDNSRMSLGENSTIRSASTQL

SEQ ID NO: 2761146 - protein, 5 aa, Entamoeba invadens
KGIDH

SEQ ID NO: 2761147 - protein, 9 aa, Entamoeba invadens
KGIDQPSLD

SEQ ID NO: 2761148 - protein, 9 aa, Entamoeba invadens
KGIGSPKYM

SEQ ID NO: 2761149 - protein, 5 aa, Entamoeba invadens
KGIGT

SEQ ID NO: 2761150 - protein, 6 aa, Entamoeba invadens
KGIGTP

SEQ ID NO: 2761151 - protein, 9 aa, Entamoeba invadens
KGIKSNKYP

SEQ ID NO: 2761152 - protein, 8 aa, Entamoeba invadens
KGIQTKES

SEQ ID NO: 2761153 - protein, 7 aa, Entamoeba invadens
KGISAER

SEQ ID NO: 2761154 - protein, 9 aa, Entamoeba invadens
KGISSTQVS

SEQ ID NO: 2761155 - protein, 6 aa, Entamoeba invadens
KGISYG

SEQ ID NO: 2761156 - protein, 5 aa, Entamoeba invadens
KGITR

SEQ ID NO: 2761157 - protein, 4 aa, Entamoeba invadens
KGKA

SEQ ID NO: 2761158 - protein, 6 aa, Entamoeba invadens
KGKCSK

SEQ ID NO: 2761159 - protein, 5 aa, Entamoeba invadens
KGKDG

SEQ ID NO: 2761160 - protein, 8 aa, Entamoeba invadens
KGKEKTGV

SEQ ID NO: 2761161 - protein, 12 aa, Entamoeba invadens
KGKIPMPPKNEL

SEQ ID NO: 2761162 - protein, 9 aa, Entamoeba invadens
KGKKREYYG

SEQ ID NO: 2761163 - protein, 9 aa, Entamoeba invadens
KGKKRQTIV

SEQ ID NO: 2761164 - protein, 11 aa, Entamoeba invadens
KGKKSLANTID

SEQ ID NO: 2761165 - protein, 6 aa, Entamoeba invadens
KGKKTV

SEQ ID NO: 2761166 - protein, 9 aa, Entamoeba invadens
KGKLEEISS

SEQ ID NO: 2761167 - protein, 22 aa, Entamoeba invadens
KGKLGNGDECIRNSEGCDSGGV

SEQ ID NO: 2761168 - protein, 5 aa, Entamoeba invadens
KGKNF

SEQ ID NO: 2761169 - protein, 8 aa, Entamoeba invadens
KGKPDAEV

SEQ ID NO: 2761170 - protein, 7 aa, Entamoeba invadens
KGKPITS

SEQ ID NO: 2761171 - protein, 46 aa, Entamoeba invadens
KGKPSRFAPPNQNESEDVDKQTNKLSPEPIPNTENPISKSRTQIPP

SEQ ID NO: 2761172 - protein, 11 aa, Entamoeba invadens
KGKPWKFRPTS

SEQ ID NO: 2761173 - protein, 4 aa, Entamoeba invadens
KGKQ

SEQ ID NO: 2761174 - protein, 5 aa, Entamoeba invadens
KGKQD

SEQ ID NO: 2761175 - protein, 7 aa, Entamoeba invadens
KGKQTVR

SEQ ID NO: 2761176 - protein, 9 aa, Entamoeba invadens
KGKRPDDKC

SEQ ID NO: 2761177 - protein, 14 aa, Entamoeba invadens
KGKRPDVPNSVDEK

SEQ ID NO: 2761178 - protein, 10 aa, Entamoeba invadens
KGKTKKGGKY

SEQ ID NO: 2761179 - protein, 10 aa, Entamoeba invadens
KGKTKNNQFK

SEQ ID NO: 2761180 - protein, 7 aa, Entamoeba invadens
KGKTLKS

SEQ ID NO: 2761181 - protein, 10 aa, Entamoeba invadens
KGKTLSNPGV

SEQ ID NO: 2761182 - protein, 6 aa, Entamoeba invadens
KGKTMG

SEQ ID NO: 2761183 - protein, 9 aa, Entamoeba invadens
KGKTRNNQF

SEQ ID NO: 2761184 - protein, 6 aa, Entamoeba invadens
KGKTSV

SEQ ID NO: 2761185 - protein, 6 aa, Entamoeba invadens
KGKYSE

SEQ ID NO: 2761186 - protein, 7 aa, Entamoeba invadens
KGLERDI

SEQ ID NO: 2761187 - protein, 8 aa, Entamoeba invadens
KGLNSHSM

SEQ ID NO: 2761188 - protein, 7 aa, Entamoeba invadens
KGLPNKE

SEQ ID NO: 2761189 - protein, 6 aa, Entamoeba invadens
KGLQPS

SEQ ID NO: 2761190 - protein, 6 aa, Entamoeba invadens
KGLSTK

SEQ ID NO: 2761191 - protein, 9 aa, Entamoeba invadens
KGMESAPQQ

SEQ ID NO: 2761192 - protein, 10 aa, Entamoeba invadens
KGMKEADKYS

SEQ ID NO: 2761193 - protein, 10 aa, Entamoeba invadens
KGMSSSVQSD

SEQ ID NO: 2761194 - protein, 7 aa, Entamoeba invadens
KGNDDIN

SEQ ID NO: 2761195 - protein, 115 aa, Entamoeba invadens
KGNDVPEISMSSSENMSVTSSEKDVTSNDTPTYSSDSLTDESVSSSNSTSFSNGSESVSNHTSEDSFSNESESSLSSNSSDYSNGTIPSESSESNSTNTSSENTFSSSSNDDPFD

SEQ ID NO: 2761196 - protein, 8 aa, Entamoeba invadens
KGNECVKS

SEQ ID NO: 2761197 - protein, 6 aa, Entamoeba invadens
KGNEEC

SEQ ID NO: 2761198 - protein, 9 aa, Entamoeba invadens
KGNGGRTLR

SEQ ID NO: 2761199 - protein, 11 aa, Entamoeba invadens
KGNGNSYSSIY

SEQ ID NO: 2761200 - protein, 4 aa, Entamoeba invadens
KGNH

SEQ ID NO: 2761201 - protein, 14 aa, Entamoeba invadens
KGNHLKKGIETDDK

SEQ ID NO: 2761202 - protein, 7 aa, Entamoeba invadens
KGNKLSI

SEQ ID NO: 2761203 - protein, 6 aa, Entamoeba invadens
KGNKQI

SEQ ID NO: 2761204 - protein, 7 aa, Entamoeba invadens
KGNLQGG

SEQ ID NO: 2761205 - protein, 4 aa, Entamoeba invadens
KGNM

SEQ ID NO: 2761206 - protein, 5 aa, Entamoeba invadens
KGNQV

SEQ ID NO: 2761207 - protein, 14 aa, Entamoeba invadens
KGNRLNKADGMPES

SEQ ID NO: 2761208 - protein, 12 aa, Entamoeba invadens
KGNRPPRPSEVR

SEQ ID NO: 2761209 - protein, 9 aa, Entamoeba invadens
KGNSDPKTL

SEQ ID NO: 2761210 - protein, 7 aa, Entamoeba invadens
KGNSECS

SEQ ID NO: 2761211 - protein, 17 aa, Entamoeba invadens
KGNSEYSKCGDNTEDCV

SEQ ID NO: 2761212 - protein, 8 aa, Entamoeba invadens
KGNSNKKR

SEQ ID NO: 2761213 - protein, 5 aa, Entamoeba invadens
KGNYD

SEQ ID NO: 2761214 - protein, 15 aa, Entamoeba invadens
KGPGACASDEVPKEK

SEQ ID NO: 2761215 - protein, 9 aa, Entamoeba invadens
KGPKKTISS

SEQ ID NO: 2761216 - protein, 14 aa, Entamoeba invadens
KGPLDGTCGAKPFS

SEQ ID NO: 2761217 - protein, 5 aa, Entamoeba invadens
KGPSL

SEQ ID NO: 2761218 - protein, 9 aa, Entamoeba invadens
KGPTTSDAF

SEQ ID NO: 2761219 - protein, 5 aa, Entamoeba invadens
KGPVE

SEQ ID NO: 2761220 - protein, 11 aa, Entamoeba invadens
KGQDIEKPTGT

SEQ ID NO: 2761221 - protein, 11 aa, Entamoeba invadens
KGQGEFNTQSG

SEQ ID NO: 2761222 - protein, 8 aa, Entamoeba invadens
KGQKGNLT

SEQ ID NO: 2761223 - protein, 7 aa, Entamoeba invadens
KGQKNKF

SEQ ID NO: 2761224 - protein, 7 aa, Entamoeba invadens
KGQMPDF

SEQ ID NO: 2761225 - protein, 9 aa, Entamoeba invadens
KGQNLSTSL

SEQ ID NO: 2761226 - protein, 7 aa, Entamoeba invadens
KGQNNKY

SEQ ID NO: 2761227 - protein, 13 aa, Entamoeba invadens
KGQQDDAEASSAI

SEQ ID NO: 2761228 - protein, 6 aa, Entamoeba invadens
KGQRVP

SEQ ID NO: 2761229 - protein, 8 aa, Entamoeba invadens
KGQSSIPD

SEQ ID NO: 2761230 - protein, 9 aa, Entamoeba invadens
KGQSSRSMQ

SEQ ID NO: 2761231 - protein, 6 aa, Entamoeba invadens
KGQSVA

SEQ ID NO: 2761232 - protein, 4 aa, Entamoeba invadens
KGQT

SEQ ID NO: 2761233 - protein, 13 aa, Entamoeba invadens
KGQTSVDISQTGS

SEQ ID NO: 2761234 - protein, 9 aa, Entamoeba invadens
KGQTTKSDV

SEQ ID NO: 2761235 - protein, 7 aa, Entamoeba invadens
KGQYSEA

SEQ ID NO: 2761236 - protein, 12 aa, Entamoeba invadens
KGQYSKGGITSC

SEQ ID NO: 2761237 - protein, 14 aa, Entamoeba invadens
KGQYSYGPSCDTCP

SEQ ID NO: 2761238 - protein, 9 aa, Entamoeba invadens
KGREGREAA

SEQ ID NO: 2761239 - protein, 4 aa, Entamoeba invadens
KGRG

SEQ ID NO: 2761240 - protein, 5 aa, Entamoeba invadens
KGRGM

SEQ ID NO: 2761241 - protein, 10 aa, Entamoeba invadens
KGRKFSDLQT

SEQ ID NO: 2761242 - protein, 8 aa, Entamoeba invadens
KGRKGNLT

SEQ ID NO: 2761243 - protein, 12 aa, Entamoeba invadens
KGRRFGQVSTQK

SEQ ID NO: 2761244 - protein, 7 aa, Entamoeba invadens
KGRRNKY

SEQ ID NO: 2761245 - protein, 5 aa, Entamoeba invadens
KGRSI

SEQ ID NO: 2761246 - protein, 7 aa, Entamoeba invadens
KGRTTLK

SEQ ID NO: 2761247 - protein, 9 aa, Entamoeba invadens
KGSADTGAE

SEQ ID NO: 2761248 - protein, 8 aa, Entamoeba invadens
KGSDISRN

SEQ ID NO: 2761249 - protein, 7 aa, Entamoeba invadens
KGSDITD

SEQ ID NO: 2761250 - protein, 19 aa, Entamoeba invadens
KGSDKHGRGNKGMTKDNEM

SEQ ID NO: 2761251 - protein, 7 aa, Entamoeba invadens
KGSDKKQ

SEQ ID NO: 2761252 - protein, 11 aa, Entamoeba invadens
KGSDLKDKRGG

SEQ ID NO: 2761253 - protein, 18 aa, Entamoeba invadens
KGSECPDSFTGDYTLQST

SEQ ID NO: 2761254 - protein, 8 aa, Entamoeba invadens
KGSGNGQY

SEQ ID NO: 2761255 - protein, 8 aa, Entamoeba invadens
KGSKNYSN

SEQ ID NO: 2761256 - protein, 7 aa, Entamoeba invadens
KGSKQSV

SEQ ID NO: 2761257 - protein, 7 aa, Entamoeba invadens
KGSMTSI

SEQ ID NO: 2761258 - protein, 4 aa, Entamoeba invadens
KGSN

SEQ ID NO: 2761259 - protein, 7 aa, Entamoeba invadens
KGSNDEE

SEQ ID NO: 2761260 - protein, 5 aa, Entamoeba invadens
KGSNM

SEQ ID NO: 2761261 - protein, 8 aa, Entamoeba invadens
KGSPDTEF

SEQ ID NO: 2761262 - protein, 8 aa, Entamoeba invadens
KGSRLEQT

SEQ ID NO: 2761263 - protein, 13 aa, Entamoeba invadens
KGSSDKYEIKTEP

SEQ ID NO: 2761264 - protein, 6 aa, Entamoeba invadens
KGSTSS

SEQ ID NO: 2761265 - protein, 8 aa, Entamoeba invadens
KGSVLESG

SEQ ID NO: 2761266 - protein, 10 aa, Entamoeba invadens
KGSYKISGES

SEQ ID NO: 2761267 - protein, 10 aa, Entamoeba invadens
KGSYNKTKTI

SEQ ID NO: 2761268 - protein, 10 aa, Entamoeba invadens
KGTEELPTLT

SEQ ID NO: 2761269 - protein, 10 aa, Entamoeba invadens
KGTETSTTSL

SEQ ID NO: 2761270 - protein, 5 aa, Entamoeba invadens
KGTFH

SEQ ID NO: 2761271 - protein, 21 aa, Entamoeba invadens
KGTFKNTEKGCTQCSNSTEYC

SEQ ID NO: 2761272 - protein, 8 aa, Entamoeba invadens
KGTFTPET

SEQ ID NO: 2761273 - protein, 6 aa, Entamoeba invadens
KGTIPG

SEQ ID NO: 2761274 - protein, 17 aa, Entamoeba invadens
KGTKCGYDGKAPDNQSP

SEQ ID NO: 2761275 - protein, 11 aa, Entamoeba invadens
KGTKGNFNGRT

SEQ ID NO: 2761276 - protein, 10 aa, Entamoeba invadens
KGTKKSGNVS

SEQ ID NO: 2761277 - protein, 18 aa, Entamoeba invadens
KGTKTGKPNQSRPAPKRV

SEQ ID NO: 2761278 - protein, 7 aa, Entamoeba invadens
KGTNEDV

SEQ ID NO: 2761279 - protein, 4 aa, Entamoeba invadens
KGTP

SEQ ID NO: 2761280 - protein, 6 aa, Entamoeba invadens
KGTPVD

SEQ ID NO: 2761281 - protein, 4 aa, Entamoeba invadens
KGTQ

SEQ ID NO: 2761282 - protein, 6 aa, Entamoeba invadens
KGTSAA

SEQ ID NO: 2761283 - protein, 4 aa, Entamoeba invadens
KGTT

SEQ ID NO: 2761284 - protein, 11 aa, Entamoeba invadens
KGTTKIPDNTF

SEQ ID NO: 2761285 - protein, 12 aa, Entamoeba invadens
KGTTSSYCSTTE

SEQ ID NO: 2761286 - protein, 10 aa, Entamoeba invadens
KGTWNEDANG

SEQ ID NO: 2761287 - protein, 5 aa, Entamoeba invadens
KGTYC

SEQ ID NO: 2761288 - protein, 13 aa, Entamoeba invadens
KGTYGTERNQGYE

SEQ ID NO: 2761289 - protein, 8 aa, Entamoeba invadens
KGTYPQNV

SEQ ID NO: 2761290 - protein, 43 aa, Entamoeba invadens
KGTYQNVKGSNHCNKCTRGTYQNEMGKSKCDKCKVGSYSKDGA

SEQ ID NO: 2761291 - protein, 8 aa, Entamoeba invadens
KGTYRGNT

SEQ ID NO: 2761292 - protein, 12 aa, Entamoeba invadens
KGTYSSLPGSDK

SEQ ID NO: 2761293 - protein, 5 aa, Entamoeba invadens
KGTYT

SEQ ID NO: 2761294 - protein, 6 aa, Entamoeba invadens
KGTYYT

SEQ ID NO: 2761295 - protein, 4 aa, Entamoeba invadens
KGVA

SEQ ID NO: 2761296 - protein, 7 aa, Entamoeba invadens
KGVADQF

SEQ ID NO: 2761297 - protein, 7 aa, Entamoeba invadens
KGVDDKR

SEQ ID NO: 2761298 - protein, 7 aa, Entamoeba invadens
KGVDSTS

SEQ ID NO: 2761299 - protein, 4 aa, Entamoeba invadens
KGVE

SEQ ID NO: 2761300 - protein, 14 aa, Entamoeba invadens
KGVEERKKKDASRF

SEQ ID NO: 2761301 - protein, 7 aa, Entamoeba invadens
KGVEQKK

SEQ ID NO: 2761302 - protein, 9 aa, Entamoeba invadens
KGVETTENI

SEQ ID NO: 2761303 - protein, 6 aa, Entamoeba invadens
KGVGSP

SEQ ID NO: 2761304 - protein, 7 aa, Entamoeba invadens
KGVGTPA

SEQ ID NO: 2761305 - protein, 10 aa, Entamoeba invadens
KGVGTPKYMP

SEQ ID NO: 2761306 - protein, 8 aa, Entamoeba invadens
KGVGTPSF

SEQ ID NO: 2761307 - protein, 7 aa, Entamoeba invadens
KGVNNTD

SEQ ID NO: 2761308 - protein, 9 aa, Entamoeba invadens
KGVQTSTNI

SEQ ID NO: 2761309 - protein, 9 aa, Entamoeba invadens
KGVQTTNKI

SEQ ID NO: 2761310 - protein, 6 aa, Entamoeba invadens
KGVQYT

SEQ ID NO: 2761311 - protein, 5 aa, Entamoeba invadens
KGVSD

SEQ ID NO: 2761312 - protein, 18 aa, Entamoeba invadens
KGVTESKCQIRDNKGCQR

SEQ ID NO: 2761313 - protein, 7 aa, Entamoeba invadens
KGVTSEM

SEQ ID NO: 2761314 - protein, 11 aa, Entamoeba invadens
KGYAADCQGCK

SEQ ID NO: 2761315 - protein, 6 aa, Entamoeba invadens
KGYDTI

SEQ ID NO: 2761316 - protein, 7 aa, Entamoeba invadens
KGYELNP

SEQ ID NO: 2761317 - protein, 5 aa, Entamoeba invadens
KGYFN

SEQ ID NO: 2761318 - protein, 11 aa, Entamoeba invadens
KGYNTYSLSST

SEQ ID NO: 2761319 - protein, 20 aa, Entamoeba invadens
KGYRPCAPGTKCTASERVDY

SEQ ID NO: 2761320 - protein, 7 aa, Entamoeba invadens
KGYRSDC

SEQ ID NO: 2761321 - protein, 6 aa, Entamoeba invadens
KGYSNT

SEQ ID NO: 2761322 - protein, 5 aa, Entamoeba invadens
KGYTP

SEQ ID NO: 2761323 - protein, 11 aa, Entamoeba invadens
KGYTTEKAYPY

SEQ ID NO: 2761324 - protein, 12 aa, Entamoeba invadens
KGYYQKDSPSGI

SEQ ID NO: 2761325 - protein, 11 aa, Entamoeba invadens
KHAGTAADPDK

SEQ ID NO: 2761326 - protein, 7 aa, Entamoeba invadens
KHATESV

SEQ ID NO: 2761327 - protein, 6 aa, Entamoeba invadens
KHDDTQ

SEQ ID NO: 2761328 - protein, 9 aa, Entamoeba invadens
KHDEINERK

SEQ ID NO: 2761329 - protein, 10 aa, Entamoeba invadens
KHDPKQRSDI

SEQ ID NO: 2761330 - protein, 6 aa, Entamoeba invadens
KHDQLA

SEQ ID NO: 2761331 - protein, 6 aa, Entamoeba invadens
KHDRIS

SEQ ID NO: 2761332 - protein, 6 aa, Entamoeba invadens
KHDRVP

SEQ ID NO: 2761333 - protein, 6 aa, Entamoeba invadens
KHEDKI

SEQ ID NO: 2761334 - protein, 7 aa, Entamoeba invadens
KHEGKDL

SEQ ID NO: 2761335 - protein, 5 aa, Entamoeba invadens
KHEIK

SEQ ID NO: 2761336 - protein, 12 aa, Entamoeba invadens
KHELDKNTQYAA

SEQ ID NO: 2761337 - protein, 8 aa, Entamoeba invadens
KHENCSSY

SEQ ID NO: 2761338 - protein, 13 aa, Entamoeba invadens
KHEYSNSACYGKS

SEQ ID NO: 2761339 - protein, 5 aa, Entamoeba invadens
KHGGY

SEQ ID NO: 2761340 - protein, 16 aa, Entamoeba invadens
KHGLGMSSKGPQKVNP

SEQ ID NO: 2761341 - protein, 5 aa, Entamoeba invadens
KHGSL

SEQ ID NO: 2761342 - protein, 15 aa, Entamoeba invadens
KHIKSGNKCEKYNNT

SEQ ID NO: 2761343 - protein, 5 aa, Entamoeba invadens
KHINK

SEQ ID NO: 2761344 - protein, 6 aa, Entamoeba invadens
KHIPNE

SEQ ID NO: 2761345 - protein, 12 aa, Entamoeba invadens
KHKECTTCSPPF

SEQ ID NO: 2761346 - protein, 10 aa, Entamoeba invadens
KHKENKKTRN

SEQ ID NO: 2761347 - protein, 5 aa, Entamoeba invadens
KHKES

SEQ ID NO: 2761348 - protein, 8 aa, Entamoeba invadens
KHKISDDG

SEQ ID NO: 2761349 - protein, 10 aa, Entamoeba invadens
KHKKQLENDE

SEQ ID NO: 2761350 - protein, 8 aa, Entamoeba invadens
KHKLPNGD

SEQ ID NO: 2761351 - protein, 7 aa, Entamoeba invadens
KHKTIND

SEQ ID NO: 2761352 - protein, 10 aa, Entamoeba invadens
KHNAANKGYT

SEQ ID NO: 2761353 - protein, 9 aa, Entamoeba invadens
KHNDKNEEI

SEQ ID NO: 2761354 - protein, 17 aa, Entamoeba invadens
KHNNHKKCVGTSKIKSS

SEQ ID NO: 2761355 - protein, 5 aa, Entamoeba invadens
KHNSI

SEQ ID NO: 2761356 - protein, 6 aa, Entamoeba invadens
KHPEVN

SEQ ID NO: 2761357 - protein, 9 aa, Entamoeba invadens
KHPKKIRKS

SEQ ID NO: 2761358 - protein, 6 aa, Entamoeba invadens
KHPNMS

SEQ ID NO: 2761359 - protein, 6 aa, Entamoeba invadens
KHPPEK

SEQ ID NO: 2761360 - protein, 16 aa, Entamoeba invadens
KHPPVPRKPVEGETAM

SEQ ID NO: 2761361 - protein, 7 aa, Entamoeba invadens
KHPQSDN

SEQ ID NO: 2761362 - protein, 6 aa, Entamoeba invadens
KHPTLD

SEQ ID NO: 2761363 - protein, 6 aa, Entamoeba invadens
KHQEEL

SEQ ID NO: 2761364 - protein, 10 aa, Entamoeba invadens
KHQKDIEKTT

SEQ ID NO: 2761365 - protein, 11 aa, Entamoeba invadens
KHQKDTEKTTT

SEQ ID NO: 2761366 - protein, 6 aa, Entamoeba invadens
KHQTYK

SEQ ID NO: 2761367 - protein, 5 aa, Entamoeba invadens
KHRIT

SEQ ID NO: 2761368 - protein, 8 aa, Entamoeba invadens
KHSENSGM

SEQ ID NO: 2761369 - protein, 8 aa, Entamoeba invadens
KHSGNDSA

SEQ ID NO: 2761370 - protein, 20 aa, Entamoeba invadens
KHSGSNGISVSGQNSKIEKN

SEQ ID NO: 2761371 - protein, 8 aa, Entamoeba invadens
KHSKRDSS

SEQ ID NO: 2761372 - protein, 14 aa, Entamoeba invadens
KHSTDEEGTQTEFE

SEQ ID NO: 2761373 - protein, 5 aa, Entamoeba invadens
KHTFE

SEQ ID NO: 2761374 - protein, 7 aa, Entamoeba invadens
KHTKVRK

SEQ ID NO: 2761375 - protein, 5 aa, Entamoeba invadens
KHTLN

SEQ ID NO: 2761376 - protein, 7 aa, Entamoeba invadens
KHTNNLK

SEQ ID NO: 2761377 - protein, 6 aa, Entamoeba invadens
KHTNRP

SEQ ID NO: 2761378 - protein, 16 aa, Entamoeba invadens
KHTPDGDVDVTSSDIK

SEQ ID NO: 2761379 - protein, 5 aa, Entamoeba invadens
KHTPS

SEQ ID NO: 2761380 - protein, 7 aa, Entamoeba invadens
KHYEKPA

SEQ ID NO: 2761381 - protein, 8 aa, Entamoeba invadens
KHYEKPAD

SEQ ID NO: 2761382 - protein, 13 aa, Entamoeba invadens
KHYKGENDGIDIS

SEQ ID NO: 2761383 - protein, 8 aa, Entamoeba invadens
KHYKKPAD

SEQ ID NO: 2761384 - protein, 8 aa, Entamoeba invadens
KHYKKSAD

SEQ ID NO: 2761385 - protein, 12 aa, Entamoeba invadens
KHYTRQEPCSSR

SEQ ID NO: 2761386 - protein, 7 aa, Entamoeba invadens
KHYTTNQ

SEQ ID NO: 2761387 - protein, 9 aa, Entamoeba invadens
KIAEGVKDV

SEQ ID NO: 2761388 - protein, 13 aa, Entamoeba invadens
KIAKGEDKGLGTP

SEQ ID NO: 2761389 - protein, 8 aa, Entamoeba invadens
KIAKKEQN

SEQ ID NO: 2761390 - protein, 9 aa, Entamoeba invadens
KIATESTGF

SEQ ID NO: 2761391 - protein, 8 aa, Entamoeba invadens
KIDATEQK

SEQ ID NO: 2761392 - protein, 7 aa, Entamoeba invadens
KIDATQP

SEQ ID NO: 2761393 - protein, 7 aa, Entamoeba invadens
KIDDSKY

SEQ ID NO: 2761394 - protein, 5 aa, Entamoeba invadens
KIDEN

SEQ ID NO: 2761395 - protein, 12 aa, Entamoeba invadens
KIDENDQNEEEK

SEQ ID NO: 2761396 - protein, 9 aa, Entamoeba invadens
KIDNATANC

SEQ ID NO: 2761397 - protein, 4 aa, Entamoeba invadens
KIDP

SEQ ID NO: 2761398 - protein, 5 aa, Entamoeba invadens
KIDPN

SEQ ID NO: 2761399 - protein, 7 aa, Entamoeba invadens
KIDPTKD

SEQ ID NO: 2761400 - protein, 4 aa, Entamoeba invadens
KIDQ

SEQ ID NO: 2761401 - protein, 6 aa, Entamoeba invadens
KIDSPP

SEQ ID NO: 2761402 - protein, 8 aa, Entamoeba invadens
KIDSYNGK

SEQ ID NO: 2761403 - protein, 14 aa, Entamoeba invadens
KIDTPKKTEERKIG

SEQ ID NO: 2761404 - protein, 14 aa, Entamoeba invadens
KIEAPKEVKPKESI

SEQ ID NO: 2761405 - protein, 12 aa, Entamoeba invadens
KIEDKLQEGVKE

SEQ ID NO: 2761406 - protein, 7 aa, Entamoeba invadens
KIEEATG

SEQ ID NO: 2761407 - protein, 11 aa, Entamoeba invadens
KIEGKKEEVVS

SEQ ID NO: 2761408 - protein, 29 aa, Entamoeba invadens
KIEKDKAGYVETTTYQDEATEEENENLER

SEQ ID NO: 2761409 - protein, 19 aa, Entamoeba invadens
KIEKPKIETKREPRTVGGK

SEQ ID NO: 2761410 - protein, 17 aa, Entamoeba invadens
KIEKTRNEQAVKHNDQN

SEQ ID NO: 2761411 - protein, 8 aa, Entamoeba invadens
KIENTTKK

SEQ ID NO: 2761412 - protein, 6 aa, Entamoeba invadens
KIEPTV

SEQ ID NO: 2761413 - protein, 5 aa, Entamoeba invadens
KIESK

SEQ ID NO: 2761414 - protein, 6 aa, Entamoeba invadens
KIESSV

SEQ ID NO: 2761415 - protein, 12 aa, Entamoeba invadens
KIETENRQTSSP

SEQ ID NO: 2761416 - protein, 5 aa, Entamoeba invadens
KIETT

SEQ ID NO: 2761417 - protein, 6 aa, Entamoeba invadens
KIEYTL

SEQ ID NO: 2761418 - protein, 6 aa, Entamoeba invadens
KIFNQD

SEQ ID NO: 2761419 - protein, 12 aa, Entamoeba invadens
KIGATKSGETSS

SEQ ID NO: 2761420 - protein, 4 aa, Entamoeba invadens
KIGE

SEQ ID NO: 2761421 - protein, 5 aa, Entamoeba invadens
KIGEP

SEQ ID NO: 2761422 - protein, 7 aa, Entamoeba invadens
KIGETRV

SEQ ID NO: 2761423 - protein, 7 aa, Entamoeba invadens
KIGKNSQ

SEQ ID NO: 2761424 - protein, 6 aa, Entamoeba invadens
KIGKPN

SEQ ID NO: 2761425 - protein, 7 aa, Entamoeba invadens
KIGKSEL

SEQ ID NO: 2761426 - protein, 7 aa, Entamoeba invadens
KIGKSER

SEQ ID NO: 2761427 - protein, 11 aa, Entamoeba invadens
KIGNGRNKIED

SEQ ID NO: 2761428 - protein, 7 aa, Entamoeba invadens
KIGPKKV

SEQ ID NO: 2761429 - protein, 8 aa, Entamoeba invadens
KIGQTSGI

SEQ ID NO: 2761430 - protein, 8 aa, Entamoeba invadens
KIGRSPVT

SEQ ID NO: 2761431 - protein, 12 aa, Entamoeba invadens
KIGSGDNSQIDE

SEQ ID NO: 2761432 - protein, 18 aa, Entamoeba invadens
KIGTTTEKITTSSQVFST

SEQ ID NO: 2761433 - protein, 5 aa, Entamoeba invadens
KIHGK

SEQ ID NO: 2761434 - protein, 5 aa, Entamoeba invadens
KIIGE

SEQ ID NO: 2761435 - protein, 17 aa, Entamoeba invadens
KIKDQVEKSNRKLNGFK

SEQ ID NO: 2761436 - protein, 11 aa, Entamoeba invadens
KIKESEARPIE

SEQ ID NO: 2761437 - protein, 7 aa, Entamoeba invadens
KIKESSK

SEQ ID NO: 2761438 - protein, 8 aa, Entamoeba invadens
KIKGSGLG

SEQ ID NO: 2761439 - protein, 6 aa, Entamoeba invadens
KIKNSK

SEQ ID NO: 2761440 - protein, 13 aa, Entamoeba invadens
KIKQDADGKEKVI

SEQ ID NO: 2761441 - protein, 23 aa, Entamoeba invadens
KIKQDENAEIEKMNNERNDESEA

SEQ ID NO: 2761442 - protein, 5 aa, Entamoeba invadens
KIKQQ

SEQ ID NO: 2761443 - protein, 12 aa, Entamoeba invadens
KIKRRDSPRTSD

SEQ ID NO: 2761444 - protein, 4 aa, Entamoeba invadens
KIKS

SEQ ID NO: 2761445 - protein, 22 aa, Entamoeba invadens
KILDKSGKCVEPTNCDSVDNSK

SEQ ID NO: 2761446 - protein, 22 aa, Entamoeba invadens
KILDRSGKCVEPTNCDSVDDSR

SEQ ID NO: 2761447 - protein, 22 aa, Entamoeba invadens
KINDQTGQVVPPLPQPTQQQQL

SEQ ID NO: 2761448 - protein, 16 aa, Entamoeba invadens
KINDRQEKEKVANEKR

SEQ ID NO: 2761449 - protein, 9 aa, Entamoeba invadens
KINEENDAI

SEQ ID NO: 2761450 - protein, 24 aa, Entamoeba invadens
KINKIKKNETQKVENDYTNKYQVP

SEQ ID NO: 2761451 - protein, 6 aa, Entamoeba invadens
KINLKE

SEQ ID NO: 2761452 - protein, 9 aa, Entamoeba invadens
KINNKINGQ

SEQ ID NO: 2761453 - protein, 10 aa, Entamoeba invadens
KINNKPDTTI

SEQ ID NO: 2761454 - protein, 8 aa, Entamoeba invadens
KINNPSNY

SEQ ID NO: 2761455 - protein, 7 aa, Entamoeba invadens
KINPQKD

SEQ ID NO: 2761456 - protein, 5 aa, Entamoeba invadens
KINRN

SEQ ID NO: 2761457 - protein, 6 aa, Entamoeba invadens
KINSTA

SEQ ID NO: 2761458 - protein, 5 aa, Entamoeba invadens
KINTG

SEQ ID NO: 2761459 - protein, 8 aa, Entamoeba invadens
KINTRKNK

SEQ ID NO: 2761460 - protein, 8 aa, Entamoeba invadens
KIPINTET

SEQ ID NO: 2761461 - protein, 5 aa, Entamoeba invadens
KIPNC

SEQ ID NO: 2761462 - protein, 9 aa, Entamoeba invadens
KIPPSGNLD

SEQ ID NO: 2761463 - protein, 9 aa, Entamoeba invadens
KIPQTPSER

SEQ ID NO: 2761464 - protein, 6 aa, Entamoeba invadens
KIPSEI

SEQ ID NO: 2761465 - protein, 8 aa, Entamoeba invadens
KIPSLPDK

SEQ ID NO: 2761466 - protein, 7 aa, Entamoeba invadens
KIPSTDR

SEQ ID NO: 2761467 - protein, 4 aa, Entamoeba invadens
KIPT

SEQ ID NO: 2761468 - protein, 14 aa, Entamoeba invadens
KIPTPPSSFETDAT

SEQ ID NO: 2761469 - protein, 6 aa, Entamoeba invadens
KIQEGS

SEQ ID NO: 2761470 - protein, 6 aa, Entamoeba invadens
KIQPKK

SEQ ID NO: 2761471 - protein, 29 aa, Entamoeba invadens
KIQQNTSKQDQNKKRQMEKKMEEKNRRER

SEQ ID NO: 2761472 - protein, 5 aa, Entamoeba invadens
KIQTN

SEQ ID NO: 2761473 - protein, 5 aa, Entamoeba invadens
KIQTT

SEQ ID NO: 2761474 - protein, 13 aa, Entamoeba invadens
KIRKEYPEDSNTQ

SEQ ID NO: 2761475 - protein, 16 aa, Entamoeba invadens
KIRNKATIKSNTESNH

SEQ ID NO: 2761476 - protein, 9 aa, Entamoeba invadens
KIRNTGRRH

SEQ ID NO: 2761477 - protein, 8 aa, Entamoeba invadens
KIRTSDEE

SEQ ID NO: 2761478 - protein, 6 aa, Entamoeba invadens
KISASG

SEQ ID NO: 2761479 - protein, 4 aa, Entamoeba invadens
KISD

SEQ ID NO: 2761480 - protein, 5 aa, Entamoeba invadens
KISED

SEQ ID NO: 2761481 - protein, 14 aa, Entamoeba invadens
KISEVENLSNENEK

SEQ ID NO: 2761482 - protein, 15 aa, Entamoeba invadens
KISGKTVANGGDKQF

SEQ ID NO: 2761483 - protein, 7 aa, Entamoeba invadens
KISGNSE

SEQ ID NO: 2761484 - protein, 10 aa, Entamoeba invadens
KISKGNDQVL

SEQ ID NO: 2761485 - protein, 5 aa, Entamoeba invadens
KISLA

SEQ ID NO: 2761486 - protein, 6 aa, Entamoeba invadens
KISNDG

SEQ ID NO: 2761487 - protein, 9 aa, Entamoeba invadens
KISSDPNRT

SEQ ID NO: 2761488 - protein, 12 aa, Entamoeba invadens
KISSFPKTIPNE

SEQ ID NO: 2761489 - protein, 5 aa, Entamoeba invadens
KISSS

SEQ ID NO: 2761490 - protein, 10 aa, Entamoeba invadens
KISSTPSREA

SEQ ID NO: 2761491 - protein, 8 aa, Entamoeba invadens
KISTENCQ

SEQ ID NO: 2761492 - protein, 6 aa, Entamoeba invadens
KISTIT

SEQ ID NO: 2761493 - protein, 9 aa, Entamoeba invadens
KISTTKEEF

SEQ ID NO: 2761494 - protein, 6 aa, Entamoeba invadens
KISTVT

SEQ ID NO: 2761495 - protein, 7 aa, Entamoeba invadens
KITAEGD

SEQ ID NO: 2761496 - protein, 7 aa, Entamoeba invadens
KITDGNG

SEQ ID NO: 2761497 - protein, 10 aa, Entamoeba invadens
KITDSGCEQC

SEQ ID NO: 2761498 - protein, 21 aa, Entamoeba invadens
KITDVKTNIEKRADMEKLPDV

SEQ ID NO: 2761499 - protein, 6 aa, Entamoeba invadens
KITEEE

SEQ ID NO: 2761500 - protein, 8 aa, Entamoeba invadens
KITHEGKE

SEQ ID NO: 2761501 - protein, 10 aa, Entamoeba invadens
KITKPKNEPE

SEQ ID NO: 2761502 - protein, 5 aa, Entamoeba invadens
KITPN

SEQ ID NO: 2761503 - protein, 11 aa, Entamoeba invadens
KITSRNTCDTT

SEQ ID NO: 2761504 - protein, 9 aa, Entamoeba invadens
KITTDDNNT

SEQ ID NO: 2761505 - protein, 4 aa, Entamoeba invadens
KITV

SEQ ID NO: 2761506 - protein, 6 aa, Entamoeba invadens
KIVESG

SEQ ID NO: 2761507 - protein, 14 aa, Entamoeba invadens
KIYSPTMTGSKDPV

SEQ ID NO: 2761508 - protein, 4 aa, Entamoeba invadens
KKAD

SEQ ID NO: 2761509 - protein, 9 aa, Entamoeba invadens
KKADAMSNT

SEQ ID NO: 2761510 - protein, 6 aa, Entamoeba invadens
KKADGT

SEQ ID NO: 2761511 - protein, 8 aa, Entamoeba invadens
KKAEEVEN

SEQ ID NO: 2761512 - protein, 8 aa, Entamoeba invadens
KKAEEVKD

SEQ ID NO: 2761513 - protein, 23 aa, Entamoeba invadens
KKAETKAKDVALTAADSTDTQLN

SEQ ID NO: 2761514 - protein, 8 aa, Entamoeba invadens
KKAGETRV

SEQ ID NO: 2761515 - protein, 7 aa, Entamoeba invadens
KKAGTKF

SEQ ID NO: 2761516 - protein, 9 aa, Entamoeba invadens
KKAHAHPKG

SEQ ID NO: 2761517 - protein, 8 aa, Entamoeba invadens
KKAKKAGF

SEQ ID NO: 2761518 - protein, 7 aa, Entamoeba invadens
KKAKSLK

SEQ ID NO: 2761519 - protein, 14 aa, Entamoeba invadens
KKAKTKTKKSSRDK

SEQ ID NO: 2761520 - protein, 15 aa, Entamoeba invadens
KKALDKRLPTQEEID

SEQ ID NO: 2761521 - protein, 7 aa, Entamoeba invadens
KKANPDL

SEQ ID NO: 2761522 - protein, 10 aa, Entamoeba invadens
KKANYENQGP

SEQ ID NO: 2761523 - protein, 6 aa, Entamoeba invadens
KKAQCD

SEQ ID NO: 2761524 - protein, 15 aa, Entamoeba invadens
KKASCPNKDKKMAGV

SEQ ID NO: 2761525 - protein, 6 aa, Entamoeba invadens
KKASDV

SEQ ID NO: 2761526 - protein, 15 aa, Entamoeba invadens
KKASKYQDLDNNTEK

SEQ ID NO: 2761527 - protein, 8 aa, Entamoeba invadens
KKASPNYS

SEQ ID NO: 2761528 - protein, 9 aa, Entamoeba invadens
KKASPNYSY

SEQ ID NO: 2761529 - protein, 8 aa, Entamoeba invadens
KKASSKLT

SEQ ID NO: 2761530 - protein, 17 aa, Entamoeba invadens
KKATKAPLAKAVQEKNG

SEQ ID NO: 2761531 - protein, 4 aa, Entamoeba invadens
KKAV

SEQ ID NO: 2761532 - protein, 7 aa, Entamoeba invadens
KKCDDRA

SEQ ID NO: 2761533 - protein, 7 aa, Entamoeba invadens
KKCDKCK

SEQ ID NO: 2761534 - protein, 4 aa, Entamoeba invadens
KKCE

SEQ ID NO: 2761535 - protein, 27 aa, Entamoeba invadens
KKCEDDKKGAKEKEESPSQDATKEQMK

SEQ ID NO: 2761536 - protein, 19 aa, Entamoeba invadens
KKCEKCASEYSLDSNDDCY

SEQ ID NO: 2761537 - protein, 8 aa, Entamoeba invadens
KKCENSVD

SEQ ID NO: 2761538 - protein, 6 aa, Entamoeba invadens
KKCEQC

SEQ ID NO: 2761539 - protein, 5 aa, Entamoeba invadens
KKCET

SEQ ID NO: 2761540 - protein, 6 aa, Entamoeba invadens
KKCISN

SEQ ID NO: 2761541 - protein, 9 aa, Entamoeba invadens
KKCKKDNYE

SEQ ID NO: 2761542 - protein, 18 aa, Entamoeba invadens
KKCKTGCSKCSDANTCTG

SEQ ID NO: 2761543 - protein, 9 aa, Entamoeba invadens
KKCNSKSCE

SEQ ID NO: 2761544 - protein, 14 aa, Entamoeba invadens
KKCNTTCSTCEDDE

SEQ ID NO: 2761545 - protein, 5 aa, Entamoeba invadens
KKCPP

SEQ ID NO: 2761546 - protein, 5 aa, Entamoeba invadens
KKCQY

SEQ ID NO: 2761547 - protein, 4 aa, Entamoeba invadens
KKCS

SEQ ID NO: 2761548 - protein, 11 aa, Entamoeba invadens
KKCSNDCPTGY

SEQ ID NO: 2761549 - protein, 14 aa, Entamoeba invadens
KKCSTDGNSCSECT

SEQ ID NO: 2761550 - protein, 10 aa, Entamoeba invadens
KKCSTTTGYC

SEQ ID NO: 2761551 - protein, 6 aa, Entamoeba invadens
KKCTNI

SEQ ID NO: 2761552 - protein, 13 aa, Entamoeba invadens
KKCTTDSTCPAGY

SEQ ID NO: 2761553 - protein, 21 aa, Entamoeba invadens
KKCTTDSTCPAGYYKEETAKK

SEQ ID NO: 2761554 - protein, 21 aa, Entamoeba invadens
KKCTTNSECPSGYTKDTANKK

SEQ ID NO: 2761555 - protein, 4 aa, Entamoeba invadens
KKCV

SEQ ID NO: 2761556 - protein, 6 aa, Entamoeba invadens
KKCYEC

SEQ ID NO: 2761557 - protein, 9 aa, Entamoeba invadens
KKDASQVDN

SEQ ID NO: 2761558 - protein, 11 aa, Entamoeba invadens
KKDDASFVQNN

SEQ ID NO: 2761559 - protein, 9 aa, Entamoeba invadens
KKDDGKSYC

SEQ ID NO: 2761560 - protein, 11 aa, Entamoeba invadens
KKDDKKGQVEF

SEQ ID NO: 2761561 - protein, 8 aa, Entamoeba invadens
KKDEANIP

SEQ ID NO: 2761562 - protein, 8 aa, Entamoeba invadens
KKDEDITK

SEQ ID NO: 2761563 - protein, 10 aa, Entamoeba invadens
KKDEDNNGVA

SEQ ID NO: 2761564 - protein, 9 aa, Entamoeba invadens
KKDEEATQK

SEQ ID NO: 2761565 - protein, 8 aa, Entamoeba invadens
KKDEEIDI

SEQ ID NO: 2761566 - protein, 7 aa, Entamoeba invadens
KKDEINK

SEQ ID NO: 2761567 - protein, 8 aa, Entamoeba invadens
KKDENTCE

SEQ ID NO: 2761568 - protein, 9 aa, Entamoeba invadens
KKDETNTCE

SEQ ID NO: 2761569 - protein, 6 aa, Entamoeba invadens
KKDEVN

SEQ ID NO: 2761570 - protein, 5 aa, Entamoeba invadens
KKDFE

SEQ ID NO: 2761571 - protein, 8 aa, Entamoeba invadens
KKDFGDES

SEQ ID NO: 2761572 - protein, 7 aa, Entamoeba invadens
KKDGCYN

SEQ ID NO: 2761573 - protein, 9 aa, Entamoeba invadens
KKDGEKYDK

SEQ ID NO: 2761574 - protein, 6 aa, Entamoeba invadens
KKDGKS

SEQ ID NO: 2761575 - protein, 10 aa, Entamoeba invadens
KKDKEENGDV

SEQ ID NO: 2761576 - protein, 10 aa, Entamoeba invadens
KKDKEENGNV

SEQ ID NO: 2761577 - protein, 7 aa, Entamoeba invadens
KKDLSKE

SEQ ID NO: 2761578 - protein, 11 aa, Entamoeba invadens
KKDLSKSYQVN

SEQ ID NO: 2761579 - protein, 6 aa, Entamoeba invadens
KKDMNK

SEQ ID NO: 2761580 - protein, 7 aa, Entamoeba invadens
KKDNGPI

SEQ ID NO: 2761581 - protein, 8 aa, Entamoeba invadens
KKDNPARL

SEQ ID NO: 2761582 - protein, 7 aa, Entamoeba invadens
KKDPGDV

SEQ ID NO: 2761583 - protein, 8 aa, Entamoeba invadens
KKDPKQTI

SEQ ID NO: 2761584 - protein, 8 aa, Entamoeba invadens
KKDPLQKR

SEQ ID NO: 2761585 - protein, 6 aa, Entamoeba invadens
KKDPYV

SEQ ID NO: 2761586 - protein, 20 aa, Entamoeba invadens
KKDQAEVPPIKTDVYLLDDS

SEQ ID NO: 2761587 - protein, 10 aa, Entamoeba invadens
KKDQDETQAV

SEQ ID NO: 2761588 - protein, 8 aa, Entamoeba invadens
KKDQEGKE

SEQ ID NO: 2761589 - protein, 8 aa, Entamoeba invadens
KKDQTPLK

SEQ ID NO: 2761590 - protein, 17 aa, Entamoeba invadens
KKDSDAASESTQWDDSS

SEQ ID NO: 2761591 - protein, 5 aa, Entamoeba invadens
KKDTK

SEQ ID NO: 2761592 - protein, 9 aa, Entamoeba invadens
KKDTTFSGR

SEQ ID NO: 2761593 - protein, 14 aa, Entamoeba invadens
KKDVANTKCVEGDE

SEQ ID NO: 2761594 - protein, 5 aa, Entamoeba invadens
KKDVK

SEQ ID NO: 2761595 - protein, 6 aa, Entamoeba invadens
KKEAEK

SEQ ID NO: 2761596 - protein, 14 aa, Entamoeba invadens
KKECDPKSEGCQAN

SEQ ID NO: 2761597 - protein, 6 aa, Entamoeba invadens
KKEDMK

SEQ ID NO: 2761598 - protein, 62 aa, Entamoeba invadens
KKEEEEIESETMSSGEEDTPEETLKPFQTAEDDSVEKYESTEDVSEEHRQGGSNDWDRRDGQ

SEQ ID NO: 2761599 - protein, 12 aa, Entamoeba invadens
KKEEHLGGTIPG

SEQ ID NO: 2761600 - protein, 6 aa, Entamoeba invadens
KKEEKK

SEQ ID NO: 2761601 - protein, 10 aa, Entamoeba invadens
KKEETKRNES

SEQ ID NO: 2761602 - protein, 8 aa, Entamoeba invadens
KKEEVSTK

SEQ ID NO: 2761603 - protein, 4 aa, Entamoeba invadens
KKEF

SEQ ID NO: 2761604 - protein, 15 aa, Entamoeba invadens
KKEGDNNCDSNKNEI

SEQ ID NO: 2761605 - protein, 7 aa, Entamoeba invadens
KKEGENV

SEQ ID NO: 2761606 - protein, 8 aa, Entamoeba invadens
KKEHEKRK

SEQ ID NO: 2761607 - protein, 14 aa, Entamoeba invadens
KKEIKNNDDDEFTK

SEQ ID NO: 2761608 - protein, 8 aa, Entamoeba invadens
KKEIKTET

SEQ ID NO: 2761609 - protein, 12 aa, Entamoeba invadens
KKEITKETQTNI

SEQ ID NO: 2761610 - protein, 4 aa, Entamoeba invadens
KKEK

SEQ ID NO: 2761611 - protein, 7 aa, Entamoeba invadens
KKEKTLT

SEQ ID NO: 2761612 - protein, 24 aa, Entamoeba invadens
KKEKVEKVQNEQASGYSIMNNSSE

SEQ ID NO: 2761613 - protein, 9 aa, Entamoeba invadens
KKEKYGGME

SEQ ID NO: 2761614 - protein, 6 aa, Entamoeba invadens
KKELCE

SEQ ID NO: 2761615 - protein, 6 aa, Entamoeba invadens
KKELDD

SEQ ID NO: 2761616 - protein, 29 aa, Entamoeba invadens
KKELEENKTKIEELKKDGEGHDAAKKECI

SEQ ID NO: 2761617 - protein, 8 aa, Entamoeba invadens
KKELPTEG

SEQ ID NO: 2761618 - protein, 8 aa, Entamoeba invadens
KKELRNSY

SEQ ID NO: 2761619 - protein, 13 aa, Entamoeba invadens
KKEMDSVYSSTKT

SEQ ID NO: 2761620 - protein, 11 aa, Entamoeba invadens
KKEMNKDDEKR

SEQ ID NO: 2761621 - protein, 7 aa, Entamoeba invadens
KKENKDN

SEQ ID NO: 2761622 - protein, 13 aa, Entamoeba invadens
KKENNNNNNTYPI

SEQ ID NO: 2761623 - protein, 8 aa, Entamoeba invadens
KKENPDLI

SEQ ID NO: 2761624 - protein, 25 aa, Entamoeba invadens
KKENSTGRLSGRLAADATKLNGVTG

SEQ ID NO: 2761625 - protein, 14 aa, Entamoeba invadens
KKENTNALQNSSDK

SEQ ID NO: 2761626 - protein, 11 aa, Entamoeba invadens
KKENTNTLQNL

SEQ ID NO: 2761627 - protein, 9 aa, Entamoeba invadens
KKEPSKEEN

SEQ ID NO: 2761628 - protein, 9 aa, Entamoeba invadens
KKEQKGGRN

SEQ ID NO: 2761629 - protein, 7 aa, Entamoeba invadens
KKERHRL

SEQ ID NO: 2761630 - protein, 9 aa, Entamoeba invadens
KKERKDKGV

SEQ ID NO: 2761631 - protein, 15 aa, Entamoeba invadens
KKERKKNAGKDMTQS

SEQ ID NO: 2761632 - protein, 10 aa, Entamoeba invadens
KKERNKNTKI

SEQ ID NO: 2761633 - protein, 7 aa, Entamoeba invadens
KKESAIN

SEQ ID NO: 2761634 - protein, 5 aa, Entamoeba invadens
KKESE

SEQ ID NO: 2761635 - protein, 22 aa, Entamoeba invadens
KKESHESESVTENKSTLAESEK

SEQ ID NO: 2761636 - protein, 8 aa, Entamoeba invadens
KKETEEEN

SEQ ID NO: 2761637 - protein, 10 aa, Entamoeba invadens
KKETIKKNGY

SEQ ID NO: 2761638 - protein, 10 aa, Entamoeba invadens
KKETKRPTFK

SEQ ID NO: 2761639 - protein, 6 aa, Entamoeba invadens
KKETNV

SEQ ID NO: 2761640 - protein, 4 aa, Entamoeba invadens
KKEV

SEQ ID NO: 2761641 - protein, 7 aa, Entamoeba invadens
KKEVESE

SEQ ID NO: 2761642 - protein, 7 aa, Entamoeba invadens
KKEVTSE

SEQ ID NO: 2761643 - protein, 6 aa, Entamoeba invadens
KKEYQM

SEQ ID NO: 2761644 - protein, 6 aa, Entamoeba invadens
KKEYTH

SEQ ID NO: 2761645 - protein, 8 aa, Entamoeba invadens
KKFDNDEE

SEQ ID NO: 2761646 - protein, 7 aa, Entamoeba invadens
KKFEATK

SEQ ID NO: 2761647 - protein, 8 aa, Entamoeba invadens
KKFEGPST

SEQ ID NO: 2761648 - protein, 6 aa, Entamoeba invadens
KKFNTD

SEQ ID NO: 2761649 - protein, 9 aa, Entamoeba invadens
KKFPGNEKQ

SEQ ID NO: 2761650 - protein, 7 aa, Entamoeba invadens
KKFSDEG

SEQ ID NO: 2761651 - protein, 10 aa, Entamoeba invadens
KKFSNTGSGC

SEQ ID NO: 2761652 - protein, 12 aa, Entamoeba invadens
KKFTNSSNLIWV

SEQ ID NO: 2761653 - protein, 7 aa, Entamoeba invadens
KKGADCA

SEQ ID NO: 2761654 - protein, 8 aa, Entamoeba invadens
KKGAKKGL

SEQ ID NO: 2761655 - protein, 9 aa, Entamoeba invadens
KKGDEKEKD

SEQ ID NO: 2761656 - protein, 7 aa, Entamoeba invadens
KKGDEVD

SEQ ID NO: 2761657 - protein, 7 aa, Entamoeba invadens
KKGEDIE

SEQ ID NO: 2761658 - protein, 6 aa, Entamoeba invadens
KKGENY

SEQ ID NO: 2761659 - protein, 15 aa, Entamoeba invadens
KKGEQKTTKISVTGK

SEQ ID NO: 2761660 - protein, 11 aa, Entamoeba invadens
KKGEQTTSPIK

SEQ ID NO: 2761661 - protein, 8 aa, Entamoeba invadens
KKGETKTV

SEQ ID NO: 2761662 - protein, 6 aa, Entamoeba invadens
KKGETV

SEQ ID NO: 2761663 - protein, 6 aa, Entamoeba invadens
KKGFLN

SEQ ID NO: 2761664 - protein, 7 aa, Entamoeba invadens
KKGFNTA

SEQ ID NO: 2761665 - protein, 9 aa, Entamoeba invadens
KKGFSAARP

SEQ ID NO: 2761666 - protein, 13 aa, Entamoeba invadens
KKGGVKRENIEGN

SEQ ID NO: 2761667 - protein, 16 aa, Entamoeba invadens
KKGISKKGEVINRGTR

SEQ ID NO: 2761668 - protein, 15 aa, Entamoeba invadens
KKGKERMFSGNGKPY

SEQ ID NO: 2761669 - protein, 6 aa, Entamoeba invadens
KKGKRQ

SEQ ID NO: 2761670 - protein, 11 aa, Entamoeba invadens
KKGKSEELRKR

SEQ ID NO: 2761671 - protein, 7 aa, Entamoeba invadens
KKGNSTL

SEQ ID NO: 2761672 - protein, 9 aa, Entamoeba invadens
KKGNYQHNI

SEQ ID NO: 2761673 - protein, 8 aa, Entamoeba invadens
KKGQTKKM

SEQ ID NO: 2761674 - protein, 6 aa, Entamoeba invadens
KKGSDD

SEQ ID NO: 2761675 - protein, 6 aa, Entamoeba invadens
KKGSRL

SEQ ID NO: 2761676 - protein, 7 aa, Entamoeba invadens
KKGSTTY

SEQ ID NO: 2761677 - protein, 6 aa, Entamoeba invadens
KKGSYY

SEQ ID NO: 2761678 - protein, 8 aa, Entamoeba invadens
KKGTEFEL

SEQ ID NO: 2761679 - protein, 8 aa, Entamoeba invadens
KKGTPYSG

SEQ ID NO: 2761680 - protein, 6 aa, Entamoeba invadens
KKGVIG

SEQ ID NO: 2761681 - protein, 5 aa, Entamoeba invadens
KKGVK

SEQ ID NO: 2761682 - protein, 6 aa, Entamoeba invadens
KKHNKL

SEQ ID NO: 2761683 - protein, 8 aa, Entamoeba invadens
KKHTSDEI

SEQ ID NO: 2761684 - protein, 4 aa, Entamoeba invadens
KKIC

SEQ ID NO: 2761685 - protein, 6 aa, Entamoeba invadens
KKIEDL

SEQ ID NO: 2761686 - protein, 5 aa, Entamoeba invadens
KKIEK

SEQ ID NO: 2761687 - protein, 7 aa, Entamoeba invadens
KKIGEGG

SEQ ID NO: 2761688 - protein, 8 aa, Entamoeba invadens
KKIGEGGF

SEQ ID NO: 2761689 - protein, 8 aa, Entamoeba invadens
KKIGEGSF

SEQ ID NO: 2761690 - protein, 7 aa, Entamoeba invadens
KKIGNGS

SEQ ID NO: 2761691 - protein, 7 aa, Entamoeba invadens
KKIGQGS

SEQ ID NO: 2761692 - protein, 11 aa, Entamoeba invadens
KKIGSGAFRNT

SEQ ID NO: 2761693 - protein, 4 aa, Entamoeba invadens
KKIK

SEQ ID NO: 2761694 - protein, 4 aa, Entamoeba invadens
KKIL

SEQ ID NO: 2761695 - protein, 4 aa, Entamoeba invadens
KKIP

SEQ ID NO: 2761696 - protein, 17 aa, Entamoeba invadens
KKIPPRPTGDISGNAEE

SEQ ID NO: 2761697 - protein, 6 aa, Entamoeba invadens
KKIQAK

SEQ ID NO: 2761698 - protein, 6 aa, Entamoeba invadens
KKIRDA

SEQ ID NO: 2761699 - protein, 6 aa, Entamoeba invadens
KKITIQ

SEQ ID NO: 2761700 - protein, 6 aa, Entamoeba invadens
KKIVET

SEQ ID NO: 2761701 - protein, 4 aa, Entamoeba invadens
KKKC

SEQ ID NO: 2761702 - protein, 8 aa, Entamoeba invadens
KKKDAKDV

SEQ ID NO: 2761703 - protein, 9 aa, Entamoeba invadens
KKKEELRKK

SEQ ID NO: 2761704 - protein, 7 aa, Entamoeba invadens
KKKEEMK

SEQ ID NO: 2761705 - protein, 23 aa, Entamoeba invadens
KKKEENAEEKTEEKTVETKEAKT

SEQ ID NO: 2761706 - protein, 33 aa, Entamoeba invadens
KKKEEVVQNVSNESVHQHDNVNGSVEESQDVSK

SEQ ID NO: 2761707 - protein, 8 aa, Entamoeba invadens
KKKEGVPG

SEQ ID NO: 2761708 - protein, 7 aa, Entamoeba invadens
KKKEKMK

SEQ ID NO: 2761709 - protein, 8 aa, Entamoeba invadens
KKKEKTTT

SEQ ID NO: 2761710 - protein, 8 aa, Entamoeba invadens
KKKELNEK

SEQ ID NO: 2761711 - protein, 17 aa, Entamoeba invadens
KKKENQKNEEKKEVKGV

SEQ ID NO: 2761712 - protein, 8 aa, Entamoeba invadens
KKKENVSV

SEQ ID NO: 2761713 - protein, 5 aa, Entamoeba invadens
KKKFG

SEQ ID NO: 2761714 - protein, 6 aa, Entamoeba invadens
KKKGVS

SEQ ID NO: 2761715 - protein, 6 aa, Entamoeba invadens
KKKHEK

SEQ ID NO: 2761716 - protein, 7 aa, Entamoeba invadens
KKKHFPN

SEQ ID NO: 2761717 - protein, 14 aa, Entamoeba invadens
KKKHNDDVKLKYSS

SEQ ID NO: 2761718 - protein, 28 aa, Entamoeba invadens
KKKHQKQKNLKIQPKRPQNPNNNEHPKT

SEQ ID NO: 2761719 - protein, 8 aa, Entamoeba invadens
KKKITKKL

SEQ ID NO: 2761720 - protein, 14 aa, Entamoeba invadens
KKKKESQTSGSLKE

SEQ ID NO: 2761721 - protein, 13 aa, Entamoeba invadens
KKKKTDEDKMPST

SEQ ID NO: 2761722 - protein, 9 aa, Entamoeba invadens
KKKKTEEKV

SEQ ID NO: 2761723 - protein, 18 aa, Entamoeba invadens
KKKLKEFEKNTQKEREGR

SEQ ID NO: 2761724 - protein, 18 aa, Entamoeba invadens
KKKLKNNDAEYKGLGTPI

SEQ ID NO: 2761725 - protein, 8 aa, Entamoeba invadens
KKKLTDNA

SEQ ID NO: 2761726 - protein, 13 aa, Entamoeba invadens
KKKNELGPVKAKK

SEQ ID NO: 2761727 - protein, 13 aa, Entamoeba invadens
KKKPEDKGYSKAD

SEQ ID NO: 2761728 - protein, 8 aa, Entamoeba invadens
KKKPIGSG

SEQ ID NO: 2761729 - protein, 6 aa, Entamoeba invadens
KKKPTF

SEQ ID NO: 2761730 - protein, 11 aa, Entamoeba invadens
KKKQKKKEKNI

SEQ ID NO: 2761731 - protein, 9 aa, Entamoeba invadens
KKKRRERGH

SEQ ID NO: 2761732 - protein, 8 aa, Entamoeba invadens
KKKRSYSV

SEQ ID NO: 2761733 - protein, 11 aa, Entamoeba invadens
KKKSLGNVISR

SEQ ID NO: 2761734 - protein, 8 aa, Entamoeba invadens
KKKSSDIS

SEQ ID NO: 2761735 - protein, 6 aa, Entamoeba invadens
KKKTDK

SEQ ID NO: 2761736 - protein, 7 aa, Entamoeba invadens
KKKTDQL

SEQ ID NO: 2761737 - protein, 7 aa, Entamoeba invadens
KKKTLEG

SEQ ID NO: 2761738 - protein, 8 aa, Entamoeba invadens
KKKVGDDY

SEQ ID NO: 2761739 - protein, 13 aa, Entamoeba invadens
KKKVRNNKELEEN

SEQ ID NO: 2761740 - protein, 4 aa, Entamoeba invadens
KKKY

SEQ ID NO: 2761741 - protein, 9 aa, Entamoeba invadens
KKKYKKAAD

SEQ ID NO: 2761742 - protein, 7 aa, Entamoeba invadens
KKKYNQV

SEQ ID NO: 2761743 - protein, 7 aa, Entamoeba invadens
KKLANGK

SEQ ID NO: 2761744 - protein, 17 aa, Entamoeba invadens
KKLDKKKKSETEKAERE

SEQ ID NO: 2761745 - protein, 21 aa, Entamoeba invadens
KKLEKKQGGEKQGLEKQNEEI

SEQ ID NO: 2761746 - protein, 6 aa, Entamoeba invadens
KKLEKR

SEQ ID NO: 2761747 - protein, 12 aa, Entamoeba invadens
KKLGDGAFKNTR

SEQ ID NO: 2761748 - protein, 7 aa, Entamoeba invadens
KKLGEDP

SEQ ID NO: 2761749 - protein, 9 aa, Entamoeba invadens
KKLGEDPLT

SEQ ID NO: 2761750 - protein, 8 aa, Entamoeba invadens
KKLGEGSC

SEQ ID NO: 2761751 - protein, 4 aa, Entamoeba invadens
KKLH

SEQ ID NO: 2761752 - protein, 9 aa, Entamoeba invadens
KKLKPSQIA

SEQ ID NO: 2761753 - protein, 4 aa, Entamoeba invadens
KKLN

SEQ ID NO: 2761754 - protein, 13 aa, Entamoeba invadens
KKLNAKKVKMGGM

SEQ ID NO: 2761755 - protein, 70 aa, Entamoeba invadens
KKLNDASKSDSKKDHSGSTGTGTNTKDKSVSSSEKKNTQENTDNTNTNTNTNTQEESIEASVSSQVAGDE

SEQ ID NO: 2761756 - protein, 71 aa, Entamoeba invadens
KKLNDASKSDSKKDHSGSTNTGTNTKDKSISSSEKKETAENTDNTNTNTNTNTQEESIEASVSSQVAGADE

SEQ ID NO: 2761757 - protein, 63 aa, Entamoeba invadens
KKLNDASKSDSKKEHSGSTGTNTKDKSVSSSEKKNTVGDGTNTNTQEESLEASMSSQFAGGEE

SEQ ID NO: 2761758 - protein, 8 aa, Entamoeba invadens
KKLNEGSF

SEQ ID NO: 2761759 - protein, 5 aa, Entamoeba invadens
KKLNQ

SEQ ID NO: 2761760 - protein, 7 aa, Entamoeba invadens
KKLQKEA

SEQ ID NO: 2761761 - protein, 11 aa, Entamoeba invadens
KKLSDDGLSCT

SEQ ID NO: 2761762 - protein, 16 aa, Entamoeba invadens
KKLSDECEKDFATDKT

SEQ ID NO: 2761763 - protein, 12 aa, Entamoeba invadens
KKLSGRKGVQQT

SEQ ID NO: 2761764 - protein, 13 aa, Entamoeba invadens
KKMEQLKNHPKKV

SEQ ID NO: 2761765 - protein, 5 aa, Entamoeba invadens
KKMES

SEQ ID NO: 2761766 - protein, 7 aa, Entamoeba invadens
KKMKEGN

SEQ ID NO: 2761767 - protein, 6 aa, Entamoeba invadens
KKMKER

SEQ ID NO: 2761768 - protein, 6 aa, Entamoeba invadens
KKMSGK

SEQ ID NO: 2761769 - protein, 41 aa, Entamoeba invadens
KKMSTPCSGDAKKDAKKADKKVAKKAAKKVAAKKAAKKAKK

SEQ ID NO: 2761770 - protein, 7 aa, Entamoeba invadens
KKMTHRK

SEQ ID NO: 2761771 - protein, 9 aa, Entamoeba invadens
KKMTSATNP

SEQ ID NO: 2761772 - protein, 4 aa, Entamoeba invadens
KKND

SEQ ID NO: 2761773 - protein, 14 aa, Entamoeba invadens
KKNDAEQQKSFVGK

SEQ ID NO: 2761774 - protein, 8 aa, Entamoeba invadens
KKNDDKNC

SEQ ID NO: 2761775 - protein, 6 aa, Entamoeba invadens
KKNEDY

SEQ ID NO: 2761776 - protein, 21 aa, Entamoeba invadens
KKNEEKRREARKKKKEEKMEK

SEQ ID NO: 2761777 - protein, 7 aa, Entamoeba invadens
KKNEEVN

SEQ ID NO: 2761778 - protein, 8 aa, Entamoeba invadens
KKNERVTS

SEQ ID NO: 2761779 - protein, 6 aa, Entamoeba invadens
KKNETH

SEQ ID NO: 2761780 - protein, 10 aa, Entamoeba invadens
KKNGEDGENY

SEQ ID NO: 2761781 - protein, 8 aa, Entamoeba invadens
KKNGPASR

SEQ ID NO: 2761782 - protein, 16 aa, Entamoeba invadens
KKNKKFPGNKVSTTKY

SEQ ID NO: 2761783 - protein, 16 aa, Entamoeba invadens
KKNKNERKKCSEIGNR

SEQ ID NO: 2761784 - protein, 16 aa, Entamoeba invadens
KKNKSSGTLEKGSGSI

SEQ ID NO: 2761785 - protein, 15 aa, Entamoeba invadens
KKNLSDAIQKQMKIL

SEQ ID NO: 2761786 - protein, 16 aa, Entamoeba invadens
KKNNEKNHNFNSKYET

SEQ ID NO: 2761787 - protein, 16 aa, Entamoeba invadens
KKNNIGSKKGEKKWYS

SEQ ID NO: 2761788 - protein, 14 aa, Entamoeba invadens
KKNNKSSVPDGGQF

SEQ ID NO: 2761789 - protein, 8 aa, Entamoeba invadens
KKNNNQKM

SEQ ID NO: 2761790 - protein, 7 aa, Entamoeba invadens
KKNNPKH

SEQ ID NO: 2761791 - protein, 14 aa, Entamoeba invadens
KKNNQGPYEQQMVD

SEQ ID NO: 2761792 - protein, 6 aa, Entamoeba invadens
KKNPEV

SEQ ID NO: 2761793 - protein, 8 aa, Entamoeba invadens
KKNPPESY

SEQ ID NO: 2761794 - protein, 8 aa, Entamoeba invadens
KKNQSKKS

SEQ ID NO: 2761795 - protein, 4 aa, Entamoeba invadens
KKNR

SEQ ID NO: 2761796 - protein, 7 aa, Entamoeba invadens
KKNREEK

SEQ ID NO: 2761797 - protein, 8 aa, Entamoeba invadens
KKNRVSGL

SEQ ID NO: 2761798 - protein, 4 aa, Entamoeba invadens
KKNS

SEQ ID NO: 2761799 - protein, 8 aa, Entamoeba invadens
KKNSCSKG

SEQ ID NO: 2761800 - protein, 8 aa, Entamoeba invadens
KKNSRYGA

SEQ ID NO: 2761801 - protein, 5 aa, Entamoeba invadens
KKNTE

SEQ ID NO: 2761802 - protein, 9 aa, Entamoeba invadens
KKNTEITCE

SEQ ID NO: 2761803 - protein, 13 aa, Entamoeba invadens
KKNTKDKERGLGT

SEQ ID NO: 2761804 - protein, 8 aa, Entamoeba invadens
KKNVGKGF

SEQ ID NO: 2761805 - protein, 5 aa, Entamoeba invadens
KKNYS

SEQ ID NO: 2761806 - protein, 9 aa, Entamoeba invadens
KKPDNDGKS

SEQ ID NO: 2761807 - protein, 8 aa, Entamoeba invadens
KKPEEKID

SEQ ID NO: 2761808 - protein, 12 aa, Entamoeba invadens
KKPGSTATENIQ

SEQ ID NO: 2761809 - protein, 8 aa, Entamoeba invadens
KKPKGENV

SEQ ID NO: 2761810 - protein, 6 aa, Entamoeba invadens
KKPKNL

SEQ ID NO: 2761811 - protein, 8 aa, Entamoeba invadens
KKPKSTYP

SEQ ID NO: 2761812 - protein, 4 aa, Entamoeba invadens
KKPQ

SEQ ID NO: 2761813 - protein, 7 aa, Entamoeba invadens
KKPRGRD

SEQ ID NO: 2761814 - protein, 9 aa, Entamoeba invadens
KKPRKKARL

SEQ ID NO: 2761815 - protein, 4 aa, Entamoeba invadens
KKPS

SEQ ID NO: 2761816 - protein, 5 aa, Entamoeba invadens
KKPSL

SEQ ID NO: 2761817 - protein, 7 aa, Entamoeba invadens
KKPSYAR

SEQ ID NO: 2761818 - protein, 7 aa, Entamoeba invadens
KKPTLEN

SEQ ID NO: 2761819 - protein, 5 aa, Entamoeba invadens
KKPYK

SEQ ID NO: 2761820 - protein, 8 aa, Entamoeba invadens
KKQDAPCY

SEQ ID NO: 2761821 - protein, 6 aa, Entamoeba invadens
KKQDKG

SEQ ID NO: 2761822 - protein, 13 aa, Entamoeba invadens
KKQEDNDQENTRI

SEQ ID NO: 2761823 - protein, 8 aa, Entamoeba invadens
KKQEDTVE

SEQ ID NO: 2761824 - protein, 7 aa, Entamoeba invadens
KKQELNT

SEQ ID NO: 2761825 - protein, 8 aa, Entamoeba invadens
KKQGNPVQ

SEQ ID NO: 2761826 - protein, 5 aa, Entamoeba invadens
KKQLH

SEQ ID NO: 2761827 - protein, 6 aa, Entamoeba invadens
KKQNIS

SEQ ID NO: 2761828 - protein, 8 aa, Entamoeba invadens
KKQNSNYE

SEQ ID NO: 2761829 - protein, 13 aa, Entamoeba invadens
KKQQENYNNLSNT

SEQ ID NO: 2761830 - protein, 6 aa, Entamoeba invadens
KKQQPS

SEQ ID NO: 2761831 - protein, 6 aa, Entamoeba invadens
KKQSDM

SEQ ID NO: 2761832 - protein, 7 aa, Entamoeba invadens
KKQTEGQ

SEQ ID NO: 2761833 - protein, 6 aa, Entamoeba invadens
KKQTER

SEQ ID NO: 2761834 - protein, 8 aa, Entamoeba invadens
KKQTIDEM

SEQ ID NO: 2761835 - protein, 6 aa, Entamoeba invadens
KKQTIK

SEQ ID NO: 2761836 - protein, 6 aa, Entamoeba invadens
KKRDEI

SEQ ID NO: 2761837 - protein, 9 aa, Entamoeba invadens
KKRDEIGSK

SEQ ID NO: 2761838 - protein, 6 aa, Entamoeba invadens
KKREDI

SEQ ID NO: 2761839 - protein, 17 aa, Entamoeba invadens
KKREEWAEPVNSPDKLY

SEQ ID NO: 2761840 - protein, 8 aa, Entamoeba invadens
KKREKTTT

SEQ ID NO: 2761841 - protein, 7 aa, Entamoeba invadens
KKRGEEV

SEQ ID NO: 2761842 - protein, 5 aa, Entamoeba invadens
KKRIE

SEQ ID NO: 2761843 - protein, 10 aa, Entamoeba invadens
KKRKDNNSFN

SEQ ID NO: 2761844 - protein, 57 aa, Entamoeba invadens
KKRKEEEERLQKEREEKERKEREIEEKLRQDRLEAERQAREEEEKERRQKEEEEKAI

SEQ ID NO: 2761845 - protein, 9 aa, Entamoeba invadens
KKRKKAQKE

SEQ ID NO: 2761846 - protein, 9 aa, Entamoeba invadens
KKRLNKYTG

SEQ ID NO: 2761847 - protein, 8 aa, Entamoeba invadens
KKRLSKTV

SEQ ID NO: 2761848 - protein, 8 aa, Entamoeba invadens
KKRNEEIE

SEQ ID NO: 2761849 - protein, 10 aa, Entamoeba invadens
KKRQNEKEDF

SEQ ID NO: 2761850 - protein, 9 aa, Entamoeba invadens
KKRRTAGAK

SEQ ID NO: 2761851 - protein, 10 aa, Entamoeba invadens
KKRSELPRMK

SEQ ID NO: 2761852 - protein, 6 aa, Entamoeba invadens
KKRSEN

SEQ ID NO: 2761853 - protein, 4 aa, Entamoeba invadens
KKRT

SEQ ID NO: 2761854 - protein, 9 aa, Entamoeba invadens
KKRTDSKMR

SEQ ID NO: 2761855 - protein, 11 aa, Entamoeba invadens
KKRVSCGEVSD

SEQ ID NO: 2761856 - protein, 6 aa, Entamoeba invadens
KKRYNE

SEQ ID NO: 2761857 - protein, 7 aa, Entamoeba invadens
KKRYSYL

SEQ ID NO: 2761858 - protein, 8 aa, Entamoeba invadens
KKSAEIDT

SEQ ID NO: 2761859 - protein, 7 aa, Entamoeba invadens
KKSAITA

SEQ ID NO: 2761860 - protein, 17 aa, Entamoeba invadens
KKSAITATYSGLPDSTF

SEQ ID NO: 2761861 - protein, 9 aa, Entamoeba invadens
KKSATNNHK

SEQ ID NO: 2761862 - protein, 16 aa, Entamoeba invadens
KKSCAESCKSNTFSAE

SEQ ID NO: 2761863 - protein, 6 aa, Entamoeba invadens
KKSDEI

SEQ ID NO: 2761864 - protein, 7 aa, Entamoeba invadens
KKSDEIE

SEQ ID NO: 2761865 - protein, 7 aa, Entamoeba invadens
KKSDEIN

SEQ ID NO: 2761866 - protein, 9 aa, Entamoeba invadens
KKSDENIRN

SEQ ID NO: 2761867 - protein, 6 aa, Entamoeba invadens
KKSDGL

SEQ ID NO: 2761868 - protein, 7 aa, Entamoeba invadens
KKSDTRF

SEQ ID NO: 2761869 - protein, 7 aa, Entamoeba invadens
KKSEDID

SEQ ID NO: 2761870 - protein, 7 aa, Entamoeba invadens
KKSEEIK

SEQ ID NO: 2761871 - protein, 7 aa, Entamoeba invadens
KKSEEVD

SEQ ID NO: 2761872 - protein, 7 aa, Entamoeba invadens
KKSEEVN

SEQ ID NO: 2761873 - protein, 8 aa, Entamoeba invadens
KKSEMSQN

SEQ ID NO: 2761874 - protein, 8 aa, Entamoeba invadens
KKSENECY

SEQ ID NO: 2761875 - protein, 8 aa, Entamoeba invadens
KKSENITK

SEQ ID NO: 2761876 - protein, 15 aa, Entamoeba invadens
KKSESNECERCSESS

SEQ ID NO: 2761877 - protein, 7 aa, Entamoeba invadens
KKSFSKR

SEQ ID NO: 2761878 - protein, 12 aa, Entamoeba invadens
KKSGAKIKVENG

SEQ ID NO: 2761879 - protein, 6 aa, Entamoeba invadens
KKSGEI

SEQ ID NO: 2761880 - protein, 7 aa, Entamoeba invadens
KKSGKCS

SEQ ID NO: 2761881 - protein, 11 aa, Entamoeba invadens
KKSGVTSKKIG

SEQ ID NO: 2761882 - protein, 5 aa, Entamoeba invadens
KKSIE

SEQ ID NO: 2761883 - protein, 8 aa, Entamoeba invadens
KKSIRRAT

SEQ ID NO: 2761884 - protein, 9 aa, Entamoeba invadens
KKSKLAAKV

SEQ ID NO: 2761885 - protein, 8 aa, Entamoeba invadens
KKSKNEIN

SEQ ID NO: 2761886 - protein, 7 aa, Entamoeba invadens
KKSKNFK

SEQ ID NO: 2761887 - protein, 10 aa, Entamoeba invadens
KKSKTEPMGM

SEQ ID NO: 2761888 - protein, 9 aa, Entamoeba invadens
KKSLTFDDT

SEQ ID NO: 2761889 - protein, 7 aa, Entamoeba invadens
KKSMTCN

SEQ ID NO: 2761890 - protein, 21 aa, Entamoeba invadens
KKSMTDSSDPKDQGNTRASIA

SEQ ID NO: 2761891 - protein, 4 aa, Entamoeba invadens
KKSN

SEQ ID NO: 2761892 - protein, 17 aa, Entamoeba invadens
KKSNAPGEASEKSKYQN

SEQ ID NO: 2761893 - protein, 6 aa, Entamoeba invadens
KKSNEC

SEQ ID NO: 2761894 - protein, 9 aa, Entamoeba invadens
KKSNYLDPD

SEQ ID NO: 2761895 - protein, 7 aa, Entamoeba invadens
KKSPALD

SEQ ID NO: 2761896 - protein, 5 aa, Entamoeba invadens
KKSPM

SEQ ID NO: 2761897 - protein, 11 aa, Entamoeba invadens
KKSPTEAANCS

SEQ ID NO: 2761898 - protein, 12 aa, Entamoeba invadens
KKSQNSKFEPLS

SEQ ID NO: 2761899 - protein, 7 aa, Entamoeba invadens
KKSRLEK

SEQ ID NO: 2761900 - protein, 8 aa, Entamoeba invadens
KKSRSVVT

SEQ ID NO: 2761901 - protein, 7 aa, Entamoeba invadens
KKSSALK

SEQ ID NO: 2761902 - protein, 12 aa, Entamoeba invadens
KKSSTEAANCSS

SEQ ID NO: 2761903 - protein, 10 aa, Entamoeba invadens
KKSSTLPSKV

SEQ ID NO: 2761904 - protein, 9 aa, Entamoeba invadens
KKSTAQFPE

SEQ ID NO: 2761905 - protein, 35 aa, Entamoeba invadens
KKSTEIENLETESPVNEQKTEIERTGFSENSKINE

SEQ ID NO: 2761906 - protein, 13 aa, Entamoeba invadens
KKSTSSASWEGKK

SEQ ID NO: 2761907 - protein, 7 aa, Entamoeba invadens
KKSVRSV

SEQ ID NO: 2761908 - protein, 7 aa, Entamoeba invadens
KKSYECK

SEQ ID NO: 2761909 - protein, 14 aa, Entamoeba invadens
KKSYRVKEEKINDE

SEQ ID NO: 2761910 - protein, 10 aa, Entamoeba invadens
KKTADKNPMK

SEQ ID NO: 2761911 - protein, 8 aa, Entamoeba invadens
KKTAKDNF

SEQ ID NO: 2761912 - protein, 5 aa, Entamoeba invadens
KKTAR

SEQ ID NO: 2761913 - protein, 8 aa, Entamoeba invadens
KKTCQSNN

SEQ ID NO: 2761914 - protein, 11 aa, Entamoeba invadens
KKTDGNTQSYA

SEQ ID NO: 2761915 - protein, 5 aa, Entamoeba invadens
KKTDV

SEQ ID NO: 2761916 - protein, 6 aa, Entamoeba invadens
KKTEEL

SEQ ID NO: 2761917 - protein, 6 aa, Entamoeba invadens
KKTEEV

SEQ ID NO: 2761918 - protein, 11 aa, Entamoeba invadens
KKTEEVKNPTR

SEQ ID NO: 2761919 - protein, 7 aa, Entamoeba invadens
KKTEEVN

SEQ ID NO: 2761920 - protein, 5 aa, Entamoeba invadens
KKTEL

SEQ ID NO: 2761921 - protein, 15 aa, Entamoeba invadens
KKTENDPNLKPNKKV

SEQ ID NO: 2761922 - protein, 6 aa, Entamoeba invadens
KKTGRL

SEQ ID NO: 2761923 - protein, 14 aa, Entamoeba invadens
KKTINQYLYGIYIL

SEQ ID NO: 2761924 - protein, 4 aa, Entamoeba invadens
KKTK

SEQ ID NO: 2761925 - protein, 34 aa, Entamoeba invadens
KKTKDDSSTDSIDLNDETPKKQKPAEDDEGYSDL

SEQ ID NO: 2761926 - protein, 10 aa, Entamoeba invadens
KKTKKSNTEI

SEQ ID NO: 2761927 - protein, 13 aa, Entamoeba invadens
KKTKNDPNLKPNK

SEQ ID NO: 2761928 - protein, 8 aa, Entamoeba invadens
KKTKPTKD

SEQ ID NO: 2761929 - protein, 9 aa, Entamoeba invadens
KKTKTLDVT

SEQ ID NO: 2761930 - protein, 8 aa, Entamoeba invadens
KKTKTTIT

SEQ ID NO: 2761931 - protein, 6 aa, Entamoeba invadens
KKTLFT

SEQ ID NO: 2761932 - protein, 8 aa, Entamoeba invadens
KKTLPSEG

SEQ ID NO: 2761933 - protein, 16 aa, Entamoeba invadens
KKTLSEQISQKELEKK

SEQ ID NO: 2761934 - protein, 4 aa, Entamoeba invadens
KKTQ

SEQ ID NO: 2761935 - protein, 7 aa, Entamoeba invadens
KKTQAKN

SEQ ID NO: 2761936 - protein, 14 aa, Entamoeba invadens
KKTQQQVDAFGNEG

SEQ ID NO: 2761937 - protein, 18 aa, Entamoeba invadens
KKTREEKENEEKKPRRLQ

SEQ ID NO: 2761938 - protein, 10 aa, Entamoeba invadens
KKTSEQQKER

SEQ ID NO: 2761939 - protein, 7 aa, Entamoeba invadens
KKTSGIP

SEQ ID NO: 2761940 - protein, 7 aa, Entamoeba invadens
KKTSSGC

SEQ ID NO: 2761941 - protein, 8 aa, Entamoeba invadens
KKTSSGSV

SEQ ID NO: 2761942 - protein, 4 aa, Entamoeba invadens
KKTT

SEQ ID NO: 2761943 - protein, 8 aa, Entamoeba invadens
KKTTFDPD

SEQ ID NO: 2761944 - protein, 9 aa, Entamoeba invadens
KKTTKGEAW

SEQ ID NO: 2761945 - protein, 6 aa, Entamoeba invadens
KKTTSE

SEQ ID NO: 2761946 - protein, 13 aa, Entamoeba invadens
KKTTSSRDRYSRV

SEQ ID NO: 2761947 - protein, 15 aa, Entamoeba invadens
KKTTYRKRALQSADT

SEQ ID NO: 2761948 - protein, 15 aa, Entamoeba invadens
KKTVEKEKTENGGCE

SEQ ID NO: 2761949 - protein, 6 aa, Entamoeba invadens
KKTVKG

SEQ ID NO: 2761950 - protein, 10 aa, Entamoeba invadens
KKTYNKKSSL

SEQ ID NO: 2761951 - protein, 9 aa, Entamoeba invadens
KKVEEVTDR

SEQ ID NO: 2761952 - protein, 7 aa, Entamoeba invadens
KKVGEGS

SEQ ID NO: 2761953 - protein, 9 aa, Entamoeba invadens
KKVGETDDT

SEQ ID NO: 2761954 - protein, 11 aa, Entamoeba invadens
KKVGGDELSCE

SEQ ID NO: 2761955 - protein, 28 aa, Entamoeba invadens
KKVGGECTSCASNGNCNSCDSDENESNR

SEQ ID NO: 2761956 - protein, 22 aa, Entamoeba invadens
KKVGTIEGDGDENSWKMASGKS

SEQ ID NO: 2761957 - protein, 6 aa, Entamoeba invadens
KKVNDT

SEQ ID NO: 2761958 - protein, 16 aa, Entamoeba invadens
KKVNEEKEKANNAKIA

SEQ ID NO: 2761959 - protein, 20 aa, Entamoeba invadens
KKVNSKNDVEAPKEMVMNVE

SEQ ID NO: 2761960 - protein, 6 aa, Entamoeba invadens
KKVPET

SEQ ID NO: 2761961 - protein, 7 aa, Entamoeba invadens
KKVSIDG

SEQ ID NO: 2761962 - protein, 13 aa, Entamoeba invadens
KKVSNYKTKDNNK

SEQ ID NO: 2761963 - protein, 8 aa, Entamoeba invadens
KKVSTNKP

SEQ ID NO: 2761964 - protein, 8 aa, Entamoeba invadens
KKVTEKRR

SEQ ID NO: 2761965 - protein, 6 aa, Entamoeba invadens
KKVVEG

SEQ ID NO: 2761966 - protein, 11 aa, Entamoeba invadens
KKVVSGSGKKR

SEQ ID NO: 2761967 - protein, 13 aa, Entamoeba invadens
KKWGGTTVAATSR

SEQ ID NO: 2761968 - protein, 14 aa, Entamoeba invadens
KKWQAYTPDHNPNK

SEQ ID NO: 2761969 - protein, 11 aa, Entamoeba invadens
KKYDRERSGAI

SEQ ID NO: 2761970 - protein, 9 aa, Entamoeba invadens
KKYEGKSSY

SEQ ID NO: 2761971 - protein, 9 aa, Entamoeba invadens
KKYETPAQR

SEQ ID NO: 2761972 - protein, 4 aa, Entamoeba invadens
KKYF

SEQ ID NO: 2761973 - protein, 11 aa, Entamoeba invadens
KKYGDKIRRER

SEQ ID NO: 2761974 - protein, 5 aa, Entamoeba invadens
KKYGN

SEQ ID NO: 2761975 - protein, 13 aa, Entamoeba invadens
KKYIEKRTEERNC

SEQ ID NO: 2761976 - protein, 8 aa, Entamoeba invadens
KKYKEPAD

SEQ ID NO: 2761977 - protein, 8 aa, Entamoeba invadens
KKYKKAAD

SEQ ID NO: 2761978 - protein, 9 aa, Entamoeba invadens
KKYKKPEDI

SEQ ID NO: 2761979 - protein, 8 aa, Entamoeba invadens
KKYKTASD

SEQ ID NO: 2761980 - protein, 8 aa, Entamoeba invadens
KKYKTPAD

SEQ ID NO: 2761981 - protein, 8 aa, Entamoeba invadens
KKYKTSAD

SEQ ID NO: 2761982 - protein, 6 aa, Entamoeba invadens
KKYPES

SEQ ID NO: 2761983 - protein, 8 aa, Entamoeba invadens
KKYPQDSE

SEQ ID NO: 2761984 - protein, 14 aa, Entamoeba invadens
KKYQNNLKKEEEGL

SEQ ID NO: 2761985 - protein, 5 aa, Entamoeba invadens
KKYQS

SEQ ID NO: 2761986 - protein, 6 aa, Entamoeba invadens
KKYSEK

SEQ ID NO: 2761987 - protein, 13 aa, Entamoeba invadens
KKYSKQIAEMFQK

SEQ ID NO: 2761988 - protein, 8 aa, Entamoeba invadens
KKYSNTSL

SEQ ID NO: 2761989 - protein, 7 aa, Entamoeba invadens
KKYSSAF

SEQ ID NO: 2761990 - protein, 7 aa, Entamoeba invadens
KKYSTNE

SEQ ID NO: 2761991 - protein, 9 aa, Entamoeba invadens
KKYSTPSQR

SEQ ID NO: 2761992 - protein, 6 aa, Entamoeba invadens
KKYSYK

SEQ ID NO: 2761993 - protein, 9 aa, Entamoeba invadens
KKYTQDQPE

SEQ ID NO: 2761994 - protein, 6 aa, Entamoeba invadens
KKYTTY

SEQ ID NO: 2761995 - protein, 7 aa, Entamoeba invadens
KKYVKGH

SEQ ID NO: 2761996 - protein, 8 aa, Entamoeba invadens
KLAGEVDN

SEQ ID NO: 2761997 - protein, 8 aa, Entamoeba invadens
KLAKKEQN

SEQ ID NO: 2761998 - protein, 8 aa, Entamoeba invadens
KLAPINTS

SEQ ID NO: 2761999 - protein, 7 aa, Entamoeba invadens
KLAQGTC

SEQ ID NO: 2762000 - protein, 10 aa, Entamoeba invadens
KLDDAENGLR

SEQ ID NO: 2762001 - protein, 7 aa, Entamoeba invadens
KLDGTDL

SEQ ID NO: 2762002 - protein, 8 aa, Entamoeba invadens
KLDKDNLK

SEQ ID NO: 2762003 - protein, 20 aa, Entamoeba invadens
KLDPQSSSFSNSTTKGSVGW

SEQ ID NO: 2762004 - protein, 19 aa, Entamoeba invadens
KLDSIEQREKEGEVGQPNG

SEQ ID NO: 2762005 - protein, 13 aa, Entamoeba invadens
KLDTEGCDGGCNC

SEQ ID NO: 2762006 - protein, 11 aa, Entamoeba invadens
KLDTKTSEMTN

SEQ ID NO: 2762007 - protein, 14 aa, Entamoeba invadens
KLDTSVKSDEAQEF

SEQ ID NO: 2762008 - protein, 6 aa, Entamoeba invadens
KLEAKG

SEQ ID NO: 2762009 - protein, 18 aa, Entamoeba invadens
KLEDTKPKDDKPQETGSV

SEQ ID NO: 2762010 - protein, 10 aa, Entamoeba invadens
KLEDTKPKKM

SEQ ID NO: 2762011 - protein, 8 aa, Entamoeba invadens
KLEEEKSE

SEQ ID NO: 2762012 - protein, 10 aa, Entamoeba invadens
KLEEMGDTRY

SEQ ID NO: 2762013 - protein, 5 aa, Entamoeba invadens
KLEER

SEQ ID NO: 2762014 - protein, 5 aa, Entamoeba invadens
KLEET

SEQ ID NO: 2762015 - protein, 8 aa, Entamoeba invadens
KLEETQQE

SEQ ID NO: 2762016 - protein, 8 aa, Entamoeba invadens
KLEGEDDV

SEQ ID NO: 2762017 - protein, 8 aa, Entamoeba invadens
KLEKKERN

SEQ ID NO: 2762018 - protein, 13 aa, Entamoeba invadens
KLEKSKDFKDTSV

SEQ ID NO: 2762019 - protein, 13 aa, Entamoeba invadens
KLELSSEDSYRPI

SEQ ID NO: 2762020 - protein, 10 aa, Entamoeba invadens
KLENSKKQLE

SEQ ID NO: 2762021 - protein, 10 aa, Entamoeba invadens
KLETNGSLTG

SEQ ID NO: 2762022 - protein, 11 aa, Entamoeba invadens
KLGDGAFKNTR

SEQ ID NO: 2762023 - protein, 7 aa, Entamoeba invadens
KLGDSGL

SEQ ID NO: 2762024 - protein, 5 aa, Entamoeba invadens
KLGEG

SEQ ID NO: 2762025 - protein, 6 aa, Entamoeba invadens
KLGEGT

SEQ ID NO: 2762026 - protein, 7 aa, Entamoeba invadens
KLGEYTK

SEQ ID NO: 2762027 - protein, 11 aa, Entamoeba invadens
KLGGGDPLDYK

SEQ ID NO: 2762028 - protein, 7 aa, Entamoeba invadens
KLGGNTV

SEQ ID NO: 2762029 - protein, 23 aa, Entamoeba invadens
KLGGYENKKKIDKLNKDKEDINQ

SEQ ID NO: 2762030 - protein, 16 aa, Entamoeba invadens
KLGKNSCAVGDGGNDV

SEQ ID NO: 2762031 - protein, 7 aa, Entamoeba invadens
KLGLPGD

SEQ ID NO: 2762032 - protein, 6 aa, Entamoeba invadens
KLGSPN

SEQ ID NO: 2762033 - protein, 7 aa, Entamoeba invadens
KLGTTKT

SEQ ID NO: 2762034 - protein, 10 aa, Entamoeba invadens
KLKDGSGNGY

SEQ ID NO: 2762035 - protein, 12 aa, Entamoeba invadens
KLKEKQNSVPRH

SEQ ID NO: 2762036 - protein, 25 aa, Entamoeba invadens
KLKEQNDQYEVDYTNGTLSEVTPSE

SEQ ID NO: 2762037 - protein, 25 aa, Entamoeba invadens
KLKERQEKNNHKFDKEEKEETYQSD

SEQ ID NO: 2762038 - protein, 43 aa, Entamoeba invadens
KLKESEERCKKLENEKEKTEKERKNTEEQKNKEKEDNSKNLEK

SEQ ID NO: 2762039 - protein, 10 aa, Entamoeba invadens
KLKKTKKGFT

SEQ ID NO: 2762040 - protein, 8 aa, Entamoeba invadens
KLKNGKSC

SEQ ID NO: 2762041 - protein, 6 aa, Entamoeba invadens
KLKNNT

SEQ ID NO: 2762042 - protein, 19 aa, Entamoeba invadens
KLKPTPETKKEADADSEKF

SEQ ID NO: 2762043 - protein, 11 aa, Entamoeba invadens
KLKQDDVDERS

SEQ ID NO: 2762044 - protein, 5 aa, Entamoeba invadens
KLKRS

SEQ ID NO: 2762045 - protein, 7 aa, Entamoeba invadens
KLKSYKP

SEQ ID NO: 2762046 - protein, 29 aa, Entamoeba invadens
KLLSSDTEKSETDIQYNEKSPEIRVGDET

SEQ ID NO: 2762047 - protein, 4 aa, Entamoeba invadens
KLNA

SEQ ID NO: 2762048 - protein, 9 aa, Entamoeba invadens
KLNASDASA

SEQ ID NO: 2762049 - protein, 19 aa, Entamoeba invadens
KLNDESEKHPKGKEEREKL

SEQ ID NO: 2762050 - protein, 7 aa, Entamoeba invadens
KLNEENY

SEQ ID NO: 2762051 - protein, 4 aa, Entamoeba invadens
KLNG

SEQ ID NO: 2762052 - protein, 9 aa, Entamoeba invadens
KLNKETGKL

SEQ ID NO: 2762053 - protein, 8 aa, Entamoeba invadens
KLNKPTSI

SEQ ID NO: 2762054 - protein, 10 aa, Entamoeba invadens
KLNRMGAQNL

SEQ ID NO: 2762055 - protein, 14 aa, Entamoeba invadens
KLNSKEECDNGTNC

SEQ ID NO: 2762056 - protein, 7 aa, Entamoeba invadens
KLNTSKN

SEQ ID NO: 2762057 - protein, 9 aa, Entamoeba invadens
KLPDDNVES

SEQ ID NO: 2762058 - protein, 13 aa, Entamoeba invadens
KLPDEKPEEMAEM

SEQ ID NO: 2762059 - protein, 6 aa, Entamoeba invadens
KLPDGE

SEQ ID NO: 2762060 - protein, 14 aa, Entamoeba invadens
KLPDGNSTGQGCGS

SEQ ID NO: 2762061 - protein, 14 aa, Entamoeba invadens
KLPEGISVGHDESS

SEQ ID NO: 2762062 - protein, 6 aa, Entamoeba invadens
KLPGHK

SEQ ID NO: 2762063 - protein, 6 aa, Entamoeba invadens
KLPKEA

SEQ ID NO: 2762064 - protein, 11 aa, Entamoeba invadens
KLPNEKSRNCQ

SEQ ID NO: 2762065 - protein, 5 aa, Entamoeba invadens
KLPNT

SEQ ID NO: 2762066 - protein, 6 aa, Entamoeba invadens
KLPPTS

SEQ ID NO: 2762067 - protein, 11 aa, Entamoeba invadens
KLPQEKIPDEN

SEQ ID NO: 2762068 - protein, 9 aa, Entamoeba invadens
KLPRKSSED

SEQ ID NO: 2762069 - protein, 7 aa, Entamoeba invadens
KLPTGGG

SEQ ID NO: 2762070 - protein, 8 aa, Entamoeba invadens
KLPTYRSE

SEQ ID NO: 2762071 - protein, 4 aa, Entamoeba invadens
KLQD

SEQ ID NO: 2762072 - protein, 8 aa, Entamoeba invadens
KLQDGVPE

SEQ ID NO: 2762073 - protein, 7 aa, Entamoeba invadens
KLQEDKK

SEQ ID NO: 2762074 - protein, 66 aa, Entamoeba invadens
KLQHDDSSKEEEETSDLEEDKKEDKEKFASSDSSEKAVSEEDKKSDKSSSSKEEPNQEPFKAENAT

SEQ ID NO: 2762075 - protein, 23 aa, Entamoeba invadens
KLQNEKTTKMYTKGASCANGTYL

SEQ ID NO: 2762076 - protein, 8 aa, Entamoeba invadens
KLQPNGND

SEQ ID NO: 2762077 - protein, 20 aa, Entamoeba invadens
KLQSSPKDLTDKVKDEISKY

SEQ ID NO: 2762078 - protein, 7 aa, Entamoeba invadens
KLQTKQH

SEQ ID NO: 2762079 - protein, 9 aa, Entamoeba invadens
KLREGESSI

SEQ ID NO: 2762080 - protein, 11 aa, Entamoeba invadens
KLRKRKKQSNV

SEQ ID NO: 2762081 - protein, 4 aa, Entamoeba invadens
KLRL

SEQ ID NO: 2762082 - protein, 4 aa, Entamoeba invadens
KLSD

SEQ ID NO: 2762083 - protein, 11 aa, Entamoeba invadens
KLSDEKEKLQT

SEQ ID NO: 2762084 - protein, 14 aa, Entamoeba invadens
KLSDFGSSRNVNRA

SEQ ID NO: 2762085 - protein, 8 aa, Entamoeba invadens
KLSDFGTA

SEQ ID NO: 2762086 - protein, 4 aa, Entamoeba invadens
KLSE

SEQ ID NO: 2762087 - protein, 21 aa, Entamoeba invadens
KLSEDKTKCYSTCPNGTYVSG

SEQ ID NO: 2762088 - protein, 9 aa, Entamoeba invadens
KLSERDPFP

SEQ ID NO: 2762089 - protein, 16 aa, Entamoeba invadens
KLSFNDDDENIKVGDY

SEQ ID NO: 2762090 - protein, 7 aa, Entamoeba invadens
KLSGDSI

SEQ ID NO: 2762091 - protein, 6 aa, Entamoeba invadens
KLSGKQ

SEQ ID NO: 2762092 - protein, 12 aa, Entamoeba invadens
KLSKRTVPFFCF

SEQ ID NO: 2762093 - protein, 10 aa, Entamoeba invadens
KLSMSNNSNF

SEQ ID NO: 2762094 - protein, 8 aa, Entamoeba invadens
KLSNKGTT

SEQ ID NO: 2762095 - protein, 4 aa, Entamoeba invadens
KLSR

SEQ ID NO: 2762096 - protein, 12 aa, Entamoeba invadens
KLSSTSSAQNIV

SEQ ID NO: 2762097 - protein, 9 aa, Entamoeba invadens
KLSSYYSNQ

SEQ ID NO: 2762098 - protein, 6 aa, Entamoeba invadens
KLSTAQ

SEQ ID NO: 2762099 - protein, 11 aa, Entamoeba invadens
KLTATSSENPH

SEQ ID NO: 2762100 - protein, 10 aa, Entamoeba invadens
KLTDDDEPPV

SEQ ID NO: 2762101 - protein, 8 aa, Entamoeba invadens
KLTDFGAS

SEQ ID NO: 2762102 - protein, 9 aa, Entamoeba invadens
KLTDFGASR

SEQ ID NO: 2762103 - protein, 11 aa, Entamoeba invadens
KLTDFGTSRNI

SEQ ID NO: 2762104 - protein, 8 aa, Entamoeba invadens
KLTDSKYK

SEQ ID NO: 2762105 - protein, 6 aa, Entamoeba invadens
KLTGDG

SEQ ID NO: 2762106 - protein, 7 aa, Entamoeba invadens
KLTGDGT

SEQ ID NO: 2762107 - protein, 4 aa, Entamoeba invadens
KLTK

SEQ ID NO: 2762108 - protein, 8 aa, Entamoeba invadens
KLTPKGVG

SEQ ID NO: 2762109 - protein, 8 aa, Entamoeba invadens
KLTQISTS

SEQ ID NO: 2762110 - protein, 10 aa, Entamoeba invadens
KLTRKSNDPY

SEQ ID NO: 2762111 - protein, 19 aa, Entamoeba invadens
KLTSIEQREKEGEVGQPNG

SEQ ID NO: 2762112 - protein, 6 aa, Entamoeba invadens
KLTTND

SEQ ID NO: 2762113 - protein, 5 aa, Entamoeba invadens
KLTTQ

SEQ ID NO: 2762114 - protein, 21 aa, Entamoeba invadens
KLTTRLDPDELKEDVKLGEGS

SEQ ID NO: 2762115 - protein, 8 aa, Entamoeba invadens
KLVNTTKP

SEQ ID NO: 2762116 - protein, 4 aa, Entamoeba invadens
KLYR

SEQ ID NO: 2762117 - protein, 8 aa, Entamoeba invadens
KMDANGNY

SEQ ID NO: 2762118 - protein, 9 aa, Entamoeba invadens
KMDKTNKHW

SEQ ID NO: 2762119 - protein, 6 aa, Entamoeba invadens
KMETAV

SEQ ID NO: 2762120 - protein, 4 aa, Entamoeba invadens
KMGD

SEQ ID NO: 2762121 - protein, 10 aa, Entamoeba invadens
KMGDDQKETI

SEQ ID NO: 2762122 - protein, 6 aa, Entamoeba invadens
KMGKGK

SEQ ID NO: 2762123 - protein, 6 aa, Entamoeba invadens
KMGNPQ

SEQ ID NO: 2762124 - protein, 6 aa, Entamoeba invadens
KMGSVR

SEQ ID NO: 2762125 - protein, 6 aa, Entamoeba invadens
KMKEET

SEQ ID NO: 2762126 - protein, 52 aa, Entamoeba invadens
KMKEKQKGIKNEEKKEDSIGKMEEPHSTTENNLKRGEEKSENVIDTHEEKQC

SEQ ID NO: 2762127 - protein, 10 aa, Entamoeba invadens
KMKKEANEVT

SEQ ID NO: 2762128 - protein, 17 aa, Entamoeba invadens
KMKNSGDINEENDEFTK

SEQ ID NO: 2762129 - protein, 11 aa, Entamoeba invadens
KMKTEKVQAEL

SEQ ID NO: 2762130 - protein, 11 aa, Entamoeba invadens
KMKTPSGKCVQ

SEQ ID NO: 2762131 - protein, 5 aa, Entamoeba invadens
KMKVN

SEQ ID NO: 2762132 - protein, 11 aa, Entamoeba invadens
KMNEGKEGNLQ

SEQ ID NO: 2762133 - protein, 6 aa, Entamoeba invadens
KMNNQN

SEQ ID NO: 2762134 - protein, 12 aa, Entamoeba invadens
KMPAEKKEGNLP

SEQ ID NO: 2762135 - protein, 9 aa, Entamoeba invadens
KMPESISKS

SEQ ID NO: 2762136 - protein, 6 aa, Entamoeba invadens
KMPIGG

SEQ ID NO: 2762137 - protein, 5 aa, Entamoeba invadens
KMPKT

SEQ ID NO: 2762138 - protein, 6 aa, Entamoeba invadens
KMPNNV

SEQ ID NO: 2762139 - protein, 12 aa, Entamoeba invadens
KMPNTQKLNNSD

SEQ ID NO: 2762140 - protein, 13 aa, Entamoeba invadens
KMPPLDDRIPKDL

SEQ ID NO: 2762141 - protein, 12 aa, Entamoeba invadens
KMPVDSKPFANN

SEQ ID NO: 2762142 - protein, 10 aa, Entamoeba invadens
KMQKDENKKE

SEQ ID NO: 2762143 - protein, 13 aa, Entamoeba invadens
KMQQSSETTESSS

SEQ ID NO: 2762144 - protein, 8 aa, Entamoeba invadens
KMSKEKSG

SEQ ID NO: 2762145 - protein, 6 aa, Entamoeba invadens
KMSKRT

SEQ ID NO: 2762146 - protein, 7 aa, Entamoeba invadens
KMSNGES

SEQ ID NO: 2762147 - protein, 5 aa, Entamoeba invadens
KMSTN

SEQ ID NO: 2762148 - protein, 11 aa, Entamoeba invadens
KMTAETKTENY

SEQ ID NO: 2762149 - protein, 9 aa, Entamoeba invadens
KMTESLNED

SEQ ID NO: 2762150 - protein, 7 aa, Entamoeba invadens
KMTETSN

SEQ ID NO: 2762151 - protein, 13 aa, Entamoeba invadens
KMTNEAVTDEIAK

SEQ ID NO: 2762152 - protein, 9 aa, Entamoeba invadens
KMTQTPPNR

SEQ ID NO: 2762153 - protein, 7 aa, Entamoeba invadens
KMTSADQ

SEQ ID NO: 2762154 - protein, 8 aa, Entamoeba invadens
KMTTKRGS

SEQ ID NO: 2762155 - protein, 12 aa, Entamoeba invadens
KNADKKREKRTI

SEQ ID NO: 2762156 - protein, 11 aa, Entamoeba invadens
KNAEDEEKRKI

SEQ ID NO: 2762157 - protein, 8 aa, Entamoeba invadens
KNAEQTEH

SEQ ID NO: 2762158 - protein, 4 aa, Entamoeba invadens
KNAG

SEQ ID NO: 2762159 - protein, 6 aa, Entamoeba invadens
KNAGSC

SEQ ID NO: 2762160 - protein, 15 aa, Entamoeba invadens
KNALRRNNSLPHETE

SEQ ID NO: 2762161 - protein, 5 aa, Entamoeba invadens
KNALT

SEQ ID NO: 2762162 - protein, 14 aa, Entamoeba invadens
KNANANNLLSKLDR

SEQ ID NO: 2762163 - protein, 7 aa, Entamoeba invadens
KNANENV

SEQ ID NO: 2762164 - protein, 13 aa, Entamoeba invadens
KNANGKNITCESC

SEQ ID NO: 2762165 - protein, 8 aa, Entamoeba invadens
KNANHGIA

SEQ ID NO: 2762166 - protein, 25 aa, Entamoeba invadens
KNANRTEESESEETESDEAIQVYDE

SEQ ID NO: 2762167 - protein, 13 aa, Entamoeba invadens
KNANTTKQALDEF

SEQ ID NO: 2762168 - protein, 10 aa, Entamoeba invadens
KNAPLEDSSD

SEQ ID NO: 2762169 - protein, 12 aa, Entamoeba invadens
KNAQATKQAIEE

SEQ ID NO: 2762170 - protein, 13 aa, Entamoeba invadens
KNAQATKSAIDEF

SEQ ID NO: 2762171 - protein, 13 aa, Entamoeba invadens
KNAQATKSAVDEF

SEQ ID NO: 2762172 - protein, 8 aa, Entamoeba invadens
KNAQKQSL

SEQ ID NO: 2762173 - protein, 17 aa, Entamoeba invadens
KNAQLTYSQRQKPTLPK

SEQ ID NO: 2762174 - protein, 14 aa, Entamoeba invadens
KNAQMKGTDLSDFE

SEQ ID NO: 2762175 - protein, 8 aa, Entamoeba invadens
KNAQSSNE

SEQ ID NO: 2762176 - protein, 4 aa, Entamoeba invadens
KNAS

SEQ ID NO: 2762177 - protein, 6 aa, Entamoeba invadens
KNASSY

SEQ ID NO: 2762178 - protein, 4 aa, Entamoeba invadens
KNAT

SEQ ID NO: 2762179 - protein, 12 aa, Entamoeba invadens
KNATDAKDQMAE

SEQ ID NO: 2762180 - protein, 5 aa, Entamoeba invadens
KNATR

SEQ ID NO: 2762181 - protein, 6 aa, Entamoeba invadens
KNATRK

SEQ ID NO: 2762182 - protein, 21 aa, Entamoeba invadens
KNATSPNEKCTTAKDISQFPT

SEQ ID NO: 2762183 - protein, 11 aa, Entamoeba invadens
KNCASASSSVC

SEQ ID NO: 2762184 - protein, 9 aa, Entamoeba invadens
KNCEAGDRL

SEQ ID NO: 2762185 - protein, 13 aa, Entamoeba invadens
KNCEGGKCKKCDE

SEQ ID NO: 2762186 - protein, 13 aa, Entamoeba invadens
KNCEGGKCKKCSK

SEQ ID NO: 2762187 - protein, 11 aa, Entamoeba invadens
KNCETYDTNGK

SEQ ID NO: 2762188 - protein, 6 aa, Entamoeba invadens
KNCFND

SEQ ID NO: 2762189 - protein, 13 aa, Entamoeba invadens
KNCGRCKQDENKC

SEQ ID NO: 2762190 - protein, 6 aa, Entamoeba invadens
KNCGTS

SEQ ID NO: 2762191 - protein, 14 aa, Entamoeba invadens
KNCKECDSTTGECS

SEQ ID NO: 2762192 - protein, 9 aa, Entamoeba invadens
KNCNGQNGI

SEQ ID NO: 2762193 - protein, 8 aa, Entamoeba invadens
KNCPNKQE

SEQ ID NO: 2762194 - protein, 6 aa, Entamoeba invadens
KNCSDN

SEQ ID NO: 2762195 - protein, 13 aa, Entamoeba invadens
KNCSESCSTCNNA

SEQ ID NO: 2762196 - protein, 6 aa, Entamoeba invadens
KNCSGT

SEQ ID NO: 2762197 - protein, 10 aa, Entamoeba invadens
KNCTTNDPNC

SEQ ID NO: 2762198 - protein, 6 aa, Entamoeba invadens
KNDCNM

SEQ ID NO: 2762199 - protein, 9 aa, Entamoeba invadens
KNDDINNST

SEQ ID NO: 2762200 - protein, 7 aa, Entamoeba invadens
KNDDNCE

SEQ ID NO: 2762201 - protein, 8 aa, Entamoeba invadens
KNDDTNCK

SEQ ID NO: 2762202 - protein, 32 aa, Entamoeba invadens
KNDEAERKNAELQKKVENEQEKIKELEKTYDE

SEQ ID NO: 2762203 - protein, 8 aa, Entamoeba invadens
KNDEEFEN

SEQ ID NO: 2762204 - protein, 7 aa, Entamoeba invadens
KNDENVD

SEQ ID NO: 2762205 - protein, 8 aa, Entamoeba invadens
KNDGVVSG

SEQ ID NO: 2762206 - protein, 5 aa, Entamoeba invadens
KNDPT

SEQ ID NO: 2762207 - protein, 10 aa, Entamoeba invadens
KNDQTKNNGC

SEQ ID NO: 2762208 - protein, 7 aa, Entamoeba invadens
KNDRCTK

SEQ ID NO: 2762209 - protein, 5 aa, Entamoeba invadens
KNDSE

SEQ ID NO: 2762210 - protein, 5 aa, Entamoeba invadens
KNDTF

SEQ ID NO: 2762211 - protein, 9 aa, Entamoeba invadens
KNDTQNTIS

SEQ ID NO: 2762212 - protein, 18 aa, Entamoeba invadens
KNDYDASNSCTGTPSNII

SEQ ID NO: 2762213 - protein, 7 aa, Entamoeba invadens
KNEARVK

SEQ ID NO: 2762214 - protein, 6 aa, Entamoeba invadens
KNECKN

SEQ ID NO: 2762215 - protein, 6 aa, Entamoeba invadens
KNECQG

SEQ ID NO: 2762216 - protein, 7 aa, Entamoeba invadens
KNECQPY

SEQ ID NO: 2762217 - protein, 6 aa, Entamoeba invadens
KNEDRK

SEQ ID NO: 2762218 - protein, 9 aa, Entamoeba invadens
KNEDTEDAV

SEQ ID NO: 2762219 - protein, 8 aa, Entamoeba invadens
KNEDTLGD

SEQ ID NO: 2762220 - protein, 6 aa, Entamoeba invadens
KNEECS

SEQ ID NO: 2762221 - protein, 8 aa, Entamoeba invadens
KNEEMNEE

SEQ ID NO: 2762222 - protein, 6 aa, Entamoeba invadens
KNEETA

SEQ ID NO: 2762223 - protein, 13 aa, Entamoeba invadens
KNEGCTKQQIEEF

SEQ ID NO: 2762224 - protein, 9 aa, Entamoeba invadens
KNEGCTRQQ

SEQ ID NO: 2762225 - protein, 5 aa, Entamoeba invadens
KNEGT

SEQ ID NO: 2762226 - protein, 7 aa, Entamoeba invadens
KNEGYLN

SEQ ID NO: 2762227 - protein, 4 aa, Entamoeba invadens
KNEK

SEQ ID NO: 2762228 - protein, 12 aa, Entamoeba invadens
KNEKCEKYSQHG

SEQ ID NO: 2762229 - protein, 13 aa, Entamoeba invadens
KNEKCEKYSQHGC

SEQ ID NO: 2762230 - protein, 15 aa, Entamoeba invadens
KNEKIEKCQTQKPNV

SEQ ID NO: 2762231 - protein, 9 aa, Entamoeba invadens
KNEKTTNGC

SEQ ID NO: 2762232 - protein, 5 aa, Entamoeba invadens
KNEMP

SEQ ID NO: 2762233 - protein, 7 aa, Entamoeba invadens
KNENGCT

SEQ ID NO: 2762234 - protein, 18 aa, Entamoeba invadens
KNENTENKNASKSSENKI

SEQ ID NO: 2762235 - protein, 8 aa, Entamoeba invadens
KNENTTQA

SEQ ID NO: 2762236 - protein, 7 aa, Entamoeba invadens
KNEPNML

SEQ ID NO: 2762237 - protein, 6 aa, Entamoeba invadens
KNEPNS

SEQ ID NO: 2762238 - protein, 5 aa, Entamoeba invadens
KNEQI

SEQ ID NO: 2762239 - protein, 14 aa, Entamoeba invadens
KNEQLEKELNDKTI

SEQ ID NO: 2762240 - protein, 14 aa, Entamoeba invadens
KNEQTNKMGGAEGA

SEQ ID NO: 2762241 - protein, 9 aa, Entamoeba invadens
KNESSHCES

SEQ ID NO: 2762242 - protein, 4 aa, Entamoeba invadens
KNET

SEQ ID NO: 2762243 - protein, 11 aa, Entamoeba invadens
KNETISNKTDV

SEQ ID NO: 2762244 - protein, 13 aa, Entamoeba invadens
KNETKDQNGQCTL

SEQ ID NO: 2762245 - protein, 34 aa, Entamoeba invadens
KNETNTSSETNETTKTTFKNENDSNCIEKTTKGC

SEQ ID NO: 2762246 - protein, 16 aa, Entamoeba invadens
KNETPQSGSTQQQVPS

SEQ ID NO: 2762247 - protein, 8 aa, Entamoeba invadens
KNETTISV

SEQ ID NO: 2762248 - protein, 8 aa, Entamoeba invadens
KNETVTDN

SEQ ID NO: 2762249 - protein, 4 aa, Entamoeba invadens
KNEV

SEQ ID NO: 2762250 - protein, 7 aa, Entamoeba invadens
KNEVPTG

SEQ ID NO: 2762251 - protein, 6 aa, Entamoeba invadens
KNEVQT

SEQ ID NO: 2762252 - protein, 12 aa, Entamoeba invadens
KNEYKSSETSAR

SEQ ID NO: 2762253 - protein, 8 aa, Entamoeba invadens
KNFDGKIP

SEQ ID NO: 2762254 - protein, 4 aa, Entamoeba invadens
KNFG

SEQ ID NO: 2762255 - protein, 7 aa, Entamoeba invadens
KNFGDAN

SEQ ID NO: 2762256 - protein, 4 aa, Entamoeba invadens
KNFP

SEQ ID NO: 2762257 - protein, 7 aa, Entamoeba invadens
KNFPEGI

SEQ ID NO: 2762258 - protein, 5 aa, Entamoeba invadens
KNFSW

SEQ ID NO: 2762259 - protein, 14 aa, Entamoeba invadens
KNGCTDKSSTKEFA

SEQ ID NO: 2762260 - protein, 7 aa, Entamoeba invadens
KNGDHYE

SEQ ID NO: 2762261 - protein, 9 aa, Entamoeba invadens
KNGDLSNTV

SEQ ID NO: 2762262 - protein, 8 aa, Entamoeba invadens
KNGDVTCN

SEQ ID NO: 2762263 - protein, 7 aa, Entamoeba invadens
KNGEESV

SEQ ID NO: 2762264 - protein, 7 aa, Entamoeba invadens
KNGETIK

SEQ ID NO: 2762265 - protein, 50 aa, Entamoeba invadens
KNGGKISQSGGEEEDDNRSSSETSSSTSSSATHSRESSRSPPLYSDQIVF

SEQ ID NO: 2762266 - protein, 8 aa, Entamoeba invadens
KNGGKRHS

SEQ ID NO: 2762267 - protein, 7 aa, Entamoeba invadens
KNGGNYE

SEQ ID NO: 2762268 - protein, 7 aa, Entamoeba invadens
KNGITKE

SEQ ID NO: 2762269 - protein, 8 aa, Entamoeba invadens
KNGKCSEN

SEQ ID NO: 2762270 - protein, 31 aa, Entamoeba invadens
KNGKCSEQFEDQENDEENNSTITKQDKKGVE

SEQ ID NO: 2762271 - protein, 8 aa, Entamoeba invadens
KNGKDDTN

SEQ ID NO: 2762272 - protein, 12 aa, Entamoeba invadens
KNGKDVPQNNEE

SEQ ID NO: 2762273 - protein, 10 aa, Entamoeba invadens
KNGKGDPQIL

SEQ ID NO: 2762274 - protein, 20 aa, Entamoeba invadens
KNGKGIIPTKSEYYSTFESS

SEQ ID NO: 2762275 - protein, 6 aa, Entamoeba invadens
KNGKKL

SEQ ID NO: 2762276 - protein, 9 aa, Entamoeba invadens
KNGKPTSKL

SEQ ID NO: 2762277 - protein, 5 aa, Entamoeba invadens
KNGMN

SEQ ID NO: 2762278 - protein, 7 aa, Entamoeba invadens
KNGMPDD

SEQ ID NO: 2762279 - protein, 29 aa, Entamoeba invadens
KNGNCSENFDDDKQETNSTNTKQNLKGAE

SEQ ID NO: 2762280 - protein, 21 aa, Entamoeba invadens
KNGNCSENFDDENEQENNSIN

SEQ ID NO: 2762281 - protein, 46 aa, Entamoeba invadens
KNGNCSENFDDIDEDENNVTNTKQMMKSGETSCFTRTNKGCERCNS

SEQ ID NO: 2762282 - protein, 29 aa, Entamoeba invadens
KNGNCSEQFDDENEQENNSTNIKQDLKGA

SEQ ID NO: 2762283 - protein, 28 aa, Entamoeba invadens
KNGNCSEQFDENEQETNSTNIKQDLKGA

SEQ ID NO: 2762284 - protein, 6 aa, Entamoeba invadens
KNGNYS

SEQ ID NO: 2762285 - protein, 8 aa, Entamoeba invadens
KNGPQVRD

SEQ ID NO: 2762286 - protein, 7 aa, Entamoeba invadens
KNGQRTC

SEQ ID NO: 2762287 - protein, 6 aa, Entamoeba invadens
KNGRMI

SEQ ID NO: 2762288 - protein, 11 aa, Entamoeba invadens
KNGSKPSYRGA

SEQ ID NO: 2762289 - protein, 10 aa, Entamoeba invadens
KNGTCGEGEY

SEQ ID NO: 2762290 - protein, 8 aa, Entamoeba invadens
KNGTFKGS

SEQ ID NO: 2762291 - protein, 6 aa, Entamoeba invadens
KNGTQI

SEQ ID NO: 2762292 - protein, 7 aa, Entamoeba invadens
KNGTTIE

SEQ ID NO: 2762293 - protein, 7 aa, Entamoeba invadens
KNGTYQD

SEQ ID NO: 2762294 - protein, 4 aa, Entamoeba invadens
KNGV

SEQ ID NO: 2762295 - protein, 5 aa, Entamoeba invadens
KNHNK

SEQ ID NO: 2762296 - protein, 7 aa, Entamoeba invadens
KNIDSKN

SEQ ID NO: 2762297 - protein, 6 aa, Entamoeba invadens
KNIEGK

SEQ ID NO: 2762298 - protein, 6 aa, Entamoeba invadens
KNIELS

SEQ ID NO: 2762299 - protein, 5 aa, Entamoeba invadens
KNIET

SEQ ID NO: 2762300 - protein, 8 aa, Entamoeba invadens
KNIGNYPN

SEQ ID NO: 2762301 - protein, 7 aa, Entamoeba invadens
KNIIPSS

SEQ ID NO: 2762302 - protein, 5 aa, Entamoeba invadens
KNIKK

SEQ ID NO: 2762303 - protein, 7 aa, Entamoeba invadens
KNIKNSY

SEQ ID NO: 2762304 - protein, 4 aa, Entamoeba invadens
KNIP

SEQ ID NO: 2762305 - protein, 4 aa, Entamoeba invadens
KNIS

SEQ ID NO: 2762306 - protein, 6 aa, Entamoeba invadens
KNISAD

SEQ ID NO: 2762307 - protein, 6 aa, Entamoeba invadens
KNISTF

SEQ ID NO: 2762308 - protein, 5 aa, Entamoeba invadens
KNITQ

SEQ ID NO: 2762309 - protein, 8 aa, Entamoeba invadens
KNITSERI

SEQ ID NO: 2762310 - protein, 4 aa, Entamoeba invadens
KNIV

SEQ ID NO: 2762311 - protein, 11 aa, Entamoeba invadens
KNKDLDLPSQK

SEQ ID NO: 2762312 - protein, 16 aa, Entamoeba invadens
KNKEKEKEKRVENGTT

SEQ ID NO: 2762313 - protein, 7 aa, Entamoeba invadens
KNKEKYD

SEQ ID NO: 2762314 - protein, 8 aa, Entamoeba invadens
KNKENVED

SEQ ID NO: 2762315 - protein, 10 aa, Entamoeba invadens
KNKEPQNEVQ

SEQ ID NO: 2762316 - protein, 6 aa, Entamoeba invadens
KNKERM

SEQ ID NO: 2762317 - protein, 5 aa, Entamoeba invadens
KNKEY

SEQ ID NO: 2762318 - protein, 8 aa, Entamoeba invadens
KNKFTTTL

SEQ ID NO: 2762319 - protein, 4 aa, Entamoeba invadens
KNKG

SEQ ID NO: 2762320 - protein, 5 aa, Entamoeba invadens
KNKGI

SEQ ID NO: 2762321 - protein, 12 aa, Entamoeba invadens
KNKGKLQDPHAV

SEQ ID NO: 2762322 - protein, 7 aa, Entamoeba invadens
KNKGKYD

SEQ ID NO: 2762323 - protein, 7 aa, Entamoeba invadens
KNKIYSQ

SEQ ID NO: 2762324 - protein, 12 aa, Entamoeba invadens
KNKKPEDTGSVS

SEQ ID NO: 2762325 - protein, 8 aa, Entamoeba invadens
KNKLDDGD

SEQ ID NO: 2762326 - protein, 7 aa, Entamoeba invadens
KNKLSTL

SEQ ID NO: 2762327 - protein, 4 aa, Entamoeba invadens
KNKM

SEQ ID NO: 2762328 - protein, 13 aa, Entamoeba invadens
KNKNDTSDGFIPF

SEQ ID NO: 2762329 - protein, 7 aa, Entamoeba invadens
KNKNLAR

SEQ ID NO: 2762330 - protein, 6 aa, Entamoeba invadens
KNKNYK

SEQ ID NO: 2762331 - protein, 35 aa, Entamoeba invadens
KNKPQKNEEDRKEEDVKESSQNDMQNINNELKEQV

SEQ ID NO: 2762332 - protein, 9 aa, Entamoeba invadens
KNKPVSKDT

SEQ ID NO: 2762333 - protein, 6 aa, Entamoeba invadens
KNKQMY

SEQ ID NO: 2762334 - protein, 24 aa, Entamoeba invadens
KNKQQQKVNHKKMPKKIENNTNKC

SEQ ID NO: 2762335 - protein, 8 aa, Entamoeba invadens
KNKQRGER

SEQ ID NO: 2762336 - protein, 11 aa, Entamoeba invadens
KNKREKSKETK

SEQ ID NO: 2762337 - protein, 7 aa, Entamoeba invadens
KNKREKV

SEQ ID NO: 2762338 - protein, 8 aa, Entamoeba invadens
KNKRPDNV

SEQ ID NO: 2762339 - protein, 7 aa, Entamoeba invadens
KNKSEMR

SEQ ID NO: 2762340 - protein, 7 aa, Entamoeba invadens
KNKSGNK

SEQ ID NO: 2762341 - protein, 7 aa, Entamoeba invadens
KNKSKNK

SEQ ID NO: 2762342 - protein, 6 aa, Entamoeba invadens
KNKSNK

SEQ ID NO: 2762343 - protein, 9 aa, Entamoeba invadens
KNKSNSEID

SEQ ID NO: 2762344 - protein, 7 aa, Entamoeba invadens
KNKSRNK

SEQ ID NO: 2762345 - protein, 11 aa, Entamoeba invadens
KNKTDDEEYIS

SEQ ID NO: 2762346 - protein, 9 aa, Entamoeba invadens
KNKTFESFT

SEQ ID NO: 2762347 - protein, 7 aa, Entamoeba invadens
KNKTLKI

SEQ ID NO: 2762348 - protein, 14 aa, Entamoeba invadens
KNKTNSCEGCSTHN

SEQ ID NO: 2762349 - protein, 9 aa, Entamoeba invadens
KNKTSEEVE

SEQ ID NO: 2762350 - protein, 9 aa, Entamoeba invadens
KNKTSSEID

SEQ ID NO: 2762351 - protein, 8 aa, Entamoeba invadens
KNKTSTKC

SEQ ID NO: 2762352 - protein, 7 aa, Entamoeba invadens
KNKVDIT

SEQ ID NO: 2762353 - protein, 14 aa, Entamoeba invadens
KNKVQVNSPNAYKS

SEQ ID NO: 2762354 - protein, 19 aa, Entamoeba invadens
KNKYGESCEKCTPTNCEKC

SEQ ID NO: 2762355 - protein, 7 aa, Entamoeba invadens
KNKYNKY

SEQ ID NO: 2762356 - protein, 8 aa, Entamoeba invadens
KNKYSQAA

SEQ ID NO: 2762357 - protein, 10 aa, Entamoeba invadens
KNLEESEASL

SEQ ID NO: 2762358 - protein, 7 aa, Entamoeba invadens
KNLEGSY

SEQ ID NO: 2762359 - protein, 9 aa, Entamoeba invadens
KNLEKPRKN

SEQ ID NO: 2762360 - protein, 10 aa, Entamoeba invadens
KNLENKEIPR

SEQ ID NO: 2762361 - protein, 6 aa, Entamoeba invadens
KNLKGN

SEQ ID NO: 2762362 - protein, 6 aa, Entamoeba invadens
KNLPEG

SEQ ID NO: 2762363 - protein, 4 aa, Entamoeba invadens
KNLR

SEQ ID NO: 2762364 - protein, 8 aa, Entamoeba invadens
KNLSSELG

SEQ ID NO: 2762365 - protein, 62 aa, Entamoeba invadens
KNLVTESSKVVKSENMGDKEQVEKNEAEEKNETTKVSLTTGEAEEVVETKESSKNIAKDNEV

SEQ ID NO: 2762366 - protein, 11 aa, Entamoeba invadens
KNMKRAEKKTP

SEQ ID NO: 2762367 - protein, 9 aa, Entamoeba invadens
KNMPATDNL

SEQ ID NO: 2762368 - protein, 9 aa, Entamoeba invadens
KNNAEQFTT

SEQ ID NO: 2762369 - protein, 10 aa, Entamoeba invadens
KNNAKQTQNF

SEQ ID NO: 2762370 - protein, 11 aa, Entamoeba invadens
KNNDSGECEEC

SEQ ID NO: 2762371 - protein, 6 aa, Entamoeba invadens
KNNEKI

SEQ ID NO: 2762372 - protein, 6 aa, Entamoeba invadens
KNNELK

SEQ ID NO: 2762373 - protein, 8 aa, Entamoeba invadens
KNNENSNT

SEQ ID NO: 2762374 - protein, 6 aa, Entamoeba invadens
KNNGRI

SEQ ID NO: 2762375 - protein, 6 aa, Entamoeba invadens
KNNGTI

SEQ ID NO: 2762376 - protein, 24 aa, Entamoeba invadens
KNNITSTETFTVQQSNSYRPSNHN

SEQ ID NO: 2762377 - protein, 4 aa, Entamoeba invadens
KNNK

SEQ ID NO: 2762378 - protein, 23 aa, Entamoeba invadens
KNNKCSKCNTKCTECTENSEKCQ

SEQ ID NO: 2762379 - protein, 9 aa, Entamoeba invadens
KNNKDASKV

SEQ ID NO: 2762380 - protein, 9 aa, Entamoeba invadens
KNNKDEAKI

SEQ ID NO: 2762381 - protein, 9 aa, Entamoeba invadens
KNNKDESKI

SEQ ID NO: 2762382 - protein, 7 aa, Entamoeba invadens
KNNKFEM

SEQ ID NO: 2762383 - protein, 7 aa, Entamoeba invadens
KNNKNDY

SEQ ID NO: 2762384 - protein, 6 aa, Entamoeba invadens
KNNKRV

SEQ ID NO: 2762385 - protein, 5 aa, Entamoeba invadens
KNNLD

SEQ ID NO: 2762386 - protein, 5 aa, Entamoeba invadens
KNNLP

SEQ ID NO: 2762387 - protein, 26 aa, Entamoeba invadens
KNNLTERPKKEKGKTDKVKETELSEL

SEQ ID NO: 2762388 - protein, 5 aa, Entamoeba invadens
KNNNE

SEQ ID NO: 2762389 - protein, 6 aa, Entamoeba invadens
KNNNNM

SEQ ID NO: 2762390 - protein, 8 aa, Entamoeba invadens
KNNNNPLS

SEQ ID NO: 2762391 - protein, 6 aa, Entamoeba invadens
KNNPLQ

SEQ ID NO: 2762392 - protein, 8 aa, Entamoeba invadens
KNNRDVTK

SEQ ID NO: 2762393 - protein, 5 aa, Entamoeba invadens
KNNRL

SEQ ID NO: 2762394 - protein, 5 aa, Entamoeba invadens
KNNSM

SEQ ID NO: 2762395 - protein, 17 aa, Entamoeba invadens
KNNSNSTITKDETRKTR

SEQ ID NO: 2762396 - protein, 28 aa, Entamoeba invadens
KNNSQNKRLSSKYKKDDDVKEPSTPRVG

SEQ ID NO: 2762397 - protein, 8 aa, Entamoeba invadens
KNNSQYVD

SEQ ID NO: 2762398 - protein, 7 aa, Entamoeba invadens
KNNSRNK

SEQ ID NO: 2762399 - protein, 5 aa, Entamoeba invadens
KNNSS

SEQ ID NO: 2762400 - protein, 5 aa, Entamoeba invadens
KNNTC

SEQ ID NO: 2762401 - protein, 5 aa, Entamoeba invadens
KNNTG

SEQ ID NO: 2762402 - protein, 5 aa, Entamoeba invadens
KNNTK

SEQ ID NO: 2762403 - protein, 8 aa, Entamoeba invadens
KNNTKVSR

SEQ ID NO: 2762404 - protein, 5 aa, Entamoeba invadens
KNNTL

SEQ ID NO: 2762405 - protein, 6 aa, Entamoeba invadens
KNNTTT

SEQ ID NO: 2762406 - protein, 6 aa, Entamoeba invadens
KNNTYT

SEQ ID NO: 2762407 - protein, 4 aa, Entamoeba invadens
KNNY

SEQ ID NO: 2762408 - protein, 5 aa, Entamoeba invadens
KNPCK

SEQ ID NO: 2762409 - protein, 6 aa, Entamoeba invadens
KNPDLL

SEQ ID NO: 2762410 - protein, 7 aa, Entamoeba invadens
KNPDVTP

SEQ ID NO: 2762411 - protein, 4 aa, Entamoeba invadens
KNPE

SEQ ID NO: 2762412 - protein, 16 aa, Entamoeba invadens
KNPEKYGNRNTRAPTL

SEQ ID NO: 2762413 - protein, 9 aa, Entamoeba invadens
KNPKTKLTQ

SEQ ID NO: 2762414 - protein, 12 aa, Entamoeba invadens
KNPNDRDSPYNV

SEQ ID NO: 2762415 - protein, 7 aa, Entamoeba invadens
KNPNEPV

SEQ ID NO: 2762416 - protein, 6 aa, Entamoeba invadens
KNPNGM

SEQ ID NO: 2762417 - protein, 8 aa, Entamoeba invadens
KNPNGVGK

SEQ ID NO: 2762418 - protein, 15 aa, Entamoeba invadens
KNPNRSNPYNYVLAD

SEQ ID NO: 2762419 - protein, 8 aa, Entamoeba invadens
KNPPLGDG

SEQ ID NO: 2762420 - protein, 15 aa, Entamoeba invadens
KNPPQPAFDSNYYTK

SEQ ID NO: 2762421 - protein, 9 aa, Entamoeba invadens
KNPPQPAFN

SEQ ID NO: 2762422 - protein, 12 aa, Entamoeba invadens
KNPPQPESMPNY

SEQ ID NO: 2762423 - protein, 16 aa, Entamoeba invadens
KNPPQPSFDSEYYKPN

SEQ ID NO: 2762424 - protein, 9 aa, Entamoeba invadens
KNPQKSVNS

SEQ ID NO: 2762425 - protein, 8 aa, Entamoeba invadens
KNPQSKRC

SEQ ID NO: 2762426 - protein, 8 aa, Entamoeba invadens
KNPRNPDQ

SEQ ID NO: 2762427 - protein, 35 aa, Entamoeba invadens
KNPSEKTQTSTTTTTLTNTNTTNIAYKTGDSTVSK

SEQ ID NO: 2762428 - protein, 7 aa, Entamoeba invadens
KNPTGSR

SEQ ID NO: 2762429 - protein, 12 aa, Entamoeba invadens
KNPTHKTGTVRT

SEQ ID NO: 2762430 - protein, 8 aa, Entamoeba invadens
KNPTLETN

SEQ ID NO: 2762431 - protein, 7 aa, Entamoeba invadens
KNPTTTL

SEQ ID NO: 2762432 - protein, 6 aa, Entamoeba invadens
KNPTYV

SEQ ID NO: 2762433 - protein, 6 aa, Entamoeba invadens
KNPVSY

SEQ ID NO: 2762434 - protein, 6 aa, Entamoeba invadens
KNPYDP

SEQ ID NO: 2762435 - protein, 8 aa, Entamoeba invadens
KNPYDPVT

SEQ ID NO: 2762436 - protein, 8 aa, Entamoeba invadens
KNQDKMAQ

SEQ ID NO: 2762437 - protein, 12 aa, Entamoeba invadens
KNQERNPTTKKC

SEQ ID NO: 2762438 - protein, 8 aa, Entamoeba invadens
KNQIESGV

SEQ ID NO: 2762439 - protein, 7 aa, Entamoeba invadens
KNQIKSS

SEQ ID NO: 2762440 - protein, 5 aa, Entamoeba invadens
KNQLI

SEQ ID NO: 2762441 - protein, 8 aa, Entamoeba invadens
KNQNSPLS

SEQ ID NO: 2762442 - protein, 6 aa, Entamoeba invadens
KNQPIA

SEQ ID NO: 2762443 - protein, 7 aa, Entamoeba invadens
KNQQLTG

SEQ ID NO: 2762444 - protein, 11 aa, Entamoeba invadens
KNQTGRDLNNN

SEQ ID NO: 2762445 - protein, 15 aa, Entamoeba invadens
KNQTNGCEGCSTHNS

SEQ ID NO: 2762446 - protein, 14 aa, Entamoeba invadens
KNQTNSCESCSTHN

SEQ ID NO: 2762447 - protein, 4 aa, Entamoeba invadens
KNRA

SEQ ID NO: 2762448 - protein, 7 aa, Entamoeba invadens
KNRCQNL

SEQ ID NO: 2762449 - protein, 7 aa, Entamoeba invadens
KNRDDVS

SEQ ID NO: 2762450 - protein, 6 aa, Entamoeba invadens
KNREKI

SEQ ID NO: 2762451 - protein, 6 aa, Entamoeba invadens
KNREKV

SEQ ID NO: 2762452 - protein, 5 aa, Entamoeba invadens
KNRGE

SEQ ID NO: 2762453 - protein, 6 aa, Entamoeba invadens
KNRHKK

SEQ ID NO: 2762454 - protein, 7 aa, Entamoeba invadens
KNRLGAN

SEQ ID NO: 2762455 - protein, 6 aa, Entamoeba invadens
KNRQNK

SEQ ID NO: 2762456 - protein, 8 aa, Entamoeba invadens
KNRSEGKV

SEQ ID NO: 2762457 - protein, 7 aa, Entamoeba invadens
KNRSRNK

SEQ ID NO: 2762458 - protein, 7 aa, Entamoeba invadens
KNRYSKA

SEQ ID NO: 2762459 - protein, 9 aa, Entamoeba invadens
KNSANGRYQ

SEQ ID NO: 2762460 - protein, 7 aa, Entamoeba invadens
KNSAPIS

SEQ ID NO: 2762461 - protein, 9 aa, Entamoeba invadens
KNSARALKA

SEQ ID NO: 2762462 - protein, 6 aa, Entamoeba invadens
KNSCDV

SEQ ID NO: 2762463 - protein, 8 aa, Entamoeba invadens
KNSCKECK

SEQ ID NO: 2762464 - protein, 10 aa, Entamoeba invadens
KNSDKGNSYD

SEQ ID NO: 2762465 - protein, 9 aa, Entamoeba invadens
KNSEAARSG

SEQ ID NO: 2762466 - protein, 14 aa, Entamoeba invadens
KNSEFGKTVNATNS

SEQ ID NO: 2762467 - protein, 8 aa, Entamoeba invadens
KNSEGKNY

SEQ ID NO: 2762468 - protein, 8 aa, Entamoeba invadens
KNSEGQCL

SEQ ID NO: 2762469 - protein, 6 aa, Entamoeba invadens
KNSEKF

SEQ ID NO: 2762470 - protein, 5 aa, Entamoeba invadens
KNSGY

SEQ ID NO: 2762471 - protein, 27 aa, Entamoeba invadens
KNSHNSSQSFNNNKNSNNTKETLKGSC

SEQ ID NO: 2762472 - protein, 50 aa, Entamoeba invadens
KNSIDKKGSEPGTNSSTKPKKDKSTTRKTATEAKNDSSKNKTANAREEFE

SEQ ID NO: 2762473 - protein, 11 aa, Entamoeba invadens
KNSIPSDDGDS

SEQ ID NO: 2762474 - protein, 6 aa, Entamoeba invadens
KNSISS

SEQ ID NO: 2762475 - protein, 6 aa, Entamoeba invadens
KNSIYE

SEQ ID NO: 2762476 - protein, 5 aa, Entamoeba invadens
KNSKC

SEQ ID NO: 2762477 - protein, 9 aa, Entamoeba invadens
KNSKEFGNY

SEQ ID NO: 2762478 - protein, 7 aa, Entamoeba invadens
KNSKEIE

SEQ ID NO: 2762479 - protein, 16 aa, Entamoeba invadens
KNSKFPENFAKTPRQC

SEQ ID NO: 2762480 - protein, 6 aa, Entamoeba invadens
KNSKKL

SEQ ID NO: 2762481 - protein, 8 aa, Entamoeba invadens
KNSKSQCS

SEQ ID NO: 2762482 - protein, 4 aa, Entamoeba invadens
KNSL

SEQ ID NO: 2762483 - protein, 10 aa, Entamoeba invadens
KNSNDNGART

SEQ ID NO: 2762484 - protein, 8 aa, Entamoeba invadens
KNSNEEQI

SEQ ID NO: 2762485 - protein, 7 aa, Entamoeba invadens
KNSNHLD

SEQ ID NO: 2762486 - protein, 4 aa, Entamoeba invadens
KNSP

SEQ ID NO: 2762487 - protein, 28 aa, Entamoeba invadens
KNSPAKTDTNKESKTATVDVGDDEDWDK

SEQ ID NO: 2762488 - protein, 8 aa, Entamoeba invadens
KNSQCTST

SEQ ID NO: 2762489 - protein, 13 aa, Entamoeba invadens
KNSQFEEKNFEGV

SEQ ID NO: 2762490 - protein, 10 aa, Entamoeba invadens
KNSRNPPKCE

SEQ ID NO: 2762491 - protein, 13 aa, Entamoeba invadens
KNSRQIKETSMTR

SEQ ID NO: 2762492 - protein, 8 aa, Entamoeba invadens
KNSSELSN

SEQ ID NO: 2762493 - protein, 9 aa, Entamoeba invadens
KNSSLNGNY

SEQ ID NO: 2762494 - protein, 8 aa, Entamoeba invadens
KNSSNYSI

SEQ ID NO: 2762495 - protein, 8 aa, Entamoeba invadens
KNSTDKYS

SEQ ID NO: 2762496 - protein, 10 aa, Entamoeba invadens
KNSTDSSAKT

SEQ ID NO: 2762497 - protein, 5 aa, Entamoeba invadens
KNSTE

SEQ ID NO: 2762498 - protein, 7 aa, Entamoeba invadens
KNSTFDE

SEQ ID NO: 2762499 - protein, 6 aa, Entamoeba invadens
KNSTHT

SEQ ID NO: 2762500 - protein, 7 aa, Entamoeba invadens
KNSTTMK

SEQ ID NO: 2762501 - protein, 12 aa, Entamoeba invadens
KNSTTSKVTSDH

SEQ ID NO: 2762502 - protein, 6 aa, Entamoeba invadens
KNSVCT

SEQ ID NO: 2762503 - protein, 10 aa, Entamoeba invadens
KNSYSTRVNT

SEQ ID NO: 2762504 - protein, 8 aa, Entamoeba invadens
KNTDDSQY

SEQ ID NO: 2762505 - protein, 5 aa, Entamoeba invadens
KNTDS

SEQ ID NO: 2762506 - protein, 8 aa, Entamoeba invadens
KNTEDGLG

SEQ ID NO: 2762507 - protein, 18 aa, Entamoeba invadens
KNTEKSSSLPTSTETPNE

SEQ ID NO: 2762508 - protein, 6 aa, Entamoeba invadens
KNTETF

SEQ ID NO: 2762509 - protein, 17 aa, Entamoeba invadens
KNTGAKLKGEFDRNAIP

SEQ ID NO: 2762510 - protein, 6 aa, Entamoeba invadens
KNTIDT

SEQ ID NO: 2762511 - protein, 5 aa, Entamoeba invadens
KNTKM

SEQ ID NO: 2762512 - protein, 10 aa, Entamoeba invadens
KNTKNCEKCD

SEQ ID NO: 2762513 - protein, 25 aa, Entamoeba invadens
KNTKQTKSEPCDDENCEQCSDDGKT

SEQ ID NO: 2762514 - protein, 6 aa, Entamoeba invadens
KNTKSG

SEQ ID NO: 2762515 - protein, 8 aa, Entamoeba invadens
KNTNVPLE

SEQ ID NO: 2762516 - protein, 10 aa, Entamoeba invadens
KNTPDTSEEH

SEQ ID NO: 2762517 - protein, 15 aa, Entamoeba invadens
KNTPSPVMKIGETSI

SEQ ID NO: 2762518 - protein, 4 aa, Entamoeba invadens
KNTQ

SEQ ID NO: 2762519 - protein, 13 aa, Entamoeba invadens
KNTQATKSAIDEF

SEQ ID NO: 2762520 - protein, 11 aa, Entamoeba invadens
KNTQESLTEEF

SEQ ID NO: 2762521 - protein, 7 aa, Entamoeba invadens
KNTQLTN

SEQ ID NO: 2762522 - protein, 5 aa, Entamoeba invadens
KNTQS

SEQ ID NO: 2762523 - protein, 8 aa, Entamoeba invadens
KNTQSACS

SEQ ID NO: 2762524 - protein, 6 aa, Entamoeba invadens
KNTQTY

SEQ ID NO: 2762525 - protein, 6 aa, Entamoeba invadens
KNTSLK

SEQ ID NO: 2762526 - protein, 24 aa, Entamoeba invadens
KNTSNSTNTETTCEPKSAKAFSRE

SEQ ID NO: 2762527 - protein, 7 aa, Entamoeba invadens
KNTSTSF

SEQ ID NO: 2762528 - protein, 7 aa, Entamoeba invadens
KNTSYQY

SEQ ID NO: 2762529 - protein, 4 aa, Entamoeba invadens
KNTT

SEQ ID NO: 2762530 - protein, 15 aa, Entamoeba invadens
KNTTASTVPPFTPTT

SEQ ID NO: 2762531 - protein, 9 aa, Entamoeba invadens
KNTTEAAQQ

SEQ ID NO: 2762532 - protein, 8 aa, Entamoeba invadens
KNTTEGKV

SEQ ID NO: 2762533 - protein, 9 aa, Entamoeba invadens
KNTTNCTSS

SEQ ID NO: 2762534 - protein, 6 aa, Entamoeba invadens
KNTTNE

SEQ ID NO: 2762535 - protein, 7 aa, Entamoeba invadens
KNTTNPL

SEQ ID NO: 2762536 - protein, 5 aa, Entamoeba invadens
KNTTP

SEQ ID NO: 2762537 - protein, 5 aa, Entamoeba invadens
KNTTQ

SEQ ID NO: 2762538 - protein, 8 aa, Entamoeba invadens
KNTTVNGR

SEQ ID NO: 2762539 - protein, 6 aa, Entamoeba invadens
KNTVDN

SEQ ID NO: 2762540 - protein, 18 aa, Entamoeba invadens
KNTVRNTVNGPPQQEEDY

SEQ ID NO: 2762541 - protein, 8 aa, Entamoeba invadens
KNTYENDT

SEQ ID NO: 2762542 - protein, 10 aa, Entamoeba invadens
KNVAPSKEGR

SEQ ID NO: 2762543 - protein, 6 aa, Entamoeba invadens
KNVDNS

SEQ ID NO: 2762544 - protein, 8 aa, Entamoeba invadens
KNVEDGEN

SEQ ID NO: 2762545 - protein, 13 aa, Entamoeba invadens
KNVEEEKKESFSV

SEQ ID NO: 2762546 - protein, 7 aa, Entamoeba invadens
KNVEESD

SEQ ID NO: 2762547 - protein, 5 aa, Entamoeba invadens
KNVIQ

SEQ ID NO: 2762548 - protein, 9 aa, Entamoeba invadens
KNVKNGRNI

SEQ ID NO: 2762549 - protein, 4 aa, Entamoeba invadens
KNVN

SEQ ID NO: 2762550 - protein, 7 aa, Entamoeba invadens
KNVNRQV

SEQ ID NO: 2762551 - protein, 9 aa, Entamoeba invadens
KNVQNSVKE

SEQ ID NO: 2762552 - protein, 12 aa, Entamoeba invadens
KNVREKAAKRKP

SEQ ID NO: 2762553 - protein, 9 aa, Entamoeba invadens
KNVSEQNNI

SEQ ID NO: 2762554 - protein, 13 aa, Entamoeba invadens
KNVSGSDEELDEF

SEQ ID NO: 2762555 - protein, 7 aa, Entamoeba invadens
KNVSQTT

SEQ ID NO: 2762556 - protein, 6 aa, Entamoeba invadens
KNVSRH

SEQ ID NO: 2762557 - protein, 12 aa, Entamoeba invadens
KNVTNAKDQMAE

SEQ ID NO: 2762558 - protein, 5 aa, Entamoeba invadens
KNVVD

SEQ ID NO: 2762559 - protein, 6 aa, Entamoeba invadens
KNYDNA

SEQ ID NO: 2762560 - protein, 9 aa, Entamoeba invadens
KNYESNQCT

SEQ ID NO: 2762561 - protein, 10 aa, Entamoeba invadens
KNYKPSDAGD

SEQ ID NO: 2762562 - protein, 7 aa, Entamoeba invadens
KNYNTIS

SEQ ID NO: 2762563 - protein, 8 aa, Entamoeba invadens
KNYRQERI

SEQ ID NO: 2762564 - protein, 12 aa, Entamoeba invadens
KNYSAVTSHSSV

SEQ ID NO: 2762565 - protein, 5 aa, Entamoeba invadens
KNYSD

SEQ ID NO: 2762566 - protein, 9 aa, Entamoeba invadens
KNYSEDENP

SEQ ID NO: 2762567 - protein, 6 aa, Entamoeba invadens
KNYSKN

SEQ ID NO: 2762568 - protein, 6 aa, Entamoeba invadens
KNYSKT

SEQ ID NO: 2762569 - protein, 7 aa, Entamoeba invadens
KNYSPAN

SEQ ID NO: 2762570 - protein, 10 aa, Entamoeba invadens
KNYVSENGSD

SEQ ID NO: 2762571 - protein, 7 aa, Entamoeba invadens
KNYYDSP

SEQ ID NO: 2762572 - protein, 14 aa, Entamoeba invadens
KPADKNETKISKIS

SEQ ID NO: 2762573 - protein, 18 aa, Entamoeba invadens
KPAELSGIGRDPSNKCEC

SEQ ID NO: 2762574 - protein, 4 aa, Entamoeba invadens
KPAS

SEQ ID NO: 2762575 - protein, 11 aa, Entamoeba invadens
KPASRKPSGRY

SEQ ID NO: 2762576 - protein, 18 aa, Entamoeba invadens
KPDDDGKCNKPKEDLNAT

SEQ ID NO: 2762577 - protein, 8 aa, Entamoeba invadens
KPDDHSDC

SEQ ID NO: 2762578 - protein, 8 aa, Entamoeba invadens
KPDDQKYL

SEQ ID NO: 2762579 - protein, 15 aa, Entamoeba invadens
KPDFESEAYYRDNQT

SEQ ID NO: 2762580 - protein, 19 aa, Entamoeba invadens
KPDIDANNVNGFTPTQCDG

SEQ ID NO: 2762581 - protein, 6 aa, Entamoeba invadens
KPDKMD

SEQ ID NO: 2762582 - protein, 8 aa, Entamoeba invadens
KPDTSGVY

SEQ ID NO: 2762583 - protein, 7 aa, Entamoeba invadens
KPDVGCE

SEQ ID NO: 2762584 - protein, 13 aa, Entamoeba invadens
KPDYAYNSKTKSC

SEQ ID NO: 2762585 - protein, 7 aa, Entamoeba invadens
KPEDDGK

SEQ ID NO: 2762586 - protein, 6 aa, Entamoeba invadens
KPEDGQ

SEQ ID NO: 2762587 - protein, 6 aa, Entamoeba invadens
KPEEHT

SEQ ID NO: 2762588 - protein, 7 aa, Entamoeba invadens
KPEERFG

SEQ ID NO: 2762589 - protein, 6 aa, Entamoeba invadens
KPEERM

SEQ ID NO: 2762590 - protein, 19 aa, Entamoeba invadens
KPEESERKDLQERISGQES

SEQ ID NO: 2762591 - protein, 20 aa, Entamoeba invadens
KPEIEKYKETRTVITPQQEL

SEQ ID NO: 2762592 - protein, 8 aa, Entamoeba invadens
KPEISTFQ

SEQ ID NO: 2762593 - protein, 7 aa, Entamoeba invadens
KPEKRPV

SEQ ID NO: 2762594 - protein, 4 aa, Entamoeba invadens
KPEL

SEQ ID NO: 2762595 - protein, 10 aa, Entamoeba invadens
KPELTTTRDT

SEQ ID NO: 2762596 - protein, 4 aa, Entamoeba invadens
KPEM

SEQ ID NO: 2762597 - protein, 10 aa, Entamoeba invadens
KPEPSERPNF

SEQ ID NO: 2762598 - protein, 6 aa, Entamoeba invadens
KPEQDR

SEQ ID NO: 2762599 - protein, 10 aa, Entamoeba invadens
KPESNNYKHS

SEQ ID NO: 2762600 - protein, 5 aa, Entamoeba invadens
KPESV

SEQ ID NO: 2762601 - protein, 44 aa, Entamoeba invadens
KPEVPTRKGSTKPVEKVEKPKSVNTTTKPANPMGNVTSENIDSI

SEQ ID NO: 2762602 - protein, 4 aa, Entamoeba invadens
KPEY

SEQ ID NO: 2762603 - protein, 5 aa, Entamoeba invadens
KPEYR

SEQ ID NO: 2762604 - protein, 4 aa, Entamoeba invadens
KPFA

SEQ ID NO: 2762605 - protein, 5 aa, Entamoeba invadens
KPFES

SEQ ID NO: 2762606 - protein, 6 aa, Entamoeba invadens
KPFGKY

SEQ ID NO: 2762607 - protein, 7 aa, Entamoeba invadens
KPFGRKA

SEQ ID NO: 2762608 - protein, 6 aa, Entamoeba invadens
KPFKQS

SEQ ID NO: 2762609 - protein, 8 aa, Entamoeba invadens
KPFKRTDG

SEQ ID NO: 2762610 - protein, 5 aa, Entamoeba invadens
KPFKV

SEQ ID NO: 2762611 - protein, 4 aa, Entamoeba invadens
KPFP

SEQ ID NO: 2762612 - protein, 4 aa, Entamoeba invadens
KPFT

SEQ ID NO: 2762613 - protein, 11 aa, Entamoeba invadens
KPFTDTTKDEQ

SEQ ID NO: 2762614 - protein, 7 aa, Entamoeba invadens
KPGNFHS

SEQ ID NO: 2762615 - protein, 18 aa, Entamoeba invadens
KPGPSGYLAKTKETRGTL

SEQ ID NO: 2762616 - protein, 8 aa, Entamoeba invadens
KPGQCYKT

SEQ ID NO: 2762617 - protein, 14 aa, Entamoeba invadens
KPGTYSSAKGSTQC

SEQ ID NO: 2762618 - protein, 12 aa, Entamoeba invadens
KPGYKQYTDSYA

SEQ ID NO: 2762619 - protein, 6 aa, Entamoeba invadens
KPHASF

SEQ ID NO: 2762620 - protein, 6 aa, Entamoeba invadens
KPIDAN

SEQ ID NO: 2762621 - protein, 11 aa, Entamoeba invadens
KPIDASGSIAN

SEQ ID NO: 2762622 - protein, 5 aa, Entamoeba invadens
KPIEN

SEQ ID NO: 2762623 - protein, 4 aa, Entamoeba invadens
KPIG

SEQ ID NO: 2762624 - protein, 15 aa, Entamoeba invadens
KPIGSSAVSNANSIS

SEQ ID NO: 2762625 - protein, 7 aa, Entamoeba invadens
KPIRSNQ

SEQ ID NO: 2762626 - protein, 4 aa, Entamoeba invadens
KPIS

SEQ ID NO: 2762627 - protein, 6 aa, Entamoeba invadens
KPISGV

SEQ ID NO: 2762628 - protein, 8 aa, Entamoeba invadens
KPITEDSR

SEQ ID NO: 2762629 - protein, 8 aa, Entamoeba invadens
KPKATPLV

SEQ ID NO: 2762630 - protein, 13 aa, Entamoeba invadens
KPKATTEEIESKM

SEQ ID NO: 2762631 - protein, 12 aa, Entamoeba invadens
KPKDNTDMSSSY

SEQ ID NO: 2762632 - protein, 16 aa, Entamoeba invadens
KPKDTDSDHRQGPIST

SEQ ID NO: 2762633 - protein, 16 aa, Entamoeba invadens
KPKKLTGWEKVKQFLK

SEQ ID NO: 2762634 - protein, 10 aa, Entamoeba invadens
KPKKQKTKTL

SEQ ID NO: 2762635 - protein, 14 aa, Entamoeba invadens
KPKNCSVEAPENNN

SEQ ID NO: 2762636 - protein, 8 aa, Entamoeba invadens
KPKPEQPR

SEQ ID NO: 2762637 - protein, 14 aa, Entamoeba invadens
KPKPSCGQPGPNRL

SEQ ID NO: 2762638 - protein, 12 aa, Entamoeba invadens
KPKRKKGKDNNM

SEQ ID NO: 2762639 - protein, 8 aa, Entamoeba invadens
KPKSDMED

SEQ ID NO: 2762640 - protein, 15 aa, Entamoeba invadens
KPKVANNTSLVPSPT

SEQ ID NO: 2762641 - protein, 7 aa, Entamoeba invadens
KPKYRFS

SEQ ID NO: 2762642 - protein, 4 aa, Entamoeba invadens
KPLE

SEQ ID NO: 2762643 - protein, 7 aa, Entamoeba invadens
KPLEDEE

SEQ ID NO: 2762644 - protein, 12 aa, Entamoeba invadens
KPLEESELKTKI

SEQ ID NO: 2762645 - protein, 14 aa, Entamoeba invadens
KPLENDTKRTQQSP

SEQ ID NO: 2762646 - protein, 18 aa, Entamoeba invadens
KPLKIKTNADPNDITTPS

SEQ ID NO: 2762647 - protein, 4 aa, Entamoeba invadens
KPLN

SEQ ID NO: 2762648 - protein, 6 aa, Entamoeba invadens
KPLPKT

SEQ ID NO: 2762649 - protein, 8 aa, Entamoeba invadens
KPLPNGQG

SEQ ID NO: 2762650 - protein, 5 aa, Entamoeba invadens
KPLRT

SEQ ID NO: 2762651 - protein, 6 aa, Entamoeba invadens
KPLSQR

SEQ ID NO: 2762652 - protein, 7 aa, Entamoeba invadens
KPLTPTN

SEQ ID NO: 2762653 - protein, 7 aa, Entamoeba invadens
KPMEDND

SEQ ID NO: 2762654 - protein, 5 aa, Entamoeba invadens
KPMKD

SEQ ID NO: 2762655 - protein, 6 aa, Entamoeba invadens
KPMSSA

SEQ ID NO: 2762656 - protein, 7 aa, Entamoeba invadens
KPNCPDG

SEQ ID NO: 2762657 - protein, 6 aa, Entamoeba invadens
KPNDRI

SEQ ID NO: 2762658 - protein, 8 aa, Entamoeba invadens
KPNEADKA

SEQ ID NO: 2762659 - protein, 9 aa, Entamoeba invadens
KPNESGTFC

SEQ ID NO: 2762660 - protein, 14 aa, Entamoeba invadens
KPNGCKNSKDSYVV

SEQ ID NO: 2762661 - protein, 9 aa, Entamoeba invadens
KPNGECNKC

SEQ ID NO: 2762662 - protein, 6 aa, Entamoeba invadens
KPNKDN

SEQ ID NO: 2762663 - protein, 6 aa, Entamoeba invadens
KPNNKA

SEQ ID NO: 2762664 - protein, 6 aa, Entamoeba invadens
KPNNKR

SEQ ID NO: 2762665 - protein, 14 aa, Entamoeba invadens
KPNPSKYPIGKKRM

SEQ ID NO: 2762666 - protein, 12 aa, Entamoeba invadens
KPNSMETAKNAA

SEQ ID NO: 2762667 - protein, 5 aa, Entamoeba invadens
KPNTF

SEQ ID NO: 2762668 - protein, 10 aa, Entamoeba invadens
KPPCTDGYER

SEQ ID NO: 2762669 - protein, 21 aa, Entamoeba invadens
KPPEQKSGLGQKIDTSDNSSQ

SEQ ID NO: 2762670 - protein, 6 aa, Entamoeba invadens
KPPNEV

SEQ ID NO: 2762671 - protein, 6 aa, Entamoeba invadens
KPPTGA

SEQ ID NO: 2762672 - protein, 4 aa, Entamoeba invadens
KPPV

SEQ ID NO: 2762673 - protein, 6 aa, Entamoeba invadens
KPQCQT

SEQ ID NO: 2762674 - protein, 4 aa, Entamoeba invadens
KPQE

SEQ ID NO: 2762675 - protein, 8 aa, Entamoeba invadens
KPQEQPNC

SEQ ID NO: 2762676 - protein, 9 aa, Entamoeba invadens
KPQKSTKFS

SEQ ID NO: 2762677 - protein, 6 aa, Entamoeba invadens
KPQKVI

SEQ ID NO: 2762678 - protein, 11 aa, Entamoeba invadens
KPQLTDPSKNV

SEQ ID NO: 2762679 - protein, 15 aa, Entamoeba invadens
KPQTTQYGDATHTFS

SEQ ID NO: 2762680 - protein, 13 aa, Entamoeba invadens
KPRASERPSFKEL

SEQ ID NO: 2762681 - protein, 6 aa, Entamoeba invadens
KPRKQT

SEQ ID NO: 2762682 - protein, 5 aa, Entamoeba invadens
KPRLQ

SEQ ID NO: 2762683 - protein, 6 aa, Entamoeba invadens
KPRNDP

SEQ ID NO: 2762684 - protein, 18 aa, Entamoeba invadens
KPSGEKSRSCGEYPAEQG

SEQ ID NO: 2762685 - protein, 6 aa, Entamoeba invadens
KPSIGL

SEQ ID NO: 2762686 - protein, 5 aa, Entamoeba invadens
KPSII

SEQ ID NO: 2762687 - protein, 5 aa, Entamoeba invadens
KPSIY

SEQ ID NO: 2762688 - protein, 12 aa, Entamoeba invadens
KPSKSNSPQNTF

SEQ ID NO: 2762689 - protein, 8 aa, Entamoeba invadens
KPSKVSHK

SEQ ID NO: 2762690 - protein, 7 aa, Entamoeba invadens
KPSKYSN

SEQ ID NO: 2762691 - protein, 8 aa, Entamoeba invadens
KPSQTKTS

SEQ ID NO: 2762692 - protein, 8 aa, Entamoeba invadens
KPSSNAPV

SEQ ID NO: 2762693 - protein, 9 aa, Entamoeba invadens
KPSSNGTIC

SEQ ID NO: 2762694 - protein, 5 aa, Entamoeba invadens
KPSTM

SEQ ID NO: 2762695 - protein, 8 aa, Entamoeba invadens
KPSTVSTS

SEQ ID NO: 2762696 - protein, 4 aa, Entamoeba invadens
KPSV

SEQ ID NO: 2762697 - protein, 26 aa, Entamoeba invadens
KPTDKKTCEKCKETYKDPCDDTDEEC

SEQ ID NO: 2762698 - protein, 26 aa, Entamoeba invadens
KPTDKKTCEKCKETYKDPCDETDEEC

SEQ ID NO: 2762699 - protein, 8 aa, Entamoeba invadens
KPTDSGVT

SEQ ID NO: 2762700 - protein, 16 aa, Entamoeba invadens
KPTEYSGQGRNPEKNC

SEQ ID NO: 2762701 - protein, 4 aa, Entamoeba invadens
KPTF

SEQ ID NO: 2762702 - protein, 7 aa, Entamoeba invadens
KPTFGRT

SEQ ID NO: 2762703 - protein, 7 aa, Entamoeba invadens
KPTGCKV

SEQ ID NO: 2762704 - protein, 8 aa, Entamoeba invadens
KPTKTQCK

SEQ ID NO: 2762705 - protein, 15 aa, Entamoeba invadens
KPTLSQNLDEIKDKN

SEQ ID NO: 2762706 - protein, 7 aa, Entamoeba invadens
KPTPQKF

SEQ ID NO: 2762707 - protein, 5 aa, Entamoeba invadens
KPTQI

SEQ ID NO: 2762708 - protein, 8 aa, Entamoeba invadens
KPTQNTIP

SEQ ID NO: 2762709 - protein, 20 aa, Entamoeba invadens
KPTQTAPVRDPVADGKQIPV

SEQ ID NO: 2762710 - protein, 6 aa, Entamoeba invadens
KPTSDL

SEQ ID NO: 2762711 - protein, 7 aa, Entamoeba invadens
KPTSRGH

SEQ ID NO: 2762712 - protein, 11 aa, Entamoeba invadens
KPTSRHDNRTK

SEQ ID NO: 2762713 - protein, 8 aa, Entamoeba invadens
KPTSSTKC

SEQ ID NO: 2762714 - protein, 12 aa, Entamoeba invadens
KPTTKKDEKTEI

SEQ ID NO: 2762715 - protein, 13 aa, Entamoeba invadens
KPTTTGMYTNSSS

SEQ ID NO: 2762716 - protein, 6 aa, Entamoeba invadens
KPVKDG

SEQ ID NO: 2762717 - protein, 13 aa, Entamoeba invadens
KPVKTFSGNYRDE

SEQ ID NO: 2762718 - protein, 6 aa, Entamoeba invadens
KPVTTT

SEQ ID NO: 2762719 - protein, 7 aa, Entamoeba invadens
KPYADKA

SEQ ID NO: 2762720 - protein, 9 aa, Entamoeba invadens
KPYNNPSSI

SEQ ID NO: 2762721 - protein, 8 aa, Entamoeba invadens
KPYSTVSN

SEQ ID NO: 2762722 - protein, 4 aa, Entamoeba invadens
KPYT

SEQ ID NO: 2762723 - protein, 6 aa, Entamoeba invadens
KPYTVT

SEQ ID NO: 2762724 - protein, 7 aa, Entamoeba invadens
KQAAPGD

SEQ ID NO: 2762725 - protein, 9 aa, Entamoeba invadens
KQAGDKEDI

SEQ ID NO: 2762726 - protein, 6 aa, Entamoeba invadens
KQAIGT

SEQ ID NO: 2762727 - protein, 6 aa, Entamoeba invadens
KQAKKY

SEQ ID NO: 2762728 - protein, 7 aa, Entamoeba invadens
KQALGDA

SEQ ID NO: 2762729 - protein, 6 aa, Entamoeba invadens
KQALPN

SEQ ID NO: 2762730 - protein, 8 aa, Entamoeba invadens
KQANNETK

SEQ ID NO: 2762731 - protein, 10 aa, Entamoeba invadens
KQAQKKQEKN

SEQ ID NO: 2762732 - protein, 18 aa, Entamoeba invadens
KQATLDKEEKAKQEFENE

SEQ ID NO: 2762733 - protein, 4 aa, Entamoeba invadens
KQCD

SEQ ID NO: 2762734 - protein, 10 aa, Entamoeba invadens
KQCDENKTVG

SEQ ID NO: 2762735 - protein, 5 aa, Entamoeba invadens
KQCDQ

SEQ ID NO: 2762736 - protein, 16 aa, Entamoeba invadens
KQCDSKCENCTSATDC

SEQ ID NO: 2762737 - protein, 8 aa, Entamoeba invadens
KQCEKCSQ

SEQ ID NO: 2762738 - protein, 6 aa, Entamoeba invadens
KQCENG

SEQ ID NO: 2762739 - protein, 16 aa, Entamoeba invadens
KQCENGMYSSTSGITA

SEQ ID NO: 2762740 - protein, 17 aa, Entamoeba invadens
KQCENGYSPMYDTTNSN

SEQ ID NO: 2762741 - protein, 4 aa, Entamoeba invadens
KQCH

SEQ ID NO: 2762742 - protein, 16 aa, Entamoeba invadens
KQCKNGTHSSTSGSTV

SEQ ID NO: 2762743 - protein, 7 aa, Entamoeba invadens
KQCSSTC

SEQ ID NO: 2762744 - protein, 10 aa, Entamoeba invadens
KQCSTDSPSC

SEQ ID NO: 2762745 - protein, 4 aa, Entamoeba invadens
KQCT

SEQ ID NO: 2762746 - protein, 7 aa, Entamoeba invadens
KQDAQLD

SEQ ID NO: 2762747 - protein, 7 aa, Entamoeba invadens
KQDEGQE

SEQ ID NO: 2762748 - protein, 7 aa, Entamoeba invadens
KQDINRF

SEQ ID NO: 2762749 - protein, 12 aa, Entamoeba invadens
KQDPGSRPTFDQ

SEQ ID NO: 2762750 - protein, 16 aa, Entamoeba invadens
KQDPPRRKTYIPSDYN

SEQ ID NO: 2762751 - protein, 5 aa, Entamoeba invadens
KQDQR

SEQ ID NO: 2762752 - protein, 6 aa, Entamoeba invadens
KQDQTS

SEQ ID NO: 2762753 - protein, 7 aa, Entamoeba invadens
KQDQTTC

SEQ ID NO: 2762754 - protein, 8 aa, Entamoeba invadens
KQDSKTHL

SEQ ID NO: 2762755 - protein, 9 aa, Entamoeba invadens
KQDTNNRPI

SEQ ID NO: 2762756 - protein, 7 aa, Entamoeba invadens
KQDVDNT

SEQ ID NO: 2762757 - protein, 11 aa, Entamoeba invadens
KQEDGLKEQTA

SEQ ID NO: 2762758 - protein, 10 aa, Entamoeba invadens
KQEEGEYEKE

SEQ ID NO: 2762759 - protein, 5 aa, Entamoeba invadens
KQEEM

SEQ ID NO: 2762760 - protein, 7 aa, Entamoeba invadens
KQEEPEC

SEQ ID NO: 2762761 - protein, 7 aa, Entamoeba invadens
KQEEQPK

SEQ ID NO: 2762762 - protein, 8 aa, Entamoeba invadens
KQEERPTV

SEQ ID NO: 2762763 - protein, 8 aa, Entamoeba invadens
KQEEVTSR

SEQ ID NO: 2762764 - protein, 4 aa, Entamoeba invadens
KQEG

SEQ ID NO: 2762765 - protein, 11 aa, Entamoeba invadens
KQEGSERPTFD

SEQ ID NO: 2762766 - protein, 8 aa, Entamoeba invadens
KQEKEPQK

SEQ ID NO: 2762767 - protein, 6 aa, Entamoeba invadens
KQENTI

SEQ ID NO: 2762768 - protein, 6 aa, Entamoeba invadens
KQENTM

SEQ ID NO: 2762769 - protein, 8 aa, Entamoeba invadens
KQEPKERS

SEQ ID NO: 2762770 - protein, 10 aa, Entamoeba invadens
KQEPTERPTI

SEQ ID NO: 2762771 - protein, 6 aa, Entamoeba invadens
KQEQRD

SEQ ID NO: 2762772 - protein, 8 aa, Entamoeba invadens
KQETEKRC

SEQ ID NO: 2762773 - protein, 8 aa, Entamoeba invadens
KQETPNQL

SEQ ID NO: 2762774 - protein, 6 aa, Entamoeba invadens
KQEVNT

SEQ ID NO: 2762775 - protein, 12 aa, Entamoeba invadens
KQFEDNKWPALN

SEQ ID NO: 2762776 - protein, 12 aa, Entamoeba invadens
KQFEEQKLPAVN

SEQ ID NO: 2762777 - protein, 13 aa, Entamoeba invadens
KQFETQRSKRQDY

SEQ ID NO: 2762778 - protein, 6 aa, Entamoeba invadens
KQFGGN

SEQ ID NO: 2762779 - protein, 6 aa, Entamoeba invadens
KQGANI

SEQ ID NO: 2762780 - protein, 11 aa, Entamoeba invadens
KQGCSDKAQVT

SEQ ID NO: 2762781 - protein, 6 aa, Entamoeba invadens
KQGDTT

SEQ ID NO: 2762782 - protein, 8 aa, Entamoeba invadens
KQGDYNEP

SEQ ID NO: 2762783 - protein, 5 aa, Entamoeba invadens
KQGET

SEQ ID NO: 2762784 - protein, 8 aa, Entamoeba invadens
KQGGESME

SEQ ID NO: 2762785 - protein, 10 aa, Entamoeba invadens
KQGKSGSVEG

SEQ ID NO: 2762786 - protein, 7 aa, Entamoeba invadens
KQGTQDL

SEQ ID NO: 2762787 - protein, 6 aa, Entamoeba invadens
KQHAKN

SEQ ID NO: 2762788 - protein, 7 aa, Entamoeba invadens
KQHEEEV

SEQ ID NO: 2762789 - protein, 6 aa, Entamoeba invadens
KQHGDD

SEQ ID NO: 2762790 - protein, 21 aa, Entamoeba invadens
KQHISQGKCSQNNPNCDNQNG

SEQ ID NO: 2762791 - protein, 21 aa, Entamoeba invadens
KQHISQGKCSQNSANCDNQNG

SEQ ID NO: 2762792 - protein, 21 aa, Entamoeba invadens
KQHISQGKCSQNSANCENQNG

SEQ ID NO: 2762793 - protein, 4 aa, Entamoeba invadens
KQIE

SEQ ID NO: 2762794 - protein, 7 aa, Entamoeba invadens
KQIEDSK

SEQ ID NO: 2762795 - protein, 17 aa, Entamoeba invadens
KQIETDCAATENDLEKI

SEQ ID NO: 2762796 - protein, 6 aa, Entamoeba invadens
KQIGEE

SEQ ID NO: 2762797 - protein, 7 aa, Entamoeba invadens
KQIGEGS

SEQ ID NO: 2762798 - protein, 8 aa, Entamoeba invadens
KQIGEGSF

SEQ ID NO: 2762799 - protein, 7 aa, Entamoeba invadens
KQIGEGT

SEQ ID NO: 2762800 - protein, 7 aa, Entamoeba invadens
KQIGKGS

SEQ ID NO: 2762801 - protein, 34 aa, Entamoeba invadens
KQIKEKNEKVEQSENKQEESEKKEITEVEDQADK

SEQ ID NO: 2762802 - protein, 7 aa, Entamoeba invadens
KQIPTKS

SEQ ID NO: 2762803 - protein, 7 aa, Entamoeba invadens
KQIRKGL

SEQ ID NO: 2762804 - protein, 11 aa, Entamoeba invadens
KQITEKKDTLA

SEQ ID NO: 2762805 - protein, 11 aa, Entamoeba invadens
KQKAKDFEKDP

SEQ ID NO: 2762806 - protein, 10 aa, Entamoeba invadens
KQKAQAALNE

SEQ ID NO: 2762807 - protein, 14 aa, Entamoeba invadens
KQKASINSNFKGKS

SEQ ID NO: 2762808 - protein, 11 aa, Entamoeba invadens
KQKDGICSESF

SEQ ID NO: 2762809 - protein, 15 aa, Entamoeba invadens
KQKEEDRPSFDSSAQ

SEQ ID NO: 2762810 - protein, 9 aa, Entamoeba invadens
KQKENTKTA

SEQ ID NO: 2762811 - protein, 20 aa, Entamoeba invadens
KQKGRNEANQDEMTKTKEYD

SEQ ID NO: 2762812 - protein, 10 aa, Entamoeba invadens
KQKISDKNEM

SEQ ID NO: 2762813 - protein, 8 aa, Entamoeba invadens
KQKKDREK

SEQ ID NO: 2762814 - protein, 7 aa, Entamoeba invadens
KQKKEEL

SEQ ID NO: 2762815 - protein, 5 aa, Entamoeba invadens
KQKKR

SEQ ID NO: 2762816 - protein, 14 aa, Entamoeba invadens
KQKKRAKVTSAYPK

SEQ ID NO: 2762817 - protein, 10 aa, Entamoeba invadens
KQKKTAEKTY

SEQ ID NO: 2762818 - protein, 7 aa, Entamoeba invadens
KQKMEEE

SEQ ID NO: 2762819 - protein, 8 aa, Entamoeba invadens
KQKPKERS

SEQ ID NO: 2762820 - protein, 9 aa, Entamoeba invadens
KQKQEETTT

SEQ ID NO: 2762821 - protein, 19 aa, Entamoeba invadens
KQKQTTESEFYTNEETSPA

SEQ ID NO: 2762822 - protein, 11 aa, Entamoeba invadens
KQKRNIPPSGV

SEQ ID NO: 2762823 - protein, 5 aa, Entamoeba invadens
KQKTG

SEQ ID NO: 2762824 - protein, 10 aa, Entamoeba invadens
KQKTQDDAEQ

SEQ ID NO: 2762825 - protein, 8 aa, Entamoeba invadens
KQKTSKGV

SEQ ID NO: 2762826 - protein, 7 aa, Entamoeba invadens
KQKTTLT

SEQ ID NO: 2762827 - protein, 8 aa, Entamoeba invadens
KQKYKKEA

SEQ ID NO: 2762828 - protein, 10 aa, Entamoeba invadens
KQKYKKSADI

SEQ ID NO: 2762829 - protein, 10 aa, Entamoeba invadens
KQKYKKSADV

SEQ ID NO: 2762830 - protein, 7 aa, Entamoeba invadens
KQLADQR

SEQ ID NO: 2762831 - protein, 8 aa, Entamoeba invadens
KQLAEKTV

SEQ ID NO: 2762832 - protein, 6 aa, Entamoeba invadens
KQLDDN

SEQ ID NO: 2762833 - protein, 6 aa, Entamoeba invadens
KQLDNN

SEQ ID NO: 2762834 - protein, 9 aa, Entamoeba invadens
KQLEETRAS

SEQ ID NO: 2762835 - protein, 6 aa, Entamoeba invadens
KQLQNS

SEQ ID NO: 2762836 - protein, 11 aa, Entamoeba invadens
KQLSDPGKEVH

SEQ ID NO: 2762837 - protein, 5 aa, Entamoeba invadens
KQMDT

SEQ ID NO: 2762838 - protein, 9 aa, Entamoeba invadens
KQNAQKITK

SEQ ID NO: 2762839 - protein, 6 aa, Entamoeba invadens
KQNATN

SEQ ID NO: 2762840 - protein, 10 aa, Entamoeba invadens
KQNCDKSSVS

SEQ ID NO: 2762841 - protein, 7 aa, Entamoeba invadens
KQNDEIP

SEQ ID NO: 2762842 - protein, 9 aa, Entamoeba invadens
KQNDTKPDL

SEQ ID NO: 2762843 - protein, 5 aa, Entamoeba invadens
KQNDY

SEQ ID NO: 2762844 - protein, 4 aa, Entamoeba invadens
KQNE

SEQ ID NO: 2762845 - protein, 7 aa, Entamoeba invadens
KQNEGKI

SEQ ID NO: 2762846 - protein, 6 aa, Entamoeba invadens
KQNESS

SEQ ID NO: 2762847 - protein, 8 aa, Entamoeba invadens
KQNETFGS

SEQ ID NO: 2762848 - protein, 5 aa, Entamoeba invadens
KQNKN

SEQ ID NO: 2762849 - protein, 6 aa, Entamoeba invadens
KQNNAN

SEQ ID NO: 2762850 - protein, 10 aa, Entamoeba invadens
KQNNSYEEMN

SEQ ID NO: 2762851 - protein, 11 aa, Entamoeba invadens
KQNPDKKSTCT

SEQ ID NO: 2762852 - protein, 8 aa, Entamoeba invadens
KQNPKERC

SEQ ID NO: 2762853 - protein, 8 aa, Entamoeba invadens
KQNPKERI

SEQ ID NO: 2762854 - protein, 6 aa, Entamoeba invadens
KQNPLE

SEQ ID NO: 2762855 - protein, 7 aa, Entamoeba invadens
KQNRKNY

SEQ ID NO: 2762856 - protein, 10 aa, Entamoeba invadens
KQNRNITPFP

SEQ ID NO: 2762857 - protein, 5 aa, Entamoeba invadens
KQNTI

SEQ ID NO: 2762858 - protein, 12 aa, Entamoeba invadens
KQNWNTQFNETK

SEQ ID NO: 2762859 - protein, 4 aa, Entamoeba invadens
KQNY

SEQ ID NO: 2762860 - protein, 5 aa, Entamoeba invadens
KQNYD

SEQ ID NO: 2762861 - protein, 7 aa, Entamoeba invadens
KQPENVK

SEQ ID NO: 2762862 - protein, 13 aa, Entamoeba invadens
KQPPQPPENSTYY

SEQ ID NO: 2762863 - protein, 9 aa, Entamoeba invadens
KQPPVGKGS

SEQ ID NO: 2762864 - protein, 9 aa, Entamoeba invadens
KQPPVGQGS

SEQ ID NO: 2762865 - protein, 9 aa, Entamoeba invadens
KQPSTTTPK

SEQ ID NO: 2762866 - protein, 8 aa, Entamoeba invadens
KQPTGKVK

SEQ ID NO: 2762867 - protein, 7 aa, Entamoeba invadens
KQPTYAN

SEQ ID NO: 2762868 - protein, 9 aa, Entamoeba invadens
KQQEEPTVT

SEQ ID NO: 2762869 - protein, 6 aa, Entamoeba invadens
KQQEID

SEQ ID NO: 2762870 - protein, 12 aa, Entamoeba invadens
KQQEKSSEDIES

SEQ ID NO: 2762871 - protein, 5 aa, Entamoeba invadens
KQQEN

SEQ ID NO: 2762872 - protein, 5 aa, Entamoeba invadens
KQQEP

SEQ ID NO: 2762873 - protein, 10 aa, Entamoeba invadens
KQQFKAEGEW

SEQ ID NO: 2762874 - protein, 8 aa, Entamoeba invadens
KQQISSNP

SEQ ID NO: 2762875 - protein, 12 aa, Entamoeba invadens
KQQKNYNNLSNT

SEQ ID NO: 2762876 - protein, 7 aa, Entamoeba invadens
KQQNEAL

SEQ ID NO: 2762877 - protein, 20 aa, Entamoeba invadens
KQQPKERSDINTIMNELSFM

SEQ ID NO: 2762878 - protein, 6 aa, Entamoeba invadens
KQQPNE

SEQ ID NO: 2762879 - protein, 6 aa, Entamoeba invadens
KQQQPT

SEQ ID NO: 2762880 - protein, 13 aa, Entamoeba invadens
KQQQSQFSNMSDE

SEQ ID NO: 2762881 - protein, 12 aa, Entamoeba invadens
KQRDIGKEGGEL

SEQ ID NO: 2762882 - protein, 9 aa, Entamoeba invadens
KQREGGKTE

SEQ ID NO: 2762883 - protein, 6 aa, Entamoeba invadens
KQREKI

SEQ ID NO: 2762884 - protein, 16 aa, Entamoeba invadens
KQRETKTTFKSNPQSV

SEQ ID NO: 2762885 - protein, 10 aa, Entamoeba invadens
KQRKTDEINT

SEQ ID NO: 2762886 - protein, 5 aa, Entamoeba invadens
KQRNG

SEQ ID NO: 2762887 - protein, 6 aa, Entamoeba invadens
KQRPTF

SEQ ID NO: 2762888 - protein, 20 aa, Entamoeba invadens
KQRREEKRLNKEKASQKPKE

SEQ ID NO: 2762889 - protein, 13 aa, Entamoeba invadens
KQRSASSKQRSKN

SEQ ID NO: 2762890 - protein, 6 aa, Entamoeba invadens
KQRSNK

SEQ ID NO: 2762891 - protein, 14 aa, Entamoeba invadens
KQRTNQEYSKSEVI

SEQ ID NO: 2762892 - protein, 7 aa, Entamoeba invadens
KQRVAKD

SEQ ID NO: 2762893 - protein, 6 aa, Entamoeba invadens
KQRVSP

SEQ ID NO: 2762894 - protein, 8 aa, Entamoeba invadens
KQSAGKDF

SEQ ID NO: 2762895 - protein, 11 aa, Entamoeba invadens
KQSAKISTNTN

SEQ ID NO: 2762896 - protein, 8 aa, Entamoeba invadens
KQSDIRTD

SEQ ID NO: 2762897 - protein, 11 aa, Entamoeba invadens
KQSEEKRSYED

SEQ ID NO: 2762898 - protein, 5 aa, Entamoeba invadens
KQSGA

SEQ ID NO: 2762899 - protein, 6 aa, Entamoeba invadens
KQSGIQ

SEQ ID NO: 2762900 - protein, 8 aa, Entamoeba invadens
KQSGQCNS

SEQ ID NO: 2762901 - protein, 15 aa, Entamoeba invadens
KQSMNEDGKEKEFRN

SEQ ID NO: 2762902 - protein, 7 aa, Entamoeba invadens
KQSNEIE

SEQ ID NO: 2762903 - protein, 8 aa, Entamoeba invadens
KQSNEVDM

SEQ ID NO: 2762904 - protein, 5 aa, Entamoeba invadens
KQSNL

SEQ ID NO: 2762905 - protein, 10 aa, Entamoeba invadens
KQSPEERTNA

SEQ ID NO: 2762906 - protein, 6 aa, Entamoeba invadens
KQSPNF

SEQ ID NO: 2762907 - protein, 7 aa, Entamoeba invadens
KQSSRDL

SEQ ID NO: 2762908 - protein, 6 aa, Entamoeba invadens
KQSVDS

SEQ ID NO: 2762909 - protein, 8 aa, Entamoeba invadens
KQSYNDEK

SEQ ID NO: 2762910 - protein, 7 aa, Entamoeba invadens
KQTDKFN

SEQ ID NO: 2762911 - protein, 7 aa, Entamoeba invadens
KQTDSDV

SEQ ID NO: 2762912 - protein, 5 aa, Entamoeba invadens
KQTDV

SEQ ID NO: 2762913 - protein, 7 aa, Entamoeba invadens
KQTEEAV

SEQ ID NO: 2762914 - protein, 5 aa, Entamoeba invadens
KQTER

SEQ ID NO: 2762915 - protein, 37 aa, Entamoeba invadens
KQTKCKNCTKEMQRSNTNMTTTNTSANVTQNKGSQVK

SEQ ID NO: 2762916 - protein, 14 aa, Entamoeba invadens
KQTKRAEQKAALKS

SEQ ID NO: 2762917 - protein, 13 aa, Entamoeba invadens
KQTMNTSQETELN

SEQ ID NO: 2762918 - protein, 20 aa, Entamoeba invadens
KQTNEKIKVSAKTKKSTKLN

SEQ ID NO: 2762919 - protein, 7 aa, Entamoeba invadens
KQTNENG

SEQ ID NO: 2762920 - protein, 7 aa, Entamoeba invadens
KQTPSSY

SEQ ID NO: 2762921 - protein, 10 aa, Entamoeba invadens
KQTPTERPSF

SEQ ID NO: 2762922 - protein, 4 aa, Entamoeba invadens
KQTQ

SEQ ID NO: 2762923 - protein, 6 aa, Entamoeba invadens
KQTSDV

SEQ ID NO: 2762924 - protein, 7 aa, Entamoeba invadens
KQTVPNL

SEQ ID NO: 2762925 - protein, 5 aa, Entamoeba invadens
KQTYN

SEQ ID NO: 2762926 - protein, 10 aa, Entamoeba invadens
KQVDENEQFD

SEQ ID NO: 2762927 - protein, 7 aa, Entamoeba invadens
KQVEEEV

SEQ ID NO: 2762928 - protein, 11 aa, Entamoeba invadens
KQVEENERSRI

SEQ ID NO: 2762929 - protein, 7 aa, Entamoeba invadens
KQVGEGA

SEQ ID NO: 2762930 - protein, 7 aa, Entamoeba invadens
KQVGEGS

SEQ ID NO: 2762931 - protein, 7 aa, Entamoeba invadens
KQVNNND

SEQ ID NO: 2762932 - protein, 13 aa, Entamoeba invadens
KQVTNQNTGNEEC

SEQ ID NO: 2762933 - protein, 11 aa, Entamoeba invadens
KQVTNQTTGNV

SEQ ID NO: 2762934 - protein, 5 aa, Entamoeba invadens
KRAGR

SEQ ID NO: 2762935 - protein, 5 aa, Entamoeba invadens
KRAKN

SEQ ID NO: 2762936 - protein, 8 aa, Entamoeba invadens
KRAQPSKA

SEQ ID NO: 2762937 - protein, 6 aa, Entamoeba invadens
KRASEK

SEQ ID NO: 2762938 - protein, 7 aa, Entamoeba invadens
KRASNLD

SEQ ID NO: 2762939 - protein, 9 aa, Entamoeba invadens
KRCDEQNAV

SEQ ID NO: 2762940 - protein, 9 aa, Entamoeba invadens
KRCDKTSGK

SEQ ID NO: 2762941 - protein, 10 aa, Entamoeba invadens
KRCEDPKEKC

SEQ ID NO: 2762942 - protein, 6 aa, Entamoeba invadens
KRCEKC

SEQ ID NO: 2762943 - protein, 6 aa, Entamoeba invadens
KRCRGT

SEQ ID NO: 2762944 - protein, 9 aa, Entamoeba invadens
KRCSDGETC

SEQ ID NO: 2762945 - protein, 7 aa, Entamoeba invadens
KRCSPCN

SEQ ID NO: 2762946 - protein, 7 aa, Entamoeba invadens
KRDDKAF

SEQ ID NO: 2762947 - protein, 10 aa, Entamoeba invadens
KRDDVKKDNY

SEQ ID NO: 2762948 - protein, 6 aa, Entamoeba invadens
KRDEIG

SEQ ID NO: 2762949 - protein, 16 aa, Entamoeba invadens
KRDENASDGCKIKTTK

SEQ ID NO: 2762950 - protein, 8 aa, Entamoeba invadens
KRDGLSLG

SEQ ID NO: 2762951 - protein, 6 aa, Entamoeba invadens
KRDHQE

SEQ ID NO: 2762952 - protein, 20 aa, Entamoeba invadens
KRDKSPKVKQNETEGNKEVQ

SEQ ID NO: 2762953 - protein, 10 aa, Entamoeba invadens
KRDNEKYNTI

SEQ ID NO: 2762954 - protein, 6 aa, Entamoeba invadens
KRDNIT

SEQ ID NO: 2762955 - protein, 8 aa, Entamoeba invadens
KRDSSGLS

SEQ ID NO: 2762956 - protein, 7 aa, Entamoeba invadens
KRDTSGL

SEQ ID NO: 2762957 - protein, 6 aa, Entamoeba invadens
KREAPI

SEQ ID NO: 2762958 - protein, 5 aa, Entamoeba invadens
KRECP

SEQ ID NO: 2762959 - protein, 6 aa, Entamoeba invadens
KREDAA

SEQ ID NO: 2762960 - protein, 8 aa, Entamoeba invadens
KREEKKRK

SEQ ID NO: 2762961 - protein, 12 aa, Entamoeba invadens
KREKIEKPEENY

SEQ ID NO: 2762962 - protein, 13 aa, Entamoeba invadens
KRENEELRTELQT

SEQ ID NO: 2762963 - protein, 9 aa, Entamoeba invadens
KRENKDKSL

SEQ ID NO: 2762964 - protein, 11 aa, Entamoeba invadens
KRENKMKEGTI

SEQ ID NO: 2762965 - protein, 5 aa, Entamoeba invadens
KREPT

SEQ ID NO: 2762966 - protein, 32 aa, Entamoeba invadens
KRERSRSDPLTPPISPKLQKSGTSMENDTNSF

SEQ ID NO: 2762967 - protein, 24 aa, Entamoeba invadens
KRETKREKVTRQTETSENPQQTKL

SEQ ID NO: 2762968 - protein, 9 aa, Entamoeba invadens
KRETNETGR

SEQ ID NO: 2762969 - protein, 9 aa, Entamoeba invadens
KREVEKTTT

SEQ ID NO: 2762970 - protein, 7 aa, Entamoeba invadens
KREVESE

SEQ ID NO: 2762971 - protein, 12 aa, Entamoeba invadens
KREYSRNDPKHC

SEQ ID NO: 2762972 - protein, 10 aa, Entamoeba invadens
KRFDRPEEIP

SEQ ID NO: 2762973 - protein, 10 aa, Entamoeba invadens
KRFEPTDGKK

SEQ ID NO: 2762974 - protein, 8 aa, Entamoeba invadens
KRFERPEE

SEQ ID NO: 2762975 - protein, 7 aa, Entamoeba invadens
KRFERTE

SEQ ID NO: 2762976 - protein, 6 aa, Entamoeba invadens
KRFKTP

SEQ ID NO: 2762977 - protein, 38 aa, Entamoeba invadens
KRFSSKLKSSMKEEHSPSSFESNPRTSITNDSEDSSVF

SEQ ID NO: 2762978 - protein, 9 aa, Entamoeba invadens
KRGEKSGEV

SEQ ID NO: 2762979 - protein, 11 aa, Entamoeba invadens
KRGFYEKESLS

SEQ ID NO: 2762980 - protein, 7 aa, Entamoeba invadens
KRGKGCE

SEQ ID NO: 2762981 - protein, 17 aa, Entamoeba invadens
KRGKGDGDNNISDEEVV

SEQ ID NO: 2762982 - protein, 7 aa, Entamoeba invadens
KRGKPEY

SEQ ID NO: 2762983 - protein, 6 aa, Entamoeba invadens
KRGMSD

SEQ ID NO: 2762984 - protein, 4 aa, Entamoeba invadens
KRGN

SEQ ID NO: 2762985 - protein, 6 aa, Entamoeba invadens
KRGNKT

SEQ ID NO: 2762986 - protein, 9 aa, Entamoeba invadens
KRHEKERKK

SEQ ID NO: 2762987 - protein, 6 aa, Entamoeba invadens
KRHGRW

SEQ ID NO: 2762988 - protein, 10 aa, Entamoeba invadens
KRHKKPQGLN

SEQ ID NO: 2762989 - protein, 27 aa, Entamoeba invadens
KRHNTTKETNTKINENLNKKENNTKEV

SEQ ID NO: 2762990 - protein, 14 aa, Entamoeba invadens
KRHRDDKKINYKTT

SEQ ID NO: 2762991 - protein, 20 aa, Entamoeba invadens
KRHSDAKTGRPKDVKTRRRL

SEQ ID NO: 2762992 - protein, 5 aa, Entamoeba invadens
KRIDA

SEQ ID NO: 2762993 - protein, 10 aa, Entamoeba invadens
KRIDKWDNKT

SEQ ID NO: 2762994 - protein, 7 aa, Entamoeba invadens
KRIGEIP

SEQ ID NO: 2762995 - protein, 7 aa, Entamoeba invadens
KRIGSGS

SEQ ID NO: 2762996 - protein, 32 aa, Entamoeba invadens
KRIKKKDTQRKRSKRETQKNEKKKKEDEKCST

SEQ ID NO: 2762997 - protein, 14 aa, Entamoeba invadens
KRIKSDSEELLTHE

SEQ ID NO: 2762998 - protein, 11 aa, Entamoeba invadens
KRINTENGQQM

SEQ ID NO: 2762999 - protein, 5 aa, Entamoeba invadens
KRIQY

SEQ ID NO: 2763000 - protein, 24 aa, Entamoeba invadens
KRIREKKRKFKDEKKKNDTTPKDI

SEQ ID NO: 2763001 - protein, 6 aa, Entamoeba invadens
KRISED

SEQ ID NO: 2763002 - protein, 10 aa, Entamoeba invadens
KRISTSPNFY

SEQ ID NO: 2763003 - protein, 6 aa, Entamoeba invadens
KRKAAL

SEQ ID NO: 2763004 - protein, 8 aa, Entamoeba invadens
KRKDLTTH

SEQ ID NO: 2763005 - protein, 10 aa, Entamoeba invadens
KRKDPIEKEQ

SEQ ID NO: 2763006 - protein, 10 aa, Entamoeba invadens
KRKDPIKKEQ

SEQ ID NO: 2763007 - protein, 53 aa, Entamoeba invadens
KRKEALDEKIKSYKAKEKLNQQQLKEEDKKKRVQEEEERRKQLAEEEERQRVD

SEQ ID NO: 2763008 - protein, 12 aa, Entamoeba invadens
KRKEANSHFLNM

SEQ ID NO: 2763009 - protein, 9 aa, Entamoeba invadens
KRKEQAPQN

SEQ ID NO: 2763010 - protein, 11 aa, Entamoeba invadens
KRKEQAPRSAI

SEQ ID NO: 2763011 - protein, 14 aa, Entamoeba invadens
KRKHKKGAPSNQLK

SEQ ID NO: 2763012 - protein, 9 aa, Entamoeba invadens
KRKKNYDIY

SEQ ID NO: 2763013 - protein, 31 aa, Entamoeba invadens
  misc_feature (15)..(16): Xaa can be any naturally occurring amino acid
KRKKSSKFRLKNYEXXKNYEYPFTTSRTFPS

SEQ ID NO: 2763014 - protein, 8 aa, Entamoeba invadens
KRKKTDAI

SEQ ID NO: 2763015 - protein, 12 aa, Entamoeba invadens
KRKNSEERVPKN

SEQ ID NO: 2763016 - protein, 11 aa, Entamoeba invadens
KRKQKKKDQNI

SEQ ID NO: 2763017 - protein, 6 aa, Entamoeba invadens
KRKREN

SEQ ID NO: 2763018 - protein, 4 aa, Entamoeba invadens
KRKS

SEQ ID NO: 2763019 - protein, 6 aa, Entamoeba invadens
KRKSFN

SEQ ID NO: 2763020 - protein, 14 aa, Entamoeba invadens
KRKSLYTKQTGCSP

SEQ ID NO: 2763021 - protein, 12 aa, Entamoeba invadens
KRKTANKDDTKI

SEQ ID NO: 2763022 - protein, 7 aa, Entamoeba invadens
KRKTVAG

SEQ ID NO: 2763023 - protein, 9 aa, Entamoeba invadens
KRKYKKPSD

SEQ ID NO: 2763024 - protein, 4 aa, Entamoeba invadens
KRLD

SEQ ID NO: 2763025 - protein, 5 aa, Entamoeba invadens
KRLDI

SEQ ID NO: 2763026 - protein, 12 aa, Entamoeba invadens
KRLDKKENMSDK

SEQ ID NO: 2763027 - protein, 12 aa, Entamoeba invadens
KRLDKKENMSEN

SEQ ID NO: 2763028 - protein, 40 aa, Entamoeba invadens
KRLEDNEKKETDVKKKDQKKEEKKKKRQSTPSLKKDKTHE

SEQ ID NO: 2763029 - protein, 5 aa, Entamoeba invadens
KRLEI

SEQ ID NO: 2763030 - protein, 7 aa, Entamoeba invadens
KRLEIPE

SEQ ID NO: 2763031 - protein, 5 aa, Entamoeba invadens
KRLEK

SEQ ID NO: 2763032 - protein, 10 aa, Entamoeba invadens
KRLEKPNNME

SEQ ID NO: 2763033 - protein, 6 aa, Entamoeba invadens
KRLERR

SEQ ID NO: 2763034 - protein, 11 aa, Entamoeba invadens
KRLERRENIPK

SEQ ID NO: 2763035 - protein, 7 aa, Entamoeba invadens
KRLETGK

SEQ ID NO: 2763036 - protein, 5 aa, Entamoeba invadens
KRLKA

SEQ ID NO: 2763037 - protein, 10 aa, Entamoeba invadens
KRLKNEGNIP

SEQ ID NO: 2763038 - protein, 4 aa, Entamoeba invadens
KRLL

SEQ ID NO: 2763039 - protein, 15 aa, Entamoeba invadens
KRLNTTSNYTPKRVE

SEQ ID NO: 2763040 - protein, 12 aa, Entamoeba invadens
KRLPKEESITQD

SEQ ID NO: 2763041 - protein, 12 aa, Entamoeba invadens
KRLPKKESITQD

SEQ ID NO: 2763042 - protein, 10 aa, Entamoeba invadens
KRLPKTDNMH

SEQ ID NO: 2763043 - protein, 10 aa, Entamoeba invadens
KRLPQPKNID

SEQ ID NO: 2763044 - protein, 11 aa, Entamoeba invadens
KRLPRKEGMSE

SEQ ID NO: 2763045 - protein, 4 aa, Entamoeba invadens
KRLQ

SEQ ID NO: 2763046 - protein, 7 aa, Entamoeba invadens
KRLTQRA

SEQ ID NO: 2763047 - protein, 6 aa, Entamoeba invadens
KRLTTK

SEQ ID NO: 2763048 - protein, 5 aa, Entamoeba invadens
KRNAD

SEQ ID NO: 2763049 - protein, 11 aa, Entamoeba invadens
KRNDKDSVGVR

SEQ ID NO: 2763050 - protein, 16 aa, Entamoeba invadens
KRNDLSGGIGSAPAYQ

SEQ ID NO: 2763051 - protein, 5 aa, Entamoeba invadens
KRNDV

SEQ ID NO: 2763052 - protein, 15 aa, Entamoeba invadens
KRNEKKKVDEESGPI

SEQ ID NO: 2763053 - protein, 12 aa, Entamoeba invadens
KRNERLKKLMGD

SEQ ID NO: 2763054 - protein, 5 aa, Entamoeba invadens
KRNLD

SEQ ID NO: 2763055 - protein, 6 aa, Entamoeba invadens
KRNNKP

SEQ ID NO: 2763056 - protein, 8 aa, Entamoeba invadens
KRNSSVTK

SEQ ID NO: 2763057 - protein, 6 aa, Entamoeba invadens
KRNSTK

SEQ ID NO: 2763058 - protein, 8 aa, Entamoeba invadens
KRNVSGKD

SEQ ID NO: 2763059 - protein, 7 aa, Entamoeba invadens
KRNYQSA

SEQ ID NO: 2763060 - protein, 5 aa, Entamoeba invadens
KRPAD

SEQ ID NO: 2763061 - protein, 12 aa, Entamoeba invadens
KRPDIFDENENV

SEQ ID NO: 2763062 - protein, 4 aa, Entamoeba invadens
KRPE

SEQ ID NO: 2763063 - protein, 7 aa, Entamoeba invadens
KRPEETK

SEQ ID NO: 2763064 - protein, 20 aa, Entamoeba invadens
KRPIDISSEDGEQPNEVKGE

SEQ ID NO: 2763065 - protein, 8 aa, Entamoeba invadens
KRPKITKN

SEQ ID NO: 2763066 - protein, 6 aa, Entamoeba invadens
KRPNYV

SEQ ID NO: 2763067 - protein, 29 aa, Entamoeba invadens
KRPSGMKGPPKKHVVPQSPLGLASSASGA

SEQ ID NO: 2763068 - protein, 6 aa, Entamoeba invadens
KRPSQV

SEQ ID NO: 2763069 - protein, 14 aa, Entamoeba invadens
KRPTEEQEDDVDPV

SEQ ID NO: 2763070 - protein, 6 aa, Entamoeba invadens
KRPTLG

SEQ ID NO: 2763071 - protein, 7 aa, Entamoeba invadens
KRPYGKM

SEQ ID NO: 2763072 - protein, 9 aa, Entamoeba invadens
KRQEEERKK

SEQ ID NO: 2763073 - protein, 6 aa, Entamoeba invadens
KRQESY

SEQ ID NO: 2763074 - protein, 14 aa, Entamoeba invadens
KRQNFSQSEEVQIA

SEQ ID NO: 2763075 - protein, 7 aa, Entamoeba invadens
KRRDKNE

SEQ ID NO: 2763076 - protein, 9 aa, Entamoeba invadens
KRREQSPRM

SEQ ID NO: 2763077 - protein, 4 aa, Entamoeba invadens
KRRG

SEQ ID NO: 2763078 - protein, 8 aa, Entamoeba invadens
KRRKEKRT

SEQ ID NO: 2763079 - protein, 9 aa, Entamoeba invadens
KRRKKAQKE

SEQ ID NO: 2763080 - protein, 9 aa, Entamoeba invadens
KRRKNAVTS

SEQ ID NO: 2763081 - protein, 8 aa, Entamoeba invadens
KRRKTPID

SEQ ID NO: 2763082 - protein, 26 aa, Entamoeba invadens
KRRNKEKKDRDERQENLEKKSEIVRR

SEQ ID NO: 2763083 - protein, 5 aa, Entamoeba invadens
KRRNM

SEQ ID NO: 2763084 - protein, 7 aa, Entamoeba invadens
KRRPPPL

SEQ ID NO: 2763085 - protein, 8 aa, Entamoeba invadens
KRSDDIPP

SEQ ID NO: 2763086 - protein, 10 aa, Entamoeba invadens
KRSDDVNSKY

SEQ ID NO: 2763087 - protein, 21 aa, Entamoeba invadens
KRSDDVNSKYSYQKSNEDVPQ

SEQ ID NO: 2763088 - protein, 8 aa, Entamoeba invadens
KRSDEIET

SEQ ID NO: 2763089 - protein, 21 aa, Entamoeba invadens
KRSDVNTKYTYQKSNQDVPQT

SEQ ID NO: 2763090 - protein, 8 aa, Entamoeba invadens
KRSEDFVS

SEQ ID NO: 2763091 - protein, 6 aa, Entamoeba invadens
KRSEEI

SEQ ID NO: 2763092 - protein, 13 aa, Entamoeba invadens
KRSERVKRNLYEI

SEQ ID NO: 2763093 - protein, 6 aa, Entamoeba invadens
KRSEYG

SEQ ID NO: 2763094 - protein, 7 aa, Entamoeba invadens
KRSGTQA

SEQ ID NO: 2763095 - protein, 7 aa, Entamoeba invadens
KRSKEAT

SEQ ID NO: 2763096 - protein, 8 aa, Entamoeba invadens
KRSKKDVQ

SEQ ID NO: 2763097 - protein, 9 aa, Entamoeba invadens
KRSKSGNQE

SEQ ID NO: 2763098 - protein, 8 aa, Entamoeba invadens
KRSNETKQ

SEQ ID NO: 2763099 - protein, 12 aa, Entamoeba invadens
KRSNYSFKDSTK

SEQ ID NO: 2763100 - protein, 8 aa, Entamoeba invadens
KRSRADQD

SEQ ID NO: 2763101 - protein, 7 aa, Entamoeba invadens
KRSVDSK

SEQ ID NO: 2763102 - protein, 5 aa, Entamoeba invadens
KRTAM

SEQ ID NO: 2763103 - protein, 13 aa, Entamoeba invadens
KRTATAKIPMSSE

SEQ ID NO: 2763104 - protein, 6 aa, Entamoeba invadens
KRTDLA

SEQ ID NO: 2763105 - protein, 9 aa, Entamoeba invadens
KRTDRDDPM

SEQ ID NO: 2763106 - protein, 11 aa, Entamoeba invadens
KRTETLQIETN

SEQ ID NO: 2763107 - protein, 5 aa, Entamoeba invadens
KRTFV

SEQ ID NO: 2763108 - protein, 7 aa, Entamoeba invadens
KRTGGYS

SEQ ID NO: 2763109 - protein, 7 aa, Entamoeba invadens
KRTGLGE

SEQ ID NO: 2763110 - protein, 11 aa, Entamoeba invadens
KRTKEELNEQL

SEQ ID NO: 2763111 - protein, 7 aa, Entamoeba invadens
KRTNTKL

SEQ ID NO: 2763112 - protein, 4 aa, Entamoeba invadens
KRTQ

SEQ ID NO: 2763113 - protein, 15 aa, Entamoeba invadens
KRTRRLQEQLVQVER

SEQ ID NO: 2763114 - protein, 6 aa, Entamoeba invadens
KRTSVL

SEQ ID NO: 2763115 - protein, 4 aa, Entamoeba invadens
KRTT

SEQ ID NO: 2763116 - protein, 7 aa, Entamoeba invadens
KRTTAVK

SEQ ID NO: 2763117 - protein, 8 aa, Entamoeba invadens
KRTTETIQ

SEQ ID NO: 2763118 - protein, 15 aa, Entamoeba invadens
KRTTKMNNMLCDVVK

SEQ ID NO: 2763119 - protein, 6 aa, Entamoeba invadens
KRTTVP

SEQ ID NO: 2763120 - protein, 5 aa, Entamoeba invadens
KRVDF

SEQ ID NO: 2763121 - protein, 37 aa, Entamoeba invadens
KRVDNSVKKLKKTEAPNVISPAPSATEAADTDSGTET

SEQ ID NO: 2763122 - protein, 5 aa, Entamoeba invadens
KRVEE

SEQ ID NO: 2763123 - protein, 11 aa, Entamoeba invadens
KRVEKKDNMPQ

SEQ ID NO: 2763124 - protein, 11 aa, Entamoeba invadens
KRVEKKENMPQ

SEQ ID NO: 2763125 - protein, 11 aa, Entamoeba invadens
KRVENSKNIPN

SEQ ID NO: 2763126 - protein, 11 aa, Entamoeba invadens
KRVENSNNIPN

SEQ ID NO: 2763127 - protein, 11 aa, Entamoeba invadens
KRVNKNPSMSD

SEQ ID NO: 2763128 - protein, 9 aa, Entamoeba invadens
KRVPSKKSK

SEQ ID NO: 2763129 - protein, 10 aa, Entamoeba invadens
KRVQDRNMTA

SEQ ID NO: 2763130 - protein, 13 aa, Entamoeba invadens
KRVTQQKYDKPSV

SEQ ID NO: 2763131 - protein, 6 aa, Entamoeba invadens
KRWKEQ

SEQ ID NO: 2763132 - protein, 7 aa, Entamoeba invadens
KRYEATK

SEQ ID NO: 2763133 - protein, 6 aa, Entamoeba invadens
KRYGTT

SEQ ID NO: 2763134 - protein, 7 aa, Entamoeba invadens
KRYKTAA

SEQ ID NO: 2763135 - protein, 18 aa, Entamoeba invadens
KRYKTERGENGEKIDVQE

SEQ ID NO: 2763136 - protein, 7 aa, Entamoeba invadens
KRYPTRD

SEQ ID NO: 2763137 - protein, 16 aa, Entamoeba invadens
KRYQKRHEESNSVSKV

SEQ ID NO: 2763138 - protein, 7 aa, Entamoeba invadens
KRYRTTA

SEQ ID NO: 2763139 - protein, 9 aa, Entamoeba invadens
KRYSAKNTK

SEQ ID NO: 2763140 - protein, 14 aa, Entamoeba invadens
KRYSCGENKHLTTQ

SEQ ID NO: 2763141 - protein, 6 aa, Entamoeba invadens
KRYSRD

SEQ ID NO: 2763142 - protein, 11 aa, Entamoeba invadens
KSACNQKRYNT

SEQ ID NO: 2763143 - protein, 7 aa, Entamoeba invadens
KSADTSC

SEQ ID NO: 2763144 - protein, 8 aa, Entamoeba invadens
KSAEDEIA

SEQ ID NO: 2763145 - protein, 8 aa, Entamoeba invadens
KSAEVETK

SEQ ID NO: 2763146 - protein, 5 aa, Entamoeba invadens
KSAGA

SEQ ID NO: 2763147 - protein, 8 aa, Entamoeba invadens
KSAISSTI

SEQ ID NO: 2763148 - protein, 9 aa, Entamoeba invadens
KSAKQNGAQ

SEQ ID NO: 2763149 - protein, 5 aa, Entamoeba invadens
KSALY

SEQ ID NO: 2763150 - protein, 8 aa, Entamoeba invadens
KSANEYGV

SEQ ID NO: 2763151 - protein, 7 aa, Entamoeba invadens
KSANGVK

SEQ ID NO: 2763152 - protein, 21 aa, Entamoeba invadens
KSANNSKCTKCEGKHKPSDMG

SEQ ID NO: 2763153 - protein, 7 aa, Entamoeba invadens
KSAPGDV

SEQ ID NO: 2763154 - protein, 6 aa, Entamoeba invadens
KSASGK

SEQ ID NO: 2763155 - protein, 7 aa, Entamoeba invadens
KSATDEL

SEQ ID NO: 2763156 - protein, 11 aa, Entamoeba invadens
KSCDENSLGPP

SEQ ID NO: 2763157 - protein, 9 aa, Entamoeba invadens
KSCDQDPDM

SEQ ID NO: 2763158 - protein, 9 aa, Entamoeba invadens
KSCDTCTEN

SEQ ID NO: 2763159 - protein, 10 aa, Entamoeba invadens
KSCEDGLSTI

SEQ ID NO: 2763160 - protein, 18 aa, Entamoeba invadens
KSCESQELQHSQQSQKFC

SEQ ID NO: 2763161 - protein, 8 aa, Entamoeba invadens
KSCETNST

SEQ ID NO: 2763162 - protein, 8 aa, Entamoeba invadens
KSCGSCEV

SEQ ID NO: 2763163 - protein, 14 aa, Entamoeba invadens
KSCIKDKEGDNKCK

SEQ ID NO: 2763164 - protein, 17 aa, Entamoeba invadens
KSCIKDKEGDNKCKGKL

SEQ ID NO: 2763165 - protein, 8 aa, Entamoeba invadens
KSCKEDKC

SEQ ID NO: 2763166 - protein, 7 aa, Entamoeba invadens
KSCKKCN

SEQ ID NO: 2763167 - protein, 7 aa, Entamoeba invadens
KSCKKCS

SEQ ID NO: 2763168 - protein, 8 aa, Entamoeba invadens
KSCKSEKS

SEQ ID NO: 2763169 - protein, 7 aa, Entamoeba invadens
KSCNKCS

SEQ ID NO: 2763170 - protein, 6 aa, Entamoeba invadens
KSCNNM

SEQ ID NO: 2763171 - protein, 7 aa, Entamoeba invadens
KSCNPRE

SEQ ID NO: 2763172 - protein, 10 aa, Entamoeba invadens
KSCNSKENKC

SEQ ID NO: 2763173 - protein, 9 aa, Entamoeba invadens
KSCNSRENK

SEQ ID NO: 2763174 - protein, 8 aa, Entamoeba invadens
KSCQEEVS

SEQ ID NO: 2763175 - protein, 5 aa, Entamoeba invadens
KSCTS

SEQ ID NO: 2763176 - protein, 9 aa, Entamoeba invadens
KSCTSEGNC

SEQ ID NO: 2763177 - protein, 9 aa, Entamoeba invadens
KSCYGKTTQ

SEQ ID NO: 2763178 - protein, 10 aa, Entamoeba invadens
KSDDLGKRQT

SEQ ID NO: 2763179 - protein, 9 aa, Entamoeba invadens
KSDDPDSSS

SEQ ID NO: 2763180 - protein, 5 aa, Entamoeba invadens
KSDID

SEQ ID NO: 2763181 - protein, 13 aa, Entamoeba invadens
KSDINGEVTTNNN

SEQ ID NO: 2763182 - protein, 21 aa, Entamoeba invadens
KSDKVTGCKRRKTVERTNLGS

SEQ ID NO: 2763183 - protein, 8 aa, Entamoeba invadens
KSDLKSEL

SEQ ID NO: 2763184 - protein, 9 aa, Entamoeba invadens
KSDLNEQEK

SEQ ID NO: 2763185 - protein, 43 aa, Entamoeba invadens
KSDMRSSKSAKYMKSSYSTGSLQNTASSEENRPDYTKAKKFST

SEQ ID NO: 2763186 - protein, 21 aa, Entamoeba invadens
KSDSKKPLVGGDEEWNNLTRK

SEQ ID NO: 2763187 - protein, 41 aa, Entamoeba invadens
KSDSSTPSRVVSRSTSKTRLPPPVRYSEEEPSSRFSGSESN

SEQ ID NO: 2763188 - protein, 5 aa, Entamoeba invadens
KSDTI

SEQ ID NO: 2763189 - protein, 7 aa, Entamoeba invadens
KSDTQST

SEQ ID NO: 2763190 - protein, 14 aa, Entamoeba invadens
KSDTYCTTNSGTTF

SEQ ID NO: 2763191 - protein, 8 aa, Entamoeba invadens
KSECERCS

SEQ ID NO: 2763192 - protein, 6 aa, Entamoeba invadens
KSEEDI

SEQ ID NO: 2763193 - protein, 5 aa, Entamoeba invadens
KSEEE

SEQ ID NO: 2763194 - protein, 11 aa, Entamoeba invadens
KSEEGNMGEIN

SEQ ID NO: 2763195 - protein, 6 aa, Entamoeba invadens
KSEEIE

SEQ ID NO: 2763196 - protein, 6 aa, Entamoeba invadens
KSEEKI

SEQ ID NO: 2763197 - protein, 7 aa, Entamoeba invadens
KSEEKQL

SEQ ID NO: 2763198 - protein, 8 aa, Entamoeba invadens
KSEEKSIT

SEQ ID NO: 2763199 - protein, 6 aa, Entamoeba invadens
KSEESF

SEQ ID NO: 2763200 - protein, 8 aa, Entamoeba invadens
KSEGDGTL

SEQ ID NO: 2763201 - protein, 23 aa, Entamoeba invadens
KSEGNITSQDKQTSFNPDGDNSA

SEQ ID NO: 2763202 - protein, 7 aa, Entamoeba invadens
KSEIEEK

SEQ ID NO: 2763203 - protein, 15 aa, Entamoeba invadens
KSEIYDADKESTENL

SEQ ID NO: 2763204 - protein, 18 aa, Entamoeba invadens
KSEKIKKTVDSKKRTDNI

SEQ ID NO: 2763205 - protein, 7 aa, Entamoeba invadens
KSEKVKR

SEQ ID NO: 2763206 - protein, 6 aa, Entamoeba invadens
KSELIE

SEQ ID NO: 2763207 - protein, 7 aa, Entamoeba invadens
KSEMPHN

SEQ ID NO: 2763208 - protein, 6 aa, Entamoeba invadens
KSENVK

SEQ ID NO: 2763209 - protein, 6 aa, Entamoeba invadens
KSESLH

SEQ ID NO: 2763210 - protein, 16 aa, Entamoeba invadens
KSESTTTEKGNVIATK

SEQ ID NO: 2763211 - protein, 9 aa, Entamoeba invadens
KSETDTLRA

SEQ ID NO: 2763212 - protein, 8 aa, Entamoeba invadens
KSETSLSP

SEQ ID NO: 2763213 - protein, 7 aa, Entamoeba invadens
KSETTTD

SEQ ID NO: 2763214 - protein, 9 aa, Entamoeba invadens
KSEVTSTFK

SEQ ID NO: 2763215 - protein, 6 aa, Entamoeba invadens
KSFCPT

SEQ ID NO: 2763216 - protein, 7 aa, Entamoeba invadens
KSFDDYE

SEQ ID NO: 2763217 - protein, 5 aa, Entamoeba invadens
KSFDG

SEQ ID NO: 2763218 - protein, 5 aa, Entamoeba invadens
KSFEK

SEQ ID NO: 2763219 - protein, 4 aa, Entamoeba invadens
KSFK

SEQ ID NO: 2763220 - protein, 13 aa, Entamoeba invadens
KSFLSTEKMTRSH

SEQ ID NO: 2763221 - protein, 11 aa, Entamoeba invadens
KSFSSGNENGC

SEQ ID NO: 2763222 - protein, 6 aa, Entamoeba invadens
KSFTDW

SEQ ID NO: 2763223 - protein, 40 aa, Entamoeba invadens
KSGACSSCSSGYKKVGDNCTSCASNGNCNSCDSNENESNR

SEQ ID NO: 2763224 - protein, 5 aa, Entamoeba invadens
KSGCD

SEQ ID NO: 2763225 - protein, 13 aa, Entamoeba invadens
KSGCDDDTSIKEF

SEQ ID NO: 2763226 - protein, 6 aa, Entamoeba invadens
KSGCEN

SEQ ID NO: 2763227 - protein, 14 aa, Entamoeba invadens
KSGCSDVSSKKEFE

SEQ ID NO: 2763228 - protein, 8 aa, Entamoeba invadens
KSGCTNET

SEQ ID NO: 2763229 - protein, 8 aa, Entamoeba invadens
KSGDKEDV

SEQ ID NO: 2763230 - protein, 5 aa, Entamoeba invadens
KSGEC

SEQ ID NO: 2763231 - protein, 8 aa, Entamoeba invadens
KSGEYKAK

SEQ ID NO: 2763232 - protein, 7 aa, Entamoeba invadens
KSGGSRD

SEQ ID NO: 2763233 - protein, 7 aa, Entamoeba invadens
KSGIAGL

SEQ ID NO: 2763234 - protein, 9 aa, Entamoeba invadens
KSGKAGRFY

SEQ ID NO: 2763235 - protein, 11 aa, Entamoeba invadens
KSGKQNSTSIA

SEQ ID NO: 2763236 - protein, 9 aa, Entamoeba invadens
KSGKTSTDN

SEQ ID NO: 2763237 - protein, 5 aa, Entamoeba invadens
KSGLD

SEQ ID NO: 2763238 - protein, 9 aa, Entamoeba invadens
KSGLQKNSL

SEQ ID NO: 2763239 - protein, 34 aa, Entamoeba invadens
KSGMYPQQNGRCGDCDPTCGNKCDGTTGACTGCN

SEQ ID NO: 2763240 - protein, 11 aa, Entamoeba invadens
KSGNCTKCEKT

SEQ ID NO: 2763241 - protein, 7 aa, Entamoeba invadens
KSGNRLK

SEQ ID NO: 2763242 - protein, 21 aa, Entamoeba invadens
KSGQCEHNNCSDPNDENGKCT

SEQ ID NO: 2763243 - protein, 21 aa, Entamoeba invadens
KSGQCEHNNCSDPNDENGRCS

SEQ ID NO: 2763244 - protein, 21 aa, Entamoeba invadens
KSGQCEHNNCSDPNDENGRCT

SEQ ID NO: 2763245 - protein, 21 aa, Entamoeba invadens
KSGQCEHNNCSEPNDENGRCS

SEQ ID NO: 2763246 - protein, 6 aa, Entamoeba invadens
KSGQKV

SEQ ID NO: 2763247 - protein, 7 aa, Entamoeba invadens
KSGQSYK

SEQ ID NO: 2763248 - protein, 26 aa, Entamoeba invadens
KSGRSGIKRSEKEYQDALSKKEKSSL

SEQ ID NO: 2763249 - protein, 9 aa, Entamoeba invadens
KSGRSGLDV

SEQ ID NO: 2763250 - protein, 5 aa, Entamoeba invadens
KSGRV

SEQ ID NO: 2763251 - protein, 6 aa, Entamoeba invadens
KSGSLQ

SEQ ID NO: 2763252 - protein, 7 aa, Entamoeba invadens
KSGSNFA

SEQ ID NO: 2763253 - protein, 6 aa, Entamoeba invadens
KSGSTF

SEQ ID NO: 2763254 - protein, 13 aa, Entamoeba invadens
KSGTAANQETNTC

SEQ ID NO: 2763255 - protein, 9 aa, Entamoeba invadens
KSGTCIKSG

SEQ ID NO: 2763256 - protein, 5 aa, Entamoeba invadens
KSGTG

SEQ ID NO: 2763257 - protein, 8 aa, Entamoeba invadens
KSGTNTTL

SEQ ID NO: 2763258 - protein, 12 aa, Entamoeba invadens
KSGTQCKKCNKS

SEQ ID NO: 2763259 - protein, 7 aa, Entamoeba invadens
KSGTSGC

SEQ ID NO: 2763260 - protein, 7 aa, Entamoeba invadens
KSGTSIH

SEQ ID NO: 2763261 - protein, 7 aa, Entamoeba invadens
KSGTTTL

SEQ ID NO: 2763262 - protein, 4 aa, Entamoeba invadens
KSGV

SEQ ID NO: 2763263 - protein, 6 aa, Entamoeba invadens
KSGVYS

SEQ ID NO: 2763264 - protein, 7 aa, Entamoeba invadens
KSGYKEV

SEQ ID NO: 2763265 - protein, 11 aa, Entamoeba invadens
KSGYQKTASNT

SEQ ID NO: 2763266 - protein, 7 aa, Entamoeba invadens
KSGYTFK

SEQ ID NO: 2763267 - protein, 4 aa, Entamoeba invadens
KSHC

SEQ ID NO: 2763268 - protein, 8 aa, Entamoeba invadens
KSHKSYES

SEQ ID NO: 2763269 - protein, 7 aa, Entamoeba invadens
KSHPGVQ

SEQ ID NO: 2763270 - protein, 8 aa, Entamoeba invadens
KSIEMEED

SEQ ID NO: 2763271 - protein, 4 aa, Entamoeba invadens
KSIK

SEQ ID NO: 2763272 - protein, 6 aa, Entamoeba invadens
KSIKAK

SEQ ID NO: 2763273 - protein, 6 aa, Entamoeba invadens
KSIKEK

SEQ ID NO: 2763274 - protein, 13 aa, Entamoeba invadens
KSIKGDTFQYPET

SEQ ID NO: 2763275 - protein, 4 aa, Entamoeba invadens
KSIL

SEQ ID NO: 2763276 - protein, 8 aa, Entamoeba invadens
KSILDNPD

SEQ ID NO: 2763277 - protein, 24 aa, Entamoeba invadens
KSINDEACGRCSSGTYFDTTTKSC

SEQ ID NO: 2763278 - protein, 5 aa, Entamoeba invadens
KSIQG

SEQ ID NO: 2763279 - protein, 7 aa, Entamoeba invadens
KSIQKQR

SEQ ID NO: 2763280 - protein, 8 aa, Entamoeba invadens
KSITEETI

SEQ ID NO: 2763281 - protein, 22 aa, Entamoeba invadens
KSITGADKVTSFGASSFQETSL

SEQ ID NO: 2763282 - protein, 6 aa, Entamoeba invadens
KSITQK

SEQ ID NO: 2763283 - protein, 5 aa, Entamoeba invadens
KSITT

SEQ ID NO: 2763284 - protein, 18 aa, Entamoeba invadens
KSKCVSKSACKSTIGGKC

SEQ ID NO: 2763285 - protein, 6 aa, Entamoeba invadens
KSKDIS

SEQ ID NO: 2763286 - protein, 4 aa, Entamoeba invadens
KSKE

SEQ ID NO: 2763287 - protein, 12 aa, Entamoeba invadens
KSKEADGKYNGM

SEQ ID NO: 2763288 - protein, 15 aa, Entamoeba invadens
KSKESGAKIEAERAP

SEQ ID NO: 2763289 - protein, 8 aa, Entamoeba invadens
KSKGATKT

SEQ ID NO: 2763290 - protein, 9 aa, Entamoeba invadens
KSKGNKGVR

SEQ ID NO: 2763291 - protein, 7 aa, Entamoeba invadens
KSKIENS

SEQ ID NO: 2763292 - protein, 8 aa, Entamoeba invadens
KSKILGKD

SEQ ID NO: 2763293 - protein, 8 aa, Entamoeba invadens
KSKIQDNS

SEQ ID NO: 2763294 - protein, 4 aa, Entamoeba invadens
KSKK

SEQ ID NO: 2763295 - protein, 7 aa, Entamoeba invadens
KSKKILQ

SEQ ID NO: 2763296 - protein, 8 aa, Entamoeba invadens
KSKKIPKK

SEQ ID NO: 2763297 - protein, 16 aa, Entamoeba invadens
KSKKNKNAKYKKEFQD

SEQ ID NO: 2763298 - protein, 8 aa, Entamoeba invadens
KSKKPESL

SEQ ID NO: 2763299 - protein, 8 aa, Entamoeba invadens
KSKKSECD

SEQ ID NO: 2763300 - protein, 6 aa, Entamoeba invadens
KSKKTL

SEQ ID NO: 2763301 - protein, 8 aa, Entamoeba invadens
KSKLAAKV

SEQ ID NO: 2763302 - protein, 7 aa, Entamoeba invadens
KSKLPEK

SEQ ID NO: 2763303 - protein, 6 aa, Entamoeba invadens
KSKNAM

SEQ ID NO: 2763304 - protein, 7 aa, Entamoeba invadens
KSKNFDD

SEQ ID NO: 2763305 - protein, 5 aa, Entamoeba invadens
KSKNQ

SEQ ID NO: 2763306 - protein, 9 aa, Entamoeba invadens
KSKNSKCSK

SEQ ID NO: 2763307 - protein, 8 aa, Entamoeba invadens
KSKQTFAT

SEQ ID NO: 2763308 - protein, 8 aa, Entamoeba invadens
KSKRSDEI

SEQ ID NO: 2763309 - protein, 9 aa, Entamoeba invadens
KSKRTPRTV

SEQ ID NO: 2763310 - protein, 8 aa, Entamoeba invadens
KSKSALSV

SEQ ID NO: 2763311 - protein, 5 aa, Entamoeba invadens
KSKSI

SEQ ID NO: 2763312 - protein, 6 aa, Entamoeba invadens
KSKSIN

SEQ ID NO: 2763313 - protein, 15 aa, Entamoeba invadens
KSKSSEYNMMNEHIF

SEQ ID NO: 2763314 - protein, 12 aa, Entamoeba invadens
KSKTETLEQERQ

SEQ ID NO: 2763315 - protein, 8 aa, Entamoeba invadens
KSKTGFDT

SEQ ID NO: 2763316 - protein, 12 aa, Entamoeba invadens
KSKTIEESQSYY

SEQ ID NO: 2763317 - protein, 9 aa, Entamoeba invadens
KSKTLSVGT

SEQ ID NO: 2763318 - protein, 30 aa, Entamoeba invadens
KSKTNKKKRRTLTKDTPKKGEGLTKSAIPS

SEQ ID NO: 2763319 - protein, 8 aa, Entamoeba invadens
KSKTNNYA

SEQ ID NO: 2763320 - protein, 7 aa, Entamoeba invadens
KSKTTIT

SEQ ID NO: 2763321 - protein, 8 aa, Entamoeba invadens
KSKTYNPF

SEQ ID NO: 2763322 - protein, 9 aa, Entamoeba invadens
KSLAAESTA

SEQ ID NO: 2763323 - protein, 5 aa, Entamoeba invadens
KSLAT

SEQ ID NO: 2763324 - protein, 9 aa, Entamoeba invadens
KSLCTKSSN

SEQ ID NO: 2763325 - protein, 4 aa, Entamoeba invadens
KSLD

SEQ ID NO: 2763326 - protein, 8 aa, Entamoeba invadens
KSLDSQSV

SEQ ID NO: 2763327 - protein, 4 aa, Entamoeba invadens
KSLE

SEQ ID NO: 2763328 - protein, 12 aa, Entamoeba invadens
KSLEEKIDDAER

SEQ ID NO: 2763329 - protein, 11 aa, Entamoeba invadens
KSLENGDENIT

SEQ ID NO: 2763330 - protein, 11 aa, Entamoeba invadens
KSLFEEQQNGM

SEQ ID NO: 2763331 - protein, 5 aa, Entamoeba invadens
KSLGK

SEQ ID NO: 2763332 - protein, 13 aa, Entamoeba invadens
KSLKDEECDGGVN

SEQ ID NO: 2763333 - protein, 7 aa, Entamoeba invadens
KSLKQKT

SEQ ID NO: 2763334 - protein, 6 aa, Entamoeba invadens
KSLPFD

SEQ ID NO: 2763335 - protein, 6 aa, Entamoeba invadens
KSLPFN

SEQ ID NO: 2763336 - protein, 6 aa, Entamoeba invadens
KSLPSQ

SEQ ID NO: 2763337 - protein, 4 aa, Entamoeba invadens
KSLQ

SEQ ID NO: 2763338 - protein, 11 aa, Entamoeba invadens
KSLQDENITES

SEQ ID NO: 2763339 - protein, 13 aa, Entamoeba invadens
KSLRNKDNTIQNY

SEQ ID NO: 2763340 - protein, 8 aa, Entamoeba invadens
KSLSGGAI

SEQ ID NO: 2763341 - protein, 10 aa, Entamoeba invadens
KSLSSQHDRE

SEQ ID NO: 2763342 - protein, 5 aa, Entamoeba invadens
KSLSV

SEQ ID NO: 2763343 - protein, 4 aa, Entamoeba invadens
KSLT

SEQ ID NO: 2763344 - protein, 25 aa, Entamoeba invadens
KSLTETIDEENKPIIPKETPKKKYV

SEQ ID NO: 2763345 - protein, 6 aa, Entamoeba invadens
KSLTFD

SEQ ID NO: 2763346 - protein, 7 aa, Entamoeba invadens
KSLTFDD

SEQ ID NO: 2763347 - protein, 8 aa, Entamoeba invadens
KSLTFDDT

SEQ ID NO: 2763348 - protein, 11 aa, Entamoeba invadens
KSMDPSVAGTA

SEQ ID NO: 2763349 - protein, 6 aa, Entamoeba invadens
KSMEVT

SEQ ID NO: 2763350 - protein, 6 aa, Entamoeba invadens
KSMGKG

SEQ ID NO: 2763351 - protein, 6 aa, Entamoeba invadens
KSMPAV

SEQ ID NO: 2763352 - protein, 6 aa, Entamoeba invadens
KSMRRS

SEQ ID NO: 2763353 - protein, 7 aa, Entamoeba invadens
KSMSRDE

SEQ ID NO: 2763354 - protein, 5 aa, Entamoeba invadens
KSMSS

SEQ ID NO: 2763355 - protein, 7 aa, Entamoeba invadens
KSNAKFQ

SEQ ID NO: 2763356 - protein, 7 aa, Entamoeba invadens
KSNAKSS

SEQ ID NO: 2763357 - protein, 5 aa, Entamoeba invadens
KSNAP

SEQ ID NO: 2763358 - protein, 6 aa, Entamoeba invadens
KSNCEQ

SEQ ID NO: 2763359 - protein, 10 aa, Entamoeba invadens
KSNDELKGSC

SEQ ID NO: 2763360 - protein, 8 aa, Entamoeba invadens
KSNGNCNS

SEQ ID NO: 2763361 - protein, 6 aa, Entamoeba invadens
KSNGQI

SEQ ID NO: 2763362 - protein, 6 aa, Entamoeba invadens
KSNGSF

SEQ ID NO: 2763363 - protein, 4 aa, Entamoeba invadens
KSNH

SEQ ID NO: 2763364 - protein, 9 aa, Entamoeba invadens
KSNHGRKTT

SEQ ID NO: 2763365 - protein, 4 aa, Entamoeba invadens
KSNI

SEQ ID NO: 2763366 - protein, 6 aa, Entamoeba invadens
KSNKIL

SEQ ID NO: 2763367 - protein, 7 aa, Entamoeba invadens
KSNKNLR

SEQ ID NO: 2763368 - protein, 7 aa, Entamoeba invadens
KSNKQTT

SEQ ID NO: 2763369 - protein, 9 aa, Entamoeba invadens
KSNKSYAEI

SEQ ID NO: 2763370 - protein, 4 aa, Entamoeba invadens
KSNL

SEQ ID NO: 2763371 - protein, 14 aa, Entamoeba invadens
KSNLDEKGLGTPVY

SEQ ID NO: 2763372 - protein, 8 aa, Entamoeba invadens
KSNLKKDD

SEQ ID NO: 2763373 - protein, 6 aa, Entamoeba invadens
KSNLNI

SEQ ID NO: 2763374 - protein, 7 aa, Entamoeba invadens
KSNMDAI

SEQ ID NO: 2763375 - protein, 5 aa, Entamoeba invadens
KSNNA

SEQ ID NO: 2763376 - protein, 7 aa, Entamoeba invadens
KSNNDEV

SEQ ID NO: 2763377 - protein, 8 aa, Entamoeba invadens
KSNNNKTV

SEQ ID NO: 2763378 - protein, 15 aa, Entamoeba invadens
KSNNSGSIPKNKSYV

SEQ ID NO: 2763379 - protein, 14 aa, Entamoeba invadens
KSNPEKRGDVDTEI

SEQ ID NO: 2763380 - protein, 5 aa, Entamoeba invadens
KSNSD

SEQ ID NO: 2763381 - protein, 6 aa, Entamoeba invadens
KSNSII

SEQ ID NO: 2763382 - protein, 7 aa, Entamoeba invadens
KSNSIST

SEQ ID NO: 2763383 - protein, 8 aa, Entamoeba invadens
KSNSNTIN

SEQ ID NO: 2763384 - protein, 7 aa, Entamoeba invadens
KSNSTDL

SEQ ID NO: 2763385 - protein, 9 aa, Entamoeba invadens
KSNTENSDY

SEQ ID NO: 2763386 - protein, 9 aa, Entamoeba invadens
KSNTENSGY

SEQ ID NO: 2763387 - protein, 9 aa, Entamoeba invadens
KSNTNSSYT

SEQ ID NO: 2763388 - protein, 6 aa, Entamoeba invadens
KSNTQH

SEQ ID NO: 2763389 - protein, 8 aa, Entamoeba invadens
KSNVNPRT

SEQ ID NO: 2763390 - protein, 23 aa, Entamoeba invadens
KSNYDYVDDNPKYFSENEMLEVH

SEQ ID NO: 2763391 - protein, 7 aa, Entamoeba invadens
KSNYETY

SEQ ID NO: 2763392 - protein, 5 aa, Entamoeba invadens
KSNYH

SEQ ID NO: 2763393 - protein, 4 aa, Entamoeba invadens
KSPC

SEQ ID NO: 2763394 - protein, 10 aa, Entamoeba invadens
KSPDDKEAIE

SEQ ID NO: 2763395 - protein, 4 aa, Entamoeba invadens
KSPE

SEQ ID NO: 2763396 - protein, 7 aa, Entamoeba invadens
KSPEKFQ

SEQ ID NO: 2763397 - protein, 23 aa, Entamoeba invadens
KSPELPLSKSQSGSGLTSPRSQL

SEQ ID NO: 2763398 - protein, 22 aa, Entamoeba invadens
KSPEQKSQPEITESEKHKNETV

SEQ ID NO: 2763399 - protein, 6 aa, Entamoeba invadens
KSPERV

SEQ ID NO: 2763400 - protein, 6 aa, Entamoeba invadens
KSPEVV

SEQ ID NO: 2763401 - protein, 7 aa, Entamoeba invadens
KSPHEIS

SEQ ID NO: 2763402 - protein, 7 aa, Entamoeba invadens
KSPKERM

SEQ ID NO: 2763403 - protein, 5 aa, Entamoeba invadens
KSPKH

SEQ ID NO: 2763404 - protein, 6 aa, Entamoeba invadens
KSPNFD

SEQ ID NO: 2763405 - protein, 17 aa, Entamoeba invadens
KSPPVPPKPASKTQSMS

SEQ ID NO: 2763406 - protein, 6 aa, Entamoeba invadens
KSPQTQ

SEQ ID NO: 2763407 - protein, 6 aa, Entamoeba invadens
KSPRTL

SEQ ID NO: 2763408 - protein, 7 aa, Entamoeba invadens
KSPSGFD

SEQ ID NO: 2763409 - protein, 13 aa, Entamoeba invadens
KSPSYCTSTSNTY

SEQ ID NO: 2763410 - protein, 5 aa, Entamoeba invadens
KSPTA

SEQ ID NO: 2763411 - protein, 8 aa, Entamoeba invadens
KSPTKLTK

SEQ ID NO: 2763412 - protein, 7 aa, Entamoeba invadens
KSPVKAG

SEQ ID NO: 2763413 - protein, 5 aa, Entamoeba invadens
KSPYI

SEQ ID NO: 2763414 - protein, 6 aa, Entamoeba invadens
KSPYND

SEQ ID NO: 2763415 - protein, 6 aa, Entamoeba invadens
KSPYQL

SEQ ID NO: 2763416 - protein, 15 aa, Entamoeba invadens
KSQCVSDSGCTQTYE

SEQ ID NO: 2763417 - protein, 4 aa, Entamoeba invadens
KSQE

SEQ ID NO: 2763418 - protein, 5 aa, Entamoeba invadens
KSQED

SEQ ID NO: 2763419 - protein, 6 aa, Entamoeba invadens
KSQGGR

SEQ ID NO: 2763420 - protein, 22 aa, Entamoeba invadens
KSQKALLRSSQPKTGFTGKSDE

SEQ ID NO: 2763421 - protein, 5 aa, Entamoeba invadens
KSQLV

SEQ ID NO: 2763422 - protein, 9 aa, Entamoeba invadens
KSQNCETYS

SEQ ID NO: 2763423 - protein, 16 aa, Entamoeba invadens
KSQNSNFQKVESKTLE

SEQ ID NO: 2763424 - protein, 18 aa, Entamoeba invadens
KSQPQVPRTPRTPKKDET

SEQ ID NO: 2763425 - protein, 5 aa, Entamoeba invadens
KSQQM

SEQ ID NO: 2763426 - protein, 8 aa, Entamoeba invadens
KSQQTRDE

SEQ ID NO: 2763427 - protein, 15 aa, Entamoeba invadens
KSQSNKIQRTDTFKG

SEQ ID NO: 2763428 - protein, 6 aa, Entamoeba invadens
KSQSYM

SEQ ID NO: 2763429 - protein, 5 aa, Entamoeba invadens
KSQTD

SEQ ID NO: 2763430 - protein, 10 aa, Entamoeba invadens
KSQTEDNVTV

SEQ ID NO: 2763431 - protein, 8 aa, Entamoeba invadens
KSQTKDTC

SEQ ID NO: 2763432 - protein, 16 aa, Entamoeba invadens
KSQTTCEKCKETYETP

SEQ ID NO: 2763433 - protein, 20 aa, Entamoeba invadens
KSQTTCEKCKETYETPCTDE

SEQ ID NO: 2763434 - protein, 7 aa, Entamoeba invadens
KSQVKEG

SEQ ID NO: 2763435 - protein, 9 aa, Entamoeba invadens
KSQVSKSDI

SEQ ID NO: 2763436 - protein, 9 aa, Entamoeba invadens
KSRDEELNK

SEQ ID NO: 2763437 - protein, 6 aa, Entamoeba invadens
KSRDIP

SEQ ID NO: 2763438 - protein, 4 aa, Entamoeba invadens
KSRK

SEQ ID NO: 2763439 - protein, 11 aa, Entamoeba invadens
KSRKTANSEDE

SEQ ID NO: 2763440 - protein, 9 aa, Entamoeba invadens
KSRKTSSTL

SEQ ID NO: 2763441 - protein, 14 aa, Entamoeba invadens
KSRNMTEEQEKEFN

SEQ ID NO: 2763442 - protein, 14 aa, Entamoeba invadens
KSRNMTQEQEKEFN

SEQ ID NO: 2763443 - protein, 13 aa, Entamoeba invadens
KSRNQQKKASGVF

SEQ ID NO: 2763444 - protein, 15 aa, Entamoeba invadens
KSRPHGCDEEYREAQ

SEQ ID NO: 2763445 - protein, 16 aa, Entamoeba invadens
KSRPNAESVVQQLENI

SEQ ID NO: 2763446 - protein, 8 aa, Entamoeba invadens
KSRPVQQQ

SEQ ID NO: 2763447 - protein, 9 aa, Entamoeba invadens
KSRSLTDEL

SEQ ID NO: 2763448 - protein, 9 aa, Entamoeba invadens
KSRSLTEEL

SEQ ID NO: 2763449 - protein, 5 aa, Entamoeba invadens
KSRTF

SEQ ID NO: 2763450 - protein, 9 aa, Entamoeba invadens
KSRTGEVKA

SEQ ID NO: 2763451 - protein, 4 aa, Entamoeba invadens
KSRV

SEQ ID NO: 2763452 - protein, 5 aa, Entamoeba invadens
KSRVC

SEQ ID NO: 2763453 - protein, 4 aa, Entamoeba invadens
KSSA

SEQ ID NO: 2763454 - protein, 6 aa, Entamoeba invadens
KSSALK

SEQ ID NO: 2763455 - protein, 4 aa, Entamoeba invadens
KSSC

SEQ ID NO: 2763456 - protein, 13 aa, Entamoeba invadens
KSSCDDTTQCSDY

SEQ ID NO: 2763457 - protein, 7 aa, Entamoeba invadens
KSSCNRC

SEQ ID NO: 2763458 - protein, 8 aa, Entamoeba invadens
KSSCRPKT

SEQ ID NO: 2763459 - protein, 5 aa, Entamoeba invadens
KSSDG

SEQ ID NO: 2763460 - protein, 7 aa, Entamoeba invadens
KSSDGEC

SEQ ID NO: 2763461 - protein, 8 aa, Entamoeba invadens
KSSDTKTC

SEQ ID NO: 2763462 - protein, 9 aa, Entamoeba invadens
KSSDTSSPC

SEQ ID NO: 2763463 - protein, 11 aa, Entamoeba invadens
KSSEENSLDEF

SEQ ID NO: 2763464 - protein, 7 aa, Entamoeba invadens
KSSEKDK

SEQ ID NO: 2763465 - protein, 5 aa, Entamoeba invadens
KSSER

SEQ ID NO: 2763466 - protein, 21 aa, Entamoeba invadens
KSSFEDEQNPEEKSLKEKEIE

SEQ ID NO: 2763467 - protein, 6 aa, Entamoeba invadens
KSSGKI

SEQ ID NO: 2763468 - protein, 9 aa, Entamoeba invadens
KSSGSNDEM

SEQ ID NO: 2763469 - protein, 8 aa, Entamoeba invadens
KSSHSTES

SEQ ID NO: 2763470 - protein, 4 aa, Entamoeba invadens
KSSI

SEQ ID NO: 2763471 - protein, 7 aa, Entamoeba invadens
KSSIKKC

SEQ ID NO: 2763472 - protein, 6 aa, Entamoeba invadens
KSSITT

SEQ ID NO: 2763473 - protein, 9 aa, Entamoeba invadens
KSSKKAIDS

SEQ ID NO: 2763474 - protein, 7 aa, Entamoeba invadens
KSSKYQK

SEQ ID NO: 2763475 - protein, 16 aa, Entamoeba invadens
KSSLDKQTISVSQSAS

SEQ ID NO: 2763476 - protein, 5 aa, Entamoeba invadens
KSSLN

SEQ ID NO: 2763477 - protein, 7 aa, Entamoeba invadens
KSSMKRK

SEQ ID NO: 2763478 - protein, 5 aa, Entamoeba invadens
KSSNN

SEQ ID NO: 2763479 - protein, 6 aa, Entamoeba invadens
KSSNNE

SEQ ID NO: 2763480 - protein, 22 aa, Entamoeba invadens
KSSPKSQEEVDCSTRNNKGCQR

SEQ ID NO: 2763481 - protein, 8 aa, Entamoeba invadens
KSSPSDPL

SEQ ID NO: 2763482 - protein, 9 aa, Entamoeba invadens
KSSQTAKTE

SEQ ID NO: 2763483 - protein, 7 aa, Entamoeba invadens
KSSQTHV

SEQ ID NO: 2763484 - protein, 5 aa, Entamoeba invadens
KSSRC

SEQ ID NO: 2763485 - protein, 12 aa, Entamoeba invadens
KSSRKYTPKKKS

SEQ ID NO: 2763486 - protein, 4 aa, Entamoeba invadens
KSSS

SEQ ID NO: 2763487 - protein, 6 aa, Entamoeba invadens
KSSSCI

SEQ ID NO: 2763488 - protein, 5 aa, Entamoeba invadens
KSSSF

SEQ ID NO: 2763489 - protein, 8 aa, Entamoeba invadens
KSSSFDSI

SEQ ID NO: 2763490 - protein, 5 aa, Entamoeba invadens
KSSSI

SEQ ID NO: 2763491 - protein, 9 aa, Entamoeba invadens
KSSSSSEQY

SEQ ID NO: 2763492 - protein, 8 aa, Entamoeba invadens
KSSTNSNA

SEQ ID NO: 2763493 - protein, 7 aa, Entamoeba invadens
KSSTQNL

SEQ ID NO: 2763494 - protein, 5 aa, Entamoeba invadens
KSSTY

SEQ ID NO: 2763495 - protein, 4 aa, Entamoeba invadens
KSSY

SEQ ID NO: 2763496 - protein, 7 aa, Entamoeba invadens
KSSYQAC

SEQ ID NO: 2763497 - protein, 6 aa, Entamoeba invadens
KSSYTS

SEQ ID NO: 2763498 - protein, 6 aa, Entamoeba invadens
KSTANG

SEQ ID NO: 2763499 - protein, 11 aa, Entamoeba invadens
KSTDENDPTVG

SEQ ID NO: 2763500 - protein, 5 aa, Entamoeba invadens
KSTDI

SEQ ID NO: 2763501 - protein, 8 aa, Entamoeba invadens
KSTDIDPI

SEQ ID NO: 2763502 - protein, 6 aa, Entamoeba invadens
KSTFED

SEQ ID NO: 2763503 - protein, 8 aa, Entamoeba invadens
KSTFETLD

SEQ ID NO: 2763504 - protein, 13 aa, Entamoeba invadens
KSTFNCKESGYSA

SEQ ID NO: 2763505 - protein, 14 aa, Entamoeba invadens
KSTFNCKESGYSAE

SEQ ID NO: 2763506 - protein, 8 aa, Entamoeba invadens
KSTHPLPA

SEQ ID NO: 2763507 - protein, 17 aa, Entamoeba invadens
KSTHTTSECTDGNSTTF

SEQ ID NO: 2763508 - protein, 4 aa, Entamoeba invadens
KSTI

SEQ ID NO: 2763509 - protein, 8 aa, Entamoeba invadens
KSTKCDSL

SEQ ID NO: 2763510 - protein, 17 aa, Entamoeba invadens
KSTKCDSLSEMNTNKTC

SEQ ID NO: 2763511 - protein, 10 aa, Entamoeba invadens
KSTKKSVDEA

SEQ ID NO: 2763512 - protein, 10 aa, Entamoeba invadens
KSTKQCKSCD

SEQ ID NO: 2763513 - protein, 4 aa, Entamoeba invadens
KSTL

SEQ ID NO: 2763514 - protein, 12 aa, Entamoeba invadens
KSTLKTSQCENT

SEQ ID NO: 2763515 - protein, 7 aa, Entamoeba invadens
KSTLRSG

SEQ ID NO: 2763516 - protein, 6 aa, Entamoeba invadens
KSTNCE

SEQ ID NO: 2763517 - protein, 9 aa, Entamoeba invadens
KSTNGDNYT

SEQ ID NO: 2763518 - protein, 7 aa, Entamoeba invadens
KSTNPAI

SEQ ID NO: 2763519 - protein, 7 aa, Entamoeba invadens
KSTPVNK

SEQ ID NO: 2763520 - protein, 7 aa, Entamoeba invadens
KSTPVRL

SEQ ID NO: 2763521 - protein, 6 aa, Entamoeba invadens
KSTQKI

SEQ ID NO: 2763522 - protein, 6 aa, Entamoeba invadens
KSTQNH

SEQ ID NO: 2763523 - protein, 34 aa, Entamoeba invadens
KSTQSSTSSISDSDTNTSSDTSSDNTDRSTKRRR

SEQ ID NO: 2763524 - protein, 7 aa, Entamoeba invadens
KSTSEKV

SEQ ID NO: 2763525 - protein, 6 aa, Entamoeba invadens
KSTSGR

SEQ ID NO: 2763526 - protein, 6 aa, Entamoeba invadens
KSTSPA

SEQ ID NO: 2763527 - protein, 8 aa, Entamoeba invadens
KSTSSTKC

SEQ ID NO: 2763528 - protein, 10 aa, Entamoeba invadens
KSTSTSAFQC

SEQ ID NO: 2763529 - protein, 7 aa, Entamoeba invadens
KSTSTSF

SEQ ID NO: 2763530 - protein, 4 aa, Entamoeba invadens
KSTT

SEQ ID NO: 2763531 - protein, 15 aa, Entamoeba invadens
KSTTFAGTGHLPTDL

SEQ ID NO: 2763532 - protein, 16 aa, Entamoeba invadens
KSTTHEKTLKTSNGLN

SEQ ID NO: 2763533 - protein, 12 aa, Entamoeba invadens
KSTTHNEEALED

SEQ ID NO: 2763534 - protein, 13 aa, Entamoeba invadens
KSTTQRAKYVEGE

SEQ ID NO: 2763535 - protein, 8 aa, Entamoeba invadens
KSTTSYGI

SEQ ID NO: 2763536 - protein, 4 aa, Entamoeba invadens
KSTV

SEQ ID NO: 2763537 - protein, 13 aa, Entamoeba invadens
KSTVDGKCVSTDS

SEQ ID NO: 2763538 - protein, 17 aa, Entamoeba invadens
KSTVKLDAATSKSFENT

SEQ ID NO: 2763539 - protein, 6 aa, Entamoeba invadens
KSTYRI

SEQ ID NO: 2763540 - protein, 7 aa, Entamoeba invadens
KSVDDGK

SEQ ID NO: 2763541 - protein, 6 aa, Entamoeba invadens
KSVEES

SEQ ID NO: 2763542 - protein, 10 aa, Entamoeba invadens
KSVESKTPNI

SEQ ID NO: 2763543 - protein, 4 aa, Entamoeba invadens
KSVF

SEQ ID NO: 2763544 - protein, 5 aa, Entamoeba invadens
KSVGI

SEQ ID NO: 2763545 - protein, 18 aa, Entamoeba invadens
KSVGNSVESELTKQQPYK

SEQ ID NO: 2763546 - protein, 15 aa, Entamoeba invadens
KSVKRRALDADRSYS

SEQ ID NO: 2763547 - protein, 14 aa, Entamoeba invadens
KSVKTEGGATVTTQ

SEQ ID NO: 2763548 - protein, 4 aa, Entamoeba invadens
KSVL

SEQ ID NO: 2763549 - protein, 8 aa, Entamoeba invadens
KSVNGASV

SEQ ID NO: 2763550 - protein, 9 aa, Entamoeba invadens
KSVNGTSKC

SEQ ID NO: 2763551 - protein, 9 aa, Entamoeba invadens
KSVPDNTSR

SEQ ID NO: 2763552 - protein, 7 aa, Entamoeba invadens
KSVPTTI

SEQ ID NO: 2763553 - protein, 6 aa, Entamoeba invadens
KSVRIE

SEQ ID NO: 2763554 - protein, 20 aa, Entamoeba invadens
KSVSEQIDAEKSHDKSDKDR

SEQ ID NO: 2763555 - protein, 8 aa, Entamoeba invadens
KSVSKAFS

SEQ ID NO: 2763556 - protein, 12 aa, Entamoeba invadens
KSVSNPTCTAVE

SEQ ID NO: 2763557 - protein, 6 aa, Entamoeba invadens
KSVSSQ

SEQ ID NO: 2763558 - protein, 8 aa, Entamoeba invadens
KSVSSQIR

SEQ ID NO: 2763559 - protein, 10 aa, Entamoeba invadens
KSVSTAVYEE

SEQ ID NO: 2763560 - protein, 11 aa, Entamoeba invadens
KSVSTTNTLTN

SEQ ID NO: 2763561 - protein, 10 aa, Entamoeba invadens
KSVTEGVEDF

SEQ ID NO: 2763562 - protein, 6 aa, Entamoeba invadens
KSVVNT

SEQ ID NO: 2763563 - protein, 25 aa, Entamoeba invadens
KSYDTQTQKCAECSGSNKVGPNGDE

SEQ ID NO: 2763564 - protein, 6 aa, Entamoeba invadens
KSYEEL

SEQ ID NO: 2763565 - protein, 7 aa, Entamoeba invadens
KSYELPD

SEQ ID NO: 2763566 - protein, 6 aa, Entamoeba invadens
KSYEQK

SEQ ID NO: 2763567 - protein, 8 aa, Entamoeba invadens
KSYESGVE

SEQ ID NO: 2763568 - protein, 8 aa, Entamoeba invadens
KSYTDEEF

SEQ ID NO: 2763569 - protein, 11 aa, Entamoeba invadens
KSYTTGAETIN

SEQ ID NO: 2763570 - protein, 6 aa, Entamoeba invadens
KSYVSS

SEQ ID NO: 2763571 - protein, 6 aa, Entamoeba invadens
KTAAYA

SEQ ID NO: 2763572 - protein, 8 aa, Entamoeba invadens
KTADGTNE

SEQ ID NO: 2763573 - protein, 6 aa, Entamoeba invadens
KTADHS

SEQ ID NO: 2763574 - protein, 7 aa, Entamoeba invadens
KTADRTI

SEQ ID NO: 2763575 - protein, 6 aa, Entamoeba invadens
KTAEGK

SEQ ID NO: 2763576 - protein, 9 aa, Entamoeba invadens
KTAGSTGSY

SEQ ID NO: 2763577 - protein, 9 aa, Entamoeba invadens
KTAKENINE

SEQ ID NO: 2763578 - protein, 6 aa, Entamoeba invadens
KTAKQV

SEQ ID NO: 2763579 - protein, 7 aa, Entamoeba invadens
KTANKDI

SEQ ID NO: 2763580 - protein, 8 aa, Entamoeba invadens
KTAPPDAI

SEQ ID NO: 2763581 - protein, 6 aa, Entamoeba invadens
KTAPVD

SEQ ID NO: 2763582 - protein, 5 aa, Entamoeba invadens
KTAQV

SEQ ID NO: 2763583 - protein, 19 aa, Entamoeba invadens
KTASCTPWPPAKPKEKVSC

SEQ ID NO: 2763584 - protein, 7 aa, Entamoeba invadens
KTASKNC

SEQ ID NO: 2763585 - protein, 8 aa, Entamoeba invadens
KTASLPNH

SEQ ID NO: 2763586 - protein, 6 aa, Entamoeba invadens
KTASTH

SEQ ID NO: 2763587 - protein, 8 aa, Entamoeba invadens
KTATPSGC

SEQ ID NO: 2763588 - protein, 5 aa, Entamoeba invadens
KTATT

SEQ ID NO: 2763589 - protein, 10 aa, Entamoeba invadens
KTAVGLSGFS

SEQ ID NO: 2763590 - protein, 12 aa, Entamoeba invadens
KTCAPGYNLKSN

SEQ ID NO: 2763591 - protein, 9 aa, Entamoeba invadens
KTCDDTNGN

SEQ ID NO: 2763592 - protein, 9 aa, Entamoeba invadens
KTCDQTNGN

SEQ ID NO: 2763593 - protein, 5 aa, Entamoeba invadens
KTCDR

SEQ ID NO: 2763594 - protein, 9 aa, Entamoeba invadens
KTCDRETSF

SEQ ID NO: 2763595 - protein, 5 aa, Entamoeba invadens
KTCDS

SEQ ID NO: 2763596 - protein, 11 aa, Entamoeba invadens
KTCDTNNTKCD

SEQ ID NO: 2763597 - protein, 6 aa, Entamoeba invadens
KTCEEC

SEQ ID NO: 2763598 - protein, 16 aa, Entamoeba invadens
KTCEEPENSNLSSNTK

SEQ ID NO: 2763599 - protein, 9 aa, Entamoeba invadens
KTCEGTSDT

SEQ ID NO: 2763600 - protein, 8 aa, Entamoeba invadens
KTCENEYK

SEQ ID NO: 2763601 - protein, 5 aa, Entamoeba invadens
KTCEP

SEQ ID NO: 2763602 - protein, 4 aa, Entamoeba invadens
KTCG

SEQ ID NO: 2763603 - protein, 9 aa, Entamoeba invadens
KTCGDNEEF

SEQ ID NO: 2763604 - protein, 10 aa, Entamoeba invadens
KTCGSGYNLE

SEQ ID NO: 2763605 - protein, 12 aa, Entamoeba invadens
KTCISNSELTES

SEQ ID NO: 2763606 - protein, 17 aa, Entamoeba invadens
KTCKKCGENCAKCSTSN

SEQ ID NO: 2763607 - protein, 5 aa, Entamoeba invadens
KTCKP

SEQ ID NO: 2763608 - protein, 9 aa, Entamoeba invadens
KTCKSKEKC

SEQ ID NO: 2763609 - protein, 16 aa, Entamoeba invadens
KTCKSSAEECTQCSQE

SEQ ID NO: 2763610 - protein, 4 aa, Entamoeba invadens
KTCN

SEQ ID NO: 2763611 - protein, 7 aa, Entamoeba invadens
KTCNDGY

SEQ ID NO: 2763612 - protein, 5 aa, Entamoeba invadens
KTCNE

SEQ ID NO: 2763613 - protein, 15 aa, Entamoeba invadens
KTCNEKGGNCTSCKT

SEQ ID NO: 2763614 - protein, 6 aa, Entamoeba invadens
KTCNGN

SEQ ID NO: 2763615 - protein, 9 aa, Entamoeba invadens
KTCNKTNGK

SEQ ID NO: 2763616 - protein, 6 aa, Entamoeba invadens
KTCNPR

SEQ ID NO: 2763617 - protein, 6 aa, Entamoeba invadens
KTCNSK

SEQ ID NO: 2763618 - protein, 4 aa, Entamoeba invadens
KTCQ

SEQ ID NO: 2763619 - protein, 7 aa, Entamoeba invadens
KTCQGAG

SEQ ID NO: 2763620 - protein, 8 aa, Entamoeba invadens
KTCQKCGE

SEQ ID NO: 2763621 - protein, 16 aa, Entamoeba invadens
KTCQQNECNTANGKCE

SEQ ID NO: 2763622 - protein, 8 aa, Entamoeba invadens
KTCQTTED

SEQ ID NO: 2763623 - protein, 10 aa, Entamoeba invadens
KTCSKSCEEG

SEQ ID NO: 2763624 - protein, 11 aa, Entamoeba invadens
KTCSKSCEEGY

SEQ ID NO: 2763625 - protein, 6 aa, Entamoeba invadens
KTCSLQ

SEQ ID NO: 2763626 - protein, 16 aa, Entamoeba invadens
KTCSLSSTKCTSCEDG

SEQ ID NO: 2763627 - protein, 8 aa, Entamoeba invadens
KTCSNDGD

SEQ ID NO: 2763628 - protein, 6 aa, Entamoeba invadens
KTCSNG

SEQ ID NO: 2763629 - protein, 10 aa, Entamoeba invadens
KTCSPDNNRK

SEQ ID NO: 2763630 - protein, 6 aa, Entamoeba invadens
KTCSQT

SEQ ID NO: 2763631 - protein, 5 aa, Entamoeba invadens
KTCSS

SEQ ID NO: 2763632 - protein, 7 aa, Entamoeba invadens
KTCSSDF

SEQ ID NO: 2763633 - protein, 9 aa, Entamoeba invadens
KTCSSDYNR

SEQ ID NO: 2763634 - protein, 6 aa, Entamoeba invadens
KTCSSG

SEQ ID NO: 2763635 - protein, 11 aa, Entamoeba invadens
KTCSSTSKKCH

SEQ ID NO: 2763636 - protein, 13 aa, Entamoeba invadens
KTCSSTSKKCHTC

SEQ ID NO: 2763637 - protein, 7 aa, Entamoeba invadens
KTCSTRG

SEQ ID NO: 2763638 - protein, 16 aa, Entamoeba invadens
KTCTAGNSETACESCP

SEQ ID NO: 2763639 - protein, 7 aa, Entamoeba invadens
KTCTEER

SEQ ID NO: 2763640 - protein, 13 aa, Entamoeba invadens
KTCTEETKCTNCK

SEQ ID NO: 2763641 - protein, 14 aa, Entamoeba invadens
KTCTGSTSSDCTSC

SEQ ID NO: 2763642 - protein, 6 aa, Entamoeba invadens
KTCVKD

SEQ ID NO: 2763643 - protein, 15 aa, Entamoeba invadens
KTDAANKEECETTAQ

SEQ ID NO: 2763644 - protein, 9 aa, Entamoeba invadens
KTDAASSTF

SEQ ID NO: 2763645 - protein, 10 aa, Entamoeba invadens
KTDAASSTHI

SEQ ID NO: 2763646 - protein, 7 aa, Entamoeba invadens
KTDAEAL

SEQ ID NO: 2763647 - protein, 10 aa, Entamoeba invadens
KTDAESSTHI

SEQ ID NO: 2763648 - protein, 8 aa, Entamoeba invadens
KTDCLDKH

SEQ ID NO: 2763649 - protein, 4 aa, Entamoeba invadens
KTDD

SEQ ID NO: 2763650 - protein, 20 aa, Entamoeba invadens
KTDEEDKEEHNDDQITKEEI

SEQ ID NO: 2763651 - protein, 10 aa, Entamoeba invadens
KTDKFKETIE

SEQ ID NO: 2763652 - protein, 7 aa, Entamoeba invadens
KTDKTTC

SEQ ID NO: 2763653 - protein, 6 aa, Entamoeba invadens
KTDMPL

SEQ ID NO: 2763654 - protein, 10 aa, Entamoeba invadens
KTDMTKTSAK

SEQ ID NO: 2763655 - protein, 8 aa, Entamoeba invadens
KTDNTEVP

SEQ ID NO: 2763656 - protein, 10 aa, Entamoeba invadens
KTDPNNPTSC

SEQ ID NO: 2763657 - protein, 8 aa, Entamoeba invadens
KTDQDSAH

SEQ ID NO: 2763658 - protein, 14 aa, Entamoeba invadens
KTDQNSAEKLRPAF

SEQ ID NO: 2763659 - protein, 9 aa, Entamoeba invadens
KTDSDFQLT

SEQ ID NO: 2763660 - protein, 7 aa, Entamoeba invadens
KTDSKIC

SEQ ID NO: 2763661 - protein, 8 aa, Entamoeba invadens
KTDSSNQC

SEQ ID NO: 2763662 - protein, 8 aa, Entamoeba invadens
KTDTEYTS

SEQ ID NO: 2763663 - protein, 8 aa, Entamoeba invadens
KTDTGENY

SEQ ID NO: 2763664 - protein, 5 aa, Entamoeba invadens
KTDTK

SEQ ID NO: 2763665 - protein, 8 aa, Entamoeba invadens
KTDVNDKQ

SEQ ID NO: 2763666 - protein, 15 aa, Entamoeba invadens
KTDVPDAAKTSTFCG

SEQ ID NO: 2763667 - protein, 6 aa, Entamoeba invadens
KTDVTE

SEQ ID NO: 2763668 - protein, 5 aa, Entamoeba invadens
KTEAD

SEQ ID NO: 2763669 - protein, 5 aa, Entamoeba invadens
KTEAS

SEQ ID NO: 2763670 - protein, 11 aa, Entamoeba invadens
KTECNSRNKRL

SEQ ID NO: 2763671 - protein, 6 aa, Entamoeba invadens
KTECTE

SEQ ID NO: 2763672 - protein, 16 aa, Entamoeba invadens
KTEDCTGAADTTTEPK

SEQ ID NO: 2763673 - protein, 8 aa, Entamoeba invadens
KTEDPLLE

SEQ ID NO: 2763674 - protein, 13 aa, Entamoeba invadens
KTEECDRVDGCGS

SEQ ID NO: 2763675 - protein, 9 aa, Entamoeba invadens
KTEEDGTKQ

SEQ ID NO: 2763676 - protein, 6 aa, Entamoeba invadens
KTEEEG

SEQ ID NO: 2763677 - protein, 5 aa, Entamoeba invadens
KTEEI

SEQ ID NO: 2763678 - protein, 7 aa, Entamoeba invadens
KTEEKKM

SEQ ID NO: 2763679 - protein, 8 aa, Entamoeba invadens
KTEESVTP

SEQ ID NO: 2763680 - protein, 9 aa, Entamoeba invadens
KTEFTSREN

SEQ ID NO: 2763681 - protein, 9 aa, Entamoeba invadens
KTEGKQDLI

SEQ ID NO: 2763682 - protein, 24 aa, Entamoeba invadens
KTEGYKTVPRPQMNRGEDSIQSMR

SEQ ID NO: 2763683 - protein, 10 aa, Entamoeba invadens
KTEHQKEVNE

SEQ ID NO: 2763684 - protein, 5 aa, Entamoeba invadens
KTEKC

SEQ ID NO: 2763685 - protein, 10 aa, Entamoeba invadens
KTEKDCNECD

SEQ ID NO: 2763686 - protein, 9 aa, Entamoeba invadens
KTEKEAKVQ

SEQ ID NO: 2763687 - protein, 9 aa, Entamoeba invadens
KTEKFENDE

SEQ ID NO: 2763688 - protein, 7 aa, Entamoeba invadens
KTEKISK

SEQ ID NO: 2763689 - protein, 6 aa, Entamoeba invadens
KTEKLD

SEQ ID NO: 2763690 - protein, 6 aa, Entamoeba invadens
KTEKLQ

SEQ ID NO: 2763691 - protein, 6 aa, Entamoeba invadens
KTEKLR

SEQ ID NO: 2763692 - protein, 6 aa, Entamoeba invadens
KTEKMR

SEQ ID NO: 2763693 - protein, 8 aa, Entamoeba invadens
KTEKQPFN

SEQ ID NO: 2763694 - protein, 10 aa, Entamoeba invadens
KTEKRGDEGV

SEQ ID NO: 2763695 - protein, 6 aa, Entamoeba invadens
KTEKVN

SEQ ID NO: 2763696 - protein, 7 aa, Entamoeba invadens
KTELKPS

SEQ ID NO: 2763697 - protein, 4 aa, Entamoeba invadens
KTEN

SEQ ID NO: 2763698 - protein, 5 aa, Entamoeba invadens
KTENA

SEQ ID NO: 2763699 - protein, 6 aa, Entamoeba invadens
KTENEP

SEQ ID NO: 2763700 - protein, 7 aa, Entamoeba invadens
KTENKTK

SEQ ID NO: 2763701 - protein, 6 aa, Entamoeba invadens
KTENRI

SEQ ID NO: 2763702 - protein, 21 aa, Entamoeba invadens
KTENVEPEKSLDEYKEKQQHN

SEQ ID NO: 2763703 - protein, 13 aa, Entamoeba invadens
KTENVEVKSEKSE

SEQ ID NO: 2763704 - protein, 12 aa, Entamoeba invadens
KTENVSDALKTS

SEQ ID NO: 2763705 - protein, 8 aa, Entamoeba invadens
KTEQKADA

SEQ ID NO: 2763706 - protein, 8 aa, Entamoeba invadens
KTERARLK

SEQ ID NO: 2763707 - protein, 9 aa, Entamoeba invadens
KTERTEAAT

SEQ ID NO: 2763708 - protein, 8 aa, Entamoeba invadens
KTESEGTW

SEQ ID NO: 2763709 - protein, 26 aa, Entamoeba invadens
KTESFGGEDYPAGQSEMFSTDSKLEK

SEQ ID NO: 2763710 - protein, 9 aa, Entamoeba invadens
KTESINENT

SEQ ID NO: 2763711 - protein, 9 aa, Entamoeba invadens
KTESMGDGE

SEQ ID NO: 2763712 - protein, 7 aa, Entamoeba invadens
KTESTCK

SEQ ID NO: 2763713 - protein, 9 aa, Entamoeba invadens
KTETEAKER

SEQ ID NO: 2763714 - protein, 10 aa, Entamoeba invadens
KTETKKESMN

SEQ ID NO: 2763715 - protein, 12 aa, Entamoeba invadens
KTETTKHPTNPS

SEQ ID NO: 2763716 - protein, 10 aa, Entamoeba invadens
KTETTTRLDP

SEQ ID NO: 2763717 - protein, 15 aa, Entamoeba invadens
KTEVSGAWDEAVPAS

SEQ ID NO: 2763718 - protein, 5 aa, Entamoeba invadens
KTEVV

SEQ ID NO: 2763719 - protein, 9 aa, Entamoeba invadens
KTEYQSVNE

SEQ ID NO: 2763720 - protein, 13 aa, Entamoeba invadens
KTFEETTSGGYEY

SEQ ID NO: 2763721 - protein, 13 aa, Entamoeba invadens
KTFGEWSSEYSND

SEQ ID NO: 2763722 - protein, 6 aa, Entamoeba invadens
KTFGSS

SEQ ID NO: 2763723 - protein, 4 aa, Entamoeba invadens
KTFS

SEQ ID NO: 2763724 - protein, 7 aa, Entamoeba invadens
KTFSNSG

SEQ ID NO: 2763725 - protein, 5 aa, Entamoeba invadens
KTFSS

SEQ ID NO: 2763726 - protein, 6 aa, Entamoeba invadens
KTFTSD

SEQ ID NO: 2763727 - protein, 6 aa, Entamoeba invadens
KTGATS

SEQ ID NO: 2763728 - protein, 11 aa, Entamoeba invadens
KTGAVTASSDV

SEQ ID NO: 2763729 - protein, 7 aa, Entamoeba invadens
KTGAYKD

SEQ ID NO: 2763730 - protein, 8 aa, Entamoeba invadens
KTGDFTTD

SEQ ID NO: 2763731 - protein, 4 aa, Entamoeba invadens
KTGE

SEQ ID NO: 2763732 - protein, 5 aa, Entamoeba invadens
KTGEE

SEQ ID NO: 2763733 - protein, 6 aa, Entamoeba invadens
KTGEEK

SEQ ID NO: 2763734 - protein, 5 aa, Entamoeba invadens
KTGEF

SEQ ID NO: 2763735 - protein, 21 aa, Entamoeba invadens
KTGELTLKDNSSLTTENNTTV

SEQ ID NO: 2763736 - protein, 7 aa, Entamoeba invadens
KTGEQIS

SEQ ID NO: 2763737 - protein, 11 aa, Entamoeba invadens
KTGEQTSTKIE

SEQ ID NO: 2763738 - protein, 6 aa, Entamoeba invadens
KTGFPG

SEQ ID NO: 2763739 - protein, 7 aa, Entamoeba invadens
KTGGLTK

SEQ ID NO: 2763740 - protein, 8 aa, Entamoeba invadens
KTGIASEL

SEQ ID NO: 2763741 - protein, 6 aa, Entamoeba invadens
KTGIGH

SEQ ID NO: 2763742 - protein, 7 aa, Entamoeba invadens
KTGITEL

SEQ ID NO: 2763743 - protein, 4 aa, Entamoeba invadens
KTGK

SEQ ID NO: 2763744 - protein, 5 aa, Entamoeba invadens
KTGKC

SEQ ID NO: 2763745 - protein, 12 aa, Entamoeba invadens
KTGKDAQVKEKE

SEQ ID NO: 2763746 - protein, 10 aa, Entamoeba invadens
KTGKKETTSI

SEQ ID NO: 2763747 - protein, 8 aa, Entamoeba invadens
KTGKKTHT

SEQ ID NO: 2763748 - protein, 7 aa, Entamoeba invadens
KTGKKVG

SEQ ID NO: 2763749 - protein, 6 aa, Entamoeba invadens
KTGKLT

SEQ ID NO: 2763750 - protein, 9 aa, Entamoeba invadens
KTGKNKELY

SEQ ID NO: 2763751 - protein, 10 aa, Entamoeba invadens
KTGKQNTTSI

SEQ ID NO: 2763752 - protein, 10 aa, Entamoeba invadens
KTGKQNTTTI

SEQ ID NO: 2763753 - protein, 4 aa, Entamoeba invadens
KTGM

SEQ ID NO: 2763754 - protein, 9 aa, Entamoeba invadens
KTGNEKVNE

SEQ ID NO: 2763755 - protein, 14 aa, Entamoeba invadens
KTGNLTLSSTKTLG

SEQ ID NO: 2763756 - protein, 5 aa, Entamoeba invadens
KTGQH

SEQ ID NO: 2763757 - protein, 6 aa, Entamoeba invadens
KTGQVI

SEQ ID NO: 2763758 - protein, 10 aa, Entamoeba invadens
KTGRGTLSLN

SEQ ID NO: 2763759 - protein, 7 aa, Entamoeba invadens
KTGSPLR

SEQ ID NO: 2763760 - protein, 9 aa, Entamoeba invadens
KTGTADHSP

SEQ ID NO: 2763761 - protein, 6 aa, Entamoeba invadens
KTGTLT

SEQ ID NO: 2763762 - protein, 8 aa, Entamoeba invadens
KTGTLTEN

SEQ ID NO: 2763763 - protein, 9 aa, Entamoeba invadens
KTGTLTKNE

SEQ ID NO: 2763764 - protein, 11 aa, Entamoeba invadens
KTGTLTSDEVS

SEQ ID NO: 2763765 - protein, 7 aa, Entamoeba invadens
KTGTMTQ

SEQ ID NO: 2763766 - protein, 8 aa, Entamoeba invadens
KTGTQYNE

SEQ ID NO: 2763767 - protein, 6 aa, Entamoeba invadens
KTGVDT

SEQ ID NO: 2763768 - protein, 6 aa, Entamoeba invadens
KTGYPL

SEQ ID NO: 2763769 - protein, 7 aa, Entamoeba invadens
KTGYSYN

SEQ ID NO: 2763770 - protein, 4 aa, Entamoeba invadens
KTHE

SEQ ID NO: 2763771 - protein, 8 aa, Entamoeba invadens
KTHEYTEI

SEQ ID NO: 2763772 - protein, 5 aa, Entamoeba invadens
KTHFE

SEQ ID NO: 2763773 - protein, 21 aa, Entamoeba invadens
KTHPDTIKRAKKLKKAKKGFT

SEQ ID NO: 2763774 - protein, 6 aa, Entamoeba invadens
KTHQLT

SEQ ID NO: 2763775 - protein, 4 aa, Entamoeba invadens
KTIC

SEQ ID NO: 2763776 - protein, 20 aa, Entamoeba invadens
KTICDGSECVSKSEELPPKS

SEQ ID NO: 2763777 - protein, 6 aa, Entamoeba invadens
KTIDSD

SEQ ID NO: 2763778 - protein, 6 aa, Entamoeba invadens
KTIEKC

SEQ ID NO: 2763779 - protein, 11 aa, Entamoeba invadens
KTIETKSQEEM

SEQ ID NO: 2763780 - protein, 4 aa, Entamoeba invadens
KTIG

SEQ ID NO: 2763781 - protein, 6 aa, Entamoeba invadens
KTIHEG

SEQ ID NO: 2763782 - protein, 14 aa, Entamoeba invadens
KTIKTTKLNNSELL

SEQ ID NO: 2763783 - protein, 10 aa, Entamoeba invadens
KTIREECDGG

SEQ ID NO: 2763784 - protein, 11 aa, Entamoeba invadens
KTISNLDTDGY

SEQ ID NO: 2763785 - protein, 16 aa, Entamoeba invadens
KTISQLTGGLEGSTNY

SEQ ID NO: 2763786 - protein, 9 aa, Entamoeba invadens
KTITADEAA

SEQ ID NO: 2763787 - protein, 9 aa, Entamoeba invadens
KTKATGSLS

SEQ ID NO: 2763788 - protein, 4 aa, Entamoeba invadens
KTKC

SEQ ID NO: 2763789 - protein, 9 aa, Entamoeba invadens
KTKDGSNVI

SEQ ID NO: 2763790 - protein, 10 aa, Entamoeba invadens
KTKDGSNVIT

SEQ ID NO: 2763791 - protein, 8 aa, Entamoeba invadens
KTKDPENT

SEQ ID NO: 2763792 - protein, 8 aa, Entamoeba invadens
KTKEEIET

SEQ ID NO: 2763793 - protein, 7 aa, Entamoeba invadens
KTKEKFE

SEQ ID NO: 2763794 - protein, 11 aa, Entamoeba invadens
KTKEQAKSSAV

SEQ ID NO: 2763795 - protein, 6 aa, Entamoeba invadens
KTKETL

SEQ ID NO: 2763796 - protein, 7 aa, Entamoeba invadens
KTKFKPR

SEQ ID NO: 2763797 - protein, 13 aa, Entamoeba invadens
KTKFSEDNKNEVV

SEQ ID NO: 2763798 - protein, 4 aa, Entamoeba invadens
KTKH

SEQ ID NO: 2763799 - protein, 5 aa, Entamoeba invadens
KTKIN

SEQ ID NO: 2763800 - protein, 12 aa, Entamoeba invadens
KTKKCDNTTDMN

SEQ ID NO: 2763801 - protein, 47 aa, Entamoeba invadens
KTKKDDNTLNREKTFNNSSSLDLKGEHSDHSKGVATDVEASEKSSVF

SEQ ID NO: 2763802 - protein, 5 aa, Entamoeba invadens
KTKKL

SEQ ID NO: 2763803 - protein, 7 aa, Entamoeba invadens
KTKKSLE

SEQ ID NO: 2763804 - protein, 5 aa, Entamoeba invadens
KTKLQ

SEQ ID NO: 2763805 - protein, 8 aa, Entamoeba invadens
KTKNFSRI

SEQ ID NO: 2763806 - protein, 7 aa, Entamoeba invadens
KTKPKKY

SEQ ID NO: 2763807 - protein, 9 aa, Entamoeba invadens
KTKPNETED

SEQ ID NO: 2763808 - protein, 5 aa, Entamoeba invadens
KTKPV

SEQ ID NO: 2763809 - protein, 7 aa, Entamoeba invadens
KTKQEMP

SEQ ID NO: 2763810 - protein, 7 aa, Entamoeba invadens
KTKQKVF

SEQ ID NO: 2763811 - protein, 10 aa, Entamoeba invadens
KTKQNCETSH

SEQ ID NO: 2763812 - protein, 4 aa, Entamoeba invadens
KTKR

SEQ ID NO: 2763813 - protein, 10 aa, Entamoeba invadens
KTKRKTTNIP

SEQ ID NO: 2763814 - protein, 6 aa, Entamoeba invadens
KTKSAK

SEQ ID NO: 2763815 - protein, 8 aa, Entamoeba invadens
KTKSPTGC

SEQ ID NO: 2763816 - protein, 10 aa, Entamoeba invadens
KTKSSQCEKC

SEQ ID NO: 2763817 - protein, 11 aa, Entamoeba invadens
KTKSYIAKSNQ

SEQ ID NO: 2763818 - protein, 7 aa, Entamoeba invadens
KTKTLEG

SEQ ID NO: 2763819 - protein, 8 aa, Entamoeba invadens
KTKTPISI

SEQ ID NO: 2763820 - protein, 10 aa, Entamoeba invadens
KTKTQDSHQN

SEQ ID NO: 2763821 - protein, 9 aa, Entamoeba invadens
KTKTVSSSI

SEQ ID NO: 2763822 - protein, 8 aa, Entamoeba invadens
KTKVKKET

SEQ ID NO: 2763823 - protein, 13 aa, Entamoeba invadens
KTLANTGTYAQNY

SEQ ID NO: 2763824 - protein, 7 aa, Entamoeba invadens
KTLDAQE

SEQ ID NO: 2763825 - protein, 7 aa, Entamoeba invadens
KTLEAGG

SEQ ID NO: 2763826 - protein, 6 aa, Entamoeba invadens
KTLGDK

SEQ ID NO: 2763827 - protein, 4 aa, Entamoeba invadens
KTLI

SEQ ID NO: 2763828 - protein, 15 aa, Entamoeba invadens
KTLKDTLSSSSSSSF

SEQ ID NO: 2763829 - protein, 14 aa, Entamoeba invadens
KTLKEAFTEQEKKN

SEQ ID NO: 2763830 - protein, 12 aa, Entamoeba invadens
KTLKTKNTGCSP

SEQ ID NO: 2763831 - protein, 9 aa, Entamoeba invadens
KTLNKRKAK

SEQ ID NO: 2763832 - protein, 6 aa, Entamoeba invadens
KTLNST

SEQ ID NO: 2763833 - protein, 6 aa, Entamoeba invadens
KTLPTG

SEQ ID NO: 2763834 - protein, 10 aa, Entamoeba invadens
KTLSDTTSPL

SEQ ID NO: 2763835 - protein, 8 aa, Entamoeba invadens
KTLSESRC

SEQ ID NO: 2763836 - protein, 7 aa, Entamoeba invadens
KTLSNAT

SEQ ID NO: 2763837 - protein, 8 aa, Entamoeba invadens
KTLSSSYP

SEQ ID NO: 2763838 - protein, 11 aa, Entamoeba invadens
KTLSSTAKNAL

SEQ ID NO: 2763839 - protein, 9 aa, Entamoeba invadens
KTLTGTKAP

SEQ ID NO: 2763840 - protein, 8 aa, Entamoeba invadens
KTLTSEPL

SEQ ID NO: 2763841 - protein, 5 aa, Entamoeba invadens
KTLTT

SEQ ID NO: 2763842 - protein, 7 aa, Entamoeba invadens
KTMASER

SEQ ID NO: 2763843 - protein, 6 aa, Entamoeba invadens
KTMDTQ

SEQ ID NO: 2763844 - protein, 16 aa, Entamoeba invadens
KTNAAISCSSGQYLSG

SEQ ID NO: 2763845 - protein, 14 aa, Entamoeba invadens
KTNAATSCSSGHYL

SEQ ID NO: 2763846 - protein, 17 aa, Entamoeba invadens
KTNAATSCSSGQYLSGT

SEQ ID NO: 2763847 - protein, 7 aa, Entamoeba invadens
KTNDEVD

SEQ ID NO: 2763848 - protein, 7 aa, Entamoeba invadens
KTNDYEE

SEQ ID NO: 2763849 - protein, 7 aa, Entamoeba invadens
KTNECDN

SEQ ID NO: 2763850 - protein, 7 aa, Entamoeba invadens
KTNEEKF

SEQ ID NO: 2763851 - protein, 34 aa, Entamoeba invadens
KTNEEKNKVKDEEIKKQKEDNKKMQTNEEEMNKK

SEQ ID NO: 2763852 - protein, 15 aa, Entamoeba invadens
KTNETRISLSSATKL

SEQ ID NO: 2763853 - protein, 12 aa, Entamoeba invadens
KTNEVTKKKEET

SEQ ID NO: 2763854 - protein, 8 aa, Entamoeba invadens
KTNGNCTS

SEQ ID NO: 2763855 - protein, 10 aa, Entamoeba invadens
KTNGSTEAIE

SEQ ID NO: 2763856 - protein, 6 aa, Entamoeba invadens
KTNGYC

SEQ ID NO: 2763857 - protein, 16 aa, Entamoeba invadens
KTNGYCSSCESGMGIT

SEQ ID NO: 2763858 - protein, 9 aa, Entamoeba invadens
KTNGYCTSC

SEQ ID NO: 2763859 - protein, 14 aa, Entamoeba invadens
KTNGYCTSCGSGMG

SEQ ID NO: 2763860 - protein, 13 aa, Entamoeba invadens
KTNHKSEDKKEVL

SEQ ID NO: 2763861 - protein, 8 aa, Entamoeba invadens
KTNIENTN

SEQ ID NO: 2763862 - protein, 4 aa, Entamoeba invadens
KTNK

SEQ ID NO: 2763863 - protein, 7 aa, Entamoeba invadens
KTNKEVD

SEQ ID NO: 2763864 - protein, 6 aa, Entamoeba invadens
KTNNKM

SEQ ID NO: 2763865 - protein, 7 aa, Entamoeba invadens
KTNNTCS

SEQ ID NO: 2763866 - protein, 5 aa, Entamoeba invadens
KTNNY

SEQ ID NO: 2763867 - protein, 5 aa, Entamoeba invadens
KTNPT

SEQ ID NO: 2763868 - protein, 8 aa, Entamoeba invadens
KTNPVNNQ

SEQ ID NO: 2763869 - protein, 6 aa, Entamoeba invadens
KTNQLG

SEQ ID NO: 2763870 - protein, 5 aa, Entamoeba invadens
KTNQR

SEQ ID NO: 2763871 - protein, 6 aa, Entamoeba invadens
KTNRVS

SEQ ID NO: 2763872 - protein, 8 aa, Entamoeba invadens
KTNSFTQT

SEQ ID NO: 2763873 - protein, 6 aa, Entamoeba invadens
KTNSGS

SEQ ID NO: 2763874 - protein, 9 aa, Entamoeba invadens
KTNSIRKDY

SEQ ID NO: 2763875 - protein, 7 aa, Entamoeba invadens
KTNSQYI

SEQ ID NO: 2763876 - protein, 4 aa, Entamoeba invadens
KTNT

SEQ ID NO: 2763877 - protein, 11 aa, Entamoeba invadens
KTNTDDQKEVT

SEQ ID NO: 2763878 - protein, 6 aa, Entamoeba invadens
KTNTKI

SEQ ID NO: 2763879 - protein, 7 aa, Entamoeba invadens
KTNTPEV

SEQ ID NO: 2763880 - protein, 15 aa, Entamoeba invadens
KTNYKTNGGDCLPQG

SEQ ID NO: 2763881 - protein, 6 aa, Entamoeba invadens
KTPADV

SEQ ID NO: 2763882 - protein, 6 aa, Entamoeba invadens
KTPAEQ

SEQ ID NO: 2763883 - protein, 8 aa, Entamoeba invadens
KTPDSSYG

SEQ ID NO: 2763884 - protein, 5 aa, Entamoeba invadens
KTPEL

SEQ ID NO: 2763885 - protein, 10 aa, Entamoeba invadens
KTPENEKSSI

SEQ ID NO: 2763886 - protein, 6 aa, Entamoeba invadens
KTPETC

SEQ ID NO: 2763887 - protein, 83 aa, Entamoeba invadens
KTPGPEKQEEKIEESIQQTENMTNTRGDGVAGQEEIQAEIKTEEKVDQKEKETHEEEKVSPPSPKENNTQNVEQEKKRCIDPL

SEQ ID NO: 2763888 - protein, 8 aa, Entamoeba invadens
KTPGSLGA

SEQ ID NO: 2763889 - protein, 4 aa, Entamoeba invadens
KTPH

SEQ ID NO: 2763890 - protein, 4 aa, Entamoeba invadens
KTPI

SEQ ID NO: 2763891 - protein, 5 aa, Entamoeba invadens
KTPIF

SEQ ID NO: 2763892 - protein, 65 aa, Entamoeba invadens
KTPITKKPEEKVEVNTPPKSELKSPENKEEVLPQTPQEVEKEEKEQNEKITTETISNSKESTENV

SEQ ID NO: 2763893 - protein, 22 aa, Entamoeba invadens
KTPKDTPSKISDEKSKTTESSF

SEQ ID NO: 2763894 - protein, 10 aa, Entamoeba invadens
KTPKIKISNT

SEQ ID NO: 2763895 - protein, 9 aa, Entamoeba invadens
KTPKLQEPY

SEQ ID NO: 2763896 - protein, 7 aa, Entamoeba invadens
KTPLNSR

SEQ ID NO: 2763897 - protein, 6 aa, Entamoeba invadens
KTPMHE

SEQ ID NO: 2763898 - protein, 6 aa, Entamoeba invadens
KTPNFP

SEQ ID NO: 2763899 - protein, 6 aa, Entamoeba invadens
KTPPTQ

SEQ ID NO: 2763900 - protein, 10 aa, Entamoeba invadens
KTPPVSSRKE

SEQ ID NO: 2763901 - protein, 4 aa, Entamoeba invadens
KTPQ

SEQ ID NO: 2763902 - protein, 5 aa, Entamoeba invadens
KTPRS

SEQ ID NO: 2763903 - protein, 5 aa, Entamoeba invadens
KTPSC

SEQ ID NO: 2763904 - protein, 7 aa, Entamoeba invadens
KTPSISS

SEQ ID NO: 2763905 - protein, 14 aa, Entamoeba invadens
KTPSKRLPPPPVNI

SEQ ID NO: 2763906 - protein, 9 aa, Entamoeba invadens
KTPSPTLNT

SEQ ID NO: 2763907 - protein, 6 aa, Entamoeba invadens
KTPSSS

SEQ ID NO: 2763908 - protein, 20 aa, Entamoeba invadens
KTPTKAQKSKIQVEEKGTTM

SEQ ID NO: 2763909 - protein, 7 aa, Entamoeba invadens
KTPTPSN

SEQ ID NO: 2763910 - protein, 5 aa, Entamoeba invadens
KTPWG

SEQ ID NO: 2763911 - protein, 4 aa, Entamoeba invadens
KTPY

SEQ ID NO: 2763912 - protein, 15 aa, Entamoeba invadens
KTQAMDDKSKTEFEA

SEQ ID NO: 2763913 - protein, 5 aa, Entamoeba invadens
KTQDH

SEQ ID NO: 2763914 - protein, 9 aa, Entamoeba invadens
KTQDRPTMK

SEQ ID NO: 2763915 - protein, 6 aa, Entamoeba invadens
KTQFSS

SEQ ID NO: 2763916 - protein, 5 aa, Entamoeba invadens
KTQGK

SEQ ID NO: 2763917 - protein, 8 aa, Entamoeba invadens
KTQGRQTY

SEQ ID NO: 2763918 - protein, 10 aa, Entamoeba invadens
KTQKCDTTSF

SEQ ID NO: 2763919 - protein, 6 aa, Entamoeba invadens
KTQKCN

SEQ ID NO: 2763920 - protein, 8 aa, Entamoeba invadens
KTQKGCKK

SEQ ID NO: 2763921 - protein, 23 aa, Entamoeba invadens
KTQLSTRLDPDELEEEKKLGEGS

SEQ ID NO: 2763922 - protein, 17 aa, Entamoeba invadens
KTQMGENTKKSNKIAEG

SEQ ID NO: 2763923 - protein, 5 aa, Entamoeba invadens
KTQND

SEQ ID NO: 2763924 - protein, 42 aa, Entamoeba invadens
KTQPKEKNSESSAPHLNTDTHEESSSKNVEENISAPSSPQDY

SEQ ID NO: 2763925 - protein, 9 aa, Entamoeba invadens
KTQPTESRK

SEQ ID NO: 2763926 - protein, 9 aa, Entamoeba invadens
KTQQNTTED

SEQ ID NO: 2763927 - protein, 9 aa, Entamoeba invadens
KTQQNTTEE

SEQ ID NO: 2763928 - protein, 6 aa, Entamoeba invadens
KTQQPR

SEQ ID NO: 2763929 - protein, 24 aa, Entamoeba invadens
KTQQTEEHPETPEIDVNNTKSELI

SEQ ID NO: 2763930 - protein, 25 aa, Entamoeba invadens
KTQQTEEHPETPEIDVNNTKSELIK

SEQ ID NO: 2763931 - protein, 7 aa, Entamoeba invadens
KTQQTSK

SEQ ID NO: 2763932 - protein, 13 aa, Entamoeba invadens
KTQRPVVPITIKK

SEQ ID NO: 2763933 - protein, 7 aa, Entamoeba invadens
KTQSGCV

SEQ ID NO: 2763934 - protein, 10 aa, Entamoeba invadens
KTQSGDGLPI

SEQ ID NO: 2763935 - protein, 9 aa, Entamoeba invadens
KTQSNQNEF

SEQ ID NO: 2763936 - protein, 5 aa, Entamoeba invadens
KTQSY

SEQ ID NO: 2763937 - protein, 10 aa, Entamoeba invadens
KTQTAYATGT

SEQ ID NO: 2763938 - protein, 11 aa, Entamoeba invadens
KTQTEGNTEIE

SEQ ID NO: 2763939 - protein, 9 aa, Entamoeba invadens
KTQTETTEN

SEQ ID NO: 2763940 - protein, 5 aa, Entamoeba invadens
KTQTL

SEQ ID NO: 2763941 - protein, 12 aa, Entamoeba invadens
KTQTTDKTEIEC

SEQ ID NO: 2763942 - protein, 21 aa, Entamoeba invadens
KTQTTGKTEIECAKSNRDVTK

SEQ ID NO: 2763943 - protein, 7 aa, Entamoeba invadens
KTQVQNS

SEQ ID NO: 2763944 - protein, 23 aa, Entamoeba invadens
KTQVTRNRASSFTKTVTKSPSPH

SEQ ID NO: 2763945 - protein, 4 aa, Entamoeba invadens
KTQY

SEQ ID NO: 2763946 - protein, 7 aa, Entamoeba invadens
KTREPLG

SEQ ID NO: 2763947 - protein, 5 aa, Entamoeba invadens
KTRGV

SEQ ID NO: 2763948 - protein, 8 aa, Entamoeba invadens
KTRKEKEK

SEQ ID NO: 2763949 - protein, 12 aa, Entamoeba invadens
KTRKKDDWKNDA

SEQ ID NO: 2763950 - protein, 185 aa, Entamoeba invadens
KTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENYI

SEQ ID NO: 2763951 - protein, 5 aa, Entamoeba invadens
KTRKY

SEQ ID NO: 2763952 - protein, 26 aa, Entamoeba invadens
KTRMEELENQKKMAEIKGDKSTAEVE

SEQ ID NO: 2763953 - protein, 8 aa, Entamoeba invadens
KTRNGNDF

SEQ ID NO: 2763954 - protein, 6 aa, Entamoeba invadens
KTRNYR

SEQ ID NO: 2763955 - protein, 7 aa, Entamoeba invadens
KTRQVNA

SEQ ID NO: 2763956 - protein, 6 aa, Entamoeba invadens
KTRSGC

SEQ ID NO: 2763957 - protein, 12 aa, Entamoeba invadens
KTRTKQKTRSMS

SEQ ID NO: 2763958 - protein, 6 aa, Entamoeba invadens
KTSAEI

SEQ ID NO: 2763959 - protein, 14 aa, Entamoeba invadens
KTSCNNCENGYYNS

SEQ ID NO: 2763960 - protein, 6 aa, Entamoeba invadens
KTSDEI

SEQ ID NO: 2763961 - protein, 11 aa, Entamoeba invadens
KTSDSYSSFEE

SEQ ID NO: 2763962 - protein, 7 aa, Entamoeba invadens
KTSEELM

SEQ ID NO: 2763963 - protein, 8 aa, Entamoeba invadens
KTSEEMSE

SEQ ID NO: 2763964 - protein, 6 aa, Entamoeba invadens
KTSEKY

SEQ ID NO: 2763965 - protein, 8 aa, Entamoeba invadens
KTSESNEY

SEQ ID NO: 2763966 - protein, 7 aa, Entamoeba invadens
KTSETTS

SEQ ID NO: 2763967 - protein, 12 aa, Entamoeba invadens
KTSETTSSKSEF

SEQ ID NO: 2763968 - protein, 5 aa, Entamoeba invadens
KTSEV

SEQ ID NO: 2763969 - protein, 5 aa, Entamoeba invadens
KTSFL

SEQ ID NO: 2763970 - protein, 7 aa, Entamoeba invadens
KTSGDGK

SEQ ID NO: 2763971 - protein, 8 aa, Entamoeba invadens
KTSGDYKC

SEQ ID NO: 2763972 - protein, 9 aa, Entamoeba invadens
KTSGFTPEI

SEQ ID NO: 2763973 - protein, 8 aa, Entamoeba invadens
KTSGHSAK

SEQ ID NO: 2763974 - protein, 9 aa, Entamoeba invadens
KTSGITGGA

SEQ ID NO: 2763975 - protein, 7 aa, Entamoeba invadens
KTSGKIS

SEQ ID NO: 2763976 - protein, 6 aa, Entamoeba invadens
KTSGTC

SEQ ID NO: 2763977 - protein, 5 aa, Entamoeba invadens
KTSHG

SEQ ID NO: 2763978 - protein, 6 aa, Entamoeba invadens
KTSING

SEQ ID NO: 2763979 - protein, 6 aa, Entamoeba invadens
KTSIPH

SEQ ID NO: 2763980 - protein, 8 aa, Entamoeba invadens
KTSKAKCI

SEQ ID NO: 2763981 - protein, 11 aa, Entamoeba invadens
KTSKDGSYCEK

SEQ ID NO: 2763982 - protein, 6 aa, Entamoeba invadens
KTSKEI

SEQ ID NO: 2763983 - protein, 12 aa, Entamoeba invadens
KTSKEKSHNTKK

SEQ ID NO: 2763984 - protein, 7 aa, Entamoeba invadens
KTSLKQK

SEQ ID NO: 2763985 - protein, 23 aa, Entamoeba invadens
KTSLNTNLKSSDNFSSESVTIGN

SEQ ID NO: 2763986 - protein, 5 aa, Entamoeba invadens
KTSLT

SEQ ID NO: 2763987 - protein, 18 aa, Entamoeba invadens
KTSLTIAKTETNNYDTGI

SEQ ID NO: 2763988 - protein, 7 aa, Entamoeba invadens
KTSNEVD

SEQ ID NO: 2763989 - protein, 12 aa, Entamoeba invadens
KTSNGNCERLTT

SEQ ID NO: 2763990 - protein, 14 aa, Entamoeba invadens
KTSNTSTQTNSKMG

SEQ ID NO: 2763991 - protein, 10 aa, Entamoeba invadens
KTSPHYKAPS

SEQ ID NO: 2763992 - protein, 16 aa, Entamoeba invadens
KTSPSENSNLPDKNTA

SEQ ID NO: 2763993 - protein, 9 aa, Entamoeba invadens
KTSPTRNIN

SEQ ID NO: 2763994 - protein, 6 aa, Entamoeba invadens
KTSQEI

SEQ ID NO: 2763995 - protein, 8 aa, Entamoeba invadens
KTSQENSC

SEQ ID NO: 2763996 - protein, 7 aa, Entamoeba invadens
KTSQQIE

SEQ ID NO: 2763997 - protein, 6 aa, Entamoeba invadens
KTSREV

SEQ ID NO: 2763998 - protein, 6 aa, Entamoeba invadens
KTSSCE

SEQ ID NO: 2763999 - protein, 11 aa, Entamoeba invadens
KTSSDKESVYS

SEQ ID NO: 2764000 - protein, 10 aa, Entamoeba invadens
KTSSEAEVKR

SEQ ID NO: 2764001 - protein, 7 aa, Entamoeba invadens
KTSSEID

SEQ ID NO: 2764002 - protein, 7 aa, Entamoeba invadens
KTSSNGV

SEQ ID NO: 2764003 - protein, 14 aa, Entamoeba invadens
KTSSNKKDITCGST

SEQ ID NO: 2764004 - protein, 18 aa, Entamoeba invadens
KTSSSTDYTTDPGSNSYP

SEQ ID NO: 2764005 - protein, 10 aa, Entamoeba invadens
KTSSTREVGT

SEQ ID NO: 2764006 - protein, 6 aa, Entamoeba invadens
KTSTAV

SEQ ID NO: 2764007 - protein, 6 aa, Entamoeba invadens
KTSTFN

SEQ ID NO: 2764008 - protein, 7 aa, Entamoeba invadens
KTSTKGK

SEQ ID NO: 2764009 - protein, 10 aa, Entamoeba invadens
KTSTKNECTS

SEQ ID NO: 2764010 - protein, 8 aa, Entamoeba invadens
KTSTQPAS

SEQ ID NO: 2764011 - protein, 5 aa, Entamoeba invadens
KTSTS

SEQ ID NO: 2764012 - protein, 7 aa, Entamoeba invadens
KTSVQEK

SEQ ID NO: 2764013 - protein, 15 aa, Entamoeba invadens
KTSYNKKDITCGSTL

SEQ ID NO: 2764014 - protein, 5 aa, Entamoeba invadens
KTSYT

SEQ ID NO: 2764015 - protein, 14 aa, Entamoeba invadens
KTTAETTKACYTQS

SEQ ID NO: 2764016 - protein, 6 aa, Entamoeba invadens
KTTAGC

SEQ ID NO: 2764017 - protein, 11 aa, Entamoeba invadens
KTTAYSNGKQQ

SEQ ID NO: 2764018 - protein, 7 aa, Entamoeba invadens
KTTCTQC

SEQ ID NO: 2764019 - protein, 7 aa, Entamoeba invadens
KTTDCSP

SEQ ID NO: 2764020 - protein, 6 aa, Entamoeba invadens
KTTDTF

SEQ ID NO: 2764021 - protein, 6 aa, Entamoeba invadens
KTTDTY

SEQ ID NO: 2764022 - protein, 6 aa, Entamoeba invadens
KTTDVN

SEQ ID NO: 2764023 - protein, 14 aa, Entamoeba invadens
KTTECEIDSQETEL

SEQ ID NO: 2764024 - protein, 84 aa, Entamoeba invadens
KTTEETPHNPFNDEKDVKKTKSKPVKKQKNIKESKSTEKTERGVAQKCPKPIYAKGAEKGSGHNTTVAVEEQKKENSELPEVPP

SEQ ID NO: 2764025 - protein, 9 aa, Entamoeba invadens
KTTEGCTQC

SEQ ID NO: 2764026 - protein, 9 aa, Entamoeba invadens
KTTEIETKN

SEQ ID NO: 2764027 - protein, 12 aa, Entamoeba invadens
KTTEIETKNEVP

SEQ ID NO: 2764028 - protein, 6 aa, Entamoeba invadens
KTTESE

SEQ ID NO: 2764029 - protein, 7 aa, Entamoeba invadens
KTTESMN

SEQ ID NO: 2764030 - protein, 6 aa, Entamoeba invadens
KTTFTS

SEQ ID NO: 2764031 - protein, 4 aa, Entamoeba invadens
KTTG

SEQ ID NO: 2764032 - protein, 7 aa, Entamoeba invadens
KTTGADK

SEQ ID NO: 2764033 - protein, 6 aa, Entamoeba invadens
KTTGKC

SEQ ID NO: 2764034 - protein, 5 aa, Entamoeba invadens
KTTGV

SEQ ID NO: 2764035 - protein, 6 aa, Entamoeba invadens
KTTHFD

SEQ ID NO: 2764036 - protein, 6 aa, Entamoeba invadens
KTTHTI

SEQ ID NO: 2764037 - protein, 7 aa, Entamoeba invadens
KTTIDQN

SEQ ID NO: 2764038 - protein, 6 aa, Entamoeba invadens
KTTIPS

SEQ ID NO: 2764039 - protein, 9 aa, Entamoeba invadens
KTTKCDANG

SEQ ID NO: 2764040 - protein, 7 aa, Entamoeba invadens
KTTKEMP

SEQ ID NO: 2764041 - protein, 7 aa, Entamoeba invadens
KTTKIPA

SEQ ID NO: 2764042 - protein, 10 aa, Entamoeba invadens
KTTKSSVEIA

SEQ ID NO: 2764043 - protein, 4 aa, Entamoeba invadens
KTTL

SEQ ID NO: 2764044 - protein, 5 aa, Entamoeba invadens
KTTLS

SEQ ID NO: 2764045 - protein, 24 aa, Entamoeba invadens
KTTNANKKEKVVQPVGDTENKEKK

SEQ ID NO: 2764046 - protein, 9 aa, Entamoeba invadens
KTTNGCTQC

SEQ ID NO: 2764047 - protein, 7 aa, Entamoeba invadens
KTTNGEI

SEQ ID NO: 2764048 - protein, 6 aa, Entamoeba invadens
KTTNTP

SEQ ID NO: 2764049 - protein, 12 aa, Entamoeba invadens
KTTPKTEKQTFE

SEQ ID NO: 2764050 - protein, 7 aa, Entamoeba invadens
KTTPLTS

SEQ ID NO: 2764051 - protein, 6 aa, Entamoeba invadens
KTTPPQ

SEQ ID NO: 2764052 - protein, 10 aa, Entamoeba invadens
KTTPQDQGEV

SEQ ID NO: 2764053 - protein, 14 aa, Entamoeba invadens
KTTPSIETTSNPTN

SEQ ID NO: 2764054 - protein, 7 aa, Entamoeba invadens
KTTQCTD

SEQ ID NO: 2764055 - protein, 7 aa, Entamoeba invadens
KTTQEEM

SEQ ID NO: 2764056 - protein, 11 aa, Entamoeba invadens
KTTQNGCAKCS

SEQ ID NO: 2764057 - protein, 9 aa, Entamoeba invadens
KTTQNGTDV

SEQ ID NO: 2764058 - protein, 7 aa, Entamoeba invadens
KTTQQCE

SEQ ID NO: 2764059 - protein, 6 aa, Entamoeba invadens
KTTQSC

SEQ ID NO: 2764060 - protein, 5 aa, Entamoeba invadens
KTTQT

SEQ ID NO: 2764061 - protein, 9 aa, Entamoeba invadens
KTTRKTTKE

SEQ ID NO: 2764062 - protein, 9 aa, Entamoeba invadens
KTTSEYNDN

SEQ ID NO: 2764063 - protein, 5 aa, Entamoeba invadens
KTTSG

SEQ ID NO: 2764064 - protein, 6 aa, Entamoeba invadens
KTTSKK

SEQ ID NO: 2764065 - protein, 6 aa, Entamoeba invadens
KTTSQM

SEQ ID NO: 2764066 - protein, 8 aa, Entamoeba invadens
KTTSSTKC

SEQ ID NO: 2764067 - protein, 4 aa, Entamoeba invadens
KTTT

SEQ ID NO: 2764068 - protein, 11 aa, Entamoeba invadens
KTTTDCPTSVE

SEQ ID NO: 2764069 - protein, 9 aa, Entamoeba invadens
KTTTDDLSN

SEQ ID NO: 2764070 - protein, 10 aa, Entamoeba invadens
KTTTENEGFS

SEQ ID NO: 2764071 - protein, 10 aa, Entamoeba invadens
KTTTGLQPPD

SEQ ID NO: 2764072 - protein, 7 aa, Entamoeba invadens
KTTTPKS

SEQ ID NO: 2764073 - protein, 7 aa, Entamoeba invadens
KTTTPYT

SEQ ID NO: 2764074 - protein, 8 aa, Entamoeba invadens
KTTTTKPT

SEQ ID NO: 2764075 - protein, 5 aa, Entamoeba invadens
KTTTV

SEQ ID NO: 2764076 - protein, 10 aa, Entamoeba invadens
KTTVDASHTY

SEQ ID NO: 2764077 - protein, 7 aa, Entamoeba invadens
KTTVERR

SEQ ID NO: 2764078 - protein, 4 aa, Entamoeba invadens
KTTY

SEQ ID NO: 2764079 - protein, 6 aa, Entamoeba invadens
KTVANR

SEQ ID NO: 2764080 - protein, 5 aa, Entamoeba invadens
KTVDQ

SEQ ID NO: 2764081 - protein, 4 aa, Entamoeba invadens
KTVH

SEQ ID NO: 2764082 - protein, 9 aa, Entamoeba invadens
KTVKGKAKL

SEQ ID NO: 2764083 - protein, 5 aa, Entamoeba invadens
KTVKQ

SEQ ID NO: 2764084 - protein, 11 aa, Entamoeba invadens
KTVKVSADSLN

SEQ ID NO: 2764085 - protein, 7 aa, Entamoeba invadens
KTVKYGD

SEQ ID NO: 2764086 - protein, 5 aa, Entamoeba invadens
KTVNK

SEQ ID NO: 2764087 - protein, 6 aa, Entamoeba invadens
KTVSQI

SEQ ID NO: 2764088 - protein, 8 aa, Entamoeba invadens
KTVSTTHT

SEQ ID NO: 2764089 - protein, 4 aa, Entamoeba invadens
KTVT

SEQ ID NO: 2764090 - protein, 9 aa, Entamoeba invadens
KTVTRDSFE

SEQ ID NO: 2764091 - protein, 6 aa, Entamoeba invadens
KTWPSI

SEQ ID NO: 2764092 - protein, 12 aa, Entamoeba invadens
KTWTSKSGANIT

SEQ ID NO: 2764093 - protein, 9 aa, Entamoeba invadens
KTYAKSQKC

SEQ ID NO: 2764094 - protein, 5 aa, Entamoeba invadens
KTYCS

SEQ ID NO: 2764095 - protein, 5 aa, Entamoeba invadens
KTYDE

SEQ ID NO: 2764096 - protein, 13 aa, Entamoeba invadens
KTYDYKTTGTTTL

SEQ ID NO: 2764097 - protein, 7 aa, Entamoeba invadens
KTYFNSN

SEQ ID NO: 2764098 - protein, 7 aa, Entamoeba invadens
KTYGDNK

SEQ ID NO: 2764099 - protein, 4 aa, Entamoeba invadens
KTYK

SEQ ID NO: 2764100 - protein, 4 aa, Entamoeba invadens
KTYL

SEQ ID NO: 2764101 - protein, 15 aa, Entamoeba invadens
KTYNKTSQTCEDPTI

SEQ ID NO: 2764102 - protein, 6 aa, Entamoeba invadens
KTYNTY

SEQ ID NO: 2764103 - protein, 10 aa, Entamoeba invadens
KTYSSTLTTV

SEQ ID NO: 2764104 - protein, 4 aa, Entamoeba invadens
KTYT

SEQ ID NO: 2764105 - protein, 15 aa, Entamoeba invadens
KTYTDTLASGGQLNG

SEQ ID NO: 2764106 - protein, 14 aa, Entamoeba invadens
KTYTYKSSTPTPIS

SEQ ID NO: 2764107 - protein, 4 aa, Entamoeba invadens
KVAA

SEQ ID NO: 2764108 - protein, 12 aa, Entamoeba invadens
KVAAKATKSEVK

SEQ ID NO: 2764109 - protein, 12 aa, Entamoeba invadens
KVAAKTTKSEVK

SEQ ID NO: 2764110 - protein, 15 aa, Entamoeba invadens
KVAGGNYCDSDKNEI

SEQ ID NO: 2764111 - protein, 4 aa, Entamoeba invadens
KVAN

SEQ ID NO: 2764112 - protein, 10 aa, Entamoeba invadens
KVCEQGTHDQ

SEQ ID NO: 2764113 - protein, 11 aa, Entamoeba invadens
KVDEKGTIAAA

SEQ ID NO: 2764114 - protein, 9 aa, Entamoeba invadens
KVDGGVSKS

SEQ ID NO: 2764115 - protein, 9 aa, Entamoeba invadens
KVDGNTRFT

SEQ ID NO: 2764116 - protein, 8 aa, Entamoeba invadens
KVDPSQNE

SEQ ID NO: 2764117 - protein, 7 aa, Entamoeba invadens
KVDRGNC

SEQ ID NO: 2764118 - protein, 18 aa, Entamoeba invadens
KVDSNNNPLIERSGSNVL

SEQ ID NO: 2764119 - protein, 7 aa, Entamoeba invadens
KVDSQLG

SEQ ID NO: 2764120 - protein, 10 aa, Entamoeba invadens
KVEAEKNEGV

SEQ ID NO: 2764121 - protein, 8 aa, Entamoeba invadens
KVEAPETH

SEQ ID NO: 2764122 - protein, 5 aa, Entamoeba invadens
KVEAS

SEQ ID NO: 2764123 - protein, 19 aa, Entamoeba invadens
KVEDARKVQSEKYDKIGKT

SEQ ID NO: 2764124 - protein, 9 aa, Entamoeba invadens
KVEELTSED

SEQ ID NO: 2764125 - protein, 27 aa, Entamoeba invadens
KVEEPLKSTEMSPASSVSQQSAQQIKH

SEQ ID NO: 2764126 - protein, 9 aa, Entamoeba invadens
KVEETSNKR

SEQ ID NO: 2764127 - protein, 6 aa, Entamoeba invadens
KVEGED

SEQ ID NO: 2764128 - protein, 7 aa, Entamoeba invadens
KVEGKVE

SEQ ID NO: 2764129 - protein, 4 aa, Entamoeba invadens
KVEI

SEQ ID NO: 2764130 - protein, 41 aa, Entamoeba invadens
KVEKERQKESRREKEMSDCSDKYYDKNEDQPSDDSKDAYGI

SEQ ID NO: 2764131 - protein, 5 aa, Entamoeba invadens
KVEKN

SEQ ID NO: 2764132 - protein, 7 aa, Entamoeba invadens
KVEKQGS

SEQ ID NO: 2764133 - protein, 12 aa, Entamoeba invadens
KVEKTGEFTRDD

SEQ ID NO: 2764134 - protein, 8 aa, Entamoeba invadens
KVENEEYQ

SEQ ID NO: 2764135 - protein, 19 aa, Entamoeba invadens
KVENENEEDSEGVKKEEDF

SEQ ID NO: 2764136 - protein, 8 aa, Entamoeba invadens
KVENGPKL

SEQ ID NO: 2764137 - protein, 33 aa, Entamoeba invadens
KVENNENLSTKENVITTENTDLPQPRGQEGNNH

SEQ ID NO: 2764138 - protein, 10 aa, Entamoeba invadens
KVENNKCGPN

SEQ ID NO: 2764139 - protein, 12 aa, Entamoeba invadens
KVESTQNDEKIE

SEQ ID NO: 2764140 - protein, 4 aa, Entamoeba invadens
KVET

SEQ ID NO: 2764141 - protein, 5 aa, Entamoeba invadens
KVETA

SEQ ID NO: 2764142 - protein, 10 aa, Entamoeba invadens
KVGARANSTI

SEQ ID NO: 2764143 - protein, 6 aa, Entamoeba invadens
KVGDAS

SEQ ID NO: 2764144 - protein, 10 aa, Entamoeba invadens
KVGDQPTSVI

SEQ ID NO: 2764145 - protein, 8 aa, Entamoeba invadens
KVGDSKCT

SEQ ID NO: 2764146 - protein, 13 aa, Entamoeba invadens
KVGDTDNYQCSAA

SEQ ID NO: 2764147 - protein, 7 aa, Entamoeba invadens
KVGEESR

SEQ ID NO: 2764148 - protein, 6 aa, Entamoeba invadens
KVGEVE

SEQ ID NO: 2764149 - protein, 5 aa, Entamoeba invadens
KVGGR

SEQ ID NO: 2764150 - protein, 10 aa, Entamoeba invadens
KVGGSDKDTD

SEQ ID NO: 2764151 - protein, 14 aa, Entamoeba invadens
KVGKDKKKRIEAKY

SEQ ID NO: 2764152 - protein, 15 aa, Entamoeba invadens
KVGPGKSKSSIEPTN

SEQ ID NO: 2764153 - protein, 16 aa, Entamoeba invadens
KVGPVEPSLPQNEGLD

SEQ ID NO: 2764154 - protein, 6 aa, Entamoeba invadens
KVGSAE

SEQ ID NO: 2764155 - protein, 6 aa, Entamoeba invadens
KVGTHR

SEQ ID NO: 2764156 - protein, 6 aa, Entamoeba invadens
KVINTN

SEQ ID NO: 2764157 - protein, 8 aa, Entamoeba invadens
KVKDSKCT

SEQ ID NO: 2764158 - protein, 51 aa, Entamoeba invadens
KVKEIENEANKDSKSGSDTSKEPLKGETKKTELKSIDKEDYNNEEISEEDV

SEQ ID NO: 2764159 - protein, 11 aa, Entamoeba invadens
KVKESKNLENK

SEQ ID NO: 2764160 - protein, 10 aa, Entamoeba invadens
KVKGKQSVKR

SEQ ID NO: 2764161 - protein, 9 aa, Entamoeba invadens
KVKNTRHLK

SEQ ID NO: 2764162 - protein, 8 aa, Entamoeba invadens
KVKRENIS

SEQ ID NO: 2764163 - protein, 5 aa, Entamoeba invadens
KVKRP

SEQ ID NO: 2764164 - protein, 8 aa, Entamoeba invadens
KVKTNKKI

SEQ ID NO: 2764165 - protein, 8 aa, Entamoeba invadens
KVKTNKKT

SEQ ID NO: 2764166 - protein, 8 aa, Entamoeba invadens
KVKTPKGC

SEQ ID NO: 2764167 - protein, 36 aa, Entamoeba invadens
KVKTQNVSVSNKKSALKSQEEIDCSTRNNKGCQRCP

SEQ ID NO: 2764168 - protein, 9 aa, Entamoeba invadens
KVLQKDKKA

SEQ ID NO: 2764169 - protein, 12 aa, Entamoeba invadens
KVNAKLTDFGSA

SEQ ID NO: 2764170 - protein, 14 aa, Entamoeba invadens
KVNAKLTDFGSSRN

SEQ ID NO: 2764171 - protein, 10 aa, Entamoeba invadens
KVNASTTLSF

SEQ ID NO: 2764172 - protein, 19 aa, Entamoeba invadens
KVNATLSSKLKDDVKQLET

SEQ ID NO: 2764173 - protein, 6 aa, Entamoeba invadens
KVNDTK

SEQ ID NO: 2764174 - protein, 21 aa, Entamoeba invadens
KVNEKAKGEMEGSCNKSKDEI

SEQ ID NO: 2764175 - protein, 9 aa, Entamoeba invadens
KVNETKTSV

SEQ ID NO: 2764176 - protein, 6 aa, Entamoeba invadens
KVNGEH

SEQ ID NO: 2764177 - protein, 18 aa, Entamoeba invadens
KVNGGATAIESEREGKGK

SEQ ID NO: 2764178 - protein, 9 aa, Entamoeba invadens
KVNNSGKCD

SEQ ID NO: 2764179 - protein, 15 aa, Entamoeba invadens
KVNPEGTQCDKTTNY

SEQ ID NO: 2764180 - protein, 8 aa, Entamoeba invadens
KVNPESGL

SEQ ID NO: 2764181 - protein, 8 aa, Entamoeba invadens
KVNPETDV

SEQ ID NO: 2764182 - protein, 6 aa, Entamoeba invadens
KVNSLK

SEQ ID NO: 2764183 - protein, 9 aa, Entamoeba invadens
KVNSTTESG

SEQ ID NO: 2764184 - protein, 12 aa, Entamoeba invadens
KVNTKKLKKSRQ

SEQ ID NO: 2764185 - protein, 7 aa, Entamoeba invadens
KVPCPGD

SEQ ID NO: 2764186 - protein, 9 aa, Entamoeba invadens
KVPDASKNV

SEQ ID NO: 2764187 - protein, 6 aa, Entamoeba invadens
KVPDKN

SEQ ID NO: 2764188 - protein, 6 aa, Entamoeba invadens
KVPDND

SEQ ID NO: 2764189 - protein, 25 aa, Entamoeba invadens
KVPEEYKKSYKKANPPQFKKTSLPE

SEQ ID NO: 2764190 - protein, 8 aa, Entamoeba invadens
KVPESKPT

SEQ ID NO: 2764191 - protein, 6 aa, Entamoeba invadens
KVPKTS

SEQ ID NO: 2764192 - protein, 6 aa, Entamoeba invadens
KVPPIS

SEQ ID NO: 2764193 - protein, 9 aa, Entamoeba invadens
KVPQKGENN

SEQ ID NO: 2764194 - protein, 7 aa, Entamoeba invadens
KVPSGDG

SEQ ID NO: 2764195 - protein, 6 aa, Entamoeba invadens
KVPSGF

SEQ ID NO: 2764196 - protein, 7 aa, Entamoeba invadens
KVPYSDS

SEQ ID NO: 2764197 - protein, 12 aa, Entamoeba invadens
KVQEERLSESNS

SEQ ID NO: 2764198 - protein, 8 aa, Entamoeba invadens
KVQFTSDS

SEQ ID NO: 2764199 - protein, 6 aa, Entamoeba invadens
KVQPHP

SEQ ID NO: 2764200 - protein, 4 aa, Entamoeba invadens
KVQS

SEQ ID NO: 2764201 - protein, 4 aa, Entamoeba invadens
KVQV

SEQ ID NO: 2764202 - protein, 6 aa, Entamoeba invadens
KVRDLQ

SEQ ID NO: 2764203 - protein, 7 aa, Entamoeba invadens
KVRGGPE

SEQ ID NO: 2764204 - protein, 11 aa, Entamoeba invadens
KVRPPKIENGE

SEQ ID NO: 2764205 - protein, 7 aa, Entamoeba invadens
KVSCSNE

SEQ ID NO: 2764206 - protein, 6 aa, Entamoeba invadens
KVSDDG

SEQ ID NO: 2764207 - protein, 7 aa, Entamoeba invadens
KVSDNGI

SEQ ID NO: 2764208 - protein, 10 aa, Entamoeba invadens
KVSDNSNVSV

SEQ ID NO: 2764209 - protein, 4 aa, Entamoeba invadens
KVSE

SEQ ID NO: 2764210 - protein, 8 aa, Entamoeba invadens
KVSEDGDR

SEQ ID NO: 2764211 - protein, 6 aa, Entamoeba invadens
KVSEDR

SEQ ID NO: 2764212 - protein, 12 aa, Entamoeba invadens
KVSGDPQTTAYT

SEQ ID NO: 2764213 - protein, 8 aa, Entamoeba invadens
KVSKGSLE

SEQ ID NO: 2764214 - protein, 6 aa, Entamoeba invadens
KVSNEV

SEQ ID NO: 2764215 - protein, 8 aa, Entamoeba invadens
KVSPIKGG

SEQ ID NO: 2764216 - protein, 10 aa, Entamoeba invadens
KVSPQETATI

SEQ ID NO: 2764217 - protein, 9 aa, Entamoeba invadens
KVSSPNGLK

SEQ ID NO: 2764218 - protein, 24 aa, Entamoeba invadens
KVSSSIKAEDASDINCQEGSYQKG

SEQ ID NO: 2764219 - protein, 7 aa, Entamoeba invadens
KVSSSSS

SEQ ID NO: 2764220 - protein, 10 aa, Entamoeba invadens
KVSTDVPLPG

SEQ ID NO: 2764221 - protein, 7 aa, Entamoeba invadens
KVSTENE

SEQ ID NO: 2764222 - protein, 18 aa, Entamoeba invadens
KVSTNQHQEDSWEETKKD

SEQ ID NO: 2764223 - protein, 5 aa, Entamoeba invadens
KVTDT

SEQ ID NO: 2764224 - protein, 21 aa, Entamoeba invadens
KVTEIGKISSELNKKIDKTMP

SEQ ID NO: 2764225 - protein, 6 aa, Entamoeba invadens
KVTEKS

SEQ ID NO: 2764226 - protein, 6 aa, Entamoeba invadens
KVTGQC

SEQ ID NO: 2764227 - protein, 6 aa, Entamoeba invadens
KVTGSS

SEQ ID NO: 2764228 - protein, 8 aa, Entamoeba invadens
KVTKELKD

SEQ ID NO: 2764229 - protein, 6 aa, Entamoeba invadens
KVTKEN

SEQ ID NO: 2764230 - protein, 10 aa, Entamoeba invadens
KVTKPTNNDE

SEQ ID NO: 2764231 - protein, 14 aa, Entamoeba invadens
KVTLDGSQKTNKLT

SEQ ID NO: 2764232 - protein, 12 aa, Entamoeba invadens
KVTNQNTGNEEC

SEQ ID NO: 2764233 - protein, 6 aa, Entamoeba invadens
KVTNVD

SEQ ID NO: 2764234 - protein, 4 aa, Entamoeba invadens
KVTP

SEQ ID NO: 2764235 - protein, 14 aa, Entamoeba invadens
KVTPTSKSQKLPKD

SEQ ID NO: 2764236 - protein, 5 aa, Entamoeba invadens
KVTQN

SEQ ID NO: 2764237 - protein, 9 aa, Entamoeba invadens
KVTTQTQTD

SEQ ID NO: 2764238 - protein, 6 aa, Entamoeba invadens
KVTTTT

SEQ ID NO: 2764239 - protein, 6 aa, Entamoeba invadens
KVTVSN

SEQ ID NO: 2764240 - protein, 7 aa, Entamoeba invadens
KVTYTIP

SEQ ID NO: 2764241 - protein, 6 aa, Entamoeba invadens
KVVGKK

SEQ ID NO: 2764242 - protein, 16 aa, Entamoeba invadens
KVYRDGDKKTVDSDHI

SEQ ID NO: 2764243 - protein, 16 aa, Entamoeba invadens
KWDSYNEECDGTPNCT

SEQ ID NO: 2764244 - protein, 8 aa, Entamoeba invadens
KYAEDGNN

SEQ ID NO: 2764245 - protein, 5 aa, Entamoeba invadens
KYALN

SEQ ID NO: 2764246 - protein, 9 aa, Entamoeba invadens
KYANNTSKV

SEQ ID NO: 2764247 - protein, 13 aa, Entamoeba invadens
KYATPTKPYAPNQ

SEQ ID NO: 2764248 - protein, 23 aa, Entamoeba invadens
KYDDDEEGRRSVSPRGSGSGAAM

SEQ ID NO: 2764249 - protein, 6 aa, Entamoeba invadens
KYEAES

SEQ ID NO: 2764250 - protein, 4 aa, Entamoeba invadens
KYED

SEQ ID NO: 2764251 - protein, 8 aa, Entamoeba invadens
KYEDSQAL

SEQ ID NO: 2764252 - protein, 6 aa, Entamoeba invadens
KYEGTF

SEQ ID NO: 2764253 - protein, 4 aa, Entamoeba invadens
KYEI

SEQ ID NO: 2764254 - protein, 10 aa, Entamoeba invadens
KYEKVENKKF

SEQ ID NO: 2764255 - protein, 6 aa, Entamoeba invadens
KYENDV

SEQ ID NO: 2764256 - protein, 20 aa, Entamoeba invadens
KYEPSPNVPQSCQPKISSTT

SEQ ID NO: 2764257 - protein, 12 aa, Entamoeba invadens
KYESPTALADYS

SEQ ID NO: 2764258 - protein, 5 aa, Entamoeba invadens
KYETE

SEQ ID NO: 2764259 - protein, 7 aa, Entamoeba invadens
KYGAYGE

SEQ ID NO: 2764260 - protein, 4 aa, Entamoeba invadens
KYGD

SEQ ID NO: 2764261 - protein, 5 aa, Entamoeba invadens
KYGDI

SEQ ID NO: 2764262 - protein, 13 aa, Entamoeba invadens
KYGDKKTELQKAP

SEQ ID NO: 2764263 - protein, 6 aa, Entamoeba invadens
KYGDRC

SEQ ID NO: 2764264 - protein, 6 aa, Entamoeba invadens
KYGDSD

SEQ ID NO: 2764265 - protein, 5 aa, Entamoeba invadens
KYGER

SEQ ID NO: 2764266 - protein, 6 aa, Entamoeba invadens
KYGGDD

SEQ ID NO: 2764267 - protein, 6 aa, Entamoeba invadens
KYGGEA

SEQ ID NO: 2764268 - protein, 8 aa, Entamoeba invadens
KYGGENTQ

SEQ ID NO: 2764269 - protein, 4 aa, Entamoeba invadens
KYGK

SEQ ID NO: 2764270 - protein, 4 aa, Entamoeba invadens
KYGN

SEQ ID NO: 2764271 - protein, 5 aa, Entamoeba invadens
KYGNA

SEQ ID NO: 2764272 - protein, 5 aa, Entamoeba invadens
KYGNC

SEQ ID NO: 2764273 - protein, 6 aa, Entamoeba invadens
KYGSAR

SEQ ID NO: 2764274 - protein, 6 aa, Entamoeba invadens
KYHDGE

SEQ ID NO: 2764275 - protein, 19 aa, Entamoeba invadens
KYIKSEMEKRGIKKDVKKG

SEQ ID NO: 2764276 - protein, 12 aa, Entamoeba invadens
KYIRKGRKGSLN

SEQ ID NO: 2764277 - protein, 12 aa, Entamoeba invadens
KYISKGRKGSLN

SEQ ID NO: 2764278 - protein, 5 aa, Entamoeba invadens
KYIST

SEQ ID NO: 2764279 - protein, 6 aa, Entamoeba invadens
KYISTN

SEQ ID NO: 2764280 - protein, 13 aa, Entamoeba invadens
KYKDTVFKNEGKI

SEQ ID NO: 2764281 - protein, 11 aa, Entamoeba invadens
KYKEAKCETLQ

SEQ ID NO: 2764282 - protein, 8 aa, Entamoeba invadens
KYKETSDM

SEQ ID NO: 2764283 - protein, 5 aa, Entamoeba invadens
KYKIS

SEQ ID NO: 2764284 - protein, 8 aa, Entamoeba invadens
KYKKSADI

SEQ ID NO: 2764285 - protein, 5 aa, Entamoeba invadens
KYKMP

SEQ ID NO: 2764286 - protein, 7 aa, Entamoeba invadens
KYKMPSD

SEQ ID NO: 2764287 - protein, 12 aa, Entamoeba invadens
KYKNDKTNPAKV

SEQ ID NO: 2764288 - protein, 8 aa, Entamoeba invadens
KYKNENVA

SEQ ID NO: 2764289 - protein, 8 aa, Entamoeba invadens
KYKPASNG

SEQ ID NO: 2764290 - protein, 10 aa, Entamoeba invadens
KYKPDYDSAR

SEQ ID NO: 2764291 - protein, 17 aa, Entamoeba invadens
KYKPEKQDEEKDDIKTP

SEQ ID NO: 2764292 - protein, 13 aa, Entamoeba invadens
KYKQKQVDDKYNK

SEQ ID NO: 2764293 - protein, 9 aa, Entamoeba invadens
KYKQNTGHN

SEQ ID NO: 2764294 - protein, 16 aa, Entamoeba invadens
KYKSNKQLTPKGNTNI

SEQ ID NO: 2764295 - protein, 29 aa, Entamoeba invadens
KYKTDELPDIEDDERFKQMKENDKEIDEK

SEQ ID NO: 2764296 - protein, 7 aa, Entamoeba invadens
KYKTPAD

SEQ ID NO: 2764297 - protein, 7 aa, Entamoeba invadens
KYKVPDD

SEQ ID NO: 2764298 - protein, 18 aa, Entamoeba invadens
KYNESYTEGAYFIVNKKK

SEQ ID NO: 2764299 - protein, 9 aa, Entamoeba invadens
KYNKQNKTI

SEQ ID NO: 2764300 - protein, 7 aa, Entamoeba invadens
KYNNNYK

SEQ ID NO: 2764301 - protein, 8 aa, Entamoeba invadens
KYNNTCQP

SEQ ID NO: 2764302 - protein, 4 aa, Entamoeba invadens
KYNP

SEQ ID NO: 2764303 - protein, 4 aa, Entamoeba invadens
KYNQ

SEQ ID NO: 2764304 - protein, 7 aa, Entamoeba invadens
KYPAPVG

SEQ ID NO: 2764305 - protein, 14 aa, Entamoeba invadens
KYPCQKGYYSNDQA

SEQ ID NO: 2764306 - protein, 13 aa, Entamoeba invadens
KYPCQKGYYSNNR

SEQ ID NO: 2764307 - protein, 6 aa, Entamoeba invadens
KYPDAL

SEQ ID NO: 2764308 - protein, 7 aa, Entamoeba invadens
KYPDKIT

SEQ ID NO: 2764309 - protein, 5 aa, Entamoeba invadens
KYPDT

SEQ ID NO: 2764310 - protein, 10 aa, Entamoeba invadens
KYPDTLKTES

SEQ ID NO: 2764311 - protein, 6 aa, Entamoeba invadens
KYPKAW

SEQ ID NO: 2764312 - protein, 7 aa, Entamoeba invadens
KYPKKSC

SEQ ID NO: 2764313 - protein, 5 aa, Entamoeba invadens
KYPNC

SEQ ID NO: 2764314 - protein, 11 aa, Entamoeba invadens
KYPNCEECNTK

SEQ ID NO: 2764315 - protein, 10 aa, Entamoeba invadens
KYPNDSSKVC

SEQ ID NO: 2764316 - protein, 11 aa, Entamoeba invadens
KYPNENPPVIT

SEQ ID NO: 2764317 - protein, 6 aa, Entamoeba invadens
KYPQPE

SEQ ID NO: 2764318 - protein, 12 aa, Entamoeba invadens
KYPQSHKESLVD

SEQ ID NO: 2764319 - protein, 9 aa, Entamoeba invadens
KYPSDSNKI

SEQ ID NO: 2764320 - protein, 9 aa, Entamoeba invadens
KYPSSSSPF

SEQ ID NO: 2764321 - protein, 4 aa, Entamoeba invadens
KYPT

SEQ ID NO: 2764322 - protein, 6 aa, Entamoeba invadens
KYPYGI

SEQ ID NO: 2764323 - protein, 6 aa, Entamoeba invadens
KYQAYR

SEQ ID NO: 2764324 - protein, 5 aa, Entamoeba invadens
KYQGN

SEQ ID NO: 2764325 - protein, 7 aa, Entamoeba invadens
KYQGTFP

SEQ ID NO: 2764326 - protein, 18 aa, Entamoeba invadens
KYQHNNKQMTVDANSSTL

SEQ ID NO: 2764327 - protein, 8 aa, Entamoeba invadens
KYQKNYKN

SEQ ID NO: 2764328 - protein, 11 aa, Entamoeba invadens
KYQKNYKNQKE

SEQ ID NO: 2764329 - protein, 10 aa, Entamoeba invadens
KYQKSEKGIS

SEQ ID NO: 2764330 - protein, 10 aa, Entamoeba invadens
KYQKSEKGVP

SEQ ID NO: 2764331 - protein, 5 aa, Entamoeba invadens
KYQLN

SEQ ID NO: 2764332 - protein, 5 aa, Entamoeba invadens
KYQQE

SEQ ID NO: 2764333 - protein, 8 aa, Entamoeba invadens
KYQRNYKT

SEQ ID NO: 2764334 - protein, 13 aa, Entamoeba invadens
KYQSKHNASTFGT

SEQ ID NO: 2764335 - protein, 17 aa, Entamoeba invadens
KYQTEQHESFEQTTQST

SEQ ID NO: 2764336 - protein, 13 aa, Entamoeba invadens
KYQTQCNKKNKRL

SEQ ID NO: 2764337 - protein, 6 aa, Entamoeba invadens
KYREND

SEQ ID NO: 2764338 - protein, 7 aa, Entamoeba invadens
KYRGDTV

SEQ ID NO: 2764339 - protein, 6 aa, Entamoeba invadens
KYRGHS

SEQ ID NO: 2764340 - protein, 6 aa, Entamoeba invadens
KYRGRD

SEQ ID NO: 2764341 - protein, 5 aa, Entamoeba invadens
KYRGS

SEQ ID NO: 2764342 - protein, 9 aa, Entamoeba invadens
KYRKDSNEL

SEQ ID NO: 2764343 - protein, 8 aa, Entamoeba invadens
KYRLGDDG

SEQ ID NO: 2764344 - protein, 6 aa, Entamoeba invadens
KYRNND

SEQ ID NO: 2764345 - protein, 7 aa, Entamoeba invadens
KYRNSDV

SEQ ID NO: 2764346 - protein, 7 aa, Entamoeba invadens
KYRSTGE

SEQ ID NO: 2764347 - protein, 15 aa, Entamoeba invadens
KYRTETAKKTTDPIW

SEQ ID NO: 2764348 - protein, 12 aa, Entamoeba invadens
KYSDGYSLSNEI

SEQ ID NO: 2764349 - protein, 4 aa, Entamoeba invadens
KYSE

SEQ ID NO: 2764350 - protein, 7 aa, Entamoeba invadens
KYSEETK

SEQ ID NO: 2764351 - protein, 9 aa, Entamoeba invadens
KYSGNENEI

SEQ ID NO: 2764352 - protein, 7 aa, Entamoeba invadens
KYSIAQS

SEQ ID NO: 2764353 - protein, 8 aa, Entamoeba invadens
KYSIRTEP

SEQ ID NO: 2764354 - protein, 6 aa, Entamoeba invadens
KYSKDC

SEQ ID NO: 2764355 - protein, 7 aa, Entamoeba invadens
KYSKDKY

SEQ ID NO: 2764356 - protein, 7 aa, Entamoeba invadens
KYSKTFP

SEQ ID NO: 2764357 - protein, 6 aa, Entamoeba invadens
KYSNKA

SEQ ID NO: 2764358 - protein, 7 aa, Entamoeba invadens
KYSNTIE

SEQ ID NO: 2764359 - protein, 10 aa, Entamoeba invadens
KYSSFASSTC

SEQ ID NO: 2764360 - protein, 6 aa, Entamoeba invadens
KYSSGD

SEQ ID NO: 2764361 - protein, 8 aa, Entamoeba invadens
KYSSGYSK

SEQ ID NO: 2764362 - protein, 14 aa, Entamoeba invadens
KYSSSGSSSCTSCS

SEQ ID NO: 2764363 - protein, 9 aa, Entamoeba invadens
KYSTKPKNY

SEQ ID NO: 2764364 - protein, 10 aa, Entamoeba invadens
KYSTPSQYPQ

SEQ ID NO: 2764365 - protein, 6 aa, Entamoeba invadens
KYSVGK

SEQ ID NO: 2764366 - protein, 8 aa, Entamoeba invadens
KYSYATNG

SEQ ID NO: 2764367 - protein, 15 aa, Entamoeba invadens
KYSYDGDASCVDPSK

SEQ ID NO: 2764368 - protein, 7 aa, Entamoeba invadens
KYSYDGN

SEQ ID NO: 2764369 - protein, 6 aa, Entamoeba invadens
KYTDCS

SEQ ID NO: 2764370 - protein, 6 aa, Entamoeba invadens
KYTDGT

SEQ ID NO: 2764371 - protein, 7 aa, Entamoeba invadens
KYTDLGN

SEQ ID NO: 2764372 - protein, 7 aa, Entamoeba invadens
KYTEEEI

SEQ ID NO: 2764373 - protein, 9 aa, Entamoeba invadens
KYTERLSAG

SEQ ID NO: 2764374 - protein, 7 aa, Entamoeba invadens
KYTESTI

SEQ ID NO: 2764375 - protein, 7 aa, Entamoeba invadens
KYTGDMG

SEQ ID NO: 2764376 - protein, 11 aa, Entamoeba invadens
KYTGDQKTLPH

SEQ ID NO: 2764377 - protein, 6 aa, Entamoeba invadens
KYTGSQ

SEQ ID NO: 2764378 - protein, 7 aa, Entamoeba invadens
KYTKASD

SEQ ID NO: 2764379 - protein, 18 aa, Entamoeba invadens
KYTKQALNSTKPVNKSSI

SEQ ID NO: 2764380 - protein, 6 aa, Entamoeba invadens
KYTKSA

SEQ ID NO: 2764381 - protein, 7 aa, Entamoeba invadens
KYTKSAD

SEQ ID NO: 2764382 - protein, 8 aa, Entamoeba invadens
KYTNPSRV

SEQ ID NO: 2764383 - protein, 7 aa, Entamoeba invadens
KYTPPNP

SEQ ID NO: 2764384 - protein, 6 aa, Entamoeba invadens
KYTQKR

SEQ ID NO: 2764385 - protein, 45 aa, Entamoeba invadens
KYTREDEAKQSCSQSVGASSVSNKGAMSCENGYSIGSGKCSTCEA

SEQ ID NO: 2764386 - protein, 9 aa, Entamoeba invadens
KYTRNNQDD

SEQ ID NO: 2764387 - protein, 8 aa, Entamoeba invadens
KYTSRPIK

SEQ ID NO: 2764388 - protein, 6 aa, Entamoeba invadens
KYTSSQ

SEQ ID NO: 2764389 - protein, 8 aa, Entamoeba invadens
KYTSTATE

SEQ ID NO: 2764390 - protein, 7 aa, Entamoeba invadens
KYTTDTN

SEQ ID NO: 2764391 - protein, 22 aa, Entamoeba invadens
KYTTKTNQLAVDEDEYKEEYRA

SEQ ID NO: 2764392 - protein, 22 aa, Entamoeba invadens
KYTTKTNQLAVDEDKEEEEYRA

SEQ ID NO: 2764393 - protein, 5 aa, Entamoeba invadens
KYTTS

SEQ ID NO: 2764394 - protein, 8 aa, Entamoeba invadens
KYVTKSAQ

SEQ ID NO: 2764395 - protein, 13 aa, Entamoeba invadens
KYYDNTTGTPSCV

SEQ ID NO: 2764396 - protein, 19 aa, Entamoeba invadens
KYYESNGKYIRTEECDGGV

SEQ ID NO: 2764397 - protein, 13 aa, Entamoeba invadens
KYYGNTQTPMDSD

SEQ ID NO: 2764398 - protein, 8 aa, Entamoeba invadens
KYYPDAPY

SEQ ID NO: 2764399 - protein, 10 aa, Entamoeba invadens
KYYSRGEKET

SEQ ID NO: 2764400 - protein, 9 aa, Entamoeba invadens
KYYTSTSDN

SEQ ID NO: 2764401 - protein, 28 aa, Entamoeba invadens
LADEIDELKKQKTAFETEKTIEEKTIDN

SEQ ID NO: 2764402 - protein, 8 aa, Entamoeba invadens
LADFGSAR

SEQ ID NO: 2764403 - protein, 8 aa, Entamoeba invadens
LADTKPSL

SEQ ID NO: 2764404 - protein, 11 aa, Entamoeba invadens
LAEDDQSLEEP

SEQ ID NO: 2764405 - protein, 10 aa, Entamoeba invadens
LAEGERTSAV

SEQ ID NO: 2764406 - protein, 4 aa, Entamoeba invadens
LAEN

SEQ ID NO: 2764407 - protein, 6 aa, Entamoeba invadens
LAENNE

SEQ ID NO: 2764408 - protein, 13 aa, Entamoeba invadens
LAESENNTEKEAL

SEQ ID NO: 2764409 - protein, 8 aa, Entamoeba invadens
LAESQNGG

SEQ ID NO: 2764410 - protein, 4 aa, Entamoeba invadens
LAGE

SEQ ID NO: 2764411 - protein, 4 aa, Entamoeba invadens
LAGN

SEQ ID NO: 2764412 - protein, 9 aa, Entamoeba invadens
LAGNAFAQT

SEQ ID NO: 2764413 - protein, 9 aa, Entamoeba invadens
LAGSEGCQS

SEQ ID NO: 2764414 - protein, 9 aa, Entamoeba invadens
LAKDDFKKS

SEQ ID NO: 2764415 - protein, 7 aa, Entamoeba invadens
LAKDGVD

SEQ ID NO: 2764416 - protein, 10 aa, Entamoeba invadens
LAKDNNNNTE

SEQ ID NO: 2764417 - protein, 9 aa, Entamoeba invadens
LAKDNTKGA

SEQ ID NO: 2764418 - protein, 14 aa, Entamoeba invadens
LAKEELVDGAGQRP

SEQ ID NO: 2764419 - protein, 7 aa, Entamoeba invadens
LAKEGQF

SEQ ID NO: 2764420 - protein, 17 aa, Entamoeba invadens
LAKEKPNKFTGKNLIFP

SEQ ID NO: 2764421 - protein, 11 aa, Entamoeba invadens
LAKKTGTSTSN

SEQ ID NO: 2764422 - protein, 9 aa, Entamoeba invadens
LALRGPEGT

SEQ ID NO: 2764423 - protein, 14 aa, Entamoeba invadens
LANDKKIGVTQPRR

SEQ ID NO: 2764424 - protein, 12 aa, Entamoeba invadens
LANEKTKAKLAT

SEQ ID NO: 2764425 - protein, 11 aa, Entamoeba invadens
LANGPKGGNIK

SEQ ID NO: 2764426 - protein, 13 aa, Entamoeba invadens
LANKNCTSCDKNG

SEQ ID NO: 2764427 - protein, 8 aa, Entamoeba invadens
LAPPQIPT

SEQ ID NO: 2764428 - protein, 14 aa, Entamoeba invadens
LAPSTKSSTRRSNR

SEQ ID NO: 2764429 - protein, 20 aa, Entamoeba invadens
LAQAKKKKHDTIDQEKTKNV

SEQ ID NO: 2764430 - protein, 6 aa, Entamoeba invadens
LAQPPE

SEQ ID NO: 2764431 - protein, 5 aa, Entamoeba invadens
LAREG

SEQ ID NO: 2764432 - protein, 10 aa, Entamoeba invadens
LARNTGGSIQ

SEQ ID NO: 2764433 - protein, 8 aa, Entamoeba invadens
LARNTGKT

SEQ ID NO: 2764434 - protein, 9 aa, Entamoeba invadens
LASADNVSV

SEQ ID NO: 2764435 - protein, 18 aa, Entamoeba invadens
LASATKLRQKDIWECITK

SEQ ID NO: 2764436 - protein, 6 aa, Entamoeba invadens
LASDPS

SEQ ID NO: 2764437 - protein, 8 aa, Entamoeba invadens
LASEDSCE

SEQ ID NO: 2764438 - protein, 8 aa, Entamoeba invadens
LASHTSGK

SEQ ID NO: 2764439 - protein, 6 aa, Entamoeba invadens
LASNEV

SEQ ID NO: 2764440 - protein, 106 aa, Entamoeba invadens
LASSHKSDSDSSSKKRKSLKLSKTTSKNTETTTTSQQESEEPTPRITTEKGRLVSDENQDESERSTKNEKVEEQQDNKQPLPNELNKTDDVKSSDDSLQSKSSTKE

SEQ ID NO: 2764441 - protein, 9 aa, Entamoeba invadens
LASSVSPIE

SEQ ID NO: 2764442 - protein, 8 aa, Entamoeba invadens
LATDPPDF

SEQ ID NO: 2764443 - protein, 41 aa, Entamoeba invadens
LATDSKKAKPPSKPLPPPKQVSFNKSPSPMINSERNSMDIK

SEQ ID NO: 2764444 - protein, 9 aa, Entamoeba invadens
LATLSSGKA

SEQ ID NO: 2764445 - protein, 5 aa, Entamoeba invadens
LATNT

SEQ ID NO: 2764446 - protein, 5 aa, Entamoeba invadens
LATSQ

SEQ ID NO: 2764447 - protein, 22 aa, Entamoeba invadens
LCENGKITKCDNSSQMNTNGKC

SEQ ID NO: 2764448 - protein, 6 aa, Entamoeba invadens
LCEPTS

SEQ ID NO: 2764449 - protein, 16 aa, Entamoeba invadens
LCESKDETCEWSHTKQ

SEQ ID NO: 2764450 - protein, 7 aa, Entamoeba invadens
LCETNSK

SEQ ID NO: 2764451 - protein, 8 aa, Entamoeba invadens
LCETNSKI

SEQ ID NO: 2764452 - protein, 18 aa, Entamoeba invadens
LCNPPQSDCGDGKFGMTP

SEQ ID NO: 2764453 - protein, 7 aa, Entamoeba invadens
LCNTENG

SEQ ID NO: 2764454 - protein, 14 aa, Entamoeba invadens
LCPKGSSSKYGSTE

SEQ ID NO: 2764455 - protein, 15 aa, Entamoeba invadens
LCPSNSQNQNSYLNS

SEQ ID NO: 2764456 - protein, 4 aa, Entamoeba invadens
LCQP

SEQ ID NO: 2764457 - protein, 12 aa, Entamoeba invadens
LCQPTEESSLDT

SEQ ID NO: 2764458 - protein, 4 aa, Entamoeba invadens
LCSN

SEQ ID NO: 2764459 - protein, 11 aa, Entamoeba invadens
LDAGETSCSKT

SEQ ID NO: 2764460 - protein, 14 aa, Entamoeba invadens
LDCPEGSKKDETNM

SEQ ID NO: 2764461 - protein, 7 aa, Entamoeba invadens
LDDAETQ

SEQ ID NO: 2764462 - protein, 14 aa, Entamoeba invadens
LDDATKKLNAQGTV

SEQ ID NO: 2764463 - protein, 4 aa, Entamoeba invadens
LDDD

SEQ ID NO: 2764464 - protein, 22 aa, Entamoeba invadens
LDDDKHDISNAPKEESIQEPLL

SEQ ID NO: 2764465 - protein, 19 aa, Entamoeba invadens
LDDEFKSQTEMSNKTAKQM

SEQ ID NO: 2764466 - protein, 13 aa, Entamoeba invadens
LDDGEECDGGTGC

SEQ ID NO: 2764467 - protein, 15 aa, Entamoeba invadens
LDDIPKPNEQVKEDE

SEQ ID NO: 2764468 - protein, 12 aa, Entamoeba invadens
LDDKSEKEKALN

SEQ ID NO: 2764469 - protein, 14 aa, Entamoeba invadens
LDDKTTKIKKTEKV

SEQ ID NO: 2764470 - protein, 5 aa, Entamoeba invadens
LDDPK

SEQ ID NO: 2764471 - protein, 14 aa, Entamoeba invadens
LDDPTAYKQLPDNA

SEQ ID NO: 2764472 - protein, 6 aa, Entamoeba invadens
LDDPTV

SEQ ID NO: 2764473 - protein, 14 aa, Entamoeba invadens
LDDPVTENGENFSL

SEQ ID NO: 2764474 - protein, 4 aa, Entamoeba invadens
LDDV

SEQ ID NO: 2764475 - protein, 8 aa, Entamoeba invadens
LDEAEQRL

SEQ ID NO: 2764476 - protein, 5 aa, Entamoeba invadens
LDEDA

SEQ ID NO: 2764477 - protein, 4 aa, Entamoeba invadens
LDEE

SEQ ID NO: 2764478 - protein, 14 aa, Entamoeba invadens
LDEEEECDNSYKND

SEQ ID NO: 2764479 - protein, 6 aa, Entamoeba invadens
LDEEGE

SEQ ID NO: 2764480 - protein, 7 aa, Entamoeba invadens
LDEEGEY

SEQ ID NO: 2764481 - protein, 27 aa, Entamoeba invadens
LDEEVKTANANIDTQTKEITEFTSSSD

SEQ ID NO: 2764482 - protein, 4 aa, Entamoeba invadens
LDEF

SEQ ID NO: 2764483 - protein, 4 aa, Entamoeba invadens
LDEK

SEQ ID NO: 2764484 - protein, 5 aa, Entamoeba invadens
LDENR

SEQ ID NO: 2764485 - protein, 29 aa, Entamoeba invadens
LDEPKEISGTPIKEQQPQQRLEQRTNSSG

SEQ ID NO: 2764486 - protein, 6 aa, Entamoeba invadens
LDEQGE

SEQ ID NO: 2764487 - protein, 13 aa, Entamoeba invadens
LDEQKDSKQFNKI

SEQ ID NO: 2764488 - protein, 7 aa, Entamoeba invadens
LDERSDV

SEQ ID NO: 2764489 - protein, 7 aa, Entamoeba invadens
LDESGVT

SEQ ID NO: 2764490 - protein, 4 aa, Entamoeba invadens
LDFG

SEQ ID NO: 2764491 - protein, 9 aa, Entamoeba invadens
LDFGNPTIP

SEQ ID NO: 2764492 - protein, 4 aa, Entamoeba invadens
LDGD

SEQ ID NO: 2764493 - protein, 6 aa, Entamoeba invadens
LDGETN

SEQ ID NO: 2764494 - protein, 9 aa, Entamoeba invadens
LDGETTLKS

SEQ ID NO: 2764495 - protein, 6 aa, Entamoeba invadens
LDGKME

SEQ ID NO: 2764496 - protein, 6 aa, Entamoeba invadens
LDGKPW

SEQ ID NO: 2764497 - protein, 7 aa, Entamoeba invadens
LDGKSVE

SEQ ID NO: 2764498 - protein, 44 aa, Entamoeba invadens
LDGKYEKGGIKKDSSNVSNLKTEKSSKEIYSNSVAGGTDYEKSH

SEQ ID NO: 2764499 - protein, 11 aa, Entamoeba invadens
LDGNEGGDMKK

SEQ ID NO: 2764500 - protein, 10 aa, Entamoeba invadens
LDGNRQNVDS

SEQ ID NO: 2764501 - protein, 6 aa, Entamoeba invadens
LDGNSV

SEQ ID NO: 2764502 - protein, 6 aa, Entamoeba invadens
LDGSTA

SEQ ID NO: 2764503 - protein, 15 aa, Entamoeba invadens
LDGTDEDTKHMKEET

SEQ ID NO: 2764504 - protein, 7 aa, Entamoeba invadens
LDGTSMQ

SEQ ID NO: 2764505 - protein, 16 aa, Entamoeba invadens
LDGTTYPQIASDYSRD

SEQ ID NO: 2764506 - protein, 11 aa, Entamoeba invadens
LDGVQSTVSQS

SEQ ID NO: 2764507 - protein, 19 aa, Entamoeba invadens
LDHSSQKYANIGKKTTKED

SEQ ID NO: 2764508 - protein, 10 aa, Entamoeba invadens
LDKASKGRTT

SEQ ID NO: 2764509 - protein, 16 aa, Entamoeba invadens
LDKDSDKSEKVTDESV

SEQ ID NO: 2764510 - protein, 7 aa, Entamoeba invadens
LDKEKEI

SEQ ID NO: 2764511 - protein, 8 aa, Entamoeba invadens
LDKEKTWS

SEQ ID NO: 2764512 - protein, 10 aa, Entamoeba invadens
LDKGCASCDS

SEQ ID NO: 2764513 - protein, 7 aa, Entamoeba invadens
LDKKQRE

SEQ ID NO: 2764514 - protein, 5 aa, Entamoeba invadens
LDKNG

SEQ ID NO: 2764515 - protein, 7 aa, Entamoeba invadens
LDKPDDS

SEQ ID NO: 2764516 - protein, 10 aa, Entamoeba invadens
LDKPNDVDEK

SEQ ID NO: 2764517 - protein, 19 aa, Entamoeba invadens
LDKTSGKSQTRGQVTYASQ

SEQ ID NO: 2764518 - protein, 8 aa, Entamoeba invadens
LDLGEDRT

SEQ ID NO: 2764519 - protein, 10 aa, Entamoeba invadens
LDNAAKGRTT

SEQ ID NO: 2764520 - protein, 7 aa, Entamoeba invadens
LDNDEKA

SEQ ID NO: 2764521 - protein, 13 aa, Entamoeba invadens
LDNDNKIRDVNSP

SEQ ID NO: 2764522 - protein, 12 aa, Entamoeba invadens
LDNEAQQKELNT

SEQ ID NO: 2764523 - protein, 17 aa, Entamoeba invadens
LDNEENEYYPSTTPVDC

SEQ ID NO: 2764524 - protein, 10 aa, Entamoeba invadens
LDNGNIAPSN

SEQ ID NO: 2764525 - protein, 8 aa, Entamoeba invadens
LDNGTQVP

SEQ ID NO: 2764526 - protein, 7 aa, Entamoeba invadens
LDNIDTN

SEQ ID NO: 2764527 - protein, 6 aa, Entamoeba invadens
LDNKSG

SEQ ID NO: 2764528 - protein, 11 aa, Entamoeba invadens
LDNNKSLDEFE

SEQ ID NO: 2764529 - protein, 29 aa, Entamoeba invadens
LDNNTKNCDNTYDCENTECTVDNTSLDVG

SEQ ID NO: 2764530 - protein, 17 aa, Entamoeba invadens
LDNRTDPQYGLEKDKEK

SEQ ID NO: 2764531 - protein, 8 aa, Entamoeba invadens
LDNTTRSK

SEQ ID NO: 2764532 - protein, 8 aa, Entamoeba invadens
LDNYESGL

SEQ ID NO: 2764533 - protein, 11 aa, Entamoeba invadens
LDNYESGLEEF

SEQ ID NO: 2764534 - protein, 6 aa, Entamoeba invadens
LDPDEL

SEQ ID NO: 2764535 - protein, 8 aa, Entamoeba invadens
LDPDGNGD

SEQ ID NO: 2764536 - protein, 15 aa, Entamoeba invadens
LDPDNFDAHKRRGQT

SEQ ID NO: 2764537 - protein, 16 aa, Entamoeba invadens
LDPDTNKCKECNNNDY

SEQ ID NO: 2764538 - protein, 13 aa, Entamoeba invadens
LDPQDNTKTGQTE

SEQ ID NO: 2764539 - protein, 19 aa, Entamoeba invadens
LDPQEINNGNKKGPKSVRE

SEQ ID NO: 2764540 - protein, 7 aa, Entamoeba invadens
LDPQNGI

SEQ ID NO: 2764541 - protein, 4 aa, Entamoeba invadens
LDPR

SEQ ID NO: 2764542 - protein, 8 aa, Entamoeba invadens
LDPSATNL

SEQ ID NO: 2764543 - protein, 5 aa, Entamoeba invadens
LDPSE

SEQ ID NO: 2764544 - protein, 16 aa, Entamoeba invadens
LDPTEIRNEKKLGEGG

SEQ ID NO: 2764545 - protein, 7 aa, Entamoeba invadens
LDPTQSE

SEQ ID NO: 2764546 - protein, 7 aa, Entamoeba invadens
LDPTTGK

SEQ ID NO: 2764547 - protein, 9 aa, Entamoeba invadens
LDQGNENTI

SEQ ID NO: 2764548 - protein, 7 aa, Entamoeba invadens
LDQNGEL

SEQ ID NO: 2764549 - protein, 7 aa, Entamoeba invadens
LDQNSKI

SEQ ID NO: 2764550 - protein, 16 aa, Entamoeba invadens
LDQTQTKKSESKSFTS

SEQ ID NO: 2764551 - protein, 10 aa, Entamoeba invadens
LDRTTNATGY

SEQ ID NO: 2764552 - protein, 4 aa, Entamoeba invadens
LDSD

SEQ ID NO: 2764553 - protein, 8 aa, Entamoeba invadens
LDSDGKKK

SEQ ID NO: 2764554 - protein, 9 aa, Entamoeba invadens
LDSEGRDSI

SEQ ID NO: 2764555 - protein, 11 aa, Entamoeba invadens
LDSHSARNTKT

SEQ ID NO: 2764556 - protein, 10 aa, Entamoeba invadens
LDSKCSKCND

SEQ ID NO: 2764557 - protein, 9 aa, Entamoeba invadens
LDSKEESKG

SEQ ID NO: 2764558 - protein, 7 aa, Entamoeba invadens
LDSNSAC

SEQ ID NO: 2764559 - protein, 5 aa, Entamoeba invadens
LDSQN

SEQ ID NO: 2764560 - protein, 15 aa, Entamoeba invadens
LDSRNTSKITLKNTT

SEQ ID NO: 2764561 - protein, 8 aa, Entamoeba invadens
LDSSNKCS

SEQ ID NO: 2764562 - protein, 8 aa, Entamoeba invadens
LDSSSTGC

SEQ ID NO: 2764563 - protein, 7 aa, Entamoeba invadens
LDSSSTI

SEQ ID NO: 2764564 - protein, 6 aa, Entamoeba invadens
LDSTEN

SEQ ID NO: 2764565 - protein, 17 aa, Entamoeba invadens
LDSTNERYETKNIRKPN

SEQ ID NO: 2764566 - protein, 9 aa, Entamoeba invadens
LDTASKDGK

SEQ ID NO: 2764567 - protein, 6 aa, Entamoeba invadens
LDTESA

SEQ ID NO: 2764568 - protein, 18 aa, Entamoeba invadens
LDTKGDKSESSGDKESEA

SEQ ID NO: 2764569 - protein, 8 aa, Entamoeba invadens
LDTKQRYN

SEQ ID NO: 2764570 - protein, 4 aa, Entamoeba invadens
LDTN

SEQ ID NO: 2764571 - protein, 4 aa, Entamoeba invadens
LDTP

SEQ ID NO: 2764572 - protein, 18 aa, Entamoeba invadens
LDTPNYLKNSGKGSPNGI

SEQ ID NO: 2764573 - protein, 9 aa, Entamoeba invadens
LDTSNKTLK

SEQ ID NO: 2764574 - protein, 23 aa, Entamoeba invadens
LDTSNQSKDEKKDNESGLSTDPV

SEQ ID NO: 2764575 - protein, 11 aa, Entamoeba invadens
LDTTDGGKGVE

SEQ ID NO: 2764576 - protein, 23 aa, Entamoeba invadens
LDVNDDAMNVENEERIGSLTDSI

SEQ ID NO: 2764577 - protein, 16 aa, Entamoeba invadens
LEAPTKMTGNRAKSMK

SEQ ID NO: 2764578 - protein, 15 aa, Entamoeba invadens
LECDPGSYIDSTETT

SEQ ID NO: 2764579 - protein, 19 aa, Entamoeba invadens
LEDDTCKQTCSDGYYKDSS

SEQ ID NO: 2764580 - protein, 10 aa, Entamoeba invadens
LEDENRYDGE

SEQ ID NO: 2764581 - protein, 13 aa, Entamoeba invadens
LEDGGGSGTAGSH

SEQ ID NO: 2764582 - protein, 9 aa, Entamoeba invadens
LEDGTTNCV

SEQ ID NO: 2764583 - protein, 5 aa, Entamoeba invadens
LEDLN

SEQ ID NO: 2764584 - protein, 5 aa, Entamoeba invadens
LEDNQ

SEQ ID NO: 2764585 - protein, 5 aa, Entamoeba invadens
LEDNS

SEQ ID NO: 2764586 - protein, 7 aa, Entamoeba invadens
LEDTHNY

SEQ ID NO: 2764587 - protein, 10 aa, Entamoeba invadens
LEEAAKGRTT

SEQ ID NO: 2764588 - protein, 14 aa, Entamoeba invadens
LEEDERKGATFDNE

SEQ ID NO: 2764589 - protein, 7 aa, Entamoeba invadens
LEEDSSL

SEQ ID NO: 2764590 - protein, 11 aa, Entamoeba invadens
LEEKGESDVEI

SEQ ID NO: 2764591 - protein, 27 aa, Entamoeba invadens
LEEKKKKGSKTVTVTPSFRGRASETSF

SEQ ID NO: 2764592 - protein, 38 aa, Entamoeba invadens
LEEKNTSDVKGLNDQLEGSKKENEELKNQLKEETSKFE

SEQ ID NO: 2764593 - protein, 7 aa, Entamoeba invadens
LEEKTGI

SEQ ID NO: 2764594 - protein, 8 aa, Entamoeba invadens
LEENEKTV

SEQ ID NO: 2764595 - protein, 16 aa, Entamoeba invadens
LEENGKETYVEKSTTQ

SEQ ID NO: 2764596 - protein, 6 aa, Entamoeba invadens
LEENKT

SEQ ID NO: 2764597 - protein, 13 aa, Entamoeba invadens
LEENNSDLYNNST

SEQ ID NO: 2764598 - protein, 18 aa, Entamoeba invadens
LEENPFESAASNGARDIS

SEQ ID NO: 2764599 - protein, 15 aa, Entamoeba invadens
LEEQKQIERPISNNK

SEQ ID NO: 2764600 - protein, 7 aa, Entamoeba invadens
LEERDKV

SEQ ID NO: 2764601 - protein, 6 aa, Entamoeba invadens
LEGDSN

SEQ ID NO: 2764602 - protein, 10 aa, Entamoeba invadens
LEGGKCSGAH

SEQ ID NO: 2764603 - protein, 8 aa, Entamoeba invadens
LEGNTENV

SEQ ID NO: 2764604 - protein, 9 aa, Entamoeba invadens
LEGQDLGQR

SEQ ID NO: 2764605 - protein, 6 aa, Entamoeba invadens
LEGQQT

SEQ ID NO: 2764606 - protein, 7 aa, Entamoeba invadens
LEGQSEC

SEQ ID NO: 2764607 - protein, 8 aa, Entamoeba invadens
LEGTKGDH

SEQ ID NO: 2764608 - protein, 4 aa, Entamoeba invadens
LEIE

SEQ ID NO: 2764609 - protein, 7 aa, Entamoeba invadens
LEIGEES

SEQ ID NO: 2764610 - protein, 6 aa, Entamoeba invadens
LEIKGK

SEQ ID NO: 2764611 - protein, 4 aa, Entamoeba invadens
LEKA

SEQ ID NO: 2764612 - protein, 7 aa, Entamoeba invadens
LEKAKSD

SEQ ID NO: 2764613 - protein, 9 aa, Entamoeba invadens
LEKASRGAL

SEQ ID NO: 2764614 - protein, 9 aa, Entamoeba invadens
LEKDVPTTV

SEQ ID NO: 2764615 - protein, 7 aa, Entamoeba invadens
LEKEDKA

SEQ ID NO: 2764616 - protein, 8 aa, Entamoeba invadens
LEKEKDVT

SEQ ID NO: 2764617 - protein, 7 aa, Entamoeba invadens
LEKEKNV

SEQ ID NO: 2764618 - protein, 21 aa, Entamoeba invadens
LEKERSTIERNKLRNSKSETV

SEQ ID NO: 2764619 - protein, 9 aa, Entamoeba invadens
LEKGPENIL

SEQ ID NO: 2764620 - protein, 10 aa, Entamoeba invadens
LEKGPLPDTE

SEQ ID NO: 2764621 - protein, 9 aa, Entamoeba invadens
LEKGRTQCN

SEQ ID NO: 2764622 - protein, 16 aa, Entamoeba invadens
LEKGSTVYSSDSFDTD

SEQ ID NO: 2764623 - protein, 7 aa, Entamoeba invadens
LEKHKRM

SEQ ID NO: 2764624 - protein, 10 aa, Entamoeba invadens
LEKHPKSPSL

SEQ ID NO: 2764625 - protein, 7 aa, Entamoeba invadens
LEKNSEF

SEQ ID NO: 2764626 - protein, 9 aa, Entamoeba invadens
LEKQTGVDI

SEQ ID NO: 2764627 - protein, 30 aa, Entamoeba invadens
LEKRRERERKIRNGERVDDDEEDEETDEHG

SEQ ID NO: 2764628 - protein, 5 aa, Entamoeba invadens
LEKSI

SEQ ID NO: 2764629 - protein, 20 aa, Entamoeba invadens
LEKSSDTPKSSSGSSLHETG

SEQ ID NO: 2764630 - protein, 9 aa, Entamoeba invadens
LEKSTGEVA

SEQ ID NO: 2764631 - protein, 10 aa, Entamoeba invadens
LEKTPRSPRI

SEQ ID NO: 2764632 - protein, 6 aa, Entamoeba invadens
LEKVTE

SEQ ID NO: 2764633 - protein, 6 aa, Entamoeba invadens
LELNEN

SEQ ID NO: 2764634 - protein, 8 aa, Entamoeba invadens
LELNQTTG

SEQ ID NO: 2764635 - protein, 10 aa, Entamoeba invadens
LENAAKGRTT

SEQ ID NO: 2764636 - protein, 5 aa, Entamoeba invadens
LENDD

SEQ ID NO: 2764637 - protein, 38 aa, Entamoeba invadens
LENEKKEKLTGEPQVTVDDKNAVVDHSEAQTRKTPRGN

SEQ ID NO: 2764638 - protein, 9 aa, Entamoeba invadens
LENGTQKTE

SEQ ID NO: 2764639 - protein, 8 aa, Entamoeba invadens
LENGTSTY

SEQ ID NO: 2764640 - protein, 6 aa, Entamoeba invadens
LENKRN

SEQ ID NO: 2764641 - protein, 11 aa, Entamoeba invadens
LENNESGLDEF

SEQ ID NO: 2764642 - protein, 29 aa, Entamoeba invadens
LENNTKNCDNTYDCENTECTVDNTSLDVG

SEQ ID NO: 2764643 - protein, 7 aa, Entamoeba invadens
LENRKSY

SEQ ID NO: 2764644 - protein, 10 aa, Entamoeba invadens
LEPEDYPKFE

SEQ ID NO: 2764645 - protein, 15 aa, Entamoeba invadens
LEPIGGQEKIRRLSS

SEQ ID NO: 2764646 - protein, 7 aa, Entamoeba invadens
LEPKGSE

SEQ ID NO: 2764647 - protein, 6 aa, Entamoeba invadens
LEPKIQ

SEQ ID NO: 2764648 - protein, 5 aa, Entamoeba invadens
LEPNY

SEQ ID NO: 2764649 - protein, 6 aa, Entamoeba invadens
LEPSEK

SEQ ID NO: 2764650 - protein, 5 aa, Entamoeba invadens
LEPTE

SEQ ID NO: 2764651 - protein, 5 aa, Entamoeba invadens
LEPTN

SEQ ID NO: 2764652 - protein, 5 aa, Entamoeba invadens
LEQEK

SEQ ID NO: 2764653 - protein, 21 aa, Entamoeba invadens
LEQNEKVKKLEEENSQNQNVF

SEQ ID NO: 2764654 - protein, 7 aa, Entamoeba invadens
LEQPFEE

SEQ ID NO: 2764655 - protein, 9 aa, Entamoeba invadens
LEQPPTCPS

SEQ ID NO: 2764656 - protein, 10 aa, Entamoeba invadens
LEQSPSLISR

SEQ ID NO: 2764657 - protein, 4 aa, Entamoeba invadens
LEQT

SEQ ID NO: 2764658 - protein, 5 aa, Entamoeba invadens
LEQTP

SEQ ID NO: 2764659 - protein, 9 aa, Entamoeba invadens
LERGGRPDN

SEQ ID NO: 2764660 - protein, 9 aa, Entamoeba invadens
LERKENIPE

SEQ ID NO: 2764661 - protein, 11 aa, Entamoeba invadens
LERKNSELETQ

SEQ ID NO: 2764662 - protein, 31 aa, Entamoeba invadens
LERKSEVVEAPTSPERKSEIGQTPRQSEESL

SEQ ID NO: 2764663 - protein, 5 aa, Entamoeba invadens
LERNQ

SEQ ID NO: 2764664 - protein, 6 aa, Entamoeba invadens
LERNTG

SEQ ID NO: 2764665 - protein, 6 aa, Entamoeba invadens
LERPEL

SEQ ID NO: 2764666 - protein, 10 aa, Entamoeba invadens
LERQEGDVTI

SEQ ID NO: 2764667 - protein, 6 aa, Entamoeba invadens
LERQPS

SEQ ID NO: 2764668 - protein, 9 aa, Entamoeba invadens
LERQQTKDN

SEQ ID NO: 2764669 - protein, 6 aa, Entamoeba invadens
LERTQH

SEQ ID NO: 2764670 - protein, 17 aa, Entamoeba invadens
LERTTQNYNNGGDETLD

SEQ ID NO: 2764671 - protein, 8 aa, Entamoeba invadens
LESGSTFV

SEQ ID NO: 2764672 - protein, 10 aa, Entamoeba invadens
LESGSTPDTA

SEQ ID NO: 2764673 - protein, 9 aa, Entamoeba invadens
LESKKDELI

SEQ ID NO: 2764674 - protein, 14 aa, Entamoeba invadens
LESKKSYNADITKY

SEQ ID NO: 2764675 - protein, 9 aa, Entamoeba invadens
LESKNTQGV

SEQ ID NO: 2764676 - protein, 7 aa, Entamoeba invadens
LESNEAH

SEQ ID NO: 2764677 - protein, 9 aa, Entamoeba invadens
LESNGKAGQ

SEQ ID NO: 2764678 - protein, 12 aa, Entamoeba invadens
LESQNCKEGSAE

SEQ ID NO: 2764679 - protein, 7 aa, Entamoeba invadens
LESRPKI

SEQ ID NO: 2764680 - protein, 9 aa, Entamoeba invadens
LESSNNRKR

SEQ ID NO: 2764681 - protein, 8 aa, Entamoeba invadens
LESSTKSC

SEQ ID NO: 2764682 - protein, 4 aa, Entamoeba invadens
LEST

SEQ ID NO: 2764683 - protein, 7 aa, Entamoeba invadens
LESTGDV

SEQ ID NO: 2764684 - protein, 5 aa, Entamoeba invadens
LESTK

SEQ ID NO: 2764685 - protein, 7 aa, Entamoeba invadens
LESTPGV

SEQ ID NO: 2764686 - protein, 11 aa, Entamoeba invadens
LESTSDAPTTT

SEQ ID NO: 2764687 - protein, 17 aa, Entamoeba invadens
LESVNLPKSNPSDGFGT

SEQ ID NO: 2764688 - protein, 5 aa, Entamoeba invadens
LETDN

SEQ ID NO: 2764689 - protein, 7 aa, Entamoeba invadens
LETESER

SEQ ID NO: 2764690 - protein, 9 aa, Entamoeba invadens
LETPPNPSV

SEQ ID NO: 2764691 - protein, 35 aa, Entamoeba invadens
LETQEKHRKEEEEEKKQILKNQTKKTENLSQTEEI

SEQ ID NO: 2764692 - protein, 14 aa, Entamoeba invadens
LETQQETSQNNYKT

SEQ ID NO: 2764693 - protein, 7 aa, Entamoeba invadens
LETRTAA

SEQ ID NO: 2764694 - protein, 5 aa, Entamoeba invadens
LETSE

SEQ ID NO: 2764695 - protein, 9 aa, Entamoeba invadens
LETSPSSFT

SEQ ID NO: 2764696 - protein, 21 aa, Entamoeba invadens
LETSSTTCTCQTGNEVYHNGN

SEQ ID NO: 2764697 - protein, 7 aa, Entamoeba invadens
LETSTSD

SEQ ID NO: 2764698 - protein, 7 aa, Entamoeba invadens
LETTSQP

SEQ ID NO: 2764699 - protein, 9 aa, Entamoeba invadens
LETTTKGVT

SEQ ID NO: 2764700 - protein, 10 aa, Entamoeba invadens
LEVKQNGVVN

SEQ ID NO: 2764701 - protein, 34 aa, Entamoeba invadens
LEVQPQPTQVTQARPQPDVNSTSGQRKRGRPRLD

SEQ ID NO: 2764702 - protein, 7 aa, Entamoeba invadens
LEVSEKR

SEQ ID NO: 2764703 - protein, 10 aa, Entamoeba invadens
LFAKKSSIEV

SEQ ID NO: 2764704 - protein, 4 aa, Entamoeba invadens
LFDT

SEQ ID NO: 2764705 - protein, 12 aa, Entamoeba invadens
LFKNPKEKNGIS

SEQ ID NO: 2764706 - protein, 14 aa, Entamoeba invadens
LFKSENDLKIGTET

SEQ ID NO: 2764707 - protein, 11 aa, Entamoeba invadens
LFSDGDDDESF

SEQ ID NO: 2764708 - protein, 6 aa, Entamoeba invadens
LFSPNG

SEQ ID NO: 2764709 - protein, 8 aa, Entamoeba invadens
LFTSNDER

SEQ ID NO: 2764710 - protein, 11 aa, Entamoeba invadens
LFTSNDSIKGI

SEQ ID NO: 2764711 - protein, 15 aa, Entamoeba invadens
LGAKEDQSISDEEVV

SEQ ID NO: 2764712 - protein, 11 aa, Entamoeba invadens
LGCEDCSNGIS

SEQ ID NO: 2764713 - protein, 6 aa, Entamoeba invadens
LGCSPV

SEQ ID NO: 2764714 - protein, 10 aa, Entamoeba invadens
LGDAPREQED

SEQ ID NO: 2764715 - protein, 4 aa, Entamoeba invadens
LGDE

SEQ ID NO: 2764716 - protein, 24 aa, Entamoeba invadens
LGDEESEEHEGTQQEVEMKEETNG

SEQ ID NO: 2764717 - protein, 12 aa, Entamoeba invadens
LGDEKAIEETKM

SEQ ID NO: 2764718 - protein, 6 aa, Entamoeba invadens
LGDETY

SEQ ID NO: 2764719 - protein, 4 aa, Entamoeba invadens
LGDG

SEQ ID NO: 2764720 - protein, 10 aa, Entamoeba invadens
LGDKLNRTTD

SEQ ID NO: 2764721 - protein, 9 aa, Entamoeba invadens
LGDNAFKAT

SEQ ID NO: 2764722 - protein, 6 aa, Entamoeba invadens
LGDPNF

SEQ ID NO: 2764723 - protein, 13 aa, Entamoeba invadens
LGDPNFRKLSIWT

SEQ ID NO: 2764724 - protein, 4 aa, Entamoeba invadens
LGEC

SEQ ID NO: 2764725 - protein, 10 aa, Entamoeba invadens
LGEDQDTVSD

SEQ ID NO: 2764726 - protein, 9 aa, Entamoeba invadens
LGEGAKEKA

SEQ ID NO: 2764727 - protein, 5 aa, Entamoeba invadens
LGEGS

SEQ ID NO: 2764728 - protein, 7 aa, Entamoeba invadens
LGELSEK

SEQ ID NO: 2764729 - protein, 41 aa, Entamoeba invadens
LGENETSTDASNDTSSDTSNTVDSSEPSVVSSNVPESSSHV

SEQ ID NO: 2764730 - protein, 10 aa, Entamoeba invadens
LGENQQPAQE

SEQ ID NO: 2764731 - protein, 7 aa, Entamoeba invadens
LGENTKN

SEQ ID NO: 2764732 - protein, 6 aa, Entamoeba invadens
LGEPKS

SEQ ID NO: 2764733 - protein, 7 aa, Entamoeba invadens
LGERASP

SEQ ID NO: 2764734 - protein, 6 aa, Entamoeba invadens
LGERIN

SEQ ID NO: 2764735 - protein, 12 aa, Entamoeba invadens
LGETEDGAVDEH

SEQ ID NO: 2764736 - protein, 6 aa, Entamoeba invadens
LGETNF

SEQ ID NO: 2764737 - protein, 7 aa, Entamoeba invadens
LGETQTV

SEQ ID NO: 2764738 - protein, 4 aa, Entamoeba invadens
LGGA

SEQ ID NO: 2764739 - protein, 5 aa, Entamoeba invadens
LGGNN

SEQ ID NO: 2764740 - protein, 8 aa, Entamoeba invadens
LGGNTSLG

SEQ ID NO: 2764741 - protein, 7 aa, Entamoeba invadens
LGGPNNT

SEQ ID NO: 2764742 - protein, 4 aa, Entamoeba invadens
LGGS

SEQ ID NO: 2764743 - protein, 12 aa, Entamoeba invadens
LGGSASDYSKQK

SEQ ID NO: 2764744 - protein, 7 aa, Entamoeba invadens
LGGSGMS

SEQ ID NO: 2764745 - protein, 4 aa, Entamoeba invadens
LGHT

SEQ ID NO: 2764746 - protein, 5 aa, Entamoeba invadens
LGHTK

SEQ ID NO: 2764747 - protein, 14 aa, Entamoeba invadens
LGIENSSDTAKDGT

SEQ ID NO: 2764748 - protein, 4 aa, Entamoeba invadens
LGIP

SEQ ID NO: 2764749 - protein, 5 aa, Entamoeba invadens
LGKEK

SEQ ID NO: 2764750 - protein, 5 aa, Entamoeba invadens
LGKGS

SEQ ID NO: 2764751 - protein, 9 aa, Entamoeba invadens
LGKKIEEGN

SEQ ID NO: 2764752 - protein, 11 aa, Entamoeba invadens
LGKKSGNVKEN

SEQ ID NO: 2764753 - protein, 4 aa, Entamoeba invadens
LGKR

SEQ ID NO: 2764754 - protein, 10 aa, Entamoeba invadens
LGKTAKGEEF

SEQ ID NO: 2764755 - protein, 7 aa, Entamoeba invadens
LGLSTNQ

SEQ ID NO: 2764756 - protein, 5 aa, Entamoeba invadens
LGLTK

SEQ ID NO: 2764757 - protein, 4 aa, Entamoeba invadens
LGME

SEQ ID NO: 2764758 - protein, 6 aa, Entamoeba invadens
LGMKTT

SEQ ID NO: 2764759 - protein, 4 aa, Entamoeba invadens
LGND

SEQ ID NO: 2764760 - protein, 15 aa, Entamoeba invadens
LGNDKYEGLEIIPLD

SEQ ID NO: 2764761 - protein, 12 aa, Entamoeba invadens
LGNESKERLWGR

SEQ ID NO: 2764762 - protein, 10 aa, Entamoeba invadens
LGNGKTYQEY

SEQ ID NO: 2764763 - protein, 11 aa, Entamoeba invadens
LGNKSDQDEKI

SEQ ID NO: 2764764 - protein, 4 aa, Entamoeba invadens
LGNS

SEQ ID NO: 2764765 - protein, 8 aa, Entamoeba invadens
LGNTPTST

SEQ ID NO: 2764766 - protein, 6 aa, Entamoeba invadens
LGPGAD

SEQ ID NO: 2764767 - protein, 4 aa, Entamoeba invadens
LGPP

SEQ ID NO: 2764768 - protein, 4 aa, Entamoeba invadens
LGPT

SEQ ID NO: 2764769 - protein, 5 aa, Entamoeba invadens
LGPVE

SEQ ID NO: 2764770 - protein, 9 aa, Entamoeba invadens
LGQDTDALA

SEQ ID NO: 2764771 - protein, 9 aa, Entamoeba invadens
LGQLSETNK

SEQ ID NO: 2764772 - protein, 7 aa, Entamoeba invadens
LGQPSNY

SEQ ID NO: 2764773 - protein, 6 aa, Entamoeba invadens
LGRNTV

SEQ ID NO: 2764774 - protein, 8 aa, Entamoeba invadens
LGRSRTTH

SEQ ID NO: 2764775 - protein, 8 aa, Entamoeba invadens
LGSASQCK

SEQ ID NO: 2764776 - protein, 16 aa, Entamoeba invadens
LGSDELDGSSESRPFK

SEQ ID NO: 2764777 - protein, 4 aa, Entamoeba invadens
LGSG

SEQ ID NO: 2764778 - protein, 15 aa, Entamoeba invadens
LGSKPKTLVNQTKHN

SEQ ID NO: 2764779 - protein, 8 aa, Entamoeba invadens
LGSKPKYD

SEQ ID NO: 2764780 - protein, 7 aa, Entamoeba invadens
LGSQHPE

SEQ ID NO: 2764781 - protein, 5 aa, Entamoeba invadens
LGSTN

SEQ ID NO: 2764782 - protein, 10 aa, Entamoeba invadens
LGSTNCDTCP

SEQ ID NO: 2764783 - protein, 6 aa, Entamoeba invadens
LGTDEV

SEQ ID NO: 2764784 - protein, 15 aa, Entamoeba invadens
LGTDKYEGLEIVPLS

SEQ ID NO: 2764785 - protein, 30 aa, Entamoeba invadens
LGTDPCYSKDTDKKCIKDSTTTTKCSGTVT

SEQ ID NO: 2764786 - protein, 10 aa, Entamoeba invadens
LGTEKPTKEL

SEQ ID NO: 2764787 - protein, 8 aa, Entamoeba invadens
LGTEKPTM

SEQ ID NO: 2764788 - protein, 5 aa, Entamoeba invadens
LGTEN

SEQ ID NO: 2764789 - protein, 4 aa, Entamoeba invadens
LGTK

SEQ ID NO: 2764790 - protein, 7 aa, Entamoeba invadens
LGTPINE

SEQ ID NO: 2764791 - protein, 5 aa, Entamoeba invadens
LGTPK

SEQ ID NO: 2764792 - protein, 6 aa, Entamoeba invadens
LGTSTT

SEQ ID NO: 2764793 - protein, 6 aa, Entamoeba invadens
LGTTEA

SEQ ID NO: 2764794 - protein, 6 aa, Entamoeba invadens
LGTTGY

SEQ ID NO: 2764795 - protein, 11 aa, Entamoeba invadens
LGTYSNEGSST

SEQ ID NO: 2764796 - protein, 11 aa, Entamoeba invadens
LGVNPKDHPLP

SEQ ID NO: 2764797 - protein, 6 aa, Entamoeba invadens
LGVNTT

SEQ ID NO: 2764798 - protein, 5 aa, Entamoeba invadens
LGVSG

SEQ ID NO: 2764799 - protein, 16 aa, Entamoeba invadens
LGVSSTNLAGTGMSST

SEQ ID NO: 2764800 - protein, 10 aa, Entamoeba invadens
LGYENRNTSL

SEQ ID NO: 2764801 - protein, 6 aa, Entamoeba invadens
LGYGDE

SEQ ID NO: 2764802 - protein, 9 aa, Entamoeba invadens
LGYPTSGDI

SEQ ID NO: 2764803 - protein, 5 aa, Entamoeba invadens
LHETH

SEQ ID NO: 2764804 - protein, 9 aa, Entamoeba invadens
LHGGSSSIV

SEQ ID NO: 2764805 - protein, 5 aa, Entamoeba invadens
LHKNN

SEQ ID NO: 2764806 - protein, 5 aa, Entamoeba invadens
LHNNR

SEQ ID NO: 2764807 - protein, 5 aa, Entamoeba invadens
LHPGE

SEQ ID NO: 2764808 - protein, 5 aa, Entamoeba invadens
LHSTT

SEQ ID NO: 2764809 - protein, 8 aa, Entamoeba invadens
LHTDQPTL

SEQ ID NO: 2764810 - protein, 6 aa, Entamoeba invadens
LHTNES

SEQ ID NO: 2764811 - protein, 10 aa, Entamoeba invadens
LHTSNNQNSI

SEQ ID NO: 2764812 - protein, 9 aa, Entamoeba invadens
LIGGGKAEV

SEQ ID NO: 2764813 - protein, 6 aa, Entamoeba invadens
LINPKN

SEQ ID NO: 2764814 - protein, 8 aa, Entamoeba invadens
LIPKTTNS

SEQ ID NO: 2764815 - protein, 6 aa, Entamoeba invadens
LISNGE

SEQ ID NO: 2764816 - protein, 11 aa, Entamoeba invadens
LISSNTKENYY

SEQ ID NO: 2764817 - protein, 11 aa, Entamoeba invadens
LITKESSSLTL

SEQ ID NO: 2764818 - protein, 25 aa, Entamoeba invadens
LKAENETLKTEIKEKEKTNEEGKTV

SEQ ID NO: 2764819 - protein, 7 aa, Entamoeba invadens
LKAGTAI

SEQ ID NO: 2764820 - protein, 11 aa, Entamoeba invadens
LKAIQKGKELD

SEQ ID NO: 2764821 - protein, 12 aa, Entamoeba invadens
LKANGGPIGEGA

SEQ ID NO: 2764822 - protein, 10 aa, Entamoeba invadens
LKCGNSDEDI

SEQ ID NO: 2764823 - protein, 7 aa, Entamoeba invadens
LKDAPDD

SEQ ID NO: 2764824 - protein, 11 aa, Entamoeba invadens
LKDDNCEKCPE

SEQ ID NO: 2764825 - protein, 11 aa, Entamoeba invadens
LKDDRKTTTTW

SEQ ID NO: 2764826 - protein, 11 aa, Entamoeba invadens
LKDEKCRECNE

SEQ ID NO: 2764827 - protein, 4 aa, Entamoeba invadens
LKDG

SEQ ID NO: 2764828 - protein, 5 aa, Entamoeba invadens
LKDGQ

SEQ ID NO: 2764829 - protein, 35 aa, Entamoeba invadens
LKDKKSVRRSDFRESISSYSANSNESDEMDRPEKC

SEQ ID NO: 2764830 - protein, 5 aa, Entamoeba invadens
LKDLT

SEQ ID NO: 2764831 - protein, 7 aa, Entamoeba invadens
LKDPEEK

SEQ ID NO: 2764832 - protein, 11 aa, Entamoeba invadens
LKDPTNSESPC

SEQ ID NO: 2764833 - protein, 13 aa, Entamoeba invadens
LKDRSDNEGAKNE

SEQ ID NO: 2764834 - protein, 7 aa, Entamoeba invadens
LKDRSEV

SEQ ID NO: 2764835 - protein, 10 aa, Entamoeba invadens
LKDSNDGCSS

SEQ ID NO: 2764836 - protein, 8 aa, Entamoeba invadens
LKDTDRTK

SEQ ID NO: 2764837 - protein, 16 aa, Entamoeba invadens
LKDTGENFEESSLEEF

SEQ ID NO: 2764838 - protein, 9 aa, Entamoeba invadens
LKDTPNGVQ

SEQ ID NO: 2764839 - protein, 9 aa, Entamoeba invadens
LKDTTNNEF

SEQ ID NO: 2764840 - protein, 6 aa, Entamoeba invadens
LKEDDD

SEQ ID NO: 2764841 - protein, 26 aa, Entamoeba invadens
LKEEEAESVKDKYHNPPSSWPSNGSI

SEQ ID NO: 2764842 - protein, 11 aa, Entamoeba invadens
LKEEKKIGEGS

SEQ ID NO: 2764843 - protein, 9 aa, Entamoeba invadens
LKEENDKEI

SEQ ID NO: 2764844 - protein, 5 aa, Entamoeba invadens
LKEES

SEQ ID NO: 2764845 - protein, 5 aa, Entamoeba invadens
LKEET

SEQ ID NO: 2764846 - protein, 8 aa, Entamoeba invadens
LKEETNPT

SEQ ID NO: 2764847 - protein, 7 aa, Entamoeba invadens
LKEETVP

SEQ ID NO: 2764848 - protein, 16 aa, Entamoeba invadens
LKEGETKVSGELTYAS

SEQ ID NO: 2764849 - protein, 6 aa, Entamoeba invadens
LKEGKC

SEQ ID NO: 2764850 - protein, 27 aa, Entamoeba invadens
LKEGNCTNCEKKNCARCNDDATKCTNC

SEQ ID NO: 2764851 - protein, 6 aa, Entamoeba invadens
LKEGPH

SEQ ID NO: 2764852 - protein, 4 aa, Entamoeba invadens
LKEK

SEQ ID NO: 2764853 - protein, 9 aa, Entamoeba invadens
LKEKEEQEA

SEQ ID NO: 2764854 - protein, 6 aa, Entamoeba invadens
LKEKHP

SEQ ID NO: 2764855 - protein, 19 aa, Entamoeba invadens
LKEKPLTEGVGTPSYMPPE

SEQ ID NO: 2764856 - protein, 12 aa, Entamoeba invadens
LKEKRGTCSTSA

SEQ ID NO: 2764857 - protein, 8 aa, Entamoeba invadens
LKEKSEVK

SEQ ID NO: 2764858 - protein, 11 aa, Entamoeba invadens
LKEKSNETTTT

SEQ ID NO: 2764859 - protein, 11 aa, Entamoeba invadens
LKEKTPETLEG

SEQ ID NO: 2764860 - protein, 5 aa, Entamoeba invadens
LKEMD

SEQ ID NO: 2764861 - protein, 8 aa, Entamoeba invadens
LKENDTAT

SEQ ID NO: 2764862 - protein, 5 aa, Entamoeba invadens
LKENE

SEQ ID NO: 2764863 - protein, 6 aa, Entamoeba invadens
LKENEH

SEQ ID NO: 2764864 - protein, 5 aa, Entamoeba invadens
LKENG

SEQ ID NO: 2764865 - protein, 8 aa, Entamoeba invadens
LKENPNGK

SEQ ID NO: 2764866 - protein, 10 aa, Entamoeba invadens
LKEPKNAFQR

SEQ ID NO: 2764867 - protein, 7 aa, Entamoeba invadens
LKEPTTT

SEQ ID NO: 2764868 - protein, 10 aa, Entamoeba invadens
LKERSEGNMS

SEQ ID NO: 2764869 - protein, 7 aa, Entamoeba invadens
LKERTDI

SEQ ID NO: 2764870 - protein, 8 aa, Entamoeba invadens
LKERVTES

SEQ ID NO: 2764871 - protein, 6 aa, Entamoeba invadens
LKESDM

SEQ ID NO: 2764872 - protein, 9 aa, Entamoeba invadens
LKESNYPEQ

SEQ ID NO: 2764873 - protein, 7 aa, Entamoeba invadens
LKESSSV

SEQ ID NO: 2764874 - protein, 10 aa, Entamoeba invadens
LKETAKGASL

SEQ ID NO: 2764875 - protein, 14 aa, Entamoeba invadens
LKETGQSKNALDEF

SEQ ID NO: 2764876 - protein, 6 aa, Entamoeba invadens
LKETNK

SEQ ID NO: 2764877 - protein, 8 aa, Entamoeba invadens
LKETPSAI

SEQ ID NO: 2764878 - protein, 17 aa, Entamoeba invadens
LKETSGKVKTSSGFNYP

SEQ ID NO: 2764879 - protein, 7 aa, Entamoeba invadens
LKEYGGK

SEQ ID NO: 2764880 - protein, 5 aa, Entamoeba invadens
LKFEK

SEQ ID NO: 2764881 - protein, 11 aa, Entamoeba invadens
LKGDLKTQETV

SEQ ID NO: 2764882 - protein, 5 aa, Entamoeba invadens
LKGDQ

SEQ ID NO: 2764883 - protein, 9 aa, Entamoeba invadens
LKGGKNNYL

SEQ ID NO: 2764884 - protein, 7 aa, Entamoeba invadens
LKGGQTI

SEQ ID NO: 2764885 - protein, 8 aa, Entamoeba invadens
LKGIDSSC

SEQ ID NO: 2764886 - protein, 8 aa, Entamoeba invadens
LKGKEGCE

SEQ ID NO: 2764887 - protein, 10 aa, Entamoeba invadens
LKGKTAQSSC

SEQ ID NO: 2764888 - protein, 16 aa, Entamoeba invadens
LKGNKSISKKSQILEN

SEQ ID NO: 2764889 - protein, 6 aa, Entamoeba invadens
LKGNNN

SEQ ID NO: 2764890 - protein, 10 aa, Entamoeba invadens
LKGNQKPKEL

SEQ ID NO: 2764891 - protein, 6 aa, Entamoeba invadens
LKGPTV

SEQ ID NO: 2764892 - protein, 14 aa, Entamoeba invadens
LKGSSDKYEIKTEP

SEQ ID NO: 2764893 - protein, 13 aa, Entamoeba invadens
LKGTTDCKTCTEC

SEQ ID NO: 2764894 - protein, 7 aa, Entamoeba invadens
LKHKMDE

SEQ ID NO: 2764895 - protein, 4 aa, Entamoeba invadens
LKID

SEQ ID NO: 2764896 - protein, 6 aa, Entamoeba invadens
LKKDDE

SEQ ID NO: 2764897 - protein, 16 aa, Entamoeba invadens
LKKEESERLKEKYNTI

SEQ ID NO: 2764898 - protein, 9 aa, Entamoeba invadens
LKKESKENI

SEQ ID NO: 2764899 - protein, 7 aa, Entamoeba invadens
LKKETAS

SEQ ID NO: 2764900 - protein, 6 aa, Entamoeba invadens
LKKGDT

SEQ ID NO: 2764901 - protein, 7 aa, Entamoeba invadens
LKKGEIS

SEQ ID NO: 2764902 - protein, 8 aa, Entamoeba invadens
LKKGEQAL

SEQ ID NO: 2764903 - protein, 9 aa, Entamoeba invadens
LKKGETSEV

SEQ ID NO: 2764904 - protein, 6 aa, Entamoeba invadens
LKKGGV

SEQ ID NO: 2764905 - protein, 5 aa, Entamoeba invadens
LKKGK

SEQ ID NO: 2764906 - protein, 9 aa, Entamoeba invadens
LKKPDMMSN

SEQ ID NO: 2764907 - protein, 8 aa, Entamoeba invadens
LKKPEMMS

SEQ ID NO: 2764908 - protein, 7 aa, Entamoeba invadens
LKKPPYL

SEQ ID NO: 2764909 - protein, 7 aa, Entamoeba invadens
LKKQEEV

SEQ ID NO: 2764910 - protein, 10 aa, Entamoeba invadens
LKKRNSNGLT

SEQ ID NO: 2764911 - protein, 10 aa, Entamoeba invadens
LKKSNIPASE

SEQ ID NO: 2764912 - protein, 9 aa, Entamoeba invadens
LKKSPSVRL

SEQ ID NO: 2764913 - protein, 9 aa, Entamoeba invadens
LKKSSKRTS

SEQ ID NO: 2764914 - protein, 7 aa, Entamoeba invadens
LKKTEEI

SEQ ID NO: 2764915 - protein, 80 aa, Entamoeba invadens
LKNDETKEINIDDPQIQHKSSTNTPTPRKEQVEPKVNGIPERTPRYKHDSLNAQKGVEEDIPKTPKTSDKSPEKTPEKVI

SEQ ID NO: 2764916 - protein, 58 aa, Entamoeba invadens
LKNDGDKHVEESDVSSSSTPSSQSKDMSKGQSKQHENVPTEADGVDKSISSKSSSDDK

SEQ ID NO: 2764917 - protein, 6 aa, Entamoeba invadens
LKNDRK

SEQ ID NO: 2764918 - protein, 8 aa, Entamoeba invadens
LKNEGTPF

SEQ ID NO: 2764919 - protein, 9 aa, Entamoeba invadens
LKNENYYEE

SEQ ID NO: 2764920 - protein, 12 aa, Entamoeba invadens
LKNGQAGKQLLK

SEQ ID NO: 2764921 - protein, 8 aa, Entamoeba invadens
LKNGSSFN

SEQ ID NO: 2764922 - protein, 8 aa, Entamoeba invadens
LKNGTCSE

SEQ ID NO: 2764923 - protein, 11 aa, Entamoeba invadens
LKNPREKAKEK

SEQ ID NO: 2764924 - protein, 9 aa, Entamoeba invadens
LKNRIRPEE

SEQ ID NO: 2764925 - protein, 6 aa, Entamoeba invadens
LKNRNT

SEQ ID NO: 2764926 - protein, 18 aa, Entamoeba invadens
LKNSEPELSKRKQVQRYE

SEQ ID NO: 2764927 - protein, 13 aa, Entamoeba invadens
LKNSNATKQAIDE

SEQ ID NO: 2764928 - protein, 12 aa, Entamoeba invadens
LKNSQRESDEDA

SEQ ID NO: 2764929 - protein, 9 aa, Entamoeba invadens
LKNSQSSIN

SEQ ID NO: 2764930 - protein, 5 aa, Entamoeba invadens
LKNSS

SEQ ID NO: 2764931 - protein, 6 aa, Entamoeba invadens
LKNTEG

SEQ ID NO: 2764932 - protein, 7 aa, Entamoeba invadens
LKNYPDP

SEQ ID NO: 2764933 - protein, 17 aa, Entamoeba invadens
LKPDTWNGSDGNAHSKQ

SEQ ID NO: 2764934 - protein, 4 aa, Entamoeba invadens
LKPE

SEQ ID NO: 2764935 - protein, 30 aa, Entamoeba invadens
LKPEAPTVLPPPLQTSQMAPDLPEVKPDER

SEQ ID NO: 2764936 - protein, 9 aa, Entamoeba invadens
LKPEKSVKE

SEQ ID NO: 2764937 - protein, 5 aa, Entamoeba invadens
LKPGY

SEQ ID NO: 2764938 - protein, 6 aa, Entamoeba invadens
LKPNSF

SEQ ID NO: 2764939 - protein, 9 aa, Entamoeba invadens
LKPNYTSKI

SEQ ID NO: 2764940 - protein, 9 aa, Entamoeba invadens
LKPQEQPNC

SEQ ID NO: 2764941 - protein, 8 aa, Entamoeba invadens
LKPRPDQH

SEQ ID NO: 2764942 - protein, 30 aa, Entamoeba invadens
LKPSHSDSSSHEHCTERSEDSQKTNTSLEG

SEQ ID NO: 2764943 - protein, 9 aa, Entamoeba invadens
LKPSTITTT

SEQ ID NO: 2764944 - protein, 14 aa, Entamoeba invadens
LKPTEEVNVKETRK

SEQ ID NO: 2764945 - protein, 4 aa, Entamoeba invadens
LKQD

SEQ ID NO: 2764946 - protein, 4 aa, Entamoeba invadens
LKQI

SEQ ID NO: 2764947 - protein, 7 aa, Entamoeba invadens
LKQIPSA

SEQ ID NO: 2764948 - protein, 11 aa, Entamoeba invadens
LKQNEEQTKEI

SEQ ID NO: 2764949 - protein, 7 aa, Entamoeba invadens
LKQPSDF

SEQ ID NO: 2764950 - protein, 6 aa, Entamoeba invadens
LKQSDN

SEQ ID NO: 2764951 - protein, 21 aa, Entamoeba invadens
LKQSKYDTTDCTGDVAKTEEL

SEQ ID NO: 2764952 - protein, 9 aa, Entamoeba invadens
LKQSNDTDK

SEQ ID NO: 2764953 - protein, 9 aa, Entamoeba invadens
LKQSQSRMD

SEQ ID NO: 2764954 - protein, 9 aa, Entamoeba invadens
LKRENEDEC

SEQ ID NO: 2764955 - protein, 6 aa, Entamoeba invadens
LKRETY

SEQ ID NO: 2764956 - protein, 11 aa, Entamoeba invadens
LKRNEQITEEQ

SEQ ID NO: 2764957 - protein, 13 aa, Entamoeba invadens
LKRQGRREATSRE

SEQ ID NO: 2764958 - protein, 23 aa, Entamoeba invadens
LKRRGLKAQSGMSTSHANSDDVT

SEQ ID NO: 2764959 - protein, 6 aa, Entamoeba invadens
LKRSTG

SEQ ID NO: 2764960 - protein, 5 aa, Entamoeba invadens
LKRTT

SEQ ID NO: 2764961 - protein, 9 aa, Entamoeba invadens
LKSAQDAFT

SEQ ID NO: 2764962 - protein, 9 aa, Entamoeba invadens
LKSAYESSY

SEQ ID NO: 2764963 - protein, 24 aa, Entamoeba invadens
LKSEEEKTSEEQEEQTEFGKRRHE

SEQ ID NO: 2764964 - protein, 7 aa, Entamoeba invadens
LKSEKGM

SEQ ID NO: 2764965 - protein, 10 aa, Entamoeba invadens
LKSEKNEVGD

SEQ ID NO: 2764966 - protein, 15 aa, Entamoeba invadens
LKSEQNKLMHRRKRD

SEQ ID NO: 2764967 - protein, 8 aa, Entamoeba invadens
LKSGEESF

SEQ ID NO: 2764968 - protein, 92 aa, Entamoeba invadens
LKSGKKDEVKKYDNDEPNGANEDEEEKQKQNLEEHEEDPKADDVTPEEEKKPETGGEENQKEEEEEVEVPKKPKHKNSKTNDQKEKKKRRDE

SEQ ID NO: 2764969 - protein, 9 aa, Entamoeba invadens
LKSGKTTEI

SEQ ID NO: 2764970 - protein, 10 aa, Entamoeba invadens
LKSGSVKTTK

SEQ ID NO: 2764971 - protein, 6 aa, Entamoeba invadens
LKSMPG

SEQ ID NO: 2764972 - protein, 11 aa, Entamoeba invadens
LKSNAAPIGEG

SEQ ID NO: 2764973 - protein, 10 aa, Entamoeba invadens
LKSNIGTPQY

SEQ ID NO: 2764974 - protein, 4 aa, Entamoeba invadens
LKSP

SEQ ID NO: 2764975 - protein, 21 aa, Entamoeba invadens
LKSQESGEDNESTGSASENNI

SEQ ID NO: 2764976 - protein, 15 aa, Entamoeba invadens
LKSQKLGSDEKNQGK

SEQ ID NO: 2764977 - protein, 5 aa, Entamoeba invadens
LKSSG

SEQ ID NO: 2764978 - protein, 7 aa, Entamoeba invadens
LKTDTGL

SEQ ID NO: 2764979 - protein, 10 aa, Entamoeba invadens
LKTEEENYNT

SEQ ID NO: 2764980 - protein, 31 aa, Entamoeba invadens
LKTENERLQKEGNDVNQKIEEEKAAKKSVEE

SEQ ID NO: 2764981 - protein, 8 aa, Entamoeba invadens
LKTESDRQ

SEQ ID NO: 2764982 - protein, 10 aa, Entamoeba invadens
LKTGEENYNT

SEQ ID NO: 2764983 - protein, 10 aa, Entamoeba invadens
LKTGEETYNE

SEQ ID NO: 2764984 - protein, 7 aa, Entamoeba invadens
LKTGEEV

SEQ ID NO: 2764985 - protein, 8 aa, Entamoeba invadens
LKTGNTSE

SEQ ID NO: 2764986 - protein, 4 aa, Entamoeba invadens
LKTK

SEQ ID NO: 2764987 - protein, 15 aa, Entamoeba invadens
LKTKEDEEKAAEYVA

SEQ ID NO: 2764988 - protein, 8 aa, Entamoeba invadens
LKTNEEKY

SEQ ID NO: 2764989 - protein, 9 aa, Entamoeba invadens
LKTNEEKYN

SEQ ID NO: 2764990 - protein, 6 aa, Entamoeba invadens
LKTNEN

SEQ ID NO: 2764991 - protein, 5 aa, Entamoeba invadens
LKTNG

SEQ ID NO: 2764992 - protein, 10 aa, Entamoeba invadens
LKTNKEKYDK

SEQ ID NO: 2764993 - protein, 10 aa, Entamoeba invadens
LKTNKEKYNE

SEQ ID NO: 2764994 - protein, 11 aa, Entamoeba invadens
LKTNKEVSGEL

SEQ ID NO: 2764995 - protein, 8 aa, Entamoeba invadens
LKTNKSYT

SEQ ID NO: 2764996 - protein, 13 aa, Entamoeba invadens
LKTNPIDKSIGSQ

SEQ ID NO: 2764997 - protein, 9 aa, Entamoeba invadens
LKTNTENTN

SEQ ID NO: 2764998 - protein, 10 aa, Entamoeba invadens
LKTPETKTPF

SEQ ID NO: 2764999 - protein, 12 aa, Entamoeba invadens
LKTPNDTSSSIS

SEQ ID NO: 2765000 - protein, 8 aa, Entamoeba invadens
LKTPQSVS

SEQ ID NO: 2765001 - protein, 23 aa, Entamoeba invadens
LKTQKASQKYMPKQAKKDEIPRP

SEQ ID NO: 2765002 - protein, 7 aa, Entamoeba invadens
LKTRENC

SEQ ID NO: 2765003 - protein, 4 aa, Entamoeba invadens
LKTS

SEQ ID NO: 2765004 - protein, 11 aa, Entamoeba invadens
LKTSEDLANEA

SEQ ID NO: 2765005 - protein, 7 aa, Entamoeba invadens
LKTSSNC

SEQ ID NO: 2765006 - protein, 9 aa, Entamoeba invadens
LKTSSSITA

SEQ ID NO: 2765007 - protein, 9 aa, Entamoeba invadens
LKTSTRSPL

SEQ ID NO: 2765008 - protein, 6 aa, Entamoeba invadens
LKTTDT

SEQ ID NO: 2765009 - protein, 6 aa, Entamoeba invadens
LKTTKC

SEQ ID NO: 2765010 - protein, 13 aa, Entamoeba invadens
LKTTTEAISKSMN

SEQ ID NO: 2765011 - protein, 5 aa, Entamoeba invadens
LKVEP

SEQ ID NO: 2765012 - protein, 5 aa, Entamoeba invadens
LKVGD

SEQ ID NO: 2765013 - protein, 7 aa, Entamoeba invadens
LKVGETK

SEQ ID NO: 2765014 - protein, 14 aa, Entamoeba invadens
LKVSSGVKEDTDLS

SEQ ID NO: 2765015 - protein, 5 aa, Entamoeba invadens
LLEGG

SEQ ID NO: 2765016 - protein, 4 aa, Entamoeba invadens
LLGN

SEQ ID NO: 2765017 - protein, 17 aa, Entamoeba invadens
LLNKKDNPTASDPDTCD

SEQ ID NO: 2765018 - protein, 18 aa, Entamoeba invadens
LLNTQSEEKSIKYKENRS

SEQ ID NO: 2765019 - protein, 9 aa, Entamoeba invadens
LLSDDSATI

SEQ ID NO: 2765020 - protein, 4 aa, Entamoeba invadens
LLSE

SEQ ID NO: 2765021 - protein, 9 aa, Entamoeba invadens
LLSKSEAKT

SEQ ID NO: 2765022 - protein, 4 aa, Entamoeba invadens
LLSN

SEQ ID NO: 2765023 - protein, 14 aa, Entamoeba invadens
LLSNGSCKETTSFN

SEQ ID NO: 2765024 - protein, 7 aa, Entamoeba invadens
LLSNTDE

SEQ ID NO: 2765025 - protein, 31 aa, Entamoeba invadens
LLTKSNSKSSSEEKEPENMKNDEKTIKQTDN

SEQ ID NO: 2765026 - protein, 6 aa, Entamoeba invadens
LLTTPQ

SEQ ID NO: 2765027 - protein, 6 aa, Entamoeba invadens
LMENDK

SEQ ID NO: 2765028 - protein, 9 aa, Entamoeba invadens
LNANCGSCS

SEQ ID NO: 2765029 - protein, 9 aa, Entamoeba invadens
LNANGQTFT

SEQ ID NO: 2765030 - protein, 12 aa, Entamoeba invadens
LNAPKDNEKDFG

SEQ ID NO: 2765031 - protein, 6 aa, Entamoeba invadens
LNASRA

SEQ ID NO: 2765032 - protein, 8 aa, Entamoeba invadens
LNCEKSSQ

SEQ ID NO: 2765033 - protein, 12 aa, Entamoeba invadens
LNCEPNKCYTTG

SEQ ID NO: 2765034 - protein, 6 aa, Entamoeba invadens
LNCEQN

SEQ ID NO: 2765035 - protein, 5 aa, Entamoeba invadens
LNDEK

SEQ ID NO: 2765036 - protein, 6 aa, Entamoeba invadens
LNDEPL

SEQ ID NO: 2765037 - protein, 8 aa, Entamoeba invadens
LNDEPREL

SEQ ID NO: 2765038 - protein, 9 aa, Entamoeba invadens
LNDGDMCEQ

SEQ ID NO: 2765039 - protein, 9 aa, Entamoeba invadens
LNDGGVCEQ

SEQ ID NO: 2765040 - protein, 10 aa, Entamoeba invadens
LNDNGAMDEF

SEQ ID NO: 2765041 - protein, 12 aa, Entamoeba invadens
LNDNPNSTNTVD

SEQ ID NO: 2765042 - protein, 13 aa, Entamoeba invadens
LNDNTKNENINEN

SEQ ID NO: 2765043 - protein, 11 aa, Entamoeba invadens
LNDPDSNDDLT

SEQ ID NO: 2765044 - protein, 13 aa, Entamoeba invadens
LNDRRRKQIENYS

SEQ ID NO: 2765045 - protein, 10 aa, Entamoeba invadens
LNDSTKPEDF

SEQ ID NO: 2765046 - protein, 9 aa, Entamoeba invadens
LNDTSVKKV

SEQ ID NO: 2765047 - protein, 5 aa, Entamoeba invadens
LNDVA

SEQ ID NO: 2765048 - protein, 7 aa, Entamoeba invadens
LNDVPTT

SEQ ID NO: 2765049 - protein, 15 aa, Entamoeba invadens
LNEDDLKQSNTKKAK

SEQ ID NO: 2765050 - protein, 5 aa, Entamoeba invadens
LNEDL

SEQ ID NO: 2765051 - protein, 9 aa, Entamoeba invadens
LNEGVNTDK

SEQ ID NO: 2765052 - protein, 4 aa, Entamoeba invadens
LNEI

SEQ ID NO: 2765053 - protein, 12 aa, Entamoeba invadens
LNEKKEKKRVME

SEQ ID NO: 2765054 - protein, 11 aa, Entamoeba invadens
LNEKTPLEDQK

SEQ ID NO: 2765055 - protein, 16 aa, Entamoeba invadens
LNEKVNSKLTDFGSAR

SEQ ID NO: 2765056 - protein, 4 aa, Entamoeba invadens
LNEN

SEQ ID NO: 2765057 - protein, 6 aa, Entamoeba invadens
LNENTQ

SEQ ID NO: 2765058 - protein, 7 aa, Entamoeba invadens
LNEQKDK

SEQ ID NO: 2765059 - protein, 8 aa, Entamoeba invadens
LNEQTQQL

SEQ ID NO: 2765060 - protein, 6 aa, Entamoeba invadens
LNERGE

SEQ ID NO: 2765061 - protein, 4 aa, Entamoeba invadens
LNES

SEQ ID NO: 2765062 - protein, 16 aa, Entamoeba invadens
LNESGWEEIPAKDPYY

SEQ ID NO: 2765063 - protein, 6 aa, Entamoeba invadens
LNESQS

SEQ ID NO: 2765064 - protein, 37 aa, Entamoeba invadens
LNESTPQDDKNEQGTGPQLLPQDENETVEDTKKKEEK

SEQ ID NO: 2765065 - protein, 9 aa, Entamoeba invadens
LNETRRINE

SEQ ID NO: 2765066 - protein, 17 aa, Entamoeba invadens
LNEVTGSDVTIKGSSDA

SEQ ID NO: 2765067 - protein, 10 aa, Entamoeba invadens
LNGAQSPLGN

SEQ ID NO: 2765068 - protein, 10 aa, Entamoeba invadens
LNGATNETTI

SEQ ID NO: 2765069 - protein, 7 aa, Entamoeba invadens
LNGATTI

SEQ ID NO: 2765070 - protein, 6 aa, Entamoeba invadens
LNGDSL

SEQ ID NO: 2765071 - protein, 5 aa, Entamoeba invadens
LNGDV

SEQ ID NO: 2765072 - protein, 8 aa, Entamoeba invadens
LNGEETIS

SEQ ID NO: 2765073 - protein, 8 aa, Entamoeba invadens
LNGESDGY

SEQ ID NO: 2765074 - protein, 12 aa, Entamoeba invadens
LNGKDKGLGTPI

SEQ ID NO: 2765075 - protein, 10 aa, Entamoeba invadens
LNGKIGQYSP

SEQ ID NO: 2765076 - protein, 14 aa, Entamoeba invadens
LNGKTTLRTSSCVD

SEQ ID NO: 2765077 - protein, 5 aa, Entamoeba invadens
LNGKV

SEQ ID NO: 2765078 - protein, 13 aa, Entamoeba invadens
LNGNDCQSAQQNL

SEQ ID NO: 2765079 - protein, 8 aa, Entamoeba invadens
LNGNFTET

SEQ ID NO: 2765080 - protein, 9 aa, Entamoeba invadens
LNGNNSSSI

SEQ ID NO: 2765081 - protein, 5 aa, Entamoeba invadens
LNGNS

SEQ ID NO: 2765082 - protein, 8 aa, Entamoeba invadens
LNGPEDDD

SEQ ID NO: 2765083 - protein, 9 aa, Entamoeba invadens
LNGPQTTNY

SEQ ID NO: 2765084 - protein, 12 aa, Entamoeba invadens
LNGSDKTKVDEF

SEQ ID NO: 2765085 - protein, 10 aa, Entamoeba invadens
LNGSQNRSCF

SEQ ID NO: 2765086 - protein, 4 aa, Entamoeba invadens
LNGT

SEQ ID NO: 2765087 - protein, 6 aa, Entamoeba invadens
LNGTTS

SEQ ID NO: 2765088 - protein, 5 aa, Entamoeba invadens
LNIEK

SEQ ID NO: 2765089 - protein, 9 aa, Entamoeba invadens
LNIKKEKEK

SEQ ID NO: 2765090 - protein, 4 aa, Entamoeba invadens
LNIT

SEQ ID NO: 2765091 - protein, 10 aa, Entamoeba invadens
LNKDPTKRSK

SEQ ID NO: 2765092 - protein, 4 aa, Entamoeba invadens
LNKE

SEQ ID NO: 2765093 - protein, 6 aa, Entamoeba invadens
LNKEGK

SEQ ID NO: 2765094 - protein, 13 aa, Entamoeba invadens
LNKGEDDLLFFRI

SEQ ID NO: 2765095 - protein, 6 aa, Entamoeba invadens
LNKGSY

SEQ ID NO: 2765096 - protein, 10 aa, Entamoeba invadens
LNKKIKEQIA

SEQ ID NO: 2765097 - protein, 8 aa, Entamoeba invadens
LNKKQNEL

SEQ ID NO: 2765098 - protein, 11 aa, Entamoeba invadens
LNKNGTKKANY

SEQ ID NO: 2765099 - protein, 8 aa, Entamoeba invadens
LNKQKNEI

SEQ ID NO: 2765100 - protein, 13 aa, Entamoeba invadens
LNKQQSSPATIAY

SEQ ID NO: 2765101 - protein, 12 aa, Entamoeba invadens
LNKSGKGYDKLS

SEQ ID NO: 2765102 - protein, 11 aa, Entamoeba invadens
LNKSNALSKQQ

SEQ ID NO: 2765103 - protein, 22 aa, Entamoeba invadens
LNKSSSSYFNNTTSRVKGDCPT

SEQ ID NO: 2765104 - protein, 9 aa, Entamoeba invadens
LNKTPSVEN

SEQ ID NO: 2765105 - protein, 12 aa, Entamoeba invadens
LNLNTKKNVLGN

SEQ ID NO: 2765106 - protein, 6 aa, Entamoeba invadens
LNNAYK

SEQ ID NO: 2765107 - protein, 4 aa, Entamoeba invadens
LNNE

SEQ ID NO: 2765108 - protein, 6 aa, Entamoeba invadens
LNNEGK

SEQ ID NO: 2765109 - protein, 10 aa, Entamoeba invadens
LNNENIKTWE

SEQ ID NO: 2765110 - protein, 7 aa, Entamoeba invadens
LNNGASN

SEQ ID NO: 2765111 - protein, 9 aa, Entamoeba invadens
LNNGNVCEQ

SEQ ID NO: 2765112 - protein, 6 aa, Entamoeba invadens
LNNKPE

SEQ ID NO: 2765113 - protein, 5 aa, Entamoeba invadens
LNNNG

SEQ ID NO: 2765114 - protein, 9 aa, Entamoeba invadens
LNNNGSLIP

SEQ ID NO: 2765115 - protein, 6 aa, Entamoeba invadens
LNNNSE

SEQ ID NO: 2765116 - protein, 7 aa, Entamoeba invadens
LNNNSNV

SEQ ID NO: 2765117 - protein, 5 aa, Entamoeba invadens
LNNPV

SEQ ID NO: 2765118 - protein, 5 aa, Entamoeba invadens
LNNSD

SEQ ID NO: 2765119 - protein, 8 aa, Entamoeba invadens
LNNSRKSL

SEQ ID NO: 2765120 - protein, 5 aa, Entamoeba invadens
LNNTD

SEQ ID NO: 2765121 - protein, 11 aa, Entamoeba invadens
LNNTDTETQHT

SEQ ID NO: 2765122 - protein, 5 aa, Entamoeba invadens
LNNYG

SEQ ID NO: 2765123 - protein, 5 aa, Entamoeba invadens
LNPKA

SEQ ID NO: 2765124 - protein, 5 aa, Entamoeba invadens
LNPNK

SEQ ID NO: 2765125 - protein, 7 aa, Entamoeba invadens
LNPNNAS

SEQ ID NO: 2765126 - protein, 59 aa, Entamoeba invadens
LNPPEPEKPTESSKPIEPSKPEKPTDKPVNPPVTPSEPENPLGPVTSEEHTENSEISNL

SEQ ID NO: 2765127 - protein, 5 aa, Entamoeba invadens
LNPTD

SEQ ID NO: 2765128 - protein, 6 aa, Entamoeba invadens
LNQGDE

SEQ ID NO: 2765129 - protein, 5 aa, Entamoeba invadens
LNQKI

SEQ ID NO: 2765130 - protein, 11 aa, Entamoeba invadens
LNQKPDDWEND

SEQ ID NO: 2765131 - protein, 23 aa, Entamoeba invadens
LNQPNQVIDPKKVKKIEDKTIET

SEQ ID NO: 2765132 - protein, 4 aa, Entamoeba invadens
LNQS

SEQ ID NO: 2765133 - protein, 9 aa, Entamoeba invadens
LNQSSKKNK

SEQ ID NO: 2765134 - protein, 7 aa, Entamoeba invadens
LNQTGSS

SEQ ID NO: 2765135 - protein, 14 aa, Entamoeba invadens
LNQTGSSMIEAPSG

SEQ ID NO: 2765136 - protein, 15 aa, Entamoeba invadens
LNQTPPQVKKSRIDK

SEQ ID NO: 2765137 - protein, 11 aa, Entamoeba invadens
LNRDKSEQYEK

SEQ ID NO: 2765138 - protein, 5 aa, Entamoeba invadens
LNRPK

SEQ ID NO: 2765139 - protein, 11 aa, Entamoeba invadens
LNSAQSSPALT

SEQ ID NO: 2765140 - protein, 4 aa, Entamoeba invadens
LNSC

SEQ ID NO: 2765141 - protein, 8 aa, Entamoeba invadens
LNSDPGVC

SEQ ID NO: 2765142 - protein, 6 aa, Entamoeba invadens
LNSDSG

SEQ ID NO: 2765143 - protein, 6 aa, Entamoeba invadens
LNSDTN

SEQ ID NO: 2765144 - protein, 9 aa, Entamoeba invadens
LNSEETCST

SEQ ID NO: 2765145 - protein, 6 aa, Entamoeba invadens
LNSEEV

SEQ ID NO: 2765146 - protein, 21 aa, Entamoeba invadens
LNSETDKAQYEKIQSSKRNSI

SEQ ID NO: 2765147 - protein, 14 aa, Entamoeba invadens
LNSETKNTLGVTGD

SEQ ID NO: 2765148 - protein, 8 aa, Entamoeba invadens
LNSGDDNE

SEQ ID NO: 2765149 - protein, 8 aa, Entamoeba invadens
LNSGTGCA

SEQ ID NO: 2765150 - protein, 19 aa, Entamoeba invadens
LNSKEKCDSCSSKCKTSGI

SEQ ID NO: 2765151 - protein, 7 aa, Entamoeba invadens
LNSKQTL

SEQ ID NO: 2765152 - protein, 12 aa, Entamoeba invadens
LNSKRKSPSDAT

SEQ ID NO: 2765153 - protein, 11 aa, Entamoeba invadens
LNSKTIKVTSN

SEQ ID NO: 2765154 - protein, 6 aa, Entamoeba invadens
LNSLPD

SEQ ID NO: 2765155 - protein, 23 aa, Entamoeba invadens
LNSLSKSPNISASPRNAPQTPNF

SEQ ID NO: 2765156 - protein, 5 aa, Entamoeba invadens
LNSNE

SEQ ID NO: 2765157 - protein, 9 aa, Entamoeba invadens
LNSNNTNAI

SEQ ID NO: 2765158 - protein, 17 aa, Entamoeba invadens
LNSQQSSPATEAYEESG

SEQ ID NO: 2765159 - protein, 7 aa, Entamoeba invadens
LNSSIQE

SEQ ID NO: 2765160 - protein, 10 aa, Entamoeba invadens
LNSSLSPPLT

SEQ ID NO: 2765161 - protein, 20 aa, Entamoeba invadens
LNSSLSSNITTDNKTIGNKT

SEQ ID NO: 2765162 - protein, 8 aa, Entamoeba invadens
LNSSQSLE

SEQ ID NO: 2765163 - protein, 13 aa, Entamoeba invadens
LNSSVTSSKTKSG

SEQ ID NO: 2765164 - protein, 11 aa, Entamoeba invadens
LNSTNSGGQLP

SEQ ID NO: 2765165 - protein, 8 aa, Entamoeba invadens
LNSVSGTG

SEQ ID NO: 2765166 - protein, 9 aa, Entamoeba invadens
LNTEETCST

SEQ ID NO: 2765167 - protein, 10 aa, Entamoeba invadens
LNTHSSSPVN

SEQ ID NO: 2765168 - protein, 6 aa, Entamoeba invadens
LNTISG

SEQ ID NO: 2765169 - protein, 6 aa, Entamoeba invadens
LNTKDG

SEQ ID NO: 2765170 - protein, 11 aa, Entamoeba invadens
LNTKTSKNNME

SEQ ID NO: 2765171 - protein, 6 aa, Entamoeba invadens
LNTNKR

SEQ ID NO: 2765172 - protein, 6 aa, Entamoeba invadens
LNTNPT

SEQ ID NO: 2765173 - protein, 8 aa, Entamoeba invadens
LNTNRDSY

SEQ ID NO: 2765174 - protein, 11 aa, Entamoeba invadens
LNTPKKNEDHE

SEQ ID NO: 2765175 - protein, 12 aa, Entamoeba invadens
LNTPNSVSGSKN

SEQ ID NO: 2765176 - protein, 8 aa, Entamoeba invadens
LNTPSSLE

SEQ ID NO: 2765177 - protein, 4 aa, Entamoeba invadens
LNTQ

SEQ ID NO: 2765178 - protein, 7 aa, Entamoeba invadens
LNTQGDI

SEQ ID NO: 2765179 - protein, 12 aa, Entamoeba invadens
LNTQGNLQMNGD

SEQ ID NO: 2765180 - protein, 6 aa, Entamoeba invadens
LNTQYN

SEQ ID NO: 2765181 - protein, 4 aa, Entamoeba invadens
LNTS

SEQ ID NO: 2765182 - protein, 7 aa, Entamoeba invadens
LNTSAPE

SEQ ID NO: 2765183 - protein, 11 aa, Entamoeba invadens
LNTSDRTNLEK

SEQ ID NO: 2765184 - protein, 6 aa, Entamoeba invadens
LNTSTL

SEQ ID NO: 2765185 - protein, 5 aa, Entamoeba invadens
LNTTQ

SEQ ID NO: 2765186 - protein, 5 aa, Entamoeba invadens
LNTTS

SEQ ID NO: 2765187 - protein, 6 aa, Entamoeba invadens
LNTTSP

SEQ ID NO: 2765188 - protein, 7 aa, Entamoeba invadens
LNVENEK

SEQ ID NO: 2765189 - protein, 10 aa, Entamoeba invadens
LNVKNAENEE

SEQ ID NO: 2765190 - protein, 7 aa, Entamoeba invadens
LNYDTRN

SEQ ID NO: 2765191 - protein, 4 aa, Entamoeba invadens
LNYN

SEQ ID NO: 2765192 - protein, 8 aa, Entamoeba invadens
LNYRDTER

SEQ ID NO: 2765193 - protein, 8 aa, Entamoeba invadens
LNYTSNSG

SEQ ID NO: 2765194 - protein, 4 aa, Entamoeba invadens
LPAD

SEQ ID NO: 2765195 - protein, 6 aa, Entamoeba invadens
LPAGGG

SEQ ID NO: 2765196 - protein, 4 aa, Entamoeba invadens
LPAK

SEQ ID NO: 2765197 - protein, 6 aa, Entamoeba invadens
LPANKV

SEQ ID NO: 2765198 - protein, 5 aa, Entamoeba invadens
LPAPT

SEQ ID NO: 2765199 - protein, 6 aa, Entamoeba invadens
LPATQL

SEQ ID NO: 2765200 - protein, 20 aa, Entamoeba invadens
LPCTSGAGTRVDNQNEKANS

SEQ ID NO: 2765201 - protein, 11 aa, Entamoeba invadens
LPDAKKAKRTI

SEQ ID NO: 2765202 - protein, 5 aa, Entamoeba invadens
LPDED

SEQ ID NO: 2765203 - protein, 6 aa, Entamoeba invadens
LPDGTE

SEQ ID NO: 2765204 - protein, 5 aa, Entamoeba invadens
LPDNF

SEQ ID NO: 2765205 - protein, 12 aa, Entamoeba invadens
LPDQADTLTGKI

SEQ ID NO: 2765206 - protein, 20 aa, Entamoeba invadens
LPDQQQSIKLPTEKPAQSLS

SEQ ID NO: 2765207 - protein, 6 aa, Entamoeba invadens
LPEDTG

SEQ ID NO: 2765208 - protein, 18 aa, Entamoeba invadens
LPEDTSLHEAKQKIKKAE

SEQ ID NO: 2765209 - protein, 28 aa, Entamoeba invadens
LPELQKPKTTKPKEIKVQQTAQSNIKEL

SEQ ID NO: 2765210 - protein, 4 aa, Entamoeba invadens
LPEN

SEQ ID NO: 2765211 - protein, 5 aa, Entamoeba invadens
LPEND

SEQ ID NO: 2765212 - protein, 14 aa, Entamoeba invadens
LPENDAECGRCPSD

SEQ ID NO: 2765213 - protein, 8 aa, Entamoeba invadens
LPENPIKE

SEQ ID NO: 2765214 - protein, 6 aa, Entamoeba invadens
LPESKR

SEQ ID NO: 2765215 - protein, 24 aa, Entamoeba invadens
LPESNTAVEQPTVNDAITEHAVLA

SEQ ID NO: 2765216 - protein, 10 aa, Entamoeba invadens
LPESPTPEDH

SEQ ID NO: 2765217 - protein, 9 aa, Entamoeba invadens
LPESSASTY

SEQ ID NO: 2765218 - protein, 4 aa, Entamoeba invadens
LPET

SEQ ID NO: 2765219 - protein, 8 aa, Entamoeba invadens
LPETAEKT

SEQ ID NO: 2765220 - protein, 5 aa, Entamoeba invadens
LPETN

SEQ ID NO: 2765221 - protein, 5 aa, Entamoeba invadens
LPEYS

SEQ ID NO: 2765222 - protein, 22 aa, Entamoeba invadens
LPGAQEDVQHGSTSSEDSSSTS

SEQ ID NO: 2765223 - protein, 10 aa, Entamoeba invadens
LPGDTREPNS

SEQ ID NO: 2765224 - protein, 9 aa, Entamoeba invadens
LPGKEQENI

SEQ ID NO: 2765225 - protein, 8 aa, Entamoeba invadens
LPGKSANN

SEQ ID NO: 2765226 - protein, 4 aa, Entamoeba invadens
LPGL

SEQ ID NO: 2765227 - protein, 25 aa, Entamoeba invadens
LPGMAQQPAAPQQEQKKQKIKYKTY

SEQ ID NO: 2765228 - protein, 5 aa, Entamoeba invadens
LPGQI

SEQ ID NO: 2765229 - protein, 4 aa, Entamoeba invadens
LPGS

SEQ ID NO: 2765230 - protein, 6 aa, Entamoeba invadens
LPGSKS

SEQ ID NO: 2765231 - protein, 7 aa, Entamoeba invadens
LPGSTSK

SEQ ID NO: 2765232 - protein, 13 aa, Entamoeba invadens
LPIHNDENGGNGD

SEQ ID NO: 2765233 - protein, 5 aa, Entamoeba invadens
LPITY

SEQ ID NO: 2765234 - protein, 5 aa, Entamoeba invadens
LPKDN

SEQ ID NO: 2765235 - protein, 9 aa, Entamoeba invadens
LPKEGKYEN

SEQ ID NO: 2765236 - protein, 5 aa, Entamoeba invadens
LPKEK

SEQ ID NO: 2765237 - protein, 17 aa, Entamoeba invadens
LPKEQQDKFREKEENGL

SEQ ID NO: 2765238 - protein, 16 aa, Entamoeba invadens
LPKGEGFGDLYVKTTL

SEQ ID NO: 2765239 - protein, 6 aa, Entamoeba invadens
LPKGGG

SEQ ID NO: 2765240 - protein, 5 aa, Entamoeba invadens
LPKKK

SEQ ID NO: 2765241 - protein, 13 aa, Entamoeba invadens
LPKLNDKSQIKEV

SEQ ID NO: 2765242 - protein, 4 aa, Entamoeba invadens
LPKN

SEQ ID NO: 2765243 - protein, 15 aa, Entamoeba invadens
LPKNHNKSILNQNEK

SEQ ID NO: 2765244 - protein, 7 aa, Entamoeba invadens
LPKNTHD

SEQ ID NO: 2765245 - protein, 8 aa, Entamoeba invadens
LPKPKNNF

SEQ ID NO: 2765246 - protein, 5 aa, Entamoeba invadens
LPKPL

SEQ ID NO: 2765247 - protein, 9 aa, Entamoeba invadens
LPKQDKVPY

SEQ ID NO: 2765248 - protein, 9 aa, Entamoeba invadens
LPKQVESLS

SEQ ID NO: 2765249 - protein, 6 aa, Entamoeba invadens
LPKTLT

SEQ ID NO: 2765250 - protein, 13 aa, Entamoeba invadens
LPKTSNKNHYTKT

SEQ ID NO: 2765251 - protein, 4 aa, Entamoeba invadens
LPKV

SEQ ID NO: 2765252 - protein, 28 aa, Entamoeba invadens
LPKYQPKNTSKLASIPDSYASCGSESDV

SEQ ID NO: 2765253 - protein, 10 aa, Entamoeba invadens
LPLEGSSGGF

SEQ ID NO: 2765254 - protein, 11 aa, Entamoeba invadens
LPLGRSQEFAQ

SEQ ID NO: 2765255 - protein, 10 aa, Entamoeba invadens
LPLNSQNTKG

SEQ ID NO: 2765256 - protein, 24 aa, Entamoeba invadens
LPLPNTPNQLEQQQDLNENTQPIT

SEQ ID NO: 2765257 - protein, 12 aa, Entamoeba invadens
LPLSSSNQYNFG

SEQ ID NO: 2765258 - protein, 4 aa, Entamoeba invadens
LPMP

SEQ ID NO: 2765259 - protein, 10 aa, Entamoeba invadens
LPNDPYGKCG

SEQ ID NO: 2765260 - protein, 11 aa, Entamoeba invadens
LPNDQNGKCTT

SEQ ID NO: 2765261 - protein, 5 aa, Entamoeba invadens
LPNEN

SEQ ID NO: 2765262 - protein, 27 aa, Entamoeba invadens
LPNETTKETTKNEDTQTDSHCEVSTTK

SEQ ID NO: 2765263 - protein, 27 aa, Entamoeba invadens
LPNETTKQTTKNVDTQTDSHCEVSTTK

SEQ ID NO: 2765264 - protein, 6 aa, Entamoeba invadens
LPNFNS

SEQ ID NO: 2765265 - protein, 4 aa, Entamoeba invadens
LPNG

SEQ ID NO: 2765266 - protein, 6 aa, Entamoeba invadens
LPNGTE

SEQ ID NO: 2765267 - protein, 15 aa, Entamoeba invadens
LPNKATLQSSATTSI

SEQ ID NO: 2765268 - protein, 5 aa, Entamoeba invadens
LPNNT

SEQ ID NO: 2765269 - protein, 6 aa, Entamoeba invadens
LPNTGT

SEQ ID NO: 2765270 - protein, 27 aa, Entamoeba invadens
LPNTLNSSNQKSPKSPSQGKSVAQHAD

SEQ ID NO: 2765271 - protein, 7 aa, Entamoeba invadens
LPNVDNG

SEQ ID NO: 2765272 - protein, 6 aa, Entamoeba invadens
LPPAER

SEQ ID NO: 2765273 - protein, 4 aa, Entamoeba invadens
LPPD

SEQ ID NO: 2765274 - protein, 12 aa, Entamoeba invadens
LPPDKSYSKDSK

SEQ ID NO: 2765275 - protein, 7 aa, Entamoeba invadens
LPPEGSP

SEQ ID NO: 2765276 - protein, 5 aa, Entamoeba invadens
LPPEL

SEQ ID NO: 2765277 - protein, 5 aa, Entamoeba invadens
LPPEQ

SEQ ID NO: 2765278 - protein, 5 aa, Entamoeba invadens
LPPET

SEQ ID NO: 2765279 - protein, 4 aa, Entamoeba invadens
LPPG

SEQ ID NO: 2765280 - protein, 6 aa, Entamoeba invadens
LPPHQE

SEQ ID NO: 2765281 - protein, 14 aa, Entamoeba invadens
LPPKEVELKKSEVN

SEQ ID NO: 2765282 - protein, 19 aa, Entamoeba invadens
LPPKSKKYCSNKVENNRYT

SEQ ID NO: 2765283 - protein, 10 aa, Entamoeba invadens
LPPPAGSGNV

SEQ ID NO: 2765284 - protein, 5 aa, Entamoeba invadens
LPPPI

SEQ ID NO: 2765285 - protein, 6 aa, Entamoeba invadens
LPPPPA

SEQ ID NO: 2765286 - protein, 6 aa, Entamoeba invadens
LPPPQI

SEQ ID NO: 2765287 - protein, 5 aa, Entamoeba invadens
LPPQC

SEQ ID NO: 2765288 - protein, 31 aa, Entamoeba invadens
LPPQPMYPNQQTTVVTTTTENDNITSEQRDK

SEQ ID NO: 2765289 - protein, 5 aa, Entamoeba invadens
LPPQS

SEQ ID NO: 2765290 - protein, 8 aa, Entamoeba invadens
LPQEDDIT

SEQ ID NO: 2765291 - protein, 4 aa, Entamoeba invadens
LPQQ

SEQ ID NO: 2765292 - protein, 20 aa, Entamoeba invadens
LPQSEDKKMRKVEEKDLEID

SEQ ID NO: 2765293 - protein, 14 aa, Entamoeba invadens
LPQSGINGCKDKVT

SEQ ID NO: 2765294 - protein, 9 aa, Entamoeba invadens
LPQTTRSPF

SEQ ID NO: 2765295 - protein, 27 aa, Entamoeba invadens
LPRDEMKDGEKSVDSESKDKISPASLQ

SEQ ID NO: 2765296 - protein, 4 aa, Entamoeba invadens
LPSA

SEQ ID NO: 2765297 - protein, 4 aa, Entamoeba invadens
LPSD

SEQ ID NO: 2765298 - protein, 11 aa, Entamoeba invadens
LPSDASKCAYP

SEQ ID NO: 2765299 - protein, 9 aa, Entamoeba invadens
LPSDDKCDD

SEQ ID NO: 2765300 - protein, 9 aa, Entamoeba invadens
LPSDKKVPA

SEQ ID NO: 2765301 - protein, 8 aa, Entamoeba invadens
LPSDPQIK

SEQ ID NO: 2765302 - protein, 13 aa, Entamoeba invadens
LPSEKEKKEADAI

SEQ ID NO: 2765303 - protein, 4 aa, Entamoeba invadens
LPSF

SEQ ID NO: 2765304 - protein, 4 aa, Entamoeba invadens
LPSK

SEQ ID NO: 2765305 - protein, 6 aa, Entamoeba invadens
LPSKPL

SEQ ID NO: 2765306 - protein, 10 aa, Entamoeba invadens
LPSKTPSAGF

SEQ ID NO: 2765307 - protein, 4 aa, Entamoeba invadens
LPSL

SEQ ID NO: 2765308 - protein, 11 aa, Entamoeba invadens
LPSLNGGFGYG

SEQ ID NO: 2765309 - protein, 4 aa, Entamoeba invadens
LPSN

SEQ ID NO: 2765310 - protein, 6 aa, Entamoeba invadens
LPSNAG

SEQ ID NO: 2765311 - protein, 38 aa, Entamoeba invadens
LPSNRGLNTDEESNNGIPPSLTNATEVPEPDTQVEQGD

SEQ ID NO: 2765312 - protein, 5 aa, Entamoeba invadens
LPSSH

SEQ ID NO: 2765313 - protein, 10 aa, Entamoeba invadens
LPSSKKVSID

SEQ ID NO: 2765314 - protein, 40 aa, Entamoeba invadens
LPSSSKKKSEKSNEQKTEKKQETLGDTTNIKKEREGQTYS

SEQ ID NO: 2765315 - protein, 8 aa, Entamoeba invadens
LPSSTITD

SEQ ID NO: 2765316 - protein, 4 aa, Entamoeba invadens
LPST

SEQ ID NO: 2765317 - protein, 9 aa, Entamoeba invadens
LPSTNQKQK

SEQ ID NO: 2765318 - protein, 9 aa, Entamoeba invadens
LPSTQIGDF

SEQ ID NO: 2765319 - protein, 11 aa, Entamoeba invadens
LPSTQKESTFT

SEQ ID NO: 2765320 - protein, 11 aa, Entamoeba invadens
LPSTTTLTVPA

SEQ ID NO: 2765321 - protein, 5 aa, Entamoeba invadens
LPSVD

SEQ ID NO: 2765322 - protein, 7 aa, Entamoeba invadens
LPTDKTA

SEQ ID NO: 2765323 - protein, 7 aa, Entamoeba invadens
LPTDSSA

SEQ ID NO: 2765324 - protein, 9 aa, Entamoeba invadens
LPTDTTKYN

SEQ ID NO: 2765325 - protein, 5 aa, Entamoeba invadens
LPTGG

SEQ ID NO: 2765326 - protein, 6 aa, Entamoeba invadens
LPTGSS

SEQ ID NO: 2765327 - protein, 4 aa, Entamoeba invadens
LPTL

SEQ ID NO: 2765328 - protein, 10 aa, Entamoeba invadens
LPTNCGSSTT

SEQ ID NO: 2765329 - protein, 5 aa, Entamoeba invadens
LPTNK

SEQ ID NO: 2765330 - protein, 14 aa, Entamoeba invadens
LPTNTTLQSSTTSP

SEQ ID NO: 2765331 - protein, 5 aa, Entamoeba invadens
LPTPE

SEQ ID NO: 2765332 - protein, 8 aa, Entamoeba invadens
LPTPPAPN

SEQ ID NO: 2765333 - protein, 13 aa, Entamoeba invadens
LPTPSEENSQTVI

SEQ ID NO: 2765334 - protein, 5 aa, Entamoeba invadens
LPTQI

SEQ ID NO: 2765335 - protein, 13 aa, Entamoeba invadens
LPTQSQLSESGNT

SEQ ID NO: 2765336 - protein, 6 aa, Entamoeba invadens
LPTSGG

SEQ ID NO: 2765337 - protein, 12 aa, Entamoeba invadens
LPTSVREAKTSI

SEQ ID NO: 2765338 - protein, 5 aa, Entamoeba invadens
LPTTY

SEQ ID NO: 2765339 - protein, 7 aa, Entamoeba invadens
LPTVSQT

SEQ ID NO: 2765340 - protein, 6 aa, Entamoeba invadens
LPVPTE

SEQ ID NO: 2765341 - protein, 4 aa, Entamoeba invadens
LPVQ

SEQ ID NO: 2765342 - protein, 8 aa, Entamoeba invadens
LPYETPRR

SEQ ID NO: 2765343 - protein, 15 aa, Entamoeba invadens
LPYKTKYADDKNAPT

SEQ ID NO: 2765344 - protein, 4 aa, Entamoeba invadens
LPYT

SEQ ID NO: 2765345 - protein, 5 aa, Entamoeba invadens
LQATG

SEQ ID NO: 2765346 - protein, 8 aa, Entamoeba invadens
LQATGAPK

SEQ ID NO: 2765347 - protein, 20 aa, Entamoeba invadens
LQDENEKESLSSTEEETYFE

SEQ ID NO: 2765348 - protein, 11 aa, Entamoeba invadens
LQDGTTKNNQI

SEQ ID NO: 2765349 - protein, 9 aa, Entamoeba invadens
LQDGVPETI

SEQ ID NO: 2765350 - protein, 11 aa, Entamoeba invadens
LQDSSTKNNQI

SEQ ID NO: 2765351 - protein, 13 aa, Entamoeba invadens
LQEEKTTNEDIFD

SEQ ID NO: 2765352 - protein, 9 aa, Entamoeba invadens
LQEGDELAT

SEQ ID NO: 2765353 - protein, 9 aa, Entamoeba invadens
LQEGRTYNF

SEQ ID NO: 2765354 - protein, 18 aa, Entamoeba invadens
LQFGDDNSLTSKGRIKVS

SEQ ID NO: 2765355 - protein, 15 aa, Entamoeba invadens
LQGCTNKTSSGCASC

SEQ ID NO: 2765356 - protein, 10 aa, Entamoeba invadens
LQGGDKATSF

SEQ ID NO: 2765357 - protein, 6 aa, Entamoeba invadens
LQGPTV

SEQ ID NO: 2765358 - protein, 14 aa, Entamoeba invadens
LQGSGPDVKQSDEE

SEQ ID NO: 2765359 - protein, 4 aa, Entamoeba invadens
LQIN

SEQ ID NO: 2765360 - protein, 9 aa, Entamoeba invadens
LQIPTSVPD

SEQ ID NO: 2765361 - protein, 9 aa, Entamoeba invadens
LQKDQQKYR

SEQ ID NO: 2765362 - protein, 10 aa, Entamoeba invadens
LQKEAQEVEQ

SEQ ID NO: 2765363 - protein, 24 aa, Entamoeba invadens
LQKEKKEKKLEEKRAREAEEEKEL

SEQ ID NO: 2765364 - protein, 4 aa, Entamoeba invadens
LQKG

SEQ ID NO: 2765365 - protein, 5 aa, Entamoeba invadens
LQKGD

SEQ ID NO: 2765366 - protein, 9 aa, Entamoeba invadens
LQKKDNIPE

SEQ ID NO: 2765367 - protein, 10 aa, Entamoeba invadens
LQKKESTTDV

SEQ ID NO: 2765368 - protein, 11 aa, Entamoeba invadens
LQKKGSITTIA

SEQ ID NO: 2765369 - protein, 14 aa, Entamoeba invadens
LQKQDRSTTTQTDY

SEQ ID NO: 2765370 - protein, 18 aa, Entamoeba invadens
LQKSPQKFSKSTQKPFDN

SEQ ID NO: 2765371 - protein, 23 aa, Entamoeba invadens
LQKTQQMQPPPQASQLPFQQTNP

SEQ ID NO: 2765372 - protein, 20 aa, Entamoeba invadens
LQLSNGKCSNTKGDNCQDAN

SEQ ID NO: 2765373 - protein, 9 aa, Entamoeba invadens
LQMNGNGSI

SEQ ID NO: 2765374 - protein, 14 aa, Entamoeba invadens
LQNDEQKAFPNREK

SEQ ID NO: 2765375 - protein, 6 aa, Entamoeba invadens
LQNDTE

SEQ ID NO: 2765376 - protein, 6 aa, Entamoeba invadens
LQNDTS

SEQ ID NO: 2765377 - protein, 5 aa, Entamoeba invadens
LQNND

SEQ ID NO: 2765378 - protein, 6 aa, Entamoeba invadens
LQNNSI

SEQ ID NO: 2765379 - protein, 6 aa, Entamoeba invadens
LQNRKL

SEQ ID NO: 2765380 - protein, 5 aa, Entamoeba invadens
LQNRN

SEQ ID NO: 2765381 - protein, 12 aa, Entamoeba invadens
LQNSESSKTTPN

SEQ ID NO: 2765382 - protein, 12 aa, Entamoeba invadens
LQNSSETTLNEY

SEQ ID NO: 2765383 - protein, 10 aa, Entamoeba invadens
LQNSSSCTKC

SEQ ID NO: 2765384 - protein, 11 aa, Entamoeba invadens
LQNSTKYCNPQ

SEQ ID NO: 2765385 - protein, 6 aa, Entamoeba invadens
LQNTTK

SEQ ID NO: 2765386 - protein, 7 aa, Entamoeba invadens
LQNTTNN

SEQ ID NO: 2765387 - protein, 5 aa, Entamoeba invadens
LQNYE

SEQ ID NO: 2765388 - protein, 9 aa, Entamoeba invadens
LQPVSDKKK

SEQ ID NO: 2765389 - protein, 7 aa, Entamoeba invadens
LQQDGKD

SEQ ID NO: 2765390 - protein, 13 aa, Entamoeba invadens
LQQENSVTIRGTN

SEQ ID NO: 2765391 - protein, 6 aa, Entamoeba invadens
LQQNPL

SEQ ID NO: 2765392 - protein, 9 aa, Entamoeba invadens
LQQTDSTTC

SEQ ID NO: 2765393 - protein, 7 aa, Entamoeba invadens
LQRPSTE

SEQ ID NO: 2765394 - protein, 4 aa, Entamoeba invadens
LQSD

SEQ ID NO: 2765395 - protein, 5 aa, Entamoeba invadens
LQSED

SEQ ID NO: 2765396 - protein, 7 aa, Entamoeba invadens
LQSETNK

SEQ ID NO: 2765397 - protein, 11 aa, Entamoeba invadens
LQSNAKTEYND

SEQ ID NO: 2765398 - protein, 26 aa, Entamoeba invadens
LQSNGEKRCQQCDTTCNGNCNTETGY

SEQ ID NO: 2765399 - protein, 18 aa, Entamoeba invadens
LQSNLQNQKGENGGSGTV

SEQ ID NO: 2765400 - protein, 10 aa, Entamoeba invadens
LQSSATSSIE

SEQ ID NO: 2765401 - protein, 18 aa, Entamoeba invadens
LQTDNTQRVMKNSSTSKM

SEQ ID NO: 2765402 - protein, 13 aa, Entamoeba invadens
LQTESGETETQTM

SEQ ID NO: 2765403 - protein, 6 aa, Entamoeba invadens
LQTKSG

SEQ ID NO: 2765404 - protein, 6 aa, Entamoeba invadens
LQTNGT

SEQ ID NO: 2765405 - protein, 10 aa, Entamoeba invadens
LQTPKGETPL

SEQ ID NO: 2765406 - protein, 7 aa, Entamoeba invadens
LQTQSGK

SEQ ID NO: 2765407 - protein, 12 aa, Entamoeba invadens
LQTQTENDKDVI

SEQ ID NO: 2765408 - protein, 7 aa, Entamoeba invadens
LQTSGET

SEQ ID NO: 2765409 - protein, 11 aa, Entamoeba invadens
LQTTDYTEHPS

SEQ ID NO: 2765410 - protein, 9 aa, Entamoeba invadens
LRAKAEDNG

SEQ ID NO: 2765411 - protein, 11 aa, Entamoeba invadens
LRCKDGSETYG

SEQ ID NO: 2765412 - protein, 13 aa, Entamoeba invadens
LRDPTISTKTFRG

SEQ ID NO: 2765413 - protein, 11 aa, Entamoeba invadens
LRDQDTAQEMK

SEQ ID NO: 2765414 - protein, 5 aa, Entamoeba invadens
LRDRL

SEQ ID NO: 2765415 - protein, 4 aa, Entamoeba invadens
LREA

SEQ ID NO: 2765416 - protein, 8 aa, Entamoeba invadens
LREDKEDY

SEQ ID NO: 2765417 - protein, 14 aa, Entamoeba invadens
LREEEEKLEEEKME

SEQ ID NO: 2765418 - protein, 10 aa, Entamoeba invadens
LREEESESIK

SEQ ID NO: 2765419 - protein, 6 aa, Entamoeba invadens
LREEND

SEQ ID NO: 2765420 - protein, 12 aa, Entamoeba invadens
LREGTTKYSNGR

SEQ ID NO: 2765421 - protein, 6 aa, Entamoeba invadens
LREKYG

SEQ ID NO: 2765422 - protein, 14 aa, Entamoeba invadens
LREPTTNCTTCKDT

SEQ ID NO: 2765423 - protein, 18 aa, Entamoeba invadens
LREQNDTLKTQNERGEIQ

SEQ ID NO: 2765424 - protein, 6 aa, Entamoeba invadens
LRGENT

SEQ ID NO: 2765425 - protein, 7 aa, Entamoeba invadens
LRGESTK

SEQ ID NO: 2765426 - protein, 9 aa, Entamoeba invadens
LRGNAQPTQ

SEQ ID NO: 2765427 - protein, 5 aa, Entamoeba invadens
LRIEE

SEQ ID NO: 2765428 - protein, 6 aa, Entamoeba invadens
LRKAQE

SEQ ID NO: 2765429 - protein, 5 aa, Entamoeba invadens
LRKEK

SEQ ID NO: 2765430 - protein, 6 aa, Entamoeba invadens
LRKEKE

SEQ ID NO: 2765431 - protein, 13 aa, Entamoeba invadens
LRKENEEKQRLEN

SEQ ID NO: 2765432 - protein, 8 aa, Entamoeba invadens
LRKGSDEY

SEQ ID NO: 2765433 - protein, 11 aa, Entamoeba invadens
LRKNNGEDAKD

SEQ ID NO: 2765434 - protein, 8 aa, Entamoeba invadens
LRKPNEIG

SEQ ID NO: 2765435 - protein, 8 aa, Entamoeba invadens
LRKSDLAA

SEQ ID NO: 2765436 - protein, 25 aa, Entamoeba invadens
LRKSKRGSGLREEKLNSEKRESLKN

SEQ ID NO: 2765437 - protein, 4 aa, Entamoeba invadens
LRND

SEQ ID NO: 2765438 - protein, 39 aa, Entamoeba invadens
LRNEARDLQRDGTRYGPINDGGYTPHSSDDEDDLDEDNG

SEQ ID NO: 2765439 - protein, 10 aa, Entamoeba invadens
LRNKTNKKLK

SEQ ID NO: 2765440 - protein, 5 aa, Entamoeba invadens
LRNNS

SEQ ID NO: 2765441 - protein, 32 aa, Entamoeba invadens
LRNQMKDAKEKTKKSKKSQKDKSIDKPKSMKT

SEQ ID NO: 2765442 - protein, 8 aa, Entamoeba invadens
LRNSNISA

SEQ ID NO: 2765443 - protein, 10 aa, Entamoeba invadens
LRPNTTSGKC

SEQ ID NO: 2765444 - protein, 12 aa, Entamoeba invadens
LRPQPSIQPHGT

SEQ ID NO: 2765445 - protein, 12 aa, Entamoeba invadens
LRPSLDDVDEKV

SEQ ID NO: 2765446 - protein, 5 aa, Entamoeba invadens
LRPTY

SEQ ID NO: 2765447 - protein, 8 aa, Entamoeba invadens
LRQDKEDY

SEQ ID NO: 2765448 - protein, 7 aa, Entamoeba invadens
LRQDKQD

SEQ ID NO: 2765449 - protein, 6 aa, Entamoeba invadens
LRQKED

SEQ ID NO: 2765450 - protein, 14 aa, Entamoeba invadens
LRQPDDEEEEQKSD

SEQ ID NO: 2765451 - protein, 4 aa, Entamoeba invadens
LRQQ

SEQ ID NO: 2765452 - protein, 12 aa, Entamoeba invadens
LRRAQEKVEGRD

SEQ ID NO: 2765453 - protein, 7 aa, Entamoeba invadens
LRRPGDV

SEQ ID NO: 2765454 - protein, 14 aa, Entamoeba invadens
LRSAPSKKAKHSID

SEQ ID NO: 2765455 - protein, 34 aa, Entamoeba invadens
LRSASSSAEGSTHNSERKPLAKGKGTELNSVPTF

SEQ ID NO: 2765456 - protein, 10 aa, Entamoeba invadens
LRSKKSASLN

SEQ ID NO: 2765457 - protein, 8 aa, Entamoeba invadens
LRSNKEDY

SEQ ID NO: 2765458 - protein, 11 aa, Entamoeba invadens
LRSNKSSIKES

SEQ ID NO: 2765459 - protein, 8 aa, Entamoeba invadens
LRSQDRRE

SEQ ID NO: 2765460 - protein, 17 aa, Entamoeba invadens
LRSRSNKQLKGAAITKY

SEQ ID NO: 2765461 - protein, 4 aa, Entamoeba invadens
LRSS

SEQ ID NO: 2765462 - protein, 23 aa, Entamoeba invadens
LRSSDGKSCDKCDESCRTCGNDG

SEQ ID NO: 2765463 - protein, 9 aa, Entamoeba invadens
LRSSDGSTC

SEQ ID NO: 2765464 - protein, 6 aa, Entamoeba invadens
LRSSSE

SEQ ID NO: 2765465 - protein, 6 aa, Entamoeba invadens
LRTDDN

SEQ ID NO: 2765466 - protein, 5 aa, Entamoeba invadens
LRTRG

SEQ ID NO: 2765467 - protein, 4 aa, Entamoeba invadens
LRTS

SEQ ID NO: 2765468 - protein, 16 aa, Entamoeba invadens
LSADPTTVKGISGERV

SEQ ID NO: 2765469 - protein, 4 aa, Entamoeba invadens
LSAG

SEQ ID NO: 2765470 - protein, 6 aa, Entamoeba invadens
LSAGEI

SEQ ID NO: 2765471 - protein, 9 aa, Entamoeba invadens
LSAQTSAKM

SEQ ID NO: 2765472 - protein, 7 aa, Entamoeba invadens
LSASSSS

SEQ ID NO: 2765473 - protein, 11 aa, Entamoeba invadens
LSCEECSSSIQ

SEQ ID NO: 2765474 - protein, 6 aa, Entamoeba invadens
LSCGQN

SEQ ID NO: 2765475 - protein, 13 aa, Entamoeba invadens
LSCNKDQKYDFNT

SEQ ID NO: 2765476 - protein, 5 aa, Entamoeba invadens
LSCQR

SEQ ID NO: 2765477 - protein, 25 aa, Entamoeba invadens
LSDDETPKETEKKTPRKSPSPFPDI

SEQ ID NO: 2765478 - protein, 13 aa, Entamoeba invadens
LSDENAEASSETI

SEQ ID NO: 2765479 - protein, 9 aa, Entamoeba invadens
LSDEQKKRM

SEQ ID NO: 2765480 - protein, 19 aa, Entamoeba invadens
LSDESPEISSSTSEEDAYF

SEQ ID NO: 2765481 - protein, 8 aa, Entamoeba invadens
LSDFGSSR

SEQ ID NO: 2765482 - protein, 13 aa, Entamoeba invadens
LSDFGSSRNVNRA

SEQ ID NO: 2765483 - protein, 6 aa, Entamoeba invadens
LSDNEI

SEQ ID NO: 2765484 - protein, 41 aa, Entamoeba invadens
LSDPPSPTRFNSNSNSSSNTMKKDDEIDGFDQNNKNSPEIQ

SEQ ID NO: 2765485 - protein, 8 aa, Entamoeba invadens
LSDPQNIP

SEQ ID NO: 2765486 - protein, 6 aa, Entamoeba invadens
LSDRSL

SEQ ID NO: 2765487 - protein, 5 aa, Entamoeba invadens
LSDSV

SEQ ID NO: 2765488 - protein, 4 aa, Entamoeba invadens
LSDT

SEQ ID NO: 2765489 - protein, 5 aa, Entamoeba invadens
LSDTD

SEQ ID NO: 2765490 - protein, 8 aa, Entamoeba invadens
LSDTGAST

SEQ ID NO: 2765491 - protein, 7 aa, Entamoeba invadens
LSDTQMS

SEQ ID NO: 2765492 - protein, 9 aa, Entamoeba invadens
LSEDAKAGA

SEQ ID NO: 2765493 - protein, 6 aa, Entamoeba invadens
LSEDLT

SEQ ID NO: 2765494 - protein, 8 aa, Entamoeba invadens
LSEDNFRD

SEQ ID NO: 2765495 - protein, 22 aa, Entamoeba invadens
LSEENDTTNVNSSSKTTTEYDD

SEQ ID NO: 2765496 - protein, 8 aa, Entamoeba invadens
LSEGSSVE

SEQ ID NO: 2765497 - protein, 7 aa, Entamoeba invadens
LSENEYS

SEQ ID NO: 2765498 - protein, 8 aa, Entamoeba invadens
LSENPNVT

SEQ ID NO: 2765499 - protein, 4 aa, Entamoeba invadens
LSEP

SEQ ID NO: 2765500 - protein, 7 aa, Entamoeba invadens
LSEPNDQ

SEQ ID NO: 2765501 - protein, 9 aa, Entamoeba invadens
LSEPNKKKI

SEQ ID NO: 2765502 - protein, 6 aa, Entamoeba invadens
LSEQRH

SEQ ID NO: 2765503 - protein, 10 aa, Entamoeba invadens
LSESASAIEE

SEQ ID NO: 2765504 - protein, 12 aa, Entamoeba invadens
LSETTKKRRCEI

SEQ ID NO: 2765505 - protein, 4 aa, Entamoeba invadens
LSEV

SEQ ID NO: 2765506 - protein, 19 aa, Entamoeba invadens
LSEYDQSEDRDKQELDEQQ

SEQ ID NO: 2765507 - protein, 11 aa, Entamoeba invadens
LSFSSDKETTI

SEQ ID NO: 2765508 - protein, 13 aa, Entamoeba invadens
LSGASKSGLPTNE

SEQ ID NO: 2765509 - protein, 12 aa, Entamoeba invadens
LSGASSCSSCDS

SEQ ID NO: 2765510 - protein, 21 aa, Entamoeba invadens
LSGASSCSSCDSKCDGCTVTT

SEQ ID NO: 2765511 - protein, 5 aa, Entamoeba invadens
LSGDA

SEQ ID NO: 2765512 - protein, 8 aa, Entamoeba invadens
LSGEEDDN

SEQ ID NO: 2765513 - protein, 6 aa, Entamoeba invadens
LSGETV

SEQ ID NO: 2765514 - protein, 5 aa, Entamoeba invadens
LSGEV

SEQ ID NO: 2765515 - protein, 13 aa, Entamoeba invadens
LSGGAAADDECIA

SEQ ID NO: 2765516 - protein, 6 aa, Entamoeba invadens
LSGGPF

SEQ ID NO: 2765517 - protein, 8 aa, Entamoeba invadens
LSGGPGDL

SEQ ID NO: 2765518 - protein, 9 aa, Entamoeba invadens
LSGISGGRF

SEQ ID NO: 2765519 - protein, 7 aa, Entamoeba invadens
LSGISSK

SEQ ID NO: 2765520 - protein, 4 aa, Entamoeba invadens
LSGN

SEQ ID NO: 2765521 - protein, 8 aa, Entamoeba invadens
LSGNCTQC

SEQ ID NO: 2765522 - protein, 7 aa, Entamoeba invadens
LSGNNNA

SEQ ID NO: 2765523 - protein, 8 aa, Entamoeba invadens
LSGPAGTL

SEQ ID NO: 2765524 - protein, 8 aa, Entamoeba invadens
LSGRCSQK

SEQ ID NO: 2765525 - protein, 4 aa, Entamoeba invadens
LSGS

SEQ ID NO: 2765526 - protein, 7 aa, Entamoeba invadens
LSGSESK

SEQ ID NO: 2765527 - protein, 7 aa, Entamoeba invadens
LSGSGLE

SEQ ID NO: 2765528 - protein, 9 aa, Entamoeba invadens
LSGSQSCTE

SEQ ID NO: 2765529 - protein, 7 aa, Entamoeba invadens
LSGSSGC

SEQ ID NO: 2765530 - protein, 5 aa, Entamoeba invadens
LSGST

SEQ ID NO: 2765531 - protein, 5 aa, Entamoeba invadens
LSGTA

SEQ ID NO: 2765532 - protein, 6 aa, Entamoeba invadens
LSGTAL

SEQ ID NO: 2765533 - protein, 8 aa, Entamoeba invadens
LSGTDRQM

SEQ ID NO: 2765534 - protein, 11 aa, Entamoeba invadens
LSGTLTSKSIT

SEQ ID NO: 2765535 - protein, 8 aa, Entamoeba invadens
LSHQETGT

SEQ ID NO: 2765536 - protein, 6 aa, Entamoeba invadens
LSIANG

SEQ ID NO: 2765537 - protein, 4 aa, Entamoeba invadens
LSID

SEQ ID NO: 2765538 - protein, 6 aa, Entamoeba invadens
LSIDKS

SEQ ID NO: 2765539 - protein, 11 aa, Entamoeba invadens
LSIGENKISIN

SEQ ID NO: 2765540 - protein, 5 aa, Entamoeba invadens
LSITG

SEQ ID NO: 2765541 - protein, 23 aa, Entamoeba invadens
LSKDKDKGDLGDSPVISGRPSQV

SEQ ID NO: 2765542 - protein, 29 aa, Entamoeba invadens
LSKDNANNTETQTCSSTSDITCDKSSTHG

SEQ ID NO: 2765543 - protein, 6 aa, Entamoeba invadens
LSKEEY

SEQ ID NO: 2765544 - protein, 12 aa, Entamoeba invadens
LSKGKDPDVYKQ

SEQ ID NO: 2765545 - protein, 5 aa, Entamoeba invadens
LSKGT

SEQ ID NO: 2765546 - protein, 6 aa, Entamoeba invadens
LSKKQI

SEQ ID NO: 2765547 - protein, 7 aa, Entamoeba invadens
LSKNRLK

SEQ ID NO: 2765548 - protein, 9 aa, Entamoeba invadens
LSKNSGDRG

SEQ ID NO: 2765549 - protein, 8 aa, Entamoeba invadens
LSKQPKGI

SEQ ID NO: 2765550 - protein, 6 aa, Entamoeba invadens
LSKQRV

SEQ ID NO: 2765551 - protein, 8 aa, Entamoeba invadens
LSKQSIDK

SEQ ID NO: 2765552 - protein, 15 aa, Entamoeba invadens
LSKRAQKEQQKEEEI

SEQ ID NO: 2765553 - protein, 5 aa, Entamoeba invadens
LSKRS

SEQ ID NO: 2765554 - protein, 12 aa, Entamoeba invadens
LSKSKKKQVTTL

SEQ ID NO: 2765555 - protein, 9 aa, Entamoeba invadens
LSKSKPTKN

SEQ ID NO: 2765556 - protein, 14 aa, Entamoeba invadens
LSKSKREKLEREGK

SEQ ID NO: 2765557 - protein, 9 aa, Entamoeba invadens
LSKSSDKVK

SEQ ID NO: 2765558 - protein, 9 aa, Entamoeba invadens
LSKSSDSGL

SEQ ID NO: 2765559 - protein, 8 aa, Entamoeba invadens
LSKSSNWK

SEQ ID NO: 2765560 - protein, 10 aa, Entamoeba invadens
LSKSSQCQNS

SEQ ID NO: 2765561 - protein, 9 aa, Entamoeba invadens
LSKTPSDAF

SEQ ID NO: 2765562 - protein, 12 aa, Entamoeba invadens
LSKTTVEASMPD

SEQ ID NO: 2765563 - protein, 6 aa, Entamoeba invadens
LSKTYE

SEQ ID NO: 2765564 - protein, 18 aa, Entamoeba invadens
LSLDGSADVSTQSSTISQ

SEQ ID NO: 2765565 - protein, 6 aa, Entamoeba invadens
LSLSGT

SEQ ID NO: 2765566 - protein, 4 aa, Entamoeba invadens
LSNA

SEQ ID NO: 2765567 - protein, 9 aa, Entamoeba invadens
LSNARDEDI

SEQ ID NO: 2765568 - protein, 4 aa, Entamoeba invadens
LSND

SEQ ID NO: 2765569 - protein, 6 aa, Entamoeba invadens
LSNDDT

SEQ ID NO: 2765570 - protein, 7 aa, Entamoeba invadens
LSNDGNN

SEQ ID NO: 2765571 - protein, 15 aa, Entamoeba invadens
LSNEDNTCEVSSSKG

SEQ ID NO: 2765572 - protein, 27 aa, Entamoeba invadens
LSNETTKQTTKNEDTQTDSHCEVSTTK

SEQ ID NO: 2765573 - protein, 12 aa, Entamoeba invadens
LSNGTWDKNDCE

SEQ ID NO: 2765574 - protein, 7 aa, Entamoeba invadens
LSNKQQL

SEQ ID NO: 2765575 - protein, 12 aa, Entamoeba invadens
LSNNANCDNQNG

SEQ ID NO: 2765576 - protein, 9 aa, Entamoeba invadens
LSNNKQSTY

SEQ ID NO: 2765577 - protein, 11 aa, Entamoeba invadens
LSNSANCDNQN

SEQ ID NO: 2765578 - protein, 13 aa, Entamoeba invadens
LSNSGECKTCNSA

SEQ ID NO: 2765579 - protein, 11 aa, Entamoeba invadens
LSNTDNHTHRS

SEQ ID NO: 2765580 - protein, 11 aa, Entamoeba invadens
LSNTQQKKGES

SEQ ID NO: 2765581 - protein, 24 aa, Entamoeba invadens
LSNTSSDSLSVNSKKTKRQTNDGL

SEQ ID NO: 2765582 - protein, 14 aa, Entamoeba invadens
LSPAPEEKVKDDTL

SEQ ID NO: 2765583 - protein, 4 aa, Entamoeba invadens
LSPD

SEQ ID NO: 2765584 - protein, 11 aa, Entamoeba invadens
LSPEGKCERCD

SEQ ID NO: 2765585 - protein, 7 aa, Entamoeba invadens
LSPEKRV

SEQ ID NO: 2765586 - protein, 14 aa, Entamoeba invadens
LSPENRKQKIQNIE

SEQ ID NO: 2765587 - protein, 5 aa, Entamoeba invadens
LSPGM

SEQ ID NO: 2765588 - protein, 12 aa, Entamoeba invadens
LSPKESDIGDNY

SEQ ID NO: 2765589 - protein, 5 aa, Entamoeba invadens
LSPKN

SEQ ID NO: 2765590 - protein, 11 aa, Entamoeba invadens
LSPKTKATNNF

SEQ ID NO: 2765591 - protein, 15 aa, Entamoeba invadens
LSPNACNKIESNELY

SEQ ID NO: 2765592 - protein, 12 aa, Entamoeba invadens
LSPPQKGQKEYT

SEQ ID NO: 2765593 - protein, 5 aa, Entamoeba invadens
LSPQD

SEQ ID NO: 2765594 - protein, 15 aa, Entamoeba invadens
LSPRKTEEKHEEEGL

SEQ ID NO: 2765595 - protein, 16 aa, Entamoeba invadens
LSPRQGSQEKDVDENT

SEQ ID NO: 2765596 - protein, 6 aa, Entamoeba invadens
LSPSTV

SEQ ID NO: 2765597 - protein, 13 aa, Entamoeba invadens
LSPTLTKIGDSAF

SEQ ID NO: 2765598 - protein, 4 aa, Entamoeba invadens
LSQD

SEQ ID NO: 2765599 - protein, 17 aa, Entamoeba invadens
LSQDNATKEDIKKSYEH

SEQ ID NO: 2765600 - protein, 5 aa, Entamoeba invadens
LSQEK

SEQ ID NO: 2765601 - protein, 4 aa, Entamoeba invadens
LSQG

SEQ ID NO: 2765602 - protein, 6 aa, Entamoeba invadens
LSQGYE

SEQ ID NO: 2765603 - protein, 16 aa, Entamoeba invadens
LSQKNSTKEEKEPGDI

SEQ ID NO: 2765604 - protein, 7 aa, Entamoeba invadens
LSQKSQI

SEQ ID NO: 2765605 - protein, 9 aa, Entamoeba invadens
LSQKTSPEI

SEQ ID NO: 2765606 - protein, 6 aa, Entamoeba invadens
LSQKYQ

SEQ ID NO: 2765607 - protein, 15 aa, Entamoeba invadens
LSQNTCNKIESNELY

SEQ ID NO: 2765608 - protein, 16 aa, Entamoeba invadens
LSQNTCNKIESNELYK

SEQ ID NO: 2765609 - protein, 6 aa, Entamoeba invadens
LSQPKG

SEQ ID NO: 2765610 - protein, 4 aa, Entamoeba invadens
LSQQ

SEQ ID NO: 2765611 - protein, 18 aa, Entamoeba invadens
LSQSDAKCLTKNTKTNRC

SEQ ID NO: 2765612 - protein, 11 aa, Entamoeba invadens
LSQSNEEMSCE

SEQ ID NO: 2765613 - protein, 5 aa, Entamoeba invadens
LSQSS

SEQ ID NO: 2765614 - protein, 10 aa, Entamoeba invadens
LSQSSTTISG

SEQ ID NO: 2765615 - protein, 5 aa, Entamoeba invadens
LSQTD

SEQ ID NO: 2765616 - protein, 9 aa, Entamoeba invadens
LSQTKSAHN

SEQ ID NO: 2765617 - protein, 5 aa, Entamoeba invadens
LSQTT

SEQ ID NO: 2765618 - protein, 7 aa, Entamoeba invadens
LSRDSKL

SEQ ID NO: 2765619 - protein, 11 aa, Entamoeba invadens
LSRKTDKSLRI

SEQ ID NO: 2765620 - protein, 8 aa, Entamoeba invadens
LSRSEKPI

SEQ ID NO: 2765621 - protein, 11 aa, Entamoeba invadens
LSRSSLGTQKP

SEQ ID NO: 2765622 - protein, 10 aa, Entamoeba invadens
LSRSSLSDNQ

SEQ ID NO: 2765623 - protein, 9 aa, Entamoeba invadens
LSSAKATFN

SEQ ID NO: 2765624 - protein, 9 aa, Entamoeba invadens
LSSDPTNMK

SEQ ID NO: 2765625 - protein, 4 aa, Entamoeba invadens
LSSE

SEQ ID NO: 2765626 - protein, 10 aa, Entamoeba invadens
LSSEGPNSIC

SEQ ID NO: 2765627 - protein, 18 aa, Entamoeba invadens
LSSESIEASSSSTEEDAY

SEQ ID NO: 2765628 - protein, 7 aa, Entamoeba invadens
LSSFPSE

SEQ ID NO: 2765629 - protein, 11 aa, Entamoeba invadens
LSSGGSINAPN

SEQ ID NO: 2765630 - protein, 9 aa, Entamoeba invadens
LSSGPRGGK

SEQ ID NO: 2765631 - protein, 7 aa, Entamoeba invadens
LSSGTGC

SEQ ID NO: 2765632 - protein, 5 aa, Entamoeba invadens
LSSIN

SEQ ID NO: 2765633 - protein, 4 aa, Entamoeba invadens
LSSK

SEQ ID NO: 2765634 - protein, 6 aa, Entamoeba invadens
LSSKLD

SEQ ID NO: 2765635 - protein, 8 aa, Entamoeba invadens
LSSKLDPD

SEQ ID NO: 2765636 - protein, 11 aa, Entamoeba invadens
LSSKNNEESYH

SEQ ID NO: 2765637 - protein, 11 aa, Entamoeba invadens
LSSKNNFDNYP

SEQ ID NO: 2765638 - protein, 9 aa, Entamoeba invadens
LSSNGQREF

SEQ ID NO: 2765639 - protein, 8 aa, Entamoeba invadens
LSSNGTCK

SEQ ID NO: 2765640 - protein, 8 aa, Entamoeba invadens
LSSNKKSI

SEQ ID NO: 2765641 - protein, 16 aa, Entamoeba invadens
LSSPSTNKTYDFSDLD

SEQ ID NO: 2765642 - protein, 7 aa, Entamoeba invadens
LSSPTDL

SEQ ID NO: 2765643 - protein, 11 aa, Entamoeba invadens
LSSQENPNYQR

SEQ ID NO: 2765644 - protein, 9 aa, Entamoeba invadens
LSSQNKQKE

SEQ ID NO: 2765645 - protein, 4 aa, Entamoeba invadens
LSSS

SEQ ID NO: 2765646 - protein, 8 aa, Entamoeba invadens
LSSSLDDD

SEQ ID NO: 2765647 - protein, 7 aa, Entamoeba invadens
LSSSRSF

SEQ ID NO: 2765648 - protein, 8 aa, Entamoeba invadens
LSSSSGCE

SEQ ID NO: 2765649 - protein, 8 aa, Entamoeba invadens
LSSSSPPL

SEQ ID NO: 2765650 - protein, 8 aa, Entamoeba invadens
LSSSYTKG

SEQ ID NO: 2765651 - protein, 10 aa, Entamoeba invadens
LSSTAQTTIN

SEQ ID NO: 2765652 - protein, 6 aa, Entamoeba invadens
LSSTDT

SEQ ID NO: 2765653 - protein, 8 aa, Entamoeba invadens
LSSTNEDG

SEQ ID NO: 2765654 - protein, 7 aa, Entamoeba invadens
LSSTNSI

SEQ ID NO: 2765655 - protein, 7 aa, Entamoeba invadens
LSSTPLD

SEQ ID NO: 2765656 - protein, 12 aa, Entamoeba invadens
LSSTTSEELTPI

SEQ ID NO: 2765657 - protein, 8 aa, Entamoeba invadens
LSTAQASA

SEQ ID NO: 2765658 - protein, 5 aa, Entamoeba invadens
LSTDK

SEQ ID NO: 2765659 - protein, 8 aa, Entamoeba invadens
LSTDSLST

SEQ ID NO: 2765660 - protein, 9 aa, Entamoeba invadens
LSTDTTKFD

SEQ ID NO: 2765661 - protein, 16 aa, Entamoeba invadens
LSTDYTKVDEENTYYT

SEQ ID NO: 2765662 - protein, 19 aa, Entamoeba invadens
LSTEIGERGVTLSGGQKQR

SEQ ID NO: 2765663 - protein, 7 aa, Entamoeba invadens
LSTESDT

SEQ ID NO: 2765664 - protein, 4 aa, Entamoeba invadens
LSTF

SEQ ID NO: 2765665 - protein, 10 aa, Entamoeba invadens
LSTGKESANE

SEQ ID NO: 2765666 - protein, 9 aa, Entamoeba invadens
LSTGPKGGT

SEQ ID NO: 2765667 - protein, 5 aa, Entamoeba invadens
LSTIG

SEQ ID NO: 2765668 - protein, 16 aa, Entamoeba invadens
LSTKDKNDKYEIRTNP

SEQ ID NO: 2765669 - protein, 7 aa, Entamoeba invadens
LSTKLDH

SEQ ID NO: 2765670 - protein, 5 aa, Entamoeba invadens
LSTKR

SEQ ID NO: 2765671 - protein, 16 aa, Entamoeba invadens
LSTKSIEKTSRSPMEV

SEQ ID NO: 2765672 - protein, 9 aa, Entamoeba invadens
LSTKSKSVI

SEQ ID NO: 2765673 - protein, 5 aa, Entamoeba invadens
LSTKT

SEQ ID NO: 2765674 - protein, 4 aa, Entamoeba invadens
LSTN

SEQ ID NO: 2765675 - protein, 29 aa, Entamoeba invadens
LSTNSQSSHDEKEDKTDDNQIKTPELEVS

SEQ ID NO: 2765676 - protein, 4 aa, Entamoeba invadens
LSTQ

SEQ ID NO: 2765677 - protein, 10 aa, Entamoeba invadens
LSTQCTSCTE

SEQ ID NO: 2765678 - protein, 19 aa, Entamoeba invadens
LSTQQKSKVDIERRGSPVI

SEQ ID NO: 2765679 - protein, 7 aa, Entamoeba invadens
LSTRIDP

SEQ ID NO: 2765680 - protein, 9 aa, Entamoeba invadens
LSTRLDPDE

SEQ ID NO: 2765681 - protein, 11 aa, Entamoeba invadens
LSTRLDSDELI

SEQ ID NO: 2765682 - protein, 4 aa, Entamoeba invadens
LSTS

SEQ ID NO: 2765683 - protein, 6 aa, Entamoeba invadens
LSTSKK

SEQ ID NO: 2765684 - protein, 9 aa, Entamoeba invadens
LSTSPTISV

SEQ ID NO: 2765685 - protein, 7 aa, Entamoeba invadens
LSTSQNQ

SEQ ID NO: 2765686 - protein, 11 aa, Entamoeba invadens
LSTSSNSLTVT

SEQ ID NO: 2765687 - protein, 23 aa, Entamoeba invadens
LSTTDEYSSVKESDWERKTCPCE

SEQ ID NO: 2765688 - protein, 7 aa, Entamoeba invadens
LSTTSDI

SEQ ID NO: 2765689 - protein, 5 aa, Entamoeba invadens
LSTTT

SEQ ID NO: 2765690 - protein, 7 aa, Entamoeba invadens
LSTVSSG

SEQ ID NO: 2765691 - protein, 8 aa, Entamoeba invadens
LSVGPTNI

SEQ ID NO: 2765692 - protein, 7 aa, Entamoeba invadens
LSVQSGK

SEQ ID NO: 2765693 - protein, 17 aa, Entamoeba invadens
LSVSSNGTCTTSTTQME

SEQ ID NO: 2765694 - protein, 4 aa, Entamoeba invadens
LSYE

SEQ ID NO: 2765695 - protein, 10 aa, Entamoeba invadens
LSYGKDENKV

SEQ ID NO: 2765696 - protein, 23 aa, Entamoeba invadens
LTADNKCKACTKESKCKTCSESI

SEQ ID NO: 2765697 - protein, 8 aa, Entamoeba invadens
LTAEEKRN

SEQ ID NO: 2765698 - protein, 9 aa, Entamoeba invadens
LTAKKEQSC

SEQ ID NO: 2765699 - protein, 12 aa, Entamoeba invadens
LTARSAPPTNGN

SEQ ID NO: 2765700 - protein, 6 aa, Entamoeba invadens
LTASAN

SEQ ID NO: 2765701 - protein, 16 aa, Entamoeba invadens
LTASKETLEKQIAEQT

SEQ ID NO: 2765702 - protein, 12 aa, Entamoeba invadens
LTDDGAKSAALG

SEQ ID NO: 2765703 - protein, 6 aa, Entamoeba invadens
LTDEKL

SEQ ID NO: 2765704 - protein, 6 aa, Entamoeba invadens
LTDEQI

SEQ ID NO: 2765705 - protein, 9 aa, Entamoeba invadens
LTDESIQEF

SEQ ID NO: 2765706 - protein, 7 aa, Entamoeba invadens
LTDFGAS

SEQ ID NO: 2765707 - protein, 8 aa, Entamoeba invadens
LTDFGSRR

SEQ ID NO: 2765708 - protein, 10 aa, Entamoeba invadens
LTDFGSSRNI

SEQ ID NO: 2765709 - protein, 10 aa, Entamoeba invadens
LTDFGSSRNY

SEQ ID NO: 2765710 - protein, 9 aa, Entamoeba invadens
LTDFGTSRN

SEQ ID NO: 2765711 - protein, 11 aa, Entamoeba invadens
LTDGKNTSNAT

SEQ ID NO: 2765712 - protein, 11 aa, Entamoeba invadens
LTDNNSVNNGT

SEQ ID NO: 2765713 - protein, 10 aa, Entamoeba invadens
LTDRTTAKRQ

SEQ ID NO: 2765714 - protein, 6 aa, Entamoeba invadens
LTDSES

SEQ ID NO: 2765715 - protein, 6 aa, Entamoeba invadens
LTDSEV

SEQ ID NO: 2765716 - protein, 8 aa, Entamoeba invadens
LTDSPNVQ

SEQ ID NO: 2765717 - protein, 9 aa, Entamoeba invadens
LTDSPTDTF

SEQ ID NO: 2765718 - protein, 6 aa, Entamoeba invadens
LTDTTV

SEQ ID NO: 2765719 - protein, 5 aa, Entamoeba invadens
LTEAK

SEQ ID NO: 2765720 - protein, 7 aa, Entamoeba invadens
LTEDSSE

SEQ ID NO: 2765721 - protein, 4 aa, Entamoeba invadens
LTEH

SEQ ID NO: 2765722 - protein, 4 aa, Entamoeba invadens
LTEN

SEQ ID NO: 2765723 - protein, 8 aa, Entamoeba invadens
LTESEVNK

SEQ ID NO: 2765724 - protein, 11 aa, Entamoeba invadens
LTESSCNSITN

SEQ ID NO: 2765725 - protein, 6 aa, Entamoeba invadens
LTETTQ

SEQ ID NO: 2765726 - protein, 4 aa, Entamoeba invadens
LTFE

SEQ ID NO: 2765727 - protein, 12 aa, Entamoeba invadens
LTFPKPKSTPTV

SEQ ID NO: 2765728 - protein, 6 aa, Entamoeba invadens
LTFSND

SEQ ID NO: 2765729 - protein, 9 aa, Entamoeba invadens
LTGAQTTAA

SEQ ID NO: 2765730 - protein, 7 aa, Entamoeba invadens
LTGETTK

SEQ ID NO: 2765731 - protein, 13 aa, Entamoeba invadens
LTGKEGVKTKKRA

SEQ ID NO: 2765732 - protein, 16 aa, Entamoeba invadens
LTGKSTYKDISQRVGG

SEQ ID NO: 2765733 - protein, 7 aa, Entamoeba invadens
LTGSSIA

SEQ ID NO: 2765734 - protein, 11 aa, Entamoeba invadens
LTGSSPECNGT

SEQ ID NO: 2765735 - protein, 5 aa, Entamoeba invadens
LTGST

SEQ ID NO: 2765736 - protein, 12 aa, Entamoeba invadens
LTGSTTCKSCSS

SEQ ID NO: 2765737 - protein, 13 aa, Entamoeba invadens
LTGVTDPKKVVSN

SEQ ID NO: 2765738 - protein, 7 aa, Entamoeba invadens
LTIPQGT

SEQ ID NO: 2765739 - protein, 14 aa, Entamoeba invadens
LTIQDGGKAVSGND

SEQ ID NO: 2765740 - protein, 6 aa, Entamoeba invadens
LTITEN

SEQ ID NO: 2765741 - protein, 11 aa, Entamoeba invadens
LTKDNNNNTDV

SEQ ID NO: 2765742 - protein, 12 aa, Entamoeba invadens
LTKDNNNNTEVN

SEQ ID NO: 2765743 - protein, 4 aa, Entamoeba invadens
LTKE

SEQ ID NO: 2765744 - protein, 12 aa, Entamoeba invadens
LTKEHDKPLKPT

SEQ ID NO: 2765745 - protein, 4 aa, Entamoeba invadens
LTKF

SEQ ID NO: 2765746 - protein, 12 aa, Entamoeba invadens
LTKGQREPSTNY

SEQ ID NO: 2765747 - protein, 10 aa, Entamoeba invadens
LTKIDTNGVD

SEQ ID NO: 2765748 - protein, 14 aa, Entamoeba invadens
LTKKNVKQAQQELS

SEQ ID NO: 2765749 - protein, 12 aa, Entamoeba invadens
LTKNNNNNTEVN

SEQ ID NO: 2765750 - protein, 17 aa, Entamoeba invadens
LTKQKNAKLKRNSTDSK

SEQ ID NO: 2765751 - protein, 20 aa, Entamoeba invadens
LTKQLKSNYNEVSKQSEIEK

SEQ ID NO: 2765752 - protein, 6 aa, Entamoeba invadens
LTKRYN

SEQ ID NO: 2765753 - protein, 10 aa, Entamoeba invadens
LTKSNMDNVS

SEQ ID NO: 2765754 - protein, 32 aa, Entamoeba invadens
LTKTDTSPSPRSSLFSPKSRTSFKEKVAQQNY

SEQ ID NO: 2765755 - protein, 6 aa, Entamoeba invadens
LTLDNN

SEQ ID NO: 2765756 - protein, 9 aa, Entamoeba invadens
LTLGSTSGV

SEQ ID NO: 2765757 - protein, 13 aa, Entamoeba invadens
LTLNGNTGKTNGY

SEQ ID NO: 2765758 - protein, 9 aa, Entamoeba invadens
LTLSNDQTK

SEQ ID NO: 2765759 - protein, 9 aa, Entamoeba invadens
LTLSNGGYD

SEQ ID NO: 2765760 - protein, 9 aa, Entamoeba invadens
LTMNDNSTI

SEQ ID NO: 2765761 - protein, 5 aa, Entamoeba invadens
LTMNG

SEQ ID NO: 2765762 - protein, 4 aa, Entamoeba invadens
LTMP

SEQ ID NO: 2765763 - protein, 10 aa, Entamoeba invadens
LTNAQNECVN

SEQ ID NO: 2765764 - protein, 7 aa, Entamoeba invadens
LTNCNQN

SEQ ID NO: 2765765 - protein, 8 aa, Entamoeba invadens
LTNDTIKN

SEQ ID NO: 2765766 - protein, 6 aa, Entamoeba invadens
LTNEQS

SEQ ID NO: 2765767 - protein, 7 aa, Entamoeba invadens
LTNKNNV

SEQ ID NO: 2765768 - protein, 9 aa, Entamoeba invadens
LTNKQAREI

SEQ ID NO: 2765769 - protein, 23 aa, Entamoeba invadens
LTNKSELTFSENGELNKIDTESR

SEQ ID NO: 2765770 - protein, 9 aa, Entamoeba invadens
LTNKTTRND

SEQ ID NO: 2765771 - protein, 7 aa, Entamoeba invadens
LTNLPQD

SEQ ID NO: 2765772 - protein, 12 aa, Entamoeba invadens
LTNNANDKNEVD

SEQ ID NO: 2765773 - protein, 6 aa, Entamoeba invadens
LTNNTP

SEQ ID NO: 2765774 - protein, 10 aa, Entamoeba invadens
LTNPEKNKIT

SEQ ID NO: 2765775 - protein, 6 aa, Entamoeba invadens
LTNPES

SEQ ID NO: 2765776 - protein, 12 aa, Entamoeba invadens
LTNPPSGSSTSN

SEQ ID NO: 2765777 - protein, 5 aa, Entamoeba invadens
LTNPV

SEQ ID NO: 2765778 - protein, 5 aa, Entamoeba invadens
LTNRQ

SEQ ID NO: 2765779 - protein, 4 aa, Entamoeba invadens
LTNS

SEQ ID NO: 2765780 - protein, 4 aa, Entamoeba invadens
LTNT

SEQ ID NO: 2765781 - protein, 5 aa, Entamoeba invadens
LTNTE

SEQ ID NO: 2765782 - protein, 5 aa, Entamoeba invadens
LTNTR

SEQ ID NO: 2765783 - protein, 9 aa, Entamoeba invadens
LTPDQKSFT

SEQ ID NO: 2765784 - protein, 5 aa, Entamoeba invadens
LTPEE

SEQ ID NO: 2765785 - protein, 5 aa, Entamoeba invadens
LTPEK

SEQ ID NO: 2765786 - protein, 7 aa, Entamoeba invadens
LTPEKDR

SEQ ID NO: 2765787 - protein, 5 aa, Entamoeba invadens
LTPEL

SEQ ID NO: 2765788 - protein, 4 aa, Entamoeba invadens
LTPL

SEQ ID NO: 2765789 - protein, 10 aa, Entamoeba invadens
LTPNNADNTI

SEQ ID NO: 2765790 - protein, 11 aa, Entamoeba invadens
LTPPESPLDSF

SEQ ID NO: 2765791 - protein, 10 aa, Entamoeba invadens
LTPPKNEGER

SEQ ID NO: 2765792 - protein, 5 aa, Entamoeba invadens
LTPPT

SEQ ID NO: 2765793 - protein, 7 aa, Entamoeba invadens
LTPPVNK

SEQ ID NO: 2765794 - protein, 4 aa, Entamoeba invadens
LTPQ

SEQ ID NO: 2765795 - protein, 6 aa, Entamoeba invadens
LTPQEM

SEQ ID NO: 2765796 - protein, 4 aa, Entamoeba invadens
LTPS

SEQ ID NO: 2765797 - protein, 5 aa, Entamoeba invadens
LTPSE

SEQ ID NO: 2765798 - protein, 5 aa, Entamoeba invadens
LTPST

SEQ ID NO: 2765799 - protein, 5 aa, Entamoeba invadens
LTPTE

SEQ ID NO: 2765800 - protein, 8 aa, Entamoeba invadens
LTPTQKER

SEQ ID NO: 2765801 - protein, 10 aa, Entamoeba invadens
LTPTSYIGSD

SEQ ID NO: 2765802 - protein, 15 aa, Entamoeba invadens
LTQEEFDASQSYQLD

SEQ ID NO: 2765803 - protein, 7 aa, Entamoeba invadens
LTQEGDR

SEQ ID NO: 2765804 - protein, 27 aa, Entamoeba invadens
LTQEKENLEKEKIEQTNKAKEITEEQV

SEQ ID NO: 2765805 - protein, 11 aa, Entamoeba invadens
LTQGIGTPTYM

SEQ ID NO: 2765806 - protein, 4 aa, Entamoeba invadens
LTQI

SEQ ID NO: 2765807 - protein, 22 aa, Entamoeba invadens
LTQKADKYTTSAGGQAESTIGN

SEQ ID NO: 2765808 - protein, 29 aa, Entamoeba invadens
LTQKEEGKETENTSKIPDQKEAAKALQSV

SEQ ID NO: 2765809 - protein, 4 aa, Entamoeba invadens
LTQN

SEQ ID NO: 2765810 - protein, 7 aa, Entamoeba invadens
LTQNDKT

SEQ ID NO: 2765811 - protein, 4 aa, Entamoeba invadens
LTQS

SEQ ID NO: 2765812 - protein, 8 aa, Entamoeba invadens
LTQSEMPD

SEQ ID NO: 2765813 - protein, 6 aa, Entamoeba invadens
LTQSGS

SEQ ID NO: 2765814 - protein, 13 aa, Entamoeba invadens
LTQSGTSGTISAD

SEQ ID NO: 2765815 - protein, 6 aa, Entamoeba invadens
LTQSNG

SEQ ID NO: 2765816 - protein, 10 aa, Entamoeba invadens
LTQTKCTSCE

SEQ ID NO: 2765817 - protein, 7 aa, Entamoeba invadens
LTQTPRY

SEQ ID NO: 2765818 - protein, 6 aa, Entamoeba invadens
LTQTPT

SEQ ID NO: 2765819 - protein, 20 aa, Entamoeba invadens
LTQTSTNAIQPGCLDSSKTS

SEQ ID NO: 2765820 - protein, 9 aa, Entamoeba invadens
LTRDQYADF

SEQ ID NO: 2765821 - protein, 12 aa, Entamoeba invadens
LTRENITTGATL

SEQ ID NO: 2765822 - protein, 12 aa, Entamoeba invadens
LTREVGSCQANT

SEQ ID NO: 2765823 - protein, 7 aa, Entamoeba invadens
LTRPSEC

SEQ ID NO: 2765824 - protein, 19 aa, Entamoeba invadens
LTSDEKNVHVTPSREKKEL

SEQ ID NO: 2765825 - protein, 7 aa, Entamoeba invadens
LTSEEVE

SEQ ID NO: 2765826 - protein, 12 aa, Entamoeba invadens
LTSEPDETTPLN

SEQ ID NO: 2765827 - protein, 5 aa, Entamoeba invadens
LTSES

SEQ ID NO: 2765828 - protein, 5 aa, Entamoeba invadens
LTSGE

SEQ ID NO: 2765829 - protein, 12 aa, Entamoeba invadens
LTSGGCESCNKF

SEQ ID NO: 2765830 - protein, 7 aa, Entamoeba invadens
LTSGGTC

SEQ ID NO: 2765831 - protein, 12 aa, Entamoeba invadens
LTSGKTSESQIQ

SEQ ID NO: 2765832 - protein, 7 aa, Entamoeba invadens
LTSGMSG

SEQ ID NO: 2765833 - protein, 10 aa, Entamoeba invadens
LTSITTENEM

SEQ ID NO: 2765834 - protein, 10 aa, Entamoeba invadens
LTSNKSDYYD

SEQ ID NO: 2765835 - protein, 8 aa, Entamoeba invadens
LTSPANNW

SEQ ID NO: 2765836 - protein, 28 aa, Entamoeba invadens
LTSPKPSTPPHSNSEIVPSDPTRPISTH

SEQ ID NO: 2765837 - protein, 4 aa, Entamoeba invadens
LTSS

SEQ ID NO: 2765838 - protein, 9 aa, Entamoeba invadens
LTSSKSGNC

SEQ ID NO: 2765839 - protein, 9 aa, Entamoeba invadens
LTSSNGDIT

SEQ ID NO: 2765840 - protein, 16 aa, Entamoeba invadens
LTSSNNCTKDEKCKYQ

SEQ ID NO: 2765841 - protein, 31 aa, Entamoeba invadens
LTSSQQERRDKKKKQNKENTEKKPKHDNENE

SEQ ID NO: 2765842 - protein, 5 aa, Entamoeba invadens
LTSTL

SEQ ID NO: 2765843 - protein, 7 aa, Entamoeba invadens
LTSTTPV

SEQ ID NO: 2765844 - protein, 11 aa, Entamoeba invadens
LTSYSTSVNEG

SEQ ID NO: 2765845 - protein, 12 aa, Entamoeba invadens
LTTDEGKNTTGY

SEQ ID NO: 2765846 - protein, 9 aa, Entamoeba invadens
LTTDSNRVQ

SEQ ID NO: 2765847 - protein, 4 aa, Entamoeba invadens
LTTE

SEQ ID NO: 2765848 - protein, 10 aa, Entamoeba invadens
LTTEGQKTAG

SEQ ID NO: 2765849 - protein, 10 aa, Entamoeba invadens
LTTESGNDDV

SEQ ID NO: 2765850 - protein, 9 aa, Entamoeba invadens
LTTGETSEI

SEQ ID NO: 2765851 - protein, 10 aa, Entamoeba invadens
LTTKDECDKC

SEQ ID NO: 2765852 - protein, 5 aa, Entamoeba invadens
LTTLQ

SEQ ID NO: 2765853 - protein, 4 aa, Entamoeba invadens
LTTN

SEQ ID NO: 2765854 - protein, 11 aa, Entamoeba invadens
LTTNEGSIGAN

SEQ ID NO: 2765855 - protein, 6 aa, Entamoeba invadens
LTTNEN

SEQ ID NO: 2765856 - protein, 8 aa, Entamoeba invadens
LTTNKEIS

SEQ ID NO: 2765857 - protein, 6 aa, Entamoeba invadens
LTTNRI

SEQ ID NO: 2765858 - protein, 12 aa, Entamoeba invadens
LTTNYYAGKEKG

SEQ ID NO: 2765859 - protein, 7 aa, Entamoeba invadens
LTTQEVK

SEQ ID NO: 2765860 - protein, 9 aa, Entamoeba invadens
LTTRPSTSH

SEQ ID NO: 2765861 - protein, 8 aa, Entamoeba invadens
LTTRTPNY

SEQ ID NO: 2765862 - protein, 11 aa, Entamoeba invadens
LTTSCSTPSPY

SEQ ID NO: 2765863 - protein, 10 aa, Entamoeba invadens
LTTSEGMGEV

SEQ ID NO: 2765864 - protein, 10 aa, Entamoeba invadens
LTTSSTGTLT

SEQ ID NO: 2765865 - protein, 7 aa, Entamoeba invadens
LTTSSVN

SEQ ID NO: 2765866 - protein, 10 aa, Entamoeba invadens
LTTSTKTRNI

SEQ ID NO: 2765867 - protein, 6 aa, Entamoeba invadens
LTTTDE

SEQ ID NO: 2765868 - protein, 7 aa, Entamoeba invadens
LTTTPVT

SEQ ID NO: 2765869 - protein, 6 aa, Entamoeba invadens
LTTTTN

SEQ ID NO: 2765870 - protein, 15 aa, Entamoeba invadens
LTTTVATEKVGKFTD

SEQ ID NO: 2765871 - protein, 4 aa, Entamoeba invadens
LTTY

SEQ ID NO: 2765872 - protein, 11 aa, Entamoeba invadens
LTVGSTGDCAT

SEQ ID NO: 2765873 - protein, 7 aa, Entamoeba invadens
LTVNSNS

SEQ ID NO: 2765874 - protein, 8 aa, Entamoeba invadens
LTVPKKNT

SEQ ID NO: 2765875 - protein, 26 aa, Entamoeba invadens
LTVPTTTEPPVEQQSEQKTQDGQPVQ

SEQ ID NO: 2765876 - protein, 12 aa, Entamoeba invadens
LTVSSGKIQVGS

SEQ ID NO: 2765877 - protein, 8 aa, Entamoeba invadens
LTYNTNTN

SEQ ID NO: 2765878 - protein, 13 aa, Entamoeba invadens
LTYNTNTNTCEEY

SEQ ID NO: 2765879 - protein, 12 aa, Entamoeba invadens
LTYNTNTNTCEK

SEQ ID NO: 2765880 - protein, 16 aa, Entamoeba invadens
LVDPKAKKEEVEDPIQ

SEQ ID NO: 2765881 - protein, 10 aa, Entamoeba invadens
LVEKNDEGNT

SEQ ID NO: 2765882 - protein, 8 aa, Entamoeba invadens
LVENSKQT

SEQ ID NO: 2765883 - protein, 6 aa, Entamoeba invadens
LVKQPC

SEQ ID NO: 2765884 - protein, 8 aa, Entamoeba invadens
LVNATDSI

SEQ ID NO: 2765885 - protein, 9 aa, Entamoeba invadens
LVPQQKTQL

SEQ ID NO: 2765886 - protein, 13 aa, Entamoeba invadens
LVQTPSDISDSEI

SEQ ID NO: 2765887 - protein, 11 aa, Entamoeba invadens
LVSNDGNLNRC

SEQ ID NO: 2765888 - protein, 23 aa, Entamoeba invadens
LVSNKSKLTFKDEAEQIPVGEES

SEQ ID NO: 2765889 - protein, 5 aa, Entamoeba invadens
LVSNQ

SEQ ID NO: 2765890 - protein, 13 aa, Entamoeba invadens
LVSTQKSDKKKKM

SEQ ID NO: 2765891 - protein, 4 aa, Entamoeba invadens
LVTS

SEQ ID NO: 2765892 - protein, 6 aa, Entamoeba invadens
LWPTTG

SEQ ID NO: 2765893 - protein, 9 aa, Entamoeba invadens
LYAKNGECY

SEQ ID NO: 2765894 - protein, 11 aa, Entamoeba invadens
LYDQKDNSCST

SEQ ID NO: 2765895 - protein, 7 aa, Entamoeba invadens
LYDQNET

SEQ ID NO: 2765896 - protein, 21 aa, Entamoeba invadens
LYDSSDRYIRTEECDNGTNCN

SEQ ID NO: 2765897 - protein, 10 aa, Entamoeba invadens
LYEQSDNSCT

SEQ ID NO: 2765898 - protein, 9 aa, Entamoeba invadens
LYESTDKNI

SEQ ID NO: 2765899 - protein, 11 aa, Entamoeba invadens
LYESTGTTYFR

SEQ ID NO: 2765900 - protein, 16 aa, Entamoeba invadens
LYKSSEVCENGRPTKC

SEQ ID NO: 2765901 - protein, 6 aa, Entamoeba invadens
LYNEKS

SEQ ID NO: 2765902 - protein, 9 aa, Entamoeba invadens
LYPNDSGKC

SEQ ID NO: 2765903 - protein, 19 aa, Entamoeba invadens
LYPPFNKKQNLEKSFQETS

SEQ ID NO: 2765904 - protein, 17 aa, Entamoeba invadens
LYPPQEVPKNTTGTYDK

SEQ ID NO: 2765905 - protein, 11 aa, Entamoeba invadens
LYQPESNQTSC

SEQ ID NO: 2765906 - protein, 7 aa, Entamoeba invadens
LYTENST

SEQ ID NO: 2765907 - protein, 6 aa, Entamoeba invadens
MADRGN

SEQ ID NO: 2765908 - protein, 4 aa, Entamoeba invadens
MAEE

SEQ ID NO: 2765909 - protein, 16 aa, Entamoeba invadens
MAEGEQLDAKHEEKKV

SEQ ID NO: 2765910 - protein, 4 aa, Entamoeba invadens
MAER

SEQ ID NO: 2765911 - protein, 12 aa, Entamoeba invadens
MAESEKVELNTS

SEQ ID NO: 2765912 - protein, 8 aa, Entamoeba invadens
MAKNGKTC

SEQ ID NO: 2765913 - protein, 8 aa, Entamoeba invadens
MAKNSKCS

SEQ ID NO: 2765914 - protein, 6 aa, Entamoeba invadens
MANEEQ

SEQ ID NO: 2765915 - protein, 5 aa, Entamoeba invadens
MANPS

SEQ ID NO: 2765916 - protein, 28 aa, Entamoeba invadens
MANQTTNKCDTCKAGTYAGEGSSECKKC

SEQ ID NO: 2765917 - protein, 27 aa, Entamoeba invadens
MANQTTNKCDTCKAGTYAGEGSSECKR

SEQ ID NO: 2765918 - protein, 28 aa, Entamoeba invadens
MANQTTNKCDTCKAGTYAGEGSSECNSC

SEQ ID NO: 2765919 - protein, 28 aa, Entamoeba invadens
MANQTTNTCDTCKAGTYAGQGSSECKKC

SEQ ID NO: 2765920 - protein, 10 aa, Entamoeba invadens
MASDTSSVED

SEQ ID NO: 2765921 - protein, 7 aa, Entamoeba invadens
MASTPSD

SEQ ID NO: 2765922 - protein, 6 aa, Entamoeba invadens
MATPSG

SEQ ID NO: 2765923 - protein, 11 aa, Entamoeba invadens
MCDRKGSTHTC

SEQ ID NO: 2765924 - protein, 7 aa, Entamoeba invadens
MCEESSA

SEQ ID NO: 2765925 - protein, 6 aa, Entamoeba invadens
MCSTEC

SEQ ID NO: 2765926 - protein, 6 aa, Entamoeba invadens
MDASAC

SEQ ID NO: 2765927 - protein, 19 aa, Entamoeba invadens
MDASSAAFKIDDDKPITPE

SEQ ID NO: 2765928 - protein, 4 aa, Entamoeba invadens
MDAT

SEQ ID NO: 2765929 - protein, 7 aa, Entamoeba invadens
MDDDDSR

SEQ ID NO: 2765930 - protein, 17 aa, Entamoeba invadens
MDDTSNSTTSVKDEATF

SEQ ID NO: 2765931 - protein, 12 aa, Entamoeba invadens
MDDTTLSYADGN

SEQ ID NO: 2765932 - protein, 9 aa, Entamoeba invadens
MDEETTQST

SEQ ID NO: 2765933 - protein, 15 aa, Entamoeba invadens
MDEKEVELTTSIDAQ

SEQ ID NO: 2765934 - protein, 7 aa, Entamoeba invadens
MDENGKC

SEQ ID NO: 2765935 - protein, 8 aa, Entamoeba invadens
MDENPPEE

SEQ ID NO: 2765936 - protein, 8 aa, Entamoeba invadens
MDETYNKD

SEQ ID NO: 2765937 - protein, 43 aa, Entamoeba invadens
MDKAEGHVDDKEEKKETPMSEEPKKVEESKAQKLDLSSPESSS

SEQ ID NO: 2765938 - protein, 8 aa, Entamoeba invadens
MDKGSSLE

SEQ ID NO: 2765939 - protein, 13 aa, Entamoeba invadens
MDKTTTSCKTENY

SEQ ID NO: 2765940 - protein, 7 aa, Entamoeba invadens
MDNTSEN

SEQ ID NO: 2765941 - protein, 5 aa, Entamoeba invadens
MDQES

SEQ ID NO: 2765942 - protein, 11 aa, Entamoeba invadens
MDQHEKDPVGD

SEQ ID NO: 2765943 - protein, 8 aa, Entamoeba invadens
MDQRVDPS

SEQ ID NO: 2765944 - protein, 8 aa, Entamoeba invadens
MDSAKDQS

SEQ ID NO: 2765945 - protein, 19 aa, Entamoeba invadens
MDSDGEPVQTGASGKAQVY

SEQ ID NO: 2765946 - protein, 7 aa, Entamoeba invadens
MDSESGQ

SEQ ID NO: 2765947 - protein, 6 aa, Entamoeba invadens
MDSYES

SEQ ID NO: 2765948 - protein, 4 aa, Entamoeba invadens
MDTD

SEQ ID NO: 2765949 - protein, 5 aa, Entamoeba invadens
MDTEK

SEQ ID NO: 2765950 - protein, 7 aa, Entamoeba invadens
MDTNEKY

SEQ ID NO: 2765951 - protein, 9 aa, Entamoeba invadens
MDTNSKYLN

SEQ ID NO: 2765952 - protein, 13 aa, Entamoeba invadens
MDTPQPIKANTKH

SEQ ID NO: 2765953 - protein, 7 aa, Entamoeba invadens
MDWDDTE

SEQ ID NO: 2765954 - protein, 4 aa, Entamoeba invadens
MEAG

SEQ ID NO: 2765955 - protein, 14 aa, Entamoeba invadens
MEDKAAAQATTGVT

SEQ ID NO: 2765956 - protein, 38 aa, Entamoeba invadens
MEEEKGKKEGEKSTLETELEKTKGELESEKKKNEEQRE

SEQ ID NO: 2765957 - protein, 17 aa, Entamoeba invadens
MEEETPEQDTKEKSVDV

SEQ ID NO: 2765958 - protein, 11 aa, Entamoeba invadens
MEEKDKDNPRF

SEQ ID NO: 2765959 - protein, 10 aa, Entamoeba invadens
MEGDLESEQL

SEQ ID NO: 2765960 - protein, 4 aa, Entamoeba invadens
MEGG

SEQ ID NO: 2765961 - protein, 9 aa, Entamoeba invadens
MEGVGNSQC

SEQ ID NO: 2765962 - protein, 4 aa, Entamoeba invadens
MEIT

SEQ ID NO: 2765963 - protein, 9 aa, Entamoeba invadens
MEKDENGSA

SEQ ID NO: 2765964 - protein, 14 aa, Entamoeba invadens
MEKHEKKEETTFNT

SEQ ID NO: 2765965 - protein, 7 aa, Entamoeba invadens
MENDNNF

SEQ ID NO: 2765966 - protein, 7 aa, Entamoeba invadens
MENEEKG

SEQ ID NO: 2765967 - protein, 5 aa, Entamoeba invadens
MENEK

SEQ ID NO: 2765968 - protein, 14 aa, Entamoeba invadens
MENGNTIIKRNIAH

SEQ ID NO: 2765969 - protein, 14 aa, Entamoeba invadens
MENTPAFKKSSIGK

SEQ ID NO: 2765970 - protein, 6 aa, Entamoeba invadens
MEPGFR

SEQ ID NO: 2765971 - protein, 5 aa, Entamoeba invadens
MEPTK

SEQ ID NO: 2765972 - protein, 12 aa, Entamoeba invadens
MEQNGVKPSERG

SEQ ID NO: 2765973 - protein, 6 aa, Entamoeba invadens
MEQNTQ

SEQ ID NO: 2765974 - protein, 10 aa, Entamoeba invadens
MESDENNNLV

SEQ ID NO: 2765975 - protein, 8 aa, Entamoeba invadens
MESEDFDK

SEQ ID NO: 2765976 - protein, 5 aa, Entamoeba invadens
MESTE

SEQ ID NO: 2765977 - protein, 4 aa, Entamoeba invadens
META

SEQ ID NO: 2765978 - protein, 7 aa, Entamoeba invadens
METDGSL

SEQ ID NO: 2765979 - protein, 5 aa, Entamoeba invadens
METNT

SEQ ID NO: 2765980 - protein, 5 aa, Entamoeba invadens
METTD

SEQ ID NO: 2765981 - protein, 17 aa, Entamoeba invadens
MEVPQQQQAFKQNTSYF

SEQ ID NO: 2765982 - protein, 17 aa, Entamoeba invadens
MEVPQQQQAVKQNTSYF

SEQ ID NO: 2765983 - protein, 9 aa, Entamoeba invadens
MGASETNNN

SEQ ID NO: 2765984 - protein, 9 aa, Entamoeba invadens
MGEKEKAHY

SEQ ID NO: 2765985 - protein, 5 aa, Entamoeba invadens
MGERE

SEQ ID NO: 2765986 - protein, 4 aa, Entamoeba invadens
MGEY

SEQ ID NO: 2765987 - protein, 5 aa, Entamoeba invadens
MGGST

SEQ ID NO: 2765988 - protein, 5 aa, Entamoeba invadens
MGITT

SEQ ID NO: 2765989 - protein, 20 aa, Entamoeba invadens
MGKQAKDKASKKAAKPAVNN

SEQ ID NO: 2765990 - protein, 9 aa, Entamoeba invadens
MGMSTSQNQ

SEQ ID NO: 2765991 - protein, 9 aa, Entamoeba invadens
MGNDIDKAH

SEQ ID NO: 2765992 - protein, 14 aa, Entamoeba invadens
MGNPQKIPERVSSP

SEQ ID NO: 2765993 - protein, 7 aa, Entamoeba invadens
MGPNGNN

SEQ ID NO: 2765994 - protein, 5 aa, Entamoeba invadens
MGSGG

SEQ ID NO: 2765995 - protein, 12 aa, Entamoeba invadens
MGSGTDLTKQSA

SEQ ID NO: 2765996 - protein, 5 aa, Entamoeba invadens
MGSPL

SEQ ID NO: 2765997 - protein, 8 aa, Entamoeba invadens
MGSQNEEE

SEQ ID NO: 2765998 - protein, 6 aa, Entamoeba invadens
MGSSEP

SEQ ID NO: 2765999 - protein, 10 aa, Entamoeba invadens
MGTEPPKNTY

SEQ ID NO: 2766000 - protein, 8 aa, Entamoeba invadens
MGTTRKYS

SEQ ID NO: 2766001 - protein, 6 aa, Entamoeba invadens
MGTYAG

SEQ ID NO: 2766002 - protein, 12 aa, Entamoeba invadens
MGYSTDSEIPQG

SEQ ID NO: 2766003 - protein, 11 aa, Entamoeba invadens
MHETKDGNCPE

SEQ ID NO: 2766004 - protein, 5 aa, Entamoeba invadens
MINST

SEQ ID NO: 2766005 - protein, 8 aa, Entamoeba invadens
MKAPSARF

SEQ ID NO: 2766006 - protein, 10 aa, Entamoeba invadens
MKDEKKESAF

SEQ ID NO: 2766007 - protein, 31 aa, Entamoeba invadens
MKDFEQNKKTEIEKCQNENNDLEKKLAEQAS

SEQ ID NO: 2766008 - protein, 9 aa, Entamoeba invadens
MKDKTTNKC

SEQ ID NO: 2766009 - protein, 37 aa, Entamoeba invadens
MKDLKKSSNTQNIEKEKEETVEHNKEDVDTKKSNGLK

SEQ ID NO: 2766010 - protein, 7 aa, Entamoeba invadens
MKDPIDK

SEQ ID NO: 2766011 - protein, 14 aa, Entamoeba invadens
MKEKDKHRTIELTL

SEQ ID NO: 2766012 - protein, 13 aa, Entamoeba invadens
MKEKEDSNNAMEE

SEQ ID NO: 2766013 - protein, 9 aa, Entamoeba invadens
MKENTKIGI

SEQ ID NO: 2766014 - protein, 8 aa, Entamoeba invadens
MKEPKMTD

SEQ ID NO: 2766015 - protein, 6 aa, Entamoeba invadens
MKEPSN

SEQ ID NO: 2766016 - protein, 7 aa, Entamoeba invadens
MKESESG

SEQ ID NO: 2766017 - protein, 5 aa, Entamoeba invadens
MKESN

SEQ ID NO: 2766018 - protein, 6 aa, Entamoeba invadens
MKESND

SEQ ID NO: 2766019 - protein, 13 aa, Entamoeba invadens
MKESTGENNDMTE

SEQ ID NO: 2766020 - protein, 13 aa, Entamoeba invadens
MKGATDKPNRTME

SEQ ID NO: 2766021 - protein, 10 aa, Entamoeba invadens
MKGRKGSLNV

SEQ ID NO: 2766022 - protein, 4 aa, Entamoeba invadens
MKGT

SEQ ID NO: 2766023 - protein, 10 aa, Entamoeba invadens
MKHANDNNTI

SEQ ID NO: 2766024 - protein, 7 aa, Entamoeba invadens
MKHNSEQ

SEQ ID NO: 2766025 - protein, 8 aa, Entamoeba invadens
MKKATPDV

SEQ ID NO: 2766026 - protein, 8 aa, Entamoeba invadens
MKKEQREM

SEQ ID NO: 2766027 - protein, 10 aa, Entamoeba invadens
MKKGKTSEID

SEQ ID NO: 2766028 - protein, 13 aa, Entamoeba invadens
MKKREDKGLGTPV

SEQ ID NO: 2766029 - protein, 10 aa, Entamoeba invadens
MKLGENDEGV

SEQ ID NO: 2766030 - protein, 13 aa, Entamoeba invadens
MKMSGQQNELNEF

SEQ ID NO: 2766031 - protein, 13 aa, Entamoeba invadens
MKNATDSKDQMAE

SEQ ID NO: 2766032 - protein, 8 aa, Entamoeba invadens
MKNESTYD

SEQ ID NO: 2766033 - protein, 15 aa, Entamoeba invadens
MKNKTDDDKKMKEFK

SEQ ID NO: 2766034 - protein, 7 aa, Entamoeba invadens
MKNNTTT

SEQ ID NO: 2766035 - protein, 8 aa, Entamoeba invadens
MKNQRPKD

SEQ ID NO: 2766036 - protein, 16 aa, Entamoeba invadens
MKNSEDMNEENDEFTK

SEQ ID NO: 2766037 - protein, 16 aa, Entamoeba invadens
MKNSNDDKDKSNEFEK

SEQ ID NO: 2766038 - protein, 10 aa, Entamoeba invadens
MKNSNDDNKL

SEQ ID NO: 2766039 - protein, 15 aa, Entamoeba invadens
MKNSNEDKEKCDEFE

SEQ ID NO: 2766040 - protein, 14 aa, Entamoeba invadens
MKNTQATKEAIDEF

SEQ ID NO: 2766041 - protein, 8 aa, Entamoeba invadens
MKNTSSDE

SEQ ID NO: 2766042 - protein, 10 aa, Entamoeba invadens
MKPQKYSEWG

SEQ ID NO: 2766043 - protein, 7 aa, Entamoeba invadens
MKPSENK

SEQ ID NO: 2766044 - protein, 7 aa, Entamoeba invadens
MKPSNPV

SEQ ID NO: 2766045 - protein, 6 aa, Entamoeba invadens
MKQENH

SEQ ID NO: 2766046 - protein, 21 aa, Entamoeba invadens
MKQKEDGKTDSGDKSDDEFEK

SEQ ID NO: 2766047 - protein, 12 aa, Entamoeba invadens
MKQSDGTKEAYN

SEQ ID NO: 2766048 - protein, 20 aa, Entamoeba invadens
MKQSGENTTLNNDKNDEEFE

SEQ ID NO: 2766049 - protein, 18 aa, Entamoeba invadens
MKQSGNESLKSGDLSEFE

SEQ ID NO: 2766050 - protein, 27 aa, Entamoeba invadens
MKQSGNESLKSGDLSEFENEVSMLDKF

SEQ ID NO: 2766051 - protein, 9 aa, Entamoeba invadens
MKQSNDTEK

SEQ ID NO: 2766052 - protein, 9 aa, Entamoeba invadens
MKQSTNNEK

SEQ ID NO: 2766053 - protein, 14 aa, Entamoeba invadens
MKQTAKQNSQIKEF

SEQ ID NO: 2766054 - protein, 21 aa, Entamoeba invadens
MKQTEDGKTDSGDKSDDEFEK

SEQ ID NO: 2766055 - protein, 19 aa, Entamoeba invadens
MKQTEDGKTDSGDKSDVEF

SEQ ID NO: 2766056 - protein, 17 aa, Entamoeba invadens
MKQTNGSEIKNENITEF

SEQ ID NO: 2766057 - protein, 6 aa, Entamoeba invadens
MKRGEV

SEQ ID NO: 2766058 - protein, 28 aa, Entamoeba invadens
MKRKDTSSKPFDRTTKSDRRHVDCNCGV

SEQ ID NO: 2766059 - protein, 8 aa, Entamoeba invadens
MKRNESGK

SEQ ID NO: 2766060 - protein, 15 aa, Entamoeba invadens
MKSADEKKQSEALEE

SEQ ID NO: 2766061 - protein, 6 aa, Entamoeba invadens
MKSAFG

SEQ ID NO: 2766062 - protein, 14 aa, Entamoeba invadens
MKSDQESYSIRTTP

SEQ ID NO: 2766063 - protein, 9 aa, Entamoeba invadens
MKSEETINS

SEQ ID NO: 2766064 - protein, 9 aa, Entamoeba invadens
MKSGDKTCS

SEQ ID NO: 2766065 - protein, 9 aa, Entamoeba invadens
MKSGTEKMR

SEQ ID NO: 2766066 - protein, 9 aa, Entamoeba invadens
MKSTETNGI

SEQ ID NO: 2766067 - protein, 6 aa, Entamoeba invadens
MKTEGI

SEQ ID NO: 2766068 - protein, 8 aa, Entamoeba invadens
MKTESNDK

SEQ ID NO: 2766069 - protein, 6 aa, Entamoeba invadens
MKTGIP

SEQ ID NO: 2766070 - protein, 11 aa, Entamoeba invadens
MKTGRKEQISA

SEQ ID NO: 2766071 - protein, 4 aa, Entamoeba invadens
MKTK

SEQ ID NO: 2766072 - protein, 54 aa, Entamoeba invadens
MKTNTCDNCPAGTYSKSRSTECTTCEENTYSLEKSATCNSCSNTCKTCDKTSGK

SEQ ID NO: 2766073 - protein, 8 aa, Entamoeba invadens
MKTSRNSM

SEQ ID NO: 2766074 - protein, 11 aa, Entamoeba invadens
MKVSSGAQAGR

SEQ ID NO: 2766075 - protein, 29 aa, Entamoeba invadens
MLGTNTKNVKKTATIKKKNRHNSNSFKPN

SEQ ID NO: 2766076 - protein, 10 aa, Entamoeba invadens
MLSPSKSQTM

SEQ ID NO: 2766077 - protein, 10 aa, Entamoeba invadens
MNAGKYGKDD

SEQ ID NO: 2766078 - protein, 5 aa, Entamoeba invadens
MNAHT

SEQ ID NO: 2766079 - protein, 6 aa, Entamoeba invadens
MNDARE

SEQ ID NO: 2766080 - protein, 4 aa, Entamoeba invadens
MNDE

SEQ ID NO: 2766081 - protein, 14 aa, Entamoeba invadens
MNDEKYGMKTESDK

SEQ ID NO: 2766082 - protein, 10 aa, Entamoeba invadens
MNDSEEAYDG

SEQ ID NO: 2766083 - protein, 22 aa, Entamoeba invadens
MNEDNNIDLSRNPDLDKYPDQD

SEQ ID NO: 2766084 - protein, 21 aa, Entamoeba invadens
MNEDNNVADYTKLDTNTEQDF

SEQ ID NO: 2766085 - protein, 6 aa, Entamoeba invadens
MNEDNS

SEQ ID NO: 2766086 - protein, 5 aa, Entamoeba invadens
MNEEK

SEQ ID NO: 2766087 - protein, 9 aa, Entamoeba invadens
MNENLTTQT

SEQ ID NO: 2766088 - protein, 7 aa, Entamoeba invadens
MNERGTL

SEQ ID NO: 2766089 - protein, 22 aa, Entamoeba invadens
MNESNNKNKNTKNNKKKNTKTL

SEQ ID NO: 2766090 - protein, 5 aa, Entamoeba invadens
MNEST

SEQ ID NO: 2766091 - protein, 7 aa, Entamoeba invadens
MNETGKN

SEQ ID NO: 2766092 - protein, 7 aa, Entamoeba invadens
MNGDNTR

SEQ ID NO: 2766093 - protein, 4 aa, Entamoeba invadens
MNGN

SEQ ID NO: 2766094 - protein, 8 aa, Entamoeba invadens
MNGNADYE

SEQ ID NO: 2766095 - protein, 5 aa, Entamoeba invadens
MNGNG

SEQ ID NO: 2766096 - protein, 5 aa, Entamoeba invadens
MNGNK

SEQ ID NO: 2766097 - protein, 8 aa, Entamoeba invadens
MNGPQDGT

SEQ ID NO: 2766098 - protein, 14 aa, Entamoeba invadens
MNIGKSKMNSKRTV

SEQ ID NO: 2766099 - protein, 25 aa, Entamoeba invadens
MNKEGESWDAEFGDATAKKQVPQMS

SEQ ID NO: 2766100 - protein, 20 aa, Entamoeba invadens
MNKNEDKTKEMESQVKEKEL

SEQ ID NO: 2766101 - protein, 12 aa, Entamoeba invadens
MNKPTQKPVEPT

SEQ ID NO: 2766102 - protein, 9 aa, Entamoeba invadens
MNNNTSMEE

SEQ ID NO: 2766103 - protein, 16 aa, Entamoeba invadens
MNNRPKIEDVVHTLEV

SEQ ID NO: 2766104 - protein, 12 aa, Entamoeba invadens
MNPSTDDSSIVT

SEQ ID NO: 2766105 - protein, 9 aa, Entamoeba invadens
MNPYSQDTS

SEQ ID NO: 2766106 - protein, 8 aa, Entamoeba invadens
MNQETSDV

SEQ ID NO: 2766107 - protein, 8 aa, Entamoeba invadens
MNRGKNAG

SEQ ID NO: 2766108 - protein, 11 aa, Entamoeba invadens
MNSSGAIAAAT

SEQ ID NO: 2766109 - protein, 13 aa, Entamoeba invadens
MNTKATNLNNEKS

SEQ ID NO: 2766110 - protein, 6 aa, Entamoeba invadens
MNTPKE

SEQ ID NO: 2766111 - protein, 12 aa, Entamoeba invadens
MNTREEDTDDAF

SEQ ID NO: 2766112 - protein, 4 aa, Entamoeba invadens
MNVQ

SEQ ID NO: 2766113 - protein, 6 aa, Entamoeba invadens
MNYSSY

SEQ ID NO: 2766114 - protein, 8 aa, Entamoeba invadens
MNYTDTRC

SEQ ID NO: 2766115 - protein, 6 aa, Entamoeba invadens
MPAPQP

SEQ ID NO: 2766116 - protein, 5 aa, Entamoeba invadens
MPDDQ

SEQ ID NO: 2766117 - protein, 5 aa, Entamoeba invadens
MPDGY

SEQ ID NO: 2766118 - protein, 5 aa, Entamoeba invadens
MPDLS

SEQ ID NO: 2766119 - protein, 9 aa, Entamoeba invadens
MPDTNVKTG

SEQ ID NO: 2766120 - protein, 9 aa, Entamoeba invadens
MPEGKTECE

SEQ ID NO: 2766121 - protein, 5 aa, Entamoeba invadens
MPGDA

SEQ ID NO: 2766122 - protein, 16 aa, Entamoeba invadens
MPGEESLRKQQYYGHP

SEQ ID NO: 2766123 - protein, 8 aa, Entamoeba invadens
MPIGSNGQ

SEQ ID NO: 2766124 - protein, 6 aa, Entamoeba invadens
MPKEDK

SEQ ID NO: 2766125 - protein, 9 aa, Entamoeba invadens
MPKPDEMSQ

SEQ ID NO: 2766126 - protein, 6 aa, Entamoeba invadens
MPKSEE

SEQ ID NO: 2766127 - protein, 7 aa, Entamoeba invadens
MPKTTKK

SEQ ID NO: 2766128 - protein, 6 aa, Entamoeba invadens
MPSFGD

SEQ ID NO: 2766129 - protein, 4 aa, Entamoeba invadens
MPSQ

SEQ ID NO: 2766130 - protein, 16 aa, Entamoeba invadens
MPSSVPGTPQKAVPKD

SEQ ID NO: 2766131 - protein, 5 aa, Entamoeba invadens
MPSTV

SEQ ID NO: 2766132 - protein, 6 aa, Entamoeba invadens
MPTEPV

SEQ ID NO: 2766133 - protein, 6 aa, Entamoeba invadens
MPTKCS

SEQ ID NO: 2766134 - protein, 4 aa, Entamoeba invadens
MPTL

SEQ ID NO: 2766135 - protein, 5 aa, Entamoeba invadens
MPTRE

SEQ ID NO: 2766136 - protein, 14 aa, Entamoeba invadens
MPTRNNTSPSTAKH

SEQ ID NO: 2766137 - protein, 8 aa, Entamoeba invadens
MPTTQTTS

SEQ ID NO: 2766138 - protein, 5 aa, Entamoeba invadens
MQGVE

SEQ ID NO: 2766139 - protein, 12 aa, Entamoeba invadens
MQQNSETTESSS

SEQ ID NO: 2766140 - protein, 8 aa, Entamoeba invadens
MQQPPMQP

SEQ ID NO: 2766141 - protein, 9 aa, Entamoeba invadens
MQRDKTYVN

SEQ ID NO: 2766142 - protein, 9 aa, Entamoeba invadens
MQSPEPNLP

SEQ ID NO: 2766143 - protein, 10 aa, Entamoeba invadens
MQSQLRKTQF

SEQ ID NO: 2766144 - protein, 12 aa, Entamoeba invadens
MQVPSTNPTPLP

SEQ ID NO: 2766145 - protein, 18 aa, Entamoeba invadens
MRAGRRKNEFTDFTTESH

SEQ ID NO: 2766146 - protein, 11 aa, Entamoeba invadens
MRDAEKKTCIA

SEQ ID NO: 2766147 - protein, 8 aa, Entamoeba invadens
MRDSKGCK

SEQ ID NO: 2766148 - protein, 10 aa, Entamoeba invadens
MRGKNTVNDL

SEQ ID NO: 2766149 - protein, 11 aa, Entamoeba invadens
MRGNTDLENKI

SEQ ID NO: 2766150 - protein, 5 aa, Entamoeba invadens
MRKDS

SEQ ID NO: 2766151 - protein, 7 aa, Entamoeba invadens
MRKNEGK

SEQ ID NO: 2766152 - protein, 7 aa, Entamoeba invadens
MRKRQNT

SEQ ID NO: 2766153 - protein, 5 aa, Entamoeba invadens
MRNTG

SEQ ID NO: 2766154 - protein, 10 aa, Entamoeba invadens
MRSADGTTCE

SEQ ID NO: 2766155 - protein, 9 aa, Entamoeba invadens
MRSKTNITA

SEQ ID NO: 2766156 - protein, 8 aa, Entamoeba invadens
MRTQEEKN

SEQ ID NO: 2766157 - protein, 6 aa, Entamoeba invadens
MRYDTS

SEQ ID NO: 2766158 - protein, 4 aa, Entamoeba invadens
MSAY

SEQ ID NO: 2766159 - protein, 8 aa, Entamoeba invadens
MSDASNGC

SEQ ID NO: 2766160 - protein, 35 aa, Entamoeba invadens
MSDGATGSCTDDQPSTSEHSETNSNSTSTTNSSLG

SEQ ID NO: 2766161 - protein, 4 aa, Entamoeba invadens
MSDL

SEQ ID NO: 2766162 - protein, 10 aa, Entamoeba invadens
MSDSTGTITA

SEQ ID NO: 2766163 - protein, 10 aa, Entamoeba invadens
MSEDTEYGKT

SEQ ID NO: 2766164 - protein, 10 aa, Entamoeba invadens
MSEGVSTTVD

SEQ ID NO: 2766165 - protein, 16 aa, Entamoeba invadens
MSERGCRGALKPGEGK

SEQ ID NO: 2766166 - protein, 10 aa, Entamoeba invadens
MSESPIAEGA

SEQ ID NO: 2766167 - protein, 8 aa, Entamoeba invadens
MSGESTIN

SEQ ID NO: 2766168 - protein, 6 aa, Entamoeba invadens
MSGNNE

SEQ ID NO: 2766169 - protein, 9 aa, Entamoeba invadens
MSGTNTNLN

SEQ ID NO: 2766170 - protein, 5 aa, Entamoeba invadens
MSISS

SEQ ID NO: 2766171 - protein, 8 aa, Entamoeba invadens
MSKNKSFD

SEQ ID NO: 2766172 - protein, 7 aa, Entamoeba invadens
MSKRSSE

SEQ ID NO: 2766173 - protein, 5 aa, Entamoeba invadens
MSKTN

SEQ ID NO: 2766174 - protein, 8 aa, Entamoeba invadens
MSKTPTDN

SEQ ID NO: 2766175 - protein, 8 aa, Entamoeba invadens
MSKTTTDN

SEQ ID NO: 2766176 - protein, 7 aa, Entamoeba invadens
MSKYTSY

SEQ ID NO: 2766177 - protein, 5 aa, Entamoeba invadens
MSNEE

SEQ ID NO: 2766178 - protein, 9 aa, Entamoeba invadens
MSNPPTEVR

SEQ ID NO: 2766179 - protein, 5 aa, Entamoeba invadens
MSNTG

SEQ ID NO: 2766180 - protein, 11 aa, Entamoeba invadens
MSPDKAKEVKR

SEQ ID NO: 2766181 - protein, 6 aa, Entamoeba invadens
MSPSPY

SEQ ID NO: 2766182 - protein, 10 aa, Entamoeba invadens
MSPTSARHGD

SEQ ID NO: 2766183 - protein, 7 aa, Entamoeba invadens
MSPYKDK

SEQ ID NO: 2766184 - protein, 6 aa, Entamoeba invadens
MSQDIN

SEQ ID NO: 2766185 - protein, 25 aa, Entamoeba invadens
MSQTTSENPSQNVQTEVVSQRQDDE

SEQ ID NO: 2766186 - protein, 6 aa, Entamoeba invadens
MSSAGT

SEQ ID NO: 2766187 - protein, 8 aa, Entamoeba invadens
MSSEEDKE

SEQ ID NO: 2766188 - protein, 9 aa, Entamoeba invadens
MSSNNNIKN

SEQ ID NO: 2766189 - protein, 8 aa, Entamoeba invadens
MSSNPDIR

SEQ ID NO: 2766190 - protein, 5 aa, Entamoeba invadens
MSSPN

SEQ ID NO: 2766191 - protein, 8 aa, Entamoeba invadens
MSSSGECL

SEQ ID NO: 2766192 - protein, 14 aa, Entamoeba invadens
MSSSLNKTKPTENF

SEQ ID NO: 2766193 - protein, 11 aa, Entamoeba invadens
MSSTTTTTLQN

SEQ ID NO: 2766194 - protein, 8 aa, Entamoeba invadens
MSTDYNPR

SEQ ID NO: 2766195 - protein, 23 aa, Entamoeba invadens
MSTESGSSETSSNAGSLKEAIIT

SEQ ID NO: 2766196 - protein, 24 aa, Entamoeba invadens
MSTKTPTDKEQPLIGGDRKSRTIS

SEQ ID NO: 2766197 - protein, 8 aa, Entamoeba invadens
MSTNNEKK

SEQ ID NO: 2766198 - protein, 9 aa, Entamoeba invadens
MSTTGKCTS

SEQ ID NO: 2766199 - protein, 5 aa, Entamoeba invadens
MSTTK

SEQ ID NO: 2766200 - protein, 5 aa, Entamoeba invadens
MSVGD

SEQ ID NO: 2766201 - protein, 5 aa, Entamoeba invadens
MTADG

SEQ ID NO: 2766202 - protein, 14 aa, Entamoeba invadens
MTAQPTTSKNTVDV

SEQ ID NO: 2766203 - protein, 4 aa, Entamoeba invadens
MTDG

SEQ ID NO: 2766204 - protein, 9 aa, Entamoeba invadens
MTDLNKDDT

SEQ ID NO: 2766205 - protein, 17 aa, Entamoeba invadens
MTDPKNKMEGSKKTIQR

SEQ ID NO: 2766206 - protein, 4 aa, Entamoeba invadens
MTDQ

SEQ ID NO: 2766207 - protein, 8 aa, Entamoeba invadens
MTEDRQNR

SEQ ID NO: 2766208 - protein, 8 aa, Entamoeba invadens
MTEDTSNY

SEQ ID NO: 2766209 - protein, 7 aa, Entamoeba invadens
MTENGQS

SEQ ID NO: 2766210 - protein, 10 aa, Entamoeba invadens
MTEQKTQKSR

SEQ ID NO: 2766211 - protein, 4 aa, Entamoeba invadens
MTES

SEQ ID NO: 2766212 - protein, 8 aa, Entamoeba invadens
MTESNEKL

SEQ ID NO: 2766213 - protein, 9 aa, Entamoeba invadens
MTGDPKTPV

SEQ ID NO: 2766214 - protein, 6 aa, Entamoeba invadens
MTGGNL

SEQ ID NO: 2766215 - protein, 7 aa, Entamoeba invadens
MTGTGNT

SEQ ID NO: 2766216 - protein, 7 aa, Entamoeba invadens
MTGTSTV

SEQ ID NO: 2766217 - protein, 8 aa, Entamoeba invadens
MTKDIKPD

SEQ ID NO: 2766218 - protein, 10 aa, Entamoeba invadens
MTKEDGSLPK

SEQ ID NO: 2766219 - protein, 7 aa, Entamoeba invadens
MTKPDYP

SEQ ID NO: 2766220 - protein, 9 aa, Entamoeba invadens
MTKRGEDFQ

SEQ ID NO: 2766221 - protein, 4 aa, Entamoeba invadens
MTNG

SEQ ID NO: 2766222 - protein, 8 aa, Entamoeba invadens
MTNKNQRT

SEQ ID NO: 2766223 - protein, 7 aa, Entamoeba invadens
MTNPSQD

SEQ ID NO: 2766224 - protein, 4 aa, Entamoeba invadens
MTNS

SEQ ID NO: 2766225 - protein, 5 aa, Entamoeba invadens
MTPDR

SEQ ID NO: 2766226 - protein, 7 aa, Entamoeba invadens
MTPPALN

SEQ ID NO: 2766227 - protein, 10 aa, Entamoeba invadens
MTPSQSTTIV

SEQ ID NO: 2766228 - protein, 9 aa, Entamoeba invadens
MTQEEIEDN

SEQ ID NO: 2766229 - protein, 5 aa, Entamoeba invadens
MTQIS

SEQ ID NO: 2766230 - protein, 4 aa, Entamoeba invadens
MTQQ

SEQ ID NO: 2766231 - protein, 5 aa, Entamoeba invadens
MTQTG

SEQ ID NO: 2766232 - protein, 4 aa, Entamoeba invadens
MTRG

SEQ ID NO: 2766233 - protein, 5 aa, Entamoeba invadens
MTSDA

SEQ ID NO: 2766234 - protein, 19 aa, Entamoeba invadens
MTSENNEVFGPNAKEVGGG

SEQ ID NO: 2766235 - protein, 5 aa, Entamoeba invadens
MTSNE

SEQ ID NO: 2766236 - protein, 12 aa, Entamoeba invadens
MTTGSTLKTEKN

SEQ ID NO: 2766237 - protein, 10 aa, Entamoeba invadens
MTTNGDKTGL

SEQ ID NO: 2766238 - protein, 5 aa, Entamoeba invadens
MTTNS

SEQ ID NO: 2766239 - protein, 4 aa, Entamoeba invadens
MTVE

SEQ ID NO: 2766240 - protein, 12 aa, Entamoeba invadens
MVEEKEGAKDFK

SEQ ID NO: 2766241 - protein, 11 aa, Entamoeba invadens
MVESEKEAFDQ

SEQ ID NO: 2766242 - protein, 12 aa, Entamoeba invadens
MVKTKREKVSSR

SEQ ID NO: 2766243 - protein, 5 aa, Entamoeba invadens
MVNGD

SEQ ID NO: 2766244 - protein, 10 aa, Entamoeba invadens
MVPNNPPSTT

SEQ ID NO: 2766245 - protein, 8 aa, Entamoeba invadens
MVPTNPLS

SEQ ID NO: 2766246 - protein, 9 aa, Entamoeba invadens
MVPTNPPST

SEQ ID NO: 2766247 - protein, 5 aa, Entamoeba invadens
MYDPE

SEQ ID NO: 2766248 - protein, 5 aa, Entamoeba invadens
MYKRK

SEQ ID NO: 2766249 - protein, 5 aa, Entamoeba invadens
MYNTP

SEQ ID NO: 2766250 - protein, 4 aa, Entamoeba invadens
MYPD

SEQ ID NO: 2766251 - protein, 5 aa, Entamoeba invadens
MYPDE

SEQ ID NO: 2766252 - protein, 10 aa, Entamoeba invadens
MYPDETSKKC

SEQ ID NO: 2766253 - protein, 6 aa, Entamoeba invadens
MYPDEV

SEQ ID NO: 2766254 - protein, 26 aa, Entamoeba invadens
MYPDVSNGKCKSCDASCGGSCDTTNG

SEQ ID NO: 2766255 - protein, 26 aa, Entamoeba invadens
MYPGVSNGKCKSCDASCNGSCETTNG

SEQ ID NO: 2766256 - protein, 8 aa, Entamoeba invadens
MYPKRDDD

SEQ ID NO: 2766257 - protein, 8 aa, Entamoeba invadens
MYPNDDKQ

SEQ ID NO: 2766258 - protein, 5 aa, Entamoeba invadens
MYPNT

SEQ ID NO: 2766259 - protein, 8 aa, Entamoeba invadens
MYPNTNGK

SEQ ID NO: 2766260 - protein, 9 aa, Entamoeba invadens
MYPNTNGTC

SEQ ID NO: 2766261 - protein, 12 aa, Entamoeba invadens
MYPNTSGTCTPC

SEQ ID NO: 2766262 - protein, 10 aa, Entamoeba invadens
MYPSAQQNGD

SEQ ID NO: 2766263 - protein, 10 aa, Entamoeba invadens
MYPSEQQNND

SEQ ID NO: 2766264 - protein, 6 aa, Entamoeba invadens
MYPSNG

SEQ ID NO: 2766265 - protein, 9 aa, Entamoeba invadens
MYPSQQQNN

SEQ ID NO: 2766266 - protein, 10 aa, Entamoeba invadens
MYPSSSGSCV

SEQ ID NO: 2766267 - protein, 14 aa, Entamoeba invadens
MYSNEGSTKCSTCG

SEQ ID NO: 2766268 - protein, 11 aa, Entamoeba invadens
MYTNDSPTTME

SEQ ID NO: 2766269 - protein, 12 aa, Entamoeba invadens
MYTNDSPTTMEG

SEQ ID NO: 2766270 - protein, 8 aa, Entamoeba invadens
NAAASTCT

SEQ ID NO: 2766271 - protein, 9 aa, Entamoeba invadens
NAADDFEKG

SEQ ID NO: 2766272 - protein, 9 aa, Entamoeba invadens
NAAQKGDLS

SEQ ID NO: 2766273 - protein, 6 aa, Entamoeba invadens
NAATAQ

SEQ ID NO: 2766274 - protein, 23 aa, Entamoeba invadens
NAATENSLLNPTNPYSATKAGAE

SEQ ID NO: 2766275 - protein, 17 aa, Entamoeba invadens
NAATSQDDIVGDGTTST

SEQ ID NO: 2766276 - protein, 7 aa, Entamoeba invadens
NAATSVR

SEQ ID NO: 2766277 - protein, 8 aa, Entamoeba invadens
NACDRNQH

SEQ ID NO: 2766278 - protein, 9 aa, Entamoeba invadens
NACEKCDEN

SEQ ID NO: 2766279 - protein, 9 aa, Entamoeba invadens
NACGSGSKC

SEQ ID NO: 2766280 - protein, 7 aa, Entamoeba invadens
NACKSNH

SEQ ID NO: 2766281 - protein, 10 aa, Entamoeba invadens
NACNGSGANN

SEQ ID NO: 2766282 - protein, 5 aa, Entamoeba invadens
NACNR

SEQ ID NO: 2766283 - protein, 6 aa, Entamoeba invadens
NADARM

SEQ ID NO: 2766284 - protein, 19 aa, Entamoeba invadens
NADCETCETVENAEQCTKC

SEQ ID NO: 2766285 - protein, 12 aa, Entamoeba invadens
NADDNTKYTNQN

SEQ ID NO: 2766286 - protein, 7 aa, Entamoeba invadens
NADEKGN

SEQ ID NO: 2766287 - protein, 7 aa, Entamoeba invadens
NADGAKM

SEQ ID NO: 2766288 - protein, 9 aa, Entamoeba invadens
NADGEDEPR

SEQ ID NO: 2766289 - protein, 12 aa, Entamoeba invadens
NADKGWGNCSTY

SEQ ID NO: 2766290 - protein, 7 aa, Entamoeba invadens
NADKTYQ

SEQ ID NO: 2766291 - protein, 8 aa, Entamoeba invadens
NADLTTTG

SEQ ID NO: 2766292 - protein, 10 aa, Entamoeba invadens
NADNRSTIQT

SEQ ID NO: 2766293 - protein, 7 aa, Entamoeba invadens
NADRSVT

SEQ ID NO: 2766294 - protein, 7 aa, Entamoeba invadens
NADSGIE

SEQ ID NO: 2766295 - protein, 15 aa, Entamoeba invadens
NADTDKKSRKTSFGS

SEQ ID NO: 2766296 - protein, 14 aa, Entamoeba invadens
NADTTTAEDKCGEC

SEQ ID NO: 2766297 - protein, 8 aa, Entamoeba invadens
NAEDDTPE

SEQ ID NO: 2766298 - protein, 52 aa, Entamoeba invadens
NAEENNEKKNNVEVPKFEEKEVNVEGKTEENQKKEDEEQVEEKPNKNGEQLA

SEQ ID NO: 2766299 - protein, 6 aa, Entamoeba invadens
NAEIQD

SEQ ID NO: 2766300 - protein, 4 aa, Entamoeba invadens
NAEK

SEQ ID NO: 2766301 - protein, 12 aa, Entamoeba invadens
NAEKSNPDCSTA

SEQ ID NO: 2766302 - protein, 29 aa, Entamoeba invadens
NAELENKNTELNDVNDKIKDVEQKLKTEI

SEQ ID NO: 2766303 - protein, 12 aa, Entamoeba invadens
NAENGQGECVTS

SEQ ID NO: 2766304 - protein, 10 aa, Entamoeba invadens
NAENNSKLST

SEQ ID NO: 2766305 - protein, 4 aa, Entamoeba invadens
NAER

SEQ ID NO: 2766306 - protein, 7 aa, Entamoeba invadens
NAESLTT

SEQ ID NO: 2766307 - protein, 8 aa, Entamoeba invadens
NAESSTHI

SEQ ID NO: 2766308 - protein, 9 aa, Entamoeba invadens
NAETDFDRK

SEQ ID NO: 2766309 - protein, 19 aa, Entamoeba invadens
NAEVDNPNYSSACFMVRTV

SEQ ID NO: 2766310 - protein, 14 aa, Entamoeba invadens
NAEYRKNAKPYIPD

SEQ ID NO: 2766311 - protein, 9 aa, Entamoeba invadens
NAFENDERF

SEQ ID NO: 2766312 - protein, 8 aa, Entamoeba invadens
NAFENNKN

SEQ ID NO: 2766313 - protein, 5 aa, Entamoeba invadens
NAFGN

SEQ ID NO: 2766314 - protein, 9 aa, Entamoeba invadens
NAFKDNQNI

SEQ ID NO: 2766315 - protein, 5 aa, Entamoeba invadens
NAFNS

SEQ ID NO: 2766316 - protein, 4 aa, Entamoeba invadens
NAGG

SEQ ID NO: 2766317 - protein, 8 aa, Entamoeba invadens
NAGGQGGM

SEQ ID NO: 2766318 - protein, 5 aa, Entamoeba invadens
NAGKM

SEQ ID NO: 2766319 - protein, 7 aa, Entamoeba invadens
NAGKNSI

SEQ ID NO: 2766320 - protein, 9 aa, Entamoeba invadens
NAGPPDGEI

SEQ ID NO: 2766321 - protein, 23 aa, Entamoeba invadens
NAGSCKNSKCAKQADDGCSADSL

SEQ ID NO: 2766322 - protein, 7 aa, Entamoeba invadens
NAGSPVA

SEQ ID NO: 2766323 - protein, 5 aa, Entamoeba invadens
NAGSV

SEQ ID NO: 2766324 - protein, 8 aa, Entamoeba invadens
NAGTCDEA

SEQ ID NO: 2766325 - protein, 15 aa, Entamoeba invadens
NAIDKKYRKEIDAMF

SEQ ID NO: 2766326 - protein, 4 aa, Entamoeba invadens
NAIP

SEQ ID NO: 2766327 - protein, 10 aa, Entamoeba invadens
NAIPNEESGT

SEQ ID NO: 2766328 - protein, 5 aa, Entamoeba invadens
NAIPP

SEQ ID NO: 2766329 - protein, 21 aa, Entamoeba invadens
NAIQPNAECTSAEAVSVPSTK

SEQ ID NO: 2766330 - protein, 19 aa, Entamoeba invadens
NAISSNYPVTKCPNPLFPF

SEQ ID NO: 2766331 - protein, 7 aa, Entamoeba invadens
NAKAYGV

SEQ ID NO: 2766332 - protein, 13 aa, Entamoeba invadens
NAKDLRDETVSDV

SEQ ID NO: 2766333 - protein, 8 aa, Entamoeba invadens
NAKDNEYK

SEQ ID NO: 2766334 - protein, 6 aa, Entamoeba invadens
NAKETY

SEQ ID NO: 2766335 - protein, 8 aa, Entamoeba invadens
NAKHTFES

SEQ ID NO: 2766336 - protein, 4 aa, Entamoeba invadens
NAKI

SEQ ID NO: 2766337 - protein, 6 aa, Entamoeba invadens
NAKKED

SEQ ID NO: 2766338 - protein, 7 aa, Entamoeba invadens
NAKNHIT

SEQ ID NO: 2766339 - protein, 14 aa, Entamoeba invadens
NAKQKSSVILQHLD

SEQ ID NO: 2766340 - protein, 5 aa, Entamoeba invadens
NAKQN

SEQ ID NO: 2766341 - protein, 8 aa, Entamoeba invadens
NAKQNGCV

SEQ ID NO: 2766342 - protein, 8 aa, Entamoeba invadens
NAKSTLAQ

SEQ ID NO: 2766343 - protein, 8 aa, Entamoeba invadens
NAKTNKGY

SEQ ID NO: 2766344 - protein, 7 aa, Entamoeba invadens
NAKTQIS

SEQ ID NO: 2766345 - protein, 9 aa, Entamoeba invadens
NAKTTTTVT

SEQ ID NO: 2766346 - protein, 9 aa, Entamoeba invadens
NAKTYKNNP

SEQ ID NO: 2766347 - protein, 8 aa, Entamoeba invadens
NAKVTTNI

SEQ ID NO: 2766348 - protein, 20 aa, Entamoeba invadens
NALKQSEKTIKQKNETIEKL

SEQ ID NO: 2766349 - protein, 7 aa, Entamoeba invadens
NALNTKT

SEQ ID NO: 2766350 - protein, 5 aa, Entamoeba invadens
NALPT

SEQ ID NO: 2766351 - protein, 11 aa, Entamoeba invadens
NALTGETEYAE

SEQ ID NO: 2766352 - protein, 19 aa, Entamoeba invadens
NALTKNGKYLATPTLQPTG

SEQ ID NO: 2766353 - protein, 6 aa, Entamoeba invadens
NAMEDG

SEQ ID NO: 2766354 - protein, 4 aa, Entamoeba invadens
NAMS

SEQ ID NO: 2766355 - protein, 7 aa, Entamoeba invadens
NANDANY

SEQ ID NO: 2766356 - protein, 7 aa, Entamoeba invadens
NANDKDY

SEQ ID NO: 2766357 - protein, 5 aa, Entamoeba invadens
NANEL

SEQ ID NO: 2766358 - protein, 6 aa, Entamoeba invadens
NANFPL

SEQ ID NO: 2766359 - protein, 7 aa, Entamoeba invadens
NANFPLK

SEQ ID NO: 2766360 - protein, 13 aa, Entamoeba invadens
NANGKDATTETPV

SEQ ID NO: 2766361 - protein, 6 aa, Entamoeba invadens
NANGTF

SEQ ID NO: 2766362 - protein, 7 aa, Entamoeba invadens
NANLTKK

SEQ ID NO: 2766363 - protein, 8 aa, Entamoeba invadens
NANLTKKG

SEQ ID NO: 2766364 - protein, 8 aa, Entamoeba invadens
NANNDDSE

SEQ ID NO: 2766365 - protein, 7 aa, Entamoeba invadens
NANPGII

SEQ ID NO: 2766366 - protein, 5 aa, Entamoeba invadens
NANQE

SEQ ID NO: 2766367 - protein, 4 aa, Entamoeba invadens
NANS

SEQ ID NO: 2766368 - protein, 6 aa, Entamoeba invadens
NANSGN

SEQ ID NO: 2766369 - protein, 4 aa, Entamoeba invadens
NANY

SEQ ID NO: 2766370 - protein, 6 aa, Entamoeba invadens
NAPGHY

SEQ ID NO: 2766371 - protein, 7 aa, Entamoeba invadens
NAPGPVQ

SEQ ID NO: 2766372 - protein, 5 aa, Entamoeba invadens
NAPHI

SEQ ID NO: 2766373 - protein, 10 aa, Entamoeba invadens
NAPNNCEQTN

SEQ ID NO: 2766374 - protein, 5 aa, Entamoeba invadens
NAPQG

SEQ ID NO: 2766375 - protein, 6 aa, Entamoeba invadens
NAPSGV

SEQ ID NO: 2766376 - protein, 11 aa, Entamoeba invadens
NAPSQSANTIG

SEQ ID NO: 2766377 - protein, 5 aa, Entamoeba invadens
NAPTY

SEQ ID NO: 2766378 - protein, 4 aa, Entamoeba invadens
NAPV

SEQ ID NO: 2766379 - protein, 5 aa, Entamoeba invadens
NAPVT

SEQ ID NO: 2766380 - protein, 9 aa, Entamoeba invadens
NAQDKEEFE

SEQ ID NO: 2766381 - protein, 16 aa, Entamoeba invadens
NAQEEVNGWSSGEETE

SEQ ID NO: 2766382 - protein, 7 aa, Entamoeba invadens
NAQGSIE

SEQ ID NO: 2766383 - protein, 6 aa, Entamoeba invadens
NAQKDN

SEQ ID NO: 2766384 - protein, 17 aa, Entamoeba invadens
NAQNCNSPSSLSPASCD

SEQ ID NO: 2766385 - protein, 17 aa, Entamoeba invadens
NAQNQVTTIDARKGTLS

SEQ ID NO: 2766386 - protein, 6 aa, Entamoeba invadens
NAQPEL

SEQ ID NO: 2766387 - protein, 4 aa, Entamoeba invadens
NAQQ

SEQ ID NO: 2766388 - protein, 14 aa, Entamoeba invadens
NARYPNKDITPEKA

SEQ ID NO: 2766389 - protein, 7 aa, Entamoeba invadens
NASGVID

SEQ ID NO: 2766390 - protein, 10 aa, Entamoeba invadens
NASKVSTSVP

SEQ ID NO: 2766391 - protein, 5 aa, Entamoeba invadens
NASQS

SEQ ID NO: 2766392 - protein, 4 aa, Entamoeba invadens
NASS

SEQ ID NO: 2766393 - protein, 6 aa, Entamoeba invadens
NASSCS

SEQ ID NO: 2766394 - protein, 10 aa, Entamoeba invadens
NASSCTPCSA

SEQ ID NO: 2766395 - protein, 6 aa, Entamoeba invadens
NASSEF

SEQ ID NO: 2766396 - protein, 4 aa, Entamoeba invadens
NATA

SEQ ID NO: 2766397 - protein, 7 aa, Entamoeba invadens
NATASYT

SEQ ID NO: 2766398 - protein, 7 aa, Entamoeba invadens
NATDEEL

SEQ ID NO: 2766399 - protein, 6 aa, Entamoeba invadens
NATDSL

SEQ ID NO: 2766400 - protein, 6 aa, Entamoeba invadens
NATECF

SEQ ID NO: 2766401 - protein, 23 aa, Entamoeba invadens
NATFGTKNQKSDQEEVEQQDLNE

SEQ ID NO: 2766402 - protein, 5 aa, Entamoeba invadens
NATFS

SEQ ID NO: 2766403 - protein, 8 aa, Entamoeba invadens
NATFTSTS

SEQ ID NO: 2766404 - protein, 4 aa, Entamoeba invadens
NATI

SEQ ID NO: 2766405 - protein, 5 aa, Entamoeba invadens
NATIE

SEQ ID NO: 2766406 - protein, 4 aa, Entamoeba invadens
NATN

SEQ ID NO: 2766407 - protein, 19 aa, Entamoeba invadens
NATNDTTKLQITTSQSESL

SEQ ID NO: 2766408 - protein, 5 aa, Entamoeba invadens
NATNL

SEQ ID NO: 2766409 - protein, 5 aa, Entamoeba invadens
NATNN

SEQ ID NO: 2766410 - protein, 10 aa, Entamoeba invadens
NATQNIKESC

SEQ ID NO: 2766411 - protein, 6 aa, Entamoeba invadens
NATQSV

SEQ ID NO: 2766412 - protein, 9 aa, Entamoeba invadens
NATSASTSD

SEQ ID NO: 2766413 - protein, 6 aa, Entamoeba invadens
NATSEM

SEQ ID NO: 2766414 - protein, 5 aa, Entamoeba invadens
NATTK

SEQ ID NO: 2766415 - protein, 22 aa, Entamoeba invadens
NATTKANESNNNDKKAEEVTPS

SEQ ID NO: 2766416 - protein, 13 aa, Entamoeba invadens
NATTKKCENNGGG

SEQ ID NO: 2766417 - protein, 8 aa, Entamoeba invadens
NAVESSRV

SEQ ID NO: 2766418 - protein, 8 aa, Entamoeba invadens
NAVGGDVS

SEQ ID NO: 2766419 - protein, 9 aa, Entamoeba invadens
NAVGKRRKL

SEQ ID NO: 2766420 - protein, 24 aa, Entamoeba invadens
NAVGQTDKVKNTNLAAQKDQPIPP

SEQ ID NO: 2766421 - protein, 4 aa, Entamoeba invadens
NAVK

SEQ ID NO: 2766422 - protein, 6 aa, Entamoeba invadens
NAVPSQ

SEQ ID NO: 2766423 - protein, 4 aa, Entamoeba invadens
NAVS

SEQ ID NO: 2766424 - protein, 12 aa, Entamoeba invadens
NAVTNRKRRPYD

SEQ ID NO: 2766425 - protein, 9 aa, Entamoeba invadens
NAYENDDRF

SEQ ID NO: 2766426 - protein, 7 aa, Entamoeba invadens
NAYGTNP

SEQ ID NO: 2766427 - protein, 6 aa, Entamoeba invadens
NAYPNS

SEQ ID NO: 2766428 - protein, 5 aa, Entamoeba invadens
NAYRR

SEQ ID NO: 2766429 - protein, 14 aa, Entamoeba invadens
NCADVPKCKEGTIL

SEQ ID NO: 2766430 - protein, 24 aa, Entamoeba invadens
NCAEASDSKCTKCKGSNKPSDVGD

SEQ ID NO: 2766431 - protein, 5 aa, Entamoeba invadens
NCAEY

SEQ ID NO: 2766432 - protein, 9 aa, Entamoeba invadens
NCARTNRQG

SEQ ID NO: 2766433 - protein, 14 aa, Entamoeba invadens
NCATCGSGSCDSCE

SEQ ID NO: 2766434 - protein, 12 aa, Entamoeba invadens
NCATDNKGLEEF

SEQ ID NO: 2766435 - protein, 14 aa, Entamoeba invadens
NCDAEGCQNGQTKY

SEQ ID NO: 2766436 - protein, 8 aa, Entamoeba invadens
NCDGTNGI

SEQ ID NO: 2766437 - protein, 6 aa, Entamoeba invadens
NCDKCD

SEQ ID NO: 2766438 - protein, 16 aa, Entamoeba invadens
NCDPTCGGQCNGTTGV

SEQ ID NO: 2766439 - protein, 16 aa, Entamoeba invadens
NCDPTCGRQCNGSTGA

SEQ ID NO: 2766440 - protein, 10 aa, Entamoeba invadens
NCDRCTQEKS

SEQ ID NO: 2766441 - protein, 70 aa, Entamoeba invadens
NCDSTKIGGTANYTNLNNKTNEMNNSNTQQTNSGTATQESTNYNTNDTSKNTTKNNTNFSMTENDEQRFE

SEQ ID NO: 2766442 - protein, 70 aa, Entamoeba invadens
NCDSTKIGGTANYTNLNNKTNGMNNLNTQQTNSGTATQESTNYNTNDTSKNTTKNNTNFSMTENDEQRFE

SEQ ID NO: 2766443 - protein, 229 aa, Entamoeba invadens
NCDSTSENSGSCEEKSSNEKSESVVTPSVEKSKEESSTEKSQSKEHSESKSKEHSESKSKEESSTEKSQSKEHSESKSKEESSTEKSQSKEHSESKSKEHSESKSKEESSTEKSQSKEHSESKSKEHSESKSKEHSESKSKEESSTEKSQSKEHSESKSKEHSESKSKEESSTEKSQSKEHSESKSKEHSESKSKEESSTEKSQSKEHSESKSKEHSEANQKKSHQLKR

SEQ ID NO: 2766444 - protein, 13 aa, Entamoeba invadens
NCDTKGCDTGDTP

SEQ ID NO: 2766445 - protein, 11 aa, Entamoeba invadens
NCEENSCGKLS

SEQ ID NO: 2766446 - protein, 11 aa, Entamoeba invadens
NCEEYETNTNT

SEQ ID NO: 2766447 - protein, 12 aa, Entamoeba invadens
NCEFGESDAHPL

SEQ ID NO: 2766448 - protein, 16 aa, Entamoeba invadens
NCEGDIKKSDVKENKK

SEQ ID NO: 2766449 - protein, 6 aa, Entamoeba invadens
NCEGDM

SEQ ID NO: 2766450 - protein, 9 aa, Entamoeba invadens
NCEKCTNGS

SEQ ID NO: 2766451 - protein, 8 aa, Entamoeba invadens
NCELTDDA

SEQ ID NO: 2766452 - protein, 4 aa, Entamoeba invadens
NCEM

SEQ ID NO: 2766453 - protein, 11 aa, Entamoeba invadens
NCENCTSQSKN

SEQ ID NO: 2766454 - protein, 5 aa, Entamoeba invadens
NCENS

SEQ ID NO: 2766455 - protein, 6 aa, Entamoeba invadens
NCENST

SEQ ID NO: 2766456 - protein, 7 aa, Entamoeba invadens
NCENTKY

SEQ ID NO: 2766457 - protein, 15 aa, Entamoeba invadens
NCEPNKESKFEVDPE

SEQ ID NO: 2766458 - protein, 10 aa, Entamoeba invadens
NCEQCDTNAT

SEQ ID NO: 2766459 - protein, 9 aa, Entamoeba invadens
NCESCQSGE

SEQ ID NO: 2766460 - protein, 8 aa, Entamoeba invadens
NCESCQSK

SEQ ID NO: 2766461 - protein, 11 aa, Entamoeba invadens
NCESGNCDTKS

SEQ ID NO: 2766462 - protein, 18 aa, Entamoeba invadens
NCETCPGGNEKKCTTCKT

SEQ ID NO: 2766463 - protein, 8 aa, Entamoeba invadens
NCETCSRN

SEQ ID NO: 2766464 - protein, 9 aa, Entamoeba invadens
NCEYSSKSN

SEQ ID NO: 2766465 - protein, 7 aa, Entamoeba invadens
NCGAGTY

SEQ ID NO: 2766466 - protein, 9 aa, Entamoeba invadens
NCGECTSTS

SEQ ID NO: 2766467 - protein, 7 aa, Entamoeba invadens
NCGEITN

SEQ ID NO: 2766468 - protein, 16 aa, Entamoeba invadens
NCGENDPNGIRGTCST

SEQ ID NO: 2766469 - protein, 12 aa, Entamoeba invadens
NCGENNCSSDMG

SEQ ID NO: 2766470 - protein, 14 aa, Entamoeba invadens
NCGESEGRGKCSWT

SEQ ID NO: 2766471 - protein, 10 aa, Entamoeba invadens
NCGETTNNCK

SEQ ID NO: 2766472 - protein, 7 aa, Entamoeba invadens
NCGNGNC

SEQ ID NO: 2766473 - protein, 7 aa, Entamoeba invadens
NCGNTTP

SEQ ID NO: 2766474 - protein, 14 aa, Entamoeba invadens
NCGSSDDGECEQCN

SEQ ID NO: 2766475 - protein, 7 aa, Entamoeba invadens
NCGTATP

SEQ ID NO: 2766476 - protein, 6 aa, Entamoeba invadens
NCGTKF

SEQ ID NO: 2766477 - protein, 5 aa, Entamoeba invadens
NCHQD

SEQ ID NO: 2766478 - protein, 12 aa, Entamoeba invadens
NCIKDGEPQCEG

SEQ ID NO: 2766479 - protein, 11 aa, Entamoeba invadens
NCKEEQNSKCS

SEQ ID NO: 2766480 - protein, 6 aa, Entamoeba invadens
NCKKCS

SEQ ID NO: 2766481 - protein, 8 aa, Entamoeba invadens
NCKKHSTT

SEQ ID NO: 2766482 - protein, 9 aa, Entamoeba invadens
NCKNSYDKN

SEQ ID NO: 2766483 - protein, 7 aa, Entamoeba invadens
NCKQCSS

SEQ ID NO: 2766484 - protein, 12 aa, Entamoeba invadens
NCKSGTDRTGGA

SEQ ID NO: 2766485 - protein, 9 aa, Entamoeba invadens
NCKSQDEMG

SEQ ID NO: 2766486 - protein, 5 aa, Entamoeba invadens
NCKTC

SEQ ID NO: 2766487 - protein, 8 aa, Entamoeba invadens
NCKTCDSN

SEQ ID NO: 2766488 - protein, 11 aa, Entamoeba invadens
NCKTCGTNKTN

SEQ ID NO: 2766489 - protein, 16 aa, Entamoeba invadens
NCKTCKPGYAYTPSTG

SEQ ID NO: 2766490 - protein, 9 aa, Entamoeba invadens
NCKTCSSKE

SEQ ID NO: 2766491 - protein, 5 aa, Entamoeba invadens
NCKTY

SEQ ID NO: 2766492 - protein, 9 aa, Entamoeba invadens
NCKTYSTNL

SEQ ID NO: 2766493 - protein, 10 aa, Entamoeba invadens
NCLNKTENRC

SEQ ID NO: 2766494 - protein, 8 aa, Entamoeba invadens
NCNAEKGY

SEQ ID NO: 2766495 - protein, 7 aa, Entamoeba invadens
NCNATCD

SEQ ID NO: 2766496 - protein, 14 aa, Entamoeba invadens
NCNGCGGTADNCTH

SEQ ID NO: 2766497 - protein, 8 aa, Entamoeba invadens
NCNGPTNL

SEQ ID NO: 2766498 - protein, 13 aa, Entamoeba invadens
NCNKKSPKGCQRC

SEQ ID NO: 2766499 - protein, 6 aa, Entamoeba invadens
NCNKNS

SEQ ID NO: 2766500 - protein, 8 aa, Entamoeba invadens
NCNKNTGI

SEQ ID NO: 2766501 - protein, 9 aa, Entamoeba invadens
NCNPDKLKP

SEQ ID NO: 2766502 - protein, 5 aa, Entamoeba invadens
NCNPP

SEQ ID NO: 2766503 - protein, 6 aa, Entamoeba invadens
NCNQNS

SEQ ID NO: 2766504 - protein, 12 aa, Entamoeba invadens
NCNTCNGTAENN

SEQ ID NO: 2766505 - protein, 13 aa, Entamoeba invadens
NCNTSGCSTTSRY

SEQ ID NO: 2766506 - protein, 5 aa, Entamoeba invadens
NCNTT

SEQ ID NO: 2766507 - protein, 6 aa, Entamoeba invadens
NCNTYD

SEQ ID NO: 2766508 - protein, 13 aa, Entamoeba invadens
NCPSGTNGDGTQC

SEQ ID NO: 2766509 - protein, 15 aa, Entamoeba invadens
NCPSGTNGDGTQCTP

SEQ ID NO: 2766510 - protein, 7 aa, Entamoeba invadens
NCPTAST

SEQ ID NO: 2766511 - protein, 6 aa, Entamoeba invadens
NCQGYR

SEQ ID NO: 2766512 - protein, 6 aa, Entamoeba invadens
NCQPCK

SEQ ID NO: 2766513 - protein, 8 aa, Entamoeba invadens
NCQQYEGD

SEQ ID NO: 2766514 - protein, 9 aa, Entamoeba invadens
NCQTKTPGG

SEQ ID NO: 2766515 - protein, 8 aa, Entamoeba invadens
NCQTSAYS

SEQ ID NO: 2766516 - protein, 9 aa, Entamoeba invadens
NCRSSQTNL

SEQ ID NO: 2766517 - protein, 4 aa, Entamoeba invadens
NCRY

SEQ ID NO: 2766518 - protein, 21 aa, Entamoeba invadens
NCSENFDDKDYDENNVTNTKQ

SEQ ID NO: 2766519 - protein, 8 aa, Entamoeba invadens
NCSIGTTT

SEQ ID NO: 2766520 - protein, 6 aa, Entamoeba invadens
NCSISD

SEQ ID NO: 2766521 - protein, 7 aa, Entamoeba invadens
NCSISGS

SEQ ID NO: 2766522 - protein, 4 aa, Entamoeba invadens
NCSK

SEQ ID NO: 2766523 - protein, 7 aa, Entamoeba invadens
NCSKDKG

SEQ ID NO: 2766524 - protein, 6 aa, Entamoeba invadens
NCSKKK

SEQ ID NO: 2766525 - protein, 7 aa, Entamoeba invadens
NCSPCGE

SEQ ID NO: 2766526 - protein, 8 aa, Entamoeba invadens
NCSPNSTE

SEQ ID NO: 2766527 - protein, 8 aa, Entamoeba invadens
NCSRESGV

SEQ ID NO: 2766528 - protein, 5 aa, Entamoeba invadens
NCSSC

SEQ ID NO: 2766529 - protein, 12 aa, Entamoeba invadens
NCSSCDNSTGYC

SEQ ID NO: 2766530 - protein, 11 aa, Entamoeba invadens
NCSSCNNTNGN

SEQ ID NO: 2766531 - protein, 9 aa, Entamoeba invadens
NCSSCNSAD

SEQ ID NO: 2766532 - protein, 15 aa, Entamoeba invadens
NCSSNNSCSHSDSGT

SEQ ID NO: 2766533 - protein, 5 aa, Entamoeba invadens
NCSSS

SEQ ID NO: 2766534 - protein, 8 aa, Entamoeba invadens
NCSSTANG

SEQ ID NO: 2766535 - protein, 5 aa, Entamoeba invadens
NCSSY

SEQ ID NO: 2766536 - protein, 13 aa, Entamoeba invadens
NCSTCNEVEEEES

SEQ ID NO: 2766537 - protein, 6 aa, Entamoeba invadens
NCSTTT

SEQ ID NO: 2766538 - protein, 6 aa, Entamoeba invadens
NCTEGQ

SEQ ID NO: 2766539 - protein, 9 aa, Entamoeba invadens
NCTGEGKNL

SEQ ID NO: 2766540 - protein, 5 aa, Entamoeba invadens
NCTKC

SEQ ID NO: 2766541 - protein, 7 aa, Entamoeba invadens
NCTKCNT

SEQ ID NO: 2766542 - protein, 26 aa, Entamoeba invadens
NCTKENDQLKQIESETDRCQIKSSKG

SEQ ID NO: 2766543 - protein, 6 aa, Entamoeba invadens
NCTQMK

SEQ ID NO: 2766544 - protein, 9 aa, Entamoeba invadens
NCTSCKQRT

SEQ ID NO: 2766545 - protein, 10 aa, Entamoeba invadens
NCTSCNSATS

SEQ ID NO: 2766546 - protein, 18 aa, Entamoeba invadens
NCTSENKGCSQASNSCSD

SEQ ID NO: 2766547 - protein, 5 aa, Entamoeba invadens
NCTSG

SEQ ID NO: 2766548 - protein, 10 aa, Entamoeba invadens
NCTSTNPNFC

SEQ ID NO: 2766549 - protein, 10 aa, Entamoeba invadens
NCTSYTITNT

SEQ ID NO: 2766550 - protein, 6 aa, Entamoeba invadens
NCTTDT

SEQ ID NO: 2766551 - protein, 5 aa, Entamoeba invadens
NCTTK

SEQ ID NO: 2766552 - protein, 7 aa, Entamoeba invadens
NCTTKDA

SEQ ID NO: 2766553 - protein, 7 aa, Entamoeba invadens
NCTTNTL

SEQ ID NO: 2766554 - protein, 6 aa, Entamoeba invadens
NCVEKP

SEQ ID NO: 2766555 - protein, 9 aa, Entamoeba invadens
NCVERSSKG

SEQ ID NO: 2766556 - protein, 9 aa, Entamoeba invadens
NCVNNSGNV

SEQ ID NO: 2766557 - protein, 6 aa, Entamoeba invadens
NCVQNN

SEQ ID NO: 2766558 - protein, 4 aa, Entamoeba invadens
NCYD

SEQ ID NO: 2766559 - protein, 7 aa, Entamoeba invadens
NCYESQK

SEQ ID NO: 2766560 - protein, 5 aa, Entamoeba invadens
NDAEM

SEQ ID NO: 2766561 - protein, 10 aa, Entamoeba invadens
NDAKPIPISE

SEQ ID NO: 2766562 - protein, 6 aa, Entamoeba invadens
NDANGI

SEQ ID NO: 2766563 - protein, 5 aa, Entamoeba invadens
NDARE

SEQ ID NO: 2766564 - protein, 26 aa, Entamoeba invadens
NDARNDQRRLRTREIRNKKTGDGTNL

SEQ ID NO: 2766565 - protein, 5 aa, Entamoeba invadens
NDATH

SEQ ID NO: 2766566 - protein, 5 aa, Entamoeba invadens
NDCNM

SEQ ID NO: 2766567 - protein, 4 aa, Entamoeba invadens
NDCP

SEQ ID NO: 2766568 - protein, 12 aa, Entamoeba invadens
NDCSSGYYKTNN

SEQ ID NO: 2766569 - protein, 8 aa, Entamoeba invadens
NDCTINNE

SEQ ID NO: 2766570 - protein, 6 aa, Entamoeba invadens
NDCTTD

SEQ ID NO: 2766571 - protein, 9 aa, Entamoeba invadens
NDDAAETPK

SEQ ID NO: 2766572 - protein, 12 aa, Entamoeba invadens
NDDAPECGSSAS

SEQ ID NO: 2766573 - protein, 5 aa, Entamoeba invadens
NDDDE

SEQ ID NO: 2766574 - protein, 7 aa, Entamoeba invadens
NDDDEET

SEQ ID NO: 2766575 - protein, 36 aa, Entamoeba invadens
NDDEIEVPQENSKETNHSSNQSSRSESSRSDTDDDF

SEQ ID NO: 2766576 - protein, 5 aa, Entamoeba invadens
NDDGK

SEQ ID NO: 2766577 - protein, 7 aa, Entamoeba invadens
NDDGTLC

SEQ ID NO: 2766578 - protein, 36 aa, Entamoeba invadens
NDDKETPKEKTVKVPKKTKGKKKKIKKTKKTDNLKK

SEQ ID NO: 2766579 - protein, 14 aa, Entamoeba invadens
NDDKPIPKTEGYEN

SEQ ID NO: 2766580 - protein, 7 aa, Entamoeba invadens
NDDMNNK

SEQ ID NO: 2766581 - protein, 5 aa, Entamoeba invadens
NDDNS

SEQ ID NO: 2766582 - protein, 9 aa, Entamoeba invadens
NDDSPECGS

SEQ ID NO: 2766583 - protein, 9 aa, Entamoeba invadens
NDDSSVQQD

SEQ ID NO: 2766584 - protein, 9 aa, Entamoeba invadens
NDDTEVSGD

SEQ ID NO: 2766585 - protein, 7 aa, Entamoeba invadens
NDDVKEL

SEQ ID NO: 2766586 - protein, 5 aa, Entamoeba invadens
NDECP

SEQ ID NO: 2766587 - protein, 7 aa, Entamoeba invadens
NDEEIKE

SEQ ID NO: 2766588 - protein, 17 aa, Entamoeba invadens
NDEEKNTENENESLPSL

SEQ ID NO: 2766589 - protein, 11 aa, Entamoeba invadens
NDEENRTPEKY

SEQ ID NO: 2766590 - protein, 12 aa, Entamoeba invadens
NDEIKSSDEKSN

SEQ ID NO: 2766591 - protein, 12 aa, Entamoeba invadens
NDEKATNVGDTR

SEQ ID NO: 2766592 - protein, 6 aa, Entamoeba invadens
NDEKEG

SEQ ID NO: 2766593 - protein, 11 aa, Entamoeba invadens
NDEMESKDVGG

SEQ ID NO: 2766594 - protein, 6 aa, Entamoeba invadens
NDENEA

SEQ ID NO: 2766595 - protein, 9 aa, Entamoeba invadens
NDENEEIPV

SEQ ID NO: 2766596 - protein, 8 aa, Entamoeba invadens
NDENGERV

SEQ ID NO: 2766597 - protein, 11 aa, Entamoeba invadens
NDENGKHTNTI

SEQ ID NO: 2766598 - protein, 20 aa, Entamoeba invadens
NDENNVNKKKENSRTKMKEN

SEQ ID NO: 2766599 - protein, 8 aa, Entamoeba invadens
NDENTLND

SEQ ID NO: 2766600 - protein, 8 aa, Entamoeba invadens
NDENVNAK

SEQ ID NO: 2766601 - protein, 8 aa, Entamoeba invadens
NDEPNPVE

SEQ ID NO: 2766602 - protein, 12 aa, Entamoeba invadens
NDEPVEMVEEHI

SEQ ID NO: 2766603 - protein, 10 aa, Entamoeba invadens
NDETNQNTSN

SEQ ID NO: 2766604 - protein, 9 aa, Entamoeba invadens
NDETQNRTF

SEQ ID NO: 2766605 - protein, 6 aa, Entamoeba invadens
NDETVP

SEQ ID NO: 2766606 - protein, 8 aa, Entamoeba invadens
NDFDNSQY

SEQ ID NO: 2766607 - protein, 9 aa, Entamoeba invadens
NDFEDGKYP

SEQ ID NO: 2766608 - protein, 14 aa, Entamoeba invadens
NDGECPMDDSSDAN

SEQ ID NO: 2766609 - protein, 10 aa, Entamoeba invadens
NDGEECDGGK

SEQ ID NO: 2766610 - protein, 8 aa, Entamoeba invadens
NDGKCQSM

SEQ ID NO: 2766611 - protein, 13 aa, Entamoeba invadens
NDGLDKSSGSPIC

SEQ ID NO: 2766612 - protein, 9 aa, Entamoeba invadens
NDGLDNENR

SEQ ID NO: 2766613 - protein, 4 aa, Entamoeba invadens
NDGN

SEQ ID NO: 2766614 - protein, 13 aa, Entamoeba invadens
NDGNEAKSWDRKG

SEQ ID NO: 2766615 - protein, 6 aa, Entamoeba invadens
NDGNNV

SEQ ID NO: 2766616 - protein, 18 aa, Entamoeba invadens
NDGNRPSLLTSSNGEVSD

SEQ ID NO: 2766617 - protein, 6 aa, Entamoeba invadens
NDGNSY

SEQ ID NO: 2766618 - protein, 4 aa, Entamoeba invadens
NDGS

SEQ ID NO: 2766619 - protein, 8 aa, Entamoeba invadens
NDGSSITP

SEQ ID NO: 2766620 - protein, 16 aa, Entamoeba invadens
NDGSTLETTSAKVRTG

SEQ ID NO: 2766621 - protein, 5 aa, Entamoeba invadens
NDGTQ

SEQ ID NO: 2766622 - protein, 4 aa, Entamoeba invadens
NDGV

SEQ ID NO: 2766623 - protein, 9 aa, Entamoeba invadens
NDGYGGDNC

SEQ ID NO: 2766624 - protein, 14 aa, Entamoeba invadens
NDGYNLNSSTTNFT

SEQ ID NO: 2766625 - protein, 5 aa, Entamoeba invadens
NDGYY

SEQ ID NO: 2766626 - protein, 6 aa, Entamoeba invadens
NDHPIA

SEQ ID NO: 2766627 - protein, 7 aa, Entamoeba invadens
NDIESTV

SEQ ID NO: 2766628 - protein, 8 aa, Entamoeba invadens
NDIETQNS

SEQ ID NO: 2766629 - protein, 8 aa, Entamoeba invadens
NDIGNERL

SEQ ID NO: 2766630 - protein, 4 aa, Entamoeba invadens
NDIK

SEQ ID NO: 2766631 - protein, 6 aa, Entamoeba invadens
NDIKTQ

SEQ ID NO: 2766632 - protein, 11 aa, Entamoeba invadens
NDIPDTTIPFN

SEQ ID NO: 2766633 - protein, 12 aa, Entamoeba invadens
NDIQSEENFFVM

SEQ ID NO: 2766634 - protein, 8 aa, Entamoeba invadens
NDISGVES

SEQ ID NO: 2766635 - protein, 7 aa, Entamoeba invadens
NDISTTS

SEQ ID NO: 2766636 - protein, 6 aa, Entamoeba invadens
NDKAKI

SEQ ID NO: 2766637 - protein, 18 aa, Entamoeba invadens
NDKDCKKCNNNCTTCTQH

SEQ ID NO: 2766638 - protein, 6 aa, Entamoeba invadens
NDKDNS

SEQ ID NO: 2766639 - protein, 7 aa, Entamoeba invadens
NDKDNSC

SEQ ID NO: 2766640 - protein, 20 aa, Entamoeba invadens
NDKEANATRHRGTESIKPPE

SEQ ID NO: 2766641 - protein, 6 aa, Entamoeba invadens
NDKEEW

SEQ ID NO: 2766642 - protein, 8 aa, Entamoeba invadens
NDKEPTRF

SEQ ID NO: 2766643 - protein, 8 aa, Entamoeba invadens
NDKFETFR

SEQ ID NO: 2766644 - protein, 8 aa, Entamoeba invadens
NDKGECEK

SEQ ID NO: 2766645 - protein, 6 aa, Entamoeba invadens
NDKGEK

SEQ ID NO: 2766646 - protein, 9 aa, Entamoeba invadens
NDKGTYCEK

SEQ ID NO: 2766647 - protein, 6 aa, Entamoeba invadens
NDKISE

SEQ ID NO: 2766648 - protein, 5 aa, Entamoeba invadens
NDKKG

SEQ ID NO: 2766649 - protein, 7 aa, Entamoeba invadens
NDKKHCT

SEQ ID NO: 2766650 - protein, 6 aa, Entamoeba invadens
NDKNLT

SEQ ID NO: 2766651 - protein, 8 aa, Entamoeba invadens
NDKQIPNC

SEQ ID NO: 2766652 - protein, 19 aa, Entamoeba invadens
NDKQQTPLAGKDKISHTEE

SEQ ID NO: 2766653 - protein, 25 aa, Entamoeba invadens
NDKQSCIDSNTNSTHYDEDKHNAIT

SEQ ID NO: 2766654 - protein, 14 aa, Entamoeba invadens
NDKQYNRSKEAQFN

SEQ ID NO: 2766655 - protein, 6 aa, Entamoeba invadens
NDKSNG

SEQ ID NO: 2766656 - protein, 6 aa, Entamoeba invadens
NDKTKV

SEQ ID NO: 2766657 - protein, 7 aa, Entamoeba invadens
NDKTTPM

SEQ ID NO: 2766658 - protein, 6 aa, Entamoeba invadens
NDKVEY

SEQ ID NO: 2766659 - protein, 12 aa, Entamoeba invadens
NDKYNKGLDTYG

SEQ ID NO: 2766660 - protein, 6 aa, Entamoeba invadens
NDLDSV

SEQ ID NO: 2766661 - protein, 9 aa, Entamoeba invadens
NDLDTSNTY

SEQ ID NO: 2766662 - protein, 19 aa, Entamoeba invadens
NDLDYSDSSSSLDEEKPII

SEQ ID NO: 2766663 - protein, 4 aa, Entamoeba invadens
NDLQ

SEQ ID NO: 2766664 - protein, 6 aa, Entamoeba invadens
NDLRNS

SEQ ID NO: 2766665 - protein, 12 aa, Entamoeba invadens
NDLTSSEKKTDH

SEQ ID NO: 2766666 - protein, 5 aa, Entamoeba invadens
NDNDI

SEQ ID NO: 2766667 - protein, 4 aa, Entamoeba invadens
NDNE

SEQ ID NO: 2766668 - protein, 8 aa, Entamoeba invadens
NDNGDIPE

SEQ ID NO: 2766669 - protein, 8 aa, Entamoeba invadens
NDNGNCTA

SEQ ID NO: 2766670 - protein, 7 aa, Entamoeba invadens
NDNHLTE

SEQ ID NO: 2766671 - protein, 11 aa, Entamoeba invadens
NDNKDQNGKCV

SEQ ID NO: 2766672 - protein, 17 aa, Entamoeba invadens
NDNLKEKCSQFASKSSG

SEQ ID NO: 2766673 - protein, 8 aa, Entamoeba invadens
NDNLREGV

SEQ ID NO: 2766674 - protein, 14 aa, Entamoeba invadens
NDNNNKDASDKRYT

SEQ ID NO: 2766675 - protein, 10 aa, Entamoeba invadens
NDNNSHANGE

SEQ ID NO: 2766676 - protein, 12 aa, Entamoeba invadens
NDNPIPVDKETR

SEQ ID NO: 2766677 - protein, 14 aa, Entamoeba invadens
NDNRTNNKKDENIK

SEQ ID NO: 2766678 - protein, 4 aa, Entamoeba invadens
NDNS

SEQ ID NO: 2766679 - protein, 9 aa, Entamoeba invadens
NDNSKEKIT

SEQ ID NO: 2766680 - protein, 5 aa, Entamoeba invadens
NDNTE

SEQ ID NO: 2766681 - protein, 7 aa, Entamoeba invadens
NDNTNTL

SEQ ID NO: 2766682 - protein, 7 aa, Entamoeba invadens
NDNVNEA

SEQ ID NO: 2766683 - protein, 7 aa, Entamoeba invadens
NDNVSRY

SEQ ID NO: 2766684 - protein, 11 aa, Entamoeba invadens
NDNYPQYDSNT

SEQ ID NO: 2766685 - protein, 10 aa, Entamoeba invadens
NDPDSNDDLT

SEQ ID NO: 2766686 - protein, 7 aa, Entamoeba invadens
NDPHEDT

SEQ ID NO: 2766687 - protein, 27 aa, Entamoeba invadens
NDPITPKLSPRKTEQQRSNSLGNGSGA

SEQ ID NO: 2766688 - protein, 4 aa, Entamoeba invadens
NDPK

SEQ ID NO: 2766689 - protein, 7 aa, Entamoeba invadens
NDPNDSS

SEQ ID NO: 2766690 - protein, 7 aa, Entamoeba invadens
NDPNNPA

SEQ ID NO: 2766691 - protein, 6 aa, Entamoeba invadens
NDPPDK

SEQ ID NO: 2766692 - protein, 13 aa, Entamoeba invadens
NDPPVEKVNRTPI

SEQ ID NO: 2766693 - protein, 9 aa, Entamoeba invadens
NDPSGNSGY

SEQ ID NO: 2766694 - protein, 7 aa, Entamoeba invadens
NDPSQRI

SEQ ID NO: 2766695 - protein, 8 aa, Entamoeba invadens
NDQKNELE

SEQ ID NO: 2766696 - protein, 25 aa, Entamoeba invadens
NDQKTTSVLDKTSESGSGSNSGSKK

SEQ ID NO: 2766697 - protein, 7 aa, Entamoeba invadens
NDQLQQT

SEQ ID NO: 2766698 - protein, 4 aa, Entamoeba invadens
NDQN

SEQ ID NO: 2766699 - protein, 9 aa, Entamoeba invadens
NDQNHEKGK

SEQ ID NO: 2766700 - protein, 7 aa, Entamoeba invadens
NDQPQWS

SEQ ID NO: 2766701 - protein, 4 aa, Entamoeba invadens
NDQQ

SEQ ID NO: 2766702 - protein, 9 aa, Entamoeba invadens
NDQRREQTR

SEQ ID NO: 2766703 - protein, 6 aa, Entamoeba invadens
NDQTRV

SEQ ID NO: 2766704 - protein, 5 aa, Entamoeba invadens
NDQTV

SEQ ID NO: 2766705 - protein, 8 aa, Entamoeba invadens
NDRFDPDL

SEQ ID NO: 2766706 - protein, 8 aa, Entamoeba invadens
NDRGECEK

SEQ ID NO: 2766707 - protein, 5 aa, Entamoeba invadens
NDRIP

SEQ ID NO: 2766708 - protein, 5 aa, Entamoeba invadens
NDRKG

SEQ ID NO: 2766709 - protein, 7 aa, Entamoeba invadens
NDRKRNV

SEQ ID NO: 2766710 - protein, 16 aa, Entamoeba invadens
NDRPRIEREVSDREDA

SEQ ID NO: 2766711 - protein, 5 aa, Entamoeba invadens
NDRSK

SEQ ID NO: 2766712 - protein, 5 aa, Entamoeba invadens
NDRVG

SEQ ID NO: 2766713 - protein, 4 aa, Entamoeba invadens
NDSA

SEQ ID NO: 2766714 - protein, 8 aa, Entamoeba invadens
NDSCSSVD

SEQ ID NO: 2766715 - protein, 6 aa, Entamoeba invadens
NDSEMK

SEQ ID NO: 2766716 - protein, 9 aa, Entamoeba invadens
NDSESNEKL

SEQ ID NO: 2766717 - protein, 4 aa, Entamoeba invadens
NDSK

SEQ ID NO: 2766718 - protein, 7 aa, Entamoeba invadens
NDSKNNL

SEQ ID NO: 2766719 - protein, 19 aa, Entamoeba invadens
NDSNDNRETTEIPVSEETR

SEQ ID NO: 2766720 - protein, 5 aa, Entamoeba invadens
NDSNI

SEQ ID NO: 2766721 - protein, 5 aa, Entamoeba invadens
NDSNL

SEQ ID NO: 2766722 - protein, 8 aa, Entamoeba invadens
NDSQDGGS

SEQ ID NO: 2766723 - protein, 12 aa, Entamoeba invadens
NDSQIITKESTQ

SEQ ID NO: 2766724 - protein, 8 aa, Entamoeba invadens
NDSSPHGA

SEQ ID NO: 2766725 - protein, 5 aa, Entamoeba invadens
NDSVL

SEQ ID NO: 2766726 - protein, 7 aa, Entamoeba invadens
NDSVTTI

SEQ ID NO: 2766727 - protein, 4 aa, Entamoeba invadens
NDSY

SEQ ID NO: 2766728 - protein, 19 aa, Entamoeba invadens
NDTAKGGKEGCNECNQDGT

SEQ ID NO: 2766729 - protein, 9 aa, Entamoeba invadens
NDTCGEEEM

SEQ ID NO: 2766730 - protein, 33 aa, Entamoeba invadens
NDTCTSDTNCNTINGSDCTTCDKSKTFKRTKNR

SEQ ID NO: 2766731 - protein, 11 aa, Entamoeba invadens
NDTDDNAESAY

SEQ ID NO: 2766732 - protein, 10 aa, Entamoeba invadens
NDTDKCNSTS

SEQ ID NO: 2766733 - protein, 10 aa, Entamoeba invadens
NDTETQDNIT

SEQ ID NO: 2766734 - protein, 4 aa, Entamoeba invadens
NDTF

SEQ ID NO: 2766735 - protein, 14 aa, Entamoeba invadens
NDTFTDDTTYSGFG

SEQ ID NO: 2766736 - protein, 7 aa, Entamoeba invadens
NDTGKYD

SEQ ID NO: 2766737 - protein, 5 aa, Entamoeba invadens
NDTIA

SEQ ID NO: 2766738 - protein, 4 aa, Entamoeba invadens
NDTK

SEQ ID NO: 2766739 - protein, 11 aa, Entamoeba invadens
NDTKASSNYQN

SEQ ID NO: 2766740 - protein, 5 aa, Entamoeba invadens
NDTKI

SEQ ID NO: 2766741 - protein, 22 aa, Entamoeba invadens
NDTLSKTLEKGEFEAYPERDFE

SEQ ID NO: 2766742 - protein, 13 aa, Entamoeba invadens
NDTNCDKCSEKCE

SEQ ID NO: 2766743 - protein, 5 aa, Entamoeba invadens
NDTNG

SEQ ID NO: 2766744 - protein, 10 aa, Entamoeba invadens
NDTNKQPNLW

SEQ ID NO: 2766745 - protein, 8 aa, Entamoeba invadens
NDTNRELM

SEQ ID NO: 2766746 - protein, 7 aa, Entamoeba invadens
NDTNYKN

SEQ ID NO: 2766747 - protein, 4 aa, Entamoeba invadens
NDTQ

SEQ ID NO: 2766748 - protein, 7 aa, Entamoeba invadens
NDTQEGI

SEQ ID NO: 2766749 - protein, 10 aa, Entamoeba invadens
NDTQEGTKVN

SEQ ID NO: 2766750 - protein, 11 aa, Entamoeba invadens
NDTQNKQTTSF

SEQ ID NO: 2766751 - protein, 11 aa, Entamoeba invadens
NDTQTKQTTSF

SEQ ID NO: 2766752 - protein, 5 aa, Entamoeba invadens
NDTSH

SEQ ID NO: 2766753 - protein, 15 aa, Entamoeba invadens
NDTSSEYTEYTNHGG

SEQ ID NO: 2766754 - protein, 8 aa, Entamoeba invadens
NDTTHKNN

SEQ ID NO: 2766755 - protein, 14 aa, Entamoeba invadens
NDTVEDGPNPFTKQ

SEQ ID NO: 2766756 - protein, 14 aa, Entamoeba invadens
NDTVQDGPNPFTKE

SEQ ID NO: 2766757 - protein, 6 aa, Entamoeba invadens
NDVDNE

SEQ ID NO: 2766758 - protein, 9 aa, Entamoeba invadens
NDVEGKATY

SEQ ID NO: 2766759 - protein, 8 aa, Entamoeba invadens
NDVMGTRS

SEQ ID NO: 2766760 - protein, 6 aa, Entamoeba invadens
NDVSGR

SEQ ID NO: 2766761 - protein, 4 aa, Entamoeba invadens
NDYD

SEQ ID NO: 2766762 - protein, 5 aa, Entamoeba invadens
NDYNA

SEQ ID NO: 2766763 - protein, 6 aa, Entamoeba invadens
NDYNES

SEQ ID NO: 2766764 - protein, 6 aa, Entamoeba invadens
NDYNVQ

SEQ ID NO: 2766765 - protein, 7 aa, Entamoeba invadens
NDYQPAL

SEQ ID NO: 2766766 - protein, 4 aa, Entamoeba invadens
NEAC

SEQ ID NO: 2766767 - protein, 37 aa, Entamoeba invadens
NEAEEAKKEAERVEKEREEKIKEEEQRRLRTQKEALE

SEQ ID NO: 2766768 - protein, 12 aa, Entamoeba invadens
NEAETTSNEMSE

SEQ ID NO: 2766769 - protein, 10 aa, Entamoeba invadens
NEAISEQKMK

SEQ ID NO: 2766770 - protein, 29 aa, Entamoeba invadens
NEAKEALENENKSKEQQRNDLENQNKKMT

SEQ ID NO: 2766771 - protein, 8 aa, Entamoeba invadens
NEAKETYK

SEQ ID NO: 2766772 - protein, 49 aa, Entamoeba invadens
NEAKQKSQGLFSSPRTRQMQKPQLSQSSSSLDTIQSPQQTQQIQQHTSP

SEQ ID NO: 2766773 - protein, 11 aa, Entamoeba invadens
NEANGQGYCSK

SEQ ID NO: 2766774 - protein, 7 aa, Entamoeba invadens
NEAQTKY

SEQ ID NO: 2766775 - protein, 6 aa, Entamoeba invadens
NEARKS

SEQ ID NO: 2766776 - protein, 21 aa, Entamoeba invadens
NEATDDSSSSNEKNNNGLSGG

SEQ ID NO: 2766777 - protein, 10 aa, Entamoeba invadens
NEATEYPQPN

SEQ ID NO: 2766778 - protein, 5 aa, Entamoeba invadens
NEATY

SEQ ID NO: 2766779 - protein, 9 aa, Entamoeba invadens
NEAVNSKCT

SEQ ID NO: 2766780 - protein, 5 aa, Entamoeba invadens
NECAK

SEQ ID NO: 2766781 - protein, 8 aa, Entamoeba invadens
NECAPLPD

SEQ ID NO: 2766782 - protein, 9 aa, Entamoeba invadens
NECDKCDEN

SEQ ID NO: 2766783 - protein, 19 aa, Entamoeba invadens
NECDKCDKNCKACSSQTTC

SEQ ID NO: 2766784 - protein, 8 aa, Entamoeba invadens
NECDNCSG

SEQ ID NO: 2766785 - protein, 23 aa, Entamoeba invadens
NECEKCDDNCETCSVSNTKCTSC

SEQ ID NO: 2766786 - protein, 16 aa, Entamoeba invadens
NECEKCDENCKTCSSQ

SEQ ID NO: 2766787 - protein, 9 aa, Entamoeba invadens
NECEKCSKT

SEQ ID NO: 2766788 - protein, 13 aa, Entamoeba invadens
NECENKTESFTEE

SEQ ID NO: 2766789 - protein, 8 aa, Entamoeba invadens
NECETCDK

SEQ ID NO: 2766790 - protein, 14 aa, Entamoeba invadens
NECHGSTNTECTSC

SEQ ID NO: 2766791 - protein, 8 aa, Entamoeba invadens
NECKESGI

SEQ ID NO: 2766792 - protein, 11 aa, Entamoeba invadens
NECKNKNENYP

SEQ ID NO: 2766793 - protein, 10 aa, Entamoeba invadens
NECKNTDDKC

SEQ ID NO: 2766794 - protein, 9 aa, Entamoeba invadens
NECKSNKTC

SEQ ID NO: 2766795 - protein, 8 aa, Entamoeba invadens
NECNTANG

SEQ ID NO: 2766796 - protein, 7 aa, Entamoeba invadens
NECNTEK

SEQ ID NO: 2766797 - protein, 4 aa, Entamoeba invadens
NECQ

SEQ ID NO: 2766798 - protein, 5 aa, Entamoeba invadens
NECQK

SEQ ID NO: 2766799 - protein, 14 aa, Entamoeba invadens
NECQKCSENCKKCS

SEQ ID NO: 2766800 - protein, 7 aa, Entamoeba invadens
NECQSCE

SEQ ID NO: 2766801 - protein, 6 aa, Entamoeba invadens
NECQTC

SEQ ID NO: 2766802 - protein, 5 aa, Entamoeba invadens
NECRQ

SEQ ID NO: 2766803 - protein, 4 aa, Entamoeba invadens
NECS

SEQ ID NO: 2766804 - protein, 5 aa, Entamoeba invadens
NECSK

SEQ ID NO: 2766805 - protein, 10 aa, Entamoeba invadens
NECTQCKEPA

SEQ ID NO: 2766806 - protein, 7 aa, Entamoeba invadens
NECTSCD

SEQ ID NO: 2766807 - protein, 6 aa, Entamoeba invadens
NECVSK

SEQ ID NO: 2766808 - protein, 6 aa, Entamoeba invadens
NEDAPD

SEQ ID NO: 2766809 - protein, 17 aa, Entamoeba invadens
NEDDNVTNIKQQDENKV

SEQ ID NO: 2766810 - protein, 10 aa, Entamoeba invadens
NEDEEKKDVL

SEQ ID NO: 2766811 - protein, 4 aa, Entamoeba invadens
NEDF

SEQ ID NO: 2766812 - protein, 7 aa, Entamoeba invadens
NEDGECK

SEQ ID NO: 2766813 - protein, 11 aa, Entamoeba invadens
NEDGKGIPVGQ

SEQ ID NO: 2766814 - protein, 8 aa, Entamoeba invadens
NEDGTVSN

SEQ ID NO: 2766815 - protein, 7 aa, Entamoeba invadens
NEDKQRV

SEQ ID NO: 2766816 - protein, 8 aa, Entamoeba invadens
NEDKTISC

SEQ ID NO: 2766817 - protein, 11 aa, Entamoeba invadens
NEDLSQKESAW

SEQ ID NO: 2766818 - protein, 9 aa, Entamoeba invadens
NEDNNVNSF

SEQ ID NO: 2766819 - protein, 7 aa, Entamoeba invadens
NEDNTCK

SEQ ID NO: 2766820 - protein, 14 aa, Entamoeba invadens
NEDQFGDESATIDN

SEQ ID NO: 2766821 - protein, 4 aa, Entamoeba invadens
NEDS

SEQ ID NO: 2766822 - protein, 6 aa, Entamoeba invadens
NEDSPY

SEQ ID NO: 2766823 - protein, 8 aa, Entamoeba invadens
NEDSSIIR

SEQ ID NO: 2766824 - protein, 13 aa, Entamoeba invadens
NEDTEEIPVNTET

SEQ ID NO: 2766825 - protein, 16 aa, Entamoeba invadens
NEDTQNGNIPVDKETR

SEQ ID NO: 2766826 - protein, 4 aa, Entamoeba invadens
NEDV

SEQ ID NO: 2766827 - protein, 4 aa, Entamoeba invadens
NEDY

SEQ ID NO: 2766828 - protein, 6 aa, Entamoeba invadens
NEDYGY

SEQ ID NO: 2766829 - protein, 9 aa, Entamoeba invadens
NEECDGGEG

SEQ ID NO: 2766830 - protein, 7 aa, Entamoeba invadens
NEEDEEH

SEQ ID NO: 2766831 - protein, 4 aa, Entamoeba invadens
NEEG

SEQ ID NO: 2766832 - protein, 8 aa, Entamoeba invadens
NEEGETPL

SEQ ID NO: 2766833 - protein, 4 aa, Entamoeba invadens
NEEH

SEQ ID NO: 2766834 - protein, 19 aa, Entamoeba invadens
NEEHTNKGSVITTTTAANK

SEQ ID NO: 2766835 - protein, 4 aa, Entamoeba invadens
NEEI

SEQ ID NO: 2766836 - protein, 6 aa, Entamoeba invadens
NEEINR

SEQ ID NO: 2766837 - protein, 5 aa, Entamoeba invadens
NEEKI

SEQ ID NO: 2766838 - protein, 10 aa, Entamoeba invadens
NEEKKLGEGS

SEQ ID NO: 2766839 - protein, 8 aa, Entamoeba invadens
NEEKRKEA

SEQ ID NO: 2766840 - protein, 5 aa, Entamoeba invadens
NEEKT

SEQ ID NO: 2766841 - protein, 13 aa, Entamoeba invadens
NEEKTLEKSRKEY

SEQ ID NO: 2766842 - protein, 5 aa, Entamoeba invadens
NEELQ

SEQ ID NO: 2766843 - protein, 13 aa, Entamoeba invadens
NEELRKKIITLGN

SEQ ID NO: 2766844 - protein, 16 aa, Entamoeba invadens
NEENCRTEIGDNQRPT

SEQ ID NO: 2766845 - protein, 16 aa, Entamoeba invadens
NEENCRTQVNDEQRPT

SEQ ID NO: 2766846 - protein, 11 aa, Entamoeba invadens
NEENRKKAEMN

SEQ ID NO: 2766847 - protein, 45 aa, Entamoeba invadens
NEENSQSETPQETQQNAQPTQSTENVTPQANAPQQPENTENAHEN

SEQ ID NO: 2766848 - protein, 8 aa, Entamoeba invadens
NEENTDSG

SEQ ID NO: 2766849 - protein, 7 aa, Entamoeba invadens
NEERQNS

SEQ ID NO: 2766850 - protein, 4 aa, Entamoeba invadens
NEES

SEQ ID NO: 2766851 - protein, 4 aa, Entamoeba invadens
NEET

SEQ ID NO: 2766852 - protein, 6 aa, Entamoeba invadens
NEETQC

SEQ ID NO: 2766853 - protein, 12 aa, Entamoeba invadens
NEFKTSETTSKA

SEQ ID NO: 2766854 - protein, 13 aa, Entamoeba invadens
NEFKTSETTSKEC

SEQ ID NO: 2766855 - protein, 11 aa, Entamoeba invadens
NEFNTSCTSGY

SEQ ID NO: 2766856 - protein, 4 aa, Entamoeba invadens
NEGC

SEQ ID NO: 2766857 - protein, 6 aa, Entamoeba invadens
NEGEPD

SEQ ID NO: 2766858 - protein, 5 aa, Entamoeba invadens
NEGET

SEQ ID NO: 2766859 - protein, 5 aa, Entamoeba invadens
NEGLG

SEQ ID NO: 2766860 - protein, 5 aa, Entamoeba invadens
NEGLT

SEQ ID NO: 2766861 - protein, 8 aa, Entamoeba invadens
NEGNETTC

SEQ ID NO: 2766862 - protein, 5 aa, Entamoeba invadens
NEGPI

SEQ ID NO: 2766863 - protein, 6 aa, Entamoeba invadens
NEGTQE

SEQ ID NO: 2766864 - protein, 7 aa, Entamoeba invadens
NEGTTEI

SEQ ID NO: 2766865 - protein, 7 aa, Entamoeba invadens
NEGTTVS

SEQ ID NO: 2766866 - protein, 7 aa, Entamoeba invadens
NEGVPTE

SEQ ID NO: 2766867 - protein, 11 aa, Entamoeba invadens
NEHDCKQSTNF

SEQ ID NO: 2766868 - protein, 6 aa, Entamoeba invadens
NEHTAV

SEQ ID NO: 2766869 - protein, 4 aa, Entamoeba invadens
NEIE

SEQ ID NO: 2766870 - protein, 8 aa, Entamoeba invadens
NEIENEEQ

SEQ ID NO: 2766871 - protein, 5 aa, Entamoeba invadens
NEINA

SEQ ID NO: 2766872 - protein, 5 aa, Entamoeba invadens
NEIND

SEQ ID NO: 2766873 - protein, 10 aa, Entamoeba invadens
NEIPKYSAGE

SEQ ID NO: 2766874 - protein, 5 aa, Entamoeba invadens
NEIPQ

SEQ ID NO: 2766875 - protein, 4 aa, Entamoeba invadens
NEIS

SEQ ID NO: 2766876 - protein, 10 aa, Entamoeba invadens
NEISFGDEND

SEQ ID NO: 2766877 - protein, 19 aa, Entamoeba invadens
NEISFGDESDKIQIESESR

SEQ ID NO: 2766878 - protein, 9 aa, Entamoeba invadens
NEISQNTTD

SEQ ID NO: 2766879 - protein, 6 aa, Entamoeba invadens
NEITNS

SEQ ID NO: 2766880 - protein, 6 aa, Entamoeba invadens
NEITSN

SEQ ID NO: 2766881 - protein, 10 aa, Entamoeba invadens
NEKCDNENEV

SEQ ID NO: 2766882 - protein, 10 aa, Entamoeba invadens
NEKCETYSQH

SEQ ID NO: 2766883 - protein, 10 aa, Entamoeba invadens
NEKDEELKIK

SEQ ID NO: 2766884 - protein, 28 aa, Entamoeba invadens
NEKDEKVVKSKSEEMDDEKTEEAMEKEK

SEQ ID NO: 2766885 - protein, 24 aa, Entamoeba invadens
NEKEDFDKKKVEHEKHDNALRSKS

SEQ ID NO: 2766886 - protein, 4 aa, Entamoeba invadens
NEKG

SEQ ID NO: 2766887 - protein, 9 aa, Entamoeba invadens
NEKGNTKIE

SEQ ID NO: 2766888 - protein, 7 aa, Entamoeba invadens
NEKIEDE

SEQ ID NO: 2766889 - protein, 5 aa, Entamoeba invadens
NEKIK

SEQ ID NO: 2766890 - protein, 21 aa, Entamoeba invadens
NEKKAEKQENAEASTPSESKP

SEQ ID NO: 2766891 - protein, 15 aa, Entamoeba invadens
NEKKEKCEKNSQHGC

SEQ ID NO: 2766892 - protein, 7 aa, Entamoeba invadens
NEKKENM

SEQ ID NO: 2766893 - protein, 10 aa, Entamoeba invadens
NEKKSVEEDC

SEQ ID NO: 2766894 - protein, 5 aa, Entamoeba invadens
NEKLP

SEQ ID NO: 2766895 - protein, 9 aa, Entamoeba invadens
NEKNDTEKI

SEQ ID NO: 2766896 - protein, 14 aa, Entamoeba invadens
NEKNEKCEKYSQHG

SEQ ID NO: 2766897 - protein, 13 aa, Entamoeba invadens
NEKNEKCETYSQH

SEQ ID NO: 2766898 - protein, 9 aa, Entamoeba invadens
NEKPERASQ

SEQ ID NO: 2766899 - protein, 5 aa, Entamoeba invadens
NEKQE

SEQ ID NO: 2766900 - protein, 9 aa, Entamoeba invadens
NEKQGSQNQ

SEQ ID NO: 2766901 - protein, 6 aa, Entamoeba invadens
NEKSQR

SEQ ID NO: 2766902 - protein, 8 aa, Entamoeba invadens
NEKSTTKI

SEQ ID NO: 2766903 - protein, 28 aa, Entamoeba invadens
NEKTETQKGDETTSQVPQRGNEDTSQIT

SEQ ID NO: 2766904 - protein, 10 aa, Entamoeba invadens
NEKTGQCENK

SEQ ID NO: 2766905 - protein, 15 aa, Entamoeba invadens
NEKTNAKLTDFGSSR

SEQ ID NO: 2766906 - protein, 7 aa, Entamoeba invadens
NEKTPLV

SEQ ID NO: 2766907 - protein, 9 aa, Entamoeba invadens
NEKTSHENN

SEQ ID NO: 2766908 - protein, 8 aa, Entamoeba invadens
NEKTSNTV

SEQ ID NO: 2766909 - protein, 50 aa, Entamoeba invadens
NEKTSTPDVQELPSNGLVEEQKDEEESKKDDDDEEPEVKSRGEEQADKAM

SEQ ID NO: 2766910 - protein, 9 aa, Entamoeba invadens
NEKVGEGSF

SEQ ID NO: 2766911 - protein, 6 aa, Entamoeba invadens
NEKVNA

SEQ ID NO: 2766912 - protein, 8 aa, Entamoeba invadens
NEKVTKGL

SEQ ID NO: 2766913 - protein, 12 aa, Entamoeba invadens
NEKVTKNTTNYT

SEQ ID NO: 2766914 - protein, 5 aa, Entamoeba invadens
NEKYR

SEQ ID NO: 2766915 - protein, 9 aa, Entamoeba invadens
NEKYTKSAD

SEQ ID NO: 2766916 - protein, 5 aa, Entamoeba invadens
NELAN

SEQ ID NO: 2766917 - protein, 13 aa, Entamoeba invadens
NELEETKKIGEGS

SEQ ID NO: 2766918 - protein, 9 aa, Entamoeba invadens
NELESKYKT

SEQ ID NO: 2766919 - protein, 6 aa, Entamoeba invadens
NELGDA

SEQ ID NO: 2766920 - protein, 7 aa, Entamoeba invadens
NELGPSG

SEQ ID NO: 2766921 - protein, 7 aa, Entamoeba invadens
NELPGGM

SEQ ID NO: 2766922 - protein, 14 aa, Entamoeba invadens
NELPVSGEGEKKNL

SEQ ID NO: 2766923 - protein, 13 aa, Entamoeba invadens
NELSEDKKIGEGS

SEQ ID NO: 2766924 - protein, 9 aa, Entamoeba invadens
NELSKGECD

SEQ ID NO: 2766925 - protein, 18 aa, Entamoeba invadens
NELTEEKEKNQKEKEEYL

SEQ ID NO: 2766926 - protein, 8 aa, Entamoeba invadens
NELTQTIK

SEQ ID NO: 2766927 - protein, 4 aa, Entamoeba invadens
NEMN

SEQ ID NO: 2766928 - protein, 5 aa, Entamoeba invadens
NEMNN

SEQ ID NO: 2766929 - protein, 7 aa, Entamoeba invadens
NEMRQPP

SEQ ID NO: 2766930 - protein, 4 aa, Entamoeba invadens
NENC

SEQ ID NO: 2766931 - protein, 4 aa, Entamoeba invadens
NENE

SEQ ID NO: 2766932 - protein, 17 aa, Entamoeba invadens
NENEKTDMSKKSKSDEE

SEQ ID NO: 2766933 - protein, 6 aa, Entamoeba invadens
NENEQI

SEQ ID NO: 2766934 - protein, 7 aa, Entamoeba invadens
NENFPLK

SEQ ID NO: 2766935 - protein, 6 aa, Entamoeba invadens
NENFTS

SEQ ID NO: 2766936 - protein, 4 aa, Entamoeba invadens
NENG

SEQ ID NO: 2766937 - protein, 15 aa, Entamoeba invadens
NENGKCVEDSNCQLK

SEQ ID NO: 2766938 - protein, 8 aa, Entamoeba invadens
NENGNKVD

SEQ ID NO: 2766939 - protein, 6 aa, Entamoeba invadens
NENIIN

SEQ ID NO: 2766940 - protein, 19 aa, Entamoeba invadens
NENKCRKEVNDKNRPPIEA

SEQ ID NO: 2766941 - protein, 5 aa, Entamoeba invadens
NENKT

SEQ ID NO: 2766942 - protein, 6 aa, Entamoeba invadens
NENMVD

SEQ ID NO: 2766943 - protein, 16 aa, Entamoeba invadens
NENNDSTNCSYQNEKG

SEQ ID NO: 2766944 - protein, 5 aa, Entamoeba invadens
NENNS

SEQ ID NO: 2766945 - protein, 8 aa, Entamoeba invadens
NENNSHSN

SEQ ID NO: 2766946 - protein, 5 aa, Entamoeba invadens
NENPY

SEQ ID NO: 2766947 - protein, 5 aa, Entamoeba invadens
NENQD

SEQ ID NO: 2766948 - protein, 8 aa, Entamoeba invadens
NENREGIR

SEQ ID NO: 2766949 - protein, 9 aa, Entamoeba invadens
NENRHNERR

SEQ ID NO: 2766950 - protein, 7 aa, Entamoeba invadens
NENSESN

SEQ ID NO: 2766951 - protein, 17 aa, Entamoeba invadens
NENSYKIGKKSEWSSHK

SEQ ID NO: 2766952 - protein, 5 aa, Entamoeba invadens
NENTQ

SEQ ID NO: 2766953 - protein, 5 aa, Entamoeba invadens
NENVE

SEQ ID NO: 2766954 - protein, 7 aa, Entamoeba invadens
NENYKCP

SEQ ID NO: 2766955 - protein, 6 aa, Entamoeba invadens
NENYQQ

SEQ ID NO: 2766956 - protein, 8 aa, Entamoeba invadens
NEPDQRPG

SEQ ID NO: 2766957 - protein, 6 aa, Entamoeba invadens
NEPEPI

SEQ ID NO: 2766958 - protein, 4 aa, Entamoeba invadens
NEPF

SEQ ID NO: 2766959 - protein, 6 aa, Entamoeba invadens
NEPFDI

SEQ ID NO: 2766960 - protein, 6 aa, Entamoeba invadens
NEPKQQ

SEQ ID NO: 2766961 - protein, 7 aa, Entamoeba invadens
NEPKSVN

SEQ ID NO: 2766962 - protein, 8 aa, Entamoeba invadens
NEPNNPRD

SEQ ID NO: 2766963 - protein, 8 aa, Entamoeba invadens
NEPPQYNG

SEQ ID NO: 2766964 - protein, 11 aa, Entamoeba invadens
NEPSKRSSLEN

SEQ ID NO: 2766965 - protein, 13 aa, Entamoeba invadens
NEPTKRSSSENVK

SEQ ID NO: 2766966 - protein, 4 aa, Entamoeba invadens
NEQG

SEQ ID NO: 2766967 - protein, 5 aa, Entamoeba invadens
NEQID

SEQ ID NO: 2766968 - protein, 5 aa, Entamoeba invadens
NEQKI

SEQ ID NO: 2766969 - protein, 4 aa, Entamoeba invadens
NEQL

SEQ ID NO: 2766970 - protein, 8 aa, Entamoeba invadens
NEQQNEVQ

SEQ ID NO: 2766971 - protein, 6 aa, Entamoeba invadens
NEQSDC

SEQ ID NO: 2766972 - protein, 6 aa, Entamoeba invadens
NEQSDV

SEQ ID NO: 2766973 - protein, 11 aa, Entamoeba invadens
NEQTKNKYMNG

SEQ ID NO: 2766974 - protein, 14 aa, Entamoeba invadens
NEQTQEMQNQISET

SEQ ID NO: 2766975 - protein, 8 aa, Entamoeba invadens
NERAKEID

SEQ ID NO: 2766976 - protein, 4 aa, Entamoeba invadens
NERD

SEQ ID NO: 2766977 - protein, 4 aa, Entamoeba invadens
NERE

SEQ ID NO: 2766978 - protein, 9 aa, Entamoeba invadens
NEREVSTSS

SEQ ID NO: 2766979 - protein, 6 aa, Entamoeba invadens
NERGQS

SEQ ID NO: 2766980 - protein, 17 aa, Entamoeba invadens
NERKCSQCTTNYYPSPT

SEQ ID NO: 2766981 - protein, 10 aa, Entamoeba invadens
NERKNTRSSC

SEQ ID NO: 2766982 - protein, 10 aa, Entamoeba invadens
NERKYADDQV

SEQ ID NO: 2766983 - protein, 5 aa, Entamoeba invadens
NERLT

SEQ ID NO: 2766984 - protein, 6 aa, Entamoeba invadens
NERRDT

SEQ ID NO: 2766985 - protein, 4 aa, Entamoeba invadens
NERS

SEQ ID NO: 2766986 - protein, 9 aa, Entamoeba invadens
NERSESRHN

SEQ ID NO: 2766987 - protein, 6 aa, Entamoeba invadens
NERVTG

SEQ ID NO: 2766988 - protein, 5 aa, Entamoeba invadens
NESCQ

SEQ ID NO: 2766989 - protein, 7 aa, Entamoeba invadens
NESCRPP

SEQ ID NO: 2766990 - protein, 11 aa, Entamoeba invadens
NESDPDGKQNM

SEQ ID NO: 2766991 - protein, 4 aa, Entamoeba invadens
NESE

SEQ ID NO: 2766992 - protein, 6 aa, Entamoeba invadens
NESEDF

SEQ ID NO: 2766993 - protein, 7 aa, Entamoeba invadens
NESGNVK

SEQ ID NO: 2766994 - protein, 10 aa, Entamoeba invadens
NESGSTYKQS

SEQ ID NO: 2766995 - protein, 6 aa, Entamoeba invadens
NESGVG

SEQ ID NO: 2766996 - protein, 11 aa, Entamoeba invadens
NESKGCTRTSF

SEQ ID NO: 2766997 - protein, 11 aa, Entamoeba invadens
NESKNYTIEES

SEQ ID NO: 2766998 - protein, 38 aa, Entamoeba invadens
NESLAEKVKEAKNANEEKTKIREDLENEKKKNETTENE

SEQ ID NO: 2766999 - protein, 14 aa, Entamoeba invadens
NESNIDINTNPTHI

SEQ ID NO: 2767000 - protein, 17 aa, Entamoeba invadens
NESNIDINTNPTHITSD

SEQ ID NO: 2767001 - protein, 7 aa, Entamoeba invadens
NESPPSC

SEQ ID NO: 2767002 - protein, 7 aa, Entamoeba invadens
NESPRSP

SEQ ID NO: 2767003 - protein, 7 aa, Entamoeba invadens
NESQTQI

SEQ ID NO: 2767004 - protein, 6 aa, Entamoeba invadens
NESSDV

SEQ ID NO: 2767005 - protein, 6 aa, Entamoeba invadens
NESSFE

SEQ ID NO: 2767006 - protein, 6 aa, Entamoeba invadens
NESTQI

SEQ ID NO: 2767007 - protein, 5 aa, Entamoeba invadens
NESYD

SEQ ID NO: 2767008 - protein, 6 aa, Entamoeba invadens
NESYGS

SEQ ID NO: 2767009 - protein, 8 aa, Entamoeba invadens
NESYVQGT

SEQ ID NO: 2767010 - protein, 10 aa, Entamoeba invadens
NESYYTGPSP

SEQ ID NO: 2767011 - protein, 18 aa, Entamoeba invadens
NETAADNAKIYNRSGCPC

SEQ ID NO: 2767012 - protein, 15 aa, Entamoeba invadens
NETCNNKCNTSDGTC

SEQ ID NO: 2767013 - protein, 6 aa, Entamoeba invadens
NETDYF

SEQ ID NO: 2767014 - protein, 14 aa, Entamoeba invadens
NETDYSCPGGVSTS

SEQ ID NO: 2767015 - protein, 4 aa, Entamoeba invadens
NETE

SEQ ID NO: 2767016 - protein, 6 aa, Entamoeba invadens
NETEIE

SEQ ID NO: 2767017 - protein, 8 aa, Entamoeba invadens
NETEITKR

SEQ ID NO: 2767018 - protein, 7 aa, Entamoeba invadens
NETFEDG

SEQ ID NO: 2767019 - protein, 6 aa, Entamoeba invadens
NETFEE

SEQ ID NO: 2767020 - protein, 5 aa, Entamoeba invadens
NETFN

SEQ ID NO: 2767021 - protein, 8 aa, Entamoeba invadens
NETFNEEN

SEQ ID NO: 2767022 - protein, 4 aa, Entamoeba invadens
NETG

SEQ ID NO: 2767023 - protein, 4 aa, Entamoeba invadens
NETH

SEQ ID NO: 2767024 - protein, 6 aa, Entamoeba invadens
NETHAT

SEQ ID NO: 2767025 - protein, 16 aa, Entamoeba invadens
NETHYNYETNNKTLNE

SEQ ID NO: 2767026 - protein, 6 aa, Entamoeba invadens
NETKDH

SEQ ID NO: 2767027 - protein, 6 aa, Entamoeba invadens
NETKDK

SEQ ID NO: 2767028 - protein, 13 aa, Entamoeba invadens
NETKGEYKSIEGE

SEQ ID NO: 2767029 - protein, 22 aa, Entamoeba invadens
NETLDKNVNEDLEDKSKLPKNP

SEQ ID NO: 2767030 - protein, 9 aa, Entamoeba invadens
NETNEGNGN

SEQ ID NO: 2767031 - protein, 8 aa, Entamoeba invadens
NETPIAEG

SEQ ID NO: 2767032 - protein, 5 aa, Entamoeba invadens
NETQQ

SEQ ID NO: 2767033 - protein, 6 aa, Entamoeba invadens
NETRTL

SEQ ID NO: 2767034 - protein, 10 aa, Entamoeba invadens
NETSEKQHIE

SEQ ID NO: 2767035 - protein, 6 aa, Entamoeba invadens
NETSGV

SEQ ID NO: 2767036 - protein, 6 aa, Entamoeba invadens
NETSHS

SEQ ID NO: 2767037 - protein, 7 aa, Entamoeba invadens
NETSMES

SEQ ID NO: 2767038 - protein, 7 aa, Entamoeba invadens
NETSNNN

SEQ ID NO: 2767039 - protein, 51 aa, Entamoeba invadens
NETSQNSLQNNTEKSGEEESTTQQQQQLPQAQPKSLECTKANEKTNDTKPV

SEQ ID NO: 2767040 - protein, 10 aa, Entamoeba invadens
NETSVDAKEV

SEQ ID NO: 2767041 - protein, 4 aa, Entamoeba invadens
NETT

SEQ ID NO: 2767042 - protein, 9 aa, Entamoeba invadens
NETTCTKCT

SEQ ID NO: 2767043 - protein, 10 aa, Entamoeba invadens
NETTESSENI

SEQ ID NO: 2767044 - protein, 13 aa, Entamoeba invadens
NETTFKSEQSVNG

SEQ ID NO: 2767045 - protein, 12 aa, Entamoeba invadens
NETTNTSNLKNT

SEQ ID NO: 2767046 - protein, 9 aa, Entamoeba invadens
NETTQQQGE

SEQ ID NO: 2767047 - protein, 14 aa, Entamoeba invadens
NETTRTKTSCTGSS

SEQ ID NO: 2767048 - protein, 4 aa, Entamoeba invadens
NETV

SEQ ID NO: 2767049 - protein, 5 aa, Entamoeba invadens
NETVS

SEQ ID NO: 2767050 - protein, 5 aa, Entamoeba invadens
NETVT

SEQ ID NO: 2767051 - protein, 11 aa, Entamoeba invadens
NETYSGSNLCE

SEQ ID NO: 2767052 - protein, 5 aa, Entamoeba invadens
NEVAD

SEQ ID NO: 2767053 - protein, 14 aa, Entamoeba invadens
NEVIDESDGTTKCE

SEQ ID NO: 2767054 - protein, 13 aa, Entamoeba invadens
NEVQERYENTAKA

SEQ ID NO: 2767055 - protein, 10 aa, Entamoeba invadens
NEVRNSDTGI

SEQ ID NO: 2767056 - protein, 16 aa, Entamoeba invadens
NEVSSMQEQESVDTTD

SEQ ID NO: 2767057 - protein, 5 aa, Entamoeba invadens
NEVTN

SEQ ID NO: 2767058 - protein, 12 aa, Entamoeba invadens
NEYKLSDDKIEC

SEQ ID NO: 2767059 - protein, 5 aa, Entamoeba invadens
NEYLN

SEQ ID NO: 2767060 - protein, 4 aa, Entamoeba invadens
NEYS

SEQ ID NO: 2767061 - protein, 6 aa, Entamoeba invadens
NEYYDQ

SEQ ID NO: 2767062 - protein, 8 aa, Entamoeba invadens
NFEDPSNQ

SEQ ID NO: 2767063 - protein, 5 aa, Entamoeba invadens
NFEGN

SEQ ID NO: 2767064 - protein, 9 aa, Entamoeba invadens
NFEKKNTPV

SEQ ID NO: 2767065 - protein, 7 aa, Entamoeba invadens
NFENERK

SEQ ID NO: 2767066 - protein, 10 aa, Entamoeba invadens
NFEPNENNTE

SEQ ID NO: 2767067 - protein, 6 aa, Entamoeba invadens
NFEPTN

SEQ ID NO: 2767068 - protein, 14 aa, Entamoeba invadens
NFESWSPSDQSEYQ

SEQ ID NO: 2767069 - protein, 4 aa, Entamoeba invadens
NFGE

SEQ ID NO: 2767070 - protein, 11 aa, Entamoeba invadens
NFGEKVKQKKV

SEQ ID NO: 2767071 - protein, 7 aa, Entamoeba invadens
NFGGNEE

SEQ ID NO: 2767072 - protein, 7 aa, Entamoeba invadens
NFGLTDG

SEQ ID NO: 2767073 - protein, 9 aa, Entamoeba invadens
NFGNDNDKM

SEQ ID NO: 2767074 - protein, 5 aa, Entamoeba invadens
NFGNE

SEQ ID NO: 2767075 - protein, 6 aa, Entamoeba invadens
NFGPNS

SEQ ID NO: 2767076 - protein, 4 aa, Entamoeba invadens
NFGR

SEQ ID NO: 2767077 - protein, 19 aa, Entamoeba invadens
NFGSSECSACPNGTVTEDS

SEQ ID NO: 2767078 - protein, 6 aa, Entamoeba invadens
NFGTED

SEQ ID NO: 2767079 - protein, 4 aa, Entamoeba invadens
NFIR

SEQ ID NO: 2767080 - protein, 7 aa, Entamoeba invadens
NFKDSTK

SEQ ID NO: 2767081 - protein, 15 aa, Entamoeba invadens
NFKENERNASKRAND

SEQ ID NO: 2767082 - protein, 9 aa, Entamoeba invadens
NFKQATERY

SEQ ID NO: 2767083 - protein, 4 aa, Entamoeba invadens
NFKT

SEQ ID NO: 2767084 - protein, 5 aa, Entamoeba invadens
NFKTV

SEQ ID NO: 2767085 - protein, 15 aa, Entamoeba invadens
NFKYTPQQTERMETQ

SEQ ID NO: 2767086 - protein, 4 aa, Entamoeba invadens
NFMD

SEQ ID NO: 2767087 - protein, 5 aa, Entamoeba invadens
NFMTN

SEQ ID NO: 2767088 - protein, 15 aa, Entamoeba invadens
NFNAEKNEIPVEQET

SEQ ID NO: 2767089 - protein, 6 aa, Entamoeba invadens
NFNDST

SEQ ID NO: 2767090 - protein, 7 aa, Entamoeba invadens
NFNDSTK

SEQ ID NO: 2767091 - protein, 9 aa, Entamoeba invadens
NFNNNTEAK

SEQ ID NO: 2767092 - protein, 4 aa, Entamoeba invadens
NFNT

SEQ ID NO: 2767093 - protein, 8 aa, Entamoeba invadens
NFPAPGED

SEQ ID NO: 2767094 - protein, 5 aa, Entamoeba invadens
NFPKT

SEQ ID NO: 2767095 - protein, 5 aa, Entamoeba invadens
NFPNT

SEQ ID NO: 2767096 - protein, 5 aa, Entamoeba invadens
NFPQS

SEQ ID NO: 2767097 - protein, 13 aa, Entamoeba invadens
NFPSKLTDFGSSR

SEQ ID NO: 2767098 - protein, 9 aa, Entamoeba invadens
NFQSKSPVN

SEQ ID NO: 2767099 - protein, 8 aa, Entamoeba invadens
NFRGKKDL

SEQ ID NO: 2767100 - protein, 5 aa, Entamoeba invadens
NFRQT

SEQ ID NO: 2767101 - protein, 10 aa, Entamoeba invadens
NFSDDDNSME

SEQ ID NO: 2767102 - protein, 6 aa, Entamoeba invadens
NFSDTN

SEQ ID NO: 2767103 - protein, 5 aa, Entamoeba invadens
NFSEN

SEQ ID NO: 2767104 - protein, 14 aa, Entamoeba invadens
NFSKDAKQIPVDSP

SEQ ID NO: 2767105 - protein, 9 aa, Entamoeba invadens
NFSKTTKKL

SEQ ID NO: 2767106 - protein, 12 aa, Entamoeba invadens
NFSNDDNSIEEF

SEQ ID NO: 2767107 - protein, 10 aa, Entamoeba invadens
NFSNDDNSME

SEQ ID NO: 2767108 - protein, 6 aa, Entamoeba invadens
NFSNTN

SEQ ID NO: 2767109 - protein, 5 aa, Entamoeba invadens
NFSSF

SEQ ID NO: 2767110 - protein, 15 aa, Entamoeba invadens
NFSYSYKENQNLEHE

SEQ ID NO: 2767111 - protein, 24 aa, Entamoeba invadens
NFTKTSTNQCTATPCGDGKFGTLP

SEQ ID NO: 2767112 - protein, 7 aa, Entamoeba invadens
NFTQEET

SEQ ID NO: 2767113 - protein, 4 aa, Entamoeba invadens
NFVD

SEQ ID NO: 2767114 - protein, 26 aa, Entamoeba invadens
NFYNKTEKNCQKCPKGTYSSLPGSEN

SEQ ID NO: 2767115 - protein, 5 aa, Entamoeba invadens
NGACT

SEQ ID NO: 2767116 - protein, 8 aa, Entamoeba invadens
NGAESPFI

SEQ ID NO: 2767117 - protein, 5 aa, Entamoeba invadens
NGAEV

SEQ ID NO: 2767118 - protein, 6 aa, Entamoeba invadens
NGAEVA

SEQ ID NO: 2767119 - protein, 16 aa, Entamoeba invadens
NGAKEDHPTGKTVNTT

SEQ ID NO: 2767120 - protein, 6 aa, Entamoeba invadens
NGAPDV

SEQ ID NO: 2767121 - protein, 6 aa, Entamoeba invadens
NGATIK

SEQ ID NO: 2767122 - protein, 7 aa, Entamoeba invadens
NGATLTK

SEQ ID NO: 2767123 - protein, 13 aa, Entamoeba invadens
NGATPSFGNSCES

SEQ ID NO: 2767124 - protein, 7 aa, Entamoeba invadens
NGAYSVS

SEQ ID NO: 2767125 - protein, 10 aa, Entamoeba invadens
NGCAKDKSTC

SEQ ID NO: 2767126 - protein, 6 aa, Entamoeba invadens
NGCEPI

SEQ ID NO: 2767127 - protein, 7 aa, Entamoeba invadens
NGCERPT

SEQ ID NO: 2767128 - protein, 5 aa, Entamoeba invadens
NGCES

SEQ ID NO: 2767129 - protein, 8 aa, Entamoeba invadens
NGCSEPNV

SEQ ID NO: 2767130 - protein, 9 aa, Entamoeba invadens
NGCSTTTGD

SEQ ID NO: 2767131 - protein, 13 aa, Entamoeba invadens
NGCTDESSTKEFA

SEQ ID NO: 2767132 - protein, 11 aa, Entamoeba invadens
NGCTGSGANNC

SEQ ID NO: 2767133 - protein, 7 aa, Entamoeba invadens
NGDAEGV

SEQ ID NO: 2767134 - protein, 5 aa, Entamoeba invadens
NGDCR

SEQ ID NO: 2767135 - protein, 10 aa, Entamoeba invadens
NGDDEGQQDV

SEQ ID NO: 2767136 - protein, 10 aa, Entamoeba invadens
NGDGSSYKEY

SEQ ID NO: 2767137 - protein, 7 aa, Entamoeba invadens
NGDGSVN

SEQ ID NO: 2767138 - protein, 6 aa, Entamoeba invadens
NGDKTT

SEQ ID NO: 2767139 - protein, 10 aa, Entamoeba invadens
NGDNDPQSDC

SEQ ID NO: 2767140 - protein, 8 aa, Entamoeba invadens
NGDNLNDS

SEQ ID NO: 2767141 - protein, 5 aa, Entamoeba invadens
NGDNP

SEQ ID NO: 2767142 - protein, 9 aa, Entamoeba invadens
NGDNTKQYD

SEQ ID NO: 2767143 - protein, 6 aa, Entamoeba invadens
NGDPQY

SEQ ID NO: 2767144 - protein, 17 aa, Entamoeba invadens
NGDPTNETDLKNSGVEH

SEQ ID NO: 2767145 - protein, 13 aa, Entamoeba invadens
NGDQCDCTTANIN

SEQ ID NO: 2767146 - protein, 6 aa, Entamoeba invadens
NGDQEF

SEQ ID NO: 2767147 - protein, 6 aa, Entamoeba invadens
NGDSCE

SEQ ID NO: 2767148 - protein, 6 aa, Entamoeba invadens
NGDSSA

SEQ ID NO: 2767149 - protein, 5 aa, Entamoeba invadens
NGDTV

SEQ ID NO: 2767150 - protein, 7 aa, Entamoeba invadens
NGDTYKP

SEQ ID NO: 2767151 - protein, 11 aa, Entamoeba invadens
NGDVQETFTPS

SEQ ID NO: 2767152 - protein, 30 aa, Entamoeba invadens
NGDYMSNEYTGTGAQKADITRTGKRTFSGM

SEQ ID NO: 2767153 - protein, 8 aa, Entamoeba invadens
NGDYSEPY

SEQ ID NO: 2767154 - protein, 7 aa, Entamoeba invadens
NGECTAC

SEQ ID NO: 2767155 - protein, 6 aa, Entamoeba invadens
NGEDFP

SEQ ID NO: 2767156 - protein, 12 aa, Entamoeba invadens
NGEDHSKAGGYY

SEQ ID NO: 2767157 - protein, 16 aa, Entamoeba invadens
NGEDYGSGTIESDTST

SEQ ID NO: 2767158 - protein, 8 aa, Entamoeba invadens
NGEEETER

SEQ ID NO: 2767159 - protein, 5 aa, Entamoeba invadens
NGEFT

SEQ ID NO: 2767160 - protein, 12 aa, Entamoeba invadens
NGEFTDTNGVYS

SEQ ID NO: 2767161 - protein, 4 aa, Entamoeba invadens
NGEG

SEQ ID NO: 2767162 - protein, 18 aa, Entamoeba invadens
NGEKDQYKRIKESERKDA

SEQ ID NO: 2767163 - protein, 12 aa, Entamoeba invadens
NGEKSDETRKCT

SEQ ID NO: 2767164 - protein, 8 aa, Entamoeba invadens
NGEKVNVR

SEQ ID NO: 2767165 - protein, 4 aa, Entamoeba invadens
NGEM

SEQ ID NO: 2767166 - protein, 9 aa, Entamoeba invadens
NGENEDDIE

SEQ ID NO: 2767167 - protein, 21 aa, Entamoeba invadens
NGENKTDEISSEVRDKEASLM

SEQ ID NO: 2767168 - protein, 8 aa, Entamoeba invadens
NGEPTKCE

SEQ ID NO: 2767169 - protein, 26 aa, Entamoeba invadens
NGEQPPETPIEVPTTKTVDDSNLSDL

SEQ ID NO: 2767170 - protein, 6 aa, Entamoeba invadens
NGEQVQ

SEQ ID NO: 2767171 - protein, 8 aa, Entamoeba invadens
NGESPVDS

SEQ ID NO: 2767172 - protein, 9 aa, Entamoeba invadens
NGESQQCSQ

SEQ ID NO: 2767173 - protein, 6 aa, Entamoeba invadens
NGESVN

SEQ ID NO: 2767174 - protein, 4 aa, Entamoeba invadens
NGET

SEQ ID NO: 2767175 - protein, 6 aa, Entamoeba invadens
NGETAF

SEQ ID NO: 2767176 - protein, 8 aa, Entamoeba invadens
NGETGCTK

SEQ ID NO: 2767177 - protein, 8 aa, Entamoeba invadens
NGETSNCE

SEQ ID NO: 2767178 - protein, 9 aa, Entamoeba invadens
NGETTSCEN

SEQ ID NO: 2767179 - protein, 5 aa, Entamoeba invadens
NGETY

SEQ ID NO: 2767180 - protein, 12 aa, Entamoeba invadens
NGEYIDNNNNCQ

SEQ ID NO: 2767181 - protein, 8 aa, Entamoeba invadens
NGFEPYKE

SEQ ID NO: 2767182 - protein, 4 aa, Entamoeba invadens
NGFL

SEQ ID NO: 2767183 - protein, 18 aa, Entamoeba invadens
NGFNKENTEVTAQLNDGL

SEQ ID NO: 2767184 - protein, 7 aa, Entamoeba invadens
NGFPDNG

SEQ ID NO: 2767185 - protein, 6 aa, Entamoeba invadens
NGGCEA

SEQ ID NO: 2767186 - protein, 6 aa, Entamoeba invadens
NGGCSP

SEQ ID NO: 2767187 - protein, 15 aa, Entamoeba invadens
NGGDVTINSDSNTKI

SEQ ID NO: 2767188 - protein, 7 aa, Entamoeba invadens
NGGENYK

SEQ ID NO: 2767189 - protein, 9 aa, Entamoeba invadens
NGGIGSSDE

SEQ ID NO: 2767190 - protein, 9 aa, Entamoeba invadens
NGGKKYKMP

SEQ ID NO: 2767191 - protein, 6 aa, Entamoeba invadens
NGGKRA

SEQ ID NO: 2767192 - protein, 16 aa, Entamoeba invadens
NGGNPTEKYVSDKARM

SEQ ID NO: 2767193 - protein, 10 aa, Entamoeba invadens
NGGPLETVQD

SEQ ID NO: 2767194 - protein, 15 aa, Entamoeba invadens
NGGPTYYSTKSGDSW

SEQ ID NO: 2767195 - protein, 12 aa, Entamoeba invadens
NGGSDKNDDQEC

SEQ ID NO: 2767196 - protein, 5 aa, Entamoeba invadens
NGGSI

SEQ ID NO: 2767197 - protein, 12 aa, Entamoeba invadens
NGGSITANPNYI

SEQ ID NO: 2767198 - protein, 8 aa, Entamoeba invadens
NGGSKTPI

SEQ ID NO: 2767199 - protein, 7 aa, Entamoeba invadens
NGGSVDN

SEQ ID NO: 2767200 - protein, 5 aa, Entamoeba invadens
NGGSY

SEQ ID NO: 2767201 - protein, 6 aa, Entamoeba invadens
NGGTNI

SEQ ID NO: 2767202 - protein, 7 aa, Entamoeba invadens
NGGTVSC

SEQ ID NO: 2767203 - protein, 12 aa, Entamoeba invadens
NGGTYPVPTEQQ

SEQ ID NO: 2767204 - protein, 4 aa, Entamoeba invadens
NGGY

SEQ ID NO: 2767205 - protein, 11 aa, Entamoeba invadens
NGGYLKSGTKF

SEQ ID NO: 2767206 - protein, 5 aa, Entamoeba invadens
NGIER

SEQ ID NO: 2767207 - protein, 13 aa, Entamoeba invadens
NGIGSLKGKAGVC

SEQ ID NO: 2767208 - protein, 4 aa, Entamoeba invadens
NGIL

SEQ ID NO: 2767209 - protein, 6 aa, Entamoeba invadens
NGIPGG

SEQ ID NO: 2767210 - protein, 10 aa, Entamoeba invadens
NGIPVNKESR

SEQ ID NO: 2767211 - protein, 4 aa, Entamoeba invadens
NGIQ

SEQ ID NO: 2767212 - protein, 4 aa, Entamoeba invadens
NGIR

SEQ ID NO: 2767213 - protein, 6 aa, Entamoeba invadens
NGISDE

SEQ ID NO: 2767214 - protein, 8 aa, Entamoeba invadens
NGISSGEI

SEQ ID NO: 2767215 - protein, 11 aa, Entamoeba invadens
NGITEKTASEC

SEQ ID NO: 2767216 - protein, 5 aa, Entamoeba invadens
NGKAS

SEQ ID NO: 2767217 - protein, 4 aa, Entamoeba invadens
NGKC

SEQ ID NO: 2767218 - protein, 22 aa, Entamoeba invadens
NGKCKSAQNCNGPSSLSPASCD

SEQ ID NO: 2767219 - protein, 8 aa, Entamoeba invadens
NGKCNECE

SEQ ID NO: 2767220 - protein, 9 aa, Entamoeba invadens
NGKCNECES

SEQ ID NO: 2767221 - protein, 7 aa, Entamoeba invadens
NGKCNSC

SEQ ID NO: 2767222 - protein, 7 aa, Entamoeba invadens
NGKDIEE

SEQ ID NO: 2767223 - protein, 7 aa, Entamoeba invadens
NGKDKTV

SEQ ID NO: 2767224 - protein, 6 aa, Entamoeba invadens
NGKDWS

SEQ ID NO: 2767225 - protein, 8 aa, Entamoeba invadens
NGKEAVGT

SEQ ID NO: 2767226 - protein, 6 aa, Entamoeba invadens
NGKGTK

SEQ ID NO: 2767227 - protein, 5 aa, Entamoeba invadens
NGKHT

SEQ ID NO: 2767228 - protein, 4 aa, Entamoeba invadens
NGKI

SEQ ID NO: 2767229 - protein, 6 aa, Entamoeba invadens
NGKIQT

SEQ ID NO: 2767230 - protein, 8 aa, Entamoeba invadens
NGKITKCN

SEQ ID NO: 2767231 - protein, 5 aa, Entamoeba invadens
NGKKL

SEQ ID NO: 2767232 - protein, 6 aa, Entamoeba invadens
NGKKLE

SEQ ID NO: 2767233 - protein, 17 aa, Entamoeba invadens
NGKLDHEEEQCDSGASC

SEQ ID NO: 2767234 - protein, 9 aa, Entamoeba invadens
NGKLETYSN

SEQ ID NO: 2767235 - protein, 8 aa, Entamoeba invadens
NGKQIPNC

SEQ ID NO: 2767236 - protein, 7 aa, Entamoeba invadens
NGKQNTT

SEQ ID NO: 2767237 - protein, 15 aa, Entamoeba invadens
NGKRLEKTNSMSNEQ

SEQ ID NO: 2767238 - protein, 11 aa, Entamoeba invadens
NGKRLKQHASI

SEQ ID NO: 2767239 - protein, 12 aa, Entamoeba invadens
NGKRLTKPDNVD

SEQ ID NO: 2767240 - protein, 15 aa, Entamoeba invadens
NGKRPDIDNSMPSKL

SEQ ID NO: 2767241 - protein, 10 aa, Entamoeba invadens
NGKRPEFDDT

SEQ ID NO: 2767242 - protein, 5 aa, Entamoeba invadens
NGKRY

SEQ ID NO: 2767243 - protein, 8 aa, Entamoeba invadens
NGKSIHED

SEQ ID NO: 2767244 - protein, 7 aa, Entamoeba invadens
NGKSKTE

SEQ ID NO: 2767245 - protein, 6 aa, Entamoeba invadens
NGKSLE

SEQ ID NO: 2767246 - protein, 4 aa, Entamoeba invadens
NGKT

SEQ ID NO: 2767247 - protein, 8 aa, Entamoeba invadens
NGKTLNED

SEQ ID NO: 2767248 - protein, 18 aa, Entamoeba invadens
NGKTTKCQSTSEMTPNGK

SEQ ID NO: 2767249 - protein, 6 aa, Entamoeba invadens
NGKVEE

SEQ ID NO: 2767250 - protein, 19 aa, Entamoeba invadens
NGKVTKCDSSSKMDTNGMC

SEQ ID NO: 2767251 - protein, 18 aa, Entamoeba invadens
NGKYANSEGQCADCSSEC

SEQ ID NO: 2767252 - protein, 8 aa, Entamoeba invadens
NGKYLDKG

SEQ ID NO: 2767253 - protein, 10 aa, Entamoeba invadens
NGKYPKDGAN

SEQ ID NO: 2767254 - protein, 13 aa, Entamoeba invadens
NGKYPKPSKNYKC

SEQ ID NO: 2767255 - protein, 6 aa, Entamoeba invadens
NGKYQI

SEQ ID NO: 2767256 - protein, 7 aa, Entamoeba invadens
NGKYQVG

SEQ ID NO: 2767257 - protein, 10 aa, Entamoeba invadens
NGLDNNDTDI

SEQ ID NO: 2767258 - protein, 5 aa, Entamoeba invadens
NGLES

SEQ ID NO: 2767259 - protein, 9 aa, Entamoeba invadens
NGLGVNSTD

SEQ ID NO: 2767260 - protein, 6 aa, Entamoeba invadens
NGLKPL

SEQ ID NO: 2767261 - protein, 8 aa, Entamoeba invadens
NGLPDSAG

SEQ ID NO: 2767262 - protein, 10 aa, Entamoeba invadens
NGLPSSDNPY

SEQ ID NO: 2767263 - protein, 11 aa, Entamoeba invadens
NGLTTTNPPTC

SEQ ID NO: 2767264 - protein, 4 aa, Entamoeba invadens
NGLV

SEQ ID NO: 2767265 - protein, 7 aa, Entamoeba invadens
NGMNTTV

SEQ ID NO: 2767266 - protein, 7 aa, Entamoeba invadens
NGMNVRA

SEQ ID NO: 2767267 - protein, 4 aa, Entamoeba invadens
NGMP

SEQ ID NO: 2767268 - protein, 10 aa, Entamoeba invadens
NGMSTDTSLD

SEQ ID NO: 2767269 - protein, 11 aa, Entamoeba invadens
NGMVDSGEECD

SEQ ID NO: 2767270 - protein, 13 aa, Entamoeba invadens
NGNAATDNTEDAL

SEQ ID NO: 2767271 - protein, 7 aa, Entamoeba invadens
NGNANTI

SEQ ID NO: 2767272 - protein, 4 aa, Entamoeba invadens
NGNC

SEQ ID NO: 2767273 - protein, 12 aa, Entamoeba invadens
NGNCTKVSDMSN

SEQ ID NO: 2767274 - protein, 6 aa, Entamoeba invadens
NGNDIG

SEQ ID NO: 2767275 - protein, 17 aa, Entamoeba invadens
NGNEYTVDETNTNTEIS

SEQ ID NO: 2767276 - protein, 21 aa, Entamoeba invadens
NGNGSGDVKEPDTSYSGLKEK

SEQ ID NO: 2767277 - protein, 14 aa, Entamoeba invadens
NGNKCDDCATGKIT

SEQ ID NO: 2767278 - protein, 24 aa, Entamoeba invadens
NGNKNCRTSVNSSTPSKIDYNQKG

SEQ ID NO: 2767279 - protein, 6 aa, Entamoeba invadens
NGNKPR

SEQ ID NO: 2767280 - protein, 6 aa, Entamoeba invadens
NGNQNG

SEQ ID NO: 2767281 - protein, 15 aa, Entamoeba invadens
NGNRFEKDDNISSEE

SEQ ID NO: 2767282 - protein, 15 aa, Entamoeba invadens
NGNRFEKDDNISTEE

SEQ ID NO: 2767283 - protein, 5 aa, Entamoeba invadens
NGNRK

SEQ ID NO: 2767284 - protein, 13 aa, Entamoeba invadens
NGNRLQKPGNMED

SEQ ID NO: 2767285 - protein, 24 aa, Entamoeba invadens
NGNSPLAPKDLSSKSPSSKSPYNH

SEQ ID NO: 2767286 - protein, 10 aa, Entamoeba invadens
NGNSPSQTPF

SEQ ID NO: 2767287 - protein, 8 aa, Entamoeba invadens
NGNSTFTM

SEQ ID NO: 2767288 - protein, 9 aa, Entamoeba invadens
NGNSTFTMN

SEQ ID NO: 2767289 - protein, 12 aa, Entamoeba invadens
NGNSYKKCESCT

SEQ ID NO: 2767290 - protein, 7 aa, Entamoeba invadens
NGNTANV

SEQ ID NO: 2767291 - protein, 5 aa, Entamoeba invadens
NGNTK

SEQ ID NO: 2767292 - protein, 5 aa, Entamoeba invadens
NGNTL

SEQ ID NO: 2767293 - protein, 5 aa, Entamoeba invadens
NGNTM

SEQ ID NO: 2767294 - protein, 5 aa, Entamoeba invadens
NGNTN

SEQ ID NO: 2767295 - protein, 10 aa, Entamoeba invadens
NGNTQSAFQC

SEQ ID NO: 2767296 - protein, 25 aa, Entamoeba invadens
NGNTQSSASVRADSLSSNSTENFGD

SEQ ID NO: 2767297 - protein, 6 aa, Entamoeba invadens
NGNVEA

SEQ ID NO: 2767298 - protein, 15 aa, Entamoeba invadens
NGNVSEDAFSDDSHK

SEQ ID NO: 2767299 - protein, 5 aa, Entamoeba invadens
NGNYM

SEQ ID NO: 2767300 - protein, 5 aa, Entamoeba invadens
NGNYQ

SEQ ID NO: 2767301 - protein, 5 aa, Entamoeba invadens
NGPDF

SEQ ID NO: 2767302 - protein, 4 aa, Entamoeba invadens
NGPI

SEQ ID NO: 2767303 - protein, 12 aa, Entamoeba invadens
NGPIQITPNGNC

SEQ ID NO: 2767304 - protein, 6 aa, Entamoeba invadens
NGPSSL

SEQ ID NO: 2767305 - protein, 6 aa, Entamoeba invadens
NGPYDE

SEQ ID NO: 2767306 - protein, 10 aa, Entamoeba invadens
NGQCNTSTGV

SEQ ID NO: 2767307 - protein, 7 aa, Entamoeba invadens
NGQDESL

SEQ ID NO: 2767308 - protein, 4 aa, Entamoeba invadens
NGQE

SEQ ID NO: 2767309 - protein, 4 aa, Entamoeba invadens
NGQF

SEQ ID NO: 2767310 - protein, 4 aa, Entamoeba invadens
NGQI

SEQ ID NO: 2767311 - protein, 19 aa, Entamoeba invadens
NGQIDSGEECENTTGCGSD

SEQ ID NO: 2767312 - protein, 11 aa, Entamoeba invadens
NGQLDKGEECE

SEQ ID NO: 2767313 - protein, 8 aa, Entamoeba invadens
NGQNKYNR

SEQ ID NO: 2767314 - protein, 9 aa, Entamoeba invadens
NGQPFDESQ

SEQ ID NO: 2767315 - protein, 8 aa, Entamoeba invadens
NGQQITTS

SEQ ID NO: 2767316 - protein, 18 aa, Entamoeba invadens
NGQSKVTKYESSQLTRPQ

SEQ ID NO: 2767317 - protein, 7 aa, Entamoeba invadens
NGQTDPF

SEQ ID NO: 2767318 - protein, 6 aa, Entamoeba invadens
NGQTFP

SEQ ID NO: 2767319 - protein, 7 aa, Entamoeba invadens
NGQTGAC

SEQ ID NO: 2767320 - protein, 7 aa, Entamoeba invadens
NGQVKSK

SEQ ID NO: 2767321 - protein, 5 aa, Entamoeba invadens
NGQYN

SEQ ID NO: 2767322 - protein, 14 aa, Entamoeba invadens
NGRAGTDGTTESVE

SEQ ID NO: 2767323 - protein, 5 aa, Entamoeba invadens
NGRCG

SEQ ID NO: 2767324 - protein, 4 aa, Entamoeba invadens
NGRF

SEQ ID NO: 2767325 - protein, 11 aa, Entamoeba invadens
NGRMGRGKNAG

SEQ ID NO: 2767326 - protein, 5 aa, Entamoeba invadens
NGRMK

SEQ ID NO: 2767327 - protein, 5 aa, Entamoeba invadens
NGRRF

SEQ ID NO: 2767328 - protein, 8 aa, Entamoeba invadens
NGRTYKDP

SEQ ID NO: 2767329 - protein, 4 aa, Entamoeba invadens
NGSA

SEQ ID NO: 2767330 - protein, 4 aa, Entamoeba invadens
NGSC

SEQ ID NO: 2767331 - protein, 5 aa, Entamoeba invadens
NGSCE

SEQ ID NO: 2767332 - protein, 10 aa, Entamoeba invadens
NGSENQSSEL

SEQ ID NO: 2767333 - protein, 4 aa, Entamoeba invadens
NGSG

SEQ ID NO: 2767334 - protein, 7 aa, Entamoeba invadens
NGSGDLG

SEQ ID NO: 2767335 - protein, 5 aa, Entamoeba invadens
NGSGI

SEQ ID NO: 2767336 - protein, 53 aa, Entamoeba invadens
NGSGTNSESKTDNDSNINSESKTNDESNINSESNINDESTNSGTETKEGSVQT

SEQ ID NO: 2767337 - protein, 9 aa, Entamoeba invadens
NGSGTSCQT

SEQ ID NO: 2767338 - protein, 9 aa, Entamoeba invadens
NGSKEKIET

SEQ ID NO: 2767339 - protein, 6 aa, Entamoeba invadens
NGSKSH

SEQ ID NO: 2767340 - protein, 7 aa, Entamoeba invadens
NGSKSRL

SEQ ID NO: 2767341 - protein, 5 aa, Entamoeba invadens
NGSLE

SEQ ID NO: 2767342 - protein, 6 aa, Entamoeba invadens
NGSPLP

SEQ ID NO: 2767343 - protein, 4 aa, Entamoeba invadens
NGSQ

SEQ ID NO: 2767344 - protein, 8 aa, Entamoeba invadens
NGSQVNYT

SEQ ID NO: 2767345 - protein, 7 aa, Entamoeba invadens
NGSRISR

SEQ ID NO: 2767346 - protein, 16 aa, Entamoeba invadens
NGSSTVTTANTYNGKT

SEQ ID NO: 2767347 - protein, 8 aa, Entamoeba invadens
NGSTSKCS

SEQ ID NO: 2767348 - protein, 6 aa, Entamoeba invadens
NGSTWN

SEQ ID NO: 2767349 - protein, 6 aa, Entamoeba invadens
NGSVDD

SEQ ID NO: 2767350 - protein, 4 aa, Entamoeba invadens
NGSY

SEQ ID NO: 2767351 - protein, 21 aa, Entamoeba invadens
NGSYGRMSPELGGEKQFEATG

SEQ ID NO: 2767352 - protein, 7 aa, Entamoeba invadens
NGSYSYS

SEQ ID NO: 2767353 - protein, 4 aa, Entamoeba invadens
NGTA

SEQ ID NO: 2767354 - protein, 10 aa, Entamoeba invadens
NGTADYIGST

SEQ ID NO: 2767355 - protein, 8 aa, Entamoeba invadens
NGTAPNNC

SEQ ID NO: 2767356 - protein, 6 aa, Entamoeba invadens
NGTARE

SEQ ID NO: 2767357 - protein, 11 aa, Entamoeba invadens
NGTATTINGTS

SEQ ID NO: 2767358 - protein, 7 aa, Entamoeba invadens
NGTCGDN

SEQ ID NO: 2767359 - protein, 10 aa, Entamoeba invadens
NGTDDARRNY

SEQ ID NO: 2767360 - protein, 6 aa, Entamoeba invadens
NGTEQS

SEQ ID NO: 2767361 - protein, 5 aa, Entamoeba invadens
NGTFE

SEQ ID NO: 2767362 - protein, 20 aa, Entamoeba invadens
NGTFKNTEKGCTQCSNSTEY

SEQ ID NO: 2767363 - protein, 15 aa, Entamoeba invadens
NGTFTNQINSTNCQK

SEQ ID NO: 2767364 - protein, 7 aa, Entamoeba invadens
NGTGIPT

SEQ ID NO: 2767365 - protein, 10 aa, Entamoeba invadens
NGTHKTQYRN

SEQ ID NO: 2767366 - protein, 6 aa, Entamoeba invadens
NGTHTI

SEQ ID NO: 2767367 - protein, 4 aa, Entamoeba invadens
NGTI

SEQ ID NO: 2767368 - protein, 7 aa, Entamoeba invadens
NGTIEST

SEQ ID NO: 2767369 - protein, 14 aa, Entamoeba invadens
NGTINLTEKGTLRC

SEQ ID NO: 2767370 - protein, 12 aa, Entamoeba invadens
NGTKHDEEQLKE

SEQ ID NO: 2767371 - protein, 7 aa, Entamoeba invadens
NGTKHTF

SEQ ID NO: 2767372 - protein, 8 aa, Entamoeba invadens
NGTNGIGN

SEQ ID NO: 2767373 - protein, 7 aa, Entamoeba invadens
NGTPAMR

SEQ ID NO: 2767374 - protein, 5 aa, Entamoeba invadens
NGTQC

SEQ ID NO: 2767375 - protein, 6 aa, Entamoeba invadens
NGTQPI

SEQ ID NO: 2767376 - protein, 7 aa, Entamoeba invadens
NGTQTRR

SEQ ID NO: 2767377 - protein, 5 aa, Entamoeba invadens
NGTRK

SEQ ID NO: 2767378 - protein, 9 aa, Entamoeba invadens
NGTSAISTK

SEQ ID NO: 2767379 - protein, 44 aa, Entamoeba invadens
NGTSPRSSLQNLGTTGQPKPIEMNQEKRKSFDVSEKSKGTTTVL

SEQ ID NO: 2767380 - protein, 4 aa, Entamoeba invadens
NGTT

SEQ ID NO: 2767381 - protein, 12 aa, Entamoeba invadens
NGTVKSNDATII

SEQ ID NO: 2767382 - protein, 16 aa, Entamoeba invadens
NGTVSTTVPDKDKDFK

SEQ ID NO: 2767383 - protein, 5 aa, Entamoeba invadens
NGTYD

SEQ ID NO: 2767384 - protein, 9 aa, Entamoeba invadens
NGTYNYTST

SEQ ID NO: 2767385 - protein, 12 aa, Entamoeba invadens
NGTYPSGHTCKN

SEQ ID NO: 2767386 - protein, 4 aa, Entamoeba invadens
NGVA

SEQ ID NO: 2767387 - protein, 6 aa, Entamoeba invadens
NGVAQT

SEQ ID NO: 2767388 - protein, 4 aa, Entamoeba invadens
NGVC

SEQ ID NO: 2767389 - protein, 5 aa, Entamoeba invadens
NGVCG

SEQ ID NO: 2767390 - protein, 7 aa, Entamoeba invadens
NGVDGKS

SEQ ID NO: 2767391 - protein, 5 aa, Entamoeba invadens
NGVED

SEQ ID NO: 2767392 - protein, 7 aa, Entamoeba invadens
NGVESLN

SEQ ID NO: 2767393 - protein, 14 aa, Entamoeba invadens
NGVFSEKSTSCTLQ

SEQ ID NO: 2767394 - protein, 11 aa, Entamoeba invadens
NGVFSETSSTC

SEQ ID NO: 2767395 - protein, 5 aa, Entamoeba invadens
NGVNG

SEQ ID NO: 2767396 - protein, 8 aa, Entamoeba invadens
NGVSTGQR

SEQ ID NO: 2767397 - protein, 9 aa, Entamoeba invadens
NGVTQDPQT

SEQ ID NO: 2767398 - protein, 7 aa, Entamoeba invadens
NGYEEVN

SEQ ID NO: 2767399 - protein, 10 aa, Entamoeba invadens
NGYELNNGQC

SEQ ID NO: 2767400 - protein, 10 aa, Entamoeba invadens
NGYETITSGN

SEQ ID NO: 2767401 - protein, 6 aa, Entamoeba invadens
NGYGGD

SEQ ID NO: 2767402 - protein, 19 aa, Entamoeba invadens
NGYINNNGKCVKSETNSEV

SEQ ID NO: 2767403 - protein, 5 aa, Entamoeba invadens
NGYKG

SEQ ID NO: 2767404 - protein, 6 aa, Entamoeba invadens
NGYNEE

SEQ ID NO: 2767405 - protein, 6 aa, Entamoeba invadens
NGYRPK

SEQ ID NO: 2767406 - protein, 10 aa, Entamoeba invadens
NGYSTTSSMT

SEQ ID NO: 2767407 - protein, 15 aa, Entamoeba invadens
NGYTLETNEEATAEY

SEQ ID NO: 2767408 - protein, 5 aa, Entamoeba invadens
NGYYN

SEQ ID NO: 2767409 - protein, 10 aa, Entamoeba invadens
NGYYNNDSEC

SEQ ID NO: 2767410 - protein, 5 aa, Entamoeba invadens
NGYYP

SEQ ID NO: 2767411 - protein, 10 aa, Entamoeba invadens
NGYYPDPNGK

SEQ ID NO: 2767412 - protein, 10 aa, Entamoeba invadens
NGYYPDSNGN

SEQ ID NO: 2767413 - protein, 9 aa, Entamoeba invadens
NGYYPNDAG

SEQ ID NO: 2767414 - protein, 7 aa, Entamoeba invadens
NGYYPNS

SEQ ID NO: 2767415 - protein, 8 aa, Entamoeba invadens
NGYYPNSA

SEQ ID NO: 2767416 - protein, 12 aa, Entamoeba invadens
NGYYPNSTDATQ

SEQ ID NO: 2767417 - protein, 14 aa, Entamoeba invadens
NGYYSDDSTKTSHK

SEQ ID NO: 2767418 - protein, 10 aa, Entamoeba invadens
NGYYSNAGDQ

SEQ ID NO: 2767419 - protein, 9 aa, Entamoeba invadens
NGYYTENGE

SEQ ID NO: 2767420 - protein, 16 aa, Entamoeba invadens
NHDEPQRFKRKKNGKT

SEQ ID NO: 2767421 - protein, 28 aa, Entamoeba invadens
NHDRIASKDGYCTDGNMGSQTTLDTENN

SEQ ID NO: 2767422 - protein, 10 aa, Entamoeba invadens
NHDVDGVYGR

SEQ ID NO: 2767423 - protein, 8 aa, Entamoeba invadens
NHEKKGIS

SEQ ID NO: 2767424 - protein, 4 aa, Entamoeba invadens
NHEL

SEQ ID NO: 2767425 - protein, 5 aa, Entamoeba invadens
NHEPS

SEQ ID NO: 2767426 - protein, 7 aa, Entamoeba invadens
NHEQNAT

SEQ ID NO: 2767427 - protein, 8 aa, Entamoeba invadens
NHEQTDVQ

SEQ ID NO: 2767428 - protein, 27 aa, Entamoeba invadens
NHETESKRKMSQEIQPLEPNVKEEGQQ

SEQ ID NO: 2767429 - protein, 5 aa, Entamoeba invadens
NHGRY

SEQ ID NO: 2767430 - protein, 11 aa, Entamoeba invadens
NHHGSKHSSSW

SEQ ID NO: 2767431 - protein, 7 aa, Entamoeba invadens
NHHGTKS

SEQ ID NO: 2767432 - protein, 10 aa, Entamoeba invadens
NHIKDDDTTF

SEQ ID NO: 2767433 - protein, 9 aa, Entamoeba invadens
NHIPSSSSN

SEQ ID NO: 2767434 - protein, 4 aa, Entamoeba invadens
NHIS

SEQ ID NO: 2767435 - protein, 7 aa, Entamoeba invadens
NHKNQLE

SEQ ID NO: 2767436 - protein, 19 aa, Entamoeba invadens
NHKTSNKSDLKGEDATPRT

SEQ ID NO: 2767437 - protein, 11 aa, Entamoeba invadens
NHLEEGNQNEK

SEQ ID NO: 2767438 - protein, 11 aa, Entamoeba invadens
NHLEEGNQNER

SEQ ID NO: 2767439 - protein, 4 aa, Entamoeba invadens
NHLT

SEQ ID NO: 2767440 - protein, 4 aa, Entamoeba invadens
NHMN

SEQ ID NO: 2767441 - protein, 6 aa, Entamoeba invadens
NHMTGK

SEQ ID NO: 2767442 - protein, 8 aa, Entamoeba invadens
NHNSSNHN

SEQ ID NO: 2767443 - protein, 9 aa, Entamoeba invadens
NHPKRDVER

SEQ ID NO: 2767444 - protein, 9 aa, Entamoeba invadens
NHPKSGALD

SEQ ID NO: 2767445 - protein, 5 aa, Entamoeba invadens
NHPMK

SEQ ID NO: 2767446 - protein, 7 aa, Entamoeba invadens
NHPRKPT

SEQ ID NO: 2767447 - protein, 5 aa, Entamoeba invadens
NHQET

SEQ ID NO: 2767448 - protein, 11 aa, Entamoeba invadens
NHQHDAEPAQV

SEQ ID NO: 2767449 - protein, 4 aa, Entamoeba invadens
NHQN

SEQ ID NO: 2767450 - protein, 10 aa, Entamoeba invadens
NHSQATSTIG

SEQ ID NO: 2767451 - protein, 7 aa, Entamoeba invadens
NHSTNYV

SEQ ID NO: 2767452 - protein, 5 aa, Entamoeba invadens
NHSVD

SEQ ID NO: 2767453 - protein, 6 aa, Entamoeba invadens
NHTATL

SEQ ID NO: 2767454 - protein, 7 aa, Entamoeba invadens
NHTCDTN

SEQ ID NO: 2767455 - protein, 8 aa, Entamoeba invadens
NHTKSLSS

SEQ ID NO: 2767456 - protein, 7 aa, Entamoeba invadens
NHTSNDN

SEQ ID NO: 2767457 - protein, 5 aa, Entamoeba invadens
NHTTT

SEQ ID NO: 2767458 - protein, 6 aa, Entamoeba invadens
NHYDRP

SEQ ID NO: 2767459 - protein, 17 aa, Entamoeba invadens
NIAGNRNSVDKTVKNAN

SEQ ID NO: 2767460 - protein, 7 aa, Entamoeba invadens
NIAKNIN

SEQ ID NO: 2767461 - protein, 9 aa, Entamoeba invadens
NIATKSANL

SEQ ID NO: 2767462 - protein, 16 aa, Entamoeba invadens
NIDGRQARRTHNATPL

SEQ ID NO: 2767463 - protein, 5 aa, Entamoeba invadens
NIDQT

SEQ ID NO: 2767464 - protein, 6 aa, Entamoeba invadens
NIEESA

SEQ ID NO: 2767465 - protein, 13 aa, Entamoeba invadens
NIEETQAKAVDEH

SEQ ID NO: 2767466 - protein, 34 aa, Entamoeba invadens
NIEEVTDTSKVEEKKEENRTGSPEVVQVTEDKKK

SEQ ID NO: 2767467 - protein, 7 aa, Entamoeba invadens
NIEGEEA

SEQ ID NO: 2767468 - protein, 6 aa, Entamoeba invadens
NIEGGK

SEQ ID NO: 2767469 - protein, 5 aa, Entamoeba invadens
NIENF

SEQ ID NO: 2767470 - protein, 16 aa, Entamoeba invadens
NIESIGEQIKEDKRPV

SEQ ID NO: 2767471 - protein, 7 aa, Entamoeba invadens
NIESYTT

SEQ ID NO: 2767472 - protein, 7 aa, Entamoeba invadens
NIETDSS

SEQ ID NO: 2767473 - protein, 7 aa, Entamoeba invadens
NIETGEE

SEQ ID NO: 2767474 - protein, 5 aa, Entamoeba invadens
NIETN

SEQ ID NO: 2767475 - protein, 4 aa, Entamoeba invadens
NIEV

SEQ ID NO: 2767476 - protein, 12 aa, Entamoeba invadens
NIFTPKGNDVKN

SEQ ID NO: 2767477 - protein, 4 aa, Entamoeba invadens
NIGD

SEQ ID NO: 2767478 - protein, 5 aa, Entamoeba invadens
NIGDG

SEQ ID NO: 2767479 - protein, 5 aa, Entamoeba invadens
NIGEG

SEQ ID NO: 2767480 - protein, 4 aa, Entamoeba invadens
NIGG

SEQ ID NO: 2767481 - protein, 9 aa, Entamoeba invadens
NIGGEKGSI

SEQ ID NO: 2767482 - protein, 6 aa, Entamoeba invadens
NIGGSD

SEQ ID NO: 2767483 - protein, 7 aa, Entamoeba invadens
NIGNGPL

SEQ ID NO: 2767484 - protein, 6 aa, Entamoeba invadens
NIGPLG

SEQ ID NO: 2767485 - protein, 4 aa, Entamoeba invadens
NIGR

SEQ ID NO: 2767486 - protein, 15 aa, Entamoeba invadens
NIGTPKYMAPEIWKI

SEQ ID NO: 2767487 - protein, 8 aa, Entamoeba invadens
NIKGTGSN

SEQ ID NO: 2767488 - protein, 8 aa, Entamoeba invadens
NIKKSDDT

SEQ ID NO: 2767489 - protein, 9 aa, Entamoeba invadens
NIKNDAQCE

SEQ ID NO: 2767490 - protein, 10 aa, Entamoeba invadens
NIKSGEEKYN

SEQ ID NO: 2767491 - protein, 7 aa, Entamoeba invadens
NIKYENE

SEQ ID NO: 2767492 - protein, 6 aa, Entamoeba invadens
NILDEN

SEQ ID NO: 2767493 - protein, 4 aa, Entamoeba invadens
NILN

SEQ ID NO: 2767494 - protein, 17 aa, Entamoeba invadens
NILNTDNTCTSNKNNEI

SEQ ID NO: 2767495 - protein, 4 aa, Entamoeba invadens
NIND

SEQ ID NO: 2767496 - protein, 28 aa, Entamoeba invadens
NINDESCKNCTEQNKGCMDANPDCGTCT

SEQ ID NO: 2767497 - protein, 19 aa, Entamoeba invadens
NINDQTIQNYKQDVDNTKY

SEQ ID NO: 2767498 - protein, 16 aa, Entamoeba invadens
NINETQNNEKKQLEEK

SEQ ID NO: 2767499 - protein, 4 aa, Entamoeba invadens
NINF

SEQ ID NO: 2767500 - protein, 5 aa, Entamoeba invadens
NINKA

SEQ ID NO: 2767501 - protein, 18 aa, Entamoeba invadens
NINNNGTCKPVDENQQNY

SEQ ID NO: 2767502 - protein, 21 aa, Entamoeba invadens
NINTTVKSENTQNDVQTSPEI

SEQ ID NO: 2767503 - protein, 21 aa, Entamoeba invadens
NIPAANENSCKDGYSFDNTTS

SEQ ID NO: 2767504 - protein, 6 aa, Entamoeba invadens
NIPADG

SEQ ID NO: 2767505 - protein, 16 aa, Entamoeba invadens
NIPEEKKDDSKVEGNE

SEQ ID NO: 2767506 - protein, 5 aa, Entamoeba invadens
NIPFT

SEQ ID NO: 2767507 - protein, 7 aa, Entamoeba invadens
NIPGRTA

SEQ ID NO: 2767508 - protein, 33 aa, Entamoeba invadens
NIPKSNGAQGNGEEADLAAERAKEGKQASEQAE

SEQ ID NO: 2767509 - protein, 7 aa, Entamoeba invadens
NIPKTNT

SEQ ID NO: 2767510 - protein, 5 aa, Entamoeba invadens
NIPMS

SEQ ID NO: 2767511 - protein, 6 aa, Entamoeba invadens
NIPQSV

SEQ ID NO: 2767512 - protein, 4 aa, Entamoeba invadens
NIQM

SEQ ID NO: 2767513 - protein, 8 aa, Entamoeba invadens
NIQSANAR

SEQ ID NO: 2767514 - protein, 7 aa, Entamoeba invadens
NIQSSGD

SEQ ID NO: 2767515 - protein, 7 aa, Entamoeba invadens
NIQTQTT

SEQ ID NO: 2767516 - protein, 7 aa, Entamoeba invadens
NIQTSSE

SEQ ID NO: 2767517 - protein, 5 aa, Entamoeba invadens
NIRTE

SEQ ID NO: 2767518 - protein, 7 aa, Entamoeba invadens
NISDKNK

SEQ ID NO: 2767519 - protein, 5 aa, Entamoeba invadens
NISDQ

SEQ ID NO: 2767520 - protein, 4 aa, Entamoeba invadens
NISF

SEQ ID NO: 2767521 - protein, 7 aa, Entamoeba invadens
NISGEDI

SEQ ID NO: 2767522 - protein, 9 aa, Entamoeba invadens
NISGSHPKS

SEQ ID NO: 2767523 - protein, 7 aa, Entamoeba invadens
NISISQG

SEQ ID NO: 2767524 - protein, 4 aa, Entamoeba invadens
NISK

SEQ ID NO: 2767525 - protein, 4 aa, Entamoeba invadens
NISN

SEQ ID NO: 2767526 - protein, 12 aa, Entamoeba invadens
NISNDKVNNTSV

SEQ ID NO: 2767527 - protein, 5 aa, Entamoeba invadens
NISNE

SEQ ID NO: 2767528 - protein, 8 aa, Entamoeba invadens
NISTTTTQ

SEQ ID NO: 2767529 - protein, 12 aa, Entamoeba invadens
NITDDSKQFSEF

SEQ ID NO: 2767530 - protein, 6 aa, Entamoeba invadens
NITDFP

SEQ ID NO: 2767531 - protein, 11 aa, Entamoeba invadens
NITDGESSCYG

SEQ ID NO: 2767532 - protein, 6 aa, Entamoeba invadens
NITDKE

SEQ ID NO: 2767533 - protein, 8 aa, Entamoeba invadens
NITDTNDN

SEQ ID NO: 2767534 - protein, 11 aa, Entamoeba invadens
NITEDNNTEIE

SEQ ID NO: 2767535 - protein, 4 aa, Entamoeba invadens
NITF

SEQ ID NO: 2767536 - protein, 5 aa, Entamoeba invadens
NITKC

SEQ ID NO: 2767537 - protein, 8 aa, Entamoeba invadens
NITRPSVS

SEQ ID NO: 2767538 - protein, 4 aa, Entamoeba invadens
NITT

SEQ ID NO: 2767539 - protein, 6 aa, Entamoeba invadens
NITTDQ

SEQ ID NO: 2767540 - protein, 5 aa, Entamoeba invadens
NITTF

SEQ ID NO: 2767541 - protein, 12 aa, Entamoeba invadens
NITTNSSDSTST

SEQ ID NO: 2767542 - protein, 6 aa, Entamoeba invadens
NITTQT

SEQ ID NO: 2767543 - protein, 6 aa, Entamoeba invadens
NITTTS

SEQ ID NO: 2767544 - protein, 9 aa, Entamoeba invadens
NKAAIAAAT

SEQ ID NO: 2767545 - protein, 8 aa, Entamoeba invadens
NKADKRIN

SEQ ID NO: 2767546 - protein, 11 aa, Entamoeba invadens
NKAHTTNKQKI

SEQ ID NO: 2767547 - protein, 8 aa, Entamoeba invadens
NKASSSAT

SEQ ID NO: 2767548 - protein, 14 aa, Entamoeba invadens
NKATKNDPSRIPKD

SEQ ID NO: 2767549 - protein, 10 aa, Entamoeba invadens
NKCASDNTRR

SEQ ID NO: 2767550 - protein, 27 aa, Entamoeba invadens
NKCDDCETGKITKDEKCDSSKNACGSG

SEQ ID NO: 2767551 - protein, 4 aa, Entamoeba invadens
NKCE

SEQ ID NO: 2767552 - protein, 5 aa, Entamoeba invadens
NKCEL

SEQ ID NO: 2767553 - protein, 8 aa, Entamoeba invadens
NKCENSRD

SEQ ID NO: 2767554 - protein, 7 aa, Entamoeba invadens
NKCEPCD

SEQ ID NO: 2767555 - protein, 6 aa, Entamoeba invadens
NKCEPQ

SEQ ID NO: 2767556 - protein, 9 aa, Entamoeba invadens
NKCESTTGV

SEQ ID NO: 2767557 - protein, 9 aa, Entamoeba invadens
NKCETCNTT

SEQ ID NO: 2767558 - protein, 4 aa, Entamoeba invadens
NKCI

SEQ ID NO: 2767559 - protein, 10 aa, Entamoeba invadens
NKCNNNKEQN

SEQ ID NO: 2767560 - protein, 4 aa, Entamoeba invadens
NKCP

SEQ ID NO: 2767561 - protein, 7 aa, Entamoeba invadens
NKCPNGC

SEQ ID NO: 2767562 - protein, 18 aa, Entamoeba invadens
NKCPTSANSNCDQFEENH

SEQ ID NO: 2767563 - protein, 8 aa, Entamoeba invadens
NKCQPQSS

SEQ ID NO: 2767564 - protein, 8 aa, Entamoeba invadens
NKCQTLGD

SEQ ID NO: 2767565 - protein, 8 aa, Entamoeba invadens
NKCSTDSY

SEQ ID NO: 2767566 - protein, 13 aa, Entamoeba invadens
NKCTCPKNNYQNF

SEQ ID NO: 2767567 - protein, 14 aa, Entamoeba invadens
NKCTDKTQIEETST

SEQ ID NO: 2767568 - protein, 15 aa, Entamoeba invadens
NKCTESSEENPSSKY

SEQ ID NO: 2767569 - protein, 23 aa, Entamoeba invadens
NKCTKCQEGYYNESDNCQKCSSS

SEQ ID NO: 2767570 - protein, 8 aa, Entamoeba invadens
NKCTNTTG

SEQ ID NO: 2767571 - protein, 19 aa, Entamoeba invadens
NKCTPGCTECSDANTCSEC

SEQ ID NO: 2767572 - protein, 8 aa, Entamoeba invadens
NKCTSCEG

SEQ ID NO: 2767573 - protein, 7 aa, Entamoeba invadens
NKCTSCN

SEQ ID NO: 2767574 - protein, 6 aa, Entamoeba invadens
NKCTSD

SEQ ID NO: 2767575 - protein, 7 aa, Entamoeba invadens
NKCVSKD

SEQ ID NO: 2767576 - protein, 14 aa, Entamoeba invadens
NKDAESYNKLGGTA

SEQ ID NO: 2767577 - protein, 9 aa, Entamoeba invadens
NKDDIPNGI

SEQ ID NO: 2767578 - protein, 4 aa, Entamoeba invadens
NKDE

SEQ ID NO: 2767579 - protein, 9 aa, Entamoeba invadens
NKDGDMNEK

SEQ ID NO: 2767580 - protein, 10 aa, Entamoeba invadens
NKDGKCEDVS

SEQ ID NO: 2767581 - protein, 7 aa, Entamoeba invadens
NKDHDYM

SEQ ID NO: 2767582 - protein, 12 aa, Entamoeba invadens
NKDKIENSNDVD

SEQ ID NO: 2767583 - protein, 7 aa, Entamoeba invadens
NKDQETV

SEQ ID NO: 2767584 - protein, 8 aa, Entamoeba invadens
NKDRQPIP

SEQ ID NO: 2767585 - protein, 8 aa, Entamoeba invadens
NKDSCNTC

SEQ ID NO: 2767586 - protein, 5 aa, Entamoeba invadens
NKDSY

SEQ ID NO: 2767587 - protein, 5 aa, Entamoeba invadens
NKDTI

SEQ ID NO: 2767588 - protein, 5 aa, Entamoeba invadens
NKDTR

SEQ ID NO: 2767589 - protein, 12 aa, Entamoeba invadens
NKDTTDNKKCGT

SEQ ID NO: 2767590 - protein, 7 aa, Entamoeba invadens
NKEAGAV

SEQ ID NO: 2767591 - protein, 8 aa, Entamoeba invadens
NKEAKDVD

SEQ ID NO: 2767592 - protein, 16 aa, Entamoeba invadens
NKECEKCNNNCTTCTQ

SEQ ID NO: 2767593 - protein, 4 aa, Entamoeba invadens
NKED

SEQ ID NO: 2767594 - protein, 6 aa, Entamoeba invadens
NKEDRI

SEQ ID NO: 2767595 - protein, 6 aa, Entamoeba invadens
NKEEKK

SEQ ID NO: 2767596 - protein, 20 aa, Entamoeba invadens
NKEEQTEAKDTLEDEKQPLQ

SEQ ID NO: 2767597 - protein, 21 aa, Entamoeba invadens
NKEETSKKMSESERSSTTIDI

SEQ ID NO: 2767598 - protein, 8 aa, Entamoeba invadens
NKEFDGGT

SEQ ID NO: 2767599 - protein, 8 aa, Entamoeba invadens
NKEGGLNY

SEQ ID NO: 2767600 - protein, 5 aa, Entamoeba invadens
NKEGL

SEQ ID NO: 2767601 - protein, 7 aa, Entamoeba invadens
NKEGMIG

SEQ ID NO: 2767602 - protein, 7 aa, Entamoeba invadens
NKEKTQC

SEQ ID NO: 2767603 - protein, 9 aa, Entamoeba invadens
NKEKVNVNE

SEQ ID NO: 2767604 - protein, 16 aa, Entamoeba invadens
NKELDDDEECDGGDGC

SEQ ID NO: 2767605 - protein, 7 aa, Entamoeba invadens
NKELEES

SEQ ID NO: 2767606 - protein, 19 aa, Entamoeba invadens
NKENENCEQNSDNGKAIPG

SEQ ID NO: 2767607 - protein, 7 aa, Entamoeba invadens
NKENNTE

SEQ ID NO: 2767608 - protein, 5 aa, Entamoeba invadens
NKEPA

SEQ ID NO: 2767609 - protein, 10 aa, Entamoeba invadens
NKERKEQQEK

SEQ ID NO: 2767610 - protein, 7 aa, Entamoeba invadens
NKESAAK

SEQ ID NO: 2767611 - protein, 6 aa, Entamoeba invadens
NKESDD

SEQ ID NO: 2767612 - protein, 5 aa, Entamoeba invadens
NKESM

SEQ ID NO: 2767613 - protein, 5 aa, Entamoeba invadens
NKESR

SEQ ID NO: 2767614 - protein, 7 aa, Entamoeba invadens
NKESRWG

SEQ ID NO: 2767615 - protein, 10 aa, Entamoeba invadens
NKESSTTCKP

SEQ ID NO: 2767616 - protein, 8 aa, Entamoeba invadens
NKETCSSC

SEQ ID NO: 2767617 - protein, 8 aa, Entamoeba invadens
NKETGCTK

SEQ ID NO: 2767618 - protein, 9 aa, Entamoeba invadens
NKETSQVGN

SEQ ID NO: 2767619 - protein, 14 aa, Entamoeba invadens
NKETTKIKDKSNKI

SEQ ID NO: 2767620 - protein, 7 aa, Entamoeba invadens
NKEYTEK

SEQ ID NO: 2767621 - protein, 6 aa, Entamoeba invadens
NKFEEI

SEQ ID NO: 2767622 - protein, 7 aa, Entamoeba invadens
NKFGGSD

SEQ ID NO: 2767623 - protein, 5 aa, Entamoeba invadens
NKFNR

SEQ ID NO: 2767624 - protein, 21 aa, Entamoeba invadens
NKFSLSTTTIPADSLPTLSST

SEQ ID NO: 2767625 - protein, 16 aa, Entamoeba invadens
NKFSSPDCLPQGENYD

SEQ ID NO: 2767626 - protein, 4 aa, Entamoeba invadens
NKFT

SEQ ID NO: 2767627 - protein, 8 aa, Entamoeba invadens
NKGAINRS

SEQ ID NO: 2767628 - protein, 30 aa, Entamoeba invadens
NKGDDEKENKIKEIQKQNTITLDNTNVSNN

SEQ ID NO: 2767629 - protein, 9 aa, Entamoeba invadens
NKGDHTKSF

SEQ ID NO: 2767630 - protein, 7 aa, Entamoeba invadens
NKGDNSL

SEQ ID NO: 2767631 - protein, 7 aa, Entamoeba invadens
NKGDYST

SEQ ID NO: 2767632 - protein, 5 aa, Entamoeba invadens
NKGET

SEQ ID NO: 2767633 - protein, 7 aa, Entamoeba invadens
NKGFGAA

SEQ ID NO: 2767634 - protein, 24 aa, Entamoeba invadens
NKGITENYIPGNNKITEDYDTQSA

SEQ ID NO: 2767635 - protein, 5 aa, Entamoeba invadens
NKGKD

SEQ ID NO: 2767636 - protein, 5 aa, Entamoeba invadens
NKGKE

SEQ ID NO: 2767637 - protein, 6 aa, Entamoeba invadens
NKGKGN

SEQ ID NO: 2767638 - protein, 8 aa, Entamoeba invadens
NKGKGSLK

SEQ ID NO: 2767639 - protein, 7 aa, Entamoeba invadens
NKGKQTV

SEQ ID NO: 2767640 - protein, 9 aa, Entamoeba invadens
NKGKYPSSV

SEQ ID NO: 2767641 - protein, 10 aa, Entamoeba invadens
NKGLENSNDA

SEQ ID NO: 2767642 - protein, 7 aa, Entamoeba invadens
NKGNAKA

SEQ ID NO: 2767643 - protein, 11 aa, Entamoeba invadens
NKGNDNKTSTG

SEQ ID NO: 2767644 - protein, 7 aa, Entamoeba invadens
NKGNETV

SEQ ID NO: 2767645 - protein, 14 aa, Entamoeba invadens
NKGNRLPKPENVTD

SEQ ID NO: 2767646 - protein, 5 aa, Entamoeba invadens
NKGNT

SEQ ID NO: 2767647 - protein, 8 aa, Entamoeba invadens
NKGNTQQL

SEQ ID NO: 2767648 - protein, 6 aa, Entamoeba invadens
NKGNTY

SEQ ID NO: 2767649 - protein, 7 aa, Entamoeba invadens
NKGRSTL

SEQ ID NO: 2767650 - protein, 25 aa, Entamoeba invadens
NKGSAEEQNTSNPSVTQIKEAQSTN

SEQ ID NO: 2767651 - protein, 7 aa, Entamoeba invadens
NKGSDEV

SEQ ID NO: 2767652 - protein, 6 aa, Entamoeba invadens
NKGTEE

SEQ ID NO: 2767653 - protein, 12 aa, Entamoeba invadens
NKGTIPSGVKSL

SEQ ID NO: 2767654 - protein, 14 aa, Entamoeba invadens
NKGTSDKVAESNGL

SEQ ID NO: 2767655 - protein, 8 aa, Entamoeba invadens
NKGTSGNM

SEQ ID NO: 2767656 - protein, 32 aa, Entamoeba invadens
NKGTSYKYTKEGDNAKYYTYSDSQCQTGETLS

SEQ ID NO: 2767657 - protein, 7 aa, Entamoeba invadens
NKGVKKW

SEQ ID NO: 2767658 - protein, 13 aa, Entamoeba invadens
NKGVSEREKHKPE

SEQ ID NO: 2767659 - protein, 5 aa, Entamoeba invadens
NKGYT

SEQ ID NO: 2767660 - protein, 9 aa, Entamoeba invadens
NKHPTPGMT

SEQ ID NO: 2767661 - protein, 5 aa, Entamoeba invadens
NKIAQ

SEQ ID NO: 2767662 - protein, 4 aa, Entamoeba invadens
NKIE

SEQ ID NO: 2767663 - protein, 6 aa, Entamoeba invadens
NKIEPF

SEQ ID NO: 2767664 - protein, 7 aa, Entamoeba invadens
NKIGEGS

SEQ ID NO: 2767665 - protein, 9 aa, Entamoeba invadens
NKIGEGSFG

SEQ ID NO: 2767666 - protein, 4 aa, Entamoeba invadens
NKIK

SEQ ID NO: 2767667 - protein, 15 aa, Entamoeba invadens
NKIKKDYPKDSNTKT

SEQ ID NO: 2767668 - protein, 15 aa, Entamoeba invadens
NKIKKDYPKESDQSK

SEQ ID NO: 2767669 - protein, 7 aa, Entamoeba invadens
NKINEGS

SEQ ID NO: 2767670 - protein, 8 aa, Entamoeba invadens
NKINSEPC

SEQ ID NO: 2767671 - protein, 6 aa, Entamoeba invadens
NKIPDN

SEQ ID NO: 2767672 - protein, 6 aa, Entamoeba invadens
NKIPGF

SEQ ID NO: 2767673 - protein, 5 aa, Entamoeba invadens
NKIRG

SEQ ID NO: 2767674 - protein, 5 aa, Entamoeba invadens
NKISN

SEQ ID NO: 2767675 - protein, 6 aa, Entamoeba invadens
NKITIE

SEQ ID NO: 2767676 - protein, 6 aa, Entamoeba invadens
NKITIQ

SEQ ID NO: 2767677 - protein, 8 aa, Entamoeba invadens
NKITNSKC

SEQ ID NO: 2767678 - protein, 6 aa, Entamoeba invadens
NKIYSG

SEQ ID NO: 2767679 - protein, 13 aa, Entamoeba invadens
NKKAETKDATPKT

SEQ ID NO: 2767680 - protein, 5 aa, Entamoeba invadens
NKKAF

SEQ ID NO: 2767681 - protein, 5 aa, Entamoeba invadens
NKKCD

SEQ ID NO: 2767682 - protein, 5 aa, Entamoeba invadens
NKKCP

SEQ ID NO: 2767683 - protein, 22 aa, Entamoeba invadens
NKKCSKCDESCDSKCDGNTGYC

SEQ ID NO: 2767684 - protein, 8 aa, Entamoeba invadens
NKKCSPCN

SEQ ID NO: 2767685 - protein, 6 aa, Entamoeba invadens
NKKCTN

SEQ ID NO: 2767686 - protein, 7 aa, Entamoeba invadens
NKKCTND

SEQ ID NO: 2767687 - protein, 4 aa, Entamoeba invadens
NKKD

SEQ ID NO: 2767688 - protein, 8 aa, Entamoeba invadens
NKKDKYTA

SEQ ID NO: 2767689 - protein, 6 aa, Entamoeba invadens
NKKDVN

SEQ ID NO: 2767690 - protein, 6 aa, Entamoeba invadens
NKKEEE

SEQ ID NO: 2767691 - protein, 7 aa, Entamoeba invadens
NKKEHVK

SEQ ID NO: 2767692 - protein, 6 aa, Entamoeba invadens
NKKENM

SEQ ID NO: 2767693 - protein, 10 aa, Entamoeba invadens
NKKETTIQKD

SEQ ID NO: 2767694 - protein, 5 aa, Entamoeba invadens
NKKEY

SEQ ID NO: 2767695 - protein, 8 aa, Entamoeba invadens
NKKGIETK

SEQ ID NO: 2767696 - protein, 29 aa, Entamoeba invadens
NKKIKEECDAVKKENKSLKTKNEKEIEEM

SEQ ID NO: 2767697 - protein, 7 aa, Entamoeba invadens
NKKISRC

SEQ ID NO: 2767698 - protein, 8 aa, Entamoeba invadens
NKKKGNLK

SEQ ID NO: 2767699 - protein, 8 aa, Entamoeba invadens
NKKKKLST

SEQ ID NO: 2767700 - protein, 6 aa, Entamoeba invadens
NKKKKY

SEQ ID NO: 2767701 - protein, 9 aa, Entamoeba invadens
NKKKQERVD

SEQ ID NO: 2767702 - protein, 6 aa, Entamoeba invadens
NKKLAN

SEQ ID NO: 2767703 - protein, 14 aa, Entamoeba invadens
NKKNEEKENEDEKR

SEQ ID NO: 2767704 - protein, 7 aa, Entamoeba invadens
NKKNERK

SEQ ID NO: 2767705 - protein, 8 aa, Entamoeba invadens
NKKNSEEI

SEQ ID NO: 2767706 - protein, 10 aa, Entamoeba invadens
NKKQKYVGSS

SEQ ID NO: 2767707 - protein, 9 aa, Entamoeba invadens
NKKRTPQTK

SEQ ID NO: 2767708 - protein, 8 aa, Entamoeba invadens
NKKSDEID

SEQ ID NO: 2767709 - protein, 8 aa, Entamoeba invadens
NKKSEQIN

SEQ ID NO: 2767710 - protein, 7 aa, Entamoeba invadens
NKKTGEC

SEQ ID NO: 2767711 - protein, 9 aa, Entamoeba invadens
NKKTSEISN

SEQ ID NO: 2767712 - protein, 9 aa, Entamoeba invadens
NKKTSSAAY

SEQ ID NO: 2767713 - protein, 32 aa, Entamoeba invadens
NKKTSYKYVKDGDNAKYYTYSDSECKQDEKLE

SEQ ID NO: 2767714 - protein, 5 aa, Entamoeba invadens
NKKTV

SEQ ID NO: 2767715 - protein, 4 aa, Entamoeba invadens
NKKV

SEQ ID NO: 2767716 - protein, 8 aa, Entamoeba invadens
NKKVGEGS

SEQ ID NO: 2767717 - protein, 7 aa, Entamoeba invadens
NKKVSND

SEQ ID NO: 2767718 - protein, 15 aa, Entamoeba invadens
NKKWDKGEECDGGDG

SEQ ID NO: 2767719 - protein, 4 aa, Entamoeba invadens
NKKY

SEQ ID NO: 2767720 - protein, 9 aa, Entamoeba invadens
NKKYASNGN

SEQ ID NO: 2767721 - protein, 6 aa, Entamoeba invadens
NKKYQS

SEQ ID NO: 2767722 - protein, 7 aa, Entamoeba invadens
NKLGEGS

SEQ ID NO: 2767723 - protein, 17 aa, Entamoeba invadens
NKLGENCTSDSEKMESV

SEQ ID NO: 2767724 - protein, 25 aa, Entamoeba invadens
NKLGESIRSEQNRDNLEEKEYKAEV

SEQ ID NO: 2767725 - protein, 16 aa, Entamoeba invadens
NKLNKNGTFQVERGGK

SEQ ID NO: 2767726 - protein, 29 aa, Entamoeba invadens
NKLNTQNQVKQEQEVNKNTFERNQKKEVK

SEQ ID NO: 2767727 - protein, 8 aa, Entamoeba invadens
NKLPKENM

SEQ ID NO: 2767728 - protein, 23 aa, Entamoeba invadens
NKLQEKEEHYTKTKMDTQKTISD

SEQ ID NO: 2767729 - protein, 24 aa, Entamoeba invadens
NKLSADKTKCSTSCAAGEYENGNN

SEQ ID NO: 2767730 - protein, 4 aa, Entamoeba invadens
NKLT

SEQ ID NO: 2767731 - protein, 5 aa, Entamoeba invadens
NKLTE

SEQ ID NO: 2767732 - protein, 20 aa, Entamoeba invadens
NKMDSKSSSSKSSSFSSSSS

SEQ ID NO: 2767733 - protein, 12 aa, Entamoeba invadens
NKMQKPKKFATQ

SEQ ID NO: 2767734 - protein, 6 aa, Entamoeba invadens
NKNDVF

SEQ ID NO: 2767735 - protein, 38 aa, Entamoeba invadens
NKNEINQKTIKKDEVKIENEKIEQDRMTEKKSSDDDEF

SEQ ID NO: 2767736 - protein, 9 aa, Entamoeba invadens
NKNEIQSEK

SEQ ID NO: 2767737 - protein, 10 aa, Entamoeba invadens
NKNEKEKYNH

SEQ ID NO: 2767738 - protein, 5 aa, Entamoeba invadens
NKNEL

SEQ ID NO: 2767739 - protein, 4 aa, Entamoeba invadens
NKNF

SEQ ID NO: 2767740 - protein, 9 aa, Entamoeba invadens
NKNGCTSCP

SEQ ID NO: 2767741 - protein, 12 aa, Entamoeba invadens
NKNIKADSNETH

SEQ ID NO: 2767742 - protein, 6 aa, Entamoeba invadens
NKNKGV

SEQ ID NO: 2767743 - protein, 6 aa, Entamoeba invadens
NKNKMA

SEQ ID NO: 2767744 - protein, 8 aa, Entamoeba invadens
NKNKTNPF

SEQ ID NO: 2767745 - protein, 8 aa, Entamoeba invadens
NKNLKTRF

SEQ ID NO: 2767746 - protein, 9 aa, Entamoeba invadens
NKNLQAATT

SEQ ID NO: 2767747 - protein, 14 aa, Entamoeba invadens
NKNNKCGNNSTNCV

SEQ ID NO: 2767748 - protein, 10 aa, Entamoeba invadens
NKNNKDEKKM

SEQ ID NO: 2767749 - protein, 10 aa, Entamoeba invadens
NKNQRSYSPQ

SEQ ID NO: 2767750 - protein, 7 aa, Entamoeba invadens
NKNRGVS

SEQ ID NO: 2767751 - protein, 7 aa, Entamoeba invadens
NKNRPQS

SEQ ID NO: 2767752 - protein, 7 aa, Entamoeba invadens
NKNSHTK

SEQ ID NO: 2767753 - protein, 5 aa, Entamoeba invadens
NKNSN

SEQ ID NO: 2767754 - protein, 8 aa, Entamoeba invadens
NKNSNEVD

SEQ ID NO: 2767755 - protein, 4 aa, Entamoeba invadens
NKNT

SEQ ID NO: 2767756 - protein, 8 aa, Entamoeba invadens
NKNTEQKL

SEQ ID NO: 2767757 - protein, 8 aa, Entamoeba invadens
NKNTETDM

SEQ ID NO: 2767758 - protein, 5 aa, Entamoeba invadens
NKNTI

SEQ ID NO: 2767759 - protein, 8 aa, Entamoeba invadens
NKNTQYGT

SEQ ID NO: 2767760 - protein, 6 aa, Entamoeba invadens
NKNTYQ

SEQ ID NO: 2767761 - protein, 8 aa, Entamoeba invadens
NKPAEKIG

SEQ ID NO: 2767762 - protein, 6 aa, Entamoeba invadens
NKPDLN

SEQ ID NO: 2767763 - protein, 23 aa, Entamoeba invadens
NKPEKAKCRNADPDDSKNGLQPT

SEQ ID NO: 2767764 - protein, 7 aa, Entamoeba invadens
NKPEVNE

SEQ ID NO: 2767765 - protein, 6 aa, Entamoeba invadens
NKPEVV

SEQ ID NO: 2767766 - protein, 5 aa, Entamoeba invadens
NKPLR

SEQ ID NO: 2767767 - protein, 14 aa, Entamoeba invadens
NKPPTLPSPRKSHK

SEQ ID NO: 2767768 - protein, 7 aa, Entamoeba invadens
NKPSEVE

SEQ ID NO: 2767769 - protein, 5 aa, Entamoeba invadens
NKPSL

SEQ ID NO: 2767770 - protein, 7 aa, Entamoeba invadens
NKPTFRS

SEQ ID NO: 2767771 - protein, 8 aa, Entamoeba invadens
NKPTTMYP

SEQ ID NO: 2767772 - protein, 7 aa, Entamoeba invadens
NKPYGTK

SEQ ID NO: 2767773 - protein, 25 aa, Entamoeba invadens
NKQCKTCDSNCNSNSCDTVNGCTSC

SEQ ID NO: 2767774 - protein, 5 aa, Entamoeba invadens
NKQCT

SEQ ID NO: 2767775 - protein, 5 aa, Entamoeba invadens
NKQEE

SEQ ID NO: 2767776 - protein, 7 aa, Entamoeba invadens
NKQESLK

SEQ ID NO: 2767777 - protein, 5 aa, Entamoeba invadens
NKQEY

SEQ ID NO: 2767778 - protein, 5 aa, Entamoeba invadens
NKQGA

SEQ ID NO: 2767779 - protein, 14 aa, Entamoeba invadens
NKQGVNEPSKEDCA

SEQ ID NO: 2767780 - protein, 33 aa, Entamoeba invadens
NKQHSSKDSLNSSTSSTSIQDQSMSSQSTEPFQ

SEQ ID NO: 2767781 - protein, 7 aa, Entamoeba invadens
NKQKEFR

SEQ ID NO: 2767782 - protein, 9 aa, Entamoeba invadens
NKQKNSDVP

SEQ ID NO: 2767783 - protein, 8 aa, Entamoeba invadens
NKQKSKFY

SEQ ID NO: 2767784 - protein, 5 aa, Entamoeba invadens
NKQLT

SEQ ID NO: 2767785 - protein, 8 aa, Entamoeba invadens
NKQLTSVD

SEQ ID NO: 2767786 - protein, 43 aa, Entamoeba invadens
NKQNEEIEKVRAEKQKVEKELENINTELNDVKEKMKDIEQNKK

SEQ ID NO: 2767787 - protein, 8 aa, Entamoeba invadens
NKQNQYRP

SEQ ID NO: 2767788 - protein, 12 aa, Entamoeba invadens
NKQRKNELEKTT

SEQ ID NO: 2767789 - protein, 9 aa, Entamoeba invadens
NKQRNSKMR

SEQ ID NO: 2767790 - protein, 6 aa, Entamoeba invadens
NKQSND

SEQ ID NO: 2767791 - protein, 6 aa, Entamoeba invadens
NKQTFQ

SEQ ID NO: 2767792 - protein, 5 aa, Entamoeba invadens
NKQTY

SEQ ID NO: 2767793 - protein, 21 aa, Entamoeba invadens
NKRCCGGNSGIAIEGQPTYSL

SEQ ID NO: 2767794 - protein, 7 aa, Entamoeba invadens
NKRDNAY

SEQ ID NO: 2767795 - protein, 15 aa, Entamoeba invadens
NKREECEKCKDGYGK

SEQ ID NO: 2767796 - protein, 7 aa, Entamoeba invadens
NKRERMG

SEQ ID NO: 2767797 - protein, 7 aa, Entamoeba invadens
NKRGTEF

SEQ ID NO: 2767798 - protein, 20 aa, Entamoeba invadens
NKRIRNNNKPEKKEAPQKNV

SEQ ID NO: 2767799 - protein, 6 aa, Entamoeba invadens
NKRISG

SEQ ID NO: 2767800 - protein, 11 aa, Entamoeba invadens
NKRLSKPSDMP

SEQ ID NO: 2767801 - protein, 13 aa, Entamoeba invadens
NKRLTDQLNEIGT

SEQ ID NO: 2767802 - protein, 8 aa, Entamoeba invadens
NKRNDEVK

SEQ ID NO: 2767803 - protein, 7 aa, Entamoeba invadens
NKRNSKL

SEQ ID NO: 2767804 - protein, 7 aa, Entamoeba invadens
NKRPMKP

SEQ ID NO: 2767805 - protein, 9 aa, Entamoeba invadens
NKRSEEIET

SEQ ID NO: 2767806 - protein, 9 aa, Entamoeba invadens
NKRSEKIET

SEQ ID NO: 2767807 - protein, 8 aa, Entamoeba invadens
NKRSRDKS

SEQ ID NO: 2767808 - protein, 9 aa, Entamoeba invadens
NKRTDNPLS

SEQ ID NO: 2767809 - protein, 19 aa, Entamoeba invadens
NKSAASPMEKAYAASGNTL

SEQ ID NO: 2767810 - protein, 5 aa, Entamoeba invadens
NKSAQ

SEQ ID NO: 2767811 - protein, 8 aa, Entamoeba invadens
NKSAVTKN

SEQ ID NO: 2767812 - protein, 5 aa, Entamoeba invadens
NKSDV

SEQ ID NO: 2767813 - protein, 6 aa, Entamoeba invadens
NKSDYT

SEQ ID NO: 2767814 - protein, 9 aa, Entamoeba invadens
NKSEENTWN

SEQ ID NO: 2767815 - protein, 8 aa, Entamoeba invadens
NKSEYSLV

SEQ ID NO: 2767816 - protein, 9 aa, Entamoeba invadens
NKSGKGEKF

SEQ ID NO: 2767817 - protein, 7 aa, Entamoeba invadens
NKSGNDK

SEQ ID NO: 2767818 - protein, 7 aa, Entamoeba invadens
NKSIEEK

SEQ ID NO: 2767819 - protein, 7 aa, Entamoeba invadens
NKSINSN

SEQ ID NO: 2767820 - protein, 9 aa, Entamoeba invadens
NKSKGSCSL

SEQ ID NO: 2767821 - protein, 7 aa, Entamoeba invadens
NKSKNAI

SEQ ID NO: 2767822 - protein, 8 aa, Entamoeba invadens
NKSKNKTL

SEQ ID NO: 2767823 - protein, 7 aa, Entamoeba invadens
NKSKNPM

SEQ ID NO: 2767824 - protein, 7 aa, Entamoeba invadens
NKSKNQI

SEQ ID NO: 2767825 - protein, 8 aa, Entamoeba invadens
NKSKNSIK

SEQ ID NO: 2767826 - protein, 8 aa, Entamoeba invadens
NKSKSNMK

SEQ ID NO: 2767827 - protein, 5 aa, Entamoeba invadens
NKSLS

SEQ ID NO: 2767828 - protein, 8 aa, Entamoeba invadens
NKSNYGQL

SEQ ID NO: 2767829 - protein, 7 aa, Entamoeba invadens
NKSPFAT

SEQ ID NO: 2767830 - protein, 9 aa, Entamoeba invadens
NKSPQFDDQ

SEQ ID NO: 2767831 - protein, 6 aa, Entamoeba invadens
NKSSDV

SEQ ID NO: 2767832 - protein, 10 aa, Entamoeba invadens
NKSSEISKGK

SEQ ID NO: 2767833 - protein, 8 aa, Entamoeba invadens
NKSSKSLK

SEQ ID NO: 2767834 - protein, 8 aa, Entamoeba invadens
NKSTGRIN

SEQ ID NO: 2767835 - protein, 7 aa, Entamoeba invadens
NKSTGRL

SEQ ID NO: 2767836 - protein, 7 aa, Entamoeba invadens
NKSTLSK

SEQ ID NO: 2767837 - protein, 7 aa, Entamoeba invadens
NKSVGAI

SEQ ID NO: 2767838 - protein, 6 aa, Entamoeba invadens
NKSVSE

SEQ ID NO: 2767839 - protein, 6 aa, Entamoeba invadens
NKSVTP

SEQ ID NO: 2767840 - protein, 5 aa, Entamoeba invadens
NKSYA

SEQ ID NO: 2767841 - protein, 21 aa, Entamoeba invadens
NKSYSTTTKKCETNENGCATA

SEQ ID NO: 2767842 - protein, 4 aa, Entamoeba invadens
NKTA

SEQ ID NO: 2767843 - protein, 8 aa, Entamoeba invadens
NKTAEEVN

SEQ ID NO: 2767844 - protein, 6 aa, Entamoeba invadens
NKTANM

SEQ ID NO: 2767845 - protein, 7 aa, Entamoeba invadens
NKTCESS

SEQ ID NO: 2767846 - protein, 9 aa, Entamoeba invadens
NKTCGKESS

SEQ ID NO: 2767847 - protein, 6 aa, Entamoeba invadens
NKTEIG

SEQ ID NO: 2767848 - protein, 9 aa, Entamoeba invadens
NKTENVNKK

SEQ ID NO: 2767849 - protein, 9 aa, Entamoeba invadens
NKTETETEK

SEQ ID NO: 2767850 - protein, 4 aa, Entamoeba invadens
NKTF

SEQ ID NO: 2767851 - protein, 11 aa, Entamoeba invadens
NKTIKNSESKH

SEQ ID NO: 2767852 - protein, 25 aa, Entamoeba invadens
NKTKESQINDVQKRHDKTRYNEVKE

SEQ ID NO: 2767853 - protein, 9 aa, Entamoeba invadens
NKTKKRTQN

SEQ ID NO: 2767854 - protein, 5 aa, Entamoeba invadens
NKTKN

SEQ ID NO: 2767855 - protein, 8 aa, Entamoeba invadens
NKTKSGCT

SEQ ID NO: 2767856 - protein, 5 aa, Entamoeba invadens
NKTKV

SEQ ID NO: 2767857 - protein, 11 aa, Entamoeba invadens
NKTKYGCKECE

SEQ ID NO: 2767858 - protein, 10 aa, Entamoeba invadens
NKTLWSGDSN

SEQ ID NO: 2767859 - protein, 8 aa, Entamoeba invadens
NKTNEVNT

SEQ ID NO: 2767860 - protein, 8 aa, Entamoeba invadens
NKTNGNCT

SEQ ID NO: 2767861 - protein, 7 aa, Entamoeba invadens
NKTNLED

SEQ ID NO: 2767862 - protein, 7 aa, Entamoeba invadens
NKTNMGC

SEQ ID NO: 2767863 - protein, 20 aa, Entamoeba invadens
NKTNRSLEDDDSSNSNEEIK

SEQ ID NO: 2767864 - protein, 20 aa, Entamoeba invadens
NKTPLNLSEPEVNKEGIEKI

SEQ ID NO: 2767865 - protein, 7 aa, Entamoeba invadens
NKTPTRL

SEQ ID NO: 2767866 - protein, 21 aa, Entamoeba invadens
NKTQEISEAVTETAYANNATK

SEQ ID NO: 2767867 - protein, 15 aa, Entamoeba invadens
NKTQRIKVSPTSTLE

SEQ ID NO: 2767868 - protein, 5 aa, Entamoeba invadens
NKTRA

SEQ ID NO: 2767869 - protein, 9 aa, Entamoeba invadens
NKTRYDTST

SEQ ID NO: 2767870 - protein, 8 aa, Entamoeba invadens
NKTSGEQF

SEQ ID NO: 2767871 - protein, 11 aa, Entamoeba invadens
NKTSKKCTSCG

SEQ ID NO: 2767872 - protein, 6 aa, Entamoeba invadens
NKTSRG

SEQ ID NO: 2767873 - protein, 7 aa, Entamoeba invadens
NKTSSGC

SEQ ID NO: 2767874 - protein, 8 aa, Entamoeba invadens
NKTSSGCA

SEQ ID NO: 2767875 - protein, 17 aa, Entamoeba invadens
NKTSYNSLSAAYLANRL

SEQ ID NO: 2767876 - protein, 5 aa, Entamoeba invadens
NKTTC

SEQ ID NO: 2767877 - protein, 7 aa, Entamoeba invadens
NKTTCTK

SEQ ID NO: 2767878 - protein, 10 aa, Entamoeba invadens
NKTTEGCSEC

SEQ ID NO: 2767879 - protein, 7 aa, Entamoeba invadens
NKTTNGC

SEQ ID NO: 2767880 - protein, 14 aa, Entamoeba invadens
NKTTNGCTQCEDGY

SEQ ID NO: 2767881 - protein, 10 aa, Entamoeba invadens
NKTTQCTSCP

SEQ ID NO: 2767882 - protein, 25 aa, Entamoeba invadens
NKTTRQTTKNEDTQTDSHCEVSTTK

SEQ ID NO: 2767883 - protein, 7 aa, Entamoeba invadens
NKTTSEC

SEQ ID NO: 2767884 - protein, 10 aa, Entamoeba invadens
NKTTSGCTQC

SEQ ID NO: 2767885 - protein, 12 aa, Entamoeba invadens
NKTTSTCNQCSS

SEQ ID NO: 2767886 - protein, 9 aa, Entamoeba invadens
NKTTTETPL

SEQ ID NO: 2767887 - protein, 9 aa, Entamoeba invadens
NKTTTETSL

SEQ ID NO: 2767888 - protein, 7 aa, Entamoeba invadens
NKTTTKV

SEQ ID NO: 2767889 - protein, 9 aa, Entamoeba invadens
NKTTVDQNG

SEQ ID NO: 2767890 - protein, 7 aa, Entamoeba invadens
NKTVEDK

SEQ ID NO: 2767891 - protein, 8 aa, Entamoeba invadens
NKTVGDKP

SEQ ID NO: 2767892 - protein, 10 aa, Entamoeba invadens
NKTVNTNKTE

SEQ ID NO: 2767893 - protein, 6 aa, Entamoeba invadens
NKTVSS

SEQ ID NO: 2767894 - protein, 13 aa, Entamoeba invadens
NKTYQSNEKQTYC

SEQ ID NO: 2767895 - protein, 4 aa, Entamoeba invadens
NKVA

SEQ ID NO: 2767896 - protein, 10 aa, Entamoeba invadens
NKVGQRRKKA

SEQ ID NO: 2767897 - protein, 5 aa, Entamoeba invadens
NKVKQ

SEQ ID NO: 2767898 - protein, 4 aa, Entamoeba invadens
NKVN

SEQ ID NO: 2767899 - protein, 5 aa, Entamoeba invadens
NKVNA

SEQ ID NO: 2767900 - protein, 7 aa, Entamoeba invadens
NKVNETK

SEQ ID NO: 2767901 - protein, 14 aa, Entamoeba invadens
NKVNTKLTDFGASR

SEQ ID NO: 2767902 - protein, 9 aa, Entamoeba invadens
NKVQEEGKI

SEQ ID NO: 2767903 - protein, 6 aa, Entamoeba invadens
NKVQSK

SEQ ID NO: 2767904 - protein, 7 aa, Entamoeba invadens
NKVSDTE

SEQ ID NO: 2767905 - protein, 7 aa, Entamoeba invadens
NKVSTVK

SEQ ID NO: 2767906 - protein, 7 aa, Entamoeba invadens
NKYCRPQ

SEQ ID NO: 2767907 - protein, 5 aa, Entamoeba invadens
NKYDT

SEQ ID NO: 2767908 - protein, 5 aa, Entamoeba invadens
NKYGR

SEQ ID NO: 2767909 - protein, 9 aa, Entamoeba invadens
NKYKKPADI

SEQ ID NO: 2767910 - protein, 7 aa, Entamoeba invadens
NKYLQDT

SEQ ID NO: 2767911 - protein, 7 aa, Entamoeba invadens
NKYPSNK

SEQ ID NO: 2767912 - protein, 6 aa, Entamoeba invadens
NKYSRE

SEQ ID NO: 2767913 - protein, 23 aa, Entamoeba invadens
NLADQAGCKECKNNLTSTENDTA

SEQ ID NO: 2767914 - protein, 6 aa, Entamoeba invadens
NLAKDG

SEQ ID NO: 2767915 - protein, 9 aa, Entamoeba invadens
NLATNNSIT

SEQ ID NO: 2767916 - protein, 6 aa, Entamoeba invadens
NLDDGV

SEQ ID NO: 2767917 - protein, 8 aa, Entamoeba invadens
NLDENEID

SEQ ID NO: 2767918 - protein, 5 aa, Entamoeba invadens
NLDEQ

SEQ ID NO: 2767919 - protein, 15 aa, Entamoeba invadens
NLDGTKKCSTPIAAN

SEQ ID NO: 2767920 - protein, 22 aa, Entamoeba invadens
NLDKSKEEDEEVEEEGDERTPL

SEQ ID NO: 2767921 - protein, 7 aa, Entamoeba invadens
NLDNTEV

SEQ ID NO: 2767922 - protein, 9 aa, Entamoeba invadens
NLDRYSPPS

SEQ ID NO: 2767923 - protein, 10 aa, Entamoeba invadens
NLDSQPSQDF

SEQ ID NO: 2767924 - protein, 5 aa, Entamoeba invadens
NLDTP

SEQ ID NO: 2767925 - protein, 6 aa, Entamoeba invadens
NLDTSQ

SEQ ID NO: 2767926 - protein, 8 aa, Entamoeba invadens
NLEETADE

SEQ ID NO: 2767927 - protein, 8 aa, Entamoeba invadens
NLEQNGEN

SEQ ID NO: 2767928 - protein, 5 aa, Entamoeba invadens
NLERA

SEQ ID NO: 2767929 - protein, 6 aa, Entamoeba invadens
NLESEN

SEQ ID NO: 2767930 - protein, 4 aa, Entamoeba invadens
NLFS

SEQ ID NO: 2767931 - protein, 7 aa, Entamoeba invadens
NLGPKGT

SEQ ID NO: 2767932 - protein, 8 aa, Entamoeba invadens
NLGQNGEL

SEQ ID NO: 2767933 - protein, 11 aa, Entamoeba invadens
NLGTDTGKGVY

SEQ ID NO: 2767934 - protein, 6 aa, Entamoeba invadens
NLIKDK

SEQ ID NO: 2767935 - protein, 8 aa, Entamoeba invadens
NLIKSQGG

SEQ ID NO: 2767936 - protein, 8 aa, Entamoeba invadens
NLKEYGGK

SEQ ID NO: 2767937 - protein, 14 aa, Entamoeba invadens
NLKGKTEETYTPDM

SEQ ID NO: 2767938 - protein, 10 aa, Entamoeba invadens
NLKKSDISAS

SEQ ID NO: 2767939 - protein, 5 aa, Entamoeba invadens
NLKPT

SEQ ID NO: 2767940 - protein, 4 aa, Entamoeba invadens
NLKR

SEQ ID NO: 2767941 - protein, 9 aa, Entamoeba invadens
NLKSGRNKK

SEQ ID NO: 2767942 - protein, 10 aa, Entamoeba invadens
NLKTNDEKFN

SEQ ID NO: 2767943 - protein, 10 aa, Entamoeba invadens
NLKTNEEKYK

SEQ ID NO: 2767944 - protein, 7 aa, Entamoeba invadens
NLKTRNK

SEQ ID NO: 2767945 - protein, 10 aa, Entamoeba invadens
NLKVDANEKL

SEQ ID NO: 2767946 - protein, 25 aa, Entamoeba invadens
NLNEENTAYCQQQKNNIKYSKYDLK

SEQ ID NO: 2767947 - protein, 9 aa, Entamoeba invadens
NLNERRDIS

SEQ ID NO: 2767948 - protein, 22 aa, Entamoeba invadens
NLNGQTTCKSCAEGCSSCNKTT

SEQ ID NO: 2767949 - protein, 5 aa, Entamoeba invadens
NLNNK

SEQ ID NO: 2767950 - protein, 6 aa, Entamoeba invadens
NLNTTN

SEQ ID NO: 2767951 - protein, 29 aa, Entamoeba invadens
NLNTTTATVVDDQKPLAGVQEASESQRDR

SEQ ID NO: 2767952 - protein, 18 aa, Entamoeba invadens
NLNYKSTHKSDDLDNTKQ

SEQ ID NO: 2767953 - protein, 17 aa, Entamoeba invadens
NLNYPSQGRCSKCQTNN

SEQ ID NO: 2767954 - protein, 8 aa, Entamoeba invadens
NLPEEPLD

SEQ ID NO: 2767955 - protein, 15 aa, Entamoeba invadens
NLPGGKGEKYEITPT

SEQ ID NO: 2767956 - protein, 34 aa, Entamoeba invadens
NLPNKVRKREDDQNDDHSNGHSAEDKDTKESTIT

SEQ ID NO: 2767957 - protein, 9 aa, Entamoeba invadens
NLPNNSIEI

SEQ ID NO: 2767958 - protein, 8 aa, Entamoeba invadens
NLPPSNSN

SEQ ID NO: 2767959 - protein, 5 aa, Entamoeba invadens
NLPQV

SEQ ID NO: 2767960 - protein, 7 aa, Entamoeba invadens
NLPTDDG

SEQ ID NO: 2767961 - protein, 7 aa, Entamoeba invadens
NLPTEID

SEQ ID NO: 2767962 - protein, 5 aa, Entamoeba invadens
NLQET

SEQ ID NO: 2767963 - protein, 6 aa, Entamoeba invadens
NLQGTN

SEQ ID NO: 2767964 - protein, 7 aa, Entamoeba invadens
NLQGTNV

SEQ ID NO: 2767965 - protein, 13 aa, Entamoeba invadens
NLQKEESSKFEQW

SEQ ID NO: 2767966 - protein, 18 aa, Entamoeba invadens
NLQKNTQDFQLENSDENV

SEQ ID NO: 2767967 - protein, 10 aa, Entamoeba invadens
NLQMSSSTQR

SEQ ID NO: 2767968 - protein, 7 aa, Entamoeba invadens
NLQNSQS

SEQ ID NO: 2767969 - protein, 13 aa, Entamoeba invadens
NLQPDKTCKPNCP

SEQ ID NO: 2767970 - protein, 8 aa, Entamoeba invadens
NLQTPTFS

SEQ ID NO: 2767971 - protein, 5 aa, Entamoeba invadens
NLRSG

SEQ ID NO: 2767972 - protein, 8 aa, Entamoeba invadens
NLSDNTMT

SEQ ID NO: 2767973 - protein, 7 aa, Entamoeba invadens
NLSETPL

SEQ ID NO: 2767974 - protein, 10 aa, Entamoeba invadens
NLSGNSGPMP

SEQ ID NO: 2767975 - protein, 5 aa, Entamoeba invadens
NLSKL

SEQ ID NO: 2767976 - protein, 11 aa, Entamoeba invadens
NLSPEKYKDWG

SEQ ID NO: 2767977 - protein, 4 aa, Entamoeba invadens
NLSR

SEQ ID NO: 2767978 - protein, 10 aa, Entamoeba invadens
NLSSGPKAGN

SEQ ID NO: 2767979 - protein, 8 aa, Entamoeba invadens
NLSSGVDT

SEQ ID NO: 2767980 - protein, 26 aa, Entamoeba invadens
NLSSNGNSCDQCDSASYYDKTTNRCV

SEQ ID NO: 2767981 - protein, 9 aa, Entamoeba invadens
NLSTGEERF

SEQ ID NO: 2767982 - protein, 7 aa, Entamoeba invadens
NLSTNDT

SEQ ID NO: 2767983 - protein, 19 aa, Entamoeba invadens
NLTDDGACAENGCKTYNTG

SEQ ID NO: 2767984 - protein, 6 aa, Entamoeba invadens
NLTDNT

SEQ ID NO: 2767985 - protein, 5 aa, Entamoeba invadens
NLTID

SEQ ID NO: 2767986 - protein, 4 aa, Entamoeba invadens
NLTK

SEQ ID NO: 2767987 - protein, 4 aa, Entamoeba invadens
NLTL

SEQ ID NO: 2767988 - protein, 9 aa, Entamoeba invadens
NLTNPELNK

SEQ ID NO: 2767989 - protein, 32 aa, Entamoeba invadens
NLTPQKSPTQLQEESAQKKFTTLTAPQSPINP

SEQ ID NO: 2767990 - protein, 9 aa, Entamoeba invadens
NLTQESKQK

SEQ ID NO: 2767991 - protein, 9 aa, Entamoeba invadens
NLTREKSTE

SEQ ID NO: 2767992 - protein, 4 aa, Entamoeba invadens
NLTT

SEQ ID NO: 2767993 - protein, 7 aa, Entamoeba invadens
NLTVEDN

SEQ ID NO: 2767994 - protein, 14 aa, Entamoeba invadens
NLTYNTKSNTCEEY

SEQ ID NO: 2767995 - protein, 6 aa, Entamoeba invadens
NLVSNK

SEQ ID NO: 2767996 - protein, 5 aa, Entamoeba invadens
NLVTN

SEQ ID NO: 2767997 - protein, 7 aa, Entamoeba invadens
NLYQSGE

SEQ ID NO: 2767998 - protein, 6 aa, Entamoeba invadens
NMDEKE

SEQ ID NO: 2767999 - protein, 5 aa, Entamoeba invadens
NMDPG

SEQ ID NO: 2768000 - protein, 33 aa, Entamoeba invadens
NMEKTDSNKSIELSDDSSSDDVPTPRASLKPGQ

SEQ ID NO: 2768001 - protein, 11 aa, Entamoeba invadens
NMELKENTTIE

SEQ ID NO: 2768002 - protein, 10 aa, Entamoeba invadens
NMKDSSKLYS

SEQ ID NO: 2768003 - protein, 4 aa, Entamoeba invadens
NMKT

SEQ ID NO: 2768004 - protein, 4 aa, Entamoeba invadens
NMLS

SEQ ID NO: 2768005 - protein, 10 aa, Entamoeba invadens
NMNNNTSMEE

SEQ ID NO: 2768006 - protein, 6 aa, Entamoeba invadens
NMPDGD

SEQ ID NO: 2768007 - protein, 4 aa, Entamoeba invadens
NMPN

SEQ ID NO: 2768008 - protein, 6 aa, Entamoeba invadens
NMREVQ

SEQ ID NO: 2768009 - protein, 12 aa, Entamoeba invadens
NMRNKKYSCNKE

SEQ ID NO: 2768010 - protein, 7 aa, Entamoeba invadens
NMSGQSS

SEQ ID NO: 2768011 - protein, 6 aa, Entamoeba invadens
NMSTKN

SEQ ID NO: 2768012 - protein, 10 aa, Entamoeba invadens
NMTSRSDQCD

SEQ ID NO: 2768013 - protein, 4 aa, Entamoeba invadens
NMTT

SEQ ID NO: 2768014 - protein, 10 aa, Entamoeba invadens
NMYPDTTTGK

SEQ ID NO: 2768015 - protein, 10 aa, Entamoeba invadens
NMYPSPDTGK

SEQ ID NO: 2768016 - protein, 4 aa, Entamoeba invadens
NNAC

SEQ ID NO: 2768017 - protein, 18 aa, Entamoeba invadens
NNAGDIDEDQIEFDDGFA

SEQ ID NO: 2768018 - protein, 7 aa, Entamoeba invadens
NNAIDEG

SEQ ID NO: 2768019 - protein, 9 aa, Entamoeba invadens
NNAKETYQN

SEQ ID NO: 2768020 - protein, 12 aa, Entamoeba invadens
NNALSKSSLNYY

SEQ ID NO: 2768021 - protein, 14 aa, Entamoeba invadens
NNASSLIENRETKV

SEQ ID NO: 2768022 - protein, 4 aa, Entamoeba invadens
NNCE

SEQ ID NO: 2768023 - protein, 12 aa, Entamoeba invadens
NNCEGGKCKKCN

SEQ ID NO: 2768024 - protein, 8 aa, Entamoeba invadens
NNCEIEGN

SEQ ID NO: 2768025 - protein, 7 aa, Entamoeba invadens
NNCEKCD

SEQ ID NO: 2768026 - protein, 5 aa, Entamoeba invadens
NNCET

SEQ ID NO: 2768027 - protein, 9 aa, Entamoeba invadens
NNCLDNTNS

SEQ ID NO: 2768028 - protein, 10 aa, Entamoeba invadens
NNCNKTEKSC

SEQ ID NO: 2768029 - protein, 9 aa, Entamoeba invadens
NNCNTTEKN

SEQ ID NO: 2768030 - protein, 9 aa, Entamoeba invadens
NNCQSNNGY

SEQ ID NO: 2768031 - protein, 18 aa, Entamoeba invadens
NNCRTCEGSSSNCTSCED

SEQ ID NO: 2768032 - protein, 11 aa, Entamoeba invadens
NNCSENYDQDN

SEQ ID NO: 2768033 - protein, 5 aa, Entamoeba invadens
NNCYK

SEQ ID NO: 2768034 - protein, 6 aa, Entamoeba invadens
NNCYKE

SEQ ID NO: 2768035 - protein, 15 aa, Entamoeba invadens
NNDDFSLSNSTTCTT

SEQ ID NO: 2768036 - protein, 16 aa, Entamoeba invadens
NNDEDDGDEYQSVSDD

SEQ ID NO: 2768037 - protein, 7 aa, Entamoeba invadens
NNDESCV

SEQ ID NO: 2768038 - protein, 5 aa, Entamoeba invadens
NNDGF

SEQ ID NO: 2768039 - protein, 12 aa, Entamoeba invadens
NNDGGCPDNTYS

SEQ ID NO: 2768040 - protein, 6 aa, Entamoeba invadens
NNDIIS

SEQ ID NO: 2768041 - protein, 19 aa, Entamoeba invadens
NNDKCEKCGTGCASCNENN

SEQ ID NO: 2768042 - protein, 6 aa, Entamoeba invadens
NNDNGK

SEQ ID NO: 2768043 - protein, 6 aa, Entamoeba invadens
NNDNVN

SEQ ID NO: 2768044 - protein, 6 aa, Entamoeba invadens
NNDPLK

SEQ ID NO: 2768045 - protein, 8 aa, Entamoeba invadens
NNDTKNKN

SEQ ID NO: 2768046 - protein, 6 aa, Entamoeba invadens
NNDVST

SEQ ID NO: 2768047 - protein, 5 aa, Entamoeba invadens
NNEAS

SEQ ID NO: 2768048 - protein, 6 aa, Entamoeba invadens
NNECDQ

SEQ ID NO: 2768049 - protein, 16 aa, Entamoeba invadens
NNECEKCNDNCTTCTQ

SEQ ID NO: 2768050 - protein, 17 aa, Entamoeba invadens
NNECEKCNNNCTTCTQH

SEQ ID NO: 2768051 - protein, 9 aa, Entamoeba invadens
NNECSECKN

SEQ ID NO: 2768052 - protein, 26 aa, Entamoeba invadens
NNEDTKTQSALELSSSPKLNDKSELK

SEQ ID NO: 2768053 - protein, 5 aa, Entamoeba invadens
NNEEC

SEQ ID NO: 2768054 - protein, 7 aa, Entamoeba invadens
NNEEPTF

SEQ ID NO: 2768055 - protein, 6 aa, Entamoeba invadens
NNEETA

SEQ ID NO: 2768056 - protein, 4 aa, Entamoeba invadens
NNEG

SEQ ID NO: 2768057 - protein, 5 aa, Entamoeba invadens
NNEGK

SEQ ID NO: 2768058 - protein, 26 aa, Entamoeba invadens
NNEIKSIKPEYTDDKNAKRAKNQEAY

SEQ ID NO: 2768059 - protein, 35 aa, Entamoeba invadens
NNEIKSIKPEYTDDKNAKRAKNQEAYIQGIDTMCE

SEQ ID NO: 2768060 - protein, 6 aa, Entamoeba invadens
NNEITD

SEQ ID NO: 2768061 - protein, 4 aa, Entamoeba invadens
NNEK

SEQ ID NO: 2768062 - protein, 15 aa, Entamoeba invadens
NNEKHVKYTSNSEKV

SEQ ID NO: 2768063 - protein, 4 aa, Entamoeba invadens
NNEL

SEQ ID NO: 2768064 - protein, 6 aa, Entamoeba invadens
NNEMGG

SEQ ID NO: 2768065 - protein, 7 aa, Entamoeba invadens
NNENEAD

SEQ ID NO: 2768066 - protein, 7 aa, Entamoeba invadens
NNENQQL

SEQ ID NO: 2768067 - protein, 11 aa, Entamoeba invadens
NNENTVDTNGY

SEQ ID NO: 2768068 - protein, 5 aa, Entamoeba invadens
NNENV

SEQ ID NO: 2768069 - protein, 10 aa, Entamoeba invadens
NNEPEPFRPE

SEQ ID NO: 2768070 - protein, 5 aa, Entamoeba invadens
NNEPK

SEQ ID NO: 2768071 - protein, 6 aa, Entamoeba invadens
NNEPNN

SEQ ID NO: 2768072 - protein, 6 aa, Entamoeba invadens
NNEQCS

SEQ ID NO: 2768073 - protein, 7 aa, Entamoeba invadens
NNERSSA

SEQ ID NO: 2768074 - protein, 4 aa, Entamoeba invadens
NNET

SEQ ID NO: 2768075 - protein, 13 aa, Entamoeba invadens
NNETCTTCSSGYF

SEQ ID NO: 2768076 - protein, 6 aa, Entamoeba invadens
NNETFS

SEQ ID NO: 2768077 - protein, 5 aa, Entamoeba invadens
NNETG

SEQ ID NO: 2768078 - protein, 5 aa, Entamoeba invadens
NNETK

SEQ ID NO: 2768079 - protein, 21 aa, Entamoeba invadens
NNETLKKNMADSNKIEEQQKT

SEQ ID NO: 2768080 - protein, 10 aa, Entamoeba invadens
NNETSTKECT

SEQ ID NO: 2768081 - protein, 7 aa, Entamoeba invadens
NNETYYS

SEQ ID NO: 2768082 - protein, 6 aa, Entamoeba invadens
NNFKKN

SEQ ID NO: 2768083 - protein, 13 aa, Entamoeba invadens
NNFNTKKEQVDEK

SEQ ID NO: 2768084 - protein, 10 aa, Entamoeba invadens
NNGCNTQLDN

SEQ ID NO: 2768085 - protein, 9 aa, Entamoeba invadens
NNGDEYYTV

SEQ ID NO: 2768086 - protein, 7 aa, Entamoeba invadens
NNGGVSG

SEQ ID NO: 2768087 - protein, 5 aa, Entamoeba invadens
NNGIS

SEQ ID NO: 2768088 - protein, 9 aa, Entamoeba invadens
NNGKGQKFI

SEQ ID NO: 2768089 - protein, 6 aa, Entamoeba invadens
NNGKQK

SEQ ID NO: 2768090 - protein, 14 aa, Entamoeba invadens
NNGKRPEKKDDMDD

SEQ ID NO: 2768091 - protein, 9 aa, Entamoeba invadens
NNGKTSSNH

SEQ ID NO: 2768092 - protein, 9 aa, Entamoeba invadens
NNGKTSSNN

SEQ ID NO: 2768093 - protein, 9 aa, Entamoeba invadens
NNGLDAKDK

SEQ ID NO: 2768094 - protein, 5 aa, Entamoeba invadens
NNGLS

SEQ ID NO: 2768095 - protein, 13 aa, Entamoeba invadens
NNGNCELQNGENE

SEQ ID NO: 2768096 - protein, 13 aa, Entamoeba invadens
NNGNCELQNGENN

SEQ ID NO: 2768097 - protein, 8 aa, Entamoeba invadens
NNGNGDCG

SEQ ID NO: 2768098 - protein, 6 aa, Entamoeba invadens
NNGNMT

SEQ ID NO: 2768099 - protein, 8 aa, Entamoeba invadens
NNGNNLNI

SEQ ID NO: 2768100 - protein, 5 aa, Entamoeba invadens
NNGNP

SEQ ID NO: 2768101 - protein, 6 aa, Entamoeba invadens
NNGNPK

SEQ ID NO: 2768102 - protein, 7 aa, Entamoeba invadens
NNGNSEI

SEQ ID NO: 2768103 - protein, 4 aa, Entamoeba invadens
NNGP

SEQ ID NO: 2768104 - protein, 8 aa, Entamoeba invadens
NNGSCSHV

SEQ ID NO: 2768105 - protein, 5 aa, Entamoeba invadens
NNGSL

SEQ ID NO: 2768106 - protein, 8 aa, Entamoeba invadens
NNGSPECT

SEQ ID NO: 2768107 - protein, 8 aa, Entamoeba invadens
NNGSPSGV

SEQ ID NO: 2768108 - protein, 8 aa, Entamoeba invadens
NNGSQSCT

SEQ ID NO: 2768109 - protein, 8 aa, Entamoeba invadens
NNGSTQIC

SEQ ID NO: 2768110 - protein, 5 aa, Entamoeba invadens
NNGTL

SEQ ID NO: 2768111 - protein, 8 aa, Entamoeba invadens
NNGTTQMC

SEQ ID NO: 2768112 - protein, 5 aa, Entamoeba invadens
NNGYI

SEQ ID NO: 2768113 - protein, 16 aa, Entamoeba invadens
NNGYINNNGKCVKSDF

SEQ ID NO: 2768114 - protein, 15 aa, Entamoeba invadens
NNGYYPKNKRCSQCN

SEQ ID NO: 2768115 - protein, 6 aa, Entamoeba invadens
NNHFDT

SEQ ID NO: 2768116 - protein, 4 aa, Entamoeba invadens
NNHP

SEQ ID NO: 2768117 - protein, 4 aa, Entamoeba invadens
NNIC

SEQ ID NO: 2768118 - protein, 10 aa, Entamoeba invadens
NNIDDYQSYE

SEQ ID NO: 2768119 - protein, 14 aa, Entamoeba invadens
NNIDTEFEAKKTLI

SEQ ID NO: 2768120 - protein, 4 aa, Entamoeba invadens
NNIE

SEQ ID NO: 2768121 - protein, 5 aa, Entamoeba invadens
NNINY

SEQ ID NO: 2768122 - protein, 4 aa, Entamoeba invadens
NNIQ

SEQ ID NO: 2768123 - protein, 5 aa, Entamoeba invadens
NNISD

SEQ ID NO: 2768124 - protein, 5 aa, Entamoeba invadens
NNITE

SEQ ID NO: 2768125 - protein, 9 aa, Entamoeba invadens
NNITSKKNI

SEQ ID NO: 2768126 - protein, 6 aa, Entamoeba invadens
NNIYGN

SEQ ID NO: 2768127 - protein, 20 aa, Entamoeba invadens
NNKCEKCGTGCASCNENNLN

SEQ ID NO: 2768128 - protein, 5 aa, Entamoeba invadens
NNKCP

SEQ ID NO: 2768129 - protein, 7 aa, Entamoeba invadens
NNKDAAV

SEQ ID NO: 2768130 - protein, 4 aa, Entamoeba invadens
NNKE

SEQ ID NO: 2768131 - protein, 10 aa, Entamoeba invadens
NNKEEGKKQV

SEQ ID NO: 2768132 - protein, 15 aa, Entamoeba invadens
NNKEKLKEKKRVEAK

SEQ ID NO: 2768133 - protein, 6 aa, Entamoeba invadens
NNKFRR

SEQ ID NO: 2768134 - protein, 10 aa, Entamoeba invadens
NNKGCERCNS

SEQ ID NO: 2768135 - protein, 6 aa, Entamoeba invadens
NNKHTN

SEQ ID NO: 2768136 - protein, 7 aa, Entamoeba invadens
NNKIAST

SEQ ID NO: 2768137 - protein, 11 aa, Entamoeba invadens
NNKIQIESESR

SEQ ID NO: 2768138 - protein, 20 aa, Entamoeba invadens
NNKNIKQGTSLATTPPPQRV

SEQ ID NO: 2768139 - protein, 10 aa, Entamoeba invadens
NNKNKKKTKN

SEQ ID NO: 2768140 - protein, 10 aa, Entamoeba invadens
NNKNKKKTQN

SEQ ID NO: 2768141 - protein, 9 aa, Entamoeba invadens
NNKNSEEID

SEQ ID NO: 2768142 - protein, 8 aa, Entamoeba invadens
NNKPESFQ

SEQ ID NO: 2768143 - protein, 8 aa, Entamoeba invadens
NNKPQVIP

SEQ ID NO: 2768144 - protein, 4 aa, Entamoeba invadens
NNKQ

SEQ ID NO: 2768145 - protein, 8 aa, Entamoeba invadens
NNKRISNG

SEQ ID NO: 2768146 - protein, 22 aa, Entamoeba invadens
NNKRQEKRVDPSPDYQQVEMKQ

SEQ ID NO: 2768147 - protein, 15 aa, Entamoeba invadens
NNKSAKTIYTHSPFY

SEQ ID NO: 2768148 - protein, 9 aa, Entamoeba invadens
NNKSDIYYD

SEQ ID NO: 2768149 - protein, 13 aa, Entamoeba invadens
NNKSTDCTTYSTH

SEQ ID NO: 2768150 - protein, 12 aa, Entamoeba invadens
NNKTDNVEYSGN

SEQ ID NO: 2768151 - protein, 9 aa, Entamoeba invadens
NNKTSSEID

SEQ ID NO: 2768152 - protein, 5 aa, Entamoeba invadens
NNKTY

SEQ ID NO: 2768153 - protein, 5 aa, Entamoeba invadens
NNKYD

SEQ ID NO: 2768154 - protein, 6 aa, Entamoeba invadens
NNKYTG

SEQ ID NO: 2768155 - protein, 9 aa, Entamoeba invadens
NNLAPDEKW

SEQ ID NO: 2768156 - protein, 7 aa, Entamoeba invadens
NNLDKPV

SEQ ID NO: 2768157 - protein, 10 aa, Entamoeba invadens
NNMDDYQSYE

SEQ ID NO: 2768158 - protein, 19 aa, Entamoeba invadens
NNMPSISEECPEDTEDSSH

SEQ ID NO: 2768159 - protein, 6 aa, Entamoeba invadens
NNNAFP

SEQ ID NO: 2768160 - protein, 4 aa, Entamoeba invadens
NNNC

SEQ ID NO: 2768161 - protein, 23 aa, Entamoeba invadens
NNNCKQKKCNKNEIEEENGKCSQ

SEQ ID NO: 2768162 - protein, 9 aa, Entamoeba invadens
NNNCNTNKN

SEQ ID NO: 2768163 - protein, 6 aa, Entamoeba invadens
NNNDIQ

SEQ ID NO: 2768164 - protein, 17 aa, Entamoeba invadens
NNNDKVFKDDNDGTDIA

SEQ ID NO: 2768165 - protein, 8 aa, Entamoeba invadens
NNNDPTKV

SEQ ID NO: 2768166 - protein, 7 aa, Entamoeba invadens
NNNENIG

SEQ ID NO: 2768167 - protein, 7 aa, Entamoeba invadens
NNNFKGV

SEQ ID NO: 2768168 - protein, 4 aa, Entamoeba invadens
NNNG

SEQ ID NO: 2768169 - protein, 10 aa, Entamoeba invadens
NNNGKEEDEI

SEQ ID NO: 2768170 - protein, 4 aa, Entamoeba invadens
NNNI

SEQ ID NO: 2768171 - protein, 8 aa, Entamoeba invadens
NNNITNIE

SEQ ID NO: 2768172 - protein, 6 aa, Entamoeba invadens
NNNKCL

SEQ ID NO: 2768173 - protein, 11 aa, Entamoeba invadens
NNNKCTSCSDG

SEQ ID NO: 2768174 - protein, 11 aa, Entamoeba invadens
NNNKNKKKTKN

SEQ ID NO: 2768175 - protein, 11 aa, Entamoeba invadens
NNNKPNGDITS

SEQ ID NO: 2768176 - protein, 5 aa, Entamoeba invadens
NNNLR

SEQ ID NO: 2768177 - protein, 7 aa, Entamoeba invadens
NNNNECS

SEQ ID NO: 2768178 - protein, 6 aa, Entamoeba invadens
NNNNGK

SEQ ID NO: 2768179 - protein, 9 aa, Entamoeba invadens
NNNNKKPNC

SEQ ID NO: 2768180 - protein, 7 aa, Entamoeba invadens
NNNNKYI

SEQ ID NO: 2768181 - protein, 20 aa, Entamoeba invadens
NNNNTPQQQELTPEQRQQRE

SEQ ID NO: 2768182 - protein, 6 aa, Entamoeba invadens
NNNNTY

SEQ ID NO: 2768183 - protein, 17 aa, Entamoeba invadens
NNNNVTNTLKKQKMEEE

SEQ ID NO: 2768184 - protein, 7 aa, Entamoeba invadens
NNNQKVD

SEQ ID NO: 2768185 - protein, 6 aa, Entamoeba invadens
NNNQTG

SEQ ID NO: 2768186 - protein, 5 aa, Entamoeba invadens
NNNSD

SEQ ID NO: 2768187 - protein, 6 aa, Entamoeba invadens
NNNSIN

SEQ ID NO: 2768188 - protein, 13 aa, Entamoeba invadens
NNNSPPQKPPRQI

SEQ ID NO: 2768189 - protein, 8 aa, Entamoeba invadens
NNNSQGCT

SEQ ID NO: 2768190 - protein, 13 aa, Entamoeba invadens
NNNSYYDGEPPFA

SEQ ID NO: 2768191 - protein, 4 aa, Entamoeba invadens
NNNT

SEQ ID NO: 2768192 - protein, 6 aa, Entamoeba invadens
NNNTCQ

SEQ ID NO: 2768193 - protein, 16 aa, Entamoeba invadens
NNNTNDENKEKELDEF

SEQ ID NO: 2768194 - protein, 6 aa, Entamoeba invadens
NNNTNI

SEQ ID NO: 2768195 - protein, 12 aa, Entamoeba invadens
NNNTSVTTQSQA

SEQ ID NO: 2768196 - protein, 9 aa, Entamoeba invadens
NNNTTTIEN

SEQ ID NO: 2768197 - protein, 4 aa, Entamoeba invadens
NNNV

SEQ ID NO: 2768198 - protein, 6 aa, Entamoeba invadens
NNNYAQ

SEQ ID NO: 2768199 - protein, 6 aa, Entamoeba invadens
NNNYDN

SEQ ID NO: 2768200 - protein, 7 aa, Entamoeba invadens
NNNYTKS

SEQ ID NO: 2768201 - protein, 15 aa, Entamoeba invadens
NNPAAGALADDHRND

SEQ ID NO: 2768202 - protein, 4 aa, Entamoeba invadens
NNPE

SEQ ID NO: 2768203 - protein, 22 aa, Entamoeba invadens
NNPESVKTAYTSLNSKRDVKEL

SEQ ID NO: 2768204 - protein, 8 aa, Entamoeba invadens
NNPISTSR

SEQ ID NO: 2768205 - protein, 5 aa, Entamoeba invadens
NNPLT

SEQ ID NO: 2768206 - protein, 6 aa, Entamoeba invadens
NNPMNC

SEQ ID NO: 2768207 - protein, 7 aa, Entamoeba invadens
NNPNEAV

SEQ ID NO: 2768208 - protein, 7 aa, Entamoeba invadens
NNPNGGV

SEQ ID NO: 2768209 - protein, 8 aa, Entamoeba invadens
NNPNNEQS

SEQ ID NO: 2768210 - protein, 18 aa, Entamoeba invadens
NNPNQRPTFEQIKSRLEK

SEQ ID NO: 2768211 - protein, 6 aa, Entamoeba invadens
NNPPNK

SEQ ID NO: 2768212 - protein, 4 aa, Entamoeba invadens
NNPR

SEQ ID NO: 2768213 - protein, 7 aa, Entamoeba invadens
NNPRKPH

SEQ ID NO: 2768214 - protein, 8 aa, Entamoeba invadens
NNPSSESF

SEQ ID NO: 2768215 - protein, 7 aa, Entamoeba invadens
NNPSTTN

SEQ ID NO: 2768216 - protein, 8 aa, Entamoeba invadens
NNPTEEKI

SEQ ID NO: 2768217 - protein, 5 aa, Entamoeba invadens
NNPTL

SEQ ID NO: 2768218 - protein, 7 aa, Entamoeba invadens
NNPTPKY

SEQ ID NO: 2768219 - protein, 4 aa, Entamoeba invadens
NNPV

SEQ ID NO: 2768220 - protein, 7 aa, Entamoeba invadens
NNPVPIN

SEQ ID NO: 2768221 - protein, 4 aa, Entamoeba invadens
NNQA

SEQ ID NO: 2768222 - protein, 10 aa, Entamoeba invadens
NNQCDTTTKL

SEQ ID NO: 2768223 - protein, 7 aa, Entamoeba invadens
NNQCKSC

SEQ ID NO: 2768224 - protein, 13 aa, Entamoeba invadens
NNQCYQGTDGCDD

SEQ ID NO: 2768225 - protein, 10 aa, Entamoeba invadens
NNQDERPTYN

SEQ ID NO: 2768226 - protein, 5 aa, Entamoeba invadens
NNQED

SEQ ID NO: 2768227 - protein, 8 aa, Entamoeba invadens
NNQESTFT

SEQ ID NO: 2768228 - protein, 4 aa, Entamoeba invadens
NNQI

SEQ ID NO: 2768229 - protein, 6 aa, Entamoeba invadens
NNQITS

SEQ ID NO: 2768230 - protein, 9 aa, Entamoeba invadens
NNQKTPRGL

SEQ ID NO: 2768231 - protein, 11 aa, Entamoeba invadens
NNQPAKWSQKT

SEQ ID NO: 2768232 - protein, 5 aa, Entamoeba invadens
NNQRC

SEQ ID NO: 2768233 - protein, 9 aa, Entamoeba invadens
NNQRPSDDC

SEQ ID NO: 2768234 - protein, 4 aa, Entamoeba invadens
NNRD

SEQ ID NO: 2768235 - protein, 5 aa, Entamoeba invadens
NNRDD

SEQ ID NO: 2768236 - protein, 11 aa, Entamoeba invadens
NNREDKIDEVG

SEQ ID NO: 2768237 - protein, 7 aa, Entamoeba invadens
NNREEVK

SEQ ID NO: 2768238 - protein, 12 aa, Entamoeba invadens
NNRIDPNESCEG

SEQ ID NO: 2768239 - protein, 13 aa, Entamoeba invadens
NNRKTYDVEQNKE

SEQ ID NO: 2768240 - protein, 4 aa, Entamoeba invadens
NNRM

SEQ ID NO: 2768241 - protein, 5 aa, Entamoeba invadens
NNRMP

SEQ ID NO: 2768242 - protein, 4 aa, Entamoeba invadens
NNRN

SEQ ID NO: 2768243 - protein, 10 aa, Entamoeba invadens
NNRPENDKQI

SEQ ID NO: 2768244 - protein, 13 aa, Entamoeba invadens
NNRQYKLGSPFGG

SEQ ID NO: 2768245 - protein, 13 aa, Entamoeba invadens
NNRVDDYEECDGG

SEQ ID NO: 2768246 - protein, 16 aa, Entamoeba invadens
NNRYDDGEECDGGNTC

SEQ ID NO: 2768247 - protein, 8 aa, Entamoeba invadens
NNSAGPKL

SEQ ID NO: 2768248 - protein, 6 aa, Entamoeba invadens
NNSAPF

SEQ ID NO: 2768249 - protein, 6 aa, Entamoeba invadens
NNSCEP

SEQ ID NO: 2768250 - protein, 10 aa, Entamoeba invadens
NNSCEQKTQI

SEQ ID NO: 2768251 - protein, 8 aa, Entamoeba invadens
NNSCETPE

SEQ ID NO: 2768252 - protein, 5 aa, Entamoeba invadens
NNSCQ

SEQ ID NO: 2768253 - protein, 5 aa, Entamoeba invadens
NNSDE

SEQ ID NO: 2768254 - protein, 15 aa, Entamoeba invadens
NNSDLTENEKLGEGS

SEQ ID NO: 2768255 - protein, 7 aa, Entamoeba invadens
NNSDQFP

SEQ ID NO: 2768256 - protein, 5 aa, Entamoeba invadens
NNSEL

SEQ ID NO: 2768257 - protein, 5 aa, Entamoeba invadens
NNSFE

SEQ ID NO: 2768258 - protein, 8 aa, Entamoeba invadens
NNSGGTVD

SEQ ID NO: 2768259 - protein, 10 aa, Entamoeba invadens
NNSGKCAKCN

SEQ ID NO: 2768260 - protein, 15 aa, Entamoeba invadens
NNSINYNSNECSNDK

SEQ ID NO: 2768261 - protein, 6 aa, Entamoeba invadens
NNSIPN

SEQ ID NO: 2768262 - protein, 4 aa, Entamoeba invadens
NNSK

SEQ ID NO: 2768263 - protein, 7 aa, Entamoeba invadens
NNSKCDD

SEQ ID NO: 2768264 - protein, 13 aa, Entamoeba invadens
NNSKCEKCKDSNC

SEQ ID NO: 2768265 - protein, 7 aa, Entamoeba invadens
NNSKCTK

SEQ ID NO: 2768266 - protein, 5 aa, Entamoeba invadens
NNSKG

SEQ ID NO: 2768267 - protein, 6 aa, Entamoeba invadens
NNSKKK

SEQ ID NO: 2768268 - protein, 7 aa, Entamoeba invadens
NNSKNTL

SEQ ID NO: 2768269 - protein, 8 aa, Entamoeba invadens
NNSKSNMK

SEQ ID NO: 2768270 - protein, 7 aa, Entamoeba invadens
NNSKTQA

SEQ ID NO: 2768271 - protein, 16 aa, Entamoeba invadens
NNSKVNAKLTDFGSAR

SEQ ID NO: 2768272 - protein, 11 aa, Entamoeba invadens
NNSNAYGEGYT

SEQ ID NO: 2768273 - protein, 7 aa, Entamoeba invadens
NNSNGSI

SEQ ID NO: 2768274 - protein, 16 aa, Entamoeba invadens
NNSNIANTSSASDDED

SEQ ID NO: 2768275 - protein, 15 aa, Entamoeba invadens
NNSNIDTSDKANHIT

SEQ ID NO: 2768276 - protein, 5 aa, Entamoeba invadens
NNSNV

SEQ ID NO: 2768277 - protein, 7 aa, Entamoeba invadens
NNSPIRI

SEQ ID NO: 2768278 - protein, 4 aa, Entamoeba invadens
NNSQ

SEQ ID NO: 2768279 - protein, 8 aa, Entamoeba invadens
NNSQIITN

SEQ ID NO: 2768280 - protein, 7 aa, Entamoeba invadens
NNSQKLP

SEQ ID NO: 2768281 - protein, 42 aa, Entamoeba invadens
NNSQTSGSKFDSSCNSESNTKSDGVVEHSSTNQVDSSSGSYH

SEQ ID NO: 2768282 - protein, 5 aa, Entamoeba invadens
NNSSI

SEQ ID NO: 2768283 - protein, 8 aa, Entamoeba invadens
NNSSPTSL

SEQ ID NO: 2768284 - protein, 8 aa, Entamoeba invadens
NNSSTCDE

SEQ ID NO: 2768285 - protein, 5 aa, Entamoeba invadens
NNSSV

SEQ ID NO: 2768286 - protein, 8 aa, Entamoeba invadens
NNSTEPKC

SEQ ID NO: 2768287 - protein, 5 aa, Entamoeba invadens
NNSTL

SEQ ID NO: 2768288 - protein, 12 aa, Entamoeba invadens
NNSTTSGTITGK

SEQ ID NO: 2768289 - protein, 23 aa, Entamoeba invadens
NNSVAQQLTSENNSTNTTPQSTQ

SEQ ID NO: 2768290 - protein, 6 aa, Entamoeba invadens
NNSYGS

SEQ ID NO: 2768291 - protein, 11 aa, Entamoeba invadens
NNTAQNTNYNV

SEQ ID NO: 2768292 - protein, 4 aa, Entamoeba invadens
NNTC

SEQ ID NO: 2768293 - protein, 7 aa, Entamoeba invadens
NNTCEKC

SEQ ID NO: 2768294 - protein, 6 aa, Entamoeba invadens
NNTCES

SEQ ID NO: 2768295 - protein, 8 aa, Entamoeba invadens
NNTCQAQT

SEQ ID NO: 2768296 - protein, 7 aa, Entamoeba invadens
NNTDFSY

SEQ ID NO: 2768297 - protein, 5 aa, Entamoeba invadens
NNTDL

SEQ ID NO: 2768298 - protein, 10 aa, Entamoeba invadens
NNTDSSNYSV

SEQ ID NO: 2768299 - protein, 5 aa, Entamoeba invadens
NNTEN

SEQ ID NO: 2768300 - protein, 6 aa, Entamoeba invadens
NNTETC

SEQ ID NO: 2768301 - protein, 5 aa, Entamoeba invadens
NNTFI

SEQ ID NO: 2768302 - protein, 6 aa, Entamoeba invadens
NNTGSY

SEQ ID NO: 2768303 - protein, 7 aa, Entamoeba invadens
NNTIRTT

SEQ ID NO: 2768304 - protein, 5 aa, Entamoeba invadens
NNTIS

SEQ ID NO: 2768305 - protein, 6 aa, Entamoeba invadens
NNTKGT

SEQ ID NO: 2768306 - protein, 5 aa, Entamoeba invadens
NNTKI

SEQ ID NO: 2768307 - protein, 27 aa, Entamoeba invadens
NNTKRPLKTQITTKSNSTKYSIRANPS

SEQ ID NO: 2768308 - protein, 9 aa, Entamoeba invadens
NNTKYTNQN

SEQ ID NO: 2768309 - protein, 18 aa, Entamoeba invadens
NNTLKYTSNIEAPVQPRT

SEQ ID NO: 2768310 - protein, 4 aa, Entamoeba invadens
NNTN

SEQ ID NO: 2768311 - protein, 6 aa, Entamoeba invadens
NNTNGK

SEQ ID NO: 2768312 - protein, 6 aa, Entamoeba invadens
NNTNGN

SEQ ID NO: 2768313 - protein, 14 aa, Entamoeba invadens
NNTNHNGKIQVESG

SEQ ID NO: 2768314 - protein, 7 aa, Entamoeba invadens
NNTNINT

SEQ ID NO: 2768315 - protein, 7 aa, Entamoeba invadens
NNTNNDI

SEQ ID NO: 2768316 - protein, 6 aa, Entamoeba invadens
NNTNNV

SEQ ID NO: 2768317 - protein, 7 aa, Entamoeba invadens
NNTNYGY

SEQ ID NO: 2768318 - protein, 6 aa, Entamoeba invadens
NNTPDT

SEQ ID NO: 2768319 - protein, 9 aa, Entamoeba invadens
NNTQEGIKA

SEQ ID NO: 2768320 - protein, 16 aa, Entamoeba invadens
NNTQEGIKANNCKYTQ

SEQ ID NO: 2768321 - protein, 11 aa, Entamoeba invadens
NNTRKEKTMKP

SEQ ID NO: 2768322 - protein, 7 aa, Entamoeba invadens
NNTRTVD

SEQ ID NO: 2768323 - protein, 5 aa, Entamoeba invadens
NNTSY

SEQ ID NO: 2768324 - protein, 6 aa, Entamoeba invadens
NNTTEN

SEQ ID NO: 2768325 - protein, 6 aa, Entamoeba invadens
NNTTER

SEQ ID NO: 2768326 - protein, 5 aa, Entamoeba invadens
NNTTK

SEQ ID NO: 2768327 - protein, 7 aa, Entamoeba invadens
NNTTQNT

SEQ ID NO: 2768328 - protein, 7 aa, Entamoeba invadens
NNTVATA

SEQ ID NO: 2768329 - protein, 4 aa, Entamoeba invadens
NNVA

SEQ ID NO: 2768330 - protein, 21 aa, Entamoeba invadens
NNVGVGPTAMNDDGINGCGKQ

SEQ ID NO: 2768331 - protein, 7 aa, Entamoeba invadens
NNVINTK

SEQ ID NO: 2768332 - protein, 4 aa, Entamoeba invadens
NNVK

SEQ ID NO: 2768333 - protein, 8 aa, Entamoeba invadens
NNVNPNAT

SEQ ID NO: 2768334 - protein, 4 aa, Entamoeba invadens
NNVP

SEQ ID NO: 2768335 - protein, 10 aa, Entamoeba invadens
NNVQNTNEKI

SEQ ID NO: 2768336 - protein, 6 aa, Entamoeba invadens
NNVSAK

SEQ ID NO: 2768337 - protein, 19 aa, Entamoeba invadens
NNVSGTQKVATVGKDAFKN

SEQ ID NO: 2768338 - protein, 17 aa, Entamoeba invadens
NNVSSTQKVATVGKEAF

SEQ ID NO: 2768339 - protein, 14 aa, Entamoeba invadens
NNVTPGTEKDTDAL

SEQ ID NO: 2768340 - protein, 5 aa, Entamoeba invadens
NNVTT

SEQ ID NO: 2768341 - protein, 6 aa, Entamoeba invadens
NNWEPN

SEQ ID NO: 2768342 - protein, 8 aa, Entamoeba invadens
NNWERTDE

SEQ ID NO: 2768343 - protein, 6 aa, Entamoeba invadens
NNYCTE

SEQ ID NO: 2768344 - protein, 4 aa, Entamoeba invadens
NNYE

SEQ ID NO: 2768345 - protein, 8 aa, Entamoeba invadens
NNYELSDD

SEQ ID NO: 2768346 - protein, 8 aa, Entamoeba invadens
NNYGKDAS

SEQ ID NO: 2768347 - protein, 5 aa, Entamoeba invadens
NNYLD

SEQ ID NO: 2768348 - protein, 6 aa, Entamoeba invadens
NNYLDS

SEQ ID NO: 2768349 - protein, 5 aa, Entamoeba invadens
NNYLN

SEQ ID NO: 2768350 - protein, 11 aa, Entamoeba invadens
NNYPNVPQDKP

SEQ ID NO: 2768351 - protein, 7 aa, Entamoeba invadens
NNYSLGG

SEQ ID NO: 2768352 - protein, 8 aa, Entamoeba invadens
NNYSPSKK

SEQ ID NO: 2768353 - protein, 7 aa, Entamoeba invadens
NNYSSPS

SEQ ID NO: 2768354 - protein, 5 aa, Entamoeba invadens
NNYTQ

SEQ ID NO: 2768355 - protein, 4 aa, Entamoeba invadens
NNYV

SEQ ID NO: 2768356 - protein, 8 aa, Entamoeba invadens
NNYYTDGD

SEQ ID NO: 2768357 - protein, 7 aa, Entamoeba invadens
NPADPLI

SEQ ID NO: 2768358 - protein, 5 aa, Entamoeba invadens
NPAFQ

SEQ ID NO: 2768359 - protein, 6 aa, Entamoeba invadens
NPAGGR

SEQ ID NO: 2768360 - protein, 11 aa, Entamoeba invadens
NPANLDTTPGK

SEQ ID NO: 2768361 - protein, 5 aa, Entamoeba invadens
NPAPY

SEQ ID NO: 2768362 - protein, 5 aa, Entamoeba invadens
NPASV

SEQ ID NO: 2768363 - protein, 6 aa, Entamoeba invadens
NPAYTC

SEQ ID NO: 2768364 - protein, 43 aa, Entamoeba invadens
NPCTTGEESHSKTEESKSKDKSKEPTTPSVDKSEDNICKGKNG

SEQ ID NO: 2768365 - protein, 4 aa, Entamoeba invadens
NPDF

SEQ ID NO: 2768366 - protein, 7 aa, Entamoeba invadens
NPDHGSK

SEQ ID NO: 2768367 - protein, 8 aa, Entamoeba invadens
NPDIENMT

SEQ ID NO: 2768368 - protein, 7 aa, Entamoeba invadens
NPDKYPE

SEQ ID NO: 2768369 - protein, 9 aa, Entamoeba invadens
NPDLDTLPT

SEQ ID NO: 2768370 - protein, 11 aa, Entamoeba invadens
NPDNTETNTTI

SEQ ID NO: 2768371 - protein, 6 aa, Entamoeba invadens
NPDPNE

SEQ ID NO: 2768372 - protein, 11 aa, Entamoeba invadens
NPEAPPGDSDF

SEQ ID NO: 2768373 - protein, 7 aa, Entamoeba invadens
NPEDTSK

SEQ ID NO: 2768374 - protein, 8 aa, Entamoeba invadens
NPEDYGYS

SEQ ID NO: 2768375 - protein, 15 aa, Entamoeba invadens
NPEDYNKCTGLSNNG

SEQ ID NO: 2768376 - protein, 4 aa, Entamoeba invadens
NPEI

SEQ ID NO: 2768377 - protein, 7 aa, Entamoeba invadens
NPEQYTL

SEQ ID NO: 2768378 - protein, 8 aa, Entamoeba invadens
NPESTDHI

SEQ ID NO: 2768379 - protein, 5 aa, Entamoeba invadens
NPFDS

SEQ ID NO: 2768380 - protein, 8 aa, Entamoeba invadens
NPFEGTNY

SEQ ID NO: 2768381 - protein, 60 aa, Entamoeba invadens
NPFKRKDEEKAEKEDQVQKEIKEKKREEKKEKKEEKEREKKKKEELKSQKRNRKGSVEGR

SEQ ID NO: 2768382 - protein, 15 aa, Entamoeba invadens
NPGGDFGKRELSPAM

SEQ ID NO: 2768383 - protein, 10 aa, Entamoeba invadens
NPGPTGDKKV

SEQ ID NO: 2768384 - protein, 5 aa, Entamoeba invadens
NPGSC

SEQ ID NO: 2768385 - protein, 8 aa, Entamoeba invadens
NPGSPLHG

SEQ ID NO: 2768386 - protein, 7 aa, Entamoeba invadens
NPGYGGD

SEQ ID NO: 2768387 - protein, 7 aa, Entamoeba invadens
NPHDPIT

SEQ ID NO: 2768388 - protein, 5 aa, Entamoeba invadens
NPIEA

SEQ ID NO: 2768389 - protein, 4 aa, Entamoeba invadens
NPIG

SEQ ID NO: 2768390 - protein, 6 aa, Entamoeba invadens
NPIGNT

SEQ ID NO: 2768391 - protein, 9 aa, Entamoeba invadens
NPINETTEN

SEQ ID NO: 2768392 - protein, 4 aa, Entamoeba invadens
NPIS

SEQ ID NO: 2768393 - protein, 8 aa, Entamoeba invadens
NPKAYERL

SEQ ID NO: 2768394 - protein, 9 aa, Entamoeba invadens
NPKCTDDLP

SEQ ID NO: 2768395 - protein, 5 aa, Entamoeba invadens
NPKDD

SEQ ID NO: 2768396 - protein, 9 aa, Entamoeba invadens
NPKDGSYPG

SEQ ID NO: 2768397 - protein, 14 aa, Entamoeba invadens
NPKEQTKYSSSNYK

SEQ ID NO: 2768398 - protein, 14 aa, Entamoeba invadens
NPKERITATDVINF

SEQ ID NO: 2768399 - protein, 8 aa, Entamoeba invadens
NPKERLTA

SEQ ID NO: 2768400 - protein, 7 aa, Entamoeba invadens
NPKGNTN

SEQ ID NO: 2768401 - protein, 5 aa, Entamoeba invadens
NPKKQ

SEQ ID NO: 2768402 - protein, 10 aa, Entamoeba invadens
NPKMKEEFEG

SEQ ID NO: 2768403 - protein, 7 aa, Entamoeba invadens
NPKNDLQ

SEQ ID NO: 2768404 - protein, 5 aa, Entamoeba invadens
NPKNG

SEQ ID NO: 2768405 - protein, 7 aa, Entamoeba invadens
NPKRGTI

SEQ ID NO: 2768406 - protein, 11 aa, Entamoeba invadens
NPKRQTLKPSY

SEQ ID NO: 2768407 - protein, 9 aa, Entamoeba invadens
NPKSDKPES

SEQ ID NO: 2768408 - protein, 7 aa, Entamoeba invadens
NPKSKEC

SEQ ID NO: 2768409 - protein, 7 aa, Entamoeba invadens
NPKSKKC

SEQ ID NO: 2768410 - protein, 7 aa, Entamoeba invadens
NPKSRMG

SEQ ID NO: 2768411 - protein, 18 aa, Entamoeba invadens
NPKSRPQMEMLVDQLFKF

SEQ ID NO: 2768412 - protein, 20 aa, Entamoeba invadens
NPKTAECESCSSFDTNCKTC

SEQ ID NO: 2768413 - protein, 4 aa, Entamoeba invadens
NPLE

SEQ ID NO: 2768414 - protein, 21 aa, Entamoeba invadens
NPLPHEKGESYSTPERTGSPF

SEQ ID NO: 2768415 - protein, 9 aa, Entamoeba invadens
NPLTEEELS

SEQ ID NO: 2768416 - protein, 12 aa, Entamoeba invadens
NPLTKNDDYESD

SEQ ID NO: 2768417 - protein, 13 aa, Entamoeba invadens
NPMDPNDEESPHR

SEQ ID NO: 2768418 - protein, 7 aa, Entamoeba invadens
NPMNGEI

SEQ ID NO: 2768419 - protein, 5 aa, Entamoeba invadens
NPMQT

SEQ ID NO: 2768420 - protein, 6 aa, Entamoeba invadens
NPNDGV

SEQ ID NO: 2768421 - protein, 15 aa, Entamoeba invadens
NPNDRVTASTAATEM

SEQ ID NO: 2768422 - protein, 4 aa, Entamoeba invadens
NPNE

SEQ ID NO: 2768423 - protein, 5 aa, Entamoeba invadens
NPNEC

SEQ ID NO: 2768424 - protein, 6 aa, Entamoeba invadens
NPNGNT

SEQ ID NO: 2768425 - protein, 32 aa, Entamoeba invadens
NPNIDEKIEDQKSQPADNEESVESPIRVAEAS

SEQ ID NO: 2768426 - protein, 7 aa, Entamoeba invadens
NPNKDGC

SEQ ID NO: 2768427 - protein, 9 aa, Entamoeba invadens
NPNKYGKDM

SEQ ID NO: 2768428 - protein, 14 aa, Entamoeba invadens
NPNLAKSADSPPST

SEQ ID NO: 2768429 - protein, 8 aa, Entamoeba invadens
NPNNIETI

SEQ ID NO: 2768430 - protein, 42 aa, Entamoeba invadens
NPNNRAQKKAEAASAKKGETKKDKPKKSLAKERLADSKRELT

SEQ ID NO: 2768431 - protein, 17 aa, Entamoeba invadens
NPNRKPTPGNKCDGCNE

SEQ ID NO: 2768432 - protein, 18 aa, Entamoeba invadens
NPNSCIPGRCKGDAASGC

SEQ ID NO: 2768433 - protein, 11 aa, Entamoeba invadens
NPNSTESKNTV

SEQ ID NO: 2768434 - protein, 4 aa, Entamoeba invadens
NPNT

SEQ ID NO: 2768435 - protein, 6 aa, Entamoeba invadens
NPNTNV

SEQ ID NO: 2768436 - protein, 6 aa, Entamoeba invadens
NPNTPM

SEQ ID NO: 2768437 - protein, 11 aa, Entamoeba invadens
NPNTTSCKGTL

SEQ ID NO: 2768438 - protein, 6 aa, Entamoeba invadens
NPPGIA

SEQ ID NO: 2768439 - protein, 6 aa, Entamoeba invadens
NPPIAP

SEQ ID NO: 2768440 - protein, 18 aa, Entamoeba invadens
NPPIIPPPPQSPFPFSQT

SEQ ID NO: 2768441 - protein, 9 aa, Entamoeba invadens
NPPKKVPQS

SEQ ID NO: 2768442 - protein, 4 aa, Entamoeba invadens
NPPL

SEQ ID NO: 2768443 - protein, 11 aa, Entamoeba invadens
NPPLGPTHGGT

SEQ ID NO: 2768444 - protein, 6 aa, Entamoeba invadens
NPPPMA

SEQ ID NO: 2768445 - protein, 8 aa, Entamoeba invadens
NPPQPSFD

SEQ ID NO: 2768446 - protein, 5 aa, Entamoeba invadens
NPPRN

SEQ ID NO: 2768447 - protein, 6 aa, Entamoeba invadens
NPPRNL

SEQ ID NO: 2768448 - protein, 8 aa, Entamoeba invadens
NPPRVETG

SEQ ID NO: 2768449 - protein, 5 aa, Entamoeba invadens
NPPRY

SEQ ID NO: 2768450 - protein, 6 aa, Entamoeba invadens
NPPSEY

SEQ ID NO: 2768451 - protein, 8 aa, Entamoeba invadens
NPPSHSKT

SEQ ID NO: 2768452 - protein, 6 aa, Entamoeba invadens
NPPSLP

SEQ ID NO: 2768453 - protein, 6 aa, Entamoeba invadens
NPPSTT

SEQ ID NO: 2768454 - protein, 16 aa, Entamoeba invadens
NPPTDVGKKDLSPGIK

SEQ ID NO: 2768455 - protein, 7 aa, Entamoeba invadens
NPPTEEE

SEQ ID NO: 2768456 - protein, 6 aa, Entamoeba invadens
NPQDRY

SEQ ID NO: 2768457 - protein, 6 aa, Entamoeba invadens
NPQERI

SEQ ID NO: 2768458 - protein, 12 aa, Entamoeba invadens
NPQETPTNTQTQ

SEQ ID NO: 2768459 - protein, 4 aa, Entamoeba invadens
NPQK

SEQ ID NO: 2768460 - protein, 8 aa, Entamoeba invadens
NPQNPKKC

SEQ ID NO: 2768461 - protein, 5 aa, Entamoeba invadens
NPQNS

SEQ ID NO: 2768462 - protein, 6 aa, Entamoeba invadens
NPQQSV

SEQ ID NO: 2768463 - protein, 4 aa, Entamoeba invadens
NPQT

SEQ ID NO: 2768464 - protein, 5 aa, Entamoeba invadens
NPQTR

SEQ ID NO: 2768465 - protein, 6 aa, Entamoeba invadens
NPQTRP

SEQ ID NO: 2768466 - protein, 38 aa, Entamoeba invadens
NPRSEGGQTLCDSNKSKCQDFEKQPLKNGQKSDVEPPK

SEQ ID NO: 2768467 - protein, 6 aa, Entamoeba invadens
NPSCSK

SEQ ID NO: 2768468 - protein, 10 aa, Entamoeba invadens
NPSDNIGADA

SEQ ID NO: 2768469 - protein, 7 aa, Entamoeba invadens
NPSDPLK

SEQ ID NO: 2768470 - protein, 8 aa, Entamoeba invadens
NPSETYQY

SEQ ID NO: 2768471 - protein, 17 aa, Entamoeba invadens
NPSFPSSNGTNKKREIS

SEQ ID NO: 2768472 - protein, 7 aa, Entamoeba invadens
NPSLDSE

SEQ ID NO: 2768473 - protein, 15 aa, Entamoeba invadens
NPSLSRPRSATKTIG

SEQ ID NO: 2768474 - protein, 4 aa, Entamoeba invadens
NPSP

SEQ ID NO: 2768475 - protein, 8 aa, Entamoeba invadens
NPSQPGKH

SEQ ID NO: 2768476 - protein, 8 aa, Entamoeba invadens
NPSQSTAS

SEQ ID NO: 2768477 - protein, 6 aa, Entamoeba invadens
NPSRNR

SEQ ID NO: 2768478 - protein, 6 aa, Entamoeba invadens
NPSRTE

SEQ ID NO: 2768479 - protein, 9 aa, Entamoeba invadens
NPSSPSSCA

SEQ ID NO: 2768480 - protein, 5 aa, Entamoeba invadens
NPSSS

SEQ ID NO: 2768481 - protein, 16 aa, Entamoeba invadens
NPSSSPKDSPGKCTRC

SEQ ID NO: 2768482 - protein, 9 aa, Entamoeba invadens
NPSSTQSAT

SEQ ID NO: 2768483 - protein, 28 aa, Entamoeba invadens
NPSTLSSNKRCCGGNSGTALLGQPTYSL

SEQ ID NO: 2768484 - protein, 12 aa, Entamoeba invadens
NPTCDGNCNGTN

SEQ ID NO: 2768485 - protein, 8 aa, Entamoeba invadens
NPTDTSHL

SEQ ID NO: 2768486 - protein, 5 aa, Entamoeba invadens
NPTEE

SEQ ID NO: 2768487 - protein, 12 aa, Entamoeba invadens
NPTESSPDDGGV

SEQ ID NO: 2768488 - protein, 7 aa, Entamoeba invadens
NPTGNTN

SEQ ID NO: 2768489 - protein, 8 aa, Entamoeba invadens
NPTKDLQA

SEQ ID NO: 2768490 - protein, 6 aa, Entamoeba invadens
NPTKER

SEQ ID NO: 2768491 - protein, 6 aa, Entamoeba invadens
NPTPSI

SEQ ID NO: 2768492 - protein, 6 aa, Entamoeba invadens
NPTPSM

SEQ ID NO: 2768493 - protein, 4 aa, Entamoeba invadens
NPTR

SEQ ID NO: 2768494 - protein, 4 aa, Entamoeba invadens
NPTT

SEQ ID NO: 2768495 - protein, 6 aa, Entamoeba invadens
NPTTGI

SEQ ID NO: 2768496 - protein, 6 aa, Entamoeba invadens
NPTTNN

SEQ ID NO: 2768497 - protein, 8 aa, Entamoeba invadens
NPTTSKEC

SEQ ID NO: 2768498 - protein, 5 aa, Entamoeba invadens
NPTWD

SEQ ID NO: 2768499 - protein, 6 aa, Entamoeba invadens
NPTYDQ

SEQ ID NO: 2768500 - protein, 4 aa, Entamoeba invadens
NPVA

SEQ ID NO: 2768501 - protein, 5 aa, Entamoeba invadens
NPVER

SEQ ID NO: 2768502 - protein, 12 aa, Entamoeba invadens
NPVESPKPKQQS

SEQ ID NO: 2768503 - protein, 4 aa, Entamoeba invadens
NPVL

SEQ ID NO: 2768504 - protein, 4 aa, Entamoeba invadens
NPVS

SEQ ID NO: 2768505 - protein, 11 aa, Entamoeba invadens
NPVVNSEASQR

SEQ ID NO: 2768506 - protein, 5 aa, Entamoeba invadens
NPVYS

SEQ ID NO: 2768507 - protein, 5 aa, Entamoeba invadens
NPWGY

SEQ ID NO: 2768508 - protein, 6 aa, Entamoeba invadens
NPYDGN

SEQ ID NO: 2768509 - protein, 15 aa, Entamoeba invadens
NPYEKSDAEPPGRPS

SEQ ID NO: 2768510 - protein, 4 aa, Entamoeba invadens
NPYH

SEQ ID NO: 2768511 - protein, 6 aa, Entamoeba invadens
NPYPKE

SEQ ID NO: 2768512 - protein, 4 aa, Entamoeba invadens
NPYR

SEQ ID NO: 2768513 - protein, 7 aa, Entamoeba invadens
NPYSKDK

SEQ ID NO: 2768514 - protein, 9 aa, Entamoeba invadens
NQADCSRMS

SEQ ID NO: 2768515 - protein, 5 aa, Entamoeba invadens
NQCEK

SEQ ID NO: 2768516 - protein, 6 aa, Entamoeba invadens
NQCEKC

SEQ ID NO: 2768517 - protein, 10 aa, Entamoeba invadens
NQCELSSQLQ

SEQ ID NO: 2768518 - protein, 8 aa, Entamoeba invadens
NQCEPSTD

SEQ ID NO: 2768519 - protein, 7 aa, Entamoeba invadens
NQCGTSL

SEQ ID NO: 2768520 - protein, 5 aa, Entamoeba invadens
NQCKS

SEQ ID NO: 2768521 - protein, 13 aa, Entamoeba invadens
NQCNEDEMKEENN

SEQ ID NO: 2768522 - protein, 11 aa, Entamoeba invadens
NQCQKCDSNCK

SEQ ID NO: 2768523 - protein, 7 aa, Entamoeba invadens
NQCSDCK

SEQ ID NO: 2768524 - protein, 10 aa, Entamoeba invadens
NQCSSTDSSC

SEQ ID NO: 2768525 - protein, 19 aa, Entamoeba invadens
NQCTSYSDSNCTKCESGTI

SEQ ID NO: 2768526 - protein, 4 aa, Entamoeba invadens
NQCV

SEQ ID NO: 2768527 - protein, 9 aa, Entamoeba invadens
NQCVPSPTT

SEQ ID NO: 2768528 - protein, 10 aa, Entamoeba invadens
NQDDDCSTCS

SEQ ID NO: 2768529 - protein, 6 aa, Entamoeba invadens
NQDDDS

SEQ ID NO: 2768530 - protein, 5 aa, Entamoeba invadens
NQDDF

SEQ ID NO: 2768531 - protein, 5 aa, Entamoeba invadens
NQDGS

SEQ ID NO: 2768532 - protein, 33 aa, Entamoeba invadens
NQDSTDSKNSSVADISGKSQSSSRPRRPTQTSI

SEQ ID NO: 2768533 - protein, 9 aa, Entamoeba invadens
NQEDNCDRM

SEQ ID NO: 2768534 - protein, 14 aa, Entamoeba invadens
NQEENCDRMNEEQD

SEQ ID NO: 2768535 - protein, 14 aa, Entamoeba invadens
NQEENCDRMNKEQD

SEQ ID NO: 2768536 - protein, 5 aa, Entamoeba invadens
NQEKH

SEQ ID NO: 2768537 - protein, 16 aa, Entamoeba invadens
NQEKVNAKISDFGTAR

SEQ ID NO: 2768538 - protein, 31 aa, Entamoeba invadens
NQEMGKKEKDKFENDEDLEEDVVPDEKVENT

SEQ ID NO: 2768539 - protein, 15 aa, Entamoeba invadens
NQENDKLPTLEIPTS

SEQ ID NO: 2768540 - protein, 5 aa, Entamoeba invadens
NQEPI

SEQ ID NO: 2768541 - protein, 15 aa, Entamoeba invadens
NQETTDALKSDLSSK

SEQ ID NO: 2768542 - protein, 8 aa, Entamoeba invadens
NQFDPTND

SEQ ID NO: 2768543 - protein, 5 aa, Entamoeba invadens
NQFNP

SEQ ID NO: 2768544 - protein, 6 aa, Entamoeba invadens
NQFPTT

SEQ ID NO: 2768545 - protein, 5 aa, Entamoeba invadens
NQGET

SEQ ID NO: 2768546 - protein, 5 aa, Entamoeba invadens
NQGGF

SEQ ID NO: 2768547 - protein, 7 aa, Entamoeba invadens
NQGKSAI

SEQ ID NO: 2768548 - protein, 9 aa, Entamoeba invadens
NQGSLPSGI

SEQ ID NO: 2768549 - protein, 6 aa, Entamoeba invadens
NQHKRY

SEQ ID NO: 2768550 - protein, 5 aa, Entamoeba invadens
NQIDF

SEQ ID NO: 2768551 - protein, 4 aa, Entamoeba invadens
NQIG

SEQ ID NO: 2768552 - protein, 4 aa, Entamoeba invadens
NQII

SEQ ID NO: 2768553 - protein, 15 aa, Entamoeba invadens
NQITNSTAVNKTQEV

SEQ ID NO: 2768554 - protein, 6 aa, Entamoeba invadens
NQITPN

SEQ ID NO: 2768555 - protein, 5 aa, Entamoeba invadens
NQITS

SEQ ID NO: 2768556 - protein, 5 aa, Entamoeba invadens
NQIYN

SEQ ID NO: 2768557 - protein, 11 aa, Entamoeba invadens
NQKAESYINNP

SEQ ID NO: 2768558 - protein, 13 aa, Entamoeba invadens
NQKCVSKESAHCN

SEQ ID NO: 2768559 - protein, 5 aa, Entamoeba invadens
NQKEM

SEQ ID NO: 2768560 - protein, 35 aa, Entamoeba invadens
NQKESLEGFEDTERDFNGGTKQQKSEKNEGKQHKV

SEQ ID NO: 2768561 - protein, 7 aa, Entamoeba invadens
NQKKEEL

SEQ ID NO: 2768562 - protein, 8 aa, Entamoeba invadens
NQKKGPYS

SEQ ID NO: 2768563 - protein, 8 aa, Entamoeba invadens
NQKKRSRC

SEQ ID NO: 2768564 - protein, 10 aa, Entamoeba invadens
NQKQPAGTKA

SEQ ID NO: 2768565 - protein, 10 aa, Entamoeba invadens
NQKRKTQKHS

SEQ ID NO: 2768566 - protein, 4 aa, Entamoeba invadens
NQKS

SEQ ID NO: 2768567 - protein, 7 aa, Entamoeba invadens
NQKSRTC

SEQ ID NO: 2768568 - protein, 8 aa, Entamoeba invadens
NQKTPNKN

SEQ ID NO: 2768569 - protein, 4 aa, Entamoeba invadens
NQKY

SEQ ID NO: 2768570 - protein, 8 aa, Entamoeba invadens
NQKYPVVP

SEQ ID NO: 2768571 - protein, 10 aa, Entamoeba invadens
NQKYSIDQET

SEQ ID NO: 2768572 - protein, 7 aa, Entamoeba invadens
NQKYSYP

SEQ ID NO: 2768573 - protein, 15 aa, Entamoeba invadens
NQLQNAESKENGVDI

SEQ ID NO: 2768574 - protein, 26 aa, Entamoeba invadens
NQLQNTQQINYKSGNKTSLKLEENVQ

SEQ ID NO: 2768575 - protein, 17 aa, Entamoeba invadens
NQLQNTQQKNYKSGTKT

SEQ ID NO: 2768576 - protein, 38 aa, Entamoeba invadens
NQLQNTQQTNDINNNTKTTPKADQNDESNCIEKSSKGC

SEQ ID NO: 2768577 - protein, 7 aa, Entamoeba invadens
NQLSEED

SEQ ID NO: 2768578 - protein, 12 aa, Entamoeba invadens
NQLTDEKKKDDV

SEQ ID NO: 2768579 - protein, 7 aa, Entamoeba invadens
NQNAADY

SEQ ID NO: 2768580 - protein, 9 aa, Entamoeba invadens
NQNDRPTIN

SEQ ID NO: 2768581 - protein, 33 aa, Entamoeba invadens
NQNEASSPSSENSPTSSDGSPHGEMKNKEKGQI

SEQ ID NO: 2768582 - protein, 6 aa, Entamoeba invadens
NQNFEP

SEQ ID NO: 2768583 - protein, 5 aa, Entamoeba invadens
NQNFT

SEQ ID NO: 2768584 - protein, 4 aa, Entamoeba invadens
NQNI

SEQ ID NO: 2768585 - protein, 19 aa, Entamoeba invadens
NQNPKAGLITDSEKKASEM

SEQ ID NO: 2768586 - protein, 8 aa, Entamoeba invadens
NQNQFTNS

SEQ ID NO: 2768587 - protein, 6 aa, Entamoeba invadens
NQNSDV

SEQ ID NO: 2768588 - protein, 9 aa, Entamoeba invadens
NQNSSTNTF

SEQ ID NO: 2768589 - protein, 10 aa, Entamoeba invadens
NQNSSTNTYS

SEQ ID NO: 2768590 - protein, 4 aa, Entamoeba invadens
NQNT

SEQ ID NO: 2768591 - protein, 8 aa, Entamoeba invadens
NQNTDHPK

SEQ ID NO: 2768592 - protein, 15 aa, Entamoeba invadens
NQNTDKNSKAPQFLL

SEQ ID NO: 2768593 - protein, 6 aa, Entamoeba invadens
NQNTVS

SEQ ID NO: 2768594 - protein, 8 aa, Entamoeba invadens
NQNYEETM

SEQ ID NO: 2768595 - protein, 5 aa, Entamoeba invadens
NQPKL

SEQ ID NO: 2768596 - protein, 9 aa, Entamoeba invadens
NQPQNSDKS

SEQ ID NO: 2768597 - protein, 5 aa, Entamoeba invadens
NQPSL

SEQ ID NO: 2768598 - protein, 16 aa, Entamoeba invadens
NQPVDSRAKPKRSFGA

SEQ ID NO: 2768599 - protein, 6 aa, Entamoeba invadens
NQQDEG

SEQ ID NO: 2768600 - protein, 10 aa, Entamoeba invadens
NQQDKNGNTP

SEQ ID NO: 2768601 - protein, 7 aa, Entamoeba invadens
NQQHDTC

SEQ ID NO: 2768602 - protein, 4 aa, Entamoeba invadens
NQQI

SEQ ID NO: 2768603 - protein, 6 aa, Entamoeba invadens
NQQLDS

SEQ ID NO: 2768604 - protein, 4 aa, Entamoeba invadens
NQQN

SEQ ID NO: 2768605 - protein, 10 aa, Entamoeba invadens
NQQPKALTKI

SEQ ID NO: 2768606 - protein, 28 aa, Entamoeba invadens
NQQYNRTNCDACPSGSFSSSEGSSQCTG

SEQ ID NO: 2768607 - protein, 8 aa, Entamoeba invadens
NQRECTSC

SEQ ID NO: 2768608 - protein, 20 aa, Entamoeba invadens
NQRGLKDNCNKYDTDGYCSE

SEQ ID NO: 2768609 - protein, 4 aa, Entamoeba invadens
NQRQ

SEQ ID NO: 2768610 - protein, 9 aa, Entamoeba invadens
NQRTTQPAL

SEQ ID NO: 2768611 - protein, 6 aa, Entamoeba invadens
NQSATG

SEQ ID NO: 2768612 - protein, 10 aa, Entamoeba invadens
NQSDRTQQLN

SEQ ID NO: 2768613 - protein, 12 aa, Entamoeba invadens
NQSEGFKSENGL

SEQ ID NO: 2768614 - protein, 19 aa, Entamoeba invadens
NQSEGFRSENGVNCDQNTQ

SEQ ID NO: 2768615 - protein, 7 aa, Entamoeba invadens
NQSKRNM

SEQ ID NO: 2768616 - protein, 4 aa, Entamoeba invadens
NQSN

SEQ ID NO: 2768617 - protein, 14 aa, Entamoeba invadens
NQSNLDIGTRPDHI

SEQ ID NO: 2768618 - protein, 14 aa, Entamoeba invadens
NQSNLDVGTTENHI

SEQ ID NO: 2768619 - protein, 14 aa, Entamoeba invadens
NQSPQTTDEADTTS

SEQ ID NO: 2768620 - protein, 6 aa, Entamoeba invadens
NQSSDV

SEQ ID NO: 2768621 - protein, 4 aa, Entamoeba invadens
NQST

SEQ ID NO: 2768622 - protein, 5 aa, Entamoeba invadens
NQSTI

SEQ ID NO: 2768623 - protein, 5 aa, Entamoeba invadens
NQTDN

SEQ ID NO: 2768624 - protein, 8 aa, Entamoeba invadens
NQTEDASC

SEQ ID NO: 2768625 - protein, 6 aa, Entamoeba invadens
NQTKLT

SEQ ID NO: 2768626 - protein, 8 aa, Entamoeba invadens
NQTKNVSK

SEQ ID NO: 2768627 - protein, 6 aa, Entamoeba invadens
NQTNPV

SEQ ID NO: 2768628 - protein, 19 aa, Entamoeba invadens
NQTRTRRVYSGNKNNIENI

SEQ ID NO: 2768629 - protein, 8 aa, Entamoeba invadens
NQTTFTEN

SEQ ID NO: 2768630 - protein, 5 aa, Entamoeba invadens
NQTTV

SEQ ID NO: 2768631 - protein, 15 aa, Entamoeba invadens
NQVATDEENKKQIKL

SEQ ID NO: 2768632 - protein, 5 aa, Entamoeba invadens
NQVDA

SEQ ID NO: 2768633 - protein, 37 aa, Entamoeba invadens
NQVDTKKQVHATPQINEESDVSPEQFKDDNDSVTTFT

SEQ ID NO: 2768634 - protein, 10 aa, Entamoeba invadens
NQVDTTDQRI

SEQ ID NO: 2768635 - protein, 15 aa, Entamoeba invadens
NQVGLSEQQKTEFAG

SEQ ID NO: 2768636 - protein, 5 aa, Entamoeba invadens
NQVKN

SEQ ID NO: 2768637 - protein, 13 aa, Entamoeba invadens
NQYDSSETNFTND

SEQ ID NO: 2768638 - protein, 11 aa, Entamoeba invadens
NQYNTDEEQQR

SEQ ID NO: 2768639 - protein, 7 aa, Entamoeba invadens
NQYSSST

SEQ ID NO: 2768640 - protein, 16 aa, Entamoeba invadens
NRANQDTQMKEDAPQT

SEQ ID NO: 2768641 - protein, 10 aa, Entamoeba invadens
NRCSSETKKC

SEQ ID NO: 2768642 - protein, 7 aa, Entamoeba invadens
NRCTSCD

SEQ ID NO: 2768643 - protein, 5 aa, Entamoeba invadens
NRCVE

SEQ ID NO: 2768644 - protein, 7 aa, Entamoeba invadens
NRDGMLN

SEQ ID NO: 2768645 - protein, 5 aa, Entamoeba invadens
NRDGN

SEQ ID NO: 2768646 - protein, 6 aa, Entamoeba invadens
NRDGVS

SEQ ID NO: 2768647 - protein, 4 aa, Entamoeba invadens
NRDI

SEQ ID NO: 2768648 - protein, 15 aa, Entamoeba invadens
NRDKDCQKLSDKEIE

SEQ ID NO: 2768649 - protein, 7 aa, Entamoeba invadens
NRDKEEI

SEQ ID NO: 2768650 - protein, 16 aa, Entamoeba invadens
NRDQRMRKQLEEISKD

SEQ ID NO: 2768651 - protein, 5 aa, Entamoeba invadens
NRDTL

SEQ ID NO: 2768652 - protein, 13 aa, Entamoeba invadens
NREDRGDDSLTGD

SEQ ID NO: 2768653 - protein, 7 aa, Entamoeba invadens
NREEGKN

SEQ ID NO: 2768654 - protein, 7 aa, Entamoeba invadens
NREGVRG

SEQ ID NO: 2768655 - protein, 6 aa, Entamoeba invadens
NRESDT

SEQ ID NO: 2768656 - protein, 9 aa, Entamoeba invadens
NRESVDREK

SEQ ID NO: 2768657 - protein, 6 aa, Entamoeba invadens
NRESYL

SEQ ID NO: 2768658 - protein, 16 aa, Entamoeba invadens
NRETAINNNETVARSP

SEQ ID NO: 2768659 - protein, 7 aa, Entamoeba invadens
NRETKRN

SEQ ID NO: 2768660 - protein, 5 aa, Entamoeba invadens
NRETR

SEQ ID NO: 2768661 - protein, 6 aa, Entamoeba invadens
NREYYS

SEQ ID NO: 2768662 - protein, 9 aa, Entamoeba invadens
NRFSKPRNL

SEQ ID NO: 2768663 - protein, 4 aa, Entamoeba invadens
NRFT

SEQ ID NO: 2768664 - protein, 7 aa, Entamoeba invadens
NRGCNTC

SEQ ID NO: 2768665 - protein, 19 aa, Entamoeba invadens
NRGNVKIRGTNEVSPHGIP

SEQ ID NO: 2768666 - protein, 4 aa, Entamoeba invadens
NRHR

SEQ ID NO: 2768667 - protein, 5 aa, Entamoeba invadens
NRHTT

SEQ ID NO: 2768668 - protein, 5 aa, Entamoeba invadens
NRINK

SEQ ID NO: 2768669 - protein, 21 aa, Entamoeba invadens
NRISSVKKAKEKGFDREDEKK

SEQ ID NO: 2768670 - protein, 26 aa, Entamoeba invadens
NRKIAGKSECDNQARLSQEPTSSSID

SEQ ID NO: 2768671 - protein, 10 aa, Entamoeba invadens
NRKKSPITNK

SEQ ID NO: 2768672 - protein, 7 aa, Entamoeba invadens
NRKLQTD

SEQ ID NO: 2768673 - protein, 10 aa, Entamoeba invadens
NRKLSGSCSK

SEQ ID NO: 2768674 - protein, 10 aa, Entamoeba invadens
NRKSVTGKRF

SEQ ID NO: 2768675 - protein, 13 aa, Entamoeba invadens
NRKTSSSRSVTNN

SEQ ID NO: 2768676 - protein, 6 aa, Entamoeba invadens
NRLPIP

SEQ ID NO: 2768677 - protein, 11 aa, Entamoeba invadens
NRLPKPDGIPE

SEQ ID NO: 2768678 - protein, 6 aa, Entamoeba invadens
NRLPRI

SEQ ID NO: 2768679 - protein, 4 aa, Entamoeba invadens
NRMD

SEQ ID NO: 2768680 - protein, 6 aa, Entamoeba invadens
NRNASE

SEQ ID NO: 2768681 - protein, 8 aa, Entamoeba invadens
NRNGEGAM

SEQ ID NO: 2768682 - protein, 5 aa, Entamoeba invadens
NRNKG

SEQ ID NO: 2768683 - protein, 8 aa, Entamoeba invadens
NRNKKCDK

SEQ ID NO: 2768684 - protein, 10 aa, Entamoeba invadens
NRNKKCEKCK

SEQ ID NO: 2768685 - protein, 9 aa, Entamoeba invadens
NRNKKFDKH

SEQ ID NO: 2768686 - protein, 12 aa, Entamoeba invadens
NRNKTIKLPDGK

SEQ ID NO: 2768687 - protein, 9 aa, Entamoeba invadens
NRNNNTCVS

SEQ ID NO: 2768688 - protein, 6 aa, Entamoeba invadens
NRNQEE

SEQ ID NO: 2768689 - protein, 4 aa, Entamoeba invadens
NRNT

SEQ ID NO: 2768690 - protein, 9 aa, Entamoeba invadens
NRNTNKVSH

SEQ ID NO: 2768691 - protein, 5 aa, Entamoeba invadens
NRNTT

SEQ ID NO: 2768692 - protein, 6 aa, Entamoeba invadens
NRNYNG

SEQ ID NO: 2768693 - protein, 7 aa, Entamoeba invadens
NRPEETQ

SEQ ID NO: 2768694 - protein, 8 aa, Entamoeba invadens
NRPENVKE

SEQ ID NO: 2768695 - protein, 11 aa, Entamoeba invadens
NRPETNSTLER

SEQ ID NO: 2768696 - protein, 8 aa, Entamoeba invadens
NRPFEGKE

SEQ ID NO: 2768697 - protein, 11 aa, Entamoeba invadens
NRPKPSAQQNI

SEQ ID NO: 2768698 - protein, 6 aa, Entamoeba invadens
NRPQGA

SEQ ID NO: 2768699 - protein, 7 aa, Entamoeba invadens
NRPYDTF

SEQ ID NO: 2768700 - protein, 5 aa, Entamoeba invadens
NRQKS

SEQ ID NO: 2768701 - protein, 6 aa, Entamoeba invadens
NRQQEV

SEQ ID NO: 2768702 - protein, 14 aa, Entamoeba invadens
NRRARKNTVNGLGR

SEQ ID NO: 2768703 - protein, 6 aa, Entamoeba invadens
NRRDET

SEQ ID NO: 2768704 - protein, 6 aa, Entamoeba invadens
NRRTKD

SEQ ID NO: 2768705 - protein, 9 aa, Entamoeba invadens
NRSAGDDFS

SEQ ID NO: 2768706 - protein, 42 aa, Entamoeba invadens
NRSASIATKADSFESGPKRKRRHNTTKDTVSPMEKKPEKPAV

SEQ ID NO: 2768707 - protein, 6 aa, Entamoeba invadens
NRSCES

SEQ ID NO: 2768708 - protein, 15 aa, Entamoeba invadens
NRSDETSTSAVQEPF

SEQ ID NO: 2768709 - protein, 16 aa, Entamoeba invadens
NRSKKKLKYRVEPPET

SEQ ID NO: 2768710 - protein, 7 aa, Entamoeba invadens
NRSKNRL

SEQ ID NO: 2768711 - protein, 7 aa, Entamoeba invadens
NRSPTNK

SEQ ID NO: 2768712 - protein, 4 aa, Entamoeba invadens
NRSR

SEQ ID NO: 2768713 - protein, 5 aa, Entamoeba invadens
NRSRN

SEQ ID NO: 2768714 - protein, 9 aa, Entamoeba invadens
NRSSDDESY

SEQ ID NO: 2768715 - protein, 5 aa, Entamoeba invadens
NRSSM

SEQ ID NO: 2768716 - protein, 4 aa, Entamoeba invadens
NRST

SEQ ID NO: 2768717 - protein, 11 aa, Entamoeba invadens
NRSTEKQNKIL

SEQ ID NO: 2768718 - protein, 7 aa, Entamoeba invadens
NRSTIQT

SEQ ID NO: 2768719 - protein, 5 aa, Entamoeba invadens
NRSTK

SEQ ID NO: 2768720 - protein, 4 aa, Entamoeba invadens
NRSV

SEQ ID NO: 2768721 - protein, 17 aa, Entamoeba invadens
NRSVEMRNGVDKEKTQL

SEQ ID NO: 2768722 - protein, 8 aa, Entamoeba invadens
NRTDDGNE

SEQ ID NO: 2768723 - protein, 5 aa, Entamoeba invadens
NRTDR

SEQ ID NO: 2768724 - protein, 6 aa, Entamoeba invadens
NRTGDM

SEQ ID NO: 2768725 - protein, 15 aa, Entamoeba invadens
NRTGTVKMSSPRRPQ

SEQ ID NO: 2768726 - protein, 19 aa, Entamoeba invadens
NRTIGSNVSQCTKVDNSKC

SEQ ID NO: 2768727 - protein, 9 aa, Entamoeba invadens
NRTLSKSGM

SEQ ID NO: 2768728 - protein, 15 aa, Entamoeba invadens
NRTNRLKKQLSENNA

SEQ ID NO: 2768729 - protein, 10 aa, Entamoeba invadens
NRTPQDAKKN

SEQ ID NO: 2768730 - protein, 12 aa, Entamoeba invadens
NRTSKSVKHITG

SEQ ID NO: 2768731 - protein, 9 aa, Entamoeba invadens
NRVKKPEHI

SEQ ID NO: 2768732 - protein, 7 aa, Entamoeba invadens
NRVPSSA

SEQ ID NO: 2768733 - protein, 6 aa, Entamoeba invadens
NRVTPS

SEQ ID NO: 2768734 - protein, 9 aa, Entamoeba invadens
NRYGAQNTK

SEQ ID NO: 2768735 - protein, 9 aa, Entamoeba invadens
NRYKNSENP

SEQ ID NO: 2768736 - protein, 5 aa, Entamoeba invadens
NRYRD

SEQ ID NO: 2768737 - protein, 4 aa, Entamoeba invadens
NRYS

SEQ ID NO: 2768738 - protein, 21 aa, Entamoeba invadens
NSADDTKVEKQQVVADSGEKV

SEQ ID NO: 2768739 - protein, 10 aa, Entamoeba invadens
NSAEDESDLV

SEQ ID NO: 2768740 - protein, 8 aa, Entamoeba invadens
NSAFEGAT

SEQ ID NO: 2768741 - protein, 9 aa, Entamoeba invadens
NSAGIEDTG

SEQ ID NO: 2768742 - protein, 8 aa, Entamoeba invadens
NSAHTARN

SEQ ID NO: 2768743 - protein, 11 aa, Entamoeba invadens
NSAKCSQTNGI

SEQ ID NO: 2768744 - protein, 6 aa, Entamoeba invadens
NSANAV

SEQ ID NO: 2768745 - protein, 8 aa, Entamoeba invadens
NSANPEEN

SEQ ID NO: 2768746 - protein, 4 aa, Entamoeba invadens
NSAP

SEQ ID NO: 2768747 - protein, 7 aa, Entamoeba invadens
NSAQESQ

SEQ ID NO: 2768748 - protein, 9 aa, Entamoeba invadens
NSASPMNVN

SEQ ID NO: 2768749 - protein, 9 aa, Entamoeba invadens
NSATDTEGH

SEQ ID NO: 2768750 - protein, 5 aa, Entamoeba invadens
NSATF

SEQ ID NO: 2768751 - protein, 9 aa, Entamoeba invadens
NSATKNIKP

SEQ ID NO: 2768752 - protein, 11 aa, Entamoeba invadens
NSATSDTLSNS

SEQ ID NO: 2768753 - protein, 6 aa, Entamoeba invadens
NSAVEE

SEQ ID NO: 2768754 - protein, 8 aa, Entamoeba invadens
NSCDPSSG

SEQ ID NO: 2768755 - protein, 9 aa, Entamoeba invadens
NSCDQSSGI

SEQ ID NO: 2768756 - protein, 11 aa, Entamoeba invadens
NSCEKADEHAT

SEQ ID NO: 2768757 - protein, 6 aa, Entamoeba invadens
NSCEKC

SEQ ID NO: 2768758 - protein, 7 aa, Entamoeba invadens
NSCEKCS

SEQ ID NO: 2768759 - protein, 10 aa, Entamoeba invadens
NSCEKESGYC

SEQ ID NO: 2768760 - protein, 6 aa, Entamoeba invadens
NSCKTC

SEQ ID NO: 2768761 - protein, 6 aa, Entamoeba invadens
NSCNEH

SEQ ID NO: 2768762 - protein, 20 aa, Entamoeba invadens
NSCNKCTNGCSACTNANTCT

SEQ ID NO: 2768763 - protein, 6 aa, Entamoeba invadens
NSCNST

SEQ ID NO: 2768764 - protein, 9 aa, Entamoeba invadens
NSCQQDNIN

SEQ ID NO: 2768765 - protein, 7 aa, Entamoeba invadens
NSCQTKG

SEQ ID NO: 2768766 - protein, 7 aa, Entamoeba invadens
NSCSEDG

SEQ ID NO: 2768767 - protein, 8 aa, Entamoeba invadens
NSCSNKYE

SEQ ID NO: 2768768 - protein, 9 aa, Entamoeba invadens
NSCSSCNIT

SEQ ID NO: 2768769 - protein, 13 aa, Entamoeba invadens
NSCSSSSSSSCKT

SEQ ID NO: 2768770 - protein, 15 aa, Entamoeba invadens
NSCTECSPGTYKNPE

SEQ ID NO: 2768771 - protein, 23 aa, Entamoeba invadens
NSCTKCKNGCSTCTDATTCSECT

SEQ ID NO: 2768772 - protein, 22 aa, Entamoeba invadens
NSCTKCTNGCTTCSAANTCSAC

SEQ ID NO: 2768773 - protein, 5 aa, Entamoeba invadens
NSCTP

SEQ ID NO: 2768774 - protein, 7 aa, Entamoeba invadens
NSCTSCD

SEQ ID NO: 2768775 - protein, 41 aa, Entamoeba invadens
NSCTSSEPNKCTSCKGTNKLSVDKTKCRATCPSGQTASNNN

SEQ ID NO: 2768776 - protein, 11 aa, Entamoeba invadens
NSDCKDNLTNC

SEQ ID NO: 2768777 - protein, 11 aa, Entamoeba invadens
NSDCKEKLTNC

SEQ ID NO: 2768778 - protein, 24 aa, Entamoeba invadens
NSDCSGTVSGAVDTSSGRTLNPPS

SEQ ID NO: 2768779 - protein, 13 aa, Entamoeba invadens
NSDDEKSSKSDEL

SEQ ID NO: 2768780 - protein, 11 aa, Entamoeba invadens
NSDGAERLEPI

SEQ ID NO: 2768781 - protein, 6 aa, Entamoeba invadens
NSDGCK

SEQ ID NO: 2768782 - protein, 35 aa, Entamoeba invadens
NSDIDNSSADVPSTPTEKGENKSETSESENKYSID

SEQ ID NO: 2768783 - protein, 6 aa, Entamoeba invadens
NSDKTL

SEQ ID NO: 2768784 - protein, 5 aa, Entamoeba invadens
NSDLL

SEQ ID NO: 2768785 - protein, 13 aa, Entamoeba invadens
NSDNNDNRLNTTD

SEQ ID NO: 2768786 - protein, 10 aa, Entamoeba invadens
NSDSDTTLND

SEQ ID NO: 2768787 - protein, 7 aa, Entamoeba invadens
NSDSTVN

SEQ ID NO: 2768788 - protein, 4 aa, Entamoeba invadens
NSDT

SEQ ID NO: 2768789 - protein, 6 aa, Entamoeba invadens
NSDTCT

SEQ ID NO: 2768790 - protein, 14 aa, Entamoeba invadens
NSDTEQIEVNKETR

SEQ ID NO: 2768791 - protein, 8 aa, Entamoeba invadens
NSDTPRQC

SEQ ID NO: 2768792 - protein, 6 aa, Entamoeba invadens
NSDTTV

SEQ ID NO: 2768793 - protein, 9 aa, Entamoeba invadens
NSDVNSETC

SEQ ID NO: 2768794 - protein, 8 aa, Entamoeba invadens
NSECQPCA

SEQ ID NO: 2768795 - protein, 14 aa, Entamoeba invadens
NSEDGDQFKNPKDY

SEQ ID NO: 2768796 - protein, 12 aa, Entamoeba invadens
NSEDGPLSEPYG

SEQ ID NO: 2768797 - protein, 9 aa, Entamoeba invadens
NSEEGPVNV

SEQ ID NO: 2768798 - protein, 13 aa, Entamoeba invadens
NSEEKNGDKHKKT

SEQ ID NO: 2768799 - protein, 7 aa, Entamoeba invadens
NSEERTM

SEQ ID NO: 2768800 - protein, 5 aa, Entamoeba invadens
NSEGC

SEQ ID NO: 2768801 - protein, 7 aa, Entamoeba invadens
NSEGCHE

SEQ ID NO: 2768802 - protein, 7 aa, Entamoeba invadens
NSEGQIE

SEQ ID NO: 2768803 - protein, 5 aa, Entamoeba invadens
NSEIQ

SEQ ID NO: 2768804 - protein, 5 aa, Entamoeba invadens
NSEIT

SEQ ID NO: 2768805 - protein, 5 aa, Entamoeba invadens
NSEKI

SEQ ID NO: 2768806 - protein, 9 aa, Entamoeba invadens
NSEKLEREL

SEQ ID NO: 2768807 - protein, 19 aa, Entamoeba invadens
NSEKVETEENEDEKKQIVD

SEQ ID NO: 2768808 - protein, 6 aa, Entamoeba invadens
NSENGT

SEQ ID NO: 2768809 - protein, 6 aa, Entamoeba invadens
NSENYD

SEQ ID NO: 2768810 - protein, 12 aa, Entamoeba invadens
NSEQEKRQFEKT

SEQ ID NO: 2768811 - protein, 6 aa, Entamoeba invadens
NSEQTE

SEQ ID NO: 2768812 - protein, 7 aa, Entamoeba invadens
NSERHEG

SEQ ID NO: 2768813 - protein, 7 aa, Entamoeba invadens
NSETDEI

SEQ ID NO: 2768814 - protein, 6 aa, Entamoeba invadens
NSETDY

SEQ ID NO: 2768815 - protein, 16 aa, Entamoeba invadens
NSETESFSEFSHMENL

SEQ ID NO: 2768816 - protein, 6 aa, Entamoeba invadens
NSETGC

SEQ ID NO: 2768817 - protein, 7 aa, Entamoeba invadens
NSETNDC

SEQ ID NO: 2768818 - protein, 12 aa, Entamoeba invadens
NSETVCSESATI

SEQ ID NO: 2768819 - protein, 13 aa, Entamoeba invadens
NSETVCSKSATIN

SEQ ID NO: 2768820 - protein, 17 aa, Entamoeba invadens
NSFESETAKDCISDSAT

SEQ ID NO: 2768821 - protein, 14 aa, Entamoeba invadens
NSFKEEECDSGVNC

SEQ ID NO: 2768822 - protein, 6 aa, Entamoeba invadens
NSFKNE

SEQ ID NO: 2768823 - protein, 5 aa, Entamoeba invadens
NSFNE

SEQ ID NO: 2768824 - protein, 5 aa, Entamoeba invadens
NSFNT

SEQ ID NO: 2768825 - protein, 5 aa, Entamoeba invadens
NSFRP

SEQ ID NO: 2768826 - protein, 4 aa, Entamoeba invadens
NSFT

SEQ ID NO: 2768827 - protein, 5 aa, Entamoeba invadens
NSGAN

SEQ ID NO: 2768828 - protein, 22 aa, Entamoeba invadens
NSGCSSCASQNCQTCSSSNGTC

SEQ ID NO: 2768829 - protein, 8 aa, Entamoeba invadens
NSGEIEET

SEQ ID NO: 2768830 - protein, 7 aa, Entamoeba invadens
NSGELTT

SEQ ID NO: 2768831 - protein, 6 aa, Entamoeba invadens
NSGGNC

SEQ ID NO: 2768832 - protein, 6 aa, Entamoeba invadens
NSGKGQ

SEQ ID NO: 2768833 - protein, 8 aa, Entamoeba invadens
NSGKHKVK

SEQ ID NO: 2768834 - protein, 9 aa, Entamoeba invadens
NSGKQNTTL

SEQ ID NO: 2768835 - protein, 9 aa, Entamoeba invadens
NSGKQQATT

SEQ ID NO: 2768836 - protein, 6 aa, Entamoeba invadens
NSGNEK

SEQ ID NO: 2768837 - protein, 6 aa, Entamoeba invadens
NSGPDA

SEQ ID NO: 2768838 - protein, 6 aa, Entamoeba invadens
NSGPKL

SEQ ID NO: 2768839 - protein, 7 aa, Entamoeba invadens
NSGSNDC

SEQ ID NO: 2768840 - protein, 6 aa, Entamoeba invadens
NSGTKV

SEQ ID NO: 2768841 - protein, 6 aa, Entamoeba invadens
NSGTLT

SEQ ID NO: 2768842 - protein, 32 aa, Entamoeba invadens
NSGTTANQTTNNCDTCKEGTYAGEGSSECKNC

SEQ ID NO: 2768843 - protein, 15 aa, Entamoeba invadens
NSGVYKQQVGENKEK

SEQ ID NO: 2768844 - protein, 16 aa, Entamoeba invadens
NSHEEESEDVTDNGLG

SEQ ID NO: 2768845 - protein, 10 aa, Entamoeba invadens
NSHGLKAETT

SEQ ID NO: 2768846 - protein, 7 aa, Entamoeba invadens
NSHKEPP

SEQ ID NO: 2768847 - protein, 6 aa, Entamoeba invadens
NSHNPI

SEQ ID NO: 2768848 - protein, 10 aa, Entamoeba invadens
NSHQKSGNKI

SEQ ID NO: 2768849 - protein, 5 aa, Entamoeba invadens
NSHSR

SEQ ID NO: 2768850 - protein, 4 aa, Entamoeba invadens
NSID

SEQ ID NO: 2768851 - protein, 5 aa, Entamoeba invadens
NSIDG

SEQ ID NO: 2768852 - protein, 11 aa, Entamoeba invadens
NSIDKKLSKEV

SEQ ID NO: 2768853 - protein, 7 aa, Entamoeba invadens
NSIDPNC

SEQ ID NO: 2768854 - protein, 12 aa, Entamoeba invadens
NSIDTPPDNDNS

SEQ ID NO: 2768855 - protein, 4 aa, Entamoeba invadens
NSIE

SEQ ID NO: 2768856 - protein, 9 aa, Entamoeba invadens
NSIENTNTI

SEQ ID NO: 2768857 - protein, 6 aa, Entamoeba invadens
NSIENV

SEQ ID NO: 2768858 - protein, 18 aa, Entamoeba invadens
NSINSELDNPQDRYERSE

SEQ ID NO: 2768859 - protein, 10 aa, Entamoeba invadens
NSINTAIDNN

SEQ ID NO: 2768860 - protein, 11 aa, Entamoeba invadens
NSIPKITREGV

SEQ ID NO: 2768861 - protein, 30 aa, Entamoeba invadens
NSIQKSTEKSKEPETPSVESPSEDDICKGK

SEQ ID NO: 2768862 - protein, 8 aa, Entamoeba invadens
NSIQNQTL

SEQ ID NO: 2768863 - protein, 11 aa, Entamoeba invadens
NSIQRKYTQNE

SEQ ID NO: 2768864 - protein, 20 aa, Entamoeba invadens
NSISGDETTVGGEPPKSKMN

SEQ ID NO: 2768865 - protein, 7 aa, Entamoeba invadens
NSISGGE

SEQ ID NO: 2768866 - protein, 11 aa, Entamoeba invadens
NSISNTGSCSG

SEQ ID NO: 2768867 - protein, 4 aa, Entamoeba invadens
NSIT

SEQ ID NO: 2768868 - protein, 5 aa, Entamoeba invadens
NSITE

SEQ ID NO: 2768869 - protein, 5 aa, Entamoeba invadens
NSITK

SEQ ID NO: 2768870 - protein, 4 aa, Entamoeba invadens
NSIY

SEQ ID NO: 2768871 - protein, 5 aa, Entamoeba invadens
NSKCE

SEQ ID NO: 2768872 - protein, 5 aa, Entamoeba invadens
NSKCT

SEQ ID NO: 2768873 - protein, 5 aa, Entamoeba invadens
NSKCV

SEQ ID NO: 2768874 - protein, 5 aa, Entamoeba invadens
NSKDL

SEQ ID NO: 2768875 - protein, 10 aa, Entamoeba invadens
NSKEDNTNCE

SEQ ID NO: 2768876 - protein, 7 aa, Entamoeba invadens
NSKEGGI

SEQ ID NO: 2768877 - protein, 15 aa, Entamoeba invadens
NSKEKQLKIADSGCS

SEQ ID NO: 2768878 - protein, 9 aa, Entamoeba invadens
NSKEKVDLN

SEQ ID NO: 2768879 - protein, 6 aa, Entamoeba invadens
NSKERA

SEQ ID NO: 2768880 - protein, 7 aa, Entamoeba invadens
NSKERIE

SEQ ID NO: 2768881 - protein, 8 aa, Entamoeba invadens
NSKFTTTS

SEQ ID NO: 2768882 - protein, 14 aa, Entamoeba invadens
NSKGSCESVNSSRC

SEQ ID NO: 2768883 - protein, 6 aa, Entamoeba invadens
NSKHNV

SEQ ID NO: 2768884 - protein, 9 aa, Entamoeba invadens
NSKKKKKIQ

SEQ ID NO: 2768885 - protein, 19 aa, Entamoeba invadens
NSKKLQKALSDARAERTHS

SEQ ID NO: 2768886 - protein, 8 aa, Entamoeba invadens
NSKKTTTF

SEQ ID NO: 2768887 - protein, 13 aa, Entamoeba invadens
NSKLEDEECIRGS

SEQ ID NO: 2768888 - protein, 6 aa, Entamoeba invadens
NSKLTQ

SEQ ID NO: 2768889 - protein, 4 aa, Entamoeba invadens
NSKN

SEQ ID NO: 2768890 - protein, 8 aa, Entamoeba invadens
NSKNKAVK

SEQ ID NO: 2768891 - protein, 8 aa, Entamoeba invadens
NSKNYEEQ

SEQ ID NO: 2768892 - protein, 15 aa, Entamoeba invadens
NSKQTIRTNECTDSD

SEQ ID NO: 2768893 - protein, 5 aa, Entamoeba invadens
NSKRI

SEQ ID NO: 2768894 - protein, 12 aa, Entamoeba invadens
NSKRKNELEKTT

SEQ ID NO: 2768895 - protein, 4 aa, Entamoeba invadens
NSKS

SEQ ID NO: 2768896 - protein, 9 aa, Entamoeba invadens
NSKSDTNKV

SEQ ID NO: 2768897 - protein, 9 aa, Entamoeba invadens
NSKSSTELF

SEQ ID NO: 2768898 - protein, 10 aa, Entamoeba invadens
NSKSSTTAGI

SEQ ID NO: 2768899 - protein, 8 aa, Entamoeba invadens
NSKTDNCT

SEQ ID NO: 2768900 - protein, 24 aa, Entamoeba invadens
NSKTGVCEKNEKPKPECKNGETKV

SEQ ID NO: 2768901 - protein, 5 aa, Entamoeba invadens
NSKTK

SEQ ID NO: 2768902 - protein, 6 aa, Entamoeba invadens
NSKTQT

SEQ ID NO: 2768903 - protein, 6 aa, Entamoeba invadens
NSKTTV

SEQ ID NO: 2768904 - protein, 10 aa, Entamoeba invadens
NSKTVGNRTI

SEQ ID NO: 2768905 - protein, 5 aa, Entamoeba invadens
NSKYY

SEQ ID NO: 2768906 - protein, 18 aa, Entamoeba invadens
NSLKGKSATVERVVVLQL

SEQ ID NO: 2768907 - protein, 17 aa, Entamoeba invadens
NSLKKGSPLNEQQKSVA

SEQ ID NO: 2768908 - protein, 10 aa, Entamoeba invadens
NSLKKQRGDC

SEQ ID NO: 2768909 - protein, 10 aa, Entamoeba invadens
NSLKTAEIST

SEQ ID NO: 2768910 - protein, 25 aa, Entamoeba invadens
NSLNECKTTCPTGYKIGDNGDCEKC

SEQ ID NO: 2768911 - protein, 7 aa, Entamoeba invadens
NSLNKGN

SEQ ID NO: 2768912 - protein, 7 aa, Entamoeba invadens
NSLNNGN

SEQ ID NO: 2768913 - protein, 7 aa, Entamoeba invadens
NSLPTKL

SEQ ID NO: 2768914 - protein, 7 aa, Entamoeba invadens
NSLQSTD

SEQ ID NO: 2768915 - protein, 10 aa, Entamoeba invadens
NSLRTSESDA

SEQ ID NO: 2768916 - protein, 4 aa, Entamoeba invadens
NSLS

SEQ ID NO: 2768917 - protein, 6 aa, Entamoeba invadens
NSLSKR

SEQ ID NO: 2768918 - protein, 5 aa, Entamoeba invadens
NSLTF

SEQ ID NO: 2768919 - protein, 7 aa, Entamoeba invadens
NSLTFND

SEQ ID NO: 2768920 - protein, 5 aa, Entamoeba invadens
NSLTI

SEQ ID NO: 2768921 - protein, 5 aa, Entamoeba invadens
NSLTS

SEQ ID NO: 2768922 - protein, 12 aa, Entamoeba invadens
NSMAKASNFNVK

SEQ ID NO: 2768923 - protein, 20 aa, Entamoeba invadens
NSMKEEPKPVSRSQSATCDD

SEQ ID NO: 2768924 - protein, 9 aa, Entamoeba invadens
NSMKGDAGI

SEQ ID NO: 2768925 - protein, 5 aa, Entamoeba invadens
NSMST

SEQ ID NO: 2768926 - protein, 9 aa, Entamoeba invadens
NSNATQRER

SEQ ID NO: 2768927 - protein, 4 aa, Entamoeba invadens
NSNC

SEQ ID NO: 2768928 - protein, 6 aa, Entamoeba invadens
NSNDFE

SEQ ID NO: 2768929 - protein, 15 aa, Entamoeba invadens
NSNDIQTSKNGNNEI

SEQ ID NO: 2768930 - protein, 8 aa, Entamoeba invadens
NSNDPDLF

SEQ ID NO: 2768931 - protein, 6 aa, Entamoeba invadens
NSNEEH

SEQ ID NO: 2768932 - protein, 8 aa, Entamoeba invadens
NSNENMPP

SEQ ID NO: 2768933 - protein, 19 aa, Entamoeba invadens
NSNGEVTISSPLEANKSNS

SEQ ID NO: 2768934 - protein, 16 aa, Entamoeba invadens
NSNGGCYSKDENSLIT

SEQ ID NO: 2768935 - protein, 10 aa, Entamoeba invadens
NSNGKCDNRA

SEQ ID NO: 2768936 - protein, 5 aa, Entamoeba invadens
NSNGY

SEQ ID NO: 2768937 - protein, 6 aa, Entamoeba invadens
NSNIKN

SEQ ID NO: 2768938 - protein, 8 aa, Entamoeba invadens
NSNKNNNN

SEQ ID NO: 2768939 - protein, 12 aa, Entamoeba invadens
NSNKRCEKCNEN

SEQ ID NO: 2768940 - protein, 5 aa, Entamoeba invadens
NSNME

SEQ ID NO: 2768941 - protein, 17 aa, Entamoeba invadens
NSNNEEVDLTEEHRQDI

SEQ ID NO: 2768942 - protein, 7 aa, Entamoeba invadens
NSNRKVT

SEQ ID NO: 2768943 - protein, 15 aa, Entamoeba invadens
NSNRLKQTPNLDNKE

SEQ ID NO: 2768944 - protein, 6 aa, Entamoeba invadens
NSNSPL

SEQ ID NO: 2768945 - protein, 5 aa, Entamoeba invadens
NSNTA

SEQ ID NO: 2768946 - protein, 10 aa, Entamoeba invadens
NSNTKLSNGK

SEQ ID NO: 2768947 - protein, 9 aa, Entamoeba invadens
NSNVEGKIP

SEQ ID NO: 2768948 - protein, 7 aa, Entamoeba invadens
NSNVSVK

SEQ ID NO: 2768949 - protein, 22 aa, Entamoeba invadens
NSNYERKCTTCNTGYYPNADGK

SEQ ID NO: 2768950 - protein, 21 aa, Entamoeba invadens
NSNYERKCTTCNTGYYPNAEG

SEQ ID NO: 2768951 - protein, 12 aa, Entamoeba invadens
NSNYKDDATGSC

SEQ ID NO: 2768952 - protein, 5 aa, Entamoeba invadens
NSPFI

SEQ ID NO: 2768953 - protein, 6 aa, Entamoeba invadens
NSPIDS

SEQ ID NO: 2768954 - protein, 6 aa, Entamoeba invadens
NSPKNL

SEQ ID NO: 2768955 - protein, 6 aa, Entamoeba invadens
NSPKPF

SEQ ID NO: 2768956 - protein, 7 aa, Entamoeba invadens
NSPLKND

SEQ ID NO: 2768957 - protein, 10 aa, Entamoeba invadens
NSPNKDGTLC

SEQ ID NO: 2768958 - protein, 6 aa, Entamoeba invadens
NSPNNL

SEQ ID NO: 2768959 - protein, 7 aa, Entamoeba invadens
NSPQHSF

SEQ ID NO: 2768960 - protein, 5 aa, Entamoeba invadens
NSPQL

SEQ ID NO: 2768961 - protein, 10 aa, Entamoeba invadens
NSPRSSPKAT

SEQ ID NO: 2768962 - protein, 6 aa, Entamoeba invadens
NSPSIT

SEQ ID NO: 2768963 - protein, 7 aa, Entamoeba invadens
NSPSQTY

SEQ ID NO: 2768964 - protein, 4 aa, Entamoeba invadens
NSPT

SEQ ID NO: 2768965 - protein, 8 aa, Entamoeba invadens
NSPTPEPM

SEQ ID NO: 2768966 - protein, 10 aa, Entamoeba invadens
NSPVKSTNSS

SEQ ID NO: 2768967 - protein, 6 aa, Entamoeba invadens
NSPYNE

SEQ ID NO: 2768968 - protein, 7 aa, Entamoeba invadens
NSQDELT

SEQ ID NO: 2768969 - protein, 5 aa, Entamoeba invadens
NSQEI

SEQ ID NO: 2768970 - protein, 9 aa, Entamoeba invadens
NSQEVEYKT

SEQ ID NO: 2768971 - protein, 6 aa, Entamoeba invadens
NSQFKT

SEQ ID NO: 2768972 - protein, 6 aa, Entamoeba invadens
NSQHPE

SEQ ID NO: 2768973 - protein, 5 aa, Entamoeba invadens
NSQHS

SEQ ID NO: 2768974 - protein, 9 aa, Entamoeba invadens
NSQIQSGSQ

SEQ ID NO: 2768975 - protein, 9 aa, Entamoeba invadens
NSQKLNYNS

SEQ ID NO: 2768976 - protein, 8 aa, Entamoeba invadens
NSQKQYTC

SEQ ID NO: 2768977 - protein, 9 aa, Entamoeba invadens
NSQLTTSKE

SEQ ID NO: 2768978 - protein, 6 aa, Entamoeba invadens
NSQMEN

SEQ ID NO: 2768979 - protein, 5 aa, Entamoeba invadens
NSQNC

SEQ ID NO: 2768980 - protein, 12 aa, Entamoeba invadens
NSQNNSASSTIG

SEQ ID NO: 2768981 - protein, 7 aa, Entamoeba invadens
NSQNTCS

SEQ ID NO: 2768982 - protein, 4 aa, Entamoeba invadens
NSQP

SEQ ID NO: 2768983 - protein, 7 aa, Entamoeba invadens
NSQPGLE

SEQ ID NO: 2768984 - protein, 13 aa, Entamoeba invadens
NSQPNPQYSNNMA

SEQ ID NO: 2768985 - protein, 6 aa, Entamoeba invadens
NSQSEL

SEQ ID NO: 2768986 - protein, 6 aa, Entamoeba invadens
NSQSRI

SEQ ID NO: 2768987 - protein, 62 aa, Entamoeba invadens
NSQSSQNSENADNKSKSSDKSASQKNSQKKGSQPSKSKSTPSGSGKSNSEDSKKKKKGKSRV

SEQ ID NO: 2768988 - protein, 5 aa, Entamoeba invadens
NSQTR

SEQ ID NO: 2768989 - protein, 9 aa, Entamoeba invadens
NSQTYNGGS

SEQ ID NO: 2768990 - protein, 5 aa, Entamoeba invadens
NSQVG

SEQ ID NO: 2768991 - protein, 4 aa, Entamoeba invadens
NSRA

SEQ ID NO: 2768992 - protein, 7 aa, Entamoeba invadens
NSRACEE

SEQ ID NO: 2768993 - protein, 17 aa, Entamoeba invadens
NSREESYECSQNHELSY

SEQ ID NO: 2768994 - protein, 5 aa, Entamoeba invadens
NSRGS

SEQ ID NO: 2768995 - protein, 6 aa, Entamoeba invadens
NSRLSV

SEQ ID NO: 2768996 - protein, 6 aa, Entamoeba invadens
NSRPIQ

SEQ ID NO: 2768997 - protein, 7 aa, Entamoeba invadens
NSRRVKN

SEQ ID NO: 2768998 - protein, 8 aa, Entamoeba invadens
NSRSQKKV

SEQ ID NO: 2768999 - protein, 5 aa, Entamoeba invadens
NSRTL

SEQ ID NO: 2769000 - protein, 16 aa, Entamoeba invadens
NSRVKKGDIDFTQLNL

SEQ ID NO: 2769001 - protein, 9 aa, Entamoeba invadens
NSSATMNEE

SEQ ID NO: 2769002 - protein, 7 aa, Entamoeba invadens
NSSCEPP

SEQ ID NO: 2769003 - protein, 10 aa, Entamoeba invadens
NSSCGKVTPR

SEQ ID NO: 2769004 - protein, 6 aa, Entamoeba invadens
NSSDVI

SEQ ID NO: 2769005 - protein, 4 aa, Entamoeba invadens
NSSE

SEQ ID NO: 2769006 - protein, 7 aa, Entamoeba invadens
NSSEQEK

SEQ ID NO: 2769007 - protein, 10 aa, Entamoeba invadens
NSSESNGTAF

SEQ ID NO: 2769008 - protein, 6 aa, Entamoeba invadens
NSSFEN

SEQ ID NO: 2769009 - protein, 4 aa, Entamoeba invadens
NSSG

SEQ ID NO: 2769010 - protein, 4 aa, Entamoeba invadens
NSSH

SEQ ID NO: 2769011 - protein, 6 aa, Entamoeba invadens
NSSIGD

SEQ ID NO: 2769012 - protein, 9 aa, Entamoeba invadens
NSSINNGFN

SEQ ID NO: 2769013 - protein, 7 aa, Entamoeba invadens
NSSIPNA

SEQ ID NO: 2769014 - protein, 5 aa, Entamoeba invadens
NSSKD

SEQ ID NO: 2769015 - protein, 27 aa, Entamoeba invadens
NSSKGNTKIQITTKDKCDKYKIRTEPQ

SEQ ID NO: 2769016 - protein, 6 aa, Entamoeba invadens
NSSKGV

SEQ ID NO: 2769017 - protein, 10 aa, Entamoeba invadens
NSSKNGENIE

SEQ ID NO: 2769018 - protein, 7 aa, Entamoeba invadens
NSSKNNM

SEQ ID NO: 2769019 - protein, 7 aa, Entamoeba invadens
NSSKNNV

SEQ ID NO: 2769020 - protein, 6 aa, Entamoeba invadens
NSSKRH

SEQ ID NO: 2769021 - protein, 8 aa, Entamoeba invadens
NSSKSIKK

SEQ ID NO: 2769022 - protein, 8 aa, Entamoeba invadens
NSSKSNVK

SEQ ID NO: 2769023 - protein, 7 aa, Entamoeba invadens
NSSKYQI

SEQ ID NO: 2769024 - protein, 4 aa, Entamoeba invadens
NSSL

SEQ ID NO: 2769025 - protein, 14 aa, Entamoeba invadens
NSSLKNETENFQKA

SEQ ID NO: 2769026 - protein, 14 aa, Entamoeba invadens
NSSLQYKTENFQKA

SEQ ID NO: 2769027 - protein, 6 aa, Entamoeba invadens
NSSMRQ

SEQ ID NO: 2769028 - protein, 15 aa, Entamoeba invadens
NSSNLNGNNKSNEYE

SEQ ID NO: 2769029 - protein, 6 aa, Entamoeba invadens
NSSPHR

SEQ ID NO: 2769030 - protein, 15 aa, Entamoeba invadens
NSSPSTSLSNENGDI

SEQ ID NO: 2769031 - protein, 7 aa, Entamoeba invadens
NSSPTTY

SEQ ID NO: 2769032 - protein, 6 aa, Entamoeba invadens
NSSQIN

SEQ ID NO: 2769033 - protein, 6 aa, Entamoeba invadens
NSSQRM

SEQ ID NO: 2769034 - protein, 16 aa, Entamoeba invadens
NSSQSTGVKTQTTQNG

SEQ ID NO: 2769035 - protein, 8 aa, Entamoeba invadens
NSSRDTSL

SEQ ID NO: 2769036 - protein, 9 aa, Entamoeba invadens
NSSSGYCTS

SEQ ID NO: 2769037 - protein, 5 aa, Entamoeba invadens
NSSSI

SEQ ID NO: 2769038 - protein, 6 aa, Entamoeba invadens
NSSSKT

SEQ ID NO: 2769039 - protein, 7 aa, Entamoeba invadens
NSSSRVA

SEQ ID NO: 2769040 - protein, 6 aa, Entamoeba invadens
NSSSVP

SEQ ID NO: 2769041 - protein, 4 aa, Entamoeba invadens
NSST

SEQ ID NO: 2769042 - protein, 12 aa, Entamoeba invadens
NSSTKENDNGKM

SEQ ID NO: 2769043 - protein, 11 aa, Entamoeba invadens
NSSTNKCERCD

SEQ ID NO: 2769044 - protein, 10 aa, Entamoeba invadens
NSSTNRCERC

SEQ ID NO: 2769045 - protein, 8 aa, Entamoeba invadens
NSSTNRKK

SEQ ID NO: 2769046 - protein, 32 aa, Entamoeba invadens
NSSTTKLAEDALTSSVSSSSSTDNFDENCGNG

SEQ ID NO: 2769047 - protein, 6 aa, Entamoeba invadens
NSSVKT

SEQ ID NO: 2769048 - protein, 13 aa, Entamoeba invadens
NSSVQGKSEGKTL

SEQ ID NO: 2769049 - protein, 7 aa, Entamoeba invadens
NSSWSDV

SEQ ID NO: 2769050 - protein, 6 aa, Entamoeba invadens
NSSYCE

SEQ ID NO: 2769051 - protein, 7 aa, Entamoeba invadens
NSSYCES

SEQ ID NO: 2769052 - protein, 5 aa, Entamoeba invadens
NSSYG

SEQ ID NO: 2769053 - protein, 6 aa, Entamoeba invadens
NSSYNN

SEQ ID NO: 2769054 - protein, 7 aa, Entamoeba invadens
NSTAGYT

SEQ ID NO: 2769055 - protein, 7 aa, Entamoeba invadens
NSTAKIH

SEQ ID NO: 2769056 - protein, 17 aa, Entamoeba invadens
NSTAKLNSAREKEFAKY

SEQ ID NO: 2769057 - protein, 4 aa, Entamoeba invadens
NSTC

SEQ ID NO: 2769058 - protein, 8 aa, Entamoeba invadens
NSTCNQSK

SEQ ID NO: 2769059 - protein, 7 aa, Entamoeba invadens
NSTCQKC

SEQ ID NO: 2769060 - protein, 7 aa, Entamoeba invadens
NSTEAID

SEQ ID NO: 2769061 - protein, 8 aa, Entamoeba invadens
NSTEPTTY

SEQ ID NO: 2769062 - protein, 5 aa, Entamoeba invadens
NSTER

SEQ ID NO: 2769063 - protein, 5 aa, Entamoeba invadens
NSTEV

SEQ ID NO: 2769064 - protein, 5 aa, Entamoeba invadens
NSTEY

SEQ ID NO: 2769065 - protein, 4 aa, Entamoeba invadens
NSTF

SEQ ID NO: 2769066 - protein, 5 aa, Entamoeba invadens
NSTFG

SEQ ID NO: 2769067 - protein, 13 aa, Entamoeba invadens
NSTGKYENYNSND

SEQ ID NO: 2769068 - protein, 6 aa, Entamoeba invadens
NSTGNI

SEQ ID NO: 2769069 - protein, 7 aa, Entamoeba invadens
NSTGSDC

SEQ ID NO: 2769070 - protein, 4 aa, Entamoeba invadens
NSTH

SEQ ID NO: 2769071 - protein, 4 aa, Entamoeba invadens
NSTI

SEQ ID NO: 2769072 - protein, 7 aa, Entamoeba invadens
NSTIPNA

SEQ ID NO: 2769073 - protein, 7 aa, Entamoeba invadens
NSTIPRP

SEQ ID NO: 2769074 - protein, 6 aa, Entamoeba invadens
NSTIQN

SEQ ID NO: 2769075 - protein, 5 aa, Entamoeba invadens
NSTKD

SEQ ID NO: 2769076 - protein, 26 aa, Entamoeba invadens
NSTKDSVQTERNTKPLNGGRELKAQS

SEQ ID NO: 2769077 - protein, 7 aa, Entamoeba invadens
NSTKNTL

SEQ ID NO: 2769078 - protein, 4 aa, Entamoeba invadens
NSTL

SEQ ID NO: 2769079 - protein, 5 aa, Entamoeba invadens
NSTLK

SEQ ID NO: 2769080 - protein, 8 aa, Entamoeba invadens
NSTNSGCY

SEQ ID NO: 2769081 - protein, 8 aa, Entamoeba invadens
NSTNSTSC

SEQ ID NO: 2769082 - protein, 7 aa, Entamoeba invadens
NSTNVET

SEQ ID NO: 2769083 - protein, 8 aa, Entamoeba invadens
NSTNYKTI

SEQ ID NO: 2769084 - protein, 13 aa, Entamoeba invadens
NSTNYKTIGGECM

SEQ ID NO: 2769085 - protein, 15 aa, Entamoeba invadens
NSTNYKTTGGDCLPQ

SEQ ID NO: 2769086 - protein, 4 aa, Entamoeba invadens
NSTQ

SEQ ID NO: 2769087 - protein, 6 aa, Entamoeba invadens
NSTQST

SEQ ID NO: 2769088 - protein, 7 aa, Entamoeba invadens
NSTQTAC

SEQ ID NO: 2769089 - protein, 7 aa, Entamoeba invadens
NSTSDTL

SEQ ID NO: 2769090 - protein, 9 aa, Entamoeba invadens
NSTSGKIEC

SEQ ID NO: 2769091 - protein, 11 aa, Entamoeba invadens
NSTSKTCERCP

SEQ ID NO: 2769092 - protein, 21 aa, Entamoeba invadens
NSTSNVTNSTDNTTDINNNTM

SEQ ID NO: 2769093 - protein, 9 aa, Entamoeba invadens
NSTSSRQKL

SEQ ID NO: 2769094 - protein, 10 aa, Entamoeba invadens
NSTSTKSMEK

SEQ ID NO: 2769095 - protein, 9 aa, Entamoeba invadens
NSTSTSVEK

SEQ ID NO: 2769096 - protein, 17 aa, Entamoeba invadens
NSTSVTINTEQDSEDLE

SEQ ID NO: 2769097 - protein, 19 aa, Entamoeba invadens
NSTSVTITAEQSSEDKEAK

SEQ ID NO: 2769098 - protein, 5 aa, Entamoeba invadens
NSTTG

SEQ ID NO: 2769099 - protein, 5 aa, Entamoeba invadens
NSTTK

SEQ ID NO: 2769100 - protein, 20 aa, Entamoeba invadens
NSTTQIESDKQTQQNQIPQL

SEQ ID NO: 2769101 - protein, 10 aa, Entamoeba invadens
NSTTQNDFDT

SEQ ID NO: 2769102 - protein, 5 aa, Entamoeba invadens
NSTTS

SEQ ID NO: 2769103 - protein, 5 aa, Entamoeba invadens
NSTVN

SEQ ID NO: 2769104 - protein, 9 aa, Entamoeba invadens
NSTVQSKNN

SEQ ID NO: 2769105 - protein, 7 aa, Entamoeba invadens
NSTVTSN

SEQ ID NO: 2769106 - protein, 13 aa, Entamoeba invadens
NSTVYSSDSFDTD

SEQ ID NO: 2769107 - protein, 7 aa, Entamoeba invadens
NSVDKET

SEQ ID NO: 2769108 - protein, 5 aa, Entamoeba invadens
NSVLN

SEQ ID NO: 2769109 - protein, 6 aa, Entamoeba invadens
NSVLPN

SEQ ID NO: 2769110 - protein, 5 aa, Entamoeba invadens
NSVNA

SEQ ID NO: 2769111 - protein, 15 aa, Entamoeba invadens
NSVNEDQVDSKYEPL

SEQ ID NO: 2769112 - protein, 4 aa, Entamoeba invadens
NSVT

SEQ ID NO: 2769113 - protein, 5 aa, Entamoeba invadens
NSVTT

SEQ ID NO: 2769114 - protein, 5 aa, Entamoeba invadens
NSYIT

SEQ ID NO: 2769115 - protein, 12 aa, Entamoeba invadens
NSYKNKYKHNSM

SEQ ID NO: 2769116 - protein, 9 aa, Entamoeba invadens
NSYNPTKSE

SEQ ID NO: 2769117 - protein, 7 aa, Entamoeba invadens
NSYPTKT

SEQ ID NO: 2769118 - protein, 9 aa, Entamoeba invadens
NSYTPTKSE

SEQ ID NO: 2769119 - protein, 9 aa, Entamoeba invadens
NSYTRNNAK

SEQ ID NO: 2769120 - protein, 9 aa, Entamoeba invadens
NSYTSQCSS

SEQ ID NO: 2769121 - protein, 16 aa, Entamoeba invadens
NTAEAAFTKAQQDQAA

SEQ ID NO: 2769122 - protein, 6 aa, Entamoeba invadens
NTAKET

SEQ ID NO: 2769123 - protein, 9 aa, Entamoeba invadens
NTALNTKNG

SEQ ID NO: 2769124 - protein, 22 aa, Entamoeba invadens
NTANENAQFKAADNEAANTNFT

SEQ ID NO: 2769125 - protein, 5 aa, Entamoeba invadens
NTASG

SEQ ID NO: 2769126 - protein, 11 aa, Entamoeba invadens
NTATNSPQNDY

SEQ ID NO: 2769127 - protein, 10 aa, Entamoeba invadens
NTATTISDTR

SEQ ID NO: 2769128 - protein, 8 aa, Entamoeba invadens
NTAYVETS

SEQ ID NO: 2769129 - protein, 14 aa, Entamoeba invadens
NTCDTTANACGSGC

SEQ ID NO: 2769130 - protein, 6 aa, Entamoeba invadens
NTCEKC

SEQ ID NO: 2769131 - protein, 7 aa, Entamoeba invadens
NTCERGN

SEQ ID NO: 2769132 - protein, 8 aa, Entamoeba invadens
NTCETGRK

SEQ ID NO: 2769133 - protein, 15 aa, Entamoeba invadens
NTCETPNDQNGRCTT

SEQ ID NO: 2769134 - protein, 7 aa, Entamoeba invadens
NTCGQTG

SEQ ID NO: 2769135 - protein, 7 aa, Entamoeba invadens
NTCKSND

SEQ ID NO: 2769136 - protein, 10 aa, Entamoeba invadens
NTCNKKTTAR

SEQ ID NO: 2769137 - protein, 6 aa, Entamoeba invadens
NTCNKN

SEQ ID NO: 2769138 - protein, 7 aa, Entamoeba invadens
NTCNNIK

SEQ ID NO: 2769139 - protein, 8 aa, Entamoeba invadens
NTCNNIKE

SEQ ID NO: 2769140 - protein, 10 aa, Entamoeba invadens
NTCNNTKKSC

SEQ ID NO: 2769141 - protein, 6 aa, Entamoeba invadens
NTCNPI

SEQ ID NO: 2769142 - protein, 17 aa, Entamoeba invadens
NTCNPPNDTNGKCTSEV

SEQ ID NO: 2769143 - protein, 8 aa, Entamoeba invadens
NTCNTKNG

SEQ ID NO: 2769144 - protein, 7 aa, Entamoeba invadens
NTCNTNA

SEQ ID NO: 2769145 - protein, 9 aa, Entamoeba invadens
NTCNTTEKS

SEQ ID NO: 2769146 - protein, 7 aa, Entamoeba invadens
NTCSKCD

SEQ ID NO: 2769147 - protein, 13 aa, Entamoeba invadens
NTCSSYSSSSCKT

SEQ ID NO: 2769148 - protein, 8 aa, Entamoeba invadens
NTCSTTAE

SEQ ID NO: 2769149 - protein, 6 aa, Entamoeba invadens
NTCTAY

SEQ ID NO: 2769150 - protein, 8 aa, Entamoeba invadens
NTCTQKDV

SEQ ID NO: 2769151 - protein, 9 aa, Entamoeba invadens
NTCTSATEI

SEQ ID NO: 2769152 - protein, 32 aa, Entamoeba invadens
NTCTSDTNCNTIDGSDCTACDKNKTLKRTKNR

SEQ ID NO: 2769153 - protein, 19 aa, Entamoeba invadens
NTCTSDTNCNTINGSDCTA

SEQ ID NO: 2769154 - protein, 7 aa, Entamoeba invadens
NTCVDDT

SEQ ID NO: 2769155 - protein, 7 aa, Entamoeba invadens
NTDCTGT

SEQ ID NO: 2769156 - protein, 4 aa, Entamoeba invadens
NTDD

SEQ ID NO: 2769157 - protein, 5 aa, Entamoeba invadens
NTDDY

SEQ ID NO: 2769158 - protein, 11 aa, Entamoeba invadens
NTDGTYTIPAR

SEQ ID NO: 2769159 - protein, 5 aa, Entamoeba invadens
NTDHP

SEQ ID NO: 2769160 - protein, 7 aa, Entamoeba invadens
NTDLPNE

SEQ ID NO: 2769161 - protein, 4 aa, Entamoeba invadens
NTDN

SEQ ID NO: 2769162 - protein, 10 aa, Entamoeba invadens
NTDNANLVGE

SEQ ID NO: 2769163 - protein, 7 aa, Entamoeba invadens
NTDNEQI

SEQ ID NO: 2769164 - protein, 6 aa, Entamoeba invadens
NTDNSK

SEQ ID NO: 2769165 - protein, 8 aa, Entamoeba invadens
NTDPKVTY

SEQ ID NO: 2769166 - protein, 6 aa, Entamoeba invadens
NTDPPI

SEQ ID NO: 2769167 - protein, 8 aa, Entamoeba invadens
NTDPSEVT

SEQ ID NO: 2769168 - protein, 6 aa, Entamoeba invadens
NTDQKK

SEQ ID NO: 2769169 - protein, 5 aa, Entamoeba invadens
NTDSK

SEQ ID NO: 2769170 - protein, 4 aa, Entamoeba invadens
NTDY

SEQ ID NO: 2769171 - protein, 8 aa, Entamoeba invadens
NTEAELED

SEQ ID NO: 2769172 - protein, 7 aa, Entamoeba invadens
NTEATQM

SEQ ID NO: 2769173 - protein, 7 aa, Entamoeba invadens
NTECSPQ

SEQ ID NO: 2769174 - protein, 11 aa, Entamoeba invadens
NTEDGTEGKSY

SEQ ID NO: 2769175 - protein, 15 aa, Entamoeba invadens
NTEEGTTNNEESMSC

SEQ ID NO: 2769176 - protein, 7 aa, Entamoeba invadens
NTEERVG

SEQ ID NO: 2769177 - protein, 13 aa, Entamoeba invadens
NTEESTIKSVEKS

SEQ ID NO: 2769178 - protein, 7 aa, Entamoeba invadens
NTEFPSV

SEQ ID NO: 2769179 - protein, 8 aa, Entamoeba invadens
NTEKCDKT

SEQ ID NO: 2769180 - protein, 10 aa, Entamoeba invadens
NTELAGQSAM

SEQ ID NO: 2769181 - protein, 55 aa, Entamoeba invadens
NTEMSGQSAMKQEKNVNPPPQEEKKEDVPQQQTESVPVTEPAADTADKKSVSSKE

SEQ ID NO: 2769182 - protein, 4 aa, Entamoeba invadens
NTEN

SEQ ID NO: 2769183 - protein, 7 aa, Entamoeba invadens
NTENAEN

SEQ ID NO: 2769184 - protein, 6 aa, Entamoeba invadens
NTENPI

SEQ ID NO: 2769185 - protein, 19 aa, Entamoeba invadens
NTEQNDSQVVPQEHHNEQN

SEQ ID NO: 2769186 - protein, 12 aa, Entamoeba invadens
NTERKRNDKCEF

SEQ ID NO: 2769187 - protein, 4 aa, Entamoeba invadens
NTES

SEQ ID NO: 2769188 - protein, 7 aa, Entamoeba invadens
NTETGKK

SEQ ID NO: 2769189 - protein, 5 aa, Entamoeba invadens
NTETT

SEQ ID NO: 2769190 - protein, 5 aa, Entamoeba invadens
NTEYG

SEQ ID NO: 2769191 - protein, 6 aa, Entamoeba invadens
NTFETT

SEQ ID NO: 2769192 - protein, 4 aa, Entamoeba invadens
NTFG

SEQ ID NO: 2769193 - protein, 6 aa, Entamoeba invadens
NTFPNA

SEQ ID NO: 2769194 - protein, 13 aa, Entamoeba invadens
NTFPNKKATLVGG

SEQ ID NO: 2769195 - protein, 6 aa, Entamoeba invadens
NTFTKG

SEQ ID NO: 2769196 - protein, 8 aa, Entamoeba invadens
NTGAVTIK

SEQ ID NO: 2769197 - protein, 5 aa, Entamoeba invadens
NTGDF

SEQ ID NO: 2769198 - protein, 7 aa, Entamoeba invadens
NTGDSTM

SEQ ID NO: 2769199 - protein, 6 aa, Entamoeba invadens
NTGECG

SEQ ID NO: 2769200 - protein, 9 aa, Entamoeba invadens
NTGEMTSRM

SEQ ID NO: 2769201 - protein, 8 aa, Entamoeba invadens
NTGETCSK

SEQ ID NO: 2769202 - protein, 5 aa, Entamoeba invadens
NTGFA

SEQ ID NO: 2769203 - protein, 5 aa, Entamoeba invadens
NTGFN

SEQ ID NO: 2769204 - protein, 8 aa, Entamoeba invadens
NTGGATTC

SEQ ID NO: 2769205 - protein, 6 aa, Entamoeba invadens
NTGIGA

SEQ ID NO: 2769206 - protein, 7 aa, Entamoeba invadens
NTGITNE

SEQ ID NO: 2769207 - protein, 7 aa, Entamoeba invadens
NTGKDRV

SEQ ID NO: 2769208 - protein, 7 aa, Entamoeba invadens
NTGKDTI

SEQ ID NO: 2769209 - protein, 11 aa, Entamoeba invadens
NTGMDASEIHE

SEQ ID NO: 2769210 - protein, 4 aa, Entamoeba invadens
NTGN

SEQ ID NO: 2769211 - protein, 7 aa, Entamoeba invadens
NTGNTSL

SEQ ID NO: 2769212 - protein, 7 aa, Entamoeba invadens
NTGTGAT

SEQ ID NO: 2769213 - protein, 7 aa, Entamoeba invadens
NTGVGAT

SEQ ID NO: 2769214 - protein, 5 aa, Entamoeba invadens
NTGVT

SEQ ID NO: 2769215 - protein, 6 aa, Entamoeba invadens
NTGYDY

SEQ ID NO: 2769216 - protein, 6 aa, Entamoeba invadens
NTGYQG

SEQ ID NO: 2769217 - protein, 6 aa, Entamoeba invadens
NTHPGK

SEQ ID NO: 2769218 - protein, 7 aa, Entamoeba invadens
NTHSDDC

SEQ ID NO: 2769219 - protein, 12 aa, Entamoeba invadens
NTIKNENEENEF

SEQ ID NO: 2769220 - protein, 5 aa, Entamoeba invadens
NTIND

SEQ ID NO: 2769221 - protein, 5 aa, Entamoeba invadens
NTINE

SEQ ID NO: 2769222 - protein, 13 aa, Entamoeba invadens
NTINSNNFKNGNK

SEQ ID NO: 2769223 - protein, 14 aa, Entamoeba invadens
NTINSNNLKNGNEY

SEQ ID NO: 2769224 - protein, 6 aa, Entamoeba invadens
NTIQSN

SEQ ID NO: 2769225 - protein, 9 aa, Entamoeba invadens
NTISNTTPK

SEQ ID NO: 2769226 - protein, 7 aa, Entamoeba invadens
NTISVNS

SEQ ID NO: 2769227 - protein, 13 aa, Entamoeba invadens
NTISVNSKGTFEM

SEQ ID NO: 2769228 - protein, 5 aa, Entamoeba invadens
NTITG

SEQ ID NO: 2769229 - protein, 6 aa, Entamoeba invadens
NTITKN

SEQ ID NO: 2769230 - protein, 7 aa, Entamoeba invadens
NTIVTPS

SEQ ID NO: 2769231 - protein, 6 aa, Entamoeba invadens
NTKATI

SEQ ID NO: 2769232 - protein, 6 aa, Entamoeba invadens
NTKCDS

SEQ ID NO: 2769233 - protein, 6 aa, Entamoeba invadens
NTKCSP

SEQ ID NO: 2769234 - protein, 7 aa, Entamoeba invadens
NTKCTSC

SEQ ID NO: 2769235 - protein, 7 aa, Entamoeba invadens
NTKCVEG

SEQ ID NO: 2769236 - protein, 8 aa, Entamoeba invadens
NTKDIGSG

SEQ ID NO: 2769237 - protein, 8 aa, Entamoeba invadens
NTKDNTLK

SEQ ID NO: 2769238 - protein, 8 aa, Entamoeba invadens
NTKDVGDS

SEQ ID NO: 2769239 - protein, 16 aa, Entamoeba invadens
NTKEASSRCTAAEEVT

SEQ ID NO: 2769240 - protein, 5 aa, Entamoeba invadens
NTKEF

SEQ ID NO: 2769241 - protein, 10 aa, Entamoeba invadens
NTKENETSKC

SEQ ID NO: 2769242 - protein, 9 aa, Entamoeba invadens
NTKEQYPSN

SEQ ID NO: 2769243 - protein, 18 aa, Entamoeba invadens
NTKERATIQQIVDALQNM

SEQ ID NO: 2769244 - protein, 15 aa, Entamoeba invadens
NTKGGPYHTAQTPEE

SEQ ID NO: 2769245 - protein, 10 aa, Entamoeba invadens
NTKGTQKEIN

SEQ ID NO: 2769246 - protein, 5 aa, Entamoeba invadens
NTKHN

SEQ ID NO: 2769247 - protein, 21 aa, Entamoeba invadens
NTKIEANQCSLSSKNFEMNGN

SEQ ID NO: 2769248 - protein, 8 aa, Entamoeba invadens
NTKITNVN

SEQ ID NO: 2769249 - protein, 14 aa, Entamoeba invadens
NTKKSSTVENQNEK

SEQ ID NO: 2769250 - protein, 9 aa, Entamoeba invadens
NTKKTYKYS

SEQ ID NO: 2769251 - protein, 4 aa, Entamoeba invadens
NTKN

SEQ ID NO: 2769252 - protein, 6 aa, Entamoeba invadens
NTKNKI

SEQ ID NO: 2769253 - protein, 8 aa, Entamoeba invadens
NTKPRLEG

SEQ ID NO: 2769254 - protein, 8 aa, Entamoeba invadens
NTKRCESE

SEQ ID NO: 2769255 - protein, 6 aa, Entamoeba invadens
NTKRDM

SEQ ID NO: 2769256 - protein, 8 aa, Entamoeba invadens
NTKRNTCC

SEQ ID NO: 2769257 - protein, 40 aa, Entamoeba invadens
NTKSKADSQESSQSFSSLGHEGSQQSKKSDTKEPKDIDID

SEQ ID NO: 2769258 - protein, 10 aa, Entamoeba invadens
NTKSKNLHQR

SEQ ID NO: 2769259 - protein, 7 aa, Entamoeba invadens
NTKSNTC

SEQ ID NO: 2769260 - protein, 8 aa, Entamoeba invadens
NTKSSLYT

SEQ ID NO: 2769261 - protein, 11 aa, Entamoeba invadens
NTKSTNDFDGV

SEQ ID NO: 2769262 - protein, 7 aa, Entamoeba invadens
NTKSTNV

SEQ ID NO: 2769263 - protein, 9 aa, Entamoeba invadens
NTKTNFDDA

SEQ ID NO: 2769264 - protein, 8 aa, Entamoeba invadens
NTKTPGTY

SEQ ID NO: 2769265 - protein, 5 aa, Entamoeba invadens
NTKTR

SEQ ID NO: 2769266 - protein, 5 aa, Entamoeba invadens
NTKTV

SEQ ID NO: 2769267 - protein, 4 aa, Entamoeba invadens
NTKW

SEQ ID NO: 2769268 - protein, 16 aa, Entamoeba invadens
NTKYYDEGGKDAAIEM

SEQ ID NO: 2769269 - protein, 21 aa, Entamoeba invadens
NTLEKAEKVPESTIEDNPQLN

SEQ ID NO: 2769270 - protein, 18 aa, Entamoeba invadens
NTLKGEEEFGDESVTFGN

SEQ ID NO: 2769271 - protein, 11 aa, Entamoeba invadens
NTLKYTQHNGD

SEQ ID NO: 2769272 - protein, 12 aa, Entamoeba invadens
NTLNSKYSNKQH

SEQ ID NO: 2769273 - protein, 15 aa, Entamoeba invadens
NTLPAPFGRKTREGT

SEQ ID NO: 2769274 - protein, 13 aa, Entamoeba invadens
NTLPPNTDPSFGP

SEQ ID NO: 2769275 - protein, 7 aa, Entamoeba invadens
NTLPRPN

SEQ ID NO: 2769276 - protein, 5 aa, Entamoeba invadens
NTLQH

SEQ ID NO: 2769277 - protein, 41 aa, Entamoeba invadens
NTLSDQSNLFSKSQDDIQVKSRQSRNSTSVDQSESVLPSQF

SEQ ID NO: 2769278 - protein, 7 aa, Entamoeba invadens
NTLSEDD

SEQ ID NO: 2769279 - protein, 9 aa, Entamoeba invadens
NTLSSGGCR

SEQ ID NO: 2769280 - protein, 6 aa, Entamoeba invadens
NTLTNF

SEQ ID NO: 2769281 - protein, 10 aa, Entamoeba invadens
NTLVKSKHSK

SEQ ID NO: 2769282 - protein, 5 aa, Entamoeba invadens
NTMKS

SEQ ID NO: 2769283 - protein, 12 aa, Entamoeba invadens
NTMKSQLGEDDN

SEQ ID NO: 2769284 - protein, 6 aa, Entamoeba invadens
NTMSCN

SEQ ID NO: 2769285 - protein, 7 aa, Entamoeba invadens
NTMSCNG

SEQ ID NO: 2769286 - protein, 10 aa, Entamoeba invadens
NTMTTSTGFA

SEQ ID NO: 2769287 - protein, 9 aa, Entamoeba invadens
NTNADYPTD

SEQ ID NO: 2769288 - protein, 12 aa, Entamoeba invadens
NTNATDEEITAA

SEQ ID NO: 2769289 - protein, 7 aa, Entamoeba invadens
NTNCKTV

SEQ ID NO: 2769290 - protein, 8 aa, Entamoeba invadens
NTNDHQSH

SEQ ID NO: 2769291 - protein, 20 aa, Entamoeba invadens
NTNEANVSYSQDKKESLMET

SEQ ID NO: 2769292 - protein, 6 aa, Entamoeba invadens
NTNECK

SEQ ID NO: 2769293 - protein, 12 aa, Entamoeba invadens
NTNECKRCDDNC

SEQ ID NO: 2769294 - protein, 5 aa, Entamoeba invadens
NTNED

SEQ ID NO: 2769295 - protein, 7 aa, Entamoeba invadens
NTNEHTE

SEQ ID NO: 2769296 - protein, 7 aa, Entamoeba invadens
NTNENEY

SEQ ID NO: 2769297 - protein, 28 aa, Entamoeba invadens
NTNESISASESDSYVNTRDCPCSKTTGS

SEQ ID NO: 2769298 - protein, 8 aa, Entamoeba invadens
NTNETNIN

SEQ ID NO: 2769299 - protein, 5 aa, Entamoeba invadens
NTNEV

SEQ ID NO: 2769300 - protein, 8 aa, Entamoeba invadens
NTNGGTSA

SEQ ID NO: 2769301 - protein, 7 aa, Entamoeba invadens
NTNGGYY

SEQ ID NO: 2769302 - protein, 5 aa, Entamoeba invadens
NTNGK

SEQ ID NO: 2769303 - protein, 23 aa, Entamoeba invadens
NTNIEAEKEENPDAPYIQGGSFQ

SEQ ID NO: 2769304 - protein, 19 aa, Entamoeba invadens
NTNINGQVGGTTKLVTDGT

SEQ ID NO: 2769305 - protein, 7 aa, Entamoeba invadens
NTNKESV

SEQ ID NO: 2769306 - protein, 46 aa, Entamoeba invadens
NTNKKKSRKGYKDGKTDDGSLKNTTSTSSLSSEGSKSQSLHPLVEQ

SEQ ID NO: 2769307 - protein, 5 aa, Entamoeba invadens
NTNKN

SEQ ID NO: 2769308 - protein, 9 aa, Entamoeba invadens
NTNKNAIKT

SEQ ID NO: 2769309 - protein, 9 aa, Entamoeba invadens
NTNKNATKI

SEQ ID NO: 2769310 - protein, 11 aa, Entamoeba invadens
NTNKNLQSKKC

SEQ ID NO: 2769311 - protein, 6 aa, Entamoeba invadens
NTNKNT

SEQ ID NO: 2769312 - protein, 9 aa, Entamoeba invadens
NTNKNTTKL

SEQ ID NO: 2769313 - protein, 7 aa, Entamoeba invadens
NTNKQVT

SEQ ID NO: 2769314 - protein, 8 aa, Entamoeba invadens
NTNLGNRP

SEQ ID NO: 2769315 - protein, 7 aa, Entamoeba invadens
NTNNHAC

SEQ ID NO: 2769316 - protein, 7 aa, Entamoeba invadens
NTNNQTV

SEQ ID NO: 2769317 - protein, 7 aa, Entamoeba invadens
NTNNSNF

SEQ ID NO: 2769318 - protein, 14 aa, Entamoeba invadens
NTNQSITGITPNND

SEQ ID NO: 2769319 - protein, 6 aa, Entamoeba invadens
NTNSAV

SEQ ID NO: 2769320 - protein, 8 aa, Entamoeba invadens
NTNSSQDP

SEQ ID NO: 2769321 - protein, 6 aa, Entamoeba invadens
NTNSTY

SEQ ID NO: 2769322 - protein, 20 aa, Entamoeba invadens
NTNTPKPEVKEDKEIKYSPE

SEQ ID NO: 2769323 - protein, 7 aa, Entamoeba invadens
NTNTPME

SEQ ID NO: 2769324 - protein, 10 aa, Entamoeba invadens
NTNTSGQQEI

SEQ ID NO: 2769325 - protein, 4 aa, Entamoeba invadens
NTNV

SEQ ID NO: 2769326 - protein, 5 aa, Entamoeba invadens
NTNYI

SEQ ID NO: 2769327 - protein, 5 aa, Entamoeba invadens
NTNYN

SEQ ID NO: 2769328 - protein, 13 aa, Entamoeba invadens
NTNYTSCSQSTKK

SEQ ID NO: 2769329 - protein, 7 aa, Entamoeba invadens
NTPDDEE

SEQ ID NO: 2769330 - protein, 6 aa, Entamoeba invadens
NTPDSV

SEQ ID NO: 2769331 - protein, 7 aa, Entamoeba invadens
NTPEGSR

SEQ ID NO: 2769332 - protein, 4 aa, Entamoeba invadens
NTPI

SEQ ID NO: 2769333 - protein, 4 aa, Entamoeba invadens
NTPK

SEQ ID NO: 2769334 - protein, 10 aa, Entamoeba invadens
NTPKTSQNKA

SEQ ID NO: 2769335 - protein, 5 aa, Entamoeba invadens
NTPLD

SEQ ID NO: 2769336 - protein, 10 aa, Entamoeba invadens
NTPNDDGTLC

SEQ ID NO: 2769337 - protein, 5 aa, Entamoeba invadens
NTPPI

SEQ ID NO: 2769338 - protein, 6 aa, Entamoeba invadens
NTPPTP

SEQ ID NO: 2769339 - protein, 5 aa, Entamoeba invadens
NTPPV

SEQ ID NO: 2769340 - protein, 4 aa, Entamoeba invadens
NTPR

SEQ ID NO: 2769341 - protein, 10 aa, Entamoeba invadens
NTPSEAGTFC

SEQ ID NO: 2769342 - protein, 12 aa, Entamoeba invadens
NTPSEDGTSCET

SEQ ID NO: 2769343 - protein, 11 aa, Entamoeba invadens
NTPTITNTKIG

SEQ ID NO: 2769344 - protein, 6 aa, Entamoeba invadens
NTPTTL

SEQ ID NO: 2769345 - protein, 6 aa, Entamoeba invadens
NTPVRS

SEQ ID NO: 2769346 - protein, 4 aa, Entamoeba invadens
NTPY

SEQ ID NO: 2769347 - protein, 7 aa, Entamoeba invadens
NTQCGYD

SEQ ID NO: 2769348 - protein, 13 aa, Entamoeba invadens
NTQCNTTNLNEED

SEQ ID NO: 2769349 - protein, 6 aa, Entamoeba invadens
NTQDDV

SEQ ID NO: 2769350 - protein, 7 aa, Entamoeba invadens
NTQERCD

SEQ ID NO: 2769351 - protein, 9 aa, Entamoeba invadens
NTQGCTQCN

SEQ ID NO: 2769352 - protein, 19 aa, Entamoeba invadens
NTQGDKNKQGIDKISKRES

SEQ ID NO: 2769353 - protein, 8 aa, Entamoeba invadens
NTQGSAMT

SEQ ID NO: 2769354 - protein, 4 aa, Entamoeba invadens
NTQI

SEQ ID NO: 2769355 - protein, 8 aa, Entamoeba invadens
NTQIEQGN

SEQ ID NO: 2769356 - protein, 6 aa, Entamoeba invadens
NTQIES

SEQ ID NO: 2769357 - protein, 6 aa, Entamoeba invadens
NTQKKL

SEQ ID NO: 2769358 - protein, 6 aa, Entamoeba invadens
NTQNVH

SEQ ID NO: 2769359 - protein, 10 aa, Entamoeba invadens
NTQQNTTKNY

SEQ ID NO: 2769360 - protein, 10 aa, Entamoeba invadens
NTQQNTTNNY

SEQ ID NO: 2769361 - protein, 9 aa, Entamoeba invadens
NTQSDENEA

SEQ ID NO: 2769362 - protein, 5 aa, Entamoeba invadens
NTQSG

SEQ ID NO: 2769363 - protein, 9 aa, Entamoeba invadens
NTQTSSSLS

SEQ ID NO: 2769364 - protein, 10 aa, Entamoeba invadens
NTQTSSSLSY

SEQ ID NO: 2769365 - protein, 13 aa, Entamoeba invadens
NTQTTHYKTKGSN

SEQ ID NO: 2769366 - protein, 9 aa, Entamoeba invadens
NTQVYDDSF

SEQ ID NO: 2769367 - protein, 6 aa, Entamoeba invadens
NTQVYQ

SEQ ID NO: 2769368 - protein, 5 aa, Entamoeba invadens
NTRCS

SEQ ID NO: 2769369 - protein, 6 aa, Entamoeba invadens
NTREKE

SEQ ID NO: 2769370 - protein, 18 aa, Entamoeba invadens
NTRGTNKCPLKTSNCQQY

SEQ ID NO: 2769371 - protein, 8 aa, Entamoeba invadens
NTRKGDDC

SEQ ID NO: 2769372 - protein, 11 aa, Entamoeba invadens
NTRNGWEDKMN

SEQ ID NO: 2769373 - protein, 13 aa, Entamoeba invadens
NTRNSIDSGYETT

SEQ ID NO: 2769374 - protein, 6 aa, Entamoeba invadens
NTRSVT

SEQ ID NO: 2769375 - protein, 7 aa, Entamoeba invadens
NTRSYST

SEQ ID NO: 2769376 - protein, 13 aa, Entamoeba invadens
NTRTIEKELTNEC

SEQ ID NO: 2769377 - protein, 5 aa, Entamoeba invadens
NTRTL

SEQ ID NO: 2769378 - protein, 27 aa, Entamoeba invadens
NTRTTGVSRRSKLSSGRIDPIQTDEDF

SEQ ID NO: 2769379 - protein, 8 aa, Entamoeba invadens
NTSCQPPV

SEQ ID NO: 2769380 - protein, 8 aa, Entamoeba invadens
NTSCTQNG

SEQ ID NO: 2769381 - protein, 8 aa, Entamoeba invadens
NTSDELTE

SEQ ID NO: 2769382 - protein, 16 aa, Entamoeba invadens
NTSENFKKATPTNLTY

SEQ ID NO: 2769383 - protein, 6 aa, Entamoeba invadens
NTSEPF

SEQ ID NO: 2769384 - protein, 8 aa, Entamoeba invadens
NTSGFNSE

SEQ ID NO: 2769385 - protein, 7 aa, Entamoeba invadens
NTSGKVP

SEQ ID NO: 2769386 - protein, 16 aa, Entamoeba invadens
NTSIQEEVSQSIEERG

SEQ ID NO: 2769387 - protein, 6 aa, Entamoeba invadens
NTSIQT

SEQ ID NO: 2769388 - protein, 6 aa, Entamoeba invadens
NTSKHK

SEQ ID NO: 2769389 - protein, 5 aa, Entamoeba invadens
NTSKN

SEQ ID NO: 2769390 - protein, 7 aa, Entamoeba invadens
NTSKNDM

SEQ ID NO: 2769391 - protein, 7 aa, Entamoeba invadens
NTSKNKL

SEQ ID NO: 2769392 - protein, 7 aa, Entamoeba invadens
NTSKNNL

SEQ ID NO: 2769393 - protein, 7 aa, Entamoeba invadens
NTSKNNM

SEQ ID NO: 2769394 - protein, 7 aa, Entamoeba invadens
NTSKNTI

SEQ ID NO: 2769395 - protein, 7 aa, Entamoeba invadens
NTSKSIK

SEQ ID NO: 2769396 - protein, 8 aa, Entamoeba invadens
NTSKSSIK

SEQ ID NO: 2769397 - protein, 6 aa, Entamoeba invadens
NTSLKE

SEQ ID NO: 2769398 - protein, 22 aa, Entamoeba invadens
NTSNPSKFCTNGQRTHSTSNGL

SEQ ID NO: 2769399 - protein, 12 aa, Entamoeba invadens
NTSNSLKDGKCE

SEQ ID NO: 2769400 - protein, 7 aa, Entamoeba invadens
NTSPRNV

SEQ ID NO: 2769401 - protein, 5 aa, Entamoeba invadens
NTSPY

SEQ ID NO: 2769402 - protein, 4 aa, Entamoeba invadens
NTSQ

SEQ ID NO: 2769403 - protein, 7 aa, Entamoeba invadens
NTSQNEK

SEQ ID NO: 2769404 - protein, 9 aa, Entamoeba invadens
NTSQNEKFE

SEQ ID NO: 2769405 - protein, 7 aa, Entamoeba invadens
NTSQNKK

SEQ ID NO: 2769406 - protein, 4 aa, Entamoeba invadens
NTSS

SEQ ID NO: 2769407 - protein, 6 aa, Entamoeba invadens
NTSSHK

SEQ ID NO: 2769408 - protein, 7 aa, Entamoeba invadens
NTSSTEE

SEQ ID NO: 2769409 - protein, 10 aa, Entamoeba invadens
NTSSYTLDGS

SEQ ID NO: 2769410 - protein, 7 aa, Entamoeba invadens
NTSTCNG

SEQ ID NO: 2769411 - protein, 5 aa, Entamoeba invadens
NTSTE

SEQ ID NO: 2769412 - protein, 9 aa, Entamoeba invadens
NTSTREKND

SEQ ID NO: 2769413 - protein, 5 aa, Entamoeba invadens
NTSTV

SEQ ID NO: 2769414 - protein, 16 aa, Entamoeba invadens
NTSVADQGSTIKGPFG

SEQ ID NO: 2769415 - protein, 9 aa, Entamoeba invadens
NTSVSPETR

SEQ ID NO: 2769416 - protein, 14 aa, Entamoeba invadens
NTTCGGKCEGNTGY

SEQ ID NO: 2769417 - protein, 11 aa, Entamoeba invadens
NTTCSDTFDDD

SEQ ID NO: 2769418 - protein, 4 aa, Entamoeba invadens
NTTD

SEQ ID NO: 2769419 - protein, 5 aa, Entamoeba invadens
NTTDK

SEQ ID NO: 2769420 - protein, 5 aa, Entamoeba invadens
NTTDR

SEQ ID NO: 2769421 - protein, 16 aa, Entamoeba invadens
NTTECEKCTAPQNRNG

SEQ ID NO: 2769422 - protein, 5 aa, Entamoeba invadens
NTTED

SEQ ID NO: 2769423 - protein, 6 aa, Entamoeba invadens
NTTEEL

SEQ ID NO: 2769424 - protein, 8 aa, Entamoeba invadens
NTTEGKSG

SEQ ID NO: 2769425 - protein, 6 aa, Entamoeba invadens
NTTEGQ

SEQ ID NO: 2769426 - protein, 7 aa, Entamoeba invadens
NTTENGQ

SEQ ID NO: 2769427 - protein, 17 aa, Entamoeba invadens
NTTEPYKTLKDKDKARE

SEQ ID NO: 2769428 - protein, 6 aa, Entamoeba invadens
NTTEQN

SEQ ID NO: 2769429 - protein, 11 aa, Entamoeba invadens
NTTEYNSKPIT

SEQ ID NO: 2769430 - protein, 4 aa, Entamoeba invadens
NTTF

SEQ ID NO: 2769431 - protein, 5 aa, Entamoeba invadens
NTTFK

SEQ ID NO: 2769432 - protein, 17 aa, Entamoeba invadens
NTTHFNKETLKSDVNDA

SEQ ID NO: 2769433 - protein, 15 aa, Entamoeba invadens
NTTHFNSETLKSDLN

SEQ ID NO: 2769434 - protein, 16 aa, Entamoeba invadens
NTTHFNSETLKSDLND

SEQ ID NO: 2769435 - protein, 5 aa, Entamoeba invadens
NTTHQ

SEQ ID NO: 2769436 - protein, 13 aa, Entamoeba invadens
NTTIISQKETDEM

SEQ ID NO: 2769437 - protein, 14 aa, Entamoeba invadens
NTTIISQKETDEMA

SEQ ID NO: 2769438 - protein, 6 aa, Entamoeba invadens
NTTKHN

SEQ ID NO: 2769439 - protein, 22 aa, Entamoeba invadens
NTTKNETVDVTQNSIQSNTDKK

SEQ ID NO: 2769440 - protein, 9 aa, Entamoeba invadens
NTTKPSDEV

SEQ ID NO: 2769441 - protein, 20 aa, Entamoeba invadens
NTTKSTSPTNSEQIQNNSYK

SEQ ID NO: 2769442 - protein, 24 aa, Entamoeba invadens
NTTKTLEENRKKIYDKTDKVSRSM

SEQ ID NO: 2769443 - protein, 15 aa, Entamoeba invadens
NTTLDNAIEDYVAHK

SEQ ID NO: 2769444 - protein, 5 aa, Entamoeba invadens
NTTLG

SEQ ID NO: 2769445 - protein, 6 aa, Entamoeba invadens
NTTLPQ

SEQ ID NO: 2769446 - protein, 6 aa, Entamoeba invadens
NTTLQD

SEQ ID NO: 2769447 - protein, 6 aa, Entamoeba invadens
NTTLRG

SEQ ID NO: 2769448 - protein, 7 aa, Entamoeba invadens
NTTMTEN

SEQ ID NO: 2769449 - protein, 5 aa, Entamoeba invadens
NTTNG

SEQ ID NO: 2769450 - protein, 24 aa, Entamoeba invadens
NTTNKKCQQCDNKTYQSNEGQTYC

SEQ ID NO: 2769451 - protein, 7 aa, Entamoeba invadens
NTTNLPK

SEQ ID NO: 2769452 - protein, 8 aa, Entamoeba invadens
NTTNNDVP

SEQ ID NO: 2769453 - protein, 7 aa, Entamoeba invadens
NTTNVDQ

SEQ ID NO: 2769454 - protein, 5 aa, Entamoeba invadens
NTTNY

SEQ ID NO: 2769455 - protein, 5 aa, Entamoeba invadens
NTTPH

SEQ ID NO: 2769456 - protein, 9 aa, Entamoeba invadens
NTTPQTPRI

SEQ ID NO: 2769457 - protein, 7 aa, Entamoeba invadens
NTTPSRV

SEQ ID NO: 2769458 - protein, 5 aa, Entamoeba invadens
NTTQE

SEQ ID NO: 2769459 - protein, 5 aa, Entamoeba invadens
NTTQN

SEQ ID NO: 2769460 - protein, 17 aa, Entamoeba invadens
NTTQSDKCTKLTQEGDR

SEQ ID NO: 2769461 - protein, 4 aa, Entamoeba invadens
NTTR

SEQ ID NO: 2769462 - protein, 10 aa, Entamoeba invadens
NTTSEEMTES

SEQ ID NO: 2769463 - protein, 9 aa, Entamoeba invadens
NTTSESETF

SEQ ID NO: 2769464 - protein, 7 aa, Entamoeba invadens
NTTSTFQ

SEQ ID NO: 2769465 - protein, 4 aa, Entamoeba invadens
NTTT

SEQ ID NO: 2769466 - protein, 5 aa, Entamoeba invadens
NTTTC

SEQ ID NO: 2769467 - protein, 8 aa, Entamoeba invadens
NTTTDGKE

SEQ ID NO: 2769468 - protein, 14 aa, Entamoeba invadens
NTTTVNGSGTNANY

SEQ ID NO: 2769469 - protein, 6 aa, Entamoeba invadens
NTTVSA

SEQ ID NO: 2769470 - protein, 4 aa, Entamoeba invadens
NTTY

SEQ ID NO: 2769471 - protein, 6 aa, Entamoeba invadens
NTTYKT

SEQ ID NO: 2769472 - protein, 5 aa, Entamoeba invadens
NTTYY

SEQ ID NO: 2769473 - protein, 8 aa, Entamoeba invadens
NTVDPQNV

SEQ ID NO: 2769474 - protein, 6 aa, Entamoeba invadens
NTVGTL

SEQ ID NO: 2769475 - protein, 4 aa, Entamoeba invadens
NTVN

SEQ ID NO: 2769476 - protein, 5 aa, Entamoeba invadens
NTVNI

SEQ ID NO: 2769477 - protein, 8 aa, Entamoeba invadens
NTVNPQEK

SEQ ID NO: 2769478 - protein, 4 aa, Entamoeba invadens
NTVQ

SEQ ID NO: 2769479 - protein, 7 aa, Entamoeba invadens
NTVRSGM

SEQ ID NO: 2769480 - protein, 12 aa, Entamoeba invadens
NTVSGSEKITSF

SEQ ID NO: 2769481 - protein, 7 aa, Entamoeba invadens
NTVSGYQ

SEQ ID NO: 2769482 - protein, 4 aa, Entamoeba invadens
NTVT

SEQ ID NO: 2769483 - protein, 8 aa, Entamoeba invadens
NTVTTGIQ

SEQ ID NO: 2769484 - protein, 5 aa, Entamoeba invadens
NTWNN

SEQ ID NO: 2769485 - protein, 6 aa, Entamoeba invadens
NTYCKA

SEQ ID NO: 2769486 - protein, 4 aa, Entamoeba invadens
NTYD

SEQ ID NO: 2769487 - protein, 7 aa, Entamoeba invadens
NTYEDQG

SEQ ID NO: 2769488 - protein, 4 aa, Entamoeba invadens
NTYF

SEQ ID NO: 2769489 - protein, 4 aa, Entamoeba invadens
NTYL

SEQ ID NO: 2769490 - protein, 5 aa, Entamoeba invadens
NTYNT

SEQ ID NO: 2769491 - protein, 10 aa, Entamoeba invadens
NTYSHEGSSQ

SEQ ID NO: 2769492 - protein, 10 aa, Entamoeba invadens
NTYSHGNSSQ

SEQ ID NO: 2769493 - protein, 9 aa, Entamoeba invadens
NTYSKDKED

SEQ ID NO: 2769494 - protein, 25 aa, Entamoeba invadens
NTYSSFKAAKSCTACPSGTISSRGA

SEQ ID NO: 2769495 - protein, 15 aa, Entamoeba invadens
NVADKTVDESASEEV

SEQ ID NO: 2769496 - protein, 18 aa, Entamoeba invadens
NVALETGNNYSRLEEVAM

SEQ ID NO: 2769497 - protein, 6 aa, Entamoeba invadens
NVCEKD

SEQ ID NO: 2769498 - protein, 13 aa, Entamoeba invadens
NVDAEGKCQTTEI

SEQ ID NO: 2769499 - protein, 4 aa, Entamoeba invadens
NVDG

SEQ ID NO: 2769500 - protein, 9 aa, Entamoeba invadens
NVDQNEKKI

SEQ ID NO: 2769501 - protein, 10 aa, Entamoeba invadens
NVDTDVIEGT

SEQ ID NO: 2769502 - protein, 10 aa, Entamoeba invadens
NVDTKEKTKQ

SEQ ID NO: 2769503 - protein, 7 aa, Entamoeba invadens
NVEGQTT

SEQ ID NO: 2769504 - protein, 13 aa, Entamoeba invadens
NVEIGTKPYYEEN

SEQ ID NO: 2769505 - protein, 4 aa, Entamoeba invadens
NVEN

SEQ ID NO: 2769506 - protein, 9 aa, Entamoeba invadens
NVENGKSKI

SEQ ID NO: 2769507 - protein, 6 aa, Entamoeba invadens
NVEPQM

SEQ ID NO: 2769508 - protein, 12 aa, Entamoeba invadens
NVEQITKRTPHI

SEQ ID NO: 2769509 - protein, 13 aa, Entamoeba invadens
NVERKSGKYVRED

SEQ ID NO: 2769510 - protein, 5 aa, Entamoeba invadens
NVESS

SEQ ID NO: 2769511 - protein, 11 aa, Entamoeba invadens
NVGKATSDRGV

SEQ ID NO: 2769512 - protein, 7 aa, Entamoeba invadens
NVGTPKY

SEQ ID NO: 2769513 - protein, 6 aa, Entamoeba invadens
NVGTPT

SEQ ID NO: 2769514 - protein, 17 aa, Entamoeba invadens
NVGTSASTLTLKSSTRG

SEQ ID NO: 2769515 - protein, 13 aa, Entamoeba invadens
NVGVKSPSGRFSY

SEQ ID NO: 2769516 - protein, 6 aa, Entamoeba invadens
NVHTNE

SEQ ID NO: 2769517 - protein, 10 aa, Entamoeba invadens
NVIPPNTKKS

SEQ ID NO: 2769518 - protein, 4 aa, Entamoeba invadens
NVKA

SEQ ID NO: 2769519 - protein, 15 aa, Entamoeba invadens
NVKANAKLTDFGSSR

SEQ ID NO: 2769520 - protein, 6 aa, Entamoeba invadens
NVKDKS

SEQ ID NO: 2769521 - protein, 16 aa, Entamoeba invadens
NVKEEEIKEAIESNDN

SEQ ID NO: 2769522 - protein, 7 aa, Entamoeba invadens
NVKESKC

SEQ ID NO: 2769523 - protein, 4 aa, Entamoeba invadens
NVKK

SEQ ID NO: 2769524 - protein, 13 aa, Entamoeba invadens
NVKNGKFQNTESV

SEQ ID NO: 2769525 - protein, 8 aa, Entamoeba invadens
NVKNTRKP

SEQ ID NO: 2769526 - protein, 5 aa, Entamoeba invadens
NVKRD

SEQ ID NO: 2769527 - protein, 10 aa, Entamoeba invadens
NVKSETSSDF

SEQ ID NO: 2769528 - protein, 5 aa, Entamoeba invadens
NVKSS

SEQ ID NO: 2769529 - protein, 59 aa, Entamoeba invadens
NVKTETEKELKNKNKELNDVNDKIKDMNENHENEIEKNNKEKEDAQKKVEELTTKNAEL

SEQ ID NO: 2769530 - protein, 7 aa, Entamoeba invadens
NVKTEVK

SEQ ID NO: 2769531 - protein, 6 aa, Entamoeba invadens
NVKTSV

SEQ ID NO: 2769532 - protein, 5 aa, Entamoeba invadens
NVKTV

SEQ ID NO: 2769533 - protein, 6 aa, Entamoeba invadens
NVNGRD

SEQ ID NO: 2769534 - protein, 7 aa, Entamoeba invadens
NVNPNAT

SEQ ID NO: 2769535 - protein, 11 aa, Entamoeba invadens
NVNQSVPETEV

SEQ ID NO: 2769536 - protein, 8 aa, Entamoeba invadens
NVNSDNVK

SEQ ID NO: 2769537 - protein, 6 aa, Entamoeba invadens
NVNSRG

SEQ ID NO: 2769538 - protein, 8 aa, Entamoeba invadens
NVNTNSKR

SEQ ID NO: 2769539 - protein, 5 aa, Entamoeba invadens
NVPEE

SEQ ID NO: 2769540 - protein, 5 aa, Entamoeba invadens
NVPET

SEQ ID NO: 2769541 - protein, 10 aa, Entamoeba invadens
NVPKKTTKEL

SEQ ID NO: 2769542 - protein, 4 aa, Entamoeba invadens
NVPN

SEQ ID NO: 2769543 - protein, 6 aa, Entamoeba invadens
NVPQDS

SEQ ID NO: 2769544 - protein, 14 aa, Entamoeba invadens
NVPQNVPQQIPQYQ

SEQ ID NO: 2769545 - protein, 4 aa, Entamoeba invadens
NVPS

SEQ ID NO: 2769546 - protein, 4 aa, Entamoeba invadens
NVPT

SEQ ID NO: 2769547 - protein, 10 aa, Entamoeba invadens
NVQEKKCTGI

SEQ ID NO: 2769548 - protein, 8 aa, Entamoeba invadens
NVQFEKSE

SEQ ID NO: 2769549 - protein, 9 aa, Entamoeba invadens
NVQNAGDAK

SEQ ID NO: 2769550 - protein, 5 aa, Entamoeba invadens
NVQNG

SEQ ID NO: 2769551 - protein, 6 aa, Entamoeba invadens
NVQSKG

SEQ ID NO: 2769552 - protein, 8 aa, Entamoeba invadens
NVQTTKQQ

SEQ ID NO: 2769553 - protein, 5 aa, Entamoeba invadens
NVRPF

SEQ ID NO: 2769554 - protein, 7 aa, Entamoeba invadens
NVSESKT

SEQ ID NO: 2769555 - protein, 14 aa, Entamoeba invadens
NVSESVDDTSDDYF

SEQ ID NO: 2769556 - protein, 9 aa, Entamoeba invadens
NVSETDPNF

SEQ ID NO: 2769557 - protein, 7 aa, Entamoeba invadens
NVSETKA

SEQ ID NO: 2769558 - protein, 20 aa, Entamoeba invadens
NVSGTKPAEVKEEKKSVEVV

SEQ ID NO: 2769559 - protein, 7 aa, Entamoeba invadens
NVSNNGI

SEQ ID NO: 2769560 - protein, 8 aa, Entamoeba invadens
NVSPDDGL

SEQ ID NO: 2769561 - protein, 7 aa, Entamoeba invadens
NVSQSVE

SEQ ID NO: 2769562 - protein, 9 aa, Entamoeba invadens
NVSQSYQND

SEQ ID NO: 2769563 - protein, 6 aa, Entamoeba invadens
NVSRGI

SEQ ID NO: 2769564 - protein, 6 aa, Entamoeba invadens
NVSTDY

SEQ ID NO: 2769565 - protein, 12 aa, Entamoeba invadens
NVSTQKDKISPK

SEQ ID NO: 2769566 - protein, 8 aa, Entamoeba invadens
NVSTTSAT

SEQ ID NO: 2769567 - protein, 17 aa, Entamoeba invadens
NVTANGKLTDFGSSRNI

SEQ ID NO: 2769568 - protein, 9 aa, Entamoeba invadens
NVTDGTNKQ

SEQ ID NO: 2769569 - protein, 5 aa, Entamoeba invadens
NVTDI

SEQ ID NO: 2769570 - protein, 6 aa, Entamoeba invadens
NVTDNT

SEQ ID NO: 2769571 - protein, 6 aa, Entamoeba invadens
NVTGRA

SEQ ID NO: 2769572 - protein, 5 aa, Entamoeba invadens
NVTMK

SEQ ID NO: 2769573 - protein, 11 aa, Entamoeba invadens
NVTNKSPKFAV

SEQ ID NO: 2769574 - protein, 11 aa, Entamoeba invadens
NVTNYKKQNNS

SEQ ID NO: 2769575 - protein, 6 aa, Entamoeba invadens
NVTPFE

SEQ ID NO: 2769576 - protein, 4 aa, Entamoeba invadens
NVTQ

SEQ ID NO: 2769577 - protein, 10 aa, Entamoeba invadens
NVTQYKDSEK

SEQ ID NO: 2769578 - protein, 9 aa, Entamoeba invadens
NVTRTGKYQ

SEQ ID NO: 2769579 - protein, 6 aa, Entamoeba invadens
NVTSKS

SEQ ID NO: 2769580 - protein, 10 aa, Entamoeba invadens
NVTSSGCSKC

SEQ ID NO: 2769581 - protein, 5 aa, Entamoeba invadens
NVTST

SEQ ID NO: 2769582 - protein, 5 aa, Entamoeba invadens
NVTTP

SEQ ID NO: 2769583 - protein, 11 aa, Entamoeba invadens
NVVPKPQTNKT

SEQ ID NO: 2769584 - protein, 12 aa, Entamoeba invadens
NWAEQKERAYNI

SEQ ID NO: 2769585 - protein, 7 aa, Entamoeba invadens
NWAPTNV

SEQ ID NO: 2769586 - protein, 10 aa, Entamoeba invadens
NWENTNAAEP

SEQ ID NO: 2769587 - protein, 8 aa, Entamoeba invadens
NWKGESLQ

SEQ ID NO: 2769588 - protein, 4 aa, Entamoeba invadens
NWNA

SEQ ID NO: 2769589 - protein, 5 aa, Entamoeba invadens
NWSGE

SEQ ID NO: 2769590 - protein, 13 aa, Entamoeba invadens
NWSKDVTSEFYNN

SEQ ID NO: 2769591 - protein, 21 aa, Entamoeba invadens
NWSLSSSATVHTTDKKDGLQS

SEQ ID NO: 2769592 - protein, 5 aa, Entamoeba invadens
NWSND

SEQ ID NO: 2769593 - protein, 5 aa, Entamoeba invadens
NYAAA

SEQ ID NO: 2769594 - protein, 8 aa, Entamoeba invadens
NYAGSDCG

SEQ ID NO: 2769595 - protein, 19 aa, Entamoeba invadens
NYAKENNVAELTEKAQNIE

SEQ ID NO: 2769596 - protein, 11 aa, Entamoeba invadens
NYDDNNSLTEF

SEQ ID NO: 2769597 - protein, 9 aa, Entamoeba invadens
NYDDVGSVD

SEQ ID NO: 2769598 - protein, 16 aa, Entamoeba invadens
NYDENGCEKCESGFYT

SEQ ID NO: 2769599 - protein, 10 aa, Entamoeba invadens
NYDENGGFYT

SEQ ID NO: 2769600 - protein, 10 aa, Entamoeba invadens
NYDGTQSPFS

SEQ ID NO: 2769601 - protein, 6 aa, Entamoeba invadens
NYDQYN

SEQ ID NO: 2769602 - protein, 15 aa, Entamoeba invadens
NYDRPNLTDDKEERL

SEQ ID NO: 2769603 - protein, 8 aa, Entamoeba invadens
NYEDRPNF

SEQ ID NO: 2769604 - protein, 16 aa, Entamoeba invadens
NYEDVPSTWPSSGTIE

SEQ ID NO: 2769605 - protein, 14 aa, Entamoeba invadens
NYEEEKKKDANKLD

SEQ ID NO: 2769606 - protein, 11 aa, Entamoeba invadens
NYEEGSCQSCE

SEQ ID NO: 2769607 - protein, 5 aa, Entamoeba invadens
NYEEI

SEQ ID NO: 2769608 - protein, 6 aa, Entamoeba invadens
NYEEVN

SEQ ID NO: 2769609 - protein, 6 aa, Entamoeba invadens
NYERPT

SEQ ID NO: 2769610 - protein, 5 aa, Entamoeba invadens
NYESD

SEQ ID NO: 2769611 - protein, 8 aa, Entamoeba invadens
NYESPSED

SEQ ID NO: 2769612 - protein, 4 aa, Entamoeba invadens
NYEV

SEQ ID NO: 2769613 - protein, 5 aa, Entamoeba invadens
NYEYN

SEQ ID NO: 2769614 - protein, 10 aa, Entamoeba invadens
NYFNTTTQQC

SEQ ID NO: 2769615 - protein, 6 aa, Entamoeba invadens
NYFTEG

SEQ ID NO: 2769616 - protein, 9 aa, Entamoeba invadens
NYGDPNRGG

SEQ ID NO: 2769617 - protein, 7 aa, Entamoeba invadens
NYGINSE

SEQ ID NO: 2769618 - protein, 7 aa, Entamoeba invadens
NYGPQES

SEQ ID NO: 2769619 - protein, 13 aa, Entamoeba invadens
NYGTTFGKTRTDS

SEQ ID NO: 2769620 - protein, 6 aa, Entamoeba invadens
NYIHNS

SEQ ID NO: 2769621 - protein, 7 aa, Entamoeba invadens
NYKEEYN

SEQ ID NO: 2769622 - protein, 10 aa, Entamoeba invadens
NYKGDKTTRV

SEQ ID NO: 2769623 - protein, 20 aa, Entamoeba invadens
NYKNEKCGETSSTNITPNLP

SEQ ID NO: 2769624 - protein, 11 aa, Entamoeba invadens
NYKTADNDCLP

SEQ ID NO: 2769625 - protein, 8 aa, Entamoeba invadens
NYKTNESG

SEQ ID NO: 2769626 - protein, 12 aa, Entamoeba invadens
NYKTNSGDCLPQ

SEQ ID NO: 2769627 - protein, 9 aa, Entamoeba invadens
NYKTQSGKC

SEQ ID NO: 2769628 - protein, 11 aa, Entamoeba invadens
NYKTQSGNCLP

SEQ ID NO: 2769629 - protein, 12 aa, Entamoeba invadens
NYKTQSGNCLPQ

SEQ ID NO: 2769630 - protein, 11 aa, Entamoeba invadens
NYKTSDGDCLP

SEQ ID NO: 2769631 - protein, 14 aa, Entamoeba invadens
NYKTSNGDCLPRSS

SEQ ID NO: 2769632 - protein, 7 aa, Entamoeba invadens
NYKTSSG

SEQ ID NO: 2769633 - protein, 15 aa, Entamoeba invadens
NYKTTSGDCLPQSSI

SEQ ID NO: 2769634 - protein, 4 aa, Entamoeba invadens
NYKV

SEQ ID NO: 2769635 - protein, 8 aa, Entamoeba invadens
NYLDDSKN

SEQ ID NO: 2769636 - protein, 13 aa, Entamoeba invadens
NYLDTDKTCKTCD

SEQ ID NO: 2769637 - protein, 13 aa, Entamoeba invadens
NYLENGKCHPNDI

SEQ ID NO: 2769638 - protein, 8 aa, Entamoeba invadens
NYLNGSNS

SEQ ID NO: 2769639 - protein, 10 aa, Entamoeba invadens
NYLNSDYPSI

SEQ ID NO: 2769640 - protein, 8 aa, Entamoeba invadens
NYLTTDGG

SEQ ID NO: 2769641 - protein, 4 aa, Entamoeba invadens
NYME

SEQ ID NO: 2769642 - protein, 13 aa, Entamoeba invadens
NYNDPSQESSDEI

SEQ ID NO: 2769643 - protein, 7 aa, Entamoeba invadens
NYNEGFS

SEQ ID NO: 2769644 - protein, 4 aa, Entamoeba invadens
NYNI

SEQ ID NO: 2769645 - protein, 6 aa, Entamoeba invadens
NYNSLT

SEQ ID NO: 2769646 - protein, 10 aa, Entamoeba invadens
NYNYSKNSNS

SEQ ID NO: 2769647 - protein, 4 aa, Entamoeba invadens
NYPC

SEQ ID NO: 2769648 - protein, 10 aa, Entamoeba invadens
NYPEEGKASK

SEQ ID NO: 2769649 - protein, 6 aa, Entamoeba invadens
NYPETL

SEQ ID NO: 2769650 - protein, 6 aa, Entamoeba invadens
NYPPEV

SEQ ID NO: 2769651 - protein, 8 aa, Entamoeba invadens
NYPQPNGM

SEQ ID NO: 2769652 - protein, 10 aa, Entamoeba invadens
NYPTECTTGI

SEQ ID NO: 2769653 - protein, 6 aa, Entamoeba invadens
NYPVKK

SEQ ID NO: 2769654 - protein, 60 aa, Entamoeba invadens
NYQDEKGKTTCKKCDSSCSTCDKTNGKCTNCKAGYGFNKTEGSCTTCTPKTYSTGNTSEC

SEQ ID NO: 2769655 - protein, 60 aa, Entamoeba invadens
NYQDEKGKTTCKKCNSSCSTCDKTNGKCTNCKAGDGFNKTEGSCTTCTPKTYSTGNTSEC

SEQ ID NO: 2769656 - protein, 27 aa, Entamoeba invadens
NYQKTTSNQCEVKPTTCPSGQYGTAPN

SEQ ID NO: 2769657 - protein, 17 aa, Entamoeba invadens
NYQSSSQEHAFHSEEQQ

SEQ ID NO: 2769658 - protein, 17 aa, Entamoeba invadens
NYRDSETECQTNYTTKS

SEQ ID NO: 2769659 - protein, 11 aa, Entamoeba invadens
NYRGDDNVDSG

SEQ ID NO: 2769660 - protein, 5 aa, Entamoeba invadens
NYRGN

SEQ ID NO: 2769661 - protein, 13 aa, Entamoeba invadens
NYRLSDDGNCETT

SEQ ID NO: 2769662 - protein, 6 aa, Entamoeba invadens
NYRPPL

SEQ ID NO: 2769663 - protein, 14 aa, Entamoeba invadens
NYRTSNNKCRPQSD

SEQ ID NO: 2769664 - protein, 10 aa, Entamoeba invadens
NYSDPQNSNF

SEQ ID NO: 2769665 - protein, 7 aa, Entamoeba invadens
NYSEEVP

SEQ ID NO: 2769666 - protein, 7 aa, Entamoeba invadens
NYSGANQ

SEQ ID NO: 2769667 - protein, 5 aa, Entamoeba invadens
NYSGN

SEQ ID NO: 2769668 - protein, 12 aa, Entamoeba invadens
NYSIKNNSNFLG

SEQ ID NO: 2769669 - protein, 6 aa, Entamoeba invadens
NYSINS

SEQ ID NO: 2769670 - protein, 9 aa, Entamoeba invadens
NYSITTSQT

SEQ ID NO: 2769671 - protein, 4 aa, Entamoeba invadens
NYSK

SEQ ID NO: 2769672 - protein, 7 aa, Entamoeba invadens
NYSLSED

SEQ ID NO: 2769673 - protein, 9 aa, Entamoeba invadens
NYSLSGTSL

SEQ ID NO: 2769674 - protein, 8 aa, Entamoeba invadens
NYSNTSCQ

SEQ ID NO: 2769675 - protein, 8 aa, Entamoeba invadens
NYSPKDVG

SEQ ID NO: 2769676 - protein, 6 aa, Entamoeba invadens
NYSQSK

SEQ ID NO: 2769677 - protein, 7 aa, Entamoeba invadens
NYSSNIT

SEQ ID NO: 2769678 - protein, 5 aa, Entamoeba invadens
NYSSY

SEQ ID NO: 2769679 - protein, 7 aa, Entamoeba invadens
NYSTKSD

SEQ ID NO: 2769680 - protein, 6 aa, Entamoeba invadens
NYSTNI

SEQ ID NO: 2769681 - protein, 9 aa, Entamoeba invadens
NYSTSEKKP

SEQ ID NO: 2769682 - protein, 7 aa, Entamoeba invadens
NYSTTLE

SEQ ID NO: 2769683 - protein, 7 aa, Entamoeba invadens
NYSTTSS

SEQ ID NO: 2769684 - protein, 4 aa, Entamoeba invadens
NYTA

SEQ ID NO: 2769685 - protein, 7 aa, Entamoeba invadens
NYTASKF

SEQ ID NO: 2769686 - protein, 8 aa, Entamoeba invadens
NYTGPTIK

SEQ ID NO: 2769687 - protein, 10 aa, Entamoeba invadens
NYTGSNKAKP

SEQ ID NO: 2769688 - protein, 4 aa, Entamoeba invadens
NYTK

SEQ ID NO: 2769689 - protein, 6 aa, Entamoeba invadens
NYTNAD

SEQ ID NO: 2769690 - protein, 11 aa, Entamoeba invadens
NYTNDDKTKVK

SEQ ID NO: 2769691 - protein, 8 aa, Entamoeba invadens
NYTSTTSH

SEQ ID NO: 2769692 - protein, 7 aa, Entamoeba invadens
NYTTPGW

SEQ ID NO: 2769693 - protein, 6 aa, Entamoeba invadens
NYTTPP

SEQ ID NO: 2769694 - protein, 6 aa, Entamoeba invadens
NYTVNT

SEQ ID NO: 2769695 - protein, 4 aa, Entamoeba invadens
NYTY

SEQ ID NO: 2769696 - protein, 5 aa, Entamoeba invadens
NYVGD

SEQ ID NO: 2769697 - protein, 5 aa, Entamoeba invadens
NYYGE

SEQ ID NO: 2769698 - protein, 9 aa, Entamoeba invadens
NYYPDASGR

SEQ ID NO: 2769699 - protein, 6 aa, Entamoeba invadens
NYYPKG

SEQ ID NO: 2769700 - protein, 10 aa, Entamoeba invadens
NYYPNASGKC

SEQ ID NO: 2769701 - protein, 6 aa, Entamoeba invadens
NYYPNS

SEQ ID NO: 2769702 - protein, 7 aa, Entamoeba invadens
NYYPNTQ

SEQ ID NO: 2769703 - protein, 12 aa, Entamoeba invadens
NYYPNTSNDTDV

SEQ ID NO: 2769704 - protein, 6 aa, Entamoeba invadens
NYYPST

SEQ ID NO: 2769705 - protein, 11 aa, Entamoeba invadens
NYYPTKQNNGD

SEQ ID NO: 2769706 - protein, 11 aa, Entamoeba invadens
NYYSSSGSISC

SEQ ID NO: 2769707 - protein, 10 aa, Entamoeba invadens
PAAAGSGVSE

SEQ ID NO: 2769708 - protein, 7 aa, Entamoeba invadens
PAAEQNK

SEQ ID NO: 2769709 - protein, 5 aa, Entamoeba invadens
PAANT

SEQ ID NO: 2769710 - protein, 12 aa, Entamoeba invadens
PAAPTLRGNGMK

SEQ ID NO: 2769711 - protein, 8 aa, Entamoeba invadens
PAASLPSD

SEQ ID NO: 2769712 - protein, 8 aa, Entamoeba invadens
PAATREPK

SEQ ID NO: 2769713 - protein, 27 aa, Entamoeba invadens
PADSSEEGLIKTKGRDGFGPSRRGKGT

SEQ ID NO: 2769714 - protein, 8 aa, Entamoeba invadens
PAECSRTE

SEQ ID NO: 2769715 - protein, 6 aa, Entamoeba invadens
PAERYT

SEQ ID NO: 2769716 - protein, 4 aa, Entamoeba invadens
PAFP

SEQ ID NO: 2769717 - protein, 6 aa, Entamoeba invadens
PAFPKG

SEQ ID NO: 2769718 - protein, 5 aa, Entamoeba invadens
PAGGE

SEQ ID NO: 2769719 - protein, 5 aa, Entamoeba invadens
PAGKK

SEQ ID NO: 2769720 - protein, 6 aa, Entamoeba invadens
PAGKNH

SEQ ID NO: 2769721 - protein, 7 aa, Entamoeba invadens
PAGKQCV

SEQ ID NO: 2769722 - protein, 12 aa, Entamoeba invadens
PAGTHSSKQSTT

SEQ ID NO: 2769723 - protein, 12 aa, Entamoeba invadens
PAGTKPDTSNAT

SEQ ID NO: 2769724 - protein, 12 aa, Entamoeba invadens
PAGTKPNYYNST

SEQ ID NO: 2769725 - protein, 7 aa, Entamoeba invadens
PAHEKNH

SEQ ID NO: 2769726 - protein, 12 aa, Entamoeba invadens
PAHRDSSVNTNP

SEQ ID NO: 2769727 - protein, 5 aa, Entamoeba invadens
PAITQ

SEQ ID NO: 2769728 - protein, 12 aa, Entamoeba invadens
PAKEKEQKPNDK

SEQ ID NO: 2769729 - protein, 19 aa, Entamoeba invadens
PAKKDIQKRKLRSSISDRL

SEQ ID NO: 2769730 - protein, 7 aa, Entamoeba invadens
PAKRPEF

SEQ ID NO: 2769731 - protein, 13 aa, Entamoeba invadens
PAKSSTDANSPMD

SEQ ID NO: 2769732 - protein, 10 aa, Entamoeba invadens
PAKVKSGNEV

SEQ ID NO: 2769733 - protein, 35 aa, Entamoeba invadens
PALGSSNELETDREKVDRKFRENQNVKETVDNIPE

SEQ ID NO: 2769734 - protein, 5 aa, Entamoeba invadens
PALRA

SEQ ID NO: 2769735 - protein, 11 aa, Entamoeba invadens
PANKNPYKNTP

SEQ ID NO: 2769736 - protein, 6 aa, Entamoeba invadens
PANNKR

SEQ ID NO: 2769737 - protein, 6 aa, Entamoeba invadens
PANSSH

SEQ ID NO: 2769738 - protein, 5 aa, Entamoeba invadens
PANTT

SEQ ID NO: 2769739 - protein, 10 aa, Entamoeba invadens
PAPINPSDNS

SEQ ID NO: 2769740 - protein, 7 aa, Entamoeba invadens
PAQGEDH

SEQ ID NO: 2769741 - protein, 8 aa, Entamoeba invadens
PAQGFSGF

SEQ ID NO: 2769742 - protein, 6 aa, Entamoeba invadens
PAQKVS

SEQ ID NO: 2769743 - protein, 4 aa, Entamoeba invadens
PAQR

SEQ ID NO: 2769744 - protein, 26 aa, Entamoeba invadens
PARSNSDAAEKPSKMSSKSSVSPSTL

SEQ ID NO: 2769745 - protein, 8 aa, Entamoeba invadens
PASCKRTE

SEQ ID NO: 2769746 - protein, 9 aa, Entamoeba invadens
PASDPTKYC

SEQ ID NO: 2769747 - protein, 5 aa, Entamoeba invadens
PASDQ

SEQ ID NO: 2769748 - protein, 8 aa, Entamoeba invadens
PATNYDKR

SEQ ID NO: 2769749 - protein, 6 aa, Entamoeba invadens
PATQQT

SEQ ID NO: 2769750 - protein, 15 aa, Entamoeba invadens
PATSSNKFKSATISR

SEQ ID NO: 2769751 - protein, 8 aa, Entamoeba invadens
PATTSPFK

SEQ ID NO: 2769752 - protein, 6 aa, Entamoeba invadens
PAVDSQ

SEQ ID NO: 2769753 - protein, 14 aa, Entamoeba invadens
PAVKPAGKMAGEIA

SEQ ID NO: 2769754 - protein, 5 aa, Entamoeba invadens
PAVRA

SEQ ID NO: 2769755 - protein, 12 aa, Entamoeba invadens
PAVTYSKDNAVL

SEQ ID NO: 2769756 - protein, 16 aa, Entamoeba invadens
PCADGTYASTMGSTSC

SEQ ID NO: 2769757 - protein, 5 aa, Entamoeba invadens
PCDER

SEQ ID NO: 2769758 - protein, 6 aa, Entamoeba invadens
PCDGTD

SEQ ID NO: 2769759 - protein, 7 aa, Entamoeba invadens
PCEECPT

SEQ ID NO: 2769760 - protein, 8 aa, Entamoeba invadens
PCEKTGGK

SEQ ID NO: 2769761 - protein, 11 aa, Entamoeba invadens
PCEKTSGKCDA

SEQ ID NO: 2769762 - protein, 21 aa, Entamoeba invadens
PCENGTHSSTSGSTACTPCQG

SEQ ID NO: 2769763 - protein, 7 aa, Entamoeba invadens
PCEPTGV

SEQ ID NO: 2769764 - protein, 8 aa, Entamoeba invadens
PCERTSGK

SEQ ID NO: 2769765 - protein, 17 aa, Entamoeba invadens
PCGDGTYANTTGSTSCK

SEQ ID NO: 2769766 - protein, 8 aa, Entamoeba invadens
PCGSGNGI

SEQ ID NO: 2769767 - protein, 4 aa, Entamoeba invadens
PCGV

SEQ ID NO: 2769768 - protein, 7 aa, Entamoeba invadens
PCNTDSA

SEQ ID NO: 2769769 - protein, 4 aa, Entamoeba invadens
PCPN

SEQ ID NO: 2769770 - protein, 14 aa, Entamoeba invadens
PCPPGTASSSGAAR

SEQ ID NO: 2769771 - protein, 13 aa, Entamoeba invadens
PCPQGEYNPSTGS

SEQ ID NO: 2769772 - protein, 4 aa, Entamoeba invadens
PCQG

SEQ ID NO: 2769773 - protein, 16 aa, Entamoeba invadens
PCQSGTYSSSSGSMTC

SEQ ID NO: 2769774 - protein, 6 aa, Entamoeba invadens
PCQTTD

SEQ ID NO: 2769775 - protein, 4 aa, Entamoeba invadens
PCSE

SEQ ID NO: 2769776 - protein, 5 aa, Entamoeba invadens
PCSGE

SEQ ID NO: 2769777 - protein, 7 aa, Entamoeba invadens
PCSPANS

SEQ ID NO: 2769778 - protein, 11 aa, Entamoeba invadens
PCSSNCNKCSD

SEQ ID NO: 2769779 - protein, 10 aa, Entamoeba invadens
PCSSSDKNTF

SEQ ID NO: 2769780 - protein, 11 aa, Entamoeba invadens
PCTGDTERVGE

SEQ ID NO: 2769781 - protein, 5 aa, Entamoeba invadens
PCTSS

SEQ ID NO: 2769782 - protein, 8 aa, Entamoeba invadens
PDAHHNSN

SEQ ID NO: 2769783 - protein, 5 aa, Entamoeba invadens
PDAPK

SEQ ID NO: 2769784 - protein, 7 aa, Entamoeba invadens
PDATTEE

SEQ ID NO: 2769785 - protein, 10 aa, Entamoeba invadens
PDDFDADKNL

SEQ ID NO: 2769786 - protein, 8 aa, Entamoeba invadens
PDDGTFNR

SEQ ID NO: 2769787 - protein, 17 aa, Entamoeba invadens
PDDIRGAASSVPSQGGV

SEQ ID NO: 2769788 - protein, 10 aa, Entamoeba invadens
PDDLTDQKLE

SEQ ID NO: 2769789 - protein, 9 aa, Entamoeba invadens
PDDTDAMEE

SEQ ID NO: 2769790 - protein, 7 aa, Entamoeba invadens
PDDTSHT

SEQ ID NO: 2769791 - protein, 7 aa, Entamoeba invadens
PDEASGK

SEQ ID NO: 2769792 - protein, 9 aa, Entamoeba invadens
PDEDFSNEN

SEQ ID NO: 2769793 - protein, 5 aa, Entamoeba invadens
PDEIR

SEQ ID NO: 2769794 - protein, 5 aa, Entamoeba invadens
PDEIS

SEQ ID NO: 2769795 - protein, 5 aa, Entamoeba invadens
PDEIY

SEQ ID NO: 2769796 - protein, 5 aa, Entamoeba invadens
PDELD

SEQ ID NO: 2769797 - protein, 20 aa, Entamoeba invadens
PDENTKSPTAVRGKSNTVLS

SEQ ID NO: 2769798 - protein, 7 aa, Entamoeba invadens
PDEPSAR

SEQ ID NO: 2769799 - protein, 5 aa, Entamoeba invadens
PDFGS

SEQ ID NO: 2769800 - protein, 13 aa, Entamoeba invadens
PDFSTDLDDNVNT

SEQ ID NO: 2769801 - protein, 6 aa, Entamoeba invadens
PDFSYE

SEQ ID NO: 2769802 - protein, 11 aa, Entamoeba invadens
PDGAKYTKCTG

SEQ ID NO: 2769803 - protein, 24 aa, Entamoeba invadens
PDGAVNGNDCTTCATGKYSGDGVT

SEQ ID NO: 2769804 - protein, 11 aa, Entamoeba invadens
PDGCNSNTGNG

SEQ ID NO: 2769805 - protein, 8 aa, Entamoeba invadens
PDGEFDRH

SEQ ID NO: 2769806 - protein, 4 aa, Entamoeba invadens
PDGF

SEQ ID NO: 2769807 - protein, 6 aa, Entamoeba invadens
PDGITS

SEQ ID NO: 2769808 - protein, 14 aa, Entamoeba invadens
PDGLTDEEPNKSRT

SEQ ID NO: 2769809 - protein, 7 aa, Entamoeba invadens
PDGNLGK

SEQ ID NO: 2769810 - protein, 7 aa, Entamoeba invadens
PDGQTAF

SEQ ID NO: 2769811 - protein, 5 aa, Entamoeba invadens
PDGSF

SEQ ID NO: 2769812 - protein, 5 aa, Entamoeba invadens
PDGSL

SEQ ID NO: 2769813 - protein, 6 aa, Entamoeba invadens
PDGSQN

SEQ ID NO: 2769814 - protein, 13 aa, Entamoeba invadens
PDGSYNPSKGSDQ

SEQ ID NO: 2769815 - protein, 17 aa, Entamoeba invadens
PDGTYSLTNSSSCTKCN

SEQ ID NO: 2769816 - protein, 5 aa, Entamoeba invadens
PDGYY

SEQ ID NO: 2769817 - protein, 4 aa, Entamoeba invadens
PDHR

SEQ ID NO: 2769818 - protein, 7 aa, Entamoeba invadens
PDIDENY

SEQ ID NO: 2769819 - protein, 19 aa, Entamoeba invadens
PDIDSKSSAGLKPATCEGN

SEQ ID NO: 2769820 - protein, 14 aa, Entamoeba invadens
PDIDSPEDSNRNMT

SEQ ID NO: 2769821 - protein, 7 aa, Entamoeba invadens
PDIPPNN

SEQ ID NO: 2769822 - protein, 5 aa, Entamoeba invadens
PDIPT

SEQ ID NO: 2769823 - protein, 4 aa, Entamoeba invadens
PDIQ

SEQ ID NO: 2769824 - protein, 9 aa, Entamoeba invadens
PDISGRSED

SEQ ID NO: 2769825 - protein, 10 aa, Entamoeba invadens
PDISKGVQAA

SEQ ID NO: 2769826 - protein, 8 aa, Entamoeba invadens
PDITETTR

SEQ ID NO: 2769827 - protein, 17 aa, Entamoeba invadens
PDKCERCNESMGYTSDC

SEQ ID NO: 2769828 - protein, 8 aa, Entamoeba invadens
PDKDKKVG

SEQ ID NO: 2769829 - protein, 10 aa, Entamoeba invadens
PDKEKEPLKI

SEQ ID NO: 2769830 - protein, 4 aa, Entamoeba invadens
PDKH

SEQ ID NO: 2769831 - protein, 5 aa, Entamoeba invadens
PDKLG

SEQ ID NO: 2769832 - protein, 14 aa, Entamoeba invadens
PDKNHSPNAEGDFN

SEQ ID NO: 2769833 - protein, 8 aa, Entamoeba invadens
PDLDEKQK

SEQ ID NO: 2769834 - protein, 10 aa, Entamoeba invadens
PDLPEGDELP

SEQ ID NO: 2769835 - protein, 8 aa, Entamoeba invadens
PDLSDQDL

SEQ ID NO: 2769836 - protein, 7 aa, Entamoeba invadens
PDMTEDV

SEQ ID NO: 2769837 - protein, 10 aa, Entamoeba invadens
PDNCKRCTST

SEQ ID NO: 2769838 - protein, 17 aa, Entamoeba invadens
PDNDPFETEEFTESSPL

SEQ ID NO: 2769839 - protein, 6 aa, Entamoeba invadens
PDNENQ

SEQ ID NO: 2769840 - protein, 11 aa, Entamoeba invadens
PDNFTQSTNPS

SEQ ID NO: 2769841 - protein, 15 aa, Entamoeba invadens
PDNIETPKSTQTAED

SEQ ID NO: 2769842 - protein, 5 aa, Entamoeba invadens
PDNLN

SEQ ID NO: 2769843 - protein, 4 aa, Entamoeba invadens
PDNP

SEQ ID NO: 2769844 - protein, 7 aa, Entamoeba invadens
PDNTTSV

SEQ ID NO: 2769845 - protein, 12 aa, Entamoeba invadens
PDNTYSSANSST

SEQ ID NO: 2769846 - protein, 5 aa, Entamoeba invadens
PDNVK

SEQ ID NO: 2769847 - protein, 4 aa, Entamoeba invadens
PDNY

SEQ ID NO: 2769848 - protein, 14 aa, Entamoeba invadens
PDPDNTGSCKGSNY

SEQ ID NO: 2769849 - protein, 4 aa, Entamoeba invadens
PDPL

SEQ ID NO: 2769850 - protein, 9 aa, Entamoeba invadens
PDPPQKAAN

SEQ ID NO: 2769851 - protein, 8 aa, Entamoeba invadens
PDPQSPLA

SEQ ID NO: 2769852 - protein, 13 aa, Entamoeba invadens
PDPSGRKSTVNTN

SEQ ID NO: 2769853 - protein, 7 aa, Entamoeba invadens
PDPTDPL

SEQ ID NO: 2769854 - protein, 5 aa, Entamoeba invadens
PDPVS

SEQ ID NO: 2769855 - protein, 11 aa, Entamoeba invadens
PDQLNVQDSNL

SEQ ID NO: 2769856 - protein, 10 aa, Entamoeba invadens
PDQNQFTENT

SEQ ID NO: 2769857 - protein, 7 aa, Entamoeba invadens
PDQTYSF

SEQ ID NO: 2769858 - protein, 6 aa, Entamoeba invadens
PDQYKN

SEQ ID NO: 2769859 - protein, 11 aa, Entamoeba invadens
PDRCVDKSGKW

SEQ ID NO: 2769860 - protein, 6 aa, Entamoeba invadens
PDRGNL

SEQ ID NO: 2769861 - protein, 9 aa, Entamoeba invadens
PDRNGSYCE

SEQ ID NO: 2769862 - protein, 14 aa, Entamoeba invadens
PDRYEAYKNSCDEC

SEQ ID NO: 2769863 - protein, 8 aa, Entamoeba invadens
PDSCAETE

SEQ ID NO: 2769864 - protein, 4 aa, Entamoeba invadens
PDSF

SEQ ID NO: 2769865 - protein, 9 aa, Entamoeba invadens
PDSLKGKKI

SEQ ID NO: 2769866 - protein, 4 aa, Entamoeba invadens
PDSS

SEQ ID NO: 2769867 - protein, 4 aa, Entamoeba invadens
PDST

SEQ ID NO: 2769868 - protein, 8 aa, Entamoeba invadens
PDSTLASP

SEQ ID NO: 2769869 - protein, 5 aa, Entamoeba invadens
PDSVE

SEQ ID NO: 2769870 - protein, 7 aa, Entamoeba invadens
PDTAGTD

SEQ ID NO: 2769871 - protein, 8 aa, Entamoeba invadens
PDTNEKFQ

SEQ ID NO: 2769872 - protein, 7 aa, Entamoeba invadens
PDTPDMA

SEQ ID NO: 2769873 - protein, 5 aa, Entamoeba invadens
PDTPQ

SEQ ID NO: 2769874 - protein, 21 aa, Entamoeba invadens
PDTRFGTTSLKSGDNSAGCVC

SEQ ID NO: 2769875 - protein, 11 aa, Entamoeba invadens
PDTTEIGSTSV

SEQ ID NO: 2769876 - protein, 14 aa, Entamoeba invadens
PDVAPAAKLAGEFT

SEQ ID NO: 2769877 - protein, 6 aa, Entamoeba invadens
PDVDAA

SEQ ID NO: 2769878 - protein, 10 aa, Entamoeba invadens
PDVDCKKKPE

SEQ ID NO: 2769879 - protein, 10 aa, Entamoeba invadens
PDVKSSSCDF

SEQ ID NO: 2769880 - protein, 6 aa, Entamoeba invadens
PDVQQQ

SEQ ID NO: 2769881 - protein, 24 aa, Entamoeba invadens
PDVSNGKCKSCDASCGGSCDTTNG

SEQ ID NO: 2769882 - protein, 7 aa, Entamoeba invadens
PDYAPTV

SEQ ID NO: 2769883 - protein, 8 aa, Entamoeba invadens
PDYEKDGY

SEQ ID NO: 2769884 - protein, 6 aa, Entamoeba invadens
PDYSEG

SEQ ID NO: 2769885 - protein, 7 aa, Entamoeba invadens
PDYTNTI

SEQ ID NO: 2769886 - protein, 7 aa, Entamoeba invadens
PDYTSSD

SEQ ID NO: 2769887 - protein, 4 aa, Entamoeba invadens
PEAF

SEQ ID NO: 2769888 - protein, 10 aa, Entamoeba invadens
PEAKKLADEG

SEQ ID NO: 2769889 - protein, 4 aa, Entamoeba invadens
PEAV

SEQ ID NO: 2769890 - protein, 7 aa, Entamoeba invadens
PEDANDI

SEQ ID NO: 2769891 - protein, 17 aa, Entamoeba invadens
PEDATEKQKKRNEEAQL

SEQ ID NO: 2769892 - protein, 20 aa, Entamoeba invadens
PEDEKEEQNVSYTKNEISSL

SEQ ID NO: 2769893 - protein, 10 aa, Entamoeba invadens
PEDPTIQDLE

SEQ ID NO: 2769894 - protein, 5 aa, Entamoeba invadens
PEDRP

SEQ ID NO: 2769895 - protein, 4 aa, Entamoeba invadens
PEDY

SEQ ID NO: 2769896 - protein, 5 aa, Entamoeba invadens
PEEDM

SEQ ID NO: 2769897 - protein, 4 aa, Entamoeba invadens
PEEE

SEQ ID NO: 2769898 - protein, 10 aa, Entamoeba invadens
PEEEAQRMQS

SEQ ID NO: 2769899 - protein, 9 aa, Entamoeba invadens
PEEESDIGE

SEQ ID NO: 2769900 - protein, 5 aa, Entamoeba invadens
PEEET

SEQ ID NO: 2769901 - protein, 13 aa, Entamoeba invadens
PEEGEKEYTNGNP

SEQ ID NO: 2769902 - protein, 5 aa, Entamoeba invadens
PEEKG

SEQ ID NO: 2769903 - protein, 23 aa, Entamoeba invadens
PEEKKKDNEQPKKQPKKKKEKII

SEQ ID NO: 2769904 - protein, 5 aa, Entamoeba invadens
PEEKS

SEQ ID NO: 2769905 - protein, 17 aa, Entamoeba invadens
PEEKTRENGKRSDQEGA

SEQ ID NO: 2769906 - protein, 5 aa, Entamoeba invadens
PEELG

SEQ ID NO: 2769907 - protein, 7 aa, Entamoeba invadens
PEELQGK

SEQ ID NO: 2769908 - protein, 15 aa, Entamoeba invadens
PEFDSTKNSNGTDIT

SEQ ID NO: 2769909 - protein, 4 aa, Entamoeba invadens
PEGA

SEQ ID NO: 2769910 - protein, 7 aa, Entamoeba invadens
PEGITDN

SEQ ID NO: 2769911 - protein, 12 aa, Entamoeba invadens
PEGYMTDKTNNK

SEQ ID NO: 2769912 - protein, 12 aa, Entamoeba invadens
PEGYMTDKTTNK

SEQ ID NO: 2769913 - protein, 22 aa, Entamoeba invadens
PEGYNTEVGERGGQLSGGQKQR

SEQ ID NO: 2769914 - protein, 30 aa, Entamoeba invadens
PEIAQPNSQQNSEHASCKNSNDNSNDTEDL

SEQ ID NO: 2769915 - protein, 7 aa, Entamoeba invadens
PEIASGD

SEQ ID NO: 2769916 - protein, 13 aa, Entamoeba invadens
PEIDGTDLKNNTL

SEQ ID NO: 2769917 - protein, 9 aa, Entamoeba invadens
PEIKNSSHT

SEQ ID NO: 2769918 - protein, 5 aa, Entamoeba invadens
PEIKQ

SEQ ID NO: 2769919 - protein, 8 aa, Entamoeba invadens
PEITKSVY

SEQ ID NO: 2769920 - protein, 35 aa, Entamoeba invadens
PEITPNVNSEDLKQQSASQSEENSPQTVSSNNSIE

SEQ ID NO: 2769921 - protein, 21 aa, Entamoeba invadens
PEKAPYYGKNQNRGCTPDRGA

SEQ ID NO: 2769922 - protein, 6 aa, Entamoeba invadens
PEKEKV

SEQ ID NO: 2769923 - protein, 5 aa, Entamoeba invadens
PEKGV

SEQ ID NO: 2769924 - protein, 6 aa, Entamoeba invadens
PEKLSD

SEQ ID NO: 2769925 - protein, 12 aa, Entamoeba invadens
PEKMPFEKGFGG

SEQ ID NO: 2769926 - protein, 5 aa, Entamoeba invadens
PEKRY

SEQ ID NO: 2769927 - protein, 5 aa, Entamoeba invadens
PEKSS

SEQ ID NO: 2769928 - protein, 4 aa, Entamoeba invadens
PEKT

SEQ ID NO: 2769929 - protein, 12 aa, Entamoeba invadens
PEKTSSSNEKYR

SEQ ID NO: 2769930 - protein, 7 aa, Entamoeba invadens
PELNAQK

SEQ ID NO: 2769931 - protein, 6 aa, Entamoeba invadens
PELNNP

SEQ ID NO: 2769932 - protein, 23 aa, Entamoeba invadens
PELPTTPEDPSNPPINDQSDATY

SEQ ID NO: 2769933 - protein, 5 aa, Entamoeba invadens
PENNG

SEQ ID NO: 2769934 - protein, 4 aa, Entamoeba invadens
PENP

SEQ ID NO: 2769935 - protein, 7 aa, Entamoeba invadens
PENPKTL

SEQ ID NO: 2769936 - protein, 18 aa, Entamoeba invadens
PENQIPAKEELQKYTASS

SEQ ID NO: 2769937 - protein, 9 aa, Entamoeba invadens
PENRKNASA

SEQ ID NO: 2769938 - protein, 8 aa, Entamoeba invadens
PENSETAE

SEQ ID NO: 2769939 - protein, 16 aa, Entamoeba invadens
PENSQFTTDSTPRTFQ

SEQ ID NO: 2769940 - protein, 10 aa, Entamoeba invadens
PENTNPKTIT

SEQ ID NO: 2769941 - protein, 5 aa, Entamoeba invadens
PENTP

SEQ ID NO: 2769942 - protein, 7 aa, Entamoeba invadens
PENTTYE

SEQ ID NO: 2769943 - protein, 11 aa, Entamoeba invadens
PENVPEKDGEV

SEQ ID NO: 2769944 - protein, 17 aa, Entamoeba invadens
PEPELEDDSIKGVSGDI

SEQ ID NO: 2769945 - protein, 7 aa, Entamoeba invadens
PEPFDTS

SEQ ID NO: 2769946 - protein, 17 aa, Entamoeba invadens
PEPNPSNYDSYESYKSA

SEQ ID NO: 2769947 - protein, 32 aa, Entamoeba invadens
PEPSSEAPKELPNQSDASPLAPPPQSQEPQPQ

SEQ ID NO: 2769948 - protein, 17 aa, Entamoeba invadens
PEPTEKYHDAKLEETVE

SEQ ID NO: 2769949 - protein, 6 aa, Entamoeba invadens
PEQDKI

SEQ ID NO: 2769950 - protein, 15 aa, Entamoeba invadens
PEQNKEDTNQVESQT

SEQ ID NO: 2769951 - protein, 8 aa, Entamoeba invadens
PEQNPIQN

SEQ ID NO: 2769952 - protein, 16 aa, Entamoeba invadens
PEQSSDDSSSSSSSGF

SEQ ID NO: 2769953 - protein, 4 aa, Entamoeba invadens
PERS

SEQ ID NO: 2769954 - protein, 10 aa, Entamoeba invadens
PERYKTTETI

SEQ ID NO: 2769955 - protein, 7 aa, Entamoeba invadens
PESKNGY

SEQ ID NO: 2769956 - protein, 4 aa, Entamoeba invadens
PESR

SEQ ID NO: 2769957 - protein, 8 aa, Entamoeba invadens
PESRRYGK

SEQ ID NO: 2769958 - protein, 4 aa, Entamoeba invadens
PESS

SEQ ID NO: 2769959 - protein, 5 aa, Entamoeba invadens
PESSA

SEQ ID NO: 2769960 - protein, 7 aa, Entamoeba invadens
PESSSAR

SEQ ID NO: 2769961 - protein, 4 aa, Entamoeba invadens
PEST

SEQ ID NO: 2769962 - protein, 4 aa, Entamoeba invadens
PESV

SEQ ID NO: 2769963 - protein, 7 aa, Entamoeba invadens
PESYSDI

SEQ ID NO: 2769964 - protein, 7 aa, Entamoeba invadens
PETCGKE

SEQ ID NO: 2769965 - protein, 9 aa, Entamoeba invadens
PETENKTPF

SEQ ID NO: 2769966 - protein, 7 aa, Entamoeba invadens
PETETHG

SEQ ID NO: 2769967 - protein, 5 aa, Entamoeba invadens
PETFT

SEQ ID NO: 2769968 - protein, 6 aa, Entamoeba invadens
PETFTD

SEQ ID NO: 2769969 - protein, 5 aa, Entamoeba invadens
PETTI

SEQ ID NO: 2769970 - protein, 5 aa, Entamoeba invadens
PETVN

SEQ ID NO: 2769971 - protein, 5 aa, Entamoeba invadens
PEVAN

SEQ ID NO: 2769972 - protein, 10 aa, Entamoeba invadens
PEVPIGDKKY

SEQ ID NO: 2769973 - protein, 9 aa, Entamoeba invadens
PEVQTSTLS

SEQ ID NO: 2769974 - protein, 6 aa, Entamoeba invadens
PEVRNK

SEQ ID NO: 2769975 - protein, 13 aa, Entamoeba invadens
PEVRTTNSPDKTF

SEQ ID NO: 2769976 - protein, 8 aa, Entamoeba invadens
PEVSDGSL

SEQ ID NO: 2769977 - protein, 15 aa, Entamoeba invadens
PEVSPSTPSSITDKP

SEQ ID NO: 2769978 - protein, 8 aa, Entamoeba invadens
PEYNQTSC

SEQ ID NO: 2769979 - protein, 5 aa, Entamoeba invadens
PEYQQ

SEQ ID NO: 2769980 - protein, 6 aa, Entamoeba invadens
PEYQQQ

SEQ ID NO: 2769981 - protein, 21 aa, Entamoeba invadens
PEYTPVAQQPTKSADKEGEAL

SEQ ID NO: 2769982 - protein, 5 aa, Entamoeba invadens
PFERQ

SEQ ID NO: 2769983 - protein, 7 aa, Entamoeba invadens
PFGDTEE

SEQ ID NO: 2769984 - protein, 5 aa, Entamoeba invadens
PFGGK

SEQ ID NO: 2769985 - protein, 5 aa, Entamoeba invadens
PFGPQ

SEQ ID NO: 2769986 - protein, 6 aa, Entamoeba invadens
PFKNEI

SEQ ID NO: 2769987 - protein, 10 aa, Entamoeba invadens
PFKTTQPTNA

SEQ ID NO: 2769988 - protein, 10 aa, Entamoeba invadens
PFNGKKPQIY

SEQ ID NO: 2769989 - protein, 8 aa, Entamoeba invadens
PFNSNNEY

SEQ ID NO: 2769990 - protein, 9 aa, Entamoeba invadens
PFPDQPNSV

SEQ ID NO: 2769991 - protein, 4 aa, Entamoeba invadens
PFPK

SEQ ID NO: 2769992 - protein, 4 aa, Entamoeba invadens
PFPP

SEQ ID NO: 2769993 - protein, 4 aa, Entamoeba invadens
PFPV

SEQ ID NO: 2769994 - protein, 4 aa, Entamoeba invadens
PFRG

SEQ ID NO: 2769995 - protein, 8 aa, Entamoeba invadens
PFSEEPGL

SEQ ID NO: 2769996 - protein, 9 aa, Entamoeba invadens
PFSFKPPEG

SEQ ID NO: 2769997 - protein, 4 aa, Entamoeba invadens
PFTE

SEQ ID NO: 2769998 - protein, 10 aa, Entamoeba invadens
PFTGEEVQVP

SEQ ID NO: 2769999 - protein, 8 aa, Entamoeba invadens
PFTQKSDV

SEQ ID NO: 2770000 - protein, 14 aa, Entamoeba invadens
PFTSQTIPSAWPKT

SEQ ID NO: 2770001 - protein, 19 aa, Entamoeba invadens
PFVPKKKRDEKSEEMSEQA

SEQ ID NO: 2770002 - protein, 8 aa, Entamoeba invadens
PGAQLNGR

SEQ ID NO: 2770003 - protein, 20 aa, Entamoeba invadens
PGAQPDTSSNSSSSGSNDTY

SEQ ID NO: 2770004 - protein, 6 aa, Entamoeba invadens
PGCEPN

SEQ ID NO: 2770005 - protein, 9 aa, Entamoeba invadens
PGCGDSSKK

SEQ ID NO: 2770006 - protein, 6 aa, Entamoeba invadens
PGCQGN

SEQ ID NO: 2770007 - protein, 4 aa, Entamoeba invadens
PGCS

SEQ ID NO: 2770008 - protein, 8 aa, Entamoeba invadens
PGDRPTFD

SEQ ID NO: 2770009 - protein, 4 aa, Entamoeba invadens
PGEI

SEQ ID NO: 2770010 - protein, 7 aa, Entamoeba invadens
PGESRKR

SEQ ID NO: 2770011 - protein, 12 aa, Entamoeba invadens
PGFDRKSKYPEL

SEQ ID NO: 2770012 - protein, 4 aa, Entamoeba invadens
PGFF

SEQ ID NO: 2770013 - protein, 8 aa, Entamoeba invadens
PGFGQNTL

SEQ ID NO: 2770014 - protein, 5 aa, Entamoeba invadens
PGFNN

SEQ ID NO: 2770015 - protein, 4 aa, Entamoeba invadens
PGFT

SEQ ID NO: 2770016 - protein, 8 aa, Entamoeba invadens
PGGMTADQ

SEQ ID NO: 2770017 - protein, 10 aa, Entamoeba invadens
PGGTKDVEQM

SEQ ID NO: 2770018 - protein, 17 aa, Entamoeba invadens
PGKCNTYKERMSTNIGK

SEQ ID NO: 2770019 - protein, 20 aa, Entamoeba invadens
PGKKMTDGTFQSCTESCSAS

SEQ ID NO: 2770020 - protein, 7 aa, Entamoeba invadens
PGKTEYD

SEQ ID NO: 2770021 - protein, 12 aa, Entamoeba invadens
PGKYPNDSNKVC

SEQ ID NO: 2770022 - protein, 12 aa, Entamoeba invadens
PGKYPNDSSKVC

SEQ ID NO: 2770023 - protein, 98 aa, Entamoeba invadens
PGLEQETELGETKNRKETKKEIDGTKAENFASKNEKSKNNGKKPQKKEKTKKPEEVEMEDQSNDKNDSNEKGKDIEKTKKSNSPSSIEDFSDVLEHHV

SEQ ID NO: 2770024 - protein, 10 aa, Entamoeba invadens
PGLPGTAAAR

SEQ ID NO: 2770025 - protein, 14 aa, Entamoeba invadens
PGLPSTDLDGKKDY

SEQ ID NO: 2770026 - protein, 8 aa, Entamoeba invadens
PGNRKPEV

SEQ ID NO: 2770027 - protein, 6 aa, Entamoeba invadens
PGNTQY

SEQ ID NO: 2770028 - protein, 4 aa, Entamoeba invadens
PGNY

SEQ ID NO: 2770029 - protein, 6 aa, Entamoeba invadens
PGPGIV

SEQ ID NO: 2770030 - protein, 4 aa, Entamoeba invadens
PGQE

SEQ ID NO: 2770031 - protein, 8 aa, Entamoeba invadens
PGQTNESK

SEQ ID NO: 2770032 - protein, 14 aa, Entamoeba invadens
PGRASTVRTIRRGT

SEQ ID NO: 2770033 - protein, 5 aa, Entamoeba invadens
PGSGF

SEQ ID NO: 2770034 - protein, 7 aa, Entamoeba invadens
PGSGLPS

SEQ ID NO: 2770035 - protein, 4 aa, Entamoeba invadens
PGSM

SEQ ID NO: 2770036 - protein, 6 aa, Entamoeba invadens
PGSNIS

SEQ ID NO: 2770037 - protein, 12 aa, Entamoeba invadens
PGSNNNGDTTDC

SEQ ID NO: 2770038 - protein, 11 aa, Entamoeba invadens
PGSTKKLDCEG

SEQ ID NO: 2770039 - protein, 5 aa, Entamoeba invadens
PGSTL

SEQ ID NO: 2770040 - protein, 7 aa, Entamoeba invadens
PGSTNHF

SEQ ID NO: 2770041 - protein, 8 aa, Entamoeba invadens
PGSVSRET

SEQ ID NO: 2770042 - protein, 11 aa, Entamoeba invadens
PGSVTAQPETV

SEQ ID NO: 2770043 - protein, 4 aa, Entamoeba invadens
PGTC

SEQ ID NO: 2770044 - protein, 12 aa, Entamoeba invadens
PGTFSTGSVTKC

SEQ ID NO: 2770045 - protein, 4 aa, Entamoeba invadens
PGTS

SEQ ID NO: 2770046 - protein, 10 aa, Entamoeba invadens
PGTSSTSSQL

SEQ ID NO: 2770047 - protein, 7 aa, Entamoeba invadens
PGTSYGV

SEQ ID NO: 2770048 - protein, 6 aa, Entamoeba invadens
PGTTGK

SEQ ID NO: 2770049 - protein, 11 aa, Entamoeba invadens
PGTYSNRLRST

SEQ ID NO: 2770050 - protein, 13 aa, Entamoeba invadens
PGTYTDKAGSSTC

SEQ ID NO: 2770051 - protein, 13 aa, Entamoeba invadens
PGVQPSDDQKKDI

SEQ ID NO: 2770052 - protein, 10 aa, Entamoeba invadens
PGVSEEMKNA

SEQ ID NO: 2770053 - protein, 8 aa, Entamoeba invadens
PGVSSQPS

SEQ ID NO: 2770054 - protein, 10 aa, Entamoeba invadens
PGYFKNGTNC

SEQ ID NO: 2770055 - protein, 6 aa, Entamoeba invadens
PGYGGD

SEQ ID NO: 2770056 - protein, 7 aa, Entamoeba invadens
PGYGGDD

SEQ ID NO: 2770057 - protein, 6 aa, Entamoeba invadens
PGYGYN

SEQ ID NO: 2770058 - protein, 14 aa, Entamoeba invadens
PGYKNDQTNPSKVF

SEQ ID NO: 2770059 - protein, 6 aa, Entamoeba invadens
PGYPPA

SEQ ID NO: 2770060 - protein, 7 aa, Entamoeba invadens
PGYSTDD

SEQ ID NO: 2770061 - protein, 24 aa, Entamoeba invadens
PGYSTKGGKCDKNDAKDNCKERAI

SEQ ID NO: 2770062 - protein, 5 aa, Entamoeba invadens
PGYSY

SEQ ID NO: 2770063 - protein, 31 aa, Entamoeba invadens
PGYYTDSVASSECKQCSSTCRTCDPTTGSCT

SEQ ID NO: 2770064 - protein, 4 aa, Entamoeba invadens
PHAS

SEQ ID NO: 2770065 - protein, 7 aa, Entamoeba invadens
PHCAGNY

SEQ ID NO: 2770066 - protein, 18 aa, Entamoeba invadens
PHHHEPHATEEEKKEAYD

SEQ ID NO: 2770067 - protein, 11 aa, Entamoeba invadens
PHHQPSTLTTP

SEQ ID NO: 2770068 - protein, 15 aa, Entamoeba invadens
PHHSTQYNANTGASE

SEQ ID NO: 2770069 - protein, 6 aa, Entamoeba invadens
PHIEDG

SEQ ID NO: 2770070 - protein, 4 aa, Entamoeba invadens
PHKS

SEQ ID NO: 2770071 - protein, 10 aa, Entamoeba invadens
PHKSTDRATE

SEQ ID NO: 2770072 - protein, 4 aa, Entamoeba invadens
PHPG

SEQ ID NO: 2770073 - protein, 7 aa, Entamoeba invadens
PHPQTNY

SEQ ID NO: 2770074 - protein, 4 aa, Entamoeba invadens
PHPT

SEQ ID NO: 2770075 - protein, 7 aa, Entamoeba invadens
PHQTGPL

SEQ ID NO: 2770076 - protein, 9 aa, Entamoeba invadens
PHSGETGHY

SEQ ID NO: 2770077 - protein, 4 aa, Entamoeba invadens
PHSL

SEQ ID NO: 2770078 - protein, 8 aa, Entamoeba invadens
PHSNTLQE

SEQ ID NO: 2770079 - protein, 4 aa, Entamoeba invadens
PHSP

SEQ ID NO: 2770080 - protein, 4 aa, Entamoeba invadens
PHSS

SEQ ID NO: 2770081 - protein, 29 aa, Entamoeba invadens
PHSTESTSKSIVTPSVDKSEDDICKDKDG

SEQ ID NO: 2770082 - protein, 11 aa, Entamoeba invadens
PHSTNHGSSDF

SEQ ID NO: 2770083 - protein, 5 aa, Entamoeba invadens
PHTDE

SEQ ID NO: 2770084 - protein, 4 aa, Entamoeba invadens
PHTR

SEQ ID NO: 2770085 - protein, 4 aa, Entamoeba invadens
PHTS

SEQ ID NO: 2770086 - protein, 13 aa, Entamoeba invadens
PHVETQQKSDRIE

SEQ ID NO: 2770087 - protein, 7 aa, Entamoeba invadens
PHYNDSS

SEQ ID NO: 2770088 - protein, 7 aa, Entamoeba invadens
PIAAKEV

SEQ ID NO: 2770089 - protein, 8 aa, Entamoeba invadens
PIAEGANG

SEQ ID NO: 2770090 - protein, 6 aa, Entamoeba invadens
PIATNK

SEQ ID NO: 2770091 - protein, 4 aa, Entamoeba invadens
PIAV

SEQ ID NO: 2770092 - protein, 4 aa, Entamoeba invadens
PIDA

SEQ ID NO: 2770093 - protein, 4 aa, Entamoeba invadens
PIDE

SEQ ID NO: 2770094 - protein, 11 aa, Entamoeba invadens
PIDGTPNPMND

SEQ ID NO: 2770095 - protein, 5 aa, Entamoeba invadens
PIEEI

SEQ ID NO: 2770096 - protein, 8 aa, Entamoeba invadens
PIEEPSNC

SEQ ID NO: 2770097 - protein, 37 aa, Entamoeba invadens
PIEEQNHKEVSNKESLLSAKQDEKVKDSTQVNTTQDE

SEQ ID NO: 2770098 - protein, 7 aa, Entamoeba invadens
PIEQEES

SEQ ID NO: 2770099 - protein, 5 aa, Entamoeba invadens
PIEQL

SEQ ID NO: 2770100 - protein, 5 aa, Entamoeba invadens
PIESQ

SEQ ID NO: 2770101 - protein, 6 aa, Entamoeba invadens
PIGAGT

SEQ ID NO: 2770102 - protein, 5 aa, Entamoeba invadens
PIGCG

SEQ ID NO: 2770103 - protein, 8 aa, Entamoeba invadens
PIGEGTYS

SEQ ID NO: 2770104 - protein, 6 aa, Entamoeba invadens
PIGEST

SEQ ID NO: 2770105 - protein, 7 aa, Entamoeba invadens
PIGGKIG

SEQ ID NO: 2770106 - protein, 8 aa, Entamoeba invadens
PIGKSDMS

SEQ ID NO: 2770107 - protein, 4 aa, Entamoeba invadens
PIGN

SEQ ID NO: 2770108 - protein, 5 aa, Entamoeba invadens
PIGPN

SEQ ID NO: 2770109 - protein, 4 aa, Entamoeba invadens
PIGS

SEQ ID NO: 2770110 - protein, 27 aa, Entamoeba invadens
PIKATNEIRDFSDGDKRRKEESTTESK

SEQ ID NO: 2770111 - protein, 12 aa, Entamoeba invadens
PIKDNDADYEYQ

SEQ ID NO: 2770112 - protein, 5 aa, Entamoeba invadens
PIKNE

SEQ ID NO: 2770113 - protein, 4 aa, Entamoeba invadens
PIKQ

SEQ ID NO: 2770114 - protein, 9 aa, Entamoeba invadens
PIKSGNLGS

SEQ ID NO: 2770115 - protein, 11 aa, Entamoeba invadens
PINAPSGSFSS

SEQ ID NO: 2770116 - protein, 4 aa, Entamoeba invadens
PINL

SEQ ID NO: 2770117 - protein, 7 aa, Entamoeba invadens
PINSTQV

SEQ ID NO: 2770118 - protein, 5 aa, Entamoeba invadens
PINTD

SEQ ID NO: 2770119 - protein, 7 aa, Entamoeba invadens
PINVKTD

SEQ ID NO: 2770120 - protein, 12 aa, Entamoeba invadens
PIPDDSKDKTGQ

SEQ ID NO: 2770121 - protein, 5 aa, Entamoeba invadens
PIPNN

SEQ ID NO: 2770122 - protein, 10 aa, Entamoeba invadens
PIQNRTQAIK

SEQ ID NO: 2770123 - protein, 8 aa, Entamoeba invadens
PIREPTES

SEQ ID NO: 2770124 - protein, 6 aa, Entamoeba invadens
PIRKSS

SEQ ID NO: 2770125 - protein, 4 aa, Entamoeba invadens
PIRQ

SEQ ID NO: 2770126 - protein, 4 aa, Entamoeba invadens
PISE

SEQ ID NO: 2770127 - protein, 14 aa, Entamoeba invadens
PISKDEKAKEVRRH

SEQ ID NO: 2770128 - protein, 6 aa, Entamoeba invadens
PISPNC

SEQ ID NO: 2770129 - protein, 12 aa, Entamoeba invadens
PISSPKSTPTKI

SEQ ID NO: 2770130 - protein, 12 aa, Entamoeba invadens
PISTNCESCSAY

SEQ ID NO: 2770131 - protein, 5 aa, Entamoeba invadens
PISVP

SEQ ID NO: 2770132 - protein, 10 aa, Entamoeba invadens
PITNKFDATY

SEQ ID NO: 2770133 - protein, 16 aa, Entamoeba invadens
PITPTDPVNPPTVTPV

SEQ ID NO: 2770134 - protein, 6 aa, Entamoeba invadens
PITQNG

SEQ ID NO: 2770135 - protein, 10 aa, Entamoeba invadens
PKAEKDKMTE

SEQ ID NO: 2770136 - protein, 5 aa, Entamoeba invadens
PKAEM

SEQ ID NO: 2770137 - protein, 5 aa, Entamoeba invadens
PKAFD

SEQ ID NO: 2770138 - protein, 8 aa, Entamoeba invadens
PKAGSITT

SEQ ID NO: 2770139 - protein, 13 aa, Entamoeba invadens
PKAKKKESRHDDV

SEQ ID NO: 2770140 - protein, 9 aa, Entamoeba invadens
PKAPRIQSS

SEQ ID NO: 2770141 - protein, 17 aa, Entamoeba invadens
PKASEVVKQKKEQKQAL

SEQ ID NO: 2770142 - protein, 6 aa, Entamoeba invadens
PKASVW

SEQ ID NO: 2770143 - protein, 11 aa, Entamoeba invadens
PKATYSPNGTE

SEQ ID NO: 2770144 - protein, 9 aa, Entamoeba invadens
PKDCKNDQC

SEQ ID NO: 2770145 - protein, 9 aa, Entamoeba invadens
PKDCKNNQC

SEQ ID NO: 2770146 - protein, 8 aa, Entamoeba invadens
PKDEQESR

SEQ ID NO: 2770147 - protein, 7 aa, Entamoeba invadens
PKDGTTC

SEQ ID NO: 2770148 - protein, 7 aa, Entamoeba invadens
PKDKTCE

SEQ ID NO: 2770149 - protein, 13 aa, Entamoeba invadens
PKDLTGKGSCQKT

SEQ ID NO: 2770150 - protein, 9 aa, Entamoeba invadens
PKDVDQSLS

SEQ ID NO: 2770151 - protein, 7 aa, Entamoeba invadens
PKEDTIN

SEQ ID NO: 2770152 - protein, 9 aa, Entamoeba invadens
PKEEQNSAN

SEQ ID NO: 2770153 - protein, 14 aa, Entamoeba invadens
PKEGKGFRVNGDDF

SEQ ID NO: 2770154 - protein, 7 aa, Entamoeba invadens
PKEGPVF

SEQ ID NO: 2770155 - protein, 17 aa, Entamoeba invadens
PKEGTTSTIGTPAKNLQ

SEQ ID NO: 2770156 - protein, 7 aa, Entamoeba invadens
PKEIPAE

SEQ ID NO: 2770157 - protein, 7 aa, Entamoeba invadens
PKEKEEI

SEQ ID NO: 2770158 - protein, 8 aa, Entamoeba invadens
PKEKKKNC

SEQ ID NO: 2770159 - protein, 9 aa, Entamoeba invadens
PKEKRPSVA

SEQ ID NO: 2770160 - protein, 16 aa, Entamoeba invadens
PKENRHDDKTYCESKR

SEQ ID NO: 2770161 - protein, 5 aa, Entamoeba invadens
PKEPI

SEQ ID NO: 2770162 - protein, 14 aa, Entamoeba invadens
PKEQEERGATKTTS

SEQ ID NO: 2770163 - protein, 8 aa, Entamoeba invadens
PKEQSDER

SEQ ID NO: 2770164 - protein, 7 aa, Entamoeba invadens
PKERANI

SEQ ID NO: 2770165 - protein, 31 aa, Entamoeba invadens
PKERETKKSNKEVKANEAARQTKKVSKKGNQ

SEQ ID NO: 2770166 - protein, 10 aa, Entamoeba invadens
PKERMTPDQA

SEQ ID NO: 2770167 - protein, 10 aa, Entamoeba invadens
PKETGKDGEL

SEQ ID NO: 2770168 - protein, 5 aa, Entamoeba invadens
PKETS

SEQ ID NO: 2770169 - protein, 18 aa, Entamoeba invadens
PKEYLEEKGNTPENEKTI

SEQ ID NO: 2770170 - protein, 12 aa, Entamoeba invadens
PKGDKQTDENAF

SEQ ID NO: 2770171 - protein, 33 aa, Entamoeba invadens
PKGENAFAPKINKNSIQNTIKTSNLNGKETQRS

SEQ ID NO: 2770172 - protein, 22 aa, Entamoeba invadens
PKGESGYAASTPKGFSPQLPAD

SEQ ID NO: 2770173 - protein, 11 aa, Entamoeba invadens
PKGHQKNETEI

SEQ ID NO: 2770174 - protein, 7 aa, Entamoeba invadens
PKGISYG

SEQ ID NO: 2770175 - protein, 5 aa, Entamoeba invadens
PKGNS

SEQ ID NO: 2770176 - protein, 9 aa, Entamoeba invadens
PKGTDSSST

SEQ ID NO: 2770177 - protein, 14 aa, Entamoeba invadens
PKGTFSSKEKSSSC

SEQ ID NO: 2770178 - protein, 12 aa, Entamoeba invadens
PKGTYSSNIASS

SEQ ID NO: 2770179 - protein, 17 aa, Entamoeba invadens
PKGTYTSGTNCKKCTTT

SEQ ID NO: 2770180 - protein, 5 aa, Entamoeba invadens
PKGYY

SEQ ID NO: 2770181 - protein, 5 aa, Entamoeba invadens
PKHHK

SEQ ID NO: 2770182 - protein, 4 aa, Entamoeba invadens
PKHQ

SEQ ID NO: 2770183 - protein, 5 aa, Entamoeba invadens
PKIDI

SEQ ID NO: 2770184 - protein, 22 aa, Entamoeba invadens
PKIDSERSTYEEETADSCITSD

SEQ ID NO: 2770185 - protein, 6 aa, Entamoeba invadens
PKIDSK

SEQ ID NO: 2770186 - protein, 8 aa, Entamoeba invadens
PKIPSDRQ

SEQ ID NO: 2770187 - protein, 4 aa, Entamoeba invadens
PKIS

SEQ ID NO: 2770188 - protein, 5 aa, Entamoeba invadens
PKISK

SEQ ID NO: 2770189 - protein, 13 aa, Entamoeba invadens
PKISPYPDDTDNV

SEQ ID NO: 2770190 - protein, 6 aa, Entamoeba invadens
PKITPD

SEQ ID NO: 2770191 - protein, 14 aa, Entamoeba invadens
PKIVKGDKGHRKFG

SEQ ID NO: 2770192 - protein, 10 aa, Entamoeba invadens
PKKDEESEIK

SEQ ID NO: 2770193 - protein, 14 aa, Entamoeba invadens
PKKGDEYKGKLEEV

SEQ ID NO: 2770194 - protein, 8 aa, Entamoeba invadens
PKKIETEA

SEQ ID NO: 2770195 - protein, 12 aa, Entamoeba invadens
PKKNGISTIETK

SEQ ID NO: 2770196 - protein, 9 aa, Entamoeba invadens
PKKNNQLTD

SEQ ID NO: 2770197 - protein, 9 aa, Entamoeba invadens
PKKQYADPA

SEQ ID NO: 2770198 - protein, 13 aa, Entamoeba invadens
PKKSPYPNEPDRQ

SEQ ID NO: 2770199 - protein, 12 aa, Entamoeba invadens
PKKTKEPTHPQY

SEQ ID NO: 2770200 - protein, 17 aa, Entamoeba invadens
PKKTQDKKDKKVPSLEN

SEQ ID NO: 2770201 - protein, 7 aa, Entamoeba invadens
PKKYEGM

SEQ ID NO: 2770202 - protein, 8 aa, Entamoeba invadens
PKLDAPPL

SEQ ID NO: 2770203 - protein, 7 aa, Entamoeba invadens
PKLGKEI

SEQ ID NO: 2770204 - protein, 14 aa, Entamoeba invadens
PKLSNKIQQPKTNR

SEQ ID NO: 2770205 - protein, 7 aa, Entamoeba invadens
PKMSKGT

SEQ ID NO: 2770206 - protein, 12 aa, Entamoeba invadens
PKMSNGDNQEEE

SEQ ID NO: 2770207 - protein, 10 aa, Entamoeba invadens
PKNDFANYSH

SEQ ID NO: 2770208 - protein, 4 aa, Entamoeba invadens
PKNE

SEQ ID NO: 2770209 - protein, 5 aa, Entamoeba invadens
PKNER

SEQ ID NO: 2770210 - protein, 8 aa, Entamoeba invadens
PKNGSCET

SEQ ID NO: 2770211 - protein, 6 aa, Entamoeba invadens
PKNPPE

SEQ ID NO: 2770212 - protein, 7 aa, Entamoeba invadens
PKNSKRD

SEQ ID NO: 2770213 - protein, 6 aa, Entamoeba invadens
PKNTQE

SEQ ID NO: 2770214 - protein, 6 aa, Entamoeba invadens
PKNVMQ

SEQ ID NO: 2770215 - protein, 6 aa, Entamoeba invadens
PKPKDV

SEQ ID NO: 2770216 - protein, 29 aa, Entamoeba invadens
PKPKRRESSAKQQNKNDNENDNFEDDGID

SEQ ID NO: 2770217 - protein, 18 aa, Entamoeba invadens
PKPKTDDAAEAKALKEKE

SEQ ID NO: 2770218 - protein, 10 aa, Entamoeba invadens
PKPNDTDEEF

SEQ ID NO: 2770219 - protein, 6 aa, Entamoeba invadens
PKPSLK

SEQ ID NO: 2770220 - protein, 7 aa, Entamoeba invadens
PKPSTHN

SEQ ID NO: 2770221 - protein, 10 aa, Entamoeba invadens
PKQATLKPQF

SEQ ID NO: 2770222 - protein, 6 aa, Entamoeba invadens
PKQCPG

SEQ ID NO: 2770223 - protein, 7 aa, Entamoeba invadens
PKQDKIP

SEQ ID NO: 2770224 - protein, 57 aa, Entamoeba invadens
PKQDNNDQTQVNDNKEDQKDIKDSSDDSFDDVHAEDQEITPIQNTQANKTNPNSNEE

SEQ ID NO: 2770225 - protein, 21 aa, Entamoeba invadens
PKQKEEQKEKAENNDQLHEKQ

SEQ ID NO: 2770226 - protein, 7 aa, Entamoeba invadens
PKQKEKL

SEQ ID NO: 2770227 - protein, 4 aa, Entamoeba invadens
PKQP

SEQ ID NO: 2770228 - protein, 8 aa, Entamoeba invadens
PKQSTTIT

SEQ ID NO: 2770229 - protein, 9 aa, Entamoeba invadens
PKRGGFSSA

SEQ ID NO: 2770230 - protein, 14 aa, Entamoeba invadens
PKRGPLKTKNSNTI

SEQ ID NO: 2770231 - protein, 4 aa, Entamoeba invadens
PKRK

SEQ ID NO: 2770232 - protein, 7 aa, Entamoeba invadens
PKRNKEI

SEQ ID NO: 2770233 - protein, 8 aa, Entamoeba invadens
PKRPVDDF

SEQ ID NO: 2770234 - protein, 7 aa, Entamoeba invadens
PKRRVGE

SEQ ID NO: 2770235 - protein, 14 aa, Entamoeba invadens
PKRSPIAIQSEPPN

SEQ ID NO: 2770236 - protein, 4 aa, Entamoeba invadens
PKRT

SEQ ID NO: 2770237 - protein, 9 aa, Entamoeba invadens
PKSDKNAMS

SEQ ID NO: 2770238 - protein, 8 aa, Entamoeba invadens
PKSDSDKL

SEQ ID NO: 2770239 - protein, 8 aa, Entamoeba invadens
PKSDTTNA

SEQ ID NO: 2770240 - protein, 5 aa, Entamoeba invadens
PKSDY

SEQ ID NO: 2770241 - protein, 25 aa, Entamoeba invadens
PKSEGSPAPKKELTKEEKEKQERSL

SEQ ID NO: 2770242 - protein, 7 aa, Entamoeba invadens
PKSFKGE

SEQ ID NO: 2770243 - protein, 10 aa, Entamoeba invadens
PKSGRLKPHR

SEQ ID NO: 2770244 - protein, 9 aa, Entamoeba invadens
PKSKGRVSK

SEQ ID NO: 2770245 - protein, 5 aa, Entamoeba invadens
PKSKN

SEQ ID NO: 2770246 - protein, 6 aa, Entamoeba invadens
PKSNKC

SEQ ID NO: 2770247 - protein, 8 aa, Entamoeba invadens
PKSNKPAV

SEQ ID NO: 2770248 - protein, 5 aa, Entamoeba invadens
PKSRL

SEQ ID NO: 2770249 - protein, 10 aa, Entamoeba invadens
PKSSTGTEKG

SEQ ID NO: 2770250 - protein, 8 aa, Entamoeba invadens
PKSVTKIE

SEQ ID NO: 2770251 - protein, 4 aa, Entamoeba invadens
PKSY

SEQ ID NO: 2770252 - protein, 4 aa, Entamoeba invadens
PKTA

SEQ ID NO: 2770253 - protein, 8 aa, Entamoeba invadens
PKTDGETM

SEQ ID NO: 2770254 - protein, 4 aa, Entamoeba invadens
PKTE

SEQ ID NO: 2770255 - protein, 6 aa, Entamoeba invadens
PKTELL

SEQ ID NO: 2770256 - protein, 19 aa, Entamoeba invadens
PKTERSEKKSKTRENKAKR

SEQ ID NO: 2770257 - protein, 9 aa, Entamoeba invadens
PKTKEAYSE

SEQ ID NO: 2770258 - protein, 8 aa, Entamoeba invadens
PKTKEQIP

SEQ ID NO: 2770259 - protein, 10 aa, Entamoeba invadens
PKTNTRSGAL

SEQ ID NO: 2770260 - protein, 8 aa, Entamoeba invadens
PKTNTTYN

SEQ ID NO: 2770261 - protein, 7 aa, Entamoeba invadens
PKTPPTK

SEQ ID NO: 2770262 - protein, 5 aa, Entamoeba invadens
PKTPS

SEQ ID NO: 2770263 - protein, 7 aa, Entamoeba invadens
PKTPYTN

SEQ ID NO: 2770264 - protein, 4 aa, Entamoeba invadens
PKTQ

SEQ ID NO: 2770265 - protein, 8 aa, Entamoeba invadens
PKTQLDDT

SEQ ID NO: 2770266 - protein, 22 aa, Entamoeba invadens
PKTRQCSERSVSNKFGPSGDEC

SEQ ID NO: 2770267 - protein, 4 aa, Entamoeba invadens
PKTS

SEQ ID NO: 2770268 - protein, 11 aa, Entamoeba invadens
PKTSCEKCTDF

SEQ ID NO: 2770269 - protein, 4 aa, Entamoeba invadens
PKVA

SEQ ID NO: 2770270 - protein, 5 aa, Entamoeba invadens
PKVAT

SEQ ID NO: 2770271 - protein, 11 aa, Entamoeba invadens
PKVDGDKCDPA

SEQ ID NO: 2770272 - protein, 5 aa, Entamoeba invadens
PKVDT

SEQ ID NO: 2770273 - protein, 6 aa, Entamoeba invadens
PKVFPT

SEQ ID NO: 2770274 - protein, 14 aa, Entamoeba invadens
PKVSCAQSVTTNSE

SEQ ID NO: 2770275 - protein, 6 aa, Entamoeba invadens
PKYCGK

SEQ ID NO: 2770276 - protein, 7 aa, Entamoeba invadens
PKYGEVN

SEQ ID NO: 2770277 - protein, 4 aa, Entamoeba invadens
PKYK

SEQ ID NO: 2770278 - protein, 8 aa, Entamoeba invadens
PKYNEREA

SEQ ID NO: 2770279 - protein, 9 aa, Entamoeba invadens
PKYNSPQAV

SEQ ID NO: 2770280 - protein, 6 aa, Entamoeba invadens
PKYSGD

SEQ ID NO: 2770281 - protein, 7 aa, Entamoeba invadens
PKYSGDF

SEQ ID NO: 2770282 - protein, 4 aa, Entamoeba invadens
PKYT

SEQ ID NO: 2770283 - protein, 6 aa, Entamoeba invadens
PLADGN

SEQ ID NO: 2770284 - protein, 5 aa, Entamoeba invadens
PLAKT

SEQ ID NO: 2770285 - protein, 12 aa, Entamoeba invadens
PLANQASVSEAL

SEQ ID NO: 2770286 - protein, 19 aa, Entamoeba invadens
PLASTSNLKTTQISTDTPY

SEQ ID NO: 2770287 - protein, 15 aa, Entamoeba invadens
PLASVPPRSSLHADS

SEQ ID NO: 2770288 - protein, 7 aa, Entamoeba invadens
PLATTDI

SEQ ID NO: 2770289 - protein, 8 aa, Entamoeba invadens
PLDEPDNV

SEQ ID NO: 2770290 - protein, 4 aa, Entamoeba invadens
PLDG

SEQ ID NO: 2770291 - protein, 6 aa, Entamoeba invadens
PLDSET

SEQ ID NO: 2770292 - protein, 5 aa, Entamoeba invadens
PLDSQ

SEQ ID NO: 2770293 - protein, 17 aa, Entamoeba invadens
PLDTDSIEGPEVTRGVS

SEQ ID NO: 2770294 - protein, 12 aa, Entamoeba invadens
PLDTSENQNTKF

SEQ ID NO: 2770295 - protein, 5 aa, Entamoeba invadens
PLDTT

SEQ ID NO: 2770296 - protein, 11 aa, Entamoeba invadens
PLEELTKNNEV

SEQ ID NO: 2770297 - protein, 10 aa, Entamoeba invadens
PLEGETGDST

SEQ ID NO: 2770298 - protein, 5 aa, Entamoeba invadens
PLEPH

SEQ ID NO: 2770299 - protein, 7 aa, Entamoeba invadens
PLFTSNG

SEQ ID NO: 2770300 - protein, 8 aa, Entamoeba invadens
PLGDTPIS

SEQ ID NO: 2770301 - protein, 28 aa, Entamoeba invadens
PLGNDQKTTSVLGKTSESGSGSSSGSKK

SEQ ID NO: 2770302 - protein, 5 aa, Entamoeba invadens
PLGSL

SEQ ID NO: 2770303 - protein, 8 aa, Entamoeba invadens
PLKEPQIK

SEQ ID NO: 2770304 - protein, 4 aa, Entamoeba invadens
PLKG

SEQ ID NO: 2770305 - protein, 4 aa, Entamoeba invadens
PLKQ

SEQ ID NO: 2770306 - protein, 39 aa, Entamoeba invadens
PLKSPSPKVVPEKSVSPKVTEKQQETVVSPGRIPSPKVE

SEQ ID NO: 2770307 - protein, 8 aa, Entamoeba invadens
PLKSTSAT

SEQ ID NO: 2770308 - protein, 16 aa, Entamoeba invadens
PLLGNGKNLKNDGTHH

SEQ ID NO: 2770309 - protein, 21 aa, Entamoeba invadens
PLLPTSSLSEHPEKRTAPAKT

SEQ ID NO: 2770310 - protein, 7 aa, Entamoeba invadens
PLNETPN

SEQ ID NO: 2770311 - protein, 5 aa, Entamoeba invadens
PLNSS

SEQ ID NO: 2770312 - protein, 6 aa, Entamoeba invadens
PLPAGG

SEQ ID NO: 2770313 - protein, 7 aa, Entamoeba invadens
PLPAGGG

SEQ ID NO: 2770314 - protein, 5 aa, Entamoeba invadens
PLPAT

SEQ ID NO: 2770315 - protein, 9 aa, Entamoeba invadens
PLPGYETAT

SEQ ID NO: 2770316 - protein, 20 aa, Entamoeba invadens
PLPKPSIEQPTNFVGDSPIV

SEQ ID NO: 2770317 - protein, 4 aa, Entamoeba invadens
PLPN

SEQ ID NO: 2770318 - protein, 4 aa, Entamoeba invadens
PLPP

SEQ ID NO: 2770319 - protein, 19 aa, Entamoeba invadens
PLPPTKEQIDVTGNESPLK

SEQ ID NO: 2770320 - protein, 6 aa, Entamoeba invadens
PLPSTW

SEQ ID NO: 2770321 - protein, 22 aa, Entamoeba invadens
PLPTDTDVSKKERSNDSSSTSS

SEQ ID NO: 2770322 - protein, 7 aa, Entamoeba invadens
PLPTGGG

SEQ ID NO: 2770323 - protein, 42 aa, Entamoeba invadens
PLPTTSSSEPVESSSHPSQSSEAHSSNTSDSDEDNNGLSGGQ

SEQ ID NO: 2770324 - protein, 5 aa, Entamoeba invadens
PLQSP

SEQ ID NO: 2770325 - protein, 5 aa, Entamoeba invadens
PLQTY

SEQ ID NO: 2770326 - protein, 7 aa, Entamoeba invadens
PLRPEVE

SEQ ID NO: 2770327 - protein, 10 aa, Entamoeba invadens
PLSATNHSKT

SEQ ID NO: 2770328 - protein, 13 aa, Entamoeba invadens
PLSDENKEKYKEV

SEQ ID NO: 2770329 - protein, 13 aa, Entamoeba invadens
PLSETTKKKRCEI

SEQ ID NO: 2770330 - protein, 10 aa, Entamoeba invadens
PLSKSTESVD

SEQ ID NO: 2770331 - protein, 7 aa, Entamoeba invadens
PLSKTKF

SEQ ID NO: 2770332 - protein, 13 aa, Entamoeba invadens
PLSNPYSSKPSTL

SEQ ID NO: 2770333 - protein, 5 aa, Entamoeba invadens
PLSNT

SEQ ID NO: 2770334 - protein, 27 aa, Entamoeba invadens
PLSSGTCKTCETTCKANQCSNTTGNCN

SEQ ID NO: 2770335 - protein, 13 aa, Entamoeba invadens
PLSSKQGRVESQN

SEQ ID NO: 2770336 - protein, 4 aa, Entamoeba invadens
PLTD

SEQ ID NO: 2770337 - protein, 8 aa, Entamoeba invadens
PLTDGNCG

SEQ ID NO: 2770338 - protein, 11 aa, Entamoeba invadens
PLTEDRFNEEC

SEQ ID NO: 2770339 - protein, 14 aa, Entamoeba invadens
PLTGAKKQSNKSTK

SEQ ID NO: 2770340 - protein, 17 aa, Entamoeba invadens
PLTVKPKKAMSLNKVIV

SEQ ID NO: 2770341 - protein, 6 aa, Entamoeba invadens
PMEEKK

SEQ ID NO: 2770342 - protein, 4 aa, Entamoeba invadens
PMET

SEQ ID NO: 2770343 - protein, 10 aa, Entamoeba invadens
PMGYDAKNKT

SEQ ID NO: 2770344 - protein, 8 aa, Entamoeba invadens
PMKNETNF

SEQ ID NO: 2770345 - protein, 4 aa, Entamoeba invadens
PMKT

SEQ ID NO: 2770346 - protein, 5 aa, Entamoeba invadens
PMNDA

SEQ ID NO: 2770347 - protein, 10 aa, Entamoeba invadens
PMPKSEETDC

SEQ ID NO: 2770348 - protein, 12 aa, Entamoeba invadens
PMPPCASSIGAL

SEQ ID NO: 2770349 - protein, 4 aa, Entamoeba invadens
PMRE

SEQ ID NO: 2770350 - protein, 13 aa, Entamoeba invadens
PMRTPGPSKSFSR

SEQ ID NO: 2770351 - protein, 13 aa, Entamoeba invadens
PMTDTNGNTVTVG

SEQ ID NO: 2770352 - protein, 9 aa, Entamoeba invadens
PMYDTTNSE

SEQ ID NO: 2770353 - protein, 4 aa, Entamoeba invadens
PMYN

SEQ ID NO: 2770354 - protein, 6 aa, Entamoeba invadens
PMYTGQ

SEQ ID NO: 2770355 - protein, 5 aa, Entamoeba invadens
PNAFP

SEQ ID NO: 2770356 - protein, 5 aa, Entamoeba invadens
PNAKS

SEQ ID NO: 2770357 - protein, 7 aa, Entamoeba invadens
PNARNTL

SEQ ID NO: 2770358 - protein, 9 aa, Entamoeba invadens
PNCDNCSRN

SEQ ID NO: 2770359 - protein, 10 aa, Entamoeba invadens
PNCEKENENG

SEQ ID NO: 2770360 - protein, 16 aa, Entamoeba invadens
PNCETCSSSSSRNCTK

SEQ ID NO: 2770361 - protein, 12 aa, Entamoeba invadens
PNCNQIKNSKCS

SEQ ID NO: 2770362 - protein, 10 aa, Entamoeba invadens
PNCSGDFSGN

SEQ ID NO: 2770363 - protein, 11 aa, Entamoeba invadens
PNDENGKCTTK

SEQ ID NO: 2770364 - protein, 12 aa, Entamoeba invadens
PNDENGKCTTTI

SEQ ID NO: 2770365 - protein, 10 aa, Entamoeba invadens
PNDENGKYSM

SEQ ID NO: 2770366 - protein, 7 aa, Entamoeba invadens
PNDENNE

SEQ ID NO: 2770367 - protein, 7 aa, Entamoeba invadens
PNDIEGT

SEQ ID NO: 2770368 - protein, 5 aa, Entamoeba invadens
PNDIT

SEQ ID NO: 2770369 - protein, 5 aa, Entamoeba invadens
PNDKG

SEQ ID NO: 2770370 - protein, 7 aa, Entamoeba invadens
PNDNNRI

SEQ ID NO: 2770371 - protein, 4 aa, Entamoeba invadens
PNDP

SEQ ID NO: 2770372 - protein, 10 aa, Entamoeba invadens
PNDQITCPED

SEQ ID NO: 2770373 - protein, 11 aa, Entamoeba invadens
PNDQNGKCTTT

SEQ ID NO: 2770374 - protein, 11 aa, Entamoeba invadens
PNDQNGRCTTT

SEQ ID NO: 2770375 - protein, 5 aa, Entamoeba invadens
PNDQV

SEQ ID NO: 2770376 - protein, 5 aa, Entamoeba invadens
PNDSR

SEQ ID NO: 2770377 - protein, 21 aa, Entamoeba invadens
PNEAIGEAAAEVGGTVGVSPN

SEQ ID NO: 2770378 - protein, 8 aa, Entamoeba invadens
PNEDGTYC

SEQ ID NO: 2770379 - protein, 6 aa, Entamoeba invadens
PNEEGY

SEQ ID NO: 2770380 - protein, 7 aa, Entamoeba invadens
PNEGHIQ

SEQ ID NO: 2770381 - protein, 8 aa, Entamoeba invadens
PNEKTDVT

SEQ ID NO: 2770382 - protein, 17 aa, Entamoeba invadens
PNEKTNAKLTDFGSSRN

SEQ ID NO: 2770383 - protein, 7 aa, Entamoeba invadens
PNEKVNA

SEQ ID NO: 2770384 - protein, 4 aa, Entamoeba invadens
PNEN

SEQ ID NO: 2770385 - protein, 5 aa, Entamoeba invadens
PNENK

SEQ ID NO: 2770386 - protein, 12 aa, Entamoeba invadens
PNEQQRDETTGN

SEQ ID NO: 2770387 - protein, 24 aa, Entamoeba invadens
PNESSTDEDDRPIAQSRQSPTKAV

SEQ ID NO: 2770388 - protein, 7 aa, Entamoeba invadens
PNETKLD

SEQ ID NO: 2770389 - protein, 4 aa, Entamoeba invadens
PNFS

SEQ ID NO: 2770390 - protein, 12 aa, Entamoeba invadens
PNFSSNGDEFEK

SEQ ID NO: 2770391 - protein, 6 aa, Entamoeba invadens
PNGCDT

SEQ ID NO: 2770392 - protein, 8 aa, Entamoeba invadens
PNGELTEK

SEQ ID NO: 2770393 - protein, 4 aa, Entamoeba invadens
PNGF

SEQ ID NO: 2770394 - protein, 7 aa, Entamoeba invadens
PNGGVNT

SEQ ID NO: 2770395 - protein, 5 aa, Entamoeba invadens
PNGLQ

SEQ ID NO: 2770396 - protein, 4 aa, Entamoeba invadens
PNGN

SEQ ID NO: 2770397 - protein, 5 aa, Entamoeba invadens
PNGNG

SEQ ID NO: 2770398 - protein, 13 aa, Entamoeba invadens
PNGNKVSRTATWT

SEQ ID NO: 2770399 - protein, 9 aa, Entamoeba invadens
PNGQYPNNN

SEQ ID NO: 2770400 - protein, 5 aa, Entamoeba invadens
PNGSP

SEQ ID NO: 2770401 - protein, 4 aa, Entamoeba invadens
PNGT

SEQ ID NO: 2770402 - protein, 23 aa, Entamoeba invadens
PNGTCSPCDSSCEYNGCNKKTGI

SEQ ID NO: 2770403 - protein, 13 aa, Entamoeba invadens
PNGTPILDQNDPV

SEQ ID NO: 2770404 - protein, 6 aa, Entamoeba invadens
PNGTSF

SEQ ID NO: 2770405 - protein, 9 aa, Entamoeba invadens
PNGTYREKK

SEQ ID NO: 2770406 - protein, 7 aa, Entamoeba invadens
PNGYDSS

SEQ ID NO: 2770407 - protein, 6 aa, Entamoeba invadens
PNHKTL

SEQ ID NO: 2770408 - protein, 7 aa, Entamoeba invadens
PNHPEFD

SEQ ID NO: 2770409 - protein, 17 aa, Entamoeba invadens
PNIDTKDNSGKKPETCD

SEQ ID NO: 2770410 - protein, 17 aa, Entamoeba invadens
PNIDTKDNSGKRPETCD

SEQ ID NO: 2770411 - protein, 17 aa, Entamoeba invadens
PNIPGTDVKNTNLPEAL

SEQ ID NO: 2770412 - protein, 10 aa, Entamoeba invadens
PNIPISEENP

SEQ ID NO: 2770413 - protein, 35 aa, Entamoeba invadens
PNITSFKSSTSNIETNTSSSSSEMISENSTIEKYR

SEQ ID NO: 2770414 - protein, 12 aa, Entamoeba invadens
PNKDKPPNPKEE

SEQ ID NO: 2770415 - protein, 5 aa, Entamoeba invadens
PNKEK

SEQ ID NO: 2770416 - protein, 8 aa, Entamoeba invadens
PNKPSDFI

SEQ ID NO: 2770417 - protein, 8 aa, Entamoeba invadens
PNKSGTLC

SEQ ID NO: 2770418 - protein, 10 aa, Entamoeba invadens
PNKSGTTCNK

SEQ ID NO: 2770419 - protein, 8 aa, Entamoeba invadens
PNKSLEGY

SEQ ID NO: 2770420 - protein, 4 aa, Entamoeba invadens
PNLT

SEQ ID NO: 2770421 - protein, 13 aa, Entamoeba invadens
PNMQQSMTQQSQP

SEQ ID NO: 2770422 - protein, 9 aa, Entamoeba invadens
PNNATPECS

SEQ ID NO: 2770423 - protein, 4 aa, Entamoeba invadens
PNNF

SEQ ID NO: 2770424 - protein, 8 aa, Entamoeba invadens
PNNGNLTY

SEQ ID NO: 2770425 - protein, 9 aa, Entamoeba invadens
PNNKHQSMS

SEQ ID NO: 2770426 - protein, 5 aa, Entamoeba invadens
PNNKR

SEQ ID NO: 2770427 - protein, 8 aa, Entamoeba invadens
PNNNDQIV

SEQ ID NO: 2770428 - protein, 8 aa, Entamoeba invadens
PNNNGTLC

SEQ ID NO: 2770429 - protein, 34 aa, Entamoeba invadens
PNNNKEDDKEKRKEKQNLDSESSESNDLSTPRNF

SEQ ID NO: 2770430 - protein, 21 aa, Entamoeba invadens
PNNNNCNNTNSSKEVKEETSD

SEQ ID NO: 2770431 - protein, 5 aa, Entamoeba invadens
PNNPK

SEQ ID NO: 2770432 - protein, 7 aa, Entamoeba invadens
PNNQTKL

SEQ ID NO: 2770433 - protein, 7 aa, Entamoeba invadens
PNNSNSV

SEQ ID NO: 2770434 - protein, 7 aa, Entamoeba invadens
PNPEMQN

SEQ ID NO: 2770435 - protein, 14 aa, Entamoeba invadens
PNPGFTPNEKYEDP

SEQ ID NO: 2770436 - protein, 12 aa, Entamoeba invadens
PNPIKKYKNEGA

SEQ ID NO: 2770437 - protein, 7 aa, Entamoeba invadens
PNPISGG

SEQ ID NO: 2770438 - protein, 4 aa, Entamoeba invadens
PNPN

SEQ ID NO: 2770439 - protein, 7 aa, Entamoeba invadens
PNPQDPL

SEQ ID NO: 2770440 - protein, 5 aa, Entamoeba invadens
PNPSF

SEQ ID NO: 2770441 - protein, 8 aa, Entamoeba invadens
PNPSNKYY

SEQ ID NO: 2770442 - protein, 18 aa, Entamoeba invadens
PNPSQPNSCKTKSVHGGA

SEQ ID NO: 2770443 - protein, 6 aa, Entamoeba invadens
PNPTAV

SEQ ID NO: 2770444 - protein, 10 aa, Entamoeba invadens
PNPYTDPERM

SEQ ID NO: 2770445 - protein, 14 aa, Entamoeba invadens
PNQDPTPDQSDTIR

SEQ ID NO: 2770446 - protein, 4 aa, Entamoeba invadens
PNRS

SEQ ID NO: 2770447 - protein, 4 aa, Entamoeba invadens
PNSD

SEQ ID NO: 2770448 - protein, 8 aa, Entamoeba invadens
PNSDGTYC

SEQ ID NO: 2770449 - protein, 4 aa, Entamoeba invadens
PNSE

SEQ ID NO: 2770450 - protein, 4 aa, Entamoeba invadens
PNSG

SEQ ID NO: 2770451 - protein, 12 aa, Entamoeba invadens
PNSINKENLHEN

SEQ ID NO: 2770452 - protein, 5 aa, Entamoeba invadens
PNSPK

SEQ ID NO: 2770453 - protein, 6 aa, Entamoeba invadens
PNSPKY

SEQ ID NO: 2770454 - protein, 7 aa, Entamoeba invadens
PNSQEEL

SEQ ID NO: 2770455 - protein, 10 aa, Entamoeba invadens
PNSQQTEGDG

SEQ ID NO: 2770456 - protein, 5 aa, Entamoeba invadens
PNSSE

SEQ ID NO: 2770457 - protein, 8 aa, Entamoeba invadens
PNSSGTFC

SEQ ID NO: 2770458 - protein, 5 aa, Entamoeba invadens
PNSSL

SEQ ID NO: 2770459 - protein, 10 aa, Entamoeba invadens
PNSSNTPPIE

SEQ ID NO: 2770460 - protein, 8 aa, Entamoeba invadens
PNSSRSQL

SEQ ID NO: 2770461 - protein, 7 aa, Entamoeba invadens
PNSTQKI

SEQ ID NO: 2770462 - protein, 5 aa, Entamoeba invadens
PNSTR

SEQ ID NO: 2770463 - protein, 5 aa, Entamoeba invadens
PNTCT

SEQ ID NO: 2770464 - protein, 4 aa, Entamoeba invadens
PNTD

SEQ ID NO: 2770465 - protein, 6 aa, Entamoeba invadens
PNTDMS

SEQ ID NO: 2770466 - protein, 20 aa, Entamoeba invadens
PNTDYNKRSVARINSSTEKV

SEQ ID NO: 2770467 - protein, 7 aa, Entamoeba invadens
PNTEVAE

SEQ ID NO: 2770468 - protein, 7 aa, Entamoeba invadens
PNTGATS

SEQ ID NO: 2770469 - protein, 12 aa, Entamoeba invadens
PNTIQKVGTEQC

SEQ ID NO: 2770470 - protein, 5 aa, Entamoeba invadens
PNTKN

SEQ ID NO: 2770471 - protein, 8 aa, Entamoeba invadens
PNTLRAKG

SEQ ID NO: 2770472 - protein, 6 aa, Entamoeba invadens
PNTQNL

SEQ ID NO: 2770473 - protein, 5 aa, Entamoeba invadens
PNTQR

SEQ ID NO: 2770474 - protein, 10 aa, Entamoeba invadens
PNTSGTDDEL

SEQ ID NO: 2770475 - protein, 12 aa, Entamoeba invadens
PNTVTDVGTEQC

SEQ ID NO: 2770476 - protein, 5 aa, Entamoeba invadens
PNTYD

SEQ ID NO: 2770477 - protein, 7 aa, Entamoeba invadens
PNVEDGY

SEQ ID NO: 2770478 - protein, 7 aa, Entamoeba invadens
PNVPNQG

SEQ ID NO: 2770479 - protein, 13 aa, Entamoeba invadens
PNVPPTNPITGER

SEQ ID NO: 2770480 - protein, 9 aa, Entamoeba invadens
PNVQKSNLS

SEQ ID NO: 2770481 - protein, 9 aa, Entamoeba invadens
PNVSNGQLE

SEQ ID NO: 2770482 - protein, 7 aa, Entamoeba invadens
PNVVGET

SEQ ID NO: 2770483 - protein, 9 aa, Entamoeba invadens
PNWPSNGSI

SEQ ID NO: 2770484 - protein, 7 aa, Entamoeba invadens
PNYDSTV

SEQ ID NO: 2770485 - protein, 12 aa, Entamoeba invadens
PNYEYTDTSHQT

SEQ ID NO: 2770486 - protein, 6 aa, Entamoeba invadens
PNYNDV

SEQ ID NO: 2770487 - protein, 6 aa, Entamoeba invadens
PNYPEE

SEQ ID NO: 2770488 - protein, 10 aa, Entamoeba invadens
PNYPEQELQD

SEQ ID NO: 2770489 - protein, 7 aa, Entamoeba invadens
PNYRPSI

SEQ ID NO: 2770490 - protein, 8 aa, Entamoeba invadens
PNYRQDED

SEQ ID NO: 2770491 - protein, 13 aa, Entamoeba invadens
PNYSGINQNKGAY

SEQ ID NO: 2770492 - protein, 7 aa, Entamoeba invadens
PNYSINS

SEQ ID NO: 2770493 - protein, 8 aa, Entamoeba invadens
PNYSPNSE

SEQ ID NO: 2770494 - protein, 21 aa, Entamoeba invadens
PNYSPTTNGTCTPCNSTYSSC

SEQ ID NO: 2770495 - protein, 7 aa, Entamoeba invadens
PNYTSTI

SEQ ID NO: 2770496 - protein, 8 aa, Entamoeba invadens
PNYYPKTE

SEQ ID NO: 2770497 - protein, 5 aa, Entamoeba invadens
PPAAF

SEQ ID NO: 2770498 - protein, 4 aa, Entamoeba invadens
PPAI

SEQ ID NO: 2770499 - protein, 14 aa, Entamoeba invadens
PPAKPKSKTSCPAD

SEQ ID NO: 2770500 - protein, 9 aa, Entamoeba invadens
PPCPTGQRN

SEQ ID NO: 2770501 - protein, 10 aa, Entamoeba invadens
PPDGQECEKC

SEQ ID NO: 2770502 - protein, 8 aa, Entamoeba invadens
PPDKNKHY

SEQ ID NO: 2770503 - protein, 18 aa, Entamoeba invadens
PPEGSSIPRELPSSSSLE

SEQ ID NO: 2770504 - protein, 10 aa, Entamoeba invadens
PPEIEGHPNY

SEQ ID NO: 2770505 - protein, 8 aa, Entamoeba invadens
PPEKRMNN

SEQ ID NO: 2770506 - protein, 12 aa, Entamoeba invadens
PPELPSISGTAT

SEQ ID NO: 2770507 - protein, 11 aa, Entamoeba invadens
PPERVSEEISK

SEQ ID NO: 2770508 - protein, 6 aa, Entamoeba invadens
PPFATG

SEQ ID NO: 2770509 - protein, 5 aa, Entamoeba invadens
PPFKD

SEQ ID NO: 2770510 - protein, 6 aa, Entamoeba invadens
PPFPTN

SEQ ID NO: 2770511 - protein, 6 aa, Entamoeba invadens
PPFQPS

SEQ ID NO: 2770512 - protein, 7 aa, Entamoeba invadens
PPFTTQE

SEQ ID NO: 2770513 - protein, 6 aa, Entamoeba invadens
PPGAAS

SEQ ID NO: 2770514 - protein, 12 aa, Entamoeba invadens
PPGEQNCKQCEG

SEQ ID NO: 2770515 - protein, 14 aa, Entamoeba invadens
PPHAPTRPSTPTKP

SEQ ID NO: 2770516 - protein, 5 aa, Entamoeba invadens
PPIDK

SEQ ID NO: 2770517 - protein, 4 aa, Entamoeba invadens
PPIG

SEQ ID NO: 2770518 - protein, 6 aa, Entamoeba invadens
PPIGEG

SEQ ID NO: 2770519 - protein, 16 aa, Entamoeba invadens
PPINKTPAIYPEPTSP

SEQ ID NO: 2770520 - protein, 17 aa, Entamoeba invadens
PPINSYRKNDEKEEQLD

SEQ ID NO: 2770521 - protein, 4 aa, Entamoeba invadens
PPIP

SEQ ID NO: 2770522 - protein, 19 aa, Entamoeba invadens
PPIPPKHSEISRRKKNKMK

SEQ ID NO: 2770523 - protein, 11 aa, Entamoeba invadens
PPKGTPSYNAN

SEQ ID NO: 2770524 - protein, 10 aa, Entamoeba invadens
PPKKGAEENY

SEQ ID NO: 2770525 - protein, 13 aa, Entamoeba invadens
PPKKNHDTNPLLS

SEQ ID NO: 2770526 - protein, 10 aa, Entamoeba invadens
PPKLARSTNK

SEQ ID NO: 2770527 - protein, 8 aa, Entamoeba invadens
PPKNTLND

SEQ ID NO: 2770528 - protein, 15 aa, Entamoeba invadens
PPKNTTELVQTNSET

SEQ ID NO: 2770529 - protein, 23 aa, Entamoeba invadens
PPKPITRSAKAEKNNCKTNEFKK

SEQ ID NO: 2770530 - protein, 5 aa, Entamoeba invadens
PPKPQ

SEQ ID NO: 2770531 - protein, 4 aa, Entamoeba invadens
PPKR

SEQ ID NO: 2770532 - protein, 8 aa, Entamoeba invadens
PPKTSFDQ

SEQ ID NO: 2770533 - protein, 4 aa, Entamoeba invadens
PPKV

SEQ ID NO: 2770534 - protein, 16 aa, Entamoeba invadens
PPKVTPQTEVPPQSED

SEQ ID NO: 2770535 - protein, 7 aa, Entamoeba invadens
PPKYEAG

SEQ ID NO: 2770536 - protein, 14 aa, Entamoeba invadens
PPLKRKSGLGDTFN

SEQ ID NO: 2770537 - protein, 13 aa, Entamoeba invadens
PPLPDLIPQTQVK

SEQ ID NO: 2770538 - protein, 7 aa, Entamoeba invadens
PPLPNTK

SEQ ID NO: 2770539 - protein, 12 aa, Entamoeba invadens
PPLQSPRSSLPT

SEQ ID NO: 2770540 - protein, 4 aa, Entamoeba invadens
PPLS

SEQ ID NO: 2770541 - protein, 6 aa, Entamoeba invadens
PPLSQD

SEQ ID NO: 2770542 - protein, 9 aa, Entamoeba invadens
PPNAIPSNR

SEQ ID NO: 2770543 - protein, 11 aa, Entamoeba invadens
PPNDKVRESPM

SEQ ID NO: 2770544 - protein, 15 aa, Entamoeba invadens
PPNPITSKETSAALS

SEQ ID NO: 2770545 - protein, 10 aa, Entamoeba invadens
PPNSQTCQPC

SEQ ID NO: 2770546 - protein, 8 aa, Entamoeba invadens
PPNSVTND

SEQ ID NO: 2770547 - protein, 7 aa, Entamoeba invadens
PPNVEKD

SEQ ID NO: 2770548 - protein, 9 aa, Entamoeba invadens
PPNYNSTKN

SEQ ID NO: 2770549 - protein, 5 aa, Entamoeba invadens
PPPCV

SEQ ID NO: 2770550 - protein, 10 aa, Entamoeba invadens
PPPENTQCPK

SEQ ID NO: 2770551 - protein, 4 aa, Entamoeba invadens
PPPF

SEQ ID NO: 2770552 - protein, 5 aa, Entamoeba invadens
PPPFG

SEQ ID NO: 2770553 - protein, 9 aa, Entamoeba invadens
PPPGSSSDV

SEQ ID NO: 2770554 - protein, 24 aa, Entamoeba invadens
PPPPPAINRASQYVPTRCDLQIEM

SEQ ID NO: 2770555 - protein, 6 aa, Entamoeba invadens
PPPTPF

SEQ ID NO: 2770556 - protein, 11 aa, Entamoeba invadens
PPQATHEPIPD

SEQ ID NO: 2770557 - protein, 7 aa, Entamoeba invadens
PPQCESC

SEQ ID NO: 2770558 - protein, 12 aa, Entamoeba invadens
PPQNAVKQYTNY

SEQ ID NO: 2770559 - protein, 22 aa, Entamoeba invadens
PPQNYEQPPPPMYQDQQNYQQQ

SEQ ID NO: 2770560 - protein, 6 aa, Entamoeba invadens
PPQPEA

SEQ ID NO: 2770561 - protein, 37 aa, Entamoeba invadens
PPQPTYNPPLPPPDFQNQPMYQPPSTPGNYNQPQMQQ

SEQ ID NO: 2770562 - protein, 7 aa, Entamoeba invadens
PPQRRKE

SEQ ID NO: 2770563 - protein, 6 aa, Entamoeba invadens
PPQTYQ

SEQ ID NO: 2770564 - protein, 6 aa, Entamoeba invadens
PPRIDN

SEQ ID NO: 2770565 - protein, 7 aa, Entamoeba invadens
PPRNAYS

SEQ ID NO: 2770566 - protein, 16 aa, Entamoeba invadens
PPRVPKGTTTTKVKKE

SEQ ID NO: 2770567 - protein, 4 aa, Entamoeba invadens
PPSE

SEQ ID NO: 2770568 - protein, 15 aa, Entamoeba invadens
PPSIGGQATSCTQAQ

SEQ ID NO: 2770569 - protein, 8 aa, Entamoeba invadens
PPSQGFTP

SEQ ID NO: 2770570 - protein, 8 aa, Entamoeba invadens
PPSQRCES

SEQ ID NO: 2770571 - protein, 7 aa, Entamoeba invadens
PPSSQIG

SEQ ID NO: 2770572 - protein, 6 aa, Entamoeba invadens
PPSSVN

SEQ ID NO: 2770573 - protein, 19 aa, Entamoeba invadens
PPSTLPDGPYTYPHPSYVS

SEQ ID NO: 2770574 - protein, 20 aa, Entamoeba invadens
PPSVDTHPLPPRVPDTYSEL

SEQ ID NO: 2770575 - protein, 30 aa, Entamoeba invadens
PPSVPNEVPYTNGPSHGQEEMPLMGTGSQI

SEQ ID NO: 2770576 - protein, 6 aa, Entamoeba invadens
PPSVTS

SEQ ID NO: 2770577 - protein, 8 aa, Entamoeba invadens
PPTDDSAK

SEQ ID NO: 2770578 - protein, 10 aa, Entamoeba invadens
PPTEAAKELT

SEQ ID NO: 2770579 - protein, 6 aa, Entamoeba invadens
PPTEKK

SEQ ID NO: 2770580 - protein, 13 aa, Entamoeba invadens
PPTNTQSSDDNDV

SEQ ID NO: 2770581 - protein, 7 aa, Entamoeba invadens
PPTPEDL

SEQ ID NO: 2770582 - protein, 14 aa, Entamoeba invadens
PPTQEYQANPHQNV

SEQ ID NO: 2770583 - protein, 5 aa, Entamoeba invadens
PPTSN

SEQ ID NO: 2770584 - protein, 9 aa, Entamoeba invadens
PPTSSADPA

SEQ ID NO: 2770585 - protein, 5 aa, Entamoeba invadens
PPTYI

SEQ ID NO: 2770586 - protein, 8 aa, Entamoeba invadens
PPVDSRAN

SEQ ID NO: 2770587 - protein, 23 aa, Entamoeba invadens
PPVPGKFNTDKADSLKVPKAKRG

SEQ ID NO: 2770588 - protein, 9 aa, Entamoeba invadens
PPWAKSPEE

SEQ ID NO: 2770589 - protein, 6 aa, Entamoeba invadens
PPYNTF

SEQ ID NO: 2770590 - protein, 7 aa, Entamoeba invadens
PPYPKSE

SEQ ID NO: 2770591 - protein, 15 aa, Entamoeba invadens
PPYTDLESNKCELGK

SEQ ID NO: 2770592 - protein, 7 aa, Entamoeba invadens
PPYTRNG

SEQ ID NO: 2770593 - protein, 4 aa, Entamoeba invadens
PQAA

SEQ ID NO: 2770594 - protein, 8 aa, Entamoeba invadens
PQAFDPKE

SEQ ID NO: 2770595 - protein, 6 aa, Entamoeba invadens
PQAKES

SEQ ID NO: 2770596 - protein, 6 aa, Entamoeba invadens
PQAQPL

SEQ ID NO: 2770597 - protein, 6 aa, Entamoeba invadens
PQASQL

SEQ ID NO: 2770598 - protein, 14 aa, Entamoeba invadens
PQCTGEADNKCTGC

SEQ ID NO: 2770599 - protein, 7 aa, Entamoeba invadens
PQDEGQM

SEQ ID NO: 2770600 - protein, 4 aa, Entamoeba invadens
PQDL

SEQ ID NO: 2770601 - protein, 8 aa, Entamoeba invadens
PQDPKDRI

SEQ ID NO: 2770602 - protein, 10 aa, Entamoeba invadens
PQDPKKNTFK

SEQ ID NO: 2770603 - protein, 4 aa, Entamoeba invadens
PQDY

SEQ ID NO: 2770604 - protein, 8 aa, Entamoeba invadens
PQDYETPM

SEQ ID NO: 2770605 - protein, 40 aa, Entamoeba invadens
PQEQTLPETKDNSNTLNNQPQPSQKKSSIFKESKSPFKGL

SEQ ID NO: 2770606 - protein, 13 aa, Entamoeba invadens
PQETQKSPRTEHS

SEQ ID NO: 2770607 - protein, 5 aa, Entamoeba invadens
PQFPN

SEQ ID NO: 2770608 - protein, 7 aa, Entamoeba invadens
PQGDRAA

SEQ ID NO: 2770609 - protein, 5 aa, Entamoeba invadens
PQGKK

SEQ ID NO: 2770610 - protein, 9 aa, Entamoeba invadens
PQGVEETCE

SEQ ID NO: 2770611 - protein, 4 aa, Entamoeba invadens
PQHE

SEQ ID NO: 2770612 - protein, 6 aa, Entamoeba invadens
PQHTTN

SEQ ID NO: 2770613 - protein, 6 aa, Entamoeba invadens
PQIGEG

SEQ ID NO: 2770614 - protein, 18 aa, Entamoeba invadens
PQIPPNSPLDRPKCPQHT

SEQ ID NO: 2770615 - protein, 7 aa, Entamoeba invadens
PQIPSGV

SEQ ID NO: 2770616 - protein, 9 aa, Entamoeba invadens
PQKAGRNQK

SEQ ID NO: 2770617 - protein, 8 aa, Entamoeba invadens
PQKEKEVS

SEQ ID NO: 2770618 - protein, 7 aa, Entamoeba invadens
PQKERGE

SEQ ID NO: 2770619 - protein, 9 aa, Entamoeba invadens
PQKGELKKH

SEQ ID NO: 2770620 - protein, 9 aa, Entamoeba invadens
PQKPSDIAE

SEQ ID NO: 2770621 - protein, 10 aa, Entamoeba invadens
PQKVGTEEDG

SEQ ID NO: 2770622 - protein, 6 aa, Entamoeba invadens
PQLADT

SEQ ID NO: 2770623 - protein, 6 aa, Entamoeba invadens
PQLAPI

SEQ ID NO: 2770624 - protein, 6 aa, Entamoeba invadens
PQLDKP

SEQ ID NO: 2770625 - protein, 6 aa, Entamoeba invadens
PQLEKP

SEQ ID NO: 2770626 - protein, 4 aa, Entamoeba invadens
PQLN

SEQ ID NO: 2770627 - protein, 4 aa, Entamoeba invadens
PQNA

SEQ ID NO: 2770628 - protein, 4 aa, Entamoeba invadens
PQNC

SEQ ID NO: 2770629 - protein, 7 aa, Entamoeba invadens
PQNCSFS

SEQ ID NO: 2770630 - protein, 6 aa, Entamoeba invadens
PQNDEY

SEQ ID NO: 2770631 - protein, 6 aa, Entamoeba invadens
PQNEKG

SEQ ID NO: 2770632 - protein, 5 aa, Entamoeba invadens
PQNGK

SEQ ID NO: 2770633 - protein, 6 aa, Entamoeba invadens
PQNKGN

SEQ ID NO: 2770634 - protein, 4 aa, Entamoeba invadens
PQNN

SEQ ID NO: 2770635 - protein, 6 aa, Entamoeba invadens
PQNNDG

SEQ ID NO: 2770636 - protein, 13 aa, Entamoeba invadens
PQNNGKYLDDKGV

SEQ ID NO: 2770637 - protein, 15 aa, Entamoeba invadens
PQNNKNNTTIPTDID

SEQ ID NO: 2770638 - protein, 27 aa, Entamoeba invadens
PQNNSESVNEKRAKKREEKRKKKLEKK

SEQ ID NO: 2770639 - protein, 8 aa, Entamoeba invadens
PQNNTNRN

SEQ ID NO: 2770640 - protein, 7 aa, Entamoeba invadens
PQNRLTA

SEQ ID NO: 2770641 - protein, 7 aa, Entamoeba invadens
PQNSFSN

SEQ ID NO: 2770642 - protein, 9 aa, Entamoeba invadens
PQNTPNEID

SEQ ID NO: 2770643 - protein, 5 aa, Entamoeba invadens
PQPKQ

SEQ ID NO: 2770644 - protein, 12 aa, Entamoeba invadens
PQPLRTKTNELK

SEQ ID NO: 2770645 - protein, 4 aa, Entamoeba invadens
PQPT

SEQ ID NO: 2770646 - protein, 16 aa, Entamoeba invadens
PQQETMTPPSPNNRSK

SEQ ID NO: 2770647 - protein, 7 aa, Entamoeba invadens
PQQEVQR

SEQ ID NO: 2770648 - protein, 4 aa, Entamoeba invadens
PQQH

SEQ ID NO: 2770649 - protein, 8 aa, Entamoeba invadens
PQQQQYQQ

SEQ ID NO: 2770650 - protein, 11 aa, Entamoeba invadens
PQQVEQKKTRF

SEQ ID NO: 2770651 - protein, 5 aa, Entamoeba invadens
PQREY

SEQ ID NO: 2770652 - protein, 6 aa, Entamoeba invadens
PQRVTG

SEQ ID NO: 2770653 - protein, 6 aa, Entamoeba invadens
PQSADA

SEQ ID NO: 2770654 - protein, 4 aa, Entamoeba invadens
PQSD

SEQ ID NO: 2770655 - protein, 7 aa, Entamoeba invadens
PQSDDQN

SEQ ID NO: 2770656 - protein, 7 aa, Entamoeba invadens
PQSDGRC

SEQ ID NO: 2770657 - protein, 5 aa, Entamoeba invadens
PQSEI

SEQ ID NO: 2770658 - protein, 8 aa, Entamoeba invadens
PQSGDHVE

SEQ ID NO: 2770659 - protein, 13 aa, Entamoeba invadens
PQSMTSKPSLGSM

SEQ ID NO: 2770660 - protein, 5 aa, Entamoeba invadens
PQSNI

SEQ ID NO: 2770661 - protein, 8 aa, Entamoeba invadens
PQSPYSEF

SEQ ID NO: 2770662 - protein, 4 aa, Entamoeba invadens
PQSQ

SEQ ID NO: 2770663 - protein, 4 aa, Entamoeba invadens
PQST

SEQ ID NO: 2770664 - protein, 8 aa, Entamoeba invadens
PQSVSADP

SEQ ID NO: 2770665 - protein, 4 aa, Entamoeba invadens
PQTC

SEQ ID NO: 2770666 - protein, 5 aa, Entamoeba invadens
PQTDP

SEQ ID NO: 2770667 - protein, 11 aa, Entamoeba invadens
PQTIDPTKTVS

SEQ ID NO: 2770668 - protein, 4 aa, Entamoeba invadens
PQTK

SEQ ID NO: 2770669 - protein, 8 aa, Entamoeba invadens
PQTNPKSK

SEQ ID NO: 2770670 - protein, 4 aa, Entamoeba invadens
PQTR

SEQ ID NO: 2770671 - protein, 4 aa, Entamoeba invadens
PQTS

SEQ ID NO: 2770672 - protein, 6 aa, Entamoeba invadens
PQTSTC

SEQ ID NO: 2770673 - protein, 4 aa, Entamoeba invadens
PQTV

SEQ ID NO: 2770674 - protein, 8 aa, Entamoeba invadens
PQTVANQP

SEQ ID NO: 2770675 - protein, 6 aa, Entamoeba invadens
PQVESS

SEQ ID NO: 2770676 - protein, 6 aa, Entamoeba invadens
PQYPTP

SEQ ID NO: 2770677 - protein, 8 aa, Entamoeba invadens
PRAGRDED

SEQ ID NO: 2770678 - protein, 5 aa, Entamoeba invadens
PRASG

SEQ ID NO: 2770679 - protein, 7 aa, Entamoeba invadens
PRCDPPE

SEQ ID NO: 2770680 - protein, 12 aa, Entamoeba invadens
PRCPQDKQRAGD

SEQ ID NO: 2770681 - protein, 8 aa, Entamoeba invadens
PRDKTSTF

SEQ ID NO: 2770682 - protein, 9 aa, Entamoeba invadens
PRDSNEFRE

SEQ ID NO: 2770683 - protein, 7 aa, Entamoeba invadens
PREASPE

SEQ ID NO: 2770684 - protein, 38 aa, Entamoeba invadens
PREDETSEYFNKQDTTAEESDISNDSQNFQNDEEDNGF

SEQ ID NO: 2770685 - protein, 6 aa, Entamoeba invadens
PRESYQ

SEQ ID NO: 2770686 - protein, 10 aa, Entamoeba invadens
PRGKFNSKSQ

SEQ ID NO: 2770687 - protein, 4 aa, Entamoeba invadens
PRIT

SEQ ID NO: 2770688 - protein, 10 aa, Entamoeba invadens
PRKGVEYSST

SEQ ID NO: 2770689 - protein, 10 aa, Entamoeba invadens
PRKNKKQTFS

SEQ ID NO: 2770690 - protein, 12 aa, Entamoeba invadens
PRKRITASDALK

SEQ ID NO: 2770691 - protein, 6 aa, Entamoeba invadens
PRKSSE

SEQ ID NO: 2770692 - protein, 9 aa, Entamoeba invadens
PRKSTKPYT

SEQ ID NO: 2770693 - protein, 4 aa, Entamoeba invadens
PRKY

SEQ ID NO: 2770694 - protein, 8 aa, Entamoeba invadens
PRLPDSQE

SEQ ID NO: 2770695 - protein, 10 aa, Entamoeba invadens
PRLQPAPGTF

SEQ ID NO: 2770696 - protein, 4 aa, Entamoeba invadens
PRLS

SEQ ID NO: 2770697 - protein, 7 aa, Entamoeba invadens
PRMGESA

SEQ ID NO: 2770698 - protein, 7 aa, Entamoeba invadens
PRNETNT

SEQ ID NO: 2770699 - protein, 8 aa, Entamoeba invadens
PRPDSPSR

SEQ ID NO: 2770700 - protein, 9 aa, Entamoeba invadens
PRPGSHAQH

SEQ ID NO: 2770701 - protein, 10 aa, Entamoeba invadens
PRPQPLNTTE

SEQ ID NO: 2770702 - protein, 4 aa, Entamoeba invadens
PRPT

SEQ ID NO: 2770703 - protein, 5 aa, Entamoeba invadens
PRQRS

SEQ ID NO: 2770704 - protein, 5 aa, Entamoeba invadens
PRREQ

SEQ ID NO: 2770705 - protein, 5 aa, Entamoeba invadens
PRRGS

SEQ ID NO: 2770706 - protein, 7 aa, Entamoeba invadens
PRRSEDR

SEQ ID NO: 2770707 - protein, 8 aa, Entamoeba invadens
PRRTDREI

SEQ ID NO: 2770708 - protein, 5 aa, Entamoeba invadens
PRSAE

SEQ ID NO: 2770709 - protein, 4 aa, Entamoeba invadens
PRSD

SEQ ID NO: 2770710 - protein, 7 aa, Entamoeba invadens
PRSGTRT

SEQ ID NO: 2770711 - protein, 14 aa, Entamoeba invadens
PRSPTESEESHNVP

SEQ ID NO: 2770712 - protein, 5 aa, Entamoeba invadens
PRSPV

SEQ ID NO: 2770713 - protein, 6 aa, Entamoeba invadens
PRTEDK

SEQ ID NO: 2770714 - protein, 5 aa, Entamoeba invadens
PRTER

SEQ ID NO: 2770715 - protein, 8 aa, Entamoeba invadens
PRTPKEDI

SEQ ID NO: 2770716 - protein, 10 aa, Entamoeba invadens
PRVGPRRLKE

SEQ ID NO: 2770717 - protein, 7 aa, Entamoeba invadens
PRYEMTD

SEQ ID NO: 2770718 - protein, 4 aa, Entamoeba invadens
PSAC

SEQ ID NO: 2770719 - protein, 16 aa, Entamoeba invadens
PSACAAPNITQTTTTC

SEQ ID NO: 2770720 - protein, 7 aa, Entamoeba invadens
PSADGSY

SEQ ID NO: 2770721 - protein, 8 aa, Entamoeba invadens
PSANDTYC

SEQ ID NO: 2770722 - protein, 6 aa, Entamoeba invadens
PSANGT

SEQ ID NO: 2770723 - protein, 7 aa, Entamoeba invadens
PSANGTF

SEQ ID NO: 2770724 - protein, 8 aa, Entamoeba invadens
PSANGTYC

SEQ ID NO: 2770725 - protein, 7 aa, Entamoeba invadens
PSAPYAK

SEQ ID NO: 2770726 - protein, 8 aa, Entamoeba invadens
PSASDTKL

SEQ ID NO: 2770727 - protein, 9 aa, Entamoeba invadens
PSATPSKSD

SEQ ID NO: 2770728 - protein, 9 aa, Entamoeba invadens
PSATQKTIQ

SEQ ID NO: 2770729 - protein, 21 aa, Entamoeba invadens
PSAYGRPKTQLSSTPKQRGCS

SEQ ID NO: 2770730 - protein, 6 aa, Entamoeba invadens
PSCDTI

SEQ ID NO: 2770731 - protein, 4 aa, Entamoeba invadens
PSCF

SEQ ID NO: 2770732 - protein, 8 aa, Entamoeba invadens
PSCNNNCD

SEQ ID NO: 2770733 - protein, 7 aa, Entamoeba invadens
PSCSTCT

SEQ ID NO: 2770734 - protein, 27 aa, Entamoeba invadens
PSCTSDESDWVDSTSTDTINKVTPEME

SEQ ID NO: 2770735 - protein, 7 aa, Entamoeba invadens
PSDAEFG

SEQ ID NO: 2770736 - protein, 5 aa, Entamoeba invadens
PSDAV

SEQ ID NO: 2770737 - protein, 8 aa, Entamoeba invadens
PSDENRVE

SEQ ID NO: 2770738 - protein, 7 aa, Entamoeba invadens
PSDLQAS

SEQ ID NO: 2770739 - protein, 7 aa, Entamoeba invadens
PSDMSRK

SEQ ID NO: 2770740 - protein, 15 aa, Entamoeba invadens
PSDPQDTDNGCTDDS

SEQ ID NO: 2770741 - protein, 12 aa, Entamoeba invadens
PSDTSRIEKSTI

SEQ ID NO: 2770742 - protein, 10 aa, Entamoeba invadens
PSEDGASCES

SEQ ID NO: 2770743 - protein, 10 aa, Entamoeba invadens
PSEDGASCKS

SEQ ID NO: 2770744 - protein, 8 aa, Entamoeba invadens
PSEDGTYC

SEQ ID NO: 2770745 - protein, 9 aa, Entamoeba invadens
PSEDKTNCK

SEQ ID NO: 2770746 - protein, 11 aa, Entamoeba invadens
PSEDNSDSKPY

SEQ ID NO: 2770747 - protein, 6 aa, Entamoeba invadens
PSELPT

SEQ ID NO: 2770748 - protein, 7 aa, Entamoeba invadens
PSENGLS

SEQ ID NO: 2770749 - protein, 7 aa, Entamoeba invadens
PSENGTF

SEQ ID NO: 2770750 - protein, 10 aa, Entamoeba invadens
PSENGTYCTT

SEQ ID NO: 2770751 - protein, 4 aa, Entamoeba invadens
PSEP

SEQ ID NO: 2770752 - protein, 20 aa, Entamoeba invadens
PSERDKDGSMLQKGKSSWIN

SEQ ID NO: 2770753 - protein, 5 aa, Entamoeba invadens
PSERI

SEQ ID NO: 2770754 - protein, 5 aa, Entamoeba invadens
PSESL

SEQ ID NO: 2770755 - protein, 20 aa, Entamoeba invadens
PSEVKKEEPTDTDLEQNEDK

SEQ ID NO: 2770756 - protein, 19 aa, Entamoeba invadens
PSFNESGEKYYQASSPDEV

SEQ ID NO: 2770757 - protein, 6 aa, Entamoeba invadens
PSFNGK

SEQ ID NO: 2770758 - protein, 5 aa, Entamoeba invadens
PSFNP

SEQ ID NO: 2770759 - protein, 7 aa, Entamoeba invadens
PSFRESD

SEQ ID NO: 2770760 - protein, 4 aa, Entamoeba invadens
PSGC

SEQ ID NO: 2770761 - protein, 8 aa, Entamoeba invadens
PSGDGTLC

SEQ ID NO: 2770762 - protein, 8 aa, Entamoeba invadens
PSGDSKPI

SEQ ID NO: 2770763 - protein, 18 aa, Entamoeba invadens
PSGKVGETSHVNTAGVTA

SEQ ID NO: 2770764 - protein, 4 aa, Entamoeba invadens
PSGS

SEQ ID NO: 2770765 - protein, 11 aa, Entamoeba invadens
PSGSASVVQTG

SEQ ID NO: 2770766 - protein, 13 aa, Entamoeba invadens
PSGSITSSITQNY

SEQ ID NO: 2770767 - protein, 8 aa, Entamoeba invadens
PSGSPLLE

SEQ ID NO: 2770768 - protein, 11 aa, Entamoeba invadens
PSGSYNPYPNS

SEQ ID NO: 2770769 - protein, 12 aa, Entamoeba invadens
PSGSYQTRGGST

SEQ ID NO: 2770770 - protein, 15 aa, Entamoeba invadens
PSGSYSDVASSSCKY

SEQ ID NO: 2770771 - protein, 4 aa, Entamoeba invadens
PSGT

SEQ ID NO: 2770772 - protein, 20 aa, Entamoeba invadens
PSGTYIDENTCKSNSELQGK

SEQ ID NO: 2770773 - protein, 4 aa, Entamoeba invadens
PSGY

SEQ ID NO: 2770774 - protein, 5 aa, Entamoeba invadens
PSGYY

SEQ ID NO: 2770775 - protein, 7 aa, Entamoeba invadens
PSHRATK

SEQ ID NO: 2770776 - protein, 8 aa, Entamoeba invadens
PSHSASET

SEQ ID NO: 2770777 - protein, 8 aa, Entamoeba invadens
PSIDASNK

SEQ ID NO: 2770778 - protein, 8 aa, Entamoeba invadens
PSIDGSSC

SEQ ID NO: 2770779 - protein, 13 aa, Entamoeba invadens
PSIGMDSSDGSFY

SEQ ID NO: 2770780 - protein, 20 aa, Entamoeba invadens
PSIKKTKEKYYISSSGKGVV

SEQ ID NO: 2770781 - protein, 4 aa, Entamoeba invadens
PSIL

SEQ ID NO: 2770782 - protein, 12 aa, Entamoeba invadens
PSINGGFGYGGA

SEQ ID NO: 2770783 - protein, 5 aa, Entamoeba invadens
PSIPV

SEQ ID NO: 2770784 - protein, 4 aa, Entamoeba invadens
PSIR

SEQ ID NO: 2770785 - protein, 7 aa, Entamoeba invadens
PSISSQI

SEQ ID NO: 2770786 - protein, 8 aa, Entamoeba invadens
PSITPGYV

SEQ ID NO: 2770787 - protein, 10 aa, Entamoeba invadens
PSKDGTSCES

SEQ ID NO: 2770788 - protein, 9 aa, Entamoeba invadens
PSKHYPNQT

SEQ ID NO: 2770789 - protein, 11 aa, Entamoeba invadens
PSKIEADAITQ

SEQ ID NO: 2770790 - protein, 9 aa, Entamoeba invadens
PSKKSKNTL

SEQ ID NO: 2770791 - protein, 5 aa, Entamoeba invadens
PSKND

SEQ ID NO: 2770792 - protein, 6 aa, Entamoeba invadens
PSKNSI

SEQ ID NO: 2770793 - protein, 10 aa, Entamoeba invadens
PSKRKCDFTT

SEQ ID NO: 2770794 - protein, 10 aa, Entamoeba invadens
PSKRNLASYT

SEQ ID NO: 2770795 - protein, 7 aa, Entamoeba invadens
PSKRTSW

SEQ ID NO: 2770796 - protein, 7 aa, Entamoeba invadens
PSKTKNI

SEQ ID NO: 2770797 - protein, 8 aa, Entamoeba invadens
PSKTSLLR

SEQ ID NO: 2770798 - protein, 8 aa, Entamoeba invadens
PSKTTGKC

SEQ ID NO: 2770799 - protein, 4 aa, Entamoeba invadens
PSKY

SEQ ID NO: 2770800 - protein, 8 aa, Entamoeba invadens
PSKYDGKY

SEQ ID NO: 2770801 - protein, 12 aa, Entamoeba invadens
PSKYPNDSNKVC

SEQ ID NO: 2770802 - protein, 7 aa, Entamoeba invadens
PSLDGTY

SEQ ID NO: 2770803 - protein, 9 aa, Entamoeba invadens
PSLKSNMTE

SEQ ID NO: 2770804 - protein, 13 aa, Entamoeba invadens
PSLLSSGNKQVIG

SEQ ID NO: 2770805 - protein, 9 aa, Entamoeba invadens
PSLPPPSHT

SEQ ID NO: 2770806 - protein, 6 aa, Entamoeba invadens
PSLRSS

SEQ ID NO: 2770807 - protein, 29 aa, Entamoeba invadens
PSLSKADKSNTPKSTTKTPPDVKESPQNL

SEQ ID NO: 2770808 - protein, 5 aa, Entamoeba invadens
PSLTR

SEQ ID NO: 2770809 - protein, 13 aa, Entamoeba invadens
PSLVNDADKKVEI

SEQ ID NO: 2770810 - protein, 4 aa, Entamoeba invadens
PSNA

SEQ ID NO: 2770811 - protein, 6 aa, Entamoeba invadens
PSNESK

SEQ ID NO: 2770812 - protein, 4 aa, Entamoeba invadens
PSNG

SEQ ID NO: 2770813 - protein, 36 aa, Entamoeba invadens
PSNGLNTDEENNNGIPPSLTNTTEVPEPDTQVGQGD

SEQ ID NO: 2770814 - protein, 5 aa, Entamoeba invadens
PSNGY

SEQ ID NO: 2770815 - protein, 5 aa, Entamoeba invadens
PSNIG

SEQ ID NO: 2770816 - protein, 8 aa, Entamoeba invadens
PSNKRGYV

SEQ ID NO: 2770817 - protein, 51 aa, Entamoeba invadens
PSNKSNTSNTTIQRTSLPSKQLSKPPSKTIDSQASKTSKTQQQHSPRLDTP

SEQ ID NO: 2770818 - protein, 17 aa, Entamoeba invadens
PSNKTVAECSKTCPDEY

SEQ ID NO: 2770819 - protein, 9 aa, Entamoeba invadens
PSNMDTPGF

SEQ ID NO: 2770820 - protein, 4 aa, Entamoeba invadens
PSNN

SEQ ID NO: 2770821 - protein, 8 aa, Entamoeba invadens
PSNNTTIN

SEQ ID NO: 2770822 - protein, 8 aa, Entamoeba invadens
PSNNTTSL

SEQ ID NO: 2770823 - protein, 7 aa, Entamoeba invadens
PSNPYTN

SEQ ID NO: 2770824 - protein, 8 aa, Entamoeba invadens
PSNQTNTP

SEQ ID NO: 2770825 - protein, 6 aa, Entamoeba invadens
PSNRET

SEQ ID NO: 2770826 - protein, 4 aa, Entamoeba invadens
PSNS

SEQ ID NO: 2770827 - protein, 5 aa, Entamoeba invadens
PSNSR

SEQ ID NO: 2770828 - protein, 13 aa, Entamoeba invadens
PSNTTNALPDDPW

SEQ ID NO: 2770829 - protein, 6 aa, Entamoeba invadens
PSPDGL

SEQ ID NO: 2770830 - protein, 8 aa, Entamoeba invadens
PSPDGTYC

SEQ ID NO: 2770831 - protein, 7 aa, Entamoeba invadens
PSPERNS

SEQ ID NO: 2770832 - protein, 5 aa, Entamoeba invadens
PSPNI

SEQ ID NO: 2770833 - protein, 12 aa, Entamoeba invadens
PSPPKDPSTSCP

SEQ ID NO: 2770834 - protein, 8 aa, Entamoeba invadens
PSPSQDDL

SEQ ID NO: 2770835 - protein, 4 aa, Entamoeba invadens
PSPV

SEQ ID NO: 2770836 - protein, 5 aa, Entamoeba invadens
PSQKA

SEQ ID NO: 2770837 - protein, 6 aa, Entamoeba invadens
PSQKAK

SEQ ID NO: 2770838 - protein, 19 aa, Entamoeba invadens
PSQKAKTDISIIRTANLLK

SEQ ID NO: 2770839 - protein, 5 aa, Entamoeba invadens
PSQMS

SEQ ID NO: 2770840 - protein, 8 aa, Entamoeba invadens
PSQQEIKK

SEQ ID NO: 2770841 - protein, 4 aa, Entamoeba invadens
PSQR

SEQ ID NO: 2770842 - protein, 9 aa, Entamoeba invadens
PSQRPRAEQ

SEQ ID NO: 2770843 - protein, 6 aa, Entamoeba invadens
PSQSND

SEQ ID NO: 2770844 - protein, 5 aa, Entamoeba invadens
PSQSQ

SEQ ID NO: 2770845 - protein, 4 aa, Entamoeba invadens
PSQV

SEQ ID NO: 2770846 - protein, 4 aa, Entamoeba invadens
PSRK

SEQ ID NO: 2770847 - protein, 8 aa, Entamoeba invadens
PSRPENSV

SEQ ID NO: 2770848 - protein, 10 aa, Entamoeba invadens
PSRSTQTVSQ

SEQ ID NO: 2770849 - protein, 5 aa, Entamoeba invadens
PSSED

SEQ ID NO: 2770850 - protein, 9 aa, Entamoeba invadens
PSSETTKGI

SEQ ID NO: 2770851 - protein, 9 aa, Entamoeba invadens
PSSFSQENY

SEQ ID NO: 2770852 - protein, 7 aa, Entamoeba invadens
PSSKVGL

SEQ ID NO: 2770853 - protein, 62 aa, Entamoeba invadens
PSSPVTTFTSGSINTGSTSPQNVNTNTRGAWGQVTSDGKKTQTRTPTSRKTFIDGSKRRSLI

SEQ ID NO: 2770854 - protein, 6 aa, Entamoeba invadens
PSSQNA

SEQ ID NO: 2770855 - protein, 9 aa, Entamoeba invadens
PSSQPAADE

SEQ ID NO: 2770856 - protein, 6 aa, Entamoeba invadens
PSSTKN

SEQ ID NO: 2770857 - protein, 11 aa, Entamoeba invadens
PSSTTKSTADE

SEQ ID NO: 2770858 - protein, 16 aa, Entamoeba invadens
PSSVSTIQNGEIPEHD

SEQ ID NO: 2770859 - protein, 8 aa, Entamoeba invadens
PSTCSVNT

SEQ ID NO: 2770860 - protein, 5 aa, Entamoeba invadens
PSTES

SEQ ID NO: 2770861 - protein, 6 aa, Entamoeba invadens
PSTGSN

SEQ ID NO: 2770862 - protein, 26 aa, Entamoeba invadens
PSTHSLSQQTGNNGSNAFQQNTPINT

SEQ ID NO: 2770863 - protein, 9 aa, Entamoeba invadens
PSTKNGEIK

SEQ ID NO: 2770864 - protein, 6 aa, Entamoeba invadens
PSTLKT

SEQ ID NO: 2770865 - protein, 21 aa, Entamoeba invadens
PSTVSEAVHSDDKDKSDSDSM

SEQ ID NO: 2770866 - protein, 4 aa, Entamoeba invadens
PSTY

SEQ ID NO: 2770867 - protein, 7 aa, Entamoeba invadens
PSVDDTS

SEQ ID NO: 2770868 - protein, 8 aa, Entamoeba invadens
PSVERNRQ

SEQ ID NO: 2770869 - protein, 8 aa, Entamoeba invadens
PSVETTSD

SEQ ID NO: 2770870 - protein, 11 aa, Entamoeba invadens
PSVTVDTATSL

SEQ ID NO: 2770871 - protein, 7 aa, Entamoeba invadens
PSYGGDD

SEQ ID NO: 2770872 - protein, 13 aa, Entamoeba invadens
PSYHKERQDLSRS

SEQ ID NO: 2770873 - protein, 6 aa, Entamoeba invadens
PSYPQN

SEQ ID NO: 2770874 - protein, 17 aa, Entamoeba invadens
PSYSDGSDNPRSQVAGD

SEQ ID NO: 2770875 - protein, 6 aa, Entamoeba invadens
PTAETV

SEQ ID NO: 2770876 - protein, 13 aa, Entamoeba invadens
PTAHTQTNTTTAH

SEQ ID NO: 2770877 - protein, 5 aa, Entamoeba invadens
PTAPE

SEQ ID NO: 2770878 - protein, 18 aa, Entamoeba invadens
PTAQAPVVKTKSNDDADL

SEQ ID NO: 2770879 - protein, 5 aa, Entamoeba invadens
PTAQI

SEQ ID NO: 2770880 - protein, 10 aa, Entamoeba invadens
PTAQNTCETS

SEQ ID NO: 2770881 - protein, 11 aa, Entamoeba invadens
PTATDREKCER

SEQ ID NO: 2770882 - protein, 17 aa, Entamoeba invadens
PTCDNKQIDEYEQCDGG

SEQ ID NO: 2770883 - protein, 17 aa, Entamoeba invadens
PTCDNKQMDEYEQCDGG

SEQ ID NO: 2770884 - protein, 18 aa, Entamoeba invadens
PTCGNGQIDENEECDGGF

SEQ ID NO: 2770885 - protein, 17 aa, Entamoeba invadens
PTCGNNAIDEYEECDDG

SEQ ID NO: 2770886 - protein, 18 aa, Entamoeba invadens
PTCGNNQIDENEECDGGF

SEQ ID NO: 2770887 - protein, 4 aa, Entamoeba invadens
PTCK

SEQ ID NO: 2770888 - protein, 5 aa, Entamoeba invadens
PTCKN

SEQ ID NO: 2770889 - protein, 13 aa, Entamoeba invadens
PTCPNGDKGTCSI

SEQ ID NO: 2770890 - protein, 4 aa, Entamoeba invadens
PTDA

SEQ ID NO: 2770891 - protein, 9 aa, Entamoeba invadens
PTDANCETF

SEQ ID NO: 2770892 - protein, 8 aa, Entamoeba invadens
PTDAVSHR

SEQ ID NO: 2770893 - protein, 9 aa, Entamoeba invadens
PTDGTPPYF

SEQ ID NO: 2770894 - protein, 10 aa, Entamoeba invadens
PTDNTYQTPI

SEQ ID NO: 2770895 - protein, 5 aa, Entamoeba invadens
PTDSE

SEQ ID NO: 2770896 - protein, 17 aa, Entamoeba invadens
PTDTSVNSCDQKTELTN

SEQ ID NO: 2770897 - protein, 11 aa, Entamoeba invadens
PTDTSVQLTPN

SEQ ID NO: 2770898 - protein, 11 aa, Entamoeba invadens
PTECSTCNSAG

SEQ ID NO: 2770899 - protein, 8 aa, Entamoeba invadens
PTEDEEDL

SEQ ID NO: 2770900 - protein, 8 aa, Entamoeba invadens
PTEDFGKE

SEQ ID NO: 2770901 - protein, 4 aa, Entamoeba invadens
PTEP

SEQ ID NO: 2770902 - protein, 8 aa, Entamoeba invadens
PTERPTFN

SEQ ID NO: 2770903 - protein, 4 aa, Entamoeba invadens
PTEV

SEQ ID NO: 2770904 - protein, 11 aa, Entamoeba invadens
PTEVQKPPKPF

SEQ ID NO: 2770905 - protein, 6 aa, Entamoeba invadens
PTEYAE

SEQ ID NO: 2770906 - protein, 12 aa, Entamoeba invadens
PTEYINNSGGCP

SEQ ID NO: 2770907 - protein, 5 aa, Entamoeba invadens
PTFTQ

SEQ ID NO: 2770908 - protein, 7 aa, Entamoeba invadens
PTFTTTS

SEQ ID NO: 2770909 - protein, 6 aa, Entamoeba invadens
PTGAIS

SEQ ID NO: 2770910 - protein, 5 aa, Entamoeba invadens
PTGGG

SEQ ID NO: 2770911 - protein, 9 aa, Entamoeba invadens
PTGGKFTYE

SEQ ID NO: 2770912 - protein, 4 aa, Entamoeba invadens
PTGN

SEQ ID NO: 2770913 - protein, 8 aa, Entamoeba invadens
PTGQEDVS

SEQ ID NO: 2770914 - protein, 11 aa, Entamoeba invadens
PTGQYKKDEMT

SEQ ID NO: 2770915 - protein, 8 aa, Entamoeba invadens
PTGTNGES

SEQ ID NO: 2770916 - protein, 5 aa, Entamoeba invadens
PTGVT

SEQ ID NO: 2770917 - protein, 33 aa, Entamoeba invadens
PTHKSRSPLANSLKGSFNSEDDPSPLNTPNKQI

SEQ ID NO: 2770918 - protein, 9 aa, Entamoeba invadens
PTHPDVRST

SEQ ID NO: 2770919 - protein, 16 aa, Entamoeba invadens
PTHSTCQRAENLTPGL

SEQ ID NO: 2770920 - protein, 6 aa, Entamoeba invadens
PTHSTS

SEQ ID NO: 2770921 - protein, 4 aa, Entamoeba invadens
PTIP

SEQ ID NO: 2770922 - protein, 8 aa, Entamoeba invadens
PTISGGYT

SEQ ID NO: 2770923 - protein, 7 aa, Entamoeba invadens
PTKCERC

SEQ ID NO: 2770924 - protein, 7 aa, Entamoeba invadens
PTKCSHN

SEQ ID NO: 2770925 - protein, 6 aa, Entamoeba invadens
PTKEGV

SEQ ID NO: 2770926 - protein, 9 aa, Entamoeba invadens
PTKESEELS

SEQ ID NO: 2770927 - protein, 8 aa, Entamoeba invadens
PTKIETQK

SEQ ID NO: 2770928 - protein, 17 aa, Entamoeba invadens
PTKKEYPYDSAHPNNCY

SEQ ID NO: 2770929 - protein, 7 aa, Entamoeba invadens
PTKPVKI

SEQ ID NO: 2770930 - protein, 7 aa, Entamoeba invadens
PTKPYTY

SEQ ID NO: 2770931 - protein, 8 aa, Entamoeba invadens
PTKPYTYG

SEQ ID NO: 2770932 - protein, 6 aa, Entamoeba invadens
PTKQHS

SEQ ID NO: 2770933 - protein, 14 aa, Entamoeba invadens
PTKRASHDLTKDMD

SEQ ID NO: 2770934 - protein, 4 aa, Entamoeba invadens
PTKS

SEQ ID NO: 2770935 - protein, 8 aa, Entamoeba invadens
PTKSGDKV

SEQ ID NO: 2770936 - protein, 9 aa, Entamoeba invadens
PTKSPTGSA

SEQ ID NO: 2770937 - protein, 8 aa, Entamoeba invadens
PTKSQQCK

SEQ ID NO: 2770938 - protein, 26 aa, Entamoeba invadens
PTKTITKPRFKTNDKFSSESVSIGNT

SEQ ID NO: 2770939 - protein, 5 aa, Entamoeba invadens
PTKVK

SEQ ID NO: 2770940 - protein, 5 aa, Entamoeba invadens
PTLEE

SEQ ID NO: 2770941 - protein, 5 aa, Entamoeba invadens
PTLET

SEQ ID NO: 2770942 - protein, 4 aa, Entamoeba invadens
PTLS

SEQ ID NO: 2770943 - protein, 5 aa, Entamoeba invadens
PTLTA

SEQ ID NO: 2770944 - protein, 6 aa, Entamoeba invadens
PTLTES

SEQ ID NO: 2770945 - protein, 10 aa, Entamoeba invadens
PTLTGDKEER

SEQ ID NO: 2770946 - protein, 10 aa, Entamoeba invadens
PTMETTKQNI

SEQ ID NO: 2770947 - protein, 6 aa, Entamoeba invadens
PTNCNV

SEQ ID NO: 2770948 - protein, 11 aa, Entamoeba invadens
PTNDPTNNSTK

SEQ ID NO: 2770949 - protein, 10 aa, Entamoeba invadens
PTNESTKSLP

SEQ ID NO: 2770950 - protein, 5 aa, Entamoeba invadens
PTNFQ

SEQ ID NO: 2770951 - protein, 6 aa, Entamoeba invadens
PTNNSP

SEQ ID NO: 2770952 - protein, 7 aa, Entamoeba invadens
PTNNTLN

SEQ ID NO: 2770953 - protein, 4 aa, Entamoeba invadens
PTNP

SEQ ID NO: 2770954 - protein, 7 aa, Entamoeba invadens
PTNPTIP

SEQ ID NO: 2770955 - protein, 4 aa, Entamoeba invadens
PTNS

SEQ ID NO: 2770956 - protein, 5 aa, Entamoeba invadens
PTNSP

SEQ ID NO: 2770957 - protein, 8 aa, Entamoeba invadens
PTNTVEGS

SEQ ID NO: 2770958 - protein, 4 aa, Entamoeba invadens
PTNY

SEQ ID NO: 2770959 - protein, 4 aa, Entamoeba invadens
PTPI

SEQ ID NO: 2770960 - protein, 7 aa, Entamoeba invadens
PTPIAPE

SEQ ID NO: 2770961 - protein, 15 aa, Entamoeba invadens
PTPIESTKEEPPMED

SEQ ID NO: 2770962 - protein, 19 aa, Entamoeba invadens
PTPINEKSNKEEKLNAKTI

SEQ ID NO: 2770963 - protein, 16 aa, Entamoeba invadens
PTPKKTSCVGGVKEGK

SEQ ID NO: 2770964 - protein, 9 aa, Entamoeba invadens
PTPKQAGNY

SEQ ID NO: 2770965 - protein, 11 aa, Entamoeba invadens
PTPRTDYYQSN

SEQ ID NO: 2770966 - protein, 4 aa, Entamoeba invadens
PTPT

SEQ ID NO: 2770967 - protein, 5 aa, Entamoeba invadens
PTQAD

SEQ ID NO: 2770968 - protein, 6 aa, Entamoeba invadens
PTQNRE

SEQ ID NO: 2770969 - protein, 5 aa, Entamoeba invadens
PTQPS

SEQ ID NO: 2770970 - protein, 8 aa, Entamoeba invadens
PTQSGRTL

SEQ ID NO: 2770971 - protein, 10 aa, Entamoeba invadens
PTQSKCSDEI

SEQ ID NO: 2770972 - protein, 11 aa, Entamoeba invadens
PTQSTSTVTTG

SEQ ID NO: 2770973 - protein, 12 aa, Entamoeba invadens
PTQTKYPVTDEE

SEQ ID NO: 2770974 - protein, 6 aa, Entamoeba invadens
PTQTQT

SEQ ID NO: 2770975 - protein, 6 aa, Entamoeba invadens
PTREPT

SEQ ID NO: 2770976 - protein, 5 aa, Entamoeba invadens
PTRER

SEQ ID NO: 2770977 - protein, 10 aa, Entamoeba invadens
PTRESCDKCE

SEQ ID NO: 2770978 - protein, 4 aa, Entamoeba invadens
PTRI

SEQ ID NO: 2770979 - protein, 7 aa, Entamoeba invadens
PTRNGTV

SEQ ID NO: 2770980 - protein, 10 aa, Entamoeba invadens
PTRPAVTQLS

SEQ ID NO: 2770981 - protein, 7 aa, Entamoeba invadens
PTRPENA

SEQ ID NO: 2770982 - protein, 8 aa, Entamoeba invadens
PTRPENSV

SEQ ID NO: 2770983 - protein, 15 aa, Entamoeba invadens
PTRPEVENYKTYEEY

SEQ ID NO: 2770984 - protein, 4 aa, Entamoeba invadens
PTSD

SEQ ID NO: 2770985 - protein, 5 aa, Entamoeba invadens
PTSDA

SEQ ID NO: 2770986 - protein, 6 aa, Entamoeba invadens
PTSDSF

SEQ ID NO: 2770987 - protein, 15 aa, Entamoeba invadens
PTSGAPSEIKNYPGR

SEQ ID NO: 2770988 - protein, 8 aa, Entamoeba invadens
PTSGISES

SEQ ID NO: 2770989 - protein, 10 aa, Entamoeba invadens
PTSKPQQNGD

SEQ ID NO: 2770990 - protein, 5 aa, Entamoeba invadens
PTSNL

SEQ ID NO: 2770991 - protein, 5 aa, Entamoeba invadens
PTSPY

SEQ ID NO: 2770992 - protein, 4 aa, Entamoeba invadens
PTSS

SEQ ID NO: 2770993 - protein, 9 aa, Entamoeba invadens
PTSSGTSCR

SEQ ID NO: 2770994 - protein, 8 aa, Entamoeba invadens
PTSSQNSI

SEQ ID NO: 2770995 - protein, 8 aa, Entamoeba invadens
PTSTGRSC

SEQ ID NO: 2770996 - protein, 4 aa, Entamoeba invadens
PTSV

SEQ ID NO: 2770997 - protein, 8 aa, Entamoeba invadens
PTSWEEEK

SEQ ID NO: 2770998 - protein, 5 aa, Entamoeba invadens
PTTCS

SEQ ID NO: 2770999 - protein, 4 aa, Entamoeba invadens
PTTF

SEQ ID NO: 2771000 - protein, 8 aa, Entamoeba invadens
PTTFKNSS

SEQ ID NO: 2771001 - protein, 6 aa, Entamoeba invadens
PTTGLD

SEQ ID NO: 2771002 - protein, 4 aa, Entamoeba invadens
PTTI

SEQ ID NO: 2771003 - protein, 5 aa, Entamoeba invadens
PTTIK

SEQ ID NO: 2771004 - protein, 4 aa, Entamoeba invadens
PTTL

SEQ ID NO: 2771005 - protein, 5 aa, Entamoeba invadens
PTTLS

SEQ ID NO: 2771006 - protein, 5 aa, Entamoeba invadens
PTTNG

SEQ ID NO: 2771007 - protein, 9 aa, Entamoeba invadens
PTTNTQDPL

SEQ ID NO: 2771008 - protein, 8 aa, Entamoeba invadens
PTTPANSP

SEQ ID NO: 2771009 - protein, 5 aa, Entamoeba invadens
PTTPI

SEQ ID NO: 2771010 - protein, 7 aa, Entamoeba invadens
PTTPLNQ

SEQ ID NO: 2771011 - protein, 4 aa, Entamoeba invadens
PTTS

SEQ ID NO: 2771012 - protein, 12 aa, Entamoeba invadens
PTTSETTKTNGY

SEQ ID NO: 2771013 - protein, 10 aa, Entamoeba invadens
PTTSQTDNTL

SEQ ID NO: 2771014 - protein, 5 aa, Entamoeba invadens
PTTTF

SEQ ID NO: 2771015 - protein, 4 aa, Entamoeba invadens
PTTV

SEQ ID NO: 2771016 - protein, 5 aa, Entamoeba invadens
PTTVE

SEQ ID NO: 2771017 - protein, 7 aa, Entamoeba invadens
PTTVNGK

SEQ ID NO: 2771018 - protein, 6 aa, Entamoeba invadens
PTVKYD

SEQ ID NO: 2771019 - protein, 7 aa, Entamoeba invadens
PTVPPAG

SEQ ID NO: 2771020 - protein, 4 aa, Entamoeba invadens
PTVS

SEQ ID NO: 2771021 - protein, 5 aa, Entamoeba invadens
PTVSK

SEQ ID NO: 2771022 - protein, 4 aa, Entamoeba invadens
PTYS

SEQ ID NO: 2771023 - protein, 5 aa, Entamoeba invadens
PTYSE

SEQ ID NO: 2771024 - protein, 15 aa, Entamoeba invadens
PVARPTKKTSQYNTD

SEQ ID NO: 2771025 - protein, 31 aa, Entamoeba invadens
PVDEEEESSSEEENENNEEGEEQEEKEKQKE

SEQ ID NO: 2771026 - protein, 7 aa, Entamoeba invadens
PVDEETR

SEQ ID NO: 2771027 - protein, 20 aa, Entamoeba invadens
PVDKRQQHALESRQKREEKA

SEQ ID NO: 2771028 - protein, 7 aa, Entamoeba invadens
PVDNETK

SEQ ID NO: 2771029 - protein, 7 aa, Entamoeba invadens
PVDSETR

SEQ ID NO: 2771030 - protein, 8 aa, Entamoeba invadens
PVDSPTTT

SEQ ID NO: 2771031 - protein, 7 aa, Entamoeba invadens
PVEAPPN

SEQ ID NO: 2771032 - protein, 4 aa, Entamoeba invadens
PVEE

SEQ ID NO: 2771033 - protein, 24 aa, Entamoeba invadens
PVEETKEKKANYSTPPDNWPTQGK

SEQ ID NO: 2771034 - protein, 7 aa, Entamoeba invadens
PVEGDTQ

SEQ ID NO: 2771035 - protein, 9 aa, Entamoeba invadens
PVEGSSEVK

SEQ ID NO: 2771036 - protein, 32 aa, Entamoeba invadens
PVEPQQPMGTAPVATTEPQADQADKKSVSSKE

SEQ ID NO: 2771037 - protein, 4 aa, Entamoeba invadens
PVES

SEQ ID NO: 2771038 - protein, 5 aa, Entamoeba invadens
PVESP

SEQ ID NO: 2771039 - protein, 12 aa, Entamoeba invadens
PVESSSDFSDDA

SEQ ID NO: 2771040 - protein, 8 aa, Entamoeba invadens
PVFPQDDN

SEQ ID NO: 2771041 - protein, 9 aa, Entamoeba invadens
PVGDDGELP

SEQ ID NO: 2771042 - protein, 14 aa, Entamoeba invadens
PVGGSVKLDGNDLR

SEQ ID NO: 2771043 - protein, 7 aa, Entamoeba invadens
PVGKESR

SEQ ID NO: 2771044 - protein, 15 aa, Entamoeba invadens
PVGSTSSSEKNGVSV

SEQ ID NO: 2771045 - protein, 10 aa, Entamoeba invadens
PVIETPDERQ

SEQ ID NO: 2771046 - protein, 7 aa, Entamoeba invadens
PVIQPNS

SEQ ID NO: 2771047 - protein, 10 aa, Entamoeba invadens
PVISTKPSSF

SEQ ID NO: 2771048 - protein, 8 aa, Entamoeba invadens
PVKGDKKK

SEQ ID NO: 2771049 - protein, 5 aa, Entamoeba invadens
PVKTP

SEQ ID NO: 2771050 - protein, 8 aa, Entamoeba invadens
PVLSEQTP

SEQ ID NO: 2771051 - protein, 7 aa, Entamoeba invadens
PVNKETS

SEQ ID NO: 2771052 - protein, 10 aa, Entamoeba invadens
PVNNNNTKKC

SEQ ID NO: 2771053 - protein, 10 aa, Entamoeba invadens
PVNPTPSNVT

SEQ ID NO: 2771054 - protein, 7 aa, Entamoeba invadens
PVNQETK

SEQ ID NO: 2771055 - protein, 24 aa, Entamoeba invadens
PVPGYTPSADKATYTPAADTTGVD

SEQ ID NO: 2771056 - protein, 34 aa, Entamoeba invadens
PVPSEVPLANDQKKTSVLDKTSESGSGSNSGSNK

SEQ ID NO: 2771057 - protein, 5 aa, Entamoeba invadens
PVPSL

SEQ ID NO: 2771058 - protein, 16 aa, Entamoeba invadens
PVQESSDTSNSETGKV

SEQ ID NO: 2771059 - protein, 6 aa, Entamoeba invadens
PVQKDS

SEQ ID NO: 2771060 - protein, 10 aa, Entamoeba invadens
PVQKDSEKKF

SEQ ID NO: 2771061 - protein, 19 aa, Entamoeba invadens
PVQPEECTATANFSRVGDE

SEQ ID NO: 2771062 - protein, 7 aa, Entamoeba invadens
PVSEETR

SEQ ID NO: 2771063 - protein, 8 aa, Entamoeba invadens
PVSGSSDF

SEQ ID NO: 2771064 - protein, 10 aa, Entamoeba invadens
PVSKGTISPL

SEQ ID NO: 2771065 - protein, 7 aa, Entamoeba invadens
PVSPTRA

SEQ ID NO: 2771066 - protein, 8 aa, Entamoeba invadens
PVSSTEAY

SEQ ID NO: 2771067 - protein, 6 aa, Entamoeba invadens
PVTFTG

SEQ ID NO: 2771068 - protein, 16 aa, Entamoeba invadens
PVTMKQASSPKLGSSA

SEQ ID NO: 2771069 - protein, 9 aa, Entamoeba invadens
PVTNSQVGD

SEQ ID NO: 2771070 - protein, 7 aa, Entamoeba invadens
PVTTSSR

SEQ ID NO: 2771071 - protein, 6 aa, Entamoeba invadens
PVTYTN

SEQ ID NO: 2771072 - protein, 9 aa, Entamoeba invadens
PVVPPETEL

SEQ ID NO: 2771073 - protein, 11 aa, Entamoeba invadens
PWDSAPTEGAI

SEQ ID NO: 2771074 - protein, 11 aa, Entamoeba invadens
PWISSNRSYTQ

SEQ ID NO: 2771075 - protein, 14 aa, Entamoeba invadens
PYAPNDSNSLEELE

SEQ ID NO: 2771076 - protein, 4 aa, Entamoeba invadens
PYDE

SEQ ID NO: 2771077 - protein, 6 aa, Entamoeba invadens
PYDNEY

SEQ ID NO: 2771078 - protein, 10 aa, Entamoeba invadens
PYEGTKETQC

SEQ ID NO: 2771079 - protein, 5 aa, Entamoeba invadens
PYEKP

SEQ ID NO: 2771080 - protein, 13 aa, Entamoeba invadens
PYGGNSQSELNAK

SEQ ID NO: 2771081 - protein, 17 aa, Entamoeba invadens
PYGSLSDLKKKKKITEV

SEQ ID NO: 2771082 - protein, 7 aa, Entamoeba invadens
PYIQPTK

SEQ ID NO: 2771083 - protein, 10 aa, Entamoeba invadens
PYKDDPQRNM

SEQ ID NO: 2771084 - protein, 4 aa, Entamoeba invadens
PYKE

SEQ ID NO: 2771085 - protein, 37 aa, Entamoeba invadens
PYKGPTQPQNSETEDDVSDEDIQNKKPLIPKPVGSPA

SEQ ID NO: 2771086 - protein, 8 aa, Entamoeba invadens
PYKTSNGV

SEQ ID NO: 2771087 - protein, 4 aa, Entamoeba invadens
PYNP

SEQ ID NO: 2771088 - protein, 10 aa, Entamoeba invadens
PYNPTQTTCQ

SEQ ID NO: 2771089 - protein, 10 aa, Entamoeba invadens
PYNSEDCTGD

SEQ ID NO: 2771090 - protein, 15 aa, Entamoeba invadens
PYNSQDCTGAVDTTL

SEQ ID NO: 2771091 - protein, 5 aa, Entamoeba invadens
PYPDN

SEQ ID NO: 2771092 - protein, 4 aa, Entamoeba invadens
PYPK

SEQ ID NO: 2771093 - protein, 5 aa, Entamoeba invadens
PYPKA

SEQ ID NO: 2771094 - protein, 11 aa, Entamoeba invadens
PYPKEQFPDTE

SEQ ID NO: 2771095 - protein, 7 aa, Entamoeba invadens
PYPKNEF

SEQ ID NO: 2771096 - protein, 5 aa, Entamoeba invadens
PYPKQ

SEQ ID NO: 2771097 - protein, 8 aa, Entamoeba invadens
PYPSNETH

SEQ ID NO: 2771098 - protein, 5 aa, Entamoeba invadens
PYQDD

SEQ ID NO: 2771099 - protein, 7 aa, Entamoeba invadens
PYQNETD

SEQ ID NO: 2771100 - protein, 5 aa, Entamoeba invadens
PYQNN

SEQ ID NO: 2771101 - protein, 13 aa, Entamoeba invadens
PYSARPKFGQEST

SEQ ID NO: 2771102 - protein, 15 aa, Entamoeba invadens
PYSASTSDNHETASD

SEQ ID NO: 2771103 - protein, 28 aa, Entamoeba invadens
PYSLSSNGKSCDQCASTSYYDKTTNRCV

SEQ ID NO: 2771104 - protein, 17 aa, Entamoeba invadens
PYSPAKVSRMSSSSSSL

SEQ ID NO: 2771105 - protein, 6 aa, Entamoeba invadens
PYSSDT

SEQ ID NO: 2771106 - protein, 16 aa, Entamoeba invadens
PYSTIQERDVGQSPTV

SEQ ID NO: 2771107 - protein, 6 aa, Entamoeba invadens
PYSTPG

SEQ ID NO: 2771108 - protein, 10 aa, Entamoeba invadens
PYSTTSEKKC

SEQ ID NO: 2771109 - protein, 4 aa, Entamoeba invadens
PYTE

SEQ ID NO: 2771110 - protein, 4 aa, Entamoeba invadens
PYTI

SEQ ID NO: 2771111 - protein, 11 aa, Entamoeba invadens
PYTKDYDSGTF

SEQ ID NO: 2771112 - protein, 9 aa, Entamoeba invadens
PYTKSKTTT

SEQ ID NO: 2771113 - protein, 12 aa, Entamoeba invadens
PYTQTRDENTKE

SEQ ID NO: 2771114 - protein, 4 aa, Entamoeba invadens
PYYT

SEQ ID NO: 2771115 - protein, 8 aa, Entamoeba invadens
QACSQKDN

SEQ ID NO: 2771116 - protein, 14 aa, Entamoeba invadens
QADANTQKSERGHS

SEQ ID NO: 2771117 - protein, 5 aa, Entamoeba invadens
QADGT

SEQ ID NO: 2771118 - protein, 4 aa, Entamoeba invadens
QADS

SEQ ID NO: 2771119 - protein, 5 aa, Entamoeba invadens
QADSQ

SEQ ID NO: 2771120 - protein, 6 aa, Entamoeba invadens
QADTTG

SEQ ID NO: 2771121 - protein, 6 aa, Entamoeba invadens
QADVRS

SEQ ID NO: 2771122 - protein, 34 aa, Entamoeba invadens
QAEGGAPPLPPRTQFETQETEEVESTEGIETTLD

SEQ ID NO: 2771123 - protein, 5 aa, Entamoeba invadens
QAEKH

SEQ ID NO: 2771124 - protein, 44 aa, Entamoeba invadens
QAEKPVDPPVAPVDPSNPSEPTEPEKPVNSEESTENSEIANLDG

SEQ ID NO: 2771125 - protein, 6 aa, Entamoeba invadens
QAERMS

SEQ ID NO: 2771126 - protein, 6 aa, Entamoeba invadens
QAESTD

SEQ ID NO: 2771127 - protein, 11 aa, Entamoeba invadens
QAFSASLSPLT

SEQ ID NO: 2771128 - protein, 8 aa, Entamoeba invadens
QAFSDNDN

SEQ ID NO: 2771129 - protein, 8 aa, Entamoeba invadens
QAGSHANQ

SEQ ID NO: 2771130 - protein, 7 aa, Entamoeba invadens
QAGTHEQ

SEQ ID NO: 2771131 - protein, 15 aa, Entamoeba invadens
QAHNTVGNNTAIGPI

SEQ ID NO: 2771132 - protein, 12 aa, Entamoeba invadens
QAKESGRGVNTT

SEQ ID NO: 2771133 - protein, 11 aa, Entamoeba invadens
QAKRQDPKEHD

SEQ ID NO: 2771134 - protein, 23 aa, Entamoeba invadens
QAKTEARSAPGQMSERTQTTTDF

SEQ ID NO: 2771135 - protein, 10 aa, Entamoeba invadens
QAKYPKDRLN

SEQ ID NO: 2771136 - protein, 14 aa, Entamoeba invadens
QALGSSNSHSALYS

SEQ ID NO: 2771137 - protein, 9 aa, Entamoeba invadens
QALRKASKI

SEQ ID NO: 2771138 - protein, 7 aa, Entamoeba invadens
QALTTQG

SEQ ID NO: 2771139 - protein, 20 aa, Entamoeba invadens
QANAQYYTTSSVDNQKEKDN

SEQ ID NO: 2771140 - protein, 13 aa, Entamoeba invadens
QANLGTTINELPE

SEQ ID NO: 2771141 - protein, 10 aa, Entamoeba invadens
QANNDEEYRY

SEQ ID NO: 2771142 - protein, 4 aa, Entamoeba invadens
QANT

SEQ ID NO: 2771143 - protein, 7 aa, Entamoeba invadens
QANTDNI

SEQ ID NO: 2771144 - protein, 7 aa, Entamoeba invadens
QANVDCD

SEQ ID NO: 2771145 - protein, 5 aa, Entamoeba invadens
QAPPF

SEQ ID NO: 2771146 - protein, 21 aa, Entamoeba invadens
QAQAEITDITTSSFSVPDNAD

SEQ ID NO: 2771147 - protein, 9 aa, Entamoeba invadens
QAQKDFDDS

SEQ ID NO: 2771148 - protein, 7 aa, Entamoeba invadens
QAQNSEE

SEQ ID NO: 2771149 - protein, 7 aa, Entamoeba invadens
QAQTEET

SEQ ID NO: 2771150 - protein, 13 aa, Entamoeba invadens
QARETEDMNDYQR

SEQ ID NO: 2771151 - protein, 4 aa, Entamoeba invadens
QARG

SEQ ID NO: 2771152 - protein, 6 aa, Entamoeba invadens
QARNNA

SEQ ID NO: 2771153 - protein, 12 aa, Entamoeba invadens
QARYTKSSSALG

SEQ ID NO: 2771154 - protein, 11 aa, Entamoeba invadens
QASASSGDIEI

SEQ ID NO: 2771155 - protein, 7 aa, Entamoeba invadens
QASGFGK

SEQ ID NO: 2771156 - protein, 10 aa, Entamoeba invadens
QASGKNTKTL

SEQ ID NO: 2771157 - protein, 13 aa, Entamoeba invadens
QASKVARKRPSNW

SEQ ID NO: 2771158 - protein, 66 aa, Entamoeba invadens
QASQSSQNSEGEKSSSSVKRRVSNSETRPSTQTTTSSSKGNSSSKDKSSKNSSKNSKSRRKKSKVS

SEQ ID NO: 2771159 - protein, 14 aa, Entamoeba invadens
QASRQANQYDLGTA

SEQ ID NO: 2771160 - protein, 12 aa, Entamoeba invadens
QASVKQRGTPLY

SEQ ID NO: 2771161 - protein, 22 aa, Entamoeba invadens
QATDNENEQIPDIDNNKENTTD

SEQ ID NO: 2771162 - protein, 14 aa, Entamoeba invadens
QATFSGDSQIRLED

SEQ ID NO: 2771163 - protein, 6 aa, Entamoeba invadens
QATPAH

SEQ ID NO: 2771164 - protein, 11 aa, Entamoeba invadens
QATTERPKFDE

SEQ ID NO: 2771165 - protein, 8 aa, Entamoeba invadens
QATVSETD

SEQ ID NO: 2771166 - protein, 7 aa, Entamoeba invadens
QATVTET

SEQ ID NO: 2771167 - protein, 16 aa, Entamoeba invadens
QAVKGTIDKNKRTVTV

SEQ ID NO: 2771168 - protein, 4 aa, Entamoeba invadens
QAYD

SEQ ID NO: 2771169 - protein, 15 aa, Entamoeba invadens
QAYEKQNAKYRAPTL

SEQ ID NO: 2771170 - protein, 8 aa, Entamoeba invadens
QAYSRSNG

SEQ ID NO: 2771171 - protein, 4 aa, Entamoeba invadens
QCAK

SEQ ID NO: 2771172 - protein, 13 aa, Entamoeba invadens
QCAQEEENGEIEE

SEQ ID NO: 2771173 - protein, 11 aa, Entamoeba invadens
QCDADKKCTYC

SEQ ID NO: 2771174 - protein, 12 aa, Entamoeba invadens
QCDPTNSEVEDV

SEQ ID NO: 2771175 - protein, 6 aa, Entamoeba invadens
QCDSSH

SEQ ID NO: 2771176 - protein, 10 aa, Entamoeba invadens
QCEDTNCKTC

SEQ ID NO: 2771177 - protein, 5 aa, Entamoeba invadens
QCENG

SEQ ID NO: 2771178 - protein, 16 aa, Entamoeba invadens
QCENGKETQCNSTSLM

SEQ ID NO: 2771179 - protein, 5 aa, Entamoeba invadens
QCENN

SEQ ID NO: 2771180 - protein, 8 aa, Entamoeba invadens
QCERCPST

SEQ ID NO: 2771181 - protein, 17 aa, Entamoeba invadens
QCGDGTYANTPGSTSCK

SEQ ID NO: 2771182 - protein, 6 aa, Entamoeba invadens
QCGQTT

SEQ ID NO: 2771183 - protein, 15 aa, Entamoeba invadens
QCGSGCSSCDNSNNC

SEQ ID NO: 2771184 - protein, 4 aa, Entamoeba invadens
QCGT

SEQ ID NO: 2771185 - protein, 8 aa, Entamoeba invadens
QCGTDNCE

SEQ ID NO: 2771186 - protein, 15 aa, Entamoeba invadens
QCHETTAYNTTDKTC

SEQ ID NO: 2771187 - protein, 4 aa, Entamoeba invadens
QCHP

SEQ ID NO: 2771188 - protein, 13 aa, Entamoeba invadens
QCIKDRDTKECTG

SEQ ID NO: 2771189 - protein, 12 aa, Entamoeba invadens
QCIKDSTTTPCT

SEQ ID NO: 2771190 - protein, 5 aa, Entamoeba invadens
QCING

SEQ ID NO: 2771191 - protein, 5 aa, Entamoeba invadens
QCKDG

SEQ ID NO: 2771192 - protein, 15 aa, Entamoeba invadens
QCKSCSSQCKQCSNA

SEQ ID NO: 2771193 - protein, 8 aa, Entamoeba invadens
QCKSNENL

SEQ ID NO: 2771194 - protein, 4 aa, Entamoeba invadens
QCKT

SEQ ID NO: 2771195 - protein, 19 aa, Entamoeba invadens
QCMETNKRIKTKNVLPEDK

SEQ ID NO: 2771196 - protein, 10 aa, Entamoeba invadens
QCNDMSTGHC

SEQ ID NO: 2771197 - protein, 9 aa, Entamoeba invadens
QCNDQDGDC

SEQ ID NO: 2771198 - protein, 11 aa, Entamoeba invadens
QCNEDDAATKC

SEQ ID NO: 2771199 - protein, 9 aa, Entamoeba invadens
QCNGQTGAC

SEQ ID NO: 2771200 - protein, 11 aa, Entamoeba invadens
QCNSGYTLSNG

SEQ ID NO: 2771201 - protein, 12 aa, Entamoeba invadens
QCNSSGNGYQGT

SEQ ID NO: 2771202 - protein, 4 aa, Entamoeba invadens
QCPY

SEQ ID NO: 2771203 - protein, 9 aa, Entamoeba invadens
QCPYTTGEK

SEQ ID NO: 2771204 - protein, 4 aa, Entamoeba invadens
QCQQ

SEQ ID NO: 2771205 - protein, 10 aa, Entamoeba invadens
QCQRCDEQCG

SEQ ID NO: 2771206 - protein, 5 aa, Entamoeba invadens
QCQTT

SEQ ID NO: 2771207 - protein, 20 aa, Entamoeba invadens
QCSAGKVGDTDECKGNTEGC

SEQ ID NO: 2771208 - protein, 5 aa, Entamoeba invadens
QCSQC

SEQ ID NO: 2771209 - protein, 12 aa, Entamoeba invadens
QCSQKAENEDFG

SEQ ID NO: 2771210 - protein, 5 aa, Entamoeba invadens
QCSSC

SEQ ID NO: 2771211 - protein, 8 aa, Entamoeba invadens
QCSSTGSC

SEQ ID NO: 2771212 - protein, 4 aa, Entamoeba invadens
QCST

SEQ ID NO: 2771213 - protein, 13 aa, Entamoeba invadens
QCSTGSQCLPQDQ

SEQ ID NO: 2771214 - protein, 9 aa, Entamoeba invadens
QCSTNPDKK

SEQ ID NO: 2771215 - protein, 9 aa, Entamoeba invadens
QCTGNAEKC

SEQ ID NO: 2771216 - protein, 14 aa, Entamoeba invadens
QCTGTNASQCGQCD

SEQ ID NO: 2771217 - protein, 4 aa, Entamoeba invadens
QCTN

SEQ ID NO: 2771218 - protein, 5 aa, Entamoeba invadens
QCTNQ

SEQ ID NO: 2771219 - protein, 6 aa, Entamoeba invadens
QCTPNT

SEQ ID NO: 2771220 - protein, 6 aa, Entamoeba invadens
QCTRCS

SEQ ID NO: 2771221 - protein, 17 aa, Entamoeba invadens
QCTSGNYLKDGGCASCT

SEQ ID NO: 2771222 - protein, 5 aa, Entamoeba invadens
QCTSS

SEQ ID NO: 2771223 - protein, 7 aa, Entamoeba invadens
QCTSTGC

SEQ ID NO: 2771224 - protein, 7 aa, Entamoeba invadens
QCTTNNY

SEQ ID NO: 2771225 - protein, 10 aa, Entamoeba invadens
QCVSSGSCES

SEQ ID NO: 2771226 - protein, 9 aa, Entamoeba invadens
QCYPNGERK

SEQ ID NO: 2771227 - protein, 6 aa, Entamoeba invadens
QDAVSN

SEQ ID NO: 2771228 - protein, 7 aa, Entamoeba invadens
QDDDTYT

SEQ ID NO: 2771229 - protein, 22 aa, Entamoeba invadens
QDDGNKGTNTQIREEKKEEESS

SEQ ID NO: 2771230 - protein, 4 aa, Entamoeba invadens
QDDT

SEQ ID NO: 2771231 - protein, 7 aa, Entamoeba invadens
QDDTKKI

SEQ ID NO: 2771232 - protein, 10 aa, Entamoeba invadens
QDDTRGYDSQ

SEQ ID NO: 2771233 - protein, 8 aa, Entamoeba invadens
QDDVPEGY

SEQ ID NO: 2771234 - protein, 10 aa, Entamoeba invadens
QDDVQTNREK

SEQ ID NO: 2771235 - protein, 9 aa, Entamoeba invadens
QDEERRKKL

SEQ ID NO: 2771236 - protein, 4 aa, Entamoeba invadens
QDEF

SEQ ID NO: 2771237 - protein, 12 aa, Entamoeba invadens
QDEKDLYKSYPD

SEQ ID NO: 2771238 - protein, 6 aa, Entamoeba invadens
QDENGK

SEQ ID NO: 2771239 - protein, 10 aa, Entamoeba invadens
QDETNTEDNI

SEQ ID NO: 2771240 - protein, 7 aa, Entamoeba invadens
QDETSGV

SEQ ID NO: 2771241 - protein, 6 aa, Entamoeba invadens
QDFSKR

SEQ ID NO: 2771242 - protein, 10 aa, Entamoeba invadens
QDGINNSEQE

SEQ ID NO: 2771243 - protein, 9 aa, Entamoeba invadens
QDGKCQKRD

SEQ ID NO: 2771244 - protein, 10 aa, Entamoeba invadens
QDGKERPTFD

SEQ ID NO: 2771245 - protein, 14 aa, Entamoeba invadens
QDGKVTKTSTPIVR

SEQ ID NO: 2771246 - protein, 23 aa, Entamoeba invadens
QDGNPVASNWANTENAPSENDYS

SEQ ID NO: 2771247 - protein, 4 aa, Entamoeba invadens
QDGR

SEQ ID NO: 2771248 - protein, 7 aa, Entamoeba invadens
QDGSYSC

SEQ ID NO: 2771249 - protein, 4 aa, Entamoeba invadens
QDGV

SEQ ID NO: 2771250 - protein, 5 aa, Entamoeba invadens
QDGYT

SEQ ID NO: 2771251 - protein, 5 aa, Entamoeba invadens
QDGYY

SEQ ID NO: 2771252 - protein, 4 aa, Entamoeba invadens
QDIK

SEQ ID NO: 2771253 - protein, 6 aa, Entamoeba invadens
QDITCG

SEQ ID NO: 2771254 - protein, 6 aa, Entamoeba invadens
QDKEFT

SEQ ID NO: 2771255 - protein, 14 aa, Entamoeba invadens
QDKETRVENKGSEL

SEQ ID NO: 2771256 - protein, 16 aa, Entamoeba invadens
QDKSNTTQCIQENNPA

SEQ ID NO: 2771257 - protein, 5 aa, Entamoeba invadens
QDKTY

SEQ ID NO: 2771258 - protein, 10 aa, Entamoeba invadens
QDKYDKPADV

SEQ ID NO: 2771259 - protein, 9 aa, Entamoeba invadens
QDKYKKAAD

SEQ ID NO: 2771260 - protein, 10 aa, Entamoeba invadens
QDKYKKSADI

SEQ ID NO: 2771261 - protein, 9 aa, Entamoeba invadens
QDKYNAPSD

SEQ ID NO: 2771262 - protein, 7 aa, Entamoeba invadens
QDLTNKT

SEQ ID NO: 2771263 - protein, 15 aa, Entamoeba invadens
QDLVPQSKRRNSISS

SEQ ID NO: 2771264 - protein, 7 aa, Entamoeba invadens
QDNARVE

SEQ ID NO: 2771265 - protein, 14 aa, Entamoeba invadens
QDNCPQDDVPATDG

SEQ ID NO: 2771266 - protein, 5 aa, Entamoeba invadens
QDNLT

SEQ ID NO: 2771267 - protein, 5 aa, Entamoeba invadens
QDNQY

SEQ ID NO: 2771268 - protein, 10 aa, Entamoeba invadens
QDNSKTAVDS

SEQ ID NO: 2771269 - protein, 5 aa, Entamoeba invadens
QDNTL

SEQ ID NO: 2771270 - protein, 8 aa, Entamoeba invadens
QDPAMRPS

SEQ ID NO: 2771271 - protein, 8 aa, Entamoeba invadens
QDPLNRPT

SEQ ID NO: 2771272 - protein, 10 aa, Entamoeba invadens
QDPNDRPQIG

SEQ ID NO: 2771273 - protein, 8 aa, Entamoeba invadens
QDPNLRPD

SEQ ID NO: 2771274 - protein, 10 aa, Entamoeba invadens
QDPSKRPTFD

SEQ ID NO: 2771275 - protein, 22 aa, Entamoeba invadens
QDPTERYTSTQLKKQLNYIYET

SEQ ID NO: 2771276 - protein, 26 aa, Entamoeba invadens
QDPTTNVKQNQKQSEKVPPKTSLKNN

SEQ ID NO: 2771277 - protein, 7 aa, Entamoeba invadens
QDQEDRL

SEQ ID NO: 2771278 - protein, 13 aa, Entamoeba invadens
QDQFETKSLTTGS

SEQ ID NO: 2771279 - protein, 9 aa, Entamoeba invadens
QDQNEEVEA

SEQ ID NO: 2771280 - protein, 5 aa, Entamoeba invadens
QDQNH

SEQ ID NO: 2771281 - protein, 21 aa, Entamoeba invadens
QDQPSDTADDVDMNESITPSD

SEQ ID NO: 2771282 - protein, 8 aa, Entamoeba invadens
QDQRASQT

SEQ ID NO: 2771283 - protein, 12 aa, Entamoeba invadens
QDQTYSSANSST

SEQ ID NO: 2771284 - protein, 9 aa, Entamoeba invadens
QDRYTTKAD

SEQ ID NO: 2771285 - protein, 7 aa, Entamoeba invadens
QDSEELH

SEQ ID NO: 2771286 - protein, 15 aa, Entamoeba invadens
QDSGKKDEQAAIDPD

SEQ ID NO: 2771287 - protein, 5 aa, Entamoeba invadens
QDSHK

SEQ ID NO: 2771288 - protein, 8 aa, Entamoeba invadens
QDSNRNTF

SEQ ID NO: 2771289 - protein, 7 aa, Entamoeba invadens
QDSPPKC

SEQ ID NO: 2771290 - protein, 8 aa, Entamoeba invadens
QDSPPKCL

SEQ ID NO: 2771291 - protein, 63 aa, Entamoeba invadens
QDSQQNDNVDEQVNTQQRAQEETQQQQNVAPQQQSTTQPTTQSDNTSLPPVTSQQQQQPVTQT

SEQ ID NO: 2771292 - protein, 7 aa, Entamoeba invadens
QDSTNDI

SEQ ID NO: 2771293 - protein, 7 aa, Entamoeba invadens
QDTAQHS

SEQ ID NO: 2771294 - protein, 8 aa, Entamoeba invadens
QDTENRMQ

SEQ ID NO: 2771295 - protein, 18 aa, Entamoeba invadens
QDTFYKNETLKGAATTTQ

SEQ ID NO: 2771296 - protein, 6 aa, Entamoeba invadens
QDTSAR

SEQ ID NO: 2771297 - protein, 8 aa, Entamoeba invadens
QDTSKGYK

SEQ ID NO: 2771298 - protein, 7 aa, Entamoeba invadens
QDTTEKM

SEQ ID NO: 2771299 - protein, 8 aa, Entamoeba invadens
QDTTGEKC

SEQ ID NO: 2771300 - protein, 16 aa, Entamoeba invadens
QDTVTESSSSSEEPIP

SEQ ID NO: 2771301 - protein, 8 aa, Entamoeba invadens
QDTYNTND

SEQ ID NO: 2771302 - protein, 5 aa, Entamoeba invadens
QDVAT

SEQ ID NO: 2771303 - protein, 5 aa, Entamoeba invadens
QDVDP

SEQ ID NO: 2771304 - protein, 22 aa, Entamoeba invadens
QDVEGKTSCKACSTSCSSCQAT

SEQ ID NO: 2771305 - protein, 6 aa, Entamoeba invadens
QDVGNK

SEQ ID NO: 2771306 - protein, 6 aa, Entamoeba invadens
QDVRDS

SEQ ID NO: 2771307 - protein, 36 aa, Entamoeba invadens
QDYDVSDKIKEKVEAKVQEKKEEIKEKEQSKAEEKI

SEQ ID NO: 2771308 - protein, 10 aa, Entamoeba invadens
QEAEKRPNMS

SEQ ID NO: 2771309 - protein, 4 aa, Entamoeba invadens
QEAI

SEQ ID NO: 2771310 - protein, 22 aa, Entamoeba invadens
QEAITDNNGNGFKYTGGDTCKA

SEQ ID NO: 2771311 - protein, 8 aa, Entamoeba invadens
QEALSRIP

SEQ ID NO: 2771312 - protein, 8 aa, Entamoeba invadens
QEATETTV

SEQ ID NO: 2771313 - protein, 5 aa, Entamoeba invadens
QEAYR

SEQ ID NO: 2771314 - protein, 21 aa, Entamoeba invadens
QECGENGKCSGYSGKCECNEG

SEQ ID NO: 2771315 - protein, 6 aa, Entamoeba invadens
QECNNG

SEQ ID NO: 2771316 - protein, 14 aa, Entamoeba invadens
QECPSGYYTEEGHC

SEQ ID NO: 2771317 - protein, 13 aa, Entamoeba invadens
QEDADRLSADLSD

SEQ ID NO: 2771318 - protein, 8 aa, Entamoeba invadens
QEDDNGEL

SEQ ID NO: 2771319 - protein, 14 aa, Entamoeba invadens
QEDDSEKSETQPKI

SEQ ID NO: 2771320 - protein, 7 aa, Entamoeba invadens
QEDPEEY

SEQ ID NO: 2771321 - protein, 7 aa, Entamoeba invadens
QEDPKLN

SEQ ID NO: 2771322 - protein, 9 aa, Entamoeba invadens
QEEDKGHLD

SEQ ID NO: 2771323 - protein, 5 aa, Entamoeba invadens
QEEND

SEQ ID NO: 2771324 - protein, 11 aa, Entamoeba invadens
QEENRREDGEK

SEQ ID NO: 2771325 - protein, 4 aa, Entamoeba invadens
QEEP

SEQ ID NO: 2771326 - protein, 5 aa, Entamoeba invadens
QEEVK

SEQ ID NO: 2771327 - protein, 8 aa, Entamoeba invadens
QEEYNPDG

SEQ ID NO: 2771328 - protein, 7 aa, Entamoeba invadens
QEFQSNS

SEQ ID NO: 2771329 - protein, 19 aa, Entamoeba invadens
QEGAKQKCSVNDNTLDAVD

SEQ ID NO: 2771330 - protein, 5 aa, Entamoeba invadens
QEGAP

SEQ ID NO: 2771331 - protein, 32 aa, Entamoeba invadens
QEGKYPKLNKNETTCSDCDSTCNSKCDTRNGY

SEQ ID NO: 2771332 - protein, 5 aa, Entamoeba invadens
QEGNC

SEQ ID NO: 2771333 - protein, 7 aa, Entamoeba invadens
QEGRHAP

SEQ ID NO: 2771334 - protein, 12 aa, Entamoeba invadens
QEGTYSSSKSAY

SEQ ID NO: 2771335 - protein, 8 aa, Entamoeba invadens
QEGYASQG

SEQ ID NO: 2771336 - protein, 13 aa, Entamoeba invadens
QEIKQAEKYQKAT

SEQ ID NO: 2771337 - protein, 11 aa, Entamoeba invadens
QEISETNREEY

SEQ ID NO: 2771338 - protein, 13 aa, Entamoeba invadens
QEISFGDQNDEID

SEQ ID NO: 2771339 - protein, 10 aa, Entamoeba invadens
QEISFGGDND

SEQ ID NO: 2771340 - protein, 5 aa, Entamoeba invadens
QEKAD

SEQ ID NO: 2771341 - protein, 13 aa, Entamoeba invadens
QEKATDKNQDIVG

SEQ ID NO: 2771342 - protein, 12 aa, Entamoeba invadens
QEKCSNSQYKNP

SEQ ID NO: 2771343 - protein, 10 aa, Entamoeba invadens
QEKDENGAIR

SEQ ID NO: 2771344 - protein, 10 aa, Entamoeba invadens
QEKDSDTCHK

SEQ ID NO: 2771345 - protein, 13 aa, Entamoeba invadens
QEKEVKKSRGERV

SEQ ID NO: 2771346 - protein, 18 aa, Entamoeba invadens
QEKGYNDTNLTENDVSVS

SEQ ID NO: 2771347 - protein, 9 aa, Entamoeba invadens
QEKNKKEAD

SEQ ID NO: 2771348 - protein, 4 aa, Entamoeba invadens
QEKQ

SEQ ID NO: 2771349 - protein, 5 aa, Entamoeba invadens
QEKQF

SEQ ID NO: 2771350 - protein, 9 aa, Entamoeba invadens
QEKQQQQVK

SEQ ID NO: 2771351 - protein, 7 aa, Entamoeba invadens
QEKSERC

SEQ ID NO: 2771352 - protein, 7 aa, Entamoeba invadens
QEKSPDS

SEQ ID NO: 2771353 - protein, 7 aa, Entamoeba invadens
QEKTKKM

SEQ ID NO: 2771354 - protein, 8 aa, Entamoeba invadens
QEKTYTSN

SEQ ID NO: 2771355 - protein, 4 aa, Entamoeba invadens
QEKY

SEQ ID NO: 2771356 - protein, 8 aa, Entamoeba invadens
QEKYKEAA

SEQ ID NO: 2771357 - protein, 9 aa, Entamoeba invadens
QEKYKKAAD

SEQ ID NO: 2771358 - protein, 10 aa, Entamoeba invadens
QEKYKKEADV

SEQ ID NO: 2771359 - protein, 10 aa, Entamoeba invadens
QEKYKKGADI

SEQ ID NO: 2771360 - protein, 9 aa, Entamoeba invadens
QEKYKKNAD

SEQ ID NO: 2771361 - protein, 10 aa, Entamoeba invadens
QEKYKKPADM

SEQ ID NO: 2771362 - protein, 10 aa, Entamoeba invadens
QEKYKKSSDI

SEQ ID NO: 2771363 - protein, 9 aa, Entamoeba invadens
QEKYKRPAD

SEQ ID NO: 2771364 - protein, 9 aa, Entamoeba invadens
QEKYTKAAD

SEQ ID NO: 2771365 - protein, 8 aa, Entamoeba invadens
QEKYTKPA

SEQ ID NO: 2771366 - protein, 8 aa, Entamoeba invadens
QEKYTKSA

SEQ ID NO: 2771367 - protein, 9 aa, Entamoeba invadens
QEKYTKSSD

SEQ ID NO: 2771368 - protein, 10 aa, Entamoeba invadens
QEKYTKSSDV

SEQ ID NO: 2771369 - protein, 8 aa, Entamoeba invadens
QEKYTTSA

SEQ ID NO: 2771370 - protein, 4 aa, Entamoeba invadens
QEMG

SEQ ID NO: 2771371 - protein, 8 aa, Entamoeba invadens
QENAVGDD

SEQ ID NO: 2771372 - protein, 14 aa, Entamoeba invadens
QENEERKKFGGAEE

SEQ ID NO: 2771373 - protein, 6 aa, Entamoeba invadens
QENEFE

SEQ ID NO: 2771374 - protein, 5 aa, Entamoeba invadens
QENGK

SEQ ID NO: 2771375 - protein, 10 aa, Entamoeba invadens
QENKGCTPCD

SEQ ID NO: 2771376 - protein, 9 aa, Entamoeba invadens
QENKSNVAY

SEQ ID NO: 2771377 - protein, 7 aa, Entamoeba invadens
QENLDEE

SEQ ID NO: 2771378 - protein, 4 aa, Entamoeba invadens
QENN

SEQ ID NO: 2771379 - protein, 9 aa, Entamoeba invadens
QENNDIKCD

SEQ ID NO: 2771380 - protein, 6 aa, Entamoeba invadens
QENPEL

SEQ ID NO: 2771381 - protein, 12 aa, Entamoeba invadens
QENSYKHNRDVN

SEQ ID NO: 2771382 - protein, 5 aa, Entamoeba invadens
QEPLD

SEQ ID NO: 2771383 - protein, 5 aa, Entamoeba invadens
QEPNS

SEQ ID NO: 2771384 - protein, 16 aa, Entamoeba invadens
QEPPDDEEQHENSDTF

SEQ ID NO: 2771385 - protein, 5 aa, Entamoeba invadens
QEPPV

SEQ ID NO: 2771386 - protein, 12 aa, Entamoeba invadens
QEPSARPSFDQV

SEQ ID NO: 2771387 - protein, 9 aa, Entamoeba invadens
QEPTERPTI

SEQ ID NO: 2771388 - protein, 5 aa, Entamoeba invadens
QEPTL

SEQ ID NO: 2771389 - protein, 6 aa, Entamoeba invadens
QEPTVF

SEQ ID NO: 2771390 - protein, 13 aa, Entamoeba invadens
QEQLKKNNKNDEK

SEQ ID NO: 2771391 - protein, 12 aa, Entamoeba invadens
QEQPPKNTNITY

SEQ ID NO: 2771392 - protein, 9 aa, Entamoeba invadens
QEQQNVSED

SEQ ID NO: 2771393 - protein, 18 aa, Entamoeba invadens
QEREKKGKPYAHTKLENQ

SEQ ID NO: 2771394 - protein, 13 aa, Entamoeba invadens
QERKAGKKKRGIS

SEQ ID NO: 2771395 - protein, 26 aa, Entamoeba invadens
QERLEKEAEDARKATLQAEQEKEAAF

SEQ ID NO: 2771396 - protein, 29 aa, Entamoeba invadens
QERLEKEAEDARKATLQAEQEKKEKEELE

SEQ ID NO: 2771397 - protein, 5 aa, Entamoeba invadens
QERPT

SEQ ID NO: 2771398 - protein, 7 aa, Entamoeba invadens
QERYGSP

SEQ ID NO: 2771399 - protein, 5 aa, Entamoeba invadens
QERYK

SEQ ID NO: 2771400 - protein, 10 aa, Entamoeba invadens
QERYKKPADI

SEQ ID NO: 2771401 - protein, 4 aa, Entamoeba invadens
QESA

SEQ ID NO: 2771402 - protein, 14 aa, Entamoeba invadens
QESASDTCEAYSKN

SEQ ID NO: 2771403 - protein, 5 aa, Entamoeba invadens
QESDI

SEQ ID NO: 2771404 - protein, 22 aa, Entamoeba invadens
QESGELTSKIASDVQEIEDGMS

SEQ ID NO: 2771405 - protein, 11 aa, Entamoeba invadens
QESGESAEVTV

SEQ ID NO: 2771406 - protein, 14 aa, Entamoeba invadens
QESGYLASTPDEYA

SEQ ID NO: 2771407 - protein, 8 aa, Entamoeba invadens
QESIETVE

SEQ ID NO: 2771408 - protein, 7 aa, Entamoeba invadens
QESKNNA

SEQ ID NO: 2771409 - protein, 17 aa, Entamoeba invadens
QESNTANCQTYDNKGKC

SEQ ID NO: 2771410 - protein, 7 aa, Entamoeba invadens
QESTTTV

SEQ ID NO: 2771411 - protein, 6 aa, Entamoeba invadens
QESVRS

SEQ ID NO: 2771412 - protein, 4 aa, Entamoeba invadens
QESY

SEQ ID NO: 2771413 - protein, 5 aa, Entamoeba invadens
QETFE

SEQ ID NO: 2771414 - protein, 4 aa, Entamoeba invadens
QETI

SEQ ID NO: 2771415 - protein, 6 aa, Entamoeba invadens
QETLDE

SEQ ID NO: 2771416 - protein, 6 aa, Entamoeba invadens
QETLNE

SEQ ID NO: 2771417 - protein, 5 aa, Entamoeba invadens
QETPC

SEQ ID NO: 2771418 - protein, 10 aa, Entamoeba invadens
QETSDARPIV

SEQ ID NO: 2771419 - protein, 7 aa, Entamoeba invadens
QETTATD

SEQ ID NO: 2771420 - protein, 6 aa, Entamoeba invadens
QEVANE

SEQ ID NO: 2771421 - protein, 4 aa, Entamoeba invadens
QEVC

SEQ ID NO: 2771422 - protein, 4 aa, Entamoeba invadens
QEVD

SEQ ID NO: 2771423 - protein, 10 aa, Entamoeba invadens
QEVSKGTVGD

SEQ ID NO: 2771424 - protein, 9 aa, Entamoeba invadens
QEVSTYSSI

SEQ ID NO: 2771425 - protein, 8 aa, Entamoeba invadens
QEVTQKEQ

SEQ ID NO: 2771426 - protein, 10 aa, Entamoeba invadens
QEYDRAKARN

SEQ ID NO: 2771427 - protein, 4 aa, Entamoeba invadens
QEYL

SEQ ID NO: 2771428 - protein, 6 aa, Entamoeba invadens
QEYTET

SEQ ID NO: 2771429 - protein, 7 aa, Entamoeba invadens
QFDGETD

SEQ ID NO: 2771430 - protein, 7 aa, Entamoeba invadens
QFDNNDY

SEQ ID NO: 2771431 - protein, 12 aa, Entamoeba invadens
QFDNNEKSIDEF

SEQ ID NO: 2771432 - protein, 12 aa, Entamoeba invadens
QFDSNESGLDEF

SEQ ID NO: 2771433 - protein, 15 aa, Entamoeba invadens
QFEDPTMSVPPPVAE

SEQ ID NO: 2771434 - protein, 7 aa, Entamoeba invadens
QFEEGFG

SEQ ID NO: 2771435 - protein, 11 aa, Entamoeba invadens
QFENSDDKFGK

SEQ ID NO: 2771436 - protein, 8 aa, Entamoeba invadens
QFEQPSQN

SEQ ID NO: 2771437 - protein, 9 aa, Entamoeba invadens
QFGDESQTF

SEQ ID NO: 2771438 - protein, 27 aa, Entamoeba invadens
QFGGIKGEAPKEAKPTVNEKKKQANVK

SEQ ID NO: 2771439 - protein, 8 aa, Entamoeba invadens
QFNETRGF

SEQ ID NO: 2771440 - protein, 8 aa, Entamoeba invadens
QFNPGVGV

SEQ ID NO: 2771441 - protein, 16 aa, Entamoeba invadens
QFPESHKETFNDPNYK

SEQ ID NO: 2771442 - protein, 12 aa, Entamoeba invadens
QFQNDEYGKSRD

SEQ ID NO: 2771443 - protein, 30 aa, Entamoeba invadens
QFQQQTQPITPQQPSVPPFQQPPQQPSAPD

SEQ ID NO: 2771444 - protein, 8 aa, Entamoeba invadens
QFQSGTTV

SEQ ID NO: 2771445 - protein, 9 aa, Entamoeba invadens
QFSEGGKWR

SEQ ID NO: 2771446 - protein, 11 aa, Entamoeba invadens
QFSRKYETPVE

SEQ ID NO: 2771447 - protein, 8 aa, Entamoeba invadens
QFSSCNNA

SEQ ID NO: 2771448 - protein, 7 aa, Entamoeba invadens
QFSSGKV

SEQ ID NO: 2771449 - protein, 5 aa, Entamoeba invadens
QFSSV

SEQ ID NO: 2771450 - protein, 10 aa, Entamoeba invadens
QFSTSNNNCE

SEQ ID NO: 2771451 - protein, 12 aa, Entamoeba invadens
QFTDDQKSLDEF

SEQ ID NO: 2771452 - protein, 8 aa, Entamoeba invadens
QGAKNERK

SEQ ID NO: 2771453 - protein, 4 aa, Entamoeba invadens
QGAS

SEQ ID NO: 2771454 - protein, 5 aa, Entamoeba invadens
QGASA

SEQ ID NO: 2771455 - protein, 6 aa, Entamoeba invadens
QGDFPS

SEQ ID NO: 2771456 - protein, 7 aa, Entamoeba invadens
QGDGSMD

SEQ ID NO: 2771457 - protein, 4 aa, Entamoeba invadens
QGDM

SEQ ID NO: 2771458 - protein, 9 aa, Entamoeba invadens
QGDYNDVTT

SEQ ID NO: 2771459 - protein, 5 aa, Entamoeba invadens
QGEKE

SEQ ID NO: 2771460 - protein, 6 aa, Entamoeba invadens
QGEKES

SEQ ID NO: 2771461 - protein, 5 aa, Entamoeba invadens
QGEKI

SEQ ID NO: 2771462 - protein, 5 aa, Entamoeba invadens
QGEMV

SEQ ID NO: 2771463 - protein, 6 aa, Entamoeba invadens
QGENGK

SEQ ID NO: 2771464 - protein, 9 aa, Entamoeba invadens
QGETTMTIQ

SEQ ID NO: 2771465 - protein, 8 aa, Entamoeba invadens
QGFNKNGT

SEQ ID NO: 2771466 - protein, 12 aa, Entamoeba invadens
QGGSCEYASVST

SEQ ID NO: 2771467 - protein, 6 aa, Entamoeba invadens
QGGSTL

SEQ ID NO: 2771468 - protein, 8 aa, Entamoeba invadens
QGGYATNN

SEQ ID NO: 2771469 - protein, 8 aa, Entamoeba invadens
QGGYATTN

SEQ ID NO: 2771470 - protein, 19 aa, Entamoeba invadens
QGIELDGEPQFADHENPTV

SEQ ID NO: 2771471 - protein, 9 aa, Entamoeba invadens
QGIKGENTL

SEQ ID NO: 2771472 - protein, 5 aa, Entamoeba invadens
QGKAM

SEQ ID NO: 2771473 - protein, 8 aa, Entamoeba invadens
QGKCPECN

SEQ ID NO: 2771474 - protein, 5 aa, Entamoeba invadens
QGKEM

SEQ ID NO: 2771475 - protein, 4 aa, Entamoeba invadens
QGKL

SEQ ID NO: 2771476 - protein, 6 aa, Entamoeba invadens
QGKQTG

SEQ ID NO: 2771477 - protein, 9 aa, Entamoeba invadens
QGKRMEKPC

SEQ ID NO: 2771478 - protein, 12 aa, Entamoeba invadens
QGKYIDSNQCKT

SEQ ID NO: 2771479 - protein, 7 aa, Entamoeba invadens
QGKYPSE

SEQ ID NO: 2771480 - protein, 13 aa, Entamoeba invadens
QGNETSETNSEFE

SEQ ID NO: 2771481 - protein, 6 aa, Entamoeba invadens
QGNTRV

SEQ ID NO: 2771482 - protein, 23 aa, Entamoeba invadens
QGPAYSEYQPPQYQQNYNQSTPI

SEQ ID NO: 2771483 - protein, 6 aa, Entamoeba invadens
QGPSRA

SEQ ID NO: 2771484 - protein, 18 aa, Entamoeba invadens
QGPTEKDTVTNKYDAEYN

SEQ ID NO: 2771485 - protein, 4 aa, Entamoeba invadens
QGQP

SEQ ID NO: 2771486 - protein, 6 aa, Entamoeba invadens
QGQQIT

SEQ ID NO: 2771487 - protein, 9 aa, Entamoeba invadens
QGRKRMGNT

SEQ ID NO: 2771488 - protein, 14 aa, Entamoeba invadens
QGRPDEEDNVTGGL

SEQ ID NO: 2771489 - protein, 5 aa, Entamoeba invadens
QGRPN

SEQ ID NO: 2771490 - protein, 15 aa, Entamoeba invadens
QGSALTLSSQKVTSY

SEQ ID NO: 2771491 - protein, 9 aa, Entamoeba invadens
QGSKSKTQK

SEQ ID NO: 2771492 - protein, 7 aa, Entamoeba invadens
QGSRLSH

SEQ ID NO: 2771493 - protein, 19 aa, Entamoeba invadens
QGTAYKNLPEQKRKEAKKA

SEQ ID NO: 2771494 - protein, 9 aa, Entamoeba invadens
QGTITQSDN

SEQ ID NO: 2771495 - protein, 6 aa, Entamoeba invadens
QGTKTS

SEQ ID NO: 2771496 - protein, 13 aa, Entamoeba invadens
QGTSDDKKTEKQV

SEQ ID NO: 2771497 - protein, 12 aa, Entamoeba invadens
QGTWDPSSENAL

SEQ ID NO: 2771498 - protein, 6 aa, Entamoeba invadens
QGVPTY

SEQ ID NO: 2771499 - protein, 7 aa, Entamoeba invadens
QGVSEDT

SEQ ID NO: 2771500 - protein, 5 aa, Entamoeba invadens
QGYIQ

SEQ ID NO: 2771501 - protein, 26 aa, Entamoeba invadens
QGYYSNEGATACTKCESGYVSGYGAQ

SEQ ID NO: 2771502 - protein, 6 aa, Entamoeba invadens
QGYYTK

SEQ ID NO: 2771503 - protein, 4 aa, Entamoeba invadens
QHAK

SEQ ID NO: 2771504 - protein, 4 aa, Entamoeba invadens
QHCS

SEQ ID NO: 2771505 - protein, 7 aa, Entamoeba invadens
QHCTSAY

SEQ ID NO: 2771506 - protein, 4 aa, Entamoeba invadens
QHDE

SEQ ID NO: 2771507 - protein, 38 aa, Entamoeba invadens
QHDSPAKEVRQNSMNNLNGNTHEDGKTQRLTQSTTMTK

SEQ ID NO: 2771508 - protein, 9 aa, Entamoeba invadens
QHDTCANAK

SEQ ID NO: 2771509 - protein, 9 aa, Entamoeba invadens
QHEKYTKSA

SEQ ID NO: 2771510 - protein, 5 aa, Entamoeba invadens
QHGSL

SEQ ID NO: 2771511 - protein, 6 aa, Entamoeba invadens
QHGSTE

SEQ ID NO: 2771512 - protein, 6 aa, Entamoeba invadens
QHIEKK

SEQ ID NO: 2771513 - protein, 5 aa, Entamoeba invadens
QHIPQ

SEQ ID NO: 2771514 - protein, 7 aa, Entamoeba invadens
QHKESVG

SEQ ID NO: 2771515 - protein, 6 aa, Entamoeba invadens
QHLSQG

SEQ ID NO: 2771516 - protein, 7 aa, Entamoeba invadens
QHPNYTE

SEQ ID NO: 2771517 - protein, 46 aa, Entamoeba invadens
QHPSPTSFGGSRAPSVPSLSPCRTPDIRPEEMNKEAKMTSPQTPLD

SEQ ID NO: 2771518 - protein, 5 aa, Entamoeba invadens
QHPTK

SEQ ID NO: 2771519 - protein, 6 aa, Entamoeba invadens
QHSETI

SEQ ID NO: 2771520 - protein, 4 aa, Entamoeba invadens
QHSH

SEQ ID NO: 2771521 - protein, 8 aa, Entamoeba invadens
QHSYTEKD

SEQ ID NO: 2771522 - protein, 4 aa, Entamoeba invadens
QHTP

SEQ ID NO: 2771523 - protein, 7 aa, Entamoeba invadens
QHTYDVE

SEQ ID NO: 2771524 - protein, 6 aa, Entamoeba invadens
QHYKKA

SEQ ID NO: 2771525 - protein, 7 aa, Entamoeba invadens
QHYKKQA

SEQ ID NO: 2771526 - protein, 7 aa, Entamoeba invadens
QHYKKSA

SEQ ID NO: 2771527 - protein, 9 aa, Entamoeba invadens
QHYKKSSDV

SEQ ID NO: 2771528 - protein, 33 aa, Entamoeba invadens
QIAEKEAELEKKKNVETDLAAKEAELKKLEESL

SEQ ID NO: 2771529 - protein, 22 aa, Entamoeba invadens
QIASPNTLTNEITDEKKSFDEF

SEQ ID NO: 2771530 - protein, 22 aa, Entamoeba invadens
QIASPNTLTNEITDEKKSLQEF

SEQ ID NO: 2771531 - protein, 22 aa, Entamoeba invadens
QIASPNTLTTEITDEKKSFQEF

SEQ ID NO: 2771532 - protein, 22 aa, Entamoeba invadens
QIASPNTVTNEITDEKKSLDEF

SEQ ID NO: 2771533 - protein, 23 aa, Entamoeba invadens
QIASPNTVTSNFTDEKKSLDEFE

SEQ ID NO: 2771534 - protein, 13 aa, Entamoeba invadens
QIASSQNTAEVKV

SEQ ID NO: 2771535 - protein, 22 aa, Entamoeba invadens
QIASTNTLTNEITDEKKSLQEF

SEQ ID NO: 2771536 - protein, 5 aa, Entamoeba invadens
QIASV

SEQ ID NO: 2771537 - protein, 48 aa, Entamoeba invadens
QIAVKNQSKTINDEIKTEEEESDGSEIKIEKKDEMSEDDEMKMKEESE

SEQ ID NO: 2771538 - protein, 13 aa, Entamoeba invadens
QIDNSNKENTIEE

SEQ ID NO: 2771539 - protein, 5 aa, Entamoeba invadens
QIDPF

SEQ ID NO: 2771540 - protein, 7 aa, Entamoeba invadens
QIDPQNL

SEQ ID NO: 2771541 - protein, 5 aa, Entamoeba invadens
QIEEE

SEQ ID NO: 2771542 - protein, 12 aa, Entamoeba invadens
QIEEQNNKEITR

SEQ ID NO: 2771543 - protein, 13 aa, Entamoeba invadens
QIEFGEDNGREED

SEQ ID NO: 2771544 - protein, 11 aa, Entamoeba invadens
QIEKKEREYTT

SEQ ID NO: 2771545 - protein, 12 aa, Entamoeba invadens
QIEKKEREYTTE

SEQ ID NO: 2771546 - protein, 9 aa, Entamoeba invadens
QIENKEDGL

SEQ ID NO: 2771547 - protein, 14 aa, Entamoeba invadens
QIENSLDDNSIDEF

SEQ ID NO: 2771548 - protein, 8 aa, Entamoeba invadens
QIESKNKV

SEQ ID NO: 2771549 - protein, 6 aa, Entamoeba invadens
QIESSS

SEQ ID NO: 2771550 - protein, 4 aa, Entamoeba invadens
QIET

SEQ ID NO: 2771551 - protein, 6 aa, Entamoeba invadens
QIGEGS

SEQ ID NO: 2771552 - protein, 9 aa, Entamoeba invadens
QIGEGTYGT

SEQ ID NO: 2771553 - protein, 15 aa, Entamoeba invadens
QIHNGQETVLSSKGL

SEQ ID NO: 2771554 - protein, 18 aa, Entamoeba invadens
QIKENEEKISTQESEIEK

SEQ ID NO: 2771555 - protein, 6 aa, Entamoeba invadens
QIKNNS

SEQ ID NO: 2771556 - protein, 5 aa, Entamoeba invadens
QIKNS

SEQ ID NO: 2771557 - protein, 19 aa, Entamoeba invadens
QIKNSEKVTSIENQAIDNT

SEQ ID NO: 2771558 - protein, 7 aa, Entamoeba invadens
QIKPYGG

SEQ ID NO: 2771559 - protein, 11 aa, Entamoeba invadens
QIKSESEQMKE

SEQ ID NO: 2771560 - protein, 9 aa, Entamoeba invadens
QIKSTQEVV

SEQ ID NO: 2771561 - protein, 10 aa, Entamoeba invadens
QIKTGSTLKT

SEQ ID NO: 2771562 - protein, 13 aa, Entamoeba invadens
QINNRSQIQQEEF

SEQ ID NO: 2771563 - protein, 10 aa, Entamoeba invadens
QINNSDEEKL

SEQ ID NO: 2771564 - protein, 14 aa, Entamoeba invadens
QINNSDEKKSIDEF

SEQ ID NO: 2771565 - protein, 8 aa, Entamoeba invadens
QINPPDTD

SEQ ID NO: 2771566 - protein, 4 aa, Entamoeba invadens
QINV

SEQ ID NO: 2771567 - protein, 6 aa, Entamoeba invadens
QIPQKE

SEQ ID NO: 2771568 - protein, 4 aa, Entamoeba invadens
QIPV

SEQ ID NO: 2771569 - protein, 10 aa, Entamoeba invadens
QIQEESLAGT

SEQ ID NO: 2771570 - protein, 9 aa, Entamoeba invadens
QIRNGGSYT

SEQ ID NO: 2771571 - protein, 7 aa, Entamoeba invadens
QISDEDH

SEQ ID NO: 2771572 - protein, 6 aa, Entamoeba invadens
QISDGG

SEQ ID NO: 2771573 - protein, 4 aa, Entamoeba invadens
QISP

SEQ ID NO: 2771574 - protein, 5 aa, Entamoeba invadens
QISPN

SEQ ID NO: 2771575 - protein, 21 aa, Entamoeba invadens
QISTRLDPEELKEEKKIGEGS

SEQ ID NO: 2771576 - protein, 4 aa, Entamoeba invadens
QITD

SEQ ID NO: 2771577 - protein, 6 aa, Entamoeba invadens
QITKNS

SEQ ID NO: 2771578 - protein, 11 aa, Entamoeba invadens
QITNEEKTECS

SEQ ID NO: 2771579 - protein, 11 aa, Entamoeba invadens
QITPNQSINPY

SEQ ID NO: 2771580 - protein, 13 aa, Entamoeba invadens
QITPSKETPDKCE

SEQ ID NO: 2771581 - protein, 12 aa, Entamoeba invadens
QITQNGNAQLNV

SEQ ID NO: 2771582 - protein, 4 aa, Entamoeba invadens
QITS

SEQ ID NO: 2771583 - protein, 4 aa, Entamoeba invadens
QITT

SEQ ID NO: 2771584 - protein, 5 aa, Entamoeba invadens
QIYTQ

SEQ ID NO: 2771585 - protein, 8 aa, Entamoeba invadens
QKAAQSVS

SEQ ID NO: 2771586 - protein, 8 aa, Entamoeba invadens
QKAEERPT

SEQ ID NO: 2771587 - protein, 7 aa, Entamoeba invadens
QKAEKEY

SEQ ID NO: 2771588 - protein, 7 aa, Entamoeba invadens
QKAIHGD

SEQ ID NO: 2771589 - protein, 7 aa, Entamoeba invadens
QKAKEDM

SEQ ID NO: 2771590 - protein, 5 aa, Entamoeba invadens
QKALP

SEQ ID NO: 2771591 - protein, 17 aa, Entamoeba invadens
QKANALQKSSTEIPQPT

SEQ ID NO: 2771592 - protein, 15 aa, Entamoeba invadens
QKAPSYKKLSDRKAV

SEQ ID NO: 2771593 - protein, 18 aa, Entamoeba invadens
QKAQKEKEEQEEKEKLAK

SEQ ID NO: 2771594 - protein, 9 aa, Entamoeba invadens
QKARPTSIS

SEQ ID NO: 2771595 - protein, 5 aa, Entamoeba invadens
QKCKD

SEQ ID NO: 2771596 - protein, 20 aa, Entamoeba invadens
QKCKDNCTSCDANEDCSSCE

SEQ ID NO: 2771597 - protein, 20 aa, Entamoeba invadens
QKCKDNCTSCDANEECSSCE

SEQ ID NO: 2771598 - protein, 4 aa, Entamoeba invadens
QKCP

SEQ ID NO: 2771599 - protein, 6 aa, Entamoeba invadens
QKCQES

SEQ ID NO: 2771600 - protein, 8 aa, Entamoeba invadens
QKCQTSYS

SEQ ID NO: 2771601 - protein, 4 aa, Entamoeba invadens
QKCS

SEQ ID NO: 2771602 - protein, 15 aa, Entamoeba invadens
QKCSETCGDEGCTQL

SEQ ID NO: 2771603 - protein, 25 aa, Entamoeba invadens
QKCSQPNCKTCSTTSNTCDECTDST

SEQ ID NO: 2771604 - protein, 6 aa, Entamoeba invadens
QKCSTI

SEQ ID NO: 2771605 - protein, 7 aa, Entamoeba invadens
QKCTSST

SEQ ID NO: 2771606 - protein, 10 aa, Entamoeba invadens
QKDAGQFQKS

SEQ ID NO: 2771607 - protein, 9 aa, Entamoeba invadens
QKDCDTCGT

SEQ ID NO: 2771608 - protein, 19 aa, Entamoeba invadens
QKDDDGIDEYYENGNDYNS

SEQ ID NO: 2771609 - protein, 12 aa, Entamoeba invadens
QKDEAETKARAS

SEQ ID NO: 2771610 - protein, 8 aa, Entamoeba invadens
QKDEPYPP

SEQ ID NO: 2771611 - protein, 5 aa, Entamoeba invadens
QKDER

SEQ ID NO: 2771612 - protein, 6 aa, Entamoeba invadens
QKDHPD

SEQ ID NO: 2771613 - protein, 10 aa, Entamoeba invadens
QKDISLNEQR

SEQ ID NO: 2771614 - protein, 75 aa, Entamoeba invadens
QKDKERKEKDAETSKRLQSPQIKSNEKEEKNVEETMKEKRKEDRPKSIRANKEEAMEDRMKSEKKKETKPENGDG

SEQ ID NO: 2771615 - protein, 9 aa, Entamoeba invadens
QKDLEEAKQ

SEQ ID NO: 2771616 - protein, 10 aa, Entamoeba invadens
QKDNEEVPKY

SEQ ID NO: 2771617 - protein, 9 aa, Entamoeba invadens
QKDPIPPGA

SEQ ID NO: 2771618 - protein, 8 aa, Entamoeba invadens
QKDQQKRI

SEQ ID NO: 2771619 - protein, 5 aa, Entamoeba invadens
QKEAE

SEQ ID NO: 2771620 - protein, 11 aa, Entamoeba invadens
QKEDKNSKTEM

SEQ ID NO: 2771621 - protein, 9 aa, Entamoeba invadens
QKEDTDKPM

SEQ ID NO: 2771622 - protein, 7 aa, Entamoeba invadens
QKEEAIV

SEQ ID NO: 2771623 - protein, 9 aa, Entamoeba invadens
QKEEDRPDI

SEQ ID NO: 2771624 - protein, 7 aa, Entamoeba invadens
QKEEEHK

SEQ ID NO: 2771625 - protein, 9 aa, Entamoeba invadens
QKEEENEMK

SEQ ID NO: 2771626 - protein, 7 aa, Entamoeba invadens
QKEFAEQ

SEQ ID NO: 2771627 - protein, 8 aa, Entamoeba invadens
QKEGQLER

SEQ ID NO: 2771628 - protein, 9 aa, Entamoeba invadens
QKEGTKESE

SEQ ID NO: 2771629 - protein, 8 aa, Entamoeba invadens
QKEIAKTT

SEQ ID NO: 2771630 - protein, 10 aa, Entamoeba invadens
QKEIEETTTR

SEQ ID NO: 2771631 - protein, 8 aa, Entamoeba invadens
QKEIETTT

SEQ ID NO: 2771632 - protein, 13 aa, Entamoeba invadens
QKEKKYQQSNGGV

SEQ ID NO: 2771633 - protein, 5 aa, Entamoeba invadens
QKELD

SEQ ID NO: 2771634 - protein, 4 aa, Entamoeba invadens
QKEM

SEQ ID NO: 2771635 - protein, 10 aa, Entamoeba invadens
QKEMTPKDRD

SEQ ID NO: 2771636 - protein, 9 aa, Entamoeba invadens
QKENDEIGE

SEQ ID NO: 2771637 - protein, 6 aa, Entamoeba invadens
QKENKD

SEQ ID NO: 2771638 - protein, 5 aa, Entamoeba invadens
QKENR

SEQ ID NO: 2771639 - protein, 10 aa, Entamoeba invadens
QKENSEVVKT

SEQ ID NO: 2771640 - protein, 11 aa, Entamoeba invadens
QKENTTLDDQN

SEQ ID NO: 2771641 - protein, 11 aa, Entamoeba invadens
QKEQAEKEKEE

SEQ ID NO: 2771642 - protein, 4 aa, Entamoeba invadens
QKER

SEQ ID NO: 2771643 - protein, 11 aa, Entamoeba invadens
QKESFKTECNE

SEQ ID NO: 2771644 - protein, 8 aa, Entamoeba invadens
QKEYDQQD

SEQ ID NO: 2771645 - protein, 14 aa, Entamoeba invadens
QKFEKKEKCGKNEN

SEQ ID NO: 2771646 - protein, 16 aa, Entamoeba invadens
QKFPGDCGEDSTDQSS

SEQ ID NO: 2771647 - protein, 8 aa, Entamoeba invadens
QKGCSECE

SEQ ID NO: 2771648 - protein, 8 aa, Entamoeba invadens
QKGDADTM

SEQ ID NO: 2771649 - protein, 9 aa, Entamoeba invadens
QKGDCNVNE

SEQ ID NO: 2771650 - protein, 9 aa, Entamoeba invadens
QKGEDDDVS

SEQ ID NO: 2771651 - protein, 8 aa, Entamoeba invadens
QKGEKSGV

SEQ ID NO: 2771652 - protein, 21 aa, Entamoeba invadens
QKGESNPCTRKRRYSQYKKDG

SEQ ID NO: 2771653 - protein, 7 aa, Entamoeba invadens
QKGETSY

SEQ ID NO: 2771654 - protein, 10 aa, Entamoeba invadens
QKGIDEQSLE

SEQ ID NO: 2771655 - protein, 5 aa, Entamoeba invadens
QKGIN

SEQ ID NO: 2771656 - protein, 5 aa, Entamoeba invadens
QKGIT

SEQ ID NO: 2771657 - protein, 9 aa, Entamoeba invadens
QKGKLKQTM

SEQ ID NO: 2771658 - protein, 6 aa, Entamoeba invadens
QKGKTV

SEQ ID NO: 2771659 - protein, 12 aa, Entamoeba invadens
QKGRIADPHTVG

SEQ ID NO: 2771660 - protein, 4 aa, Entamoeba invadens
QKGT

SEQ ID NO: 2771661 - protein, 6 aa, Entamoeba invadens
QKGTTR

SEQ ID NO: 2771662 - protein, 13 aa, Entamoeba invadens
QKHKSTKFANEQH

SEQ ID NO: 2771663 - protein, 6 aa, Entamoeba invadens
QKIGDG

SEQ ID NO: 2771664 - protein, 10 aa, Entamoeba invadens
QKIGNTTKQY

SEQ ID NO: 2771665 - protein, 14 aa, Entamoeba invadens
QKINGKLTDFGSSR

SEQ ID NO: 2771666 - protein, 13 aa, Entamoeba invadens
QKIQPEQNKATNQ

SEQ ID NO: 2771667 - protein, 4 aa, Entamoeba invadens
QKKA

SEQ ID NO: 2771668 - protein, 25 aa, Entamoeba invadens
QKKAPKNYFATKEDPKIAPKANVYP

SEQ ID NO: 2771669 - protein, 16 aa, Entamoeba invadens
QKKDEEINSTSPQLLQ

SEQ ID NO: 2771670 - protein, 11 aa, Entamoeba invadens
QKKDESAKQKN

SEQ ID NO: 2771671 - protein, 4 aa, Entamoeba invadens
QKKE

SEQ ID NO: 2771672 - protein, 11 aa, Entamoeba invadens
QKKEETHGAEE

SEQ ID NO: 2771673 - protein, 25 aa, Entamoeba invadens
QKKEKSNNKKDKKDKKNKEKTELSV

SEQ ID NO: 2771674 - protein, 8 aa, Entamoeba invadens
QKKGKNQK

SEQ ID NO: 2771675 - protein, 10 aa, Entamoeba invadens
QKKHENEKVE

SEQ ID NO: 2771676 - protein, 10 aa, Entamoeba invadens
QKKKTNKTYN

SEQ ID NO: 2771677 - protein, 10 aa, Entamoeba invadens
QKKLEKISKT

SEQ ID NO: 2771678 - protein, 8 aa, Entamoeba invadens
QKKLGEGS

SEQ ID NO: 2771679 - protein, 6 aa, Entamoeba invadens
QKKSFP

SEQ ID NO: 2771680 - protein, 8 aa, Entamoeba invadens
QKKSGELY

SEQ ID NO: 2771681 - protein, 8 aa, Entamoeba invadens
QKKSNEID

SEQ ID NO: 2771682 - protein, 22 aa, Entamoeba invadens
QKKTDFSRDESIIDEKTKSKVK

SEQ ID NO: 2771683 - protein, 6 aa, Entamoeba invadens
QKKTEL

SEQ ID NO: 2771684 - protein, 12 aa, Entamoeba invadens
QKKTTEKKQTEK

SEQ ID NO: 2771685 - protein, 158 aa, Entamoeba invadens
QKKYGSRGDRYDRSRDRNRSPSRGRRSRSRSHSRSSRRRRRDSYSSSSSRSSSRGRRNTRRRSRSPLRSRSRDSYDRRDRHGSRDRSGSRDRRDSRDRRDSRRSSYKDSGRDRRDRRDEKDNRAVSPKRDELPKKDDLKKDESINKAPETKEETPKKN

SEQ ID NO: 2771686 - protein, 9 aa, Entamoeba invadens
QKKYKKSAD

SEQ ID NO: 2771687 - protein, 9 aa, Entamoeba invadens
QKKYKTAAD

SEQ ID NO: 2771688 - protein, 4 aa, Entamoeba invadens
QKLE

SEQ ID NO: 2771689 - protein, 7 aa, Entamoeba invadens
QKLGEGS

SEQ ID NO: 2771690 - protein, 7 aa, Entamoeba invadens
QKLKEDV

SEQ ID NO: 2771691 - protein, 11 aa, Entamoeba invadens
QKLNSKSAQND

SEQ ID NO: 2771692 - protein, 11 aa, Entamoeba invadens
QKLNTKHSQKI

SEQ ID NO: 2771693 - protein, 11 aa, Entamoeba invadens
QKLRKDAGLKV

SEQ ID NO: 2771694 - protein, 8 aa, Entamoeba invadens
QKLSTVSQ

SEQ ID NO: 2771695 - protein, 8 aa, Entamoeba invadens
QKLTQKTD

SEQ ID NO: 2771696 - protein, 13 aa, Entamoeba invadens
QKLYNESKTNSDV

SEQ ID NO: 2771697 - protein, 10 aa, Entamoeba invadens
QKMNEKLSQN

SEQ ID NO: 2771698 - protein, 4 aa, Entamoeba invadens
QKMR

SEQ ID NO: 2771699 - protein, 14 aa, Entamoeba invadens
QKMTSDSSKNTGRA

SEQ ID NO: 2771700 - protein, 6 aa, Entamoeba invadens
QKNCGC

SEQ ID NO: 2771701 - protein, 8 aa, Entamoeba invadens
QKNDLTST

SEQ ID NO: 2771702 - protein, 4 aa, Entamoeba invadens
QKNE

SEQ ID NO: 2771703 - protein, 8 aa, Entamoeba invadens
QKNKPFKK

SEQ ID NO: 2771704 - protein, 6 aa, Entamoeba invadens
QKNKYS

SEQ ID NO: 2771705 - protein, 10 aa, Entamoeba invadens
QKNLEGSYKT

SEQ ID NO: 2771706 - protein, 11 aa, Entamoeba invadens
QKNLPNNTNYT

SEQ ID NO: 2771707 - protein, 8 aa, Entamoeba invadens
QKNQRIQS

SEQ ID NO: 2771708 - protein, 10 aa, Entamoeba invadens
QKNQSDDENV

SEQ ID NO: 2771709 - protein, 5 aa, Entamoeba invadens
QKNRN

SEQ ID NO: 2771710 - protein, 9 aa, Entamoeba invadens
QKNSTQQFN

SEQ ID NO: 2771711 - protein, 8 aa, Entamoeba invadens
QKNTEERG

SEQ ID NO: 2771712 - protein, 5 aa, Entamoeba invadens
QKNTP

SEQ ID NO: 2771713 - protein, 12 aa, Entamoeba invadens
QKNYETSKNWDT

SEQ ID NO: 2771714 - protein, 9 aa, Entamoeba invadens
QKNYKNQKE

SEQ ID NO: 2771715 - protein, 13 aa, Entamoeba invadens
QKNYSSQVSTKTA

SEQ ID NO: 2771716 - protein, 4 aa, Entamoeba invadens
QKPA

SEQ ID NO: 2771717 - protein, 9 aa, Entamoeba invadens
QKPEARPNF

SEQ ID NO: 2771718 - protein, 10 aa, Entamoeba invadens
QKPEARPNFD

SEQ ID NO: 2771719 - protein, 7 aa, Entamoeba invadens
QKPEDRP

SEQ ID NO: 2771720 - protein, 10 aa, Entamoeba invadens
QKPEDRPSAD

SEQ ID NO: 2771721 - protein, 15 aa, Entamoeba invadens
QKPHQSKKINQPKAL

SEQ ID NO: 2771722 - protein, 7 aa, Entamoeba invadens
QKPIEQG

SEQ ID NO: 2771723 - protein, 7 aa, Entamoeba invadens
QKPNTNE

SEQ ID NO: 2771724 - protein, 10 aa, Entamoeba invadens
QKPSKKTTHI

SEQ ID NO: 2771725 - protein, 14 aa, Entamoeba invadens
QKQAELYSDESATI

SEQ ID NO: 2771726 - protein, 9 aa, Entamoeba invadens
QKQEERPTI

SEQ ID NO: 2771727 - protein, 12 aa, Entamoeba invadens
QKQGTPTIETPD

SEQ ID NO: 2771728 - protein, 14 aa, Entamoeba invadens
QKQKEDEQKPYEDV

SEQ ID NO: 2771729 - protein, 37 aa, Entamoeba invadens
QKQKKAQWKGQITHEDKIRGNVQLDENNKLKQKDGIE

SEQ ID NO: 2771730 - protein, 9 aa, Entamoeba invadens
QKQLAKTTT

SEQ ID NO: 2771731 - protein, 11 aa, Entamoeba invadens
QKQLAKTTTSF

SEQ ID NO: 2771732 - protein, 11 aa, Entamoeba invadens
QKQLEKTTTSF

SEQ ID NO: 2771733 - protein, 4 aa, Entamoeba invadens
QKQR

SEQ ID NO: 2771734 - protein, 5 aa, Entamoeba invadens
QKQRS

SEQ ID NO: 2771735 - protein, 7 aa, Entamoeba invadens
QKQVENA

SEQ ID NO: 2771736 - protein, 7 aa, Entamoeba invadens
QKREQPI

SEQ ID NO: 2771737 - protein, 15 aa, Entamoeba invadens
QKRLKSGEIVSLLQK

SEQ ID NO: 2771738 - protein, 8 aa, Entamoeba invadens
QKRPEIRG

SEQ ID NO: 2771739 - protein, 16 aa, Entamoeba invadens
QKRRMEQTLDNSSKVK

SEQ ID NO: 2771740 - protein, 9 aa, Entamoeba invadens
QKSDPNEPS

SEQ ID NO: 2771741 - protein, 7 aa, Entamoeba invadens
QKSDSRF

SEQ ID NO: 2771742 - protein, 8 aa, Entamoeba invadens
QKSEEIDK

SEQ ID NO: 2771743 - protein, 8 aa, Entamoeba invadens
QKSEEIEK

SEQ ID NO: 2771744 - protein, 5 aa, Entamoeba invadens
QKSEK

SEQ ID NO: 2771745 - protein, 7 aa, Entamoeba invadens
QKSERGI

SEQ ID NO: 2771746 - protein, 5 aa, Entamoeba invadens
QKSKN

SEQ ID NO: 2771747 - protein, 5 aa, Entamoeba invadens
QKSKQ

SEQ ID NO: 2771748 - protein, 8 aa, Entamoeba invadens
QKSLEKTT

SEQ ID NO: 2771749 - protein, 6 aa, Entamoeba invadens
QKSNEI

SEQ ID NO: 2771750 - protein, 5 aa, Entamoeba invadens
QKSNG

SEQ ID NO: 2771751 - protein, 8 aa, Entamoeba invadens
QKSNNNKY

SEQ ID NO: 2771752 - protein, 10 aa, Entamoeba invadens
QKSQENEFEK

SEQ ID NO: 2771753 - protein, 13 aa, Entamoeba invadens
QKSQKNKNYGNKL

SEQ ID NO: 2771754 - protein, 13 aa, Entamoeba invadens
QKSSGKNAKPFKV

SEQ ID NO: 2771755 - protein, 6 aa, Entamoeba invadens
QKSTYR

SEQ ID NO: 2771756 - protein, 7 aa, Entamoeba invadens
QKSVYEK

SEQ ID NO: 2771757 - protein, 7 aa, Entamoeba invadens
QKTAGYT

SEQ ID NO: 2771758 - protein, 5 aa, Entamoeba invadens
QKTCT

SEQ ID NO: 2771759 - protein, 7 aa, Entamoeba invadens
QKTDGKC

SEQ ID NO: 2771760 - protein, 32 aa, Entamoeba invadens
QKTENIDDTQKEQNNAKNLKNKEINNNKKGIK

SEQ ID NO: 2771761 - protein, 22 aa, Entamoeba invadens
QKTGSDYDLSRSKSAPPTKSEM

SEQ ID NO: 2771762 - protein, 13 aa, Entamoeba invadens
QKTGTNNTNNCNV

SEQ ID NO: 2771763 - protein, 16 aa, Entamoeba invadens
QKTLNSQNWIIKKIAE

SEQ ID NO: 2771764 - protein, 4 aa, Entamoeba invadens
QKTM

SEQ ID NO: 2771765 - protein, 8 aa, Entamoeba invadens
QKTMNSTS

SEQ ID NO: 2771766 - protein, 9 aa, Entamoeba invadens
QKTPKTARE

SEQ ID NO: 2771767 - protein, 6 aa, Entamoeba invadens
QKTSEG

SEQ ID NO: 2771768 - protein, 7 aa, Entamoeba invadens
QKTSEHY

SEQ ID NO: 2771769 - protein, 11 aa, Entamoeba invadens
QKTSKIDPDDI

SEQ ID NO: 2771770 - protein, 13 aa, Entamoeba invadens
QKTSTMRNEMKRE

SEQ ID NO: 2771771 - protein, 7 aa, Entamoeba invadens
QKTSTNV

SEQ ID NO: 2771772 - protein, 11 aa, Entamoeba invadens
QKTTKTSSQEC

SEQ ID NO: 2771773 - protein, 8 aa, Entamoeba invadens
QKTYEKTT

SEQ ID NO: 2771774 - protein, 10 aa, Entamoeba invadens
QKVAAGNTIR

SEQ ID NO: 2771775 - protein, 27 aa, Entamoeba invadens
QKVAKNDERQEESVAPTKDTNEKHGRL

SEQ ID NO: 2771776 - protein, 21 aa, Entamoeba invadens
QKVETPKKRNSLEEKSIAKKH

SEQ ID NO: 2771777 - protein, 12 aa, Entamoeba invadens
QKVGATDKPVQV

SEQ ID NO: 2771778 - protein, 8 aa, Entamoeba invadens
QKVLKTEE

SEQ ID NO: 2771779 - protein, 13 aa, Entamoeba invadens
QKVPADRKPFEKN

SEQ ID NO: 2771780 - protein, 8 aa, Entamoeba invadens
QKVSPSIK

SEQ ID NO: 2771781 - protein, 10 aa, Entamoeba invadens
QKVSSGNTIR

SEQ ID NO: 2771782 - protein, 8 aa, Entamoeba invadens
QKWDNSTF

SEQ ID NO: 2771783 - protein, 7 aa, Entamoeba invadens
QKYAKEH

SEQ ID NO: 2771784 - protein, 6 aa, Entamoeba invadens
QKYDMK

SEQ ID NO: 2771785 - protein, 8 aa, Entamoeba invadens
QKYKKPAD

SEQ ID NO: 2771786 - protein, 8 aa, Entamoeba invadens
QKYKKQAD

SEQ ID NO: 2771787 - protein, 6 aa, Entamoeba invadens
QKYKNQ

SEQ ID NO: 2771788 - protein, 8 aa, Entamoeba invadens
QKYNKPSD

SEQ ID NO: 2771789 - protein, 5 aa, Entamoeba invadens
QKYNQ

SEQ ID NO: 2771790 - protein, 18 aa, Entamoeba invadens
QKYPAESFDESTTRSTKL

SEQ ID NO: 2771791 - protein, 5 aa, Entamoeba invadens
QKYPD

SEQ ID NO: 2771792 - protein, 7 aa, Entamoeba invadens
QKYSKTT

SEQ ID NO: 2771793 - protein, 7 aa, Entamoeba invadens
QKYTKTN

SEQ ID NO: 2771794 - protein, 18 aa, Entamoeba invadens
QKYTSCNVKEKERETYRE

SEQ ID NO: 2771795 - protein, 9 aa, Entamoeba invadens
QLAKEGIND

SEQ ID NO: 2771796 - protein, 8 aa, Entamoeba invadens
QLAPQTAK

SEQ ID NO: 2771797 - protein, 11 aa, Entamoeba invadens
QLDATTKRCVE

SEQ ID NO: 2771798 - protein, 7 aa, Entamoeba invadens
QLDGETD

SEQ ID NO: 2771799 - protein, 4 aa, Entamoeba invadens
QLDM

SEQ ID NO: 2771800 - protein, 4 aa, Entamoeba invadens
QLDQ

SEQ ID NO: 2771801 - protein, 7 aa, Entamoeba invadens
QLDSSGM

SEQ ID NO: 2771802 - protein, 12 aa, Entamoeba invadens
QLEEEKKRVEEL

SEQ ID NO: 2771803 - protein, 6 aa, Entamoeba invadens
QLEGTE

SEQ ID NO: 2771804 - protein, 63 aa, Entamoeba invadens
QLENAEKVSKDAEKTTAEKIEQINKESQAHVAEKQKVEEELKKVSDELSKEKDEIKKTQEMRE

SEQ ID NO: 2771805 - protein, 4 aa, Entamoeba invadens
QLEQ

SEQ ID NO: 2771806 - protein, 7 aa, Entamoeba invadens
QLESPSA

SEQ ID NO: 2771807 - protein, 6 aa, Entamoeba invadens
QLGGGA

SEQ ID NO: 2771808 - protein, 5 aa, Entamoeba invadens
QLGKV

SEQ ID NO: 2771809 - protein, 6 aa, Entamoeba invadens
QLGSNS

SEQ ID NO: 2771810 - protein, 30 aa, Entamoeba invadens
QLKEKENKSSKTKACAETMPSKVAKESVSG

SEQ ID NO: 2771811 - protein, 5 aa, Entamoeba invadens
QLKSV

SEQ ID NO: 2771812 - protein, 4 aa, Entamoeba invadens
QLKT

SEQ ID NO: 2771813 - protein, 9 aa, Entamoeba invadens
QLNNTNNAL

SEQ ID NO: 2771814 - protein, 11 aa, Entamoeba invadens
QLNNTNNALTE

SEQ ID NO: 2771815 - protein, 12 aa, Entamoeba invadens
QLPENRSSADKI

SEQ ID NO: 2771816 - protein, 12 aa, Entamoeba invadens
QLPGWSKNSTDY

SEQ ID NO: 2771817 - protein, 8 aa, Entamoeba invadens
QLPQPESD

SEQ ID NO: 2771818 - protein, 4 aa, Entamoeba invadens
QLPS

SEQ ID NO: 2771819 - protein, 5 aa, Entamoeba invadens
QLPSS

SEQ ID NO: 2771820 - protein, 4 aa, Entamoeba invadens
QLPT

SEQ ID NO: 2771821 - protein, 5 aa, Entamoeba invadens
QLPTD

SEQ ID NO: 2771822 - protein, 5 aa, Entamoeba invadens
QLQEA

SEQ ID NO: 2771823 - protein, 10 aa, Entamoeba invadens
QLQKKPHGME

SEQ ID NO: 2771824 - protein, 4 aa, Entamoeba invadens
QLQN

SEQ ID NO: 2771825 - protein, 14 aa, Entamoeba invadens
QLQNTQQKNYKSGT

SEQ ID NO: 2771826 - protein, 20 aa, Entamoeba invadens
QLQREKQQNQRVADSAEHQK

SEQ ID NO: 2771827 - protein, 9 aa, Entamoeba invadens
QLQTNSHVE

SEQ ID NO: 2771828 - protein, 14 aa, Entamoeba invadens
QLSAETRSALISSY

SEQ ID NO: 2771829 - protein, 4 aa, Entamoeba invadens
QLSD

SEQ ID NO: 2771830 - protein, 7 aa, Entamoeba invadens
QLSNEEC

SEQ ID NO: 2771831 - protein, 9 aa, Entamoeba invadens
QLSSYGEST

SEQ ID NO: 2771832 - protein, 6 aa, Entamoeba invadens
QLSVSD

SEQ ID NO: 2771833 - protein, 4 aa, Entamoeba invadens
QLTC

SEQ ID NO: 2771834 - protein, 12 aa, Entamoeba invadens
QLTEEQANSKTI

SEQ ID NO: 2771835 - protein, 10 aa, Entamoeba invadens
QLTERTREFG

SEQ ID NO: 2771836 - protein, 7 aa, Entamoeba invadens
QLTIESD

SEQ ID NO: 2771837 - protein, 5 aa, Entamoeba invadens
QLTKS

SEQ ID NO: 2771838 - protein, 10 aa, Entamoeba invadens
QLTKSNTSGV

SEQ ID NO: 2771839 - protein, 21 aa, Entamoeba invadens
QLTPQPTPNPPQESDKPSEII

SEQ ID NO: 2771840 - protein, 11 aa, Entamoeba invadens
QLTSKNEQKTN

SEQ ID NO: 2771841 - protein, 10 aa, Entamoeba invadens
QLVDTKDGKR

SEQ ID NO: 2771842 - protein, 20 aa, Entamoeba invadens
QLYPSGKYYNQNSKSCQSND

SEQ ID NO: 2771843 - protein, 6 aa, Entamoeba invadens
QLYQGT

SEQ ID NO: 2771844 - protein, 4 aa, Entamoeba invadens
QMEE

SEQ ID NO: 2771845 - protein, 19 aa, Entamoeba invadens
QMKRNTGELNQFEEQSDID

SEQ ID NO: 2771846 - protein, 7 aa, Entamoeba invadens
QMKTDGE

SEQ ID NO: 2771847 - protein, 4 aa, Entamoeba invadens
QMPP

SEQ ID NO: 2771848 - protein, 10 aa, Entamoeba invadens
QMPSTSPAFA

SEQ ID NO: 2771849 - protein, 20 aa, Entamoeba invadens
QMQEVKKKQKTISKSKTPKE

SEQ ID NO: 2771850 - protein, 9 aa, Entamoeba invadens
QMQPDGSKK

SEQ ID NO: 2771851 - protein, 4 aa, Entamoeba invadens
QMRE

SEQ ID NO: 2771852 - protein, 10 aa, Entamoeba invadens
QMSEDNMEEF

SEQ ID NO: 2771853 - protein, 10 aa, Entamoeba invadens
QMSEDSMEEF

SEQ ID NO: 2771854 - protein, 5 aa, Entamoeba invadens
QMTAS

SEQ ID NO: 2771855 - protein, 8 aa, Entamoeba invadens
QMTSSSTE

SEQ ID NO: 2771856 - protein, 27 aa, Entamoeba invadens
QMVSSSDNSPNITTTISPSVSSPSPSI

SEQ ID NO: 2771857 - protein, 9 aa, Entamoeba invadens
QNADDYTTQ

SEQ ID NO: 2771858 - protein, 8 aa, Entamoeba invadens
QNAFNSQD

SEQ ID NO: 2771859 - protein, 24 aa, Entamoeba invadens
QNAKNSNLNDEMSYPENQQDIISQ

SEQ ID NO: 2771860 - protein, 9 aa, Entamoeba invadens
QNAKSSIKN

SEQ ID NO: 2771861 - protein, 10 aa, Entamoeba invadens
QNAKYKEQIA

SEQ ID NO: 2771862 - protein, 6 aa, Entamoeba invadens
QNATNT

SEQ ID NO: 2771863 - protein, 7 aa, Entamoeba invadens
QNAYPSQ

SEQ ID NO: 2771864 - protein, 5 aa, Entamoeba invadens
QNCDD

SEQ ID NO: 2771865 - protein, 16 aa, Entamoeba invadens
QNCDQTKEYSATINQE

SEQ ID NO: 2771866 - protein, 9 aa, Entamoeba invadens
QNCGNRQEK

SEQ ID NO: 2771867 - protein, 12 aa, Entamoeba invadens
QNCKTCSSDYNR

SEQ ID NO: 2771868 - protein, 19 aa, Entamoeba invadens
QNCRGDVAGDKANENSVSK

SEQ ID NO: 2771869 - protein, 10 aa, Entamoeba invadens
QNCSSGTYGE

SEQ ID NO: 2771870 - protein, 6 aa, Entamoeba invadens
QNCTSM

SEQ ID NO: 2771871 - protein, 6 aa, Entamoeba invadens
QNDDTI

SEQ ID NO: 2771872 - protein, 8 aa, Entamoeba invadens
QNDEDSMN

SEQ ID NO: 2771873 - protein, 7 aa, Entamoeba invadens
QNDEEKF

SEQ ID NO: 2771874 - protein, 5 aa, Entamoeba invadens
QNDGI

SEQ ID NO: 2771875 - protein, 9 aa, Entamoeba invadens
QNDGTCNTN

SEQ ID NO: 2771876 - protein, 7 aa, Entamoeba invadens
QNDISYP

SEQ ID NO: 2771877 - protein, 9 aa, Entamoeba invadens
QNDKNHIKG

SEQ ID NO: 2771878 - protein, 4 aa, Entamoeba invadens
QNDP

SEQ ID NO: 2771879 - protein, 10 aa, Entamoeba invadens
QNDQFNKEGY

SEQ ID NO: 2771880 - protein, 9 aa, Entamoeba invadens
QNDQLRSQC

SEQ ID NO: 2771881 - protein, 8 aa, Entamoeba invadens
QNDRKRSL

SEQ ID NO: 2771882 - protein, 7 aa, Entamoeba invadens
QNDTNDV

SEQ ID NO: 2771883 - protein, 8 aa, Entamoeba invadens
QNDTPTQV

SEQ ID NO: 2771884 - protein, 6 aa, Entamoeba invadens
QNDTSY

SEQ ID NO: 2771885 - protein, 6 aa, Entamoeba invadens
QNDVDT

SEQ ID NO: 2771886 - protein, 6 aa, Entamoeba invadens
QNEDAF

SEQ ID NO: 2771887 - protein, 9 aa, Entamoeba invadens
QNEDQKGIV

SEQ ID NO: 2771888 - protein, 6 aa, Entamoeba invadens
QNEHDE

SEQ ID NO: 2771889 - protein, 7 aa, Entamoeba invadens
QNEKNGD

SEQ ID NO: 2771890 - protein, 14 aa, Entamoeba invadens
QNEMTQRENNEEME

SEQ ID NO: 2771891 - protein, 5 aa, Entamoeba invadens
QNENT

SEQ ID NO: 2771892 - protein, 11 aa, Entamoeba invadens
QNENTKTCEVP

SEQ ID NO: 2771893 - protein, 20 aa, Entamoeba invadens
QNEQIQQNTHKEIEKTPISN

SEQ ID NO: 2771894 - protein, 7 aa, Entamoeba invadens
QNEQSDC

SEQ ID NO: 2771895 - protein, 62 aa, Entamoeba invadens
QNESEEKSPKPEMSESPNESTNKASKTSDKESDSSSPRSDDKKSSSSMSSGDENELNTQRKV

SEQ ID NO: 2771896 - protein, 7 aa, Entamoeba invadens
QNESFHS

SEQ ID NO: 2771897 - protein, 12 aa, Entamoeba invadens
QNESTGENTPAE

SEQ ID NO: 2771898 - protein, 10 aa, Entamoeba invadens
QNETGQSSCT

SEQ ID NO: 2771899 - protein, 4 aa, Entamoeba invadens
QNEV

SEQ ID NO: 2771900 - protein, 26 aa, Entamoeba invadens
QNEVKKDDAKVEGEKTSTESKEEVTH

SEQ ID NO: 2771901 - protein, 4 aa, Entamoeba invadens
QNFE

SEQ ID NO: 2771902 - protein, 8 aa, Entamoeba invadens
QNFPEKRS

SEQ ID NO: 2771903 - protein, 7 aa, Entamoeba invadens
QNFPGNK

SEQ ID NO: 2771904 - protein, 6 aa, Entamoeba invadens
QNFSSG

SEQ ID NO: 2771905 - protein, 7 aa, Entamoeba invadens
QNGCPKC

SEQ ID NO: 2771906 - protein, 9 aa, Entamoeba invadens
QNGEMPDYN

SEQ ID NO: 2771907 - protein, 8 aa, Entamoeba invadens
QNGSTIKN

SEQ ID NO: 2771908 - protein, 8 aa, Entamoeba invadens
QNGSYPHH

SEQ ID NO: 2771909 - protein, 6 aa, Entamoeba invadens
QNGTFA

SEQ ID NO: 2771910 - protein, 7 aa, Entamoeba invadens
QNHNANY

SEQ ID NO: 2771911 - protein, 14 aa, Entamoeba invadens
QNHPDRNPNSTEFK

SEQ ID NO: 2771912 - protein, 8 aa, Entamoeba invadens
QNHRPSDD

SEQ ID NO: 2771913 - protein, 11 aa, Entamoeba invadens
QNHSNSFANSG

SEQ ID NO: 2771914 - protein, 15 aa, Entamoeba invadens
QNHSNYISESNGVCS

SEQ ID NO: 2771915 - protein, 11 aa, Entamoeba invadens
QNIEPEKKTKL

SEQ ID NO: 2771916 - protein, 10 aa, Entamoeba invadens
QNIKTEETDN

SEQ ID NO: 2771917 - protein, 6 aa, Entamoeba invadens
QNKGRG

SEQ ID NO: 2771918 - protein, 8 aa, Entamoeba invadens
QNKKSSLT

SEQ ID NO: 2771919 - protein, 15 aa, Entamoeba invadens
QNKLDEEKENKKKSI

SEQ ID NO: 2771920 - protein, 21 aa, Entamoeba invadens
QNKMNTNDSNSQKNGIKTTET

SEQ ID NO: 2771921 - protein, 7 aa, Entamoeba invadens
QNKNERI

SEQ ID NO: 2771922 - protein, 10 aa, Entamoeba invadens
QNKNNNNPEC

SEQ ID NO: 2771923 - protein, 10 aa, Entamoeba invadens
QNKQSDDVSI

SEQ ID NO: 2771924 - protein, 7 aa, Entamoeba invadens
QNKSNFV

SEQ ID NO: 2771925 - protein, 8 aa, Entamoeba invadens
QNKTERDM

SEQ ID NO: 2771926 - protein, 23 aa, Entamoeba invadens
QNKTERVNKQSNSTSIENNITDT

SEQ ID NO: 2771927 - protein, 9 aa, Entamoeba invadens
QNKTFTKGI

SEQ ID NO: 2771928 - protein, 9 aa, Entamoeba invadens
QNKTPSSFT

SEQ ID NO: 2771929 - protein, 12 aa, Entamoeba invadens
QNKTTKGCSKCE

SEQ ID NO: 2771930 - protein, 8 aa, Entamoeba invadens
QNLEDSKH

SEQ ID NO: 2771931 - protein, 10 aa, Entamoeba invadens
QNLEPSNVVP

SEQ ID NO: 2771932 - protein, 7 aa, Entamoeba invadens
QNLGTTT

SEQ ID NO: 2771933 - protein, 9 aa, Entamoeba invadens
QNLTPESLS

SEQ ID NO: 2771934 - protein, 14 aa, Entamoeba invadens
QNMTSEQKRYNEKR

SEQ ID NO: 2771935 - protein, 6 aa, Entamoeba invadens
QNNATA

SEQ ID NO: 2771936 - protein, 14 aa, Entamoeba invadens
QNNCNTCDSSNGNC

SEQ ID NO: 2771937 - protein, 7 aa, Entamoeba invadens
QNNDETG

SEQ ID NO: 2771938 - protein, 8 aa, Entamoeba invadens
QNNEDLTK

SEQ ID NO: 2771939 - protein, 7 aa, Entamoeba invadens
QNNESVE

SEQ ID NO: 2771940 - protein, 11 aa, Entamoeba invadens
QNNHLKEETVP

SEQ ID NO: 2771941 - protein, 15 aa, Entamoeba invadens
QNNKCRRCNDNSTNI

SEQ ID NO: 2771942 - protein, 16 aa, Entamoeba invadens
QNNKVNAKLTDFGSSR

SEQ ID NO: 2771943 - protein, 6 aa, Entamoeba invadens
QNNLPG

SEQ ID NO: 2771944 - protein, 10 aa, Entamoeba invadens
QNNPPFHEND

SEQ ID NO: 2771945 - protein, 8 aa, Entamoeba invadens
QNNSHIKT

SEQ ID NO: 2771946 - protein, 9 aa, Entamoeba invadens
QNNSSSCDE

SEQ ID NO: 2771947 - protein, 8 aa, Entamoeba invadens
QNNTDHPK

SEQ ID NO: 2771948 - protein, 7 aa, Entamoeba invadens
QNNTEKY

SEQ ID NO: 2771949 - protein, 12 aa, Entamoeba invadens
QNNTNKIFPKPE

SEQ ID NO: 2771950 - protein, 16 aa, Entamoeba invadens
QNPAERTSIDDVIIKL

SEQ ID NO: 2771951 - protein, 8 aa, Entamoeba invadens
QNPDKVGK

SEQ ID NO: 2771952 - protein, 9 aa, Entamoeba invadens
QNPDSTVRS

SEQ ID NO: 2771953 - protein, 9 aa, Entamoeba invadens
QNPEERPSA

SEQ ID NO: 2771954 - protein, 5 aa, Entamoeba invadens
QNPFD

SEQ ID NO: 2771955 - protein, 4 aa, Entamoeba invadens
QNPH

SEQ ID NO: 2771956 - protein, 6 aa, Entamoeba invadens
QNPIKD

SEQ ID NO: 2771957 - protein, 8 aa, Entamoeba invadens
QNPKERID

SEQ ID NO: 2771958 - protein, 10 aa, Entamoeba invadens
QNPKERKTIE

SEQ ID NO: 2771959 - protein, 19 aa, Entamoeba invadens
QNPKERNSITKVVECIQNI

SEQ ID NO: 2771960 - protein, 12 aa, Entamoeba invadens
QNPKERTDIQTV

SEQ ID NO: 2771961 - protein, 54 aa, Entamoeba invadens
QNPKLEPPKRSPPALPKKMNESEFKERPPLPPKEKEMTTSTKPKPPLPPKIQEM

SEQ ID NO: 2771962 - protein, 7 aa, Entamoeba invadens
QNPKLST

SEQ ID NO: 2771963 - protein, 8 aa, Entamoeba invadens
QNPLDRPQ

SEQ ID NO: 2771964 - protein, 15 aa, Entamoeba invadens
QNPLGEGSGRKGLPQ

SEQ ID NO: 2771965 - protein, 4 aa, Entamoeba invadens
QNPN

SEQ ID NO: 2771966 - protein, 11 aa, Entamoeba invadens
QNPPNTYGGRK

SEQ ID NO: 2771967 - protein, 9 aa, Entamoeba invadens
QNPQNRPDF

SEQ ID NO: 2771968 - protein, 7 aa, Entamoeba invadens
QNPSNRF

SEQ ID NO: 2771969 - protein, 7 aa, Entamoeba invadens
QNPSNRL

SEQ ID NO: 2771970 - protein, 16 aa, Entamoeba invadens
QNPTASSITPPSGDIK

SEQ ID NO: 2771971 - protein, 9 aa, Entamoeba invadens
QNPYNSSEF

SEQ ID NO: 2771972 - protein, 8 aa, Entamoeba invadens
QNQCTSCD

SEQ ID NO: 2771973 - protein, 8 aa, Entamoeba invadens
QNQDKCSK

SEQ ID NO: 2771974 - protein, 9 aa, Entamoeba invadens
QNQPTQYNF

SEQ ID NO: 2771975 - protein, 8 aa, Entamoeba invadens
QNQTGEPD

SEQ ID NO: 2771976 - protein, 14 aa, Entamoeba invadens
QNRCQSNDKLTKSC

SEQ ID NO: 2771977 - protein, 7 aa, Entamoeba invadens
QNRPNTI

SEQ ID NO: 2771978 - protein, 7 aa, Entamoeba invadens
QNRSKCD

SEQ ID NO: 2771979 - protein, 9 aa, Entamoeba invadens
QNRSLRPIT

SEQ ID NO: 2771980 - protein, 5 aa, Entamoeba invadens
QNRST

SEQ ID NO: 2771981 - protein, 9 aa, Entamoeba invadens
QNRYTPKQA

SEQ ID NO: 2771982 - protein, 8 aa, Entamoeba invadens
QNSCNTGF

SEQ ID NO: 2771983 - protein, 5 aa, Entamoeba invadens
QNSEL

SEQ ID NO: 2771984 - protein, 6 aa, Entamoeba invadens
QNSESS

SEQ ID NO: 2771985 - protein, 32 aa, Entamoeba invadens
QNSFESDSLNDQNTSSGQNTQNMSIPQNPPNM

SEQ ID NO: 2771986 - protein, 11 aa, Entamoeba invadens
QNSGQITLQND

SEQ ID NO: 2771987 - protein, 4 aa, Entamoeba invadens
QNSM

SEQ ID NO: 2771988 - protein, 6 aa, Entamoeba invadens
QNSNVE

SEQ ID NO: 2771989 - protein, 7 aa, Entamoeba invadens
QNSPFPQ

SEQ ID NO: 2771990 - protein, 6 aa, Entamoeba invadens
QNSPLS

SEQ ID NO: 2771991 - protein, 6 aa, Entamoeba invadens
QNSQWG

SEQ ID NO: 2771992 - protein, 8 aa, Entamoeba invadens
QNSRCTSC

SEQ ID NO: 2771993 - protein, 9 aa, Entamoeba invadens
QNSRNSEVP

SEQ ID NO: 2771994 - protein, 20 aa, Entamoeba invadens
QNSTEQSETKVPKSGKDSYI

SEQ ID NO: 2771995 - protein, 9 aa, Entamoeba invadens
QNSTFTKGI

SEQ ID NO: 2771996 - protein, 8 aa, Entamoeba invadens
QNSTGNNE

SEQ ID NO: 2771997 - protein, 6 aa, Entamoeba invadens
QNSTGS

SEQ ID NO: 2771998 - protein, 17 aa, Entamoeba invadens
QNSTKITRFDGENYNKC

SEQ ID NO: 2771999 - protein, 8 aa, Entamoeba invadens
QNSTLQNM

SEQ ID NO: 2772000 - protein, 11 aa, Entamoeba invadens
QNSTVDKGPCF

SEQ ID NO: 2772001 - protein, 16 aa, Entamoeba invadens
QNTALRGSAKNATQPF

SEQ ID NO: 2772002 - protein, 11 aa, Entamoeba invadens
QNTCETKDKYC

SEQ ID NO: 2772003 - protein, 4 aa, Entamoeba invadens
QNTD

SEQ ID NO: 2772004 - protein, 10 aa, Entamoeba invadens
QNTENYTNNQ

SEQ ID NO: 2772005 - protein, 8 aa, Entamoeba invadens
QNTESDEM

SEQ ID NO: 2772006 - protein, 7 aa, Entamoeba invadens
QNTFGNV

SEQ ID NO: 2772007 - protein, 9 aa, Entamoeba invadens
QNTIQKVGT

SEQ ID NO: 2772008 - protein, 5 aa, Entamoeba invadens
QNTKK

SEQ ID NO: 2772009 - protein, 5 aa, Entamoeba invadens
QNTNN

SEQ ID NO: 2772010 - protein, 14 aa, Entamoeba invadens
QNTNTEQEPEQKGR

SEQ ID NO: 2772011 - protein, 6 aa, Entamoeba invadens
QNTNVY

SEQ ID NO: 2772012 - protein, 12 aa, Entamoeba invadens
QNTPTTEQPQQH

SEQ ID NO: 2772013 - protein, 6 aa, Entamoeba invadens
QNTPVD

SEQ ID NO: 2772014 - protein, 6 aa, Entamoeba invadens
QNTQER

SEQ ID NO: 2772015 - protein, 10 aa, Entamoeba invadens
QNTQITTEGT

SEQ ID NO: 2772016 - protein, 10 aa, Entamoeba invadens
QNTQITTQGT

SEQ ID NO: 2772017 - protein, 5 aa, Entamoeba invadens
QNTQN

SEQ ID NO: 2772018 - protein, 14 aa, Entamoeba invadens
QNTQQKNYKSGTKT

SEQ ID NO: 2772019 - protein, 7 aa, Entamoeba invadens
QNTQRRV

SEQ ID NO: 2772020 - protein, 5 aa, Entamoeba invadens
QNTQT

SEQ ID NO: 2772021 - protein, 7 aa, Entamoeba invadens
QNTQVQV

SEQ ID NO: 2772022 - protein, 38 aa, Entamoeba invadens
QNTSAPPSNRQSGSSGDWANSTDSLLAQNSSGEETLSK

SEQ ID NO: 2772023 - protein, 10 aa, Entamoeba invadens
QNTSDQNSDI

SEQ ID NO: 2772024 - protein, 9 aa, Entamoeba invadens
QNTSDYSYP

SEQ ID NO: 2772025 - protein, 6 aa, Entamoeba invadens
QNTSIS

SEQ ID NO: 2772026 - protein, 15 aa, Entamoeba invadens
QNTSKPDNTMDPAEL

SEQ ID NO: 2772027 - protein, 8 aa, Entamoeba invadens
QNTSNTCD

SEQ ID NO: 2772028 - protein, 8 aa, Entamoeba invadens
QNTSSTCD

SEQ ID NO: 2772029 - protein, 9 aa, Entamoeba invadens
QNTSSTCDD

SEQ ID NO: 2772030 - protein, 9 aa, Entamoeba invadens
QNTSSTCDE

SEQ ID NO: 2772031 - protein, 10 aa, Entamoeba invadens
QNTSSTCDEC

SEQ ID NO: 2772032 - protein, 9 aa, Entamoeba invadens
QNTTNGCSS

SEQ ID NO: 2772033 - protein, 16 aa, Entamoeba invadens
QNTTYNFPTTPDPSVS

SEQ ID NO: 2772034 - protein, 7 aa, Entamoeba invadens
QNVETQA

SEQ ID NO: 2772035 - protein, 6 aa, Entamoeba invadens
QNVPEY

SEQ ID NO: 2772036 - protein, 10 aa, Entamoeba invadens
QNVSMDSTSV

SEQ ID NO: 2772037 - protein, 6 aa, Entamoeba invadens
QNVTGQ

SEQ ID NO: 2772038 - protein, 5 aa, Entamoeba invadens
QNWAI

SEQ ID NO: 2772039 - protein, 6 aa, Entamoeba invadens
QNYEDK

SEQ ID NO: 2772040 - protein, 12 aa, Entamoeba invadens
QPAKRNKNKETI

SEQ ID NO: 2772041 - protein, 14 aa, Entamoeba invadens
QPCGDGEYGTKPNC

SEQ ID NO: 2772042 - protein, 15 aa, Entamoeba invadens
QPCSGGTFQNQTGQA

SEQ ID NO: 2772043 - protein, 5 aa, Entamoeba invadens
QPCSH

SEQ ID NO: 2772044 - protein, 5 aa, Entamoeba invadens
QPDCD

SEQ ID NO: 2772045 - protein, 9 aa, Entamoeba invadens
QPDCNSTSF

SEQ ID NO: 2772046 - protein, 9 aa, Entamoeba invadens
QPDPYGTSH

SEQ ID NO: 2772047 - protein, 12 aa, Entamoeba invadens
QPEAVPVQEPKV

SEQ ID NO: 2772048 - protein, 4 aa, Entamoeba invadens
QPEE

SEQ ID NO: 2772049 - protein, 5 aa, Entamoeba invadens
QPEID

SEQ ID NO: 2772050 - protein, 4 aa, Entamoeba invadens
QPEN

SEQ ID NO: 2772051 - protein, 13 aa, Entamoeba invadens
QPENTYNPQDYTP

SEQ ID NO: 2772052 - protein, 14 aa, Entamoeba invadens
QPESASTANPQSAI

SEQ ID NO: 2772053 - protein, 11 aa, Entamoeba invadens
QPESNNYKHSA

SEQ ID NO: 2772054 - protein, 5 aa, Entamoeba invadens
QPFNT

SEQ ID NO: 2772055 - protein, 6 aa, Entamoeba invadens
QPGSVY

SEQ ID NO: 2772056 - protein, 27 aa, Entamoeba invadens
QPGTYSSVDGASSCSKCAAGYTSSMSS

SEQ ID NO: 2772057 - protein, 12 aa, Entamoeba invadens
QPGTYSTGGSVS

SEQ ID NO: 2772058 - protein, 15 aa, Entamoeba invadens
QPHPTSSDYSQEVQQ

SEQ ID NO: 2772059 - protein, 11 aa, Entamoeba invadens
QPIAQGASGTV

SEQ ID NO: 2772060 - protein, 4 aa, Entamoeba invadens
QPIE

SEQ ID NO: 2772061 - protein, 11 aa, Entamoeba invadens
QPIGNKGDNQC

SEQ ID NO: 2772062 - protein, 33 aa, Entamoeba invadens
QPIPQQVDQPINYAPPPLNQQLQPQHQENELQQ

SEQ ID NO: 2772063 - protein, 18 aa, Entamoeba invadens
QPIQPEAKKLSAAERRKQ

SEQ ID NO: 2772064 - protein, 24 aa, Entamoeba invadens
QPITQKDTQPQHKEASESQQTGSI

SEQ ID NO: 2772065 - protein, 14 aa, Entamoeba invadens
QPKEPVSTDKIHTN

SEQ ID NO: 2772066 - protein, 5 aa, Entamoeba invadens
QPKFA

SEQ ID NO: 2772067 - protein, 11 aa, Entamoeba invadens
QPKNDKPPISQ

SEQ ID NO: 2772068 - protein, 7 aa, Entamoeba invadens
QPKRNSF

SEQ ID NO: 2772069 - protein, 8 aa, Entamoeba invadens
QPKSCTSV

SEQ ID NO: 2772070 - protein, 12 aa, Entamoeba invadens
QPLNSSQTARRH

SEQ ID NO: 2772071 - protein, 9 aa, Entamoeba invadens
QPMDQDGKY

SEQ ID NO: 2772072 - protein, 4 aa, Entamoeba invadens
QPMP

SEQ ID NO: 2772073 - protein, 8 aa, Entamoeba invadens
QPNDATGI

SEQ ID NO: 2772074 - protein, 15 aa, Entamoeba invadens
QPNELSEFLKDDPIP

SEQ ID NO: 2772075 - protein, 8 aa, Entamoeba invadens
QPNPNCSS

SEQ ID NO: 2772076 - protein, 8 aa, Entamoeba invadens
QPNSNNNT

SEQ ID NO: 2772077 - protein, 6 aa, Entamoeba invadens
QPNSRT

SEQ ID NO: 2772078 - protein, 8 aa, Entamoeba invadens
QPNSYQKV

SEQ ID NO: 2772079 - protein, 6 aa, Entamoeba invadens
QPNTAN

SEQ ID NO: 2772080 - protein, 6 aa, Entamoeba invadens
QPNTEI

SEQ ID NO: 2772081 - protein, 6 aa, Entamoeba invadens
QPNTTL

SEQ ID NO: 2772082 - protein, 8 aa, Entamoeba invadens
QPNYKQND

SEQ ID NO: 2772083 - protein, 7 aa, Entamoeba invadens
QPPIGQG

SEQ ID NO: 2772084 - protein, 10 aa, Entamoeba invadens
QPPKDVGDYD

SEQ ID NO: 2772085 - protein, 12 aa, Entamoeba invadens
QPPTARESSEPS

SEQ ID NO: 2772086 - protein, 33 aa, Entamoeba invadens
QPQEEQHTEQVEETSALNNEAQPPQQNQQTEQI

SEQ ID NO: 2772087 - protein, 34 aa, Entamoeba invadens
QPQMPNVQQGPVGLTQPSMPNVPQYQQQVGGPIG

SEQ ID NO: 2772088 - protein, 23 aa, Entamoeba invadens
QPQTSNPTNPQGEQSSGETEQLL

SEQ ID NO: 2772089 - protein, 6 aa, Entamoeba invadens
QPRGNT

SEQ ID NO: 2772090 - protein, 6 aa, Entamoeba invadens
QPRNRH

SEQ ID NO: 2772091 - protein, 5 aa, Entamoeba invadens
QPSFH

SEQ ID NO: 2772092 - protein, 6 aa, Entamoeba invadens
QPSNPN

SEQ ID NO: 2772093 - protein, 11 aa, Entamoeba invadens
QPSSKGCNRCE

SEQ ID NO: 2772094 - protein, 12 aa, Entamoeba invadens
QPSVDPYADDQK

SEQ ID NO: 2772095 - protein, 6 aa, Entamoeba invadens
QPTELE

SEQ ID NO: 2772096 - protein, 6 aa, Entamoeba invadens
QPTENP

SEQ ID NO: 2772097 - protein, 8 aa, Entamoeba invadens
QPTGAELS

SEQ ID NO: 2772098 - protein, 4 aa, Entamoeba invadens
QPTL

SEQ ID NO: 2772099 - protein, 31 aa, Entamoeba invadens
QPTLTEENVTTFKSNVEENCETKTTKGCTRC

SEQ ID NO: 2772100 - protein, 19 aa, Entamoeba invadens
QPTNTTNSTNQTNSTLTTC

SEQ ID NO: 2772101 - protein, 9 aa, Entamoeba invadens
QPTRPSKVK

SEQ ID NO: 2772102 - protein, 5 aa, Entamoeba invadens
QPTSD

SEQ ID NO: 2772103 - protein, 9 aa, Entamoeba invadens
QPTSSQCST

SEQ ID NO: 2772104 - protein, 13 aa, Entamoeba invadens
QPTTLPDPTTPIN

SEQ ID NO: 2772105 - protein, 15 aa, Entamoeba invadens
QPTTLPTKESPINPK

SEQ ID NO: 2772106 - protein, 13 aa, Entamoeba invadens
QPTTLPTTTSPIN

SEQ ID NO: 2772107 - protein, 14 aa, Entamoeba invadens
QPTTLSDSTTPINN

SEQ ID NO: 2772108 - protein, 4 aa, Entamoeba invadens
QPVN

SEQ ID NO: 2772109 - protein, 9 aa, Entamoeba invadens
QPVTVTNTN

SEQ ID NO: 2772110 - protein, 4 aa, Entamoeba invadens
QPYC

SEQ ID NO: 2772111 - protein, 15 aa, Entamoeba invadens
QPYEETVEVSNTTKK

SEQ ID NO: 2772112 - protein, 4 aa, Entamoeba invadens
QPYK

SEQ ID NO: 2772113 - protein, 5 aa, Entamoeba invadens
QPYKE

SEQ ID NO: 2772114 - protein, 6 aa, Entamoeba invadens
QPYPTP

SEQ ID NO: 2772115 - protein, 20 aa, Entamoeba invadens
QQAKQSKSTDERSAIQTHKT

SEQ ID NO: 2772116 - protein, 8 aa, Entamoeba invadens
QQALSNGK

SEQ ID NO: 2772117 - protein, 12 aa, Entamoeba invadens
QQANDEECGRCD

SEQ ID NO: 2772118 - protein, 12 aa, Entamoeba invadens
QQCETCKSDRYL

SEQ ID NO: 2772119 - protein, 7 aa, Entamoeba invadens
QQCNNTN

SEQ ID NO: 2772120 - protein, 5 aa, Entamoeba invadens
QQCSS

SEQ ID NO: 2772121 - protein, 6 aa, Entamoeba invadens
QQCSSG

SEQ ID NO: 2772122 - protein, 4 aa, Entamoeba invadens
QQCT

SEQ ID NO: 2772123 - protein, 7 aa, Entamoeba invadens
QQCTKTK

SEQ ID NO: 2772124 - protein, 9 aa, Entamoeba invadens
QQDPKDRIK

SEQ ID NO: 2772125 - protein, 4 aa, Entamoeba invadens
QQEL

SEQ ID NO: 2772126 - protein, 10 aa, Entamoeba invadens
QQENETLSSE

SEQ ID NO: 2772127 - protein, 12 aa, Entamoeba invadens
QQEQHETKTLEL

SEQ ID NO: 2772128 - protein, 21 aa, Entamoeba invadens
QQEYETQKDGSSSKSNVSSLS

SEQ ID NO: 2772129 - protein, 5 aa, Entamoeba invadens
QQFPD

SEQ ID NO: 2772130 - protein, 12 aa, Entamoeba invadens
QQFTKDSCNPSN

SEQ ID NO: 2772131 - protein, 8 aa, Entamoeba invadens
QQFTPTEQ

SEQ ID NO: 2772132 - protein, 7 aa, Entamoeba invadens
QQGCGLG

SEQ ID NO: 2772133 - protein, 16 aa, Entamoeba invadens
QQGNPTLSFSTSPSVE

SEQ ID NO: 2772134 - protein, 9 aa, Entamoeba invadens
QQGTYSNIG

SEQ ID NO: 2772135 - protein, 4 aa, Entamoeba invadens
QQGY

SEQ ID NO: 2772136 - protein, 5 aa, Entamoeba invadens
QQHDE

SEQ ID NO: 2772137 - protein, 10 aa, Entamoeba invadens
QQHRDRGQYV

SEQ ID NO: 2772138 - protein, 7 aa, Entamoeba invadens
QQIGDGK

SEQ ID NO: 2772139 - protein, 5 aa, Entamoeba invadens
QQIKK

SEQ ID NO: 2772140 - protein, 8 aa, Entamoeba invadens
QQKAHIEN

SEQ ID NO: 2772141 - protein, 12 aa, Entamoeba invadens
QQKARDPDSYTE

SEQ ID NO: 2772142 - protein, 4 aa, Entamoeba invadens
QQKD

SEQ ID NO: 2772143 - protein, 7 aa, Entamoeba invadens
QQKESLN

SEQ ID NO: 2772144 - protein, 19 aa, Entamoeba invadens
QQKGLNSHKQNSGESCGAT

SEQ ID NO: 2772145 - protein, 8 aa, Entamoeba invadens
QQKKTSLK

SEQ ID NO: 2772146 - protein, 4 aa, Entamoeba invadens
QQKL

SEQ ID NO: 2772147 - protein, 7 aa, Entamoeba invadens
QQKNGYD

SEQ ID NO: 2772148 - protein, 29 aa, Entamoeba invadens
QQKSTIEHKKGIDSLDSITSSSKNQTQEI

SEQ ID NO: 2772149 - protein, 7 aa, Entamoeba invadens
QQKTLSN

SEQ ID NO: 2772150 - protein, 8 aa, Entamoeba invadens
QQKYKRAA

SEQ ID NO: 2772151 - protein, 6 aa, Entamoeba invadens
QQKYTF

SEQ ID NO: 2772152 - protein, 9 aa, Entamoeba invadens
QQKYTKSAD

SEQ ID NO: 2772153 - protein, 9 aa, Entamoeba invadens
QQLEPTESK

SEQ ID NO: 2772154 - protein, 17 aa, Entamoeba invadens
QQLKGTSSNTTKTRRKC

SEQ ID NO: 2772155 - protein, 18 aa, Entamoeba invadens
QQLQTLEEQKKDLERQTE

SEQ ID NO: 2772156 - protein, 5 aa, Entamoeba invadens
QQLTE

SEQ ID NO: 2772157 - protein, 12 aa, Entamoeba invadens
QQLTNDNTIPDS

SEQ ID NO: 2772158 - protein, 13 aa, Entamoeba invadens
QQMGQPPMQQNPP

SEQ ID NO: 2772159 - protein, 14 aa, Entamoeba invadens
QQMQEADQKRAEKI

SEQ ID NO: 2772160 - protein, 10 aa, Entamoeba invadens
QQNEPKAPLK

SEQ ID NO: 2772161 - protein, 8 aa, Entamoeba invadens
QQNETVAS

SEQ ID NO: 2772162 - protein, 21 aa, Entamoeba invadens
QQNGRQQTTPPQQQNIQPNRE

SEQ ID NO: 2772163 - protein, 6 aa, Entamoeba invadens
QQNGYY

SEQ ID NO: 2772164 - protein, 5 aa, Entamoeba invadens
QQNHK

SEQ ID NO: 2772165 - protein, 13 aa, Entamoeba invadens
QQNISSLNNESAM

SEQ ID NO: 2772166 - protein, 8 aa, Entamoeba invadens
QQNKETHC

SEQ ID NO: 2772167 - protein, 12 aa, Entamoeba invadens
QQNNDMFPFDND

SEQ ID NO: 2772168 - protein, 10 aa, Entamoeba invadens
QQNRGGVGHN

SEQ ID NO: 2772169 - protein, 7 aa, Entamoeba invadens
QQNRQKY

SEQ ID NO: 2772170 - protein, 11 aa, Entamoeba invadens
QQNSTTPLKTT

SEQ ID NO: 2772171 - protein, 11 aa, Entamoeba invadens
QQNTSGDKSLT

SEQ ID NO: 2772172 - protein, 5 aa, Entamoeba invadens
QQNVT

SEQ ID NO: 2772173 - protein, 23 aa, Entamoeba invadens
QQNWDQQQNVNVQTAQQPQNSDD

SEQ ID NO: 2772174 - protein, 10 aa, Entamoeba invadens
QQNYNQSTPM

SEQ ID NO: 2772175 - protein, 11 aa, Entamoeba invadens
QQPASGNEEEM

SEQ ID NO: 2772176 - protein, 4 aa, Entamoeba invadens
QQPE

SEQ ID NO: 2772177 - protein, 18 aa, Entamoeba invadens
QQPEDRPKIDEIVEVIKT

SEQ ID NO: 2772178 - protein, 5 aa, Entamoeba invadens
QQPLL

SEQ ID NO: 2772179 - protein, 7 aa, Entamoeba invadens
QQPNQQQ

SEQ ID NO: 2772180 - protein, 9 aa, Entamoeba invadens
QQPPPPLYT

SEQ ID NO: 2772181 - protein, 4 aa, Entamoeba invadens
QQPQ

SEQ ID NO: 2772182 - protein, 11 aa, Entamoeba invadens
QQPQGTPVQPQ

SEQ ID NO: 2772183 - protein, 9 aa, Entamoeba invadens
QQPSCRPSF

SEQ ID NO: 2772184 - protein, 6 aa, Entamoeba invadens
QQPYGK

SEQ ID NO: 2772185 - protein, 9 aa, Entamoeba invadens
QQQIPVGSY

SEQ ID NO: 2772186 - protein, 5 aa, Entamoeba invadens
QQQPE

SEQ ID NO: 2772187 - protein, 5 aa, Entamoeba invadens
QQQQD

SEQ ID NO: 2772188 - protein, 15 aa, Entamoeba invadens
QQQRVYNKPTQRHAQ

SEQ ID NO: 2772189 - protein, 5 aa, Entamoeba invadens
QQRGR

SEQ ID NO: 2772190 - protein, 6 aa, Entamoeba invadens
QQRNQD

SEQ ID NO: 2772191 - protein, 12 aa, Entamoeba invadens
QQSKNSLPEGAL

SEQ ID NO: 2772192 - protein, 8 aa, Entamoeba invadens
QQSKYGYG

SEQ ID NO: 2772193 - protein, 4 aa, Entamoeba invadens
QQST

SEQ ID NO: 2772194 - protein, 7 aa, Entamoeba invadens
QQSTEEI

SEQ ID NO: 2772195 - protein, 9 aa, Entamoeba invadens
QQSTNCSSK

SEQ ID NO: 2772196 - protein, 7 aa, Entamoeba invadens
QQSTRID

SEQ ID NO: 2772197 - protein, 23 aa, Entamoeba invadens
QQSTTARSDIQSVSKELRSVYMK

SEQ ID NO: 2772198 - protein, 12 aa, Entamoeba invadens
QQTDEIQHNENL

SEQ ID NO: 2772199 - protein, 9 aa, Entamoeba invadens
QQTESSDLV

SEQ ID NO: 2772200 - protein, 6 aa, Entamoeba invadens
QQTFGS

SEQ ID NO: 2772201 - protein, 8 aa, Entamoeba invadens
QQTNFYDS

SEQ ID NO: 2772202 - protein, 19 aa, Entamoeba invadens
QQTPKDRPDIEMVIKQLES

SEQ ID NO: 2772203 - protein, 19 aa, Entamoeba invadens
QQTPKDRPDIETVIKQLES

SEQ ID NO: 2772204 - protein, 10 aa, Entamoeba invadens
QQTPKERPDI

SEQ ID NO: 2772205 - protein, 13 aa, Entamoeba invadens
QQTSNLEAYNTSS

SEQ ID NO: 2772206 - protein, 48 aa, Entamoeba invadens
QQTSPTHSVRSRPKQVTHNESDISDIPASDVQPFPDLQTTKQDETSIN

SEQ ID NO: 2772207 - protein, 16 aa, Entamoeba invadens
QQTTRCQSPSNTTMSS

SEQ ID NO: 2772208 - protein, 9 aa, Entamoeba invadens
QQTYPSQQL

SEQ ID NO: 2772209 - protein, 4 aa, Entamoeba invadens
QQVD

SEQ ID NO: 2772210 - protein, 11 aa, Entamoeba invadens
QQVSDKKKVFE

SEQ ID NO: 2772211 - protein, 6 aa, Entamoeba invadens
QQYCSS

SEQ ID NO: 2772212 - protein, 7 aa, Entamoeba invadens
QQYDPRQ

SEQ ID NO: 2772213 - protein, 20 aa, Entamoeba invadens
QQYEDTPYKKVTTEPPAKDL

SEQ ID NO: 2772214 - protein, 11 aa, Entamoeba invadens
QQYQNTSNSCR

SEQ ID NO: 2772215 - protein, 14 aa, Entamoeba invadens
QQYQPQPPQQYQQP

SEQ ID NO: 2772216 - protein, 8 aa, Entamoeba invadens
QQYTGRRE

SEQ ID NO: 2772217 - protein, 8 aa, Entamoeba invadens
QRCESIDE

SEQ ID NO: 2772218 - protein, 9 aa, Entamoeba invadens
QRCKTCDEN

SEQ ID NO: 2772219 - protein, 5 aa, Entamoeba invadens
QRCSN

SEQ ID NO: 2772220 - protein, 6 aa, Entamoeba invadens
QRCTGK

SEQ ID NO: 2772221 - protein, 6 aa, Entamoeba invadens
QRCTTK

SEQ ID NO: 2772222 - protein, 6 aa, Entamoeba invadens
QRDELS

SEQ ID NO: 2772223 - protein, 7 aa, Entamoeba invadens
QRDGRKI

SEQ ID NO: 2772224 - protein, 11 aa, Entamoeba invadens
QRDRKGLYAKA

SEQ ID NO: 2772225 - protein, 4 aa, Entamoeba invadens
QRDS

SEQ ID NO: 2772226 - protein, 12 aa, Entamoeba invadens
QRDSPNATLSSF

SEQ ID NO: 2772227 - protein, 6 aa, Entamoeba invadens
QRDSRK

SEQ ID NO: 2772228 - protein, 16 aa, Entamoeba invadens
QREGMNEGVEKHKAQI

SEQ ID NO: 2772229 - protein, 9 aa, Entamoeba invadens
QRETKKTTT

SEQ ID NO: 2772230 - protein, 4 aa, Entamoeba invadens
QRFN

SEQ ID NO: 2772231 - protein, 22 aa, Entamoeba invadens
QRGCTQCEEGYHTYKSNQCQKC

SEQ ID NO: 2772232 - protein, 5 aa, Entamoeba invadens
QRGVC

SEQ ID NO: 2772233 - protein, 11 aa, Entamoeba invadens
QRIDQSKEFSK

SEQ ID NO: 2772234 - protein, 20 aa, Entamoeba invadens
QRIKADDLTAEQNKDETQRS

SEQ ID NO: 2772235 - protein, 8 aa, Entamoeba invadens
QRINGRKN

SEQ ID NO: 2772236 - protein, 5 aa, Entamoeba invadens
QRIRP

SEQ ID NO: 2772237 - protein, 8 aa, Entamoeba invadens
QRITPDGE

SEQ ID NO: 2772238 - protein, 16 aa, Entamoeba invadens
QRKRENKMEKIESKPL

SEQ ID NO: 2772239 - protein, 6 aa, Entamoeba invadens
QRKSEE

SEQ ID NO: 2772240 - protein, 9 aa, Entamoeba invadens
QRKYKKPAD

SEQ ID NO: 2772241 - protein, 14 aa, Entamoeba invadens
QRLDEATDQIEQSN

SEQ ID NO: 2772242 - protein, 4 aa, Entamoeba invadens
QRLL

SEQ ID NO: 2772243 - protein, 10 aa, Entamoeba invadens
QRLNNENTCA

SEQ ID NO: 2772244 - protein, 13 aa, Entamoeba invadens
QRMKDQLKEIAND

SEQ ID NO: 2772245 - protein, 4 aa, Entamoeba invadens
QRNA

SEQ ID NO: 2772246 - protein, 7 aa, Entamoeba invadens
QRNATEH

SEQ ID NO: 2772247 - protein, 7 aa, Entamoeba invadens
QRNGKRL

SEQ ID NO: 2772248 - protein, 9 aa, Entamoeba invadens
QRNKTQHFP

SEQ ID NO: 2772249 - protein, 7 aa, Entamoeba invadens
QRNTKMR

SEQ ID NO: 2772250 - protein, 9 aa, Entamoeba invadens
QRPGDDSLD

SEQ ID NO: 2772251 - protein, 32 aa, Entamoeba invadens
QRPIDVDESKEFNENKKKEHLGVQENKGKEIK

SEQ ID NO: 2772252 - protein, 17 aa, Entamoeba invadens
QRPKPQGLSNSASQKMF

SEQ ID NO: 2772253 - protein, 18 aa, Entamoeba invadens
QRPNDRPNIDEVVKKLEA

SEQ ID NO: 2772254 - protein, 6 aa, Entamoeba invadens
QRPPLN

SEQ ID NO: 2772255 - protein, 12 aa, Entamoeba invadens
QRPQPPQRQPNI

SEQ ID NO: 2772256 - protein, 5 aa, Entamoeba invadens
QRQDE

SEQ ID NO: 2772257 - protein, 5 aa, Entamoeba invadens
QRQET

SEQ ID NO: 2772258 - protein, 8 aa, Entamoeba invadens
QRREKDPP

SEQ ID NO: 2772259 - protein, 97 aa, Entamoeba invadens
QRSANANAITQTDQSPEDTGLTSDEVSPHSHSPESFKNDNNKSQNEKVEKTEKIEKEEKEEKEEKEEKEEKEEKEEPQKDSKDTPTESKGDEKNDHS

SEQ ID NO: 2772260 - protein, 12 aa, Entamoeba invadens
QRSDARSKDHIE

SEQ ID NO: 2772261 - protein, 7 aa, Entamoeba invadens
QRSDARV

SEQ ID NO: 2772262 - protein, 10 aa, Entamoeba invadens
QRSDARVKEH

SEQ ID NO: 2772263 - protein, 14 aa, Entamoeba invadens
QRSDKRSKKDIREI

SEQ ID NO: 2772264 - protein, 14 aa, Entamoeba invadens
QRSDRKSKTDIRPI

SEQ ID NO: 2772265 - protein, 6 aa, Entamoeba invadens
QRSFPE

SEQ ID NO: 2772266 - protein, 5 aa, Entamoeba invadens
QRSGY

SEQ ID NO: 2772267 - protein, 36 aa, Entamoeba invadens
QRSHTPAMTERSPSPSPRGERKKTTFTGLFKKKDPK

SEQ ID NO: 2772268 - protein, 7 aa, Entamoeba invadens
QRSKDVS

SEQ ID NO: 2772269 - protein, 7 aa, Entamoeba invadens
QRSKEQE

SEQ ID NO: 2772270 - protein, 5 aa, Entamoeba invadens
QRSQK

SEQ ID NO: 2772271 - protein, 10 aa, Entamoeba invadens
QRSSPMQTAG

SEQ ID NO: 2772272 - protein, 21 aa, Entamoeba invadens
QRSTIETCSGVPADRVKRRYD

SEQ ID NO: 2772273 - protein, 4 aa, Entamoeba invadens
QRSV

SEQ ID NO: 2772274 - protein, 5 aa, Entamoeba invadens
QRSVD

SEQ ID NO: 2772275 - protein, 8 aa, Entamoeba invadens
QRTETKYA

SEQ ID NO: 2772276 - protein, 6 aa, Entamoeba invadens
QRTKKF

SEQ ID NO: 2772277 - protein, 8 aa, Entamoeba invadens
QRTYQQTQ

SEQ ID NO: 2772278 - protein, 7 aa, Entamoeba invadens
QRVGESG

SEQ ID NO: 2772279 - protein, 6 aa, Entamoeba invadens
QRVSPI

SEQ ID NO: 2772280 - protein, 4 aa, Entamoeba invadens
QRYV

SEQ ID NO: 2772281 - protein, 11 aa, Entamoeba invadens
QSAGIKSSQVN

SEQ ID NO: 2772282 - protein, 5 aa, Entamoeba invadens
QSALE

SEQ ID NO: 2772283 - protein, 7 aa, Entamoeba invadens
QSANDVR

SEQ ID NO: 2772284 - protein, 5 aa, Entamoeba invadens
QSATV

SEQ ID NO: 2772285 - protein, 8 aa, Entamoeba invadens
QSCERCDD

SEQ ID NO: 2772286 - protein, 9 aa, Entamoeba invadens
QSCETYNKN

SEQ ID NO: 2772287 - protein, 5 aa, Entamoeba invadens
QSCGN

SEQ ID NO: 2772288 - protein, 11 aa, Entamoeba invadens
QSCSDANVRRD

SEQ ID NO: 2772289 - protein, 34 aa, Entamoeba invadens
QSDDETYSYLPDSQTGHCKSNKKVEQKKGSKGGI

SEQ ID NO: 2772290 - protein, 28 aa, Entamoeba invadens
QSDDGSKGECYTKHEESPLGKGEETTLI

SEQ ID NO: 2772291 - protein, 35 aa, Entamoeba invadens
QSDDKEEIQLEDGDQTQIEAEEETENKVKDSSLTD

SEQ ID NO: 2772292 - protein, 6 aa, Entamoeba invadens
QSDEKT

SEQ ID NO: 2772293 - protein, 77 aa, Entamoeba invadens
QSDEYQKQTFEKEEPKEETTEEPLYDKNENMKSTKFRRNENKSKKKSKKEKNKNNKQKKQNNLQKLTKTTTSVAEEI

SEQ ID NO: 2772294 - protein, 19 aa, Entamoeba invadens
QSDGSCKLESEKTCNKNTE

SEQ ID NO: 2772295 - protein, 6 aa, Entamoeba invadens
QSDHKP

SEQ ID NO: 2772296 - protein, 4 aa, Entamoeba invadens
QSDI

SEQ ID NO: 2772297 - protein, 6 aa, Entamoeba invadens
QSDLNT

SEQ ID NO: 2772298 - protein, 7 aa, Entamoeba invadens
QSDLSGF

SEQ ID NO: 2772299 - protein, 4 aa, Entamoeba invadens
QSDM

SEQ ID NO: 2772300 - protein, 8 aa, Entamoeba invadens
QSDSYQSS

SEQ ID NO: 2772301 - protein, 8 aa, Entamoeba invadens
QSDTNNAT

SEQ ID NO: 2772302 - protein, 6 aa, Entamoeba invadens
QSDTNY

SEQ ID NO: 2772303 - protein, 7 aa, Entamoeba invadens
QSEATRP

SEQ ID NO: 2772304 - protein, 5 aa, Entamoeba invadens
QSEEM

SEQ ID NO: 2772305 - protein, 5 aa, Entamoeba invadens
QSEHC

SEQ ID NO: 2772306 - protein, 4 aa, Entamoeba invadens
QSEL

SEQ ID NO: 2772307 - protein, 5 aa, Entamoeba invadens
QSELN

SEQ ID NO: 2772308 - protein, 7 aa, Entamoeba invadens
QSEMGEE

SEQ ID NO: 2772309 - protein, 15 aa, Entamoeba invadens
QSESNKLCSSNTTLS

SEQ ID NO: 2772310 - protein, 6 aa, Entamoeba invadens
QSESTM

SEQ ID NO: 2772311 - protein, 13 aa, Entamoeba invadens
QSETLGENPPDIS

SEQ ID NO: 2772312 - protein, 15 aa, Entamoeba invadens
QSETQQTLDTANTKM

SEQ ID NO: 2772313 - protein, 15 aa, Entamoeba invadens
QSETQQTLDTTNTKM

SEQ ID NO: 2772314 - protein, 5 aa, Entamoeba invadens
QSEYD

SEQ ID NO: 2772315 - protein, 14 aa, Entamoeba invadens
QSEYQTSYSANKNY

SEQ ID NO: 2772316 - protein, 10 aa, Entamoeba invadens
QSFGNGDSAI

SEQ ID NO: 2772317 - protein, 9 aa, Entamoeba invadens
QSFTDGEIM

SEQ ID NO: 2772318 - protein, 5 aa, Entamoeba invadens
QSFTS

SEQ ID NO: 2772319 - protein, 7 aa, Entamoeba invadens
QSGCADE

SEQ ID NO: 2772320 - protein, 6 aa, Entamoeba invadens
QSGCAE

SEQ ID NO: 2772321 - protein, 12 aa, Entamoeba invadens
QSGCKECANTQN

SEQ ID NO: 2772322 - protein, 8 aa, Entamoeba invadens
QSGCPDEL

SEQ ID NO: 2772323 - protein, 7 aa, Entamoeba invadens
QSGCPEE

SEQ ID NO: 2772324 - protein, 6 aa, Entamoeba invadens
QSGCSE

SEQ ID NO: 2772325 - protein, 7 aa, Entamoeba invadens
QSGDKSP

SEQ ID NO: 2772326 - protein, 11 aa, Entamoeba invadens
QSGECKEPPTF

SEQ ID NO: 2772327 - protein, 5 aa, Entamoeba invadens
QSGLT

SEQ ID NO: 2772328 - protein, 9 aa, Entamoeba invadens
QSGNEQEGI

SEQ ID NO: 2772329 - protein, 6 aa, Entamoeba invadens
QSGNGD

SEQ ID NO: 2772330 - protein, 17 aa, Entamoeba invadens
QSGSNINCGSSLSGGDN

SEQ ID NO: 2772331 - protein, 9 aa, Entamoeba invadens
QSGSSTLPN

SEQ ID NO: 2772332 - protein, 9 aa, Entamoeba invadens
QSGTLSPGV

SEQ ID NO: 2772333 - protein, 10 aa, Entamoeba invadens
QSGTNNFNDR

SEQ ID NO: 2772334 - protein, 15 aa, Entamoeba invadens
QSGYSKSENGRCEKT

SEQ ID NO: 2772335 - protein, 5 aa, Entamoeba invadens
QSHED

SEQ ID NO: 2772336 - protein, 6 aa, Entamoeba invadens
QSHLQR

SEQ ID NO: 2772337 - protein, 4 aa, Entamoeba invadens
QSIE

SEQ ID NO: 2772338 - protein, 6 aa, Entamoeba invadens
QSIENE

SEQ ID NO: 2772339 - protein, 9 aa, Entamoeba invadens
QSIGTPTYM

SEQ ID NO: 2772340 - protein, 6 aa, Entamoeba invadens
QSIGYS

SEQ ID NO: 2772341 - protein, 7 aa, Entamoeba invadens
QSINSNV

SEQ ID NO: 2772342 - protein, 9 aa, Entamoeba invadens
QSITKNFSR

SEQ ID NO: 2772343 - protein, 25 aa, Entamoeba invadens
QSKEIKEKSDLALQDQSHKTDTNAF

SEQ ID NO: 2772344 - protein, 5 aa, Entamoeba invadens
QSKHN

SEQ ID NO: 2772345 - protein, 12 aa, Entamoeba invadens
QSKTERGDFENV

SEQ ID NO: 2772346 - protein, 8 aa, Entamoeba invadens
QSKTVGTN

SEQ ID NO: 2772347 - protein, 7 aa, Entamoeba invadens
QSKVDEE

SEQ ID NO: 2772348 - protein, 8 aa, Entamoeba invadens
QSKYSEKA

SEQ ID NO: 2772349 - protein, 9 aa, Entamoeba invadens
QSKYSEKAD

SEQ ID NO: 2772350 - protein, 47 aa, Entamoeba invadens
QSLEEEADQDDVDQKVKESMTLKDNKVEDSPLSDDIKNVNEENDEKV

SEQ ID NO: 2772351 - protein, 19 aa, Entamoeba invadens
QSLEEEADQDEVDQKMKNS

SEQ ID NO: 2772352 - protein, 7 aa, Entamoeba invadens
QSLGEEA

SEQ ID NO: 2772353 - protein, 9 aa, Entamoeba invadens
QSLGQEKEF

SEQ ID NO: 2772354 - protein, 9 aa, Entamoeba invadens
QSLKKKRNI

SEQ ID NO: 2772355 - protein, 8 aa, Entamoeba invadens
QSLKPSQT

SEQ ID NO: 2772356 - protein, 4 aa, Entamoeba invadens
QSLQ

SEQ ID NO: 2772357 - protein, 15 aa, Entamoeba invadens
QSLQRTGRAGREAPG

SEQ ID NO: 2772358 - protein, 15 aa, Entamoeba invadens
QSMEDETDQETVEND

SEQ ID NO: 2772359 - protein, 15 aa, Entamoeba invadens
QSMEEEVDQDQVEED

SEQ ID NO: 2772360 - protein, 15 aa, Entamoeba invadens
QSMEEEVDQETVEQD

SEQ ID NO: 2772361 - protein, 9 aa, Entamoeba invadens
QSMPTYGTD

SEQ ID NO: 2772362 - protein, 6 aa, Entamoeba invadens
QSMSSD

SEQ ID NO: 2772363 - protein, 11 aa, Entamoeba invadens
QSNDIENIQEK

SEQ ID NO: 2772364 - protein, 10 aa, Entamoeba invadens
QSNDTSCHYP

SEQ ID NO: 2772365 - protein, 7 aa, Entamoeba invadens
QSNEGSI

SEQ ID NO: 2772366 - protein, 10 aa, Entamoeba invadens
QSNESKMCEP

SEQ ID NO: 2772367 - protein, 7 aa, Entamoeba invadens
QSNGGST

SEQ ID NO: 2772368 - protein, 5 aa, Entamoeba invadens
QSNGM

SEQ ID NO: 2772369 - protein, 7 aa, Entamoeba invadens
QSNKNEL

SEQ ID NO: 2772370 - protein, 5 aa, Entamoeba invadens
QSNNE

SEQ ID NO: 2772371 - protein, 7 aa, Entamoeba invadens
QSNNNNC

SEQ ID NO: 2772372 - protein, 4 aa, Entamoeba invadens
QSNT

SEQ ID NO: 2772373 - protein, 5 aa, Entamoeba invadens
QSNTT

SEQ ID NO: 2772374 - protein, 7 aa, Entamoeba invadens
QSNYSFP

SEQ ID NO: 2772375 - protein, 8 aa, Entamoeba invadens
QSPAAMHG

SEQ ID NO: 2772376 - protein, 6 aa, Entamoeba invadens
QSPEQT

SEQ ID NO: 2772377 - protein, 5 aa, Entamoeba invadens
QSPHE

SEQ ID NO: 2772378 - protein, 8 aa, Entamoeba invadens
QSPIGQGS

SEQ ID NO: 2772379 - protein, 4 aa, Entamoeba invadens
QSPK

SEQ ID NO: 2772380 - protein, 10 aa, Entamoeba invadens
QSPKERITSQ

SEQ ID NO: 2772381 - protein, 9 aa, Entamoeba invadens
QSPPSTSQS

SEQ ID NO: 2772382 - protein, 7 aa, Entamoeba invadens
QSPQIKR

SEQ ID NO: 2772383 - protein, 9 aa, Entamoeba invadens
QSPSELAPY

SEQ ID NO: 2772384 - protein, 7 aa, Entamoeba invadens
QSPTERL

SEQ ID NO: 2772385 - protein, 5 aa, Entamoeba invadens
QSQCT

SEQ ID NO: 2772386 - protein, 5 aa, Entamoeba invadens
QSQEE

SEQ ID NO: 2772387 - protein, 17 aa, Entamoeba invadens
QSQHGNAETFQENSNYG

SEQ ID NO: 2772388 - protein, 17 aa, Entamoeba invadens
QSQHGSAETFQENSNYG

SEQ ID NO: 2772389 - protein, 7 aa, Entamoeba invadens
QSQLSTR

SEQ ID NO: 2772390 - protein, 5 aa, Entamoeba invadens
QSQND

SEQ ID NO: 2772391 - protein, 8 aa, Entamoeba invadens
QSQSPDEI

SEQ ID NO: 2772392 - protein, 13 aa, Entamoeba invadens
QSQTTDLGTGGIT

SEQ ID NO: 2772393 - protein, 7 aa, Entamoeba invadens
QSRAVPD

SEQ ID NO: 2772394 - protein, 9 aa, Entamoeba invadens
QSREKEDTK

SEQ ID NO: 2772395 - protein, 9 aa, Entamoeba invadens
QSRGEACED

SEQ ID NO: 2772396 - protein, 11 aa, Entamoeba invadens
QSRQWKTESVR

SEQ ID NO: 2772397 - protein, 7 aa, Entamoeba invadens
QSRRENI

SEQ ID NO: 2772398 - protein, 6 aa, Entamoeba invadens
QSRSNP

SEQ ID NO: 2772399 - protein, 10 aa, Entamoeba invadens
QSRVNTNEGV

SEQ ID NO: 2772400 - protein, 6 aa, Entamoeba invadens
QSSDEV

SEQ ID NO: 2772401 - protein, 4 aa, Entamoeba invadens
QSSE

SEQ ID NO: 2772402 - protein, 7 aa, Entamoeba invadens
QSSENEE

SEQ ID NO: 2772403 - protein, 4 aa, Entamoeba invadens
QSSG

SEQ ID NO: 2772404 - protein, 4 aa, Entamoeba invadens
QSSI

SEQ ID NO: 2772405 - protein, 9 aa, Entamoeba invadens
QSSIENSKL

SEQ ID NO: 2772406 - protein, 5 aa, Entamoeba invadens
QSSIN

SEQ ID NO: 2772407 - protein, 8 aa, Entamoeba invadens
QSSIPSAD

SEQ ID NO: 2772408 - protein, 6 aa, Entamoeba invadens
QSSLGQ

SEQ ID NO: 2772409 - protein, 11 aa, Entamoeba invadens
QSSLLTPKEDI

SEQ ID NO: 2772410 - protein, 8 aa, Entamoeba invadens
QSSLSTEE

SEQ ID NO: 2772411 - protein, 5 aa, Entamoeba invadens
QSSMT

SEQ ID NO: 2772412 - protein, 10 aa, Entamoeba invadens
QSSNENNSEI

SEQ ID NO: 2772413 - protein, 9 aa, Entamoeba invadens
QSSNKEYAI

SEQ ID NO: 2772414 - protein, 9 aa, Entamoeba invadens
QSSNTNGSC

SEQ ID NO: 2772415 - protein, 6 aa, Entamoeba invadens
QSSPNP

SEQ ID NO: 2772416 - protein, 7 aa, Entamoeba invadens
QSSPNPY

SEQ ID NO: 2772417 - protein, 8 aa, Entamoeba invadens
QSSRERCD

SEQ ID NO: 2772418 - protein, 9 aa, Entamoeba invadens
QSSSEVQAA

SEQ ID NO: 2772419 - protein, 20 aa, Entamoeba invadens
QSSSLPSSASVSRNSIASSE

SEQ ID NO: 2772420 - protein, 11 aa, Entamoeba invadens
QSSSNAEISDR

SEQ ID NO: 2772421 - protein, 9 aa, Entamoeba invadens
QSSSPEKTS

SEQ ID NO: 2772422 - protein, 7 aa, Entamoeba invadens
QSSSQLD

SEQ ID NO: 2772423 - protein, 10 aa, Entamoeba invadens
QSSSSNRDDF

SEQ ID NO: 2772424 - protein, 8 aa, Entamoeba invadens
QSSSSSCE

SEQ ID NO: 2772425 - protein, 8 aa, Entamoeba invadens
QSSTRTLS

SEQ ID NO: 2772426 - protein, 8 aa, Entamoeba invadens
QSSTTCKT

SEQ ID NO: 2772427 - protein, 5 aa, Entamoeba invadens
QSTAT

SEQ ID NO: 2772428 - protein, 6 aa, Entamoeba invadens
QSTEEL

SEQ ID NO: 2772429 - protein, 10 aa, Entamoeba invadens
QSTFNTTSST

SEQ ID NO: 2772430 - protein, 9 aa, Entamoeba invadens
QSTHDKEAS

SEQ ID NO: 2772431 - protein, 5 aa, Entamoeba invadens
QSTKE

SEQ ID NO: 2772432 - protein, 9 aa, Entamoeba invadens
QSTKEPCKN

SEQ ID NO: 2772433 - protein, 8 aa, Entamoeba invadens
QSTKQLQA

SEQ ID NO: 2772434 - protein, 4 aa, Entamoeba invadens
QSTL

SEQ ID NO: 2772435 - protein, 6 aa, Entamoeba invadens
QSTLKR

SEQ ID NO: 2772436 - protein, 12 aa, Entamoeba invadens
QSTLQESKSPID

SEQ ID NO: 2772437 - protein, 6 aa, Entamoeba invadens
QSTLST

SEQ ID NO: 2772438 - protein, 11 aa, Entamoeba invadens
QSTMKQDDVEM

SEQ ID NO: 2772439 - protein, 8 aa, Entamoeba invadens
QSTMTTKS

SEQ ID NO: 2772440 - protein, 11 aa, Entamoeba invadens
QSTNEKRMSAG

SEQ ID NO: 2772441 - protein, 5 aa, Entamoeba invadens
QSTPN

SEQ ID NO: 2772442 - protein, 9 aa, Entamoeba invadens
QSTREKGEI

SEQ ID NO: 2772443 - protein, 10 aa, Entamoeba invadens
QSTRRTKITG

SEQ ID NO: 2772444 - protein, 5 aa, Entamoeba invadens
QSTRS

SEQ ID NO: 2772445 - protein, 8 aa, Entamoeba invadens
QSTSELQK

SEQ ID NO: 2772446 - protein, 22 aa, Entamoeba invadens
QSTSLKTIDSTSALVDPNPVNN

SEQ ID NO: 2772447 - protein, 5 aa, Entamoeba invadens
QSTST

SEQ ID NO: 2772448 - protein, 10 aa, Entamoeba invadens
QSTTFGKQTK

SEQ ID NO: 2772449 - protein, 18 aa, Entamoeba invadens
QSTTPSHKFPKNTVKTTK

SEQ ID NO: 2772450 - protein, 6 aa, Entamoeba invadens
QSTTTT

SEQ ID NO: 2772451 - protein, 15 aa, Entamoeba invadens
QSVATECSKGCSSGC

SEQ ID NO: 2772452 - protein, 11 aa, Entamoeba invadens
QSVSKIGNNSF

SEQ ID NO: 2772453 - protein, 8 aa, Entamoeba invadens
QSVSPKIS

SEQ ID NO: 2772454 - protein, 4 aa, Entamoeba invadens
QSVT

SEQ ID NO: 2772455 - protein, 7 aa, Entamoeba invadens
QSVTNNN

SEQ ID NO: 2772456 - protein, 6 aa, Entamoeba invadens
QSYGEN

SEQ ID NO: 2772457 - protein, 7 aa, Entamoeba invadens
QSYPNQY

SEQ ID NO: 2772458 - protein, 5 aa, Entamoeba invadens
QSYSI

SEQ ID NO: 2772459 - protein, 9 aa, Entamoeba invadens
QSYTCTDAP

SEQ ID NO: 2772460 - protein, 13 aa, Entamoeba invadens
QTADKETSSTASN

SEQ ID NO: 2772461 - protein, 9 aa, Entamoeba invadens
QTAEECSKK

SEQ ID NO: 2772462 - protein, 6 aa, Entamoeba invadens
QTAGSL

SEQ ID NO: 2772463 - protein, 9 aa, Entamoeba invadens
QTAGSNGLS

SEQ ID NO: 2772464 - protein, 10 aa, Entamoeba invadens
QTAKTGTKCF

SEQ ID NO: 2772465 - protein, 5 aa, Entamoeba invadens
QTAQG

SEQ ID NO: 2772466 - protein, 4 aa, Entamoeba invadens
QTAR

SEQ ID NO: 2772467 - protein, 10 aa, Entamoeba invadens
QTASSQISIN

SEQ ID NO: 2772468 - protein, 6 aa, Entamoeba invadens
QTATGS

SEQ ID NO: 2772469 - protein, 8 aa, Entamoeba invadens
QTATSVDR

SEQ ID NO: 2772470 - protein, 10 aa, Entamoeba invadens
QTCATDGTRS

SEQ ID NO: 2772471 - protein, 14 aa, Entamoeba invadens
QTCATDGTRSCSQC

SEQ ID NO: 2772472 - protein, 11 aa, Entamoeba invadens
QTCDSSNSESC

SEQ ID NO: 2772473 - protein, 17 aa, Entamoeba invadens
QTCDSTCNKQCDKVTGA

SEQ ID NO: 2772474 - protein, 10 aa, Entamoeba invadens
QTCQAKNSNC

SEQ ID NO: 2772475 - protein, 7 aa, Entamoeba invadens
QTCSNDG

SEQ ID NO: 2772476 - protein, 9 aa, Entamoeba invadens
QTCSTQSVG

SEQ ID NO: 2772477 - protein, 11 aa, Entamoeba invadens
QTCTSQRCTKC

SEQ ID NO: 2772478 - protein, 9 aa, Entamoeba invadens
QTCTTNPTT

SEQ ID NO: 2772479 - protein, 10 aa, Entamoeba invadens
QTCVSKSSQC

SEQ ID NO: 2772480 - protein, 11 aa, Entamoeba invadens
QTCVSTQQTMN

SEQ ID NO: 2772481 - protein, 6 aa, Entamoeba invadens
QTCYSN

SEQ ID NO: 2772482 - protein, 10 aa, Entamoeba invadens
QTDAASSTHL

SEQ ID NO: 2772483 - protein, 10 aa, Entamoeba invadens
QTDAKNVEDK

SEQ ID NO: 2772484 - protein, 11 aa, Entamoeba invadens
QTDGKVPPEEE

SEQ ID NO: 2772485 - protein, 9 aa, Entamoeba invadens
QTDGLDPES

SEQ ID NO: 2772486 - protein, 9 aa, Entamoeba invadens
QTDKNHVKG

SEQ ID NO: 2772487 - protein, 9 aa, Entamoeba invadens
QTDKNHVRG

SEQ ID NO: 2772488 - protein, 8 aa, Entamoeba invadens
QTDKSHIR

SEQ ID NO: 2772489 - protein, 14 aa, Entamoeba invadens
QTDKVGSEYTEQNL

SEQ ID NO: 2772490 - protein, 4 aa, Entamoeba invadens
QTDN

SEQ ID NO: 2772491 - protein, 9 aa, Entamoeba invadens
QTDNSKQPF

SEQ ID NO: 2772492 - protein, 9 aa, Entamoeba invadens
QTDSYINGS

SEQ ID NO: 2772493 - protein, 4 aa, Entamoeba invadens
QTDY

SEQ ID NO: 2772494 - protein, 49 aa, Entamoeba invadens
QTEAEQQENNEDNYDEKNEVNEENVKKNDDKETLNQEKLKEKIENEKED

SEQ ID NO: 2772495 - protein, 12 aa, Entamoeba invadens
QTEDTRKSMKTD

SEQ ID NO: 2772496 - protein, 5 aa, Entamoeba invadens
QTEFS

SEQ ID NO: 2772497 - protein, 8 aa, Entamoeba invadens
QTEGKYPY

SEQ ID NO: 2772498 - protein, 6 aa, Entamoeba invadens
QTEIED

SEQ ID NO: 2772499 - protein, 20 aa, Entamoeba invadens
QTEIKGAVGGPTKIDTDGTN

SEQ ID NO: 2772500 - protein, 8 aa, Entamoeba invadens
QTEISSRL

SEQ ID NO: 2772501 - protein, 13 aa, Entamoeba invadens
QTELKNKNEELEN

SEQ ID NO: 2772502 - protein, 6 aa, Entamoeba invadens
QTENLN

SEQ ID NO: 2772503 - protein, 8 aa, Entamoeba invadens
QTENPVEI

SEQ ID NO: 2772504 - protein, 4 aa, Entamoeba invadens
QTEP

SEQ ID NO: 2772505 - protein, 19 aa, Entamoeba invadens
QTEPTEDEGISSSSDDEIK

SEQ ID NO: 2772506 - protein, 7 aa, Entamoeba invadens
QTESCEH

SEQ ID NO: 2772507 - protein, 9 aa, Entamoeba invadens
QTESEQKTM

SEQ ID NO: 2772508 - protein, 5 aa, Entamoeba invadens
QTESK

SEQ ID NO: 2772509 - protein, 4 aa, Entamoeba invadens
QTET

SEQ ID NO: 2772510 - protein, 7 aa, Entamoeba invadens
QTETGSE

SEQ ID NO: 2772511 - protein, 13 aa, Entamoeba invadens
QTETKGESDENDP

SEQ ID NO: 2772512 - protein, 8 aa, Entamoeba invadens
QTETNPDL

SEQ ID NO: 2772513 - protein, 16 aa, Entamoeba invadens
QTETVKPGTRRKQKSN

SEQ ID NO: 2772514 - protein, 11 aa, Entamoeba invadens
QTEVKEKDESM

SEQ ID NO: 2772515 - protein, 6 aa, Entamoeba invadens
QTEYPV

SEQ ID NO: 2772516 - protein, 10 aa, Entamoeba invadens
QTFEKEENMN

SEQ ID NO: 2772517 - protein, 13 aa, Entamoeba invadens
QTFVESPDTNRKE

SEQ ID NO: 2772518 - protein, 5 aa, Entamoeba invadens
QTGAN

SEQ ID NO: 2772519 - protein, 14 aa, Entamoeba invadens
QTGGPIKEKPTNTN

SEQ ID NO: 2772520 - protein, 7 aa, Entamoeba invadens
QTGIDEK

SEQ ID NO: 2772521 - protein, 4 aa, Entamoeba invadens
QTGK

SEQ ID NO: 2772522 - protein, 8 aa, Entamoeba invadens
QTGVSSQI

SEQ ID NO: 2772523 - protein, 15 aa, Entamoeba invadens
QTHKTLNTTKPKKED

SEQ ID NO: 2772524 - protein, 7 aa, Entamoeba invadens
QTHRREK

SEQ ID NO: 2772525 - protein, 20 aa, Entamoeba invadens
QTIEEKVDQDNAHKNVEPGT

SEQ ID NO: 2772526 - protein, 5 aa, Entamoeba invadens
QTINK

SEQ ID NO: 2772527 - protein, 5 aa, Entamoeba invadens
QTIRG

SEQ ID NO: 2772528 - protein, 7 aa, Entamoeba invadens
QTITRSM

SEQ ID NO: 2772529 - protein, 10 aa, Entamoeba invadens
QTKAKCTKCK

SEQ ID NO: 2772530 - protein, 8 aa, Entamoeba invadens
QTKDGYYI

SEQ ID NO: 2772531 - protein, 8 aa, Entamoeba invadens
QTKEEEKH

SEQ ID NO: 2772532 - protein, 5 aa, Entamoeba invadens
QTKGD

SEQ ID NO: 2772533 - protein, 8 aa, Entamoeba invadens
QTKIPPKV

SEQ ID NO: 2772534 - protein, 9 aa, Entamoeba invadens
QTKKAKLTE

SEQ ID NO: 2772535 - protein, 10 aa, Entamoeba invadens
QTKKSYEIGN

SEQ ID NO: 2772536 - protein, 9 aa, Entamoeba invadens
QTKNPSLGV

SEQ ID NO: 2772537 - protein, 6 aa, Entamoeba invadens
QTKPPK

SEQ ID NO: 2772538 - protein, 13 aa, Entamoeba invadens
QTKPYKTDQFKTP

SEQ ID NO: 2772539 - protein, 7 aa, Entamoeba invadens
QTKQEDS

SEQ ID NO: 2772540 - protein, 6 aa, Entamoeba invadens
QTKRNV

SEQ ID NO: 2772541 - protein, 13 aa, Entamoeba invadens
QTKSKEVKAESVK

SEQ ID NO: 2772542 - protein, 9 aa, Entamoeba invadens
QTKSLDNTN

SEQ ID NO: 2772543 - protein, 4 aa, Entamoeba invadens
QTKT

SEQ ID NO: 2772544 - protein, 11 aa, Entamoeba invadens
QTKTKIDRITN

SEQ ID NO: 2772545 - protein, 4 aa, Entamoeba invadens
QTLA

SEQ ID NO: 2772546 - protein, 4 aa, Entamoeba invadens
QTLD

SEQ ID NO: 2772547 - protein, 14 aa, Entamoeba invadens
QTLDQTVTKVNENV

SEQ ID NO: 2772548 - protein, 14 aa, Entamoeba invadens
QTLEDPNDGTSCNS

SEQ ID NO: 2772549 - protein, 6 aa, Entamoeba invadens
QTLEYS

SEQ ID NO: 2772550 - protein, 4 aa, Entamoeba invadens
QTLN

SEQ ID NO: 2772551 - protein, 5 aa, Entamoeba invadens
QTLPQ

SEQ ID NO: 2772552 - protein, 7 aa, Entamoeba invadens
QTLQKKT

SEQ ID NO: 2772553 - protein, 6 aa, Entamoeba invadens
QTLSNK

SEQ ID NO: 2772554 - protein, 20 aa, Entamoeba invadens
QTLTSSFQTRKYNTKEGLDD

SEQ ID NO: 2772555 - protein, 6 aa, Entamoeba invadens
QTMNEG

SEQ ID NO: 2772556 - protein, 6 aa, Entamoeba invadens
QTMTSE

SEQ ID NO: 2772557 - protein, 5 aa, Entamoeba invadens
QTNAL

SEQ ID NO: 2772558 - protein, 7 aa, Entamoeba invadens
QTNAQHY

SEQ ID NO: 2772559 - protein, 5 aa, Entamoeba invadens
QTNKT

SEQ ID NO: 2772560 - protein, 5 aa, Entamoeba invadens
QTNNA

SEQ ID NO: 2772561 - protein, 11 aa, Entamoeba invadens
QTNPYQSSQPM

SEQ ID NO: 2772562 - protein, 5 aa, Entamoeba invadens
QTNSL

SEQ ID NO: 2772563 - protein, 8 aa, Entamoeba invadens
QTNTCEQC

SEQ ID NO: 2772564 - protein, 7 aa, Entamoeba invadens
QTNTLNY

SEQ ID NO: 2772565 - protein, 5 aa, Entamoeba invadens
QTNTN

SEQ ID NO: 2772566 - protein, 4 aa, Entamoeba invadens
QTNY

SEQ ID NO: 2772567 - protein, 10 aa, Entamoeba invadens
QTNYTANTNY

SEQ ID NO: 2772568 - protein, 7 aa, Entamoeba invadens
QTNYTTS

SEQ ID NO: 2772569 - protein, 14 aa, Entamoeba invadens
QTPDVDKSGKKIEK

SEQ ID NO: 2772570 - protein, 4 aa, Entamoeba invadens
QTPE

SEQ ID NO: 2772571 - protein, 6 aa, Entamoeba invadens
QTPETV

SEQ ID NO: 2772572 - protein, 4 aa, Entamoeba invadens
QTPK

SEQ ID NO: 2772573 - protein, 8 aa, Entamoeba invadens
QTPKEDLS

SEQ ID NO: 2772574 - protein, 9 aa, Entamoeba invadens
QTPLPTGGG

SEQ ID NO: 2772575 - protein, 4 aa, Entamoeba invadens
QTPP

SEQ ID NO: 2772576 - protein, 12 aa, Entamoeba invadens
QTPPNGIDVKIE

SEQ ID NO: 2772577 - protein, 8 aa, Entamoeba invadens
QTPPQQYQ

SEQ ID NO: 2772578 - protein, 10 aa, Entamoeba invadens
QTPQHRKYGD

SEQ ID NO: 2772579 - protein, 8 aa, Entamoeba invadens
QTPQPDPF

SEQ ID NO: 2772580 - protein, 5 aa, Entamoeba invadens
QTPQS

SEQ ID NO: 2772581 - protein, 5 aa, Entamoeba invadens
QTPSL

SEQ ID NO: 2772582 - protein, 5 aa, Entamoeba invadens
QTPTC

SEQ ID NO: 2772583 - protein, 5 aa, Entamoeba invadens
QTPTV

SEQ ID NO: 2772584 - protein, 8 aa, Entamoeba invadens
QTQCEPGY

SEQ ID NO: 2772585 - protein, 6 aa, Entamoeba invadens
QTQDIR

SEQ ID NO: 2772586 - protein, 10 aa, Entamoeba invadens
QTQEESLPYY

SEQ ID NO: 2772587 - protein, 6 aa, Entamoeba invadens
QTQETP

SEQ ID NO: 2772588 - protein, 12 aa, Entamoeba invadens
QTQKRQINEKED

SEQ ID NO: 2772589 - protein, 23 aa, Entamoeba invadens
QTQNSAAEETENEEKKPENTTPP

SEQ ID NO: 2772590 - protein, 7 aa, Entamoeba invadens
QTQQDSL

SEQ ID NO: 2772591 - protein, 9 aa, Entamoeba invadens
QTQQSSIID

SEQ ID NO: 2772592 - protein, 10 aa, Entamoeba invadens
QTQSISDVSN

SEQ ID NO: 2772593 - protein, 6 aa, Entamoeba invadens
QTQVEE

SEQ ID NO: 2772594 - protein, 7 aa, Entamoeba invadens
QTRCSEC

SEQ ID NO: 2772595 - protein, 6 aa, Entamoeba invadens
QTRNNS

SEQ ID NO: 2772596 - protein, 11 aa, Entamoeba invadens
QTRQLQQRKTT

SEQ ID NO: 2772597 - protein, 10 aa, Entamoeba invadens
QTRYKTPADV

SEQ ID NO: 2772598 - protein, 13 aa, Entamoeba invadens
QTSAQIDLNTNEA

SEQ ID NO: 2772599 - protein, 5 aa, Entamoeba invadens
QTSAV

SEQ ID NO: 2772600 - protein, 9 aa, Entamoeba invadens
QTSAVNSTH

SEQ ID NO: 2772601 - protein, 10 aa, Entamoeba invadens
QTSCEECSSG

SEQ ID NO: 2772602 - protein, 9 aa, Entamoeba invadens
QTSDNNCTL

SEQ ID NO: 2772603 - protein, 7 aa, Entamoeba invadens
QTSEERG

SEQ ID NO: 2772604 - protein, 5 aa, Entamoeba invadens
QTSEG

SEQ ID NO: 2772605 - protein, 6 aa, Entamoeba invadens
QTSKEC

SEQ ID NO: 2772606 - protein, 11 aa, Entamoeba invadens
QTSLEVGGQTK

SEQ ID NO: 2772607 - protein, 18 aa, Entamoeba invadens
QTSLSCASGTYKKTETSC

SEQ ID NO: 2772608 - protein, 11 aa, Entamoeba invadens
QTSLYETNKIK

SEQ ID NO: 2772609 - protein, 6 aa, Entamoeba invadens
QTSMTS

SEQ ID NO: 2772610 - protein, 7 aa, Entamoeba invadens
QTSNERL

SEQ ID NO: 2772611 - protein, 8 aa, Entamoeba invadens
QTSPFNKG

SEQ ID NO: 2772612 - protein, 5 aa, Entamoeba invadens
QTSPM

SEQ ID NO: 2772613 - protein, 8 aa, Entamoeba invadens
QTSPSRGI

SEQ ID NO: 2772614 - protein, 5 aa, Entamoeba invadens
QTSPV

SEQ ID NO: 2772615 - protein, 6 aa, Entamoeba invadens
QTSPWT

SEQ ID NO: 2772616 - protein, 6 aa, Entamoeba invadens
QTSPYT

SEQ ID NO: 2772617 - protein, 7 aa, Entamoeba invadens
QTSSDEN

SEQ ID NO: 2772618 - protein, 8 aa, Entamoeba invadens
QTSSEASG

SEQ ID NO: 2772619 - protein, 6 aa, Entamoeba invadens
QTSSSK

SEQ ID NO: 2772620 - protein, 9 aa, Entamoeba invadens
QTSTHTKFQ

SEQ ID NO: 2772621 - protein, 4 aa, Entamoeba invadens
QTSV

SEQ ID NO: 2772622 - protein, 9 aa, Entamoeba invadens
QTTAKDNWR

SEQ ID NO: 2772623 - protein, 7 aa, Entamoeba invadens
QTTAQPV

SEQ ID NO: 2772624 - protein, 18 aa, Entamoeba invadens
QTTCEKCKTGYRYNSGKC

SEQ ID NO: 2772625 - protein, 8 aa, Entamoeba invadens
QTTCTQCK

SEQ ID NO: 2772626 - protein, 5 aa, Entamoeba invadens
QTTDQ

SEQ ID NO: 2772627 - protein, 13 aa, Entamoeba invadens
QTTDRNNDEEKGK

SEQ ID NO: 2772628 - protein, 7 aa, Entamoeba invadens
QTTGKNG

SEQ ID NO: 2772629 - protein, 4 aa, Entamoeba invadens
QTTK

SEQ ID NO: 2772630 - protein, 5 aa, Entamoeba invadens
QTTKI

SEQ ID NO: 2772631 - protein, 7 aa, Entamoeba invadens
QTTKSPH

SEQ ID NO: 2772632 - protein, 6 aa, Entamoeba invadens
QTTKTD

SEQ ID NO: 2772633 - protein, 4 aa, Entamoeba invadens
QTTM

SEQ ID NO: 2772634 - protein, 6 aa, Entamoeba invadens
QTTMTG

SEQ ID NO: 2772635 - protein, 19 aa, Entamoeba invadens
QTTNGISETMRGEKTHKFR

SEQ ID NO: 2772636 - protein, 23 aa, Entamoeba invadens
QTTNKTFTSANKQEISKTEVSNC

SEQ ID NO: 2772637 - protein, 12 aa, Entamoeba invadens
QTTNPCGNYTSF

SEQ ID NO: 2772638 - protein, 6 aa, Entamoeba invadens
QTTPIE

SEQ ID NO: 2772639 - protein, 8 aa, Entamoeba invadens
QTTQGETE

SEQ ID NO: 2772640 - protein, 10 aa, Entamoeba invadens
QTTQKSDNSE

SEQ ID NO: 2772641 - protein, 16 aa, Entamoeba invadens
QTTQNYQSGINETDGY

SEQ ID NO: 2772642 - protein, 9 aa, Entamoeba invadens
QTTQPYTQQ

SEQ ID NO: 2772643 - protein, 6 aa, Entamoeba invadens
QTTQRK

SEQ ID NO: 2772644 - protein, 6 aa, Entamoeba invadens
QTTQTT

SEQ ID NO: 2772645 - protein, 10 aa, Entamoeba invadens
QTTSCESCTT

SEQ ID NO: 2772646 - protein, 14 aa, Entamoeba invadens
QTTSQDNPLTKKLP

SEQ ID NO: 2772647 - protein, 8 aa, Entamoeba invadens
QTTTTTEN

SEQ ID NO: 2772648 - protein, 40 aa, Entamoeba invadens
QTTVDDTSEIVSENKTKEEHNDTTIKTDEASGEPSDIENR

SEQ ID NO: 2772649 - protein, 5 aa, Entamoeba invadens
QTTYE

SEQ ID NO: 2772650 - protein, 4 aa, Entamoeba invadens
QTVT

SEQ ID NO: 2772651 - protein, 13 aa, Entamoeba invadens
QTVTGKITHEGKE

SEQ ID NO: 2772652 - protein, 6 aa, Entamoeba invadens
QTYKCK

SEQ ID NO: 2772653 - protein, 7 aa, Entamoeba invadens
QTYKYED

SEQ ID NO: 2772654 - protein, 5 aa, Entamoeba invadens
QTYPN

SEQ ID NO: 2772655 - protein, 12 aa, Entamoeba invadens
QTYRKEEDAKTL

SEQ ID NO: 2772656 - protein, 5 aa, Entamoeba invadens
QTYSL

SEQ ID NO: 2772657 - protein, 6 aa, Entamoeba invadens
QTYSLA

SEQ ID NO: 2772658 - protein, 31 aa, Entamoeba invadens
QVADESDGLISDGKDMKKEDVEEEDNEEGNS

SEQ ID NO: 2772659 - protein, 6 aa, Entamoeba invadens
QVDEER

SEQ ID NO: 2772660 - protein, 13 aa, Entamoeba invadens
QVDGSHEDSLNEF

SEQ ID NO: 2772661 - protein, 10 aa, Entamoeba invadens
QVDNSNGENA

SEQ ID NO: 2772662 - protein, 13 aa, Entamoeba invadens
QVDNSNKENTIEE

SEQ ID NO: 2772663 - protein, 25 aa, Entamoeba invadens
QVDQDEEERRASEIELKDETQNEQL

SEQ ID NO: 2772664 - protein, 30 aa, Entamoeba invadens
QVDSEEKSTETADQEKVSECEENEKTKKPF

SEQ ID NO: 2772665 - protein, 7 aa, Entamoeba invadens
QVDTGER

SEQ ID NO: 2772666 - protein, 4 aa, Entamoeba invadens
QVEK

SEQ ID NO: 2772667 - protein, 23 aa, Entamoeba invadens
QVENSTHLDSDELKEEKKIGEGS

SEQ ID NO: 2772668 - protein, 8 aa, Entamoeba invadens
QVEQGQNL

SEQ ID NO: 2772669 - protein, 6 aa, Entamoeba invadens
QVGEET

SEQ ID NO: 2772670 - protein, 6 aa, Entamoeba invadens
QVGEGG

SEQ ID NO: 2772671 - protein, 6 aa, Entamoeba invadens
QVGPNT

SEQ ID NO: 2772672 - protein, 7 aa, Entamoeba invadens
QVGQHGD

SEQ ID NO: 2772673 - protein, 4 aa, Entamoeba invadens
QVHN

SEQ ID NO: 2772674 - protein, 7 aa, Entamoeba invadens
QVKESSV

SEQ ID NO: 2772675 - protein, 6 aa, Entamoeba invadens
QVKETA

SEQ ID NO: 2772676 - protein, 5 aa, Entamoeba invadens
QVKKK

SEQ ID NO: 2772677 - protein, 10 aa, Entamoeba invadens
QVKKKMQNVR

SEQ ID NO: 2772678 - protein, 5 aa, Entamoeba invadens
QVKKN

SEQ ID NO: 2772679 - protein, 8 aa, Entamoeba invadens
QVKSNDGK

SEQ ID NO: 2772680 - protein, 11 aa, Entamoeba invadens
QVKTDTEISTN

SEQ ID NO: 2772681 - protein, 8 aa, Entamoeba invadens
QVNDEQRP

SEQ ID NO: 2772682 - protein, 11 aa, Entamoeba invadens
QVNNEQCARDG

SEQ ID NO: 2772683 - protein, 6 aa, Entamoeba invadens
QVNRNK

SEQ ID NO: 2772684 - protein, 9 aa, Entamoeba invadens
QVNSPNNYG

SEQ ID NO: 2772685 - protein, 12 aa, Entamoeba invadens
QVPAGTNGGVSS

SEQ ID NO: 2772686 - protein, 5 aa, Entamoeba invadens
QVPES

SEQ ID NO: 2772687 - protein, 8 aa, Entamoeba invadens
QVPKRPSL

SEQ ID NO: 2772688 - protein, 14 aa, Entamoeba invadens
QVPQQAPVKTESHV

SEQ ID NO: 2772689 - protein, 5 aa, Entamoeba invadens
QVQDN

SEQ ID NO: 2772690 - protein, 7 aa, Entamoeba invadens
QVSEPND

SEQ ID NO: 2772691 - protein, 7 aa, Entamoeba invadens
QVSGSTC

SEQ ID NO: 2772692 - protein, 4 aa, Entamoeba invadens
QVSS

SEQ ID NO: 2772693 - protein, 6 aa, Entamoeba invadens
QVTDGV

SEQ ID NO: 2772694 - protein, 5 aa, Entamoeba invadens
QVTDT

SEQ ID NO: 2772695 - protein, 11 aa, Entamoeba invadens
QVTENGENFSL

SEQ ID NO: 2772696 - protein, 5 aa, Entamoeba invadens
QVTGS

SEQ ID NO: 2772697 - protein, 10 aa, Entamoeba invadens
QVTSIGKKSL

SEQ ID NO: 2772698 - protein, 20 aa, Entamoeba invadens
QWEDYGNDTKYKNDCYDPSL

SEQ ID NO: 2772699 - protein, 5 aa, Entamoeba invadens
QWGKT

SEQ ID NO: 2772700 - protein, 6 aa, Entamoeba invadens
QWSGDV

SEQ ID NO: 2772701 - protein, 8 aa, Entamoeba invadens
QWTTSDNA

SEQ ID NO: 2772702 - protein, 9 aa, Entamoeba invadens
QYAECPENT

SEQ ID NO: 2772703 - protein, 37 aa, Entamoeba invadens
QYAQELASSTCDNCGPGTYSNGDNKKSCTKCSAGTYS

SEQ ID NO: 2772704 - protein, 5 aa, Entamoeba invadens
QYASF

SEQ ID NO: 2772705 - protein, 5 aa, Entamoeba invadens
QYDAE

SEQ ID NO: 2772706 - protein, 20 aa, Entamoeba invadens
QYDEGDLNQEEKIQSALESL

SEQ ID NO: 2772707 - protein, 13 aa, Entamoeba invadens
QYDLPEPLQSPNG

SEQ ID NO: 2772708 - protein, 13 aa, Entamoeba invadens
QYDLPEPLQSPNK

SEQ ID NO: 2772709 - protein, 20 aa, Entamoeba invadens
QYELESNNTLVNNKHSQQLS

SEQ ID NO: 2772710 - protein, 6 aa, Entamoeba invadens
QYGGDE

SEQ ID NO: 2772711 - protein, 9 aa, Entamoeba invadens
QYGRNGRYR

SEQ ID NO: 2772712 - protein, 5 aa, Entamoeba invadens
QYGST

SEQ ID NO: 2772713 - protein, 8 aa, Entamoeba invadens
QYGSVSQR

SEQ ID NO: 2772714 - protein, 6 aa, Entamoeba invadens
QYIDST

SEQ ID NO: 2772715 - protein, 13 aa, Entamoeba invadens
QYIQKGRKGSLEV

SEQ ID NO: 2772716 - protein, 4 aa, Entamoeba invadens
QYIR

SEQ ID NO: 2772717 - protein, 11 aa, Entamoeba invadens
QYKAENEKMKQ

SEQ ID NO: 2772718 - protein, 8 aa, Entamoeba invadens
QYKEPPST

SEQ ID NO: 2772719 - protein, 9 aa, Entamoeba invadens
QYKQQKRRT

SEQ ID NO: 2772720 - protein, 14 aa, Entamoeba invadens
QYKTSTSADSFDSD

SEQ ID NO: 2772721 - protein, 4 aa, Entamoeba invadens
QYLS

SEQ ID NO: 2772722 - protein, 5 aa, Entamoeba invadens
QYLSG

SEQ ID NO: 2772723 - protein, 10 aa, Entamoeba invadens
QYNADGTCSS

SEQ ID NO: 2772724 - protein, 6 aa, Entamoeba invadens
QYNPNT

SEQ ID NO: 2772725 - protein, 21 aa, Entamoeba invadens
QYNPPEIPHNENPQQATPNQP

SEQ ID NO: 2772726 - protein, 7 aa, Entamoeba invadens
QYPAKSP

SEQ ID NO: 2772727 - protein, 32 aa, Entamoeba invadens
QYPIQSAQYQGPAYSEYQPPQYQQNYNQSTPI

SEQ ID NO: 2772728 - protein, 4 aa, Entamoeba invadens
QYPP

SEQ ID NO: 2772729 - protein, 11 aa, Entamoeba invadens
QYQGPAYSEYQ

SEQ ID NO: 2772730 - protein, 7 aa, Entamoeba invadens
QYQNTLN

SEQ ID NO: 2772731 - protein, 19 aa, Entamoeba invadens
QYQPPPQYQQQNTQQYQQP

SEQ ID NO: 2772732 - protein, 54 aa, Entamoeba invadens
QYQQEENSYVPQRRGEYPQNPQQYGTSQYQDYSQATYQNYPNVNSRYEVQQEDW

SEQ ID NO: 2772733 - protein, 10 aa, Entamoeba invadens
QYQTNGVDTC

SEQ ID NO: 2772734 - protein, 4 aa, Entamoeba invadens
QYRG

SEQ ID NO: 2772735 - protein, 18 aa, Entamoeba invadens
QYSEQNDDVNEEEAEKMG

SEQ ID NO: 2772736 - protein, 14 aa, Entamoeba invadens
QYSGGKIEVGNESK

SEQ ID NO: 2772737 - protein, 5 aa, Entamoeba invadens
QYSPI

SEQ ID NO: 2772738 - protein, 5 aa, Entamoeba invadens
QYSSL

SEQ ID NO: 2772739 - protein, 10 aa, Entamoeba invadens
QYSTGGTSQC

SEQ ID NO: 2772740 - protein, 9 aa, Entamoeba invadens
QYSTSGSNV

SEQ ID NO: 2772741 - protein, 5 aa, Entamoeba invadens
QYTND

SEQ ID NO: 2772742 - protein, 8 aa, Entamoeba invadens
QYTPPSFD

SEQ ID NO: 2772743 - protein, 7 aa, Entamoeba invadens
QYTPSDD

SEQ ID NO: 2772744 - protein, 9 aa, Entamoeba invadens
QYTRQGIDR

SEQ ID NO: 2772745 - protein, 10 aa, Entamoeba invadens
QYVDSTSKKC

SEQ ID NO: 2772746 - protein, 6 aa, Entamoeba invadens
QYVTKT

SEQ ID NO: 2772747 - protein, 5 aa, Entamoeba invadens
RACPN

SEQ ID NO: 2772748 - protein, 13 aa, Entamoeba invadens
RADAQDSEYIDGD

SEQ ID NO: 2772749 - protein, 7 aa, Entamoeba invadens
RAEAGQD

SEQ ID NO: 2772750 - protein, 9 aa, Entamoeba invadens
RAEDNSCQS

SEQ ID NO: 2772751 - protein, 26 aa, Entamoeba invadens
RAEESENVKEKYHNPPSSWPSTGSVE

SEQ ID NO: 2772752 - protein, 26 aa, Entamoeba invadens
RAEESESVKDKYHNPPPSWPSTGSVE

SEQ ID NO: 2772753 - protein, 7 aa, Entamoeba invadens
RAESAAL

SEQ ID NO: 2772754 - protein, 7 aa, Entamoeba invadens
RAESTKF

SEQ ID NO: 2772755 - protein, 9 aa, Entamoeba invadens
RAEYKPSDE

SEQ ID NO: 2772756 - protein, 5 aa, Entamoeba invadens
RAFEK

SEQ ID NO: 2772757 - protein, 10 aa, Entamoeba invadens
RAGSNQDSRG

SEQ ID NO: 2772758 - protein, 17 aa, Entamoeba invadens
RAGTYADEQGSSSCKTC

SEQ ID NO: 2772759 - protein, 4 aa, Entamoeba invadens
RAKE

SEQ ID NO: 2772760 - protein, 10 aa, Entamoeba invadens
RAKERKEKGV

SEQ ID NO: 2772761 - protein, 12 aa, Entamoeba invadens
RAKKSESDNNSE

SEQ ID NO: 2772762 - protein, 5 aa, Entamoeba invadens
RAKNE

SEQ ID NO: 2772763 - protein, 7 aa, Entamoeba invadens
RAKNYSK

SEQ ID NO: 2772764 - protein, 4 aa, Entamoeba invadens
RAKP

SEQ ID NO: 2772765 - protein, 4 aa, Entamoeba invadens
RALE

SEQ ID NO: 2772766 - protein, 19 aa, Entamoeba invadens
RANGLEESRTFESMDQFEL

SEQ ID NO: 2772767 - protein, 6 aa, Entamoeba invadens
RANIRR

SEQ ID NO: 2772768 - protein, 4 aa, Entamoeba invadens
RANN

SEQ ID NO: 2772769 - protein, 5 aa, Entamoeba invadens
RANNN

SEQ ID NO: 2772770 - protein, 5 aa, Entamoeba invadens
RAPFG

SEQ ID NO: 2772771 - protein, 12 aa, Entamoeba invadens
RAPITRRAPTDL

SEQ ID NO: 2772772 - protein, 18 aa, Entamoeba invadens
RAQERMSSYNKKNSSGKW

SEQ ID NO: 2772773 - protein, 6 aa, Entamoeba invadens
RAREDS

SEQ ID NO: 2772774 - protein, 17 aa, Entamoeba invadens
RARKIETKCGGSNTQRG

SEQ ID NO: 2772775 - protein, 12 aa, Entamoeba invadens
RARNKKNVVEEL

SEQ ID NO: 2772776 - protein, 6 aa, Entamoeba invadens
RARPDG

SEQ ID NO: 2772777 - protein, 10 aa, Entamoeba invadens
RARRLKDPKA

SEQ ID NO: 2772778 - protein, 7 aa, Entamoeba invadens
RASDAPF

SEQ ID NO: 2772779 - protein, 8 aa, Entamoeba invadens
RASEESKS

SEQ ID NO: 2772780 - protein, 8 aa, Entamoeba invadens
RASEKSKG

SEQ ID NO: 2772781 - protein, 7 aa, Entamoeba invadens
RASEQKK

SEQ ID NO: 2772782 - protein, 8 aa, Entamoeba invadens
RASESSKS

SEQ ID NO: 2772783 - protein, 8 aa, Entamoeba invadens
RASHSPCT

SEQ ID NO: 2772784 - protein, 4 aa, Entamoeba invadens
RASL

SEQ ID NO: 2772785 - protein, 9 aa, Entamoeba invadens
RASLPNKEI

SEQ ID NO: 2772786 - protein, 7 aa, Entamoeba invadens
RASMNNP

SEQ ID NO: 2772787 - protein, 9 aa, Entamoeba invadens
RASTNKKYP

SEQ ID NO: 2772788 - protein, 8 aa, Entamoeba invadens
RASTQQQS

SEQ ID NO: 2772789 - protein, 9 aa, Entamoeba invadens
RASTTTAID

SEQ ID NO: 2772790 - protein, 8 aa, Entamoeba invadens
RATASTNA

SEQ ID NO: 2772791 - protein, 12 aa, Entamoeba invadens
RATASTNATFEE

SEQ ID NO: 2772792 - protein, 9 aa, Entamoeba invadens
RATKKNPQY

SEQ ID NO: 2772793 - protein, 4 aa, Entamoeba invadens
RATQ

SEQ ID NO: 2772794 - protein, 18 aa, Entamoeba invadens
RATTNTKGTFSSVESSDV

SEQ ID NO: 2772795 - protein, 12 aa, Entamoeba invadens
RAVSGGDGVTNE

SEQ ID NO: 2772796 - protein, 8 aa, Entamoeba invadens
RCCGGNSG

SEQ ID NO: 2772797 - protein, 8 aa, Entamoeba invadens
RCDAASGK

SEQ ID NO: 2772798 - protein, 4 aa, Entamoeba invadens
RCDE

SEQ ID NO: 2772799 - protein, 7 aa, Entamoeba invadens
RCDRKTC

SEQ ID NO: 2772800 - protein, 8 aa, Entamoeba invadens
RCEAPRDP

SEQ ID NO: 2772801 - protein, 5 aa, Entamoeba invadens
RCEEK

SEQ ID NO: 2772802 - protein, 6 aa, Entamoeba invadens
RCEKCD

SEQ ID NO: 2772803 - protein, 6 aa, Entamoeba invadens
RCENGK

SEQ ID NO: 2772804 - protein, 8 aa, Entamoeba invadens
RCEQCEPT

SEQ ID NO: 2772805 - protein, 11 aa, Entamoeba invadens
RCGGQGKVRQQ

SEQ ID NO: 2772806 - protein, 6 aa, Entamoeba invadens
RCGPCT

SEQ ID NO: 2772807 - protein, 18 aa, Entamoeba invadens
RCKEPDDNCQTRNNDNTC

SEQ ID NO: 2772808 - protein, 11 aa, Entamoeba invadens
RCKSSVNESPH

SEQ ID NO: 2772809 - protein, 7 aa, Entamoeba invadens
RCNATDG

SEQ ID NO: 2772810 - protein, 8 aa, Entamoeba invadens
RCNATNGK

SEQ ID NO: 2772811 - protein, 9 aa, Entamoeba invadens
RCNDGYISN

SEQ ID NO: 2772812 - protein, 7 aa, Entamoeba invadens
RCNGPNY

SEQ ID NO: 2772813 - protein, 6 aa, Entamoeba invadens
RCNQSS

SEQ ID NO: 2772814 - protein, 6 aa, Entamoeba invadens
RCPGGY

SEQ ID NO: 2772815 - protein, 5 aa, Entamoeba invadens
RCPSF

SEQ ID NO: 2772816 - protein, 6 aa, Entamoeba invadens
RCQKST

SEQ ID NO: 2772817 - protein, 10 aa, Entamoeba invadens
RCRSTSHNLK

SEQ ID NO: 2772818 - protein, 9 aa, Entamoeba invadens
RCSKCQTTN

SEQ ID NO: 2772819 - protein, 12 aa, Entamoeba invadens
RCSQCSENCTSC

SEQ ID NO: 2772820 - protein, 8 aa, Entamoeba invadens
RCSQTDSK

SEQ ID NO: 2772821 - protein, 5 aa, Entamoeba invadens
RCSRC

SEQ ID NO: 2772822 - protein, 12 aa, Entamoeba invadens
RCSSESNCNSCE

SEQ ID NO: 2772823 - protein, 8 aa, Entamoeba invadens
RCSTTNNS

SEQ ID NO: 2772824 - protein, 7 aa, Entamoeba invadens
RCTEAGK

SEQ ID NO: 2772825 - protein, 5 aa, Entamoeba invadens
RCTKC

SEQ ID NO: 2772826 - protein, 11 aa, Entamoeba invadens
RCTNDRSGVGV

SEQ ID NO: 2772827 - protein, 5 aa, Entamoeba invadens
RCTPC

SEQ ID NO: 2772828 - protein, 5 aa, Entamoeba invadens
RCTPS

SEQ ID NO: 2772829 - protein, 5 aa, Entamoeba invadens
RCTTA

SEQ ID NO: 2772830 - protein, 9 aa, Entamoeba invadens
RCVPNSENI

SEQ ID NO: 2772831 - protein, 9 aa, Entamoeba invadens
RCVPNSENL

SEQ ID NO: 2772832 - protein, 9 aa, Entamoeba invadens
RDAEQAKYE

SEQ ID NO: 2772833 - protein, 11 aa, Entamoeba invadens
RDAGQTEADTQ

SEQ ID NO: 2772834 - protein, 6 aa, Entamoeba invadens
RDAIKN

SEQ ID NO: 2772835 - protein, 9 aa, Entamoeba invadens
RDCSGESLQ

SEQ ID NO: 2772836 - protein, 7 aa, Entamoeba invadens
RDDEGVD

SEQ ID NO: 2772837 - protein, 6 aa, Entamoeba invadens
RDDGNS

SEQ ID NO: 2772838 - protein, 44 aa, Entamoeba invadens
RDEAQSEYFTTTDYGRDEDNYDEDSNEEVEEENDVNDDVNEDEQ

SEQ ID NO: 2772839 - protein, 5 aa, Entamoeba invadens
RDEDV

SEQ ID NO: 2772840 - protein, 5 aa, Entamoeba invadens
RDEIG

SEQ ID NO: 2772841 - protein, 4 aa, Entamoeba invadens
RDEM

SEQ ID NO: 2772842 - protein, 6 aa, Entamoeba invadens
RDENAL

SEQ ID NO: 2772843 - protein, 7 aa, Entamoeba invadens
RDESDGI

SEQ ID NO: 2772844 - protein, 15 aa, Entamoeba invadens
RDESEMAEELRQESN

SEQ ID NO: 2772845 - protein, 12 aa, Entamoeba invadens
RDFPTVNARKKN

SEQ ID NO: 2772846 - protein, 8 aa, Entamoeba invadens
RDGCGRTP

SEQ ID NO: 2772847 - protein, 10 aa, Entamoeba invadens
RDGETPTEDE

SEQ ID NO: 2772848 - protein, 11 aa, Entamoeba invadens
RDGIEANKIPD

SEQ ID NO: 2772849 - protein, 11 aa, Entamoeba invadens
RDGKYPKDGVN

SEQ ID NO: 2772850 - protein, 26 aa, Entamoeba invadens
RDGNVCTTKGKCIKEKNNNLRSSSQH

SEQ ID NO: 2772851 - protein, 6 aa, Entamoeba invadens
RDGQYL

SEQ ID NO: 2772852 - protein, 13 aa, Entamoeba invadens
RDGVSRPNMVQSN

SEQ ID NO: 2772853 - protein, 13 aa, Entamoeba invadens
RDIEETKKLGEGS

SEQ ID NO: 2772854 - protein, 4 aa, Entamoeba invadens
RDKA

SEQ ID NO: 2772855 - protein, 8 aa, Entamoeba invadens
RDKDPNHP

SEQ ID NO: 2772856 - protein, 5 aa, Entamoeba invadens
RDKEA

SEQ ID NO: 2772857 - protein, 10 aa, Entamoeba invadens
RDKGLGTPTY

SEQ ID NO: 2772858 - protein, 10 aa, Entamoeba invadens
RDKNNRMTGS

SEQ ID NO: 2772859 - protein, 7 aa, Entamoeba invadens
RDKPEQN

SEQ ID NO: 2772860 - protein, 5 aa, Entamoeba invadens
RDKRQ

SEQ ID NO: 2772861 - protein, 6 aa, Entamoeba invadens
RDKSEL

SEQ ID NO: 2772862 - protein, 9 aa, Entamoeba invadens
RDKSTKYEE

SEQ ID NO: 2772863 - protein, 8 aa, Entamoeba invadens
RDKSVENT

SEQ ID NO: 2772864 - protein, 14 aa, Entamoeba invadens
RDLAPKVKSGTIQR

SEQ ID NO: 2772865 - protein, 14 aa, Entamoeba invadens
RDLEAKVTKKTIKR

SEQ ID NO: 2772866 - protein, 10 aa, Entamoeba invadens
RDLQTSRKRM

SEQ ID NO: 2772867 - protein, 8 aa, Entamoeba invadens
RDMDNKSY

SEQ ID NO: 2772868 - protein, 14 aa, Entamoeba invadens
RDMSNYDYTRNSNA

SEQ ID NO: 2772869 - protein, 6 aa, Entamoeba invadens
RDNADF

SEQ ID NO: 2772870 - protein, 7 aa, Entamoeba invadens
RDNDENH

SEQ ID NO: 2772871 - protein, 5 aa, Entamoeba invadens
RDNSF

SEQ ID NO: 2772872 - protein, 10 aa, Entamoeba invadens
RDNSKCTNCT

SEQ ID NO: 2772873 - protein, 7 aa, Entamoeba invadens
RDNSKYQ

SEQ ID NO: 2772874 - protein, 8 aa, Entamoeba invadens
RDNTGNEV

SEQ ID NO: 2772875 - protein, 8 aa, Entamoeba invadens
RDPPTASG

SEQ ID NO: 2772876 - protein, 7 aa, Entamoeba invadens
RDPQVDS

SEQ ID NO: 2772877 - protein, 4 aa, Entamoeba invadens
RDPY

SEQ ID NO: 2772878 - protein, 5 aa, Entamoeba invadens
RDQEM

SEQ ID NO: 2772879 - protein, 11 aa, Entamoeba invadens
RDQRKSFDSTK

SEQ ID NO: 2772880 - protein, 15 aa, Entamoeba invadens
RDQRMRKQLEEISKD

SEQ ID NO: 2772881 - protein, 8 aa, Entamoeba invadens
RDRDGNMS

SEQ ID NO: 2772882 - protein, 5 aa, Entamoeba invadens
RDSDH

SEQ ID NO: 2772883 - protein, 7 aa, Entamoeba invadens
RDSNEEW

SEQ ID NO: 2772884 - protein, 14 aa, Entamoeba invadens
RDSPTENGKCTGAV

SEQ ID NO: 2772885 - protein, 23 aa, Entamoeba invadens
RDSVNAPPVPKRSYKHRKDRLER

SEQ ID NO: 2772886 - protein, 6 aa, Entamoeba invadens
RDTNTP

SEQ ID NO: 2772887 - protein, 14 aa, Entamoeba invadens
RDTTDNKKCGTCNN

SEQ ID NO: 2772888 - protein, 6 aa, Entamoeba invadens
RDTTYN

SEQ ID NO: 2772889 - protein, 5 aa, Entamoeba invadens
RDVEK

SEQ ID NO: 2772890 - protein, 9 aa, Entamoeba invadens
RDVEYPTSI

SEQ ID NO: 2772891 - protein, 7 aa, Entamoeba invadens
RDVGEEY

SEQ ID NO: 2772892 - protein, 9 aa, Entamoeba invadens
RDVGQSPTV

SEQ ID NO: 2772893 - protein, 13 aa, Entamoeba invadens
RDYKQTDNNLGET

SEQ ID NO: 2772894 - protein, 8 aa, Entamoeba invadens
RDYPNTEY

SEQ ID NO: 2772895 - protein, 13 aa, Entamoeba invadens
RDYQISRSKSAEA

SEQ ID NO: 2772896 - protein, 9 aa, Entamoeba invadens
REAAKTSDN

SEQ ID NO: 2772897 - protein, 8 aa, Entamoeba invadens
READTPFE

SEQ ID NO: 2772898 - protein, 5 aa, Entamoeba invadens
REANC

SEQ ID NO: 2772899 - protein, 4 aa, Entamoeba invadens
REAS

SEQ ID NO: 2772900 - protein, 11 aa, Entamoeba invadens
RECKSCGTNCN

SEQ ID NO: 2772901 - protein, 4 aa, Entamoeba invadens
RECS

SEQ ID NO: 2772902 - protein, 7 aa, Entamoeba invadens
RECVTSK

SEQ ID NO: 2772903 - protein, 10 aa, Entamoeba invadens
REDAHSAKIT

SEQ ID NO: 2772904 - protein, 5 aa, Entamoeba invadens
REDEK

SEQ ID NO: 2772905 - protein, 4 aa, Entamoeba invadens
REDG

SEQ ID NO: 2772906 - protein, 10 aa, Entamoeba invadens
REDGSGCQKK

SEQ ID NO: 2772907 - protein, 11 aa, Entamoeba invadens
REDPTQTNCTE

SEQ ID NO: 2772908 - protein, 5 aa, Entamoeba invadens
REDSN

SEQ ID NO: 2772909 - protein, 7 aa, Entamoeba invadens
REEEKTP

SEQ ID NO: 2772910 - protein, 11 aa, Entamoeba invadens
REEELNAGEDI

SEQ ID NO: 2772911 - protein, 7 aa, Entamoeba invadens
REEIERR

SEQ ID NO: 2772912 - protein, 12 aa, Entamoeba invadens
REEKKKKKSLND

SEQ ID NO: 2772913 - protein, 11 aa, Entamoeba invadens
REENCQTESPN

SEQ ID NO: 2772914 - protein, 39 aa, Entamoeba invadens
REERNSKEQKVEVPPADLPQPENVIPQTQQTVEKSTIEP

SEQ ID NO: 2772915 - protein, 6 aa, Entamoeba invadens
REESVK

SEQ ID NO: 2772916 - protein, 8 aa, Entamoeba invadens
REETITSN

SEQ ID NO: 2772917 - protein, 14 aa, Entamoeba invadens
REETSGSVEEDSSF

SEQ ID NO: 2772918 - protein, 13 aa, Entamoeba invadens
REGCSDEGKVREF

SEQ ID NO: 2772919 - protein, 12 aa, Entamoeba invadens
REGCSDESKVHE

SEQ ID NO: 2772920 - protein, 8 aa, Entamoeba invadens
REGEEPQL

SEQ ID NO: 2772921 - protein, 10 aa, Entamoeba invadens
REGESNNARG

SEQ ID NO: 2772922 - protein, 4 aa, Entamoeba invadens
REGG

SEQ ID NO: 2772923 - protein, 7 aa, Entamoeba invadens
REGGSGC

SEQ ID NO: 2772924 - protein, 5 aa, Entamoeba invadens
REGGY

SEQ ID NO: 2772925 - protein, 5 aa, Entamoeba invadens
REGID

SEQ ID NO: 2772926 - protein, 4 aa, Entamoeba invadens
REGT

SEQ ID NO: 2772927 - protein, 8 aa, Entamoeba invadens
REGTSAED

SEQ ID NO: 2772928 - protein, 7 aa, Entamoeba invadens
REGYNLE

SEQ ID NO: 2772929 - protein, 7 aa, Entamoeba invadens
REHSQSP

SEQ ID NO: 2772930 - protein, 10 aa, Entamoeba invadens
REHTKTKQQV

SEQ ID NO: 2772931 - protein, 11 aa, Entamoeba invadens
REIAEKEKGLK

SEQ ID NO: 2772932 - protein, 6 aa, Entamoeba invadens
REIAGG

SEQ ID NO: 2772933 - protein, 16 aa, Entamoeba invadens
REIERGKNHVYGESRG

SEQ ID NO: 2772934 - protein, 6 aa, Entamoeba invadens
REIEVG

SEQ ID NO: 2772935 - protein, 11 aa, Entamoeba invadens
REIQDSNGKTA

SEQ ID NO: 2772936 - protein, 4 aa, Entamoeba invadens
REIS

SEQ ID NO: 2772937 - protein, 4 aa, Entamoeba invadens
REKD

SEQ ID NO: 2772938 - protein, 9 aa, Entamoeba invadens
REKDDQQVY

SEQ ID NO: 2772939 - protein, 8 aa, Entamoeba invadens
REKDEQQP

SEQ ID NO: 2772940 - protein, 5 aa, Entamoeba invadens
REKDF

SEQ ID NO: 2772941 - protein, 7 aa, Entamoeba invadens
REKEANV

SEQ ID NO: 2772942 - protein, 6 aa, Entamoeba invadens
REKEES

SEQ ID NO: 2772943 - protein, 9 aa, Entamoeba invadens
REKEVSPRN

SEQ ID NO: 2772944 - protein, 5 aa, Entamoeba invadens
REKIN

SEQ ID NO: 2772945 - protein, 19 aa, Entamoeba invadens
REKMAKNKKPKKDLDKEKV

SEQ ID NO: 2772946 - protein, 5 aa, Entamoeba invadens
REKRG

SEQ ID NO: 2772947 - protein, 6 aa, Entamoeba invadens
REKSGV

SEQ ID NO: 2772948 - protein, 8 aa, Entamoeba invadens
REKSSDTV

SEQ ID NO: 2772949 - protein, 5 aa, Entamoeba invadens
REKTG

SEQ ID NO: 2772950 - protein, 6 aa, Entamoeba invadens
REKTTT

SEQ ID NO: 2772951 - protein, 9 aa, Entamoeba invadens
REKVGEAGG

SEQ ID NO: 2772952 - protein, 5 aa, Entamoeba invadens
REKVQ

SEQ ID NO: 2772953 - protein, 10 aa, Entamoeba invadens
REKYKKEADV

SEQ ID NO: 2772954 - protein, 10 aa, Entamoeba invadens
REKYKKSADI

SEQ ID NO: 2772955 - protein, 10 aa, Entamoeba invadens
REKYKKSADV

SEQ ID NO: 2772956 - protein, 9 aa, Entamoeba invadens
REKYTKSAD

SEQ ID NO: 2772957 - protein, 41 aa, Entamoeba invadens
RELAKTQEELKTEKSAKESTESRLKEAQETIEKNKITAEEL

SEQ ID NO: 2772958 - protein, 15 aa, Entamoeba invadens
RELAPKVASGATQRG

SEQ ID NO: 2772959 - protein, 13 aa, Entamoeba invadens
RELEEDKKIGEGS

SEQ ID NO: 2772960 - protein, 13 aa, Entamoeba invadens
RELEESSQIGEGS

SEQ ID NO: 2772961 - protein, 13 aa, Entamoeba invadens
RELEETKKLGEGS

SEQ ID NO: 2772962 - protein, 6 aa, Entamoeba invadens
RELKNE

SEQ ID NO: 2772963 - protein, 13 aa, Entamoeba invadens
RELNDANKKKRTI

SEQ ID NO: 2772964 - protein, 12 aa, Entamoeba invadens
RELNSQRTRKSD

SEQ ID NO: 2772965 - protein, 11 aa, Entamoeba invadens
RELSDTQGPVG

SEQ ID NO: 2772966 - protein, 13 aa, Entamoeba invadens
RELTEEKKLGEGS

SEQ ID NO: 2772967 - protein, 8 aa, Entamoeba invadens
REMAEDNQ

SEQ ID NO: 2772968 - protein, 8 aa, Entamoeba invadens
REMEETKF

SEQ ID NO: 2772969 - protein, 7 aa, Entamoeba invadens
REMENSE

SEQ ID NO: 2772970 - protein, 10 aa, Entamoeba invadens
RENDAVSLQS

SEQ ID NO: 2772971 - protein, 6 aa, Entamoeba invadens
RENDTY

SEQ ID NO: 2772972 - protein, 12 aa, Entamoeba invadens
RENEKHKGIQQE

SEQ ID NO: 2772973 - protein, 41 aa, Entamoeba invadens
RENERVDANGLKKKSQDCGGRNDEEFGEGNSEEKEKDAKKV

SEQ ID NO: 2772974 - protein, 13 aa, Entamoeba invadens
RENIEDEKLGEGS

SEQ ID NO: 2772975 - protein, 6 aa, Entamoeba invadens
RENKIR

SEQ ID NO: 2772976 - protein, 8 aa, Entamoeba invadens
RENKNTTI

SEQ ID NO: 2772977 - protein, 6 aa, Entamoeba invadens
RENNRV

SEQ ID NO: 2772978 - protein, 9 aa, Entamoeba invadens
RENNSKGLK

SEQ ID NO: 2772979 - protein, 8 aa, Entamoeba invadens
RENPIAEG

SEQ ID NO: 2772980 - protein, 6 aa, Entamoeba invadens
RENPNQ

SEQ ID NO: 2772981 - protein, 4 aa, Entamoeba invadens
RENQ

SEQ ID NO: 2772982 - protein, 5 aa, Entamoeba invadens
RENTS

SEQ ID NO: 2772983 - protein, 10 aa, Entamoeba invadens
RENYKKPADI

SEQ ID NO: 2772984 - protein, 10 aa, Entamoeba invadens
REQASENDYS

SEQ ID NO: 2772985 - protein, 7 aa, Entamoeba invadens
REQEQNL

SEQ ID NO: 2772986 - protein, 6 aa, Entamoeba invadens
REQNLT

SEQ ID NO: 2772987 - protein, 9 aa, Entamoeba invadens
REQQGNLKG

SEQ ID NO: 2772988 - protein, 9 aa, Entamoeba invadens
REQQQGDIT

SEQ ID NO: 2772989 - protein, 6 aa, Entamoeba invadens
REQRQY

SEQ ID NO: 2772990 - protein, 9 aa, Entamoeba invadens
REQSNVKTN

SEQ ID NO: 2772991 - protein, 6 aa, Entamoeba invadens
RERDEK

SEQ ID NO: 2772992 - protein, 4 aa, Entamoeba invadens
RERG

SEQ ID NO: 2772993 - protein, 19 aa, Entamoeba invadens
RERLAKEKAEKTKTKKDVK

SEQ ID NO: 2772994 - protein, 8 aa, Entamoeba invadens
RERPYKQH

SEQ ID NO: 2772995 - protein, 15 aa, Entamoeba invadens
RERRPQYFSEDSRGQ

SEQ ID NO: 2772996 - protein, 23 aa, Entamoeba invadens
RERSPSPPPQPKVQTPPPQPIQP

SEQ ID NO: 2772997 - protein, 6 aa, Entamoeba invadens
RERTKS

SEQ ID NO: 2772998 - protein, 7 aa, Entamoeba invadens
RESCESY

SEQ ID NO: 2772999 - protein, 8 aa, Entamoeba invadens
RESDSFRS

SEQ ID NO: 2773000 - protein, 4 aa, Entamoeba invadens
RESG

SEQ ID NO: 2773001 - protein, 11 aa, Entamoeba invadens
RESGECTSCRS

SEQ ID NO: 2773002 - protein, 7 aa, Entamoeba invadens
RESGLTR

SEQ ID NO: 2773003 - protein, 6 aa, Entamoeba invadens
RESKNI

SEQ ID NO: 2773004 - protein, 6 aa, Entamoeba invadens
RESRDL

SEQ ID NO: 2773005 - protein, 4 aa, Entamoeba invadens
RESV

SEQ ID NO: 2773006 - protein, 4 aa, Entamoeba invadens
RESY

SEQ ID NO: 2773007 - protein, 6 aa, Entamoeba invadens
RESYEV

SEQ ID NO: 2773008 - protein, 8 aa, Entamoeba invadens
RESYSSPS

SEQ ID NO: 2773009 - protein, 5 aa, Entamoeba invadens
RETDC

SEQ ID NO: 2773010 - protein, 5 aa, Entamoeba invadens
RETES

SEQ ID NO: 2773011 - protein, 11 aa, Entamoeba invadens
RETFSESQSRR

SEQ ID NO: 2773012 - protein, 7 aa, Entamoeba invadens
RETGETL

SEQ ID NO: 2773013 - protein, 7 aa, Entamoeba invadens
RETKLAE

SEQ ID NO: 2773014 - protein, 4 aa, Entamoeba invadens
RETL

SEQ ID NO: 2773015 - protein, 30 aa, Entamoeba invadens
RETLTTVDQPVNHRPKMTPRYSVNSDKAMQ

SEQ ID NO: 2773016 - protein, 6 aa, Entamoeba invadens
RETNEK

SEQ ID NO: 2773017 - protein, 6 aa, Entamoeba invadens
RETNPI

SEQ ID NO: 2773018 - protein, 5 aa, Entamoeba invadens
RETQP

SEQ ID NO: 2773019 - protein, 5 aa, Entamoeba invadens
RETSD

SEQ ID NO: 2773020 - protein, 6 aa, Entamoeba invadens
RETTNF

SEQ ID NO: 2773021 - protein, 12 aa, Entamoeba invadens
REVKVAKDEQYS

SEQ ID NO: 2773022 - protein, 4 aa, Entamoeba invadens
REVS

SEQ ID NO: 2773023 - protein, 14 aa, Entamoeba invadens
REVSTSKLEGKTDG

SEQ ID NO: 2773024 - protein, 4 aa, Entamoeba invadens
REVT

SEQ ID NO: 2773025 - protein, 5 aa, Entamoeba invadens
REVTA

SEQ ID NO: 2773026 - protein, 5 aa, Entamoeba invadens
REYEG

SEQ ID NO: 2773027 - protein, 5 aa, Entamoeba invadens
REYEK

SEQ ID NO: 2773028 - protein, 13 aa, Entamoeba invadens
REYQEEKKRLKTT

SEQ ID NO: 2773029 - protein, 10 aa, Entamoeba invadens
RFEDNDLTTI

SEQ ID NO: 2773030 - protein, 8 aa, Entamoeba invadens
RFEGYGKD

SEQ ID NO: 2773031 - protein, 8 aa, Entamoeba invadens
RFEQEDAE

SEQ ID NO: 2773032 - protein, 13 aa, Entamoeba invadens
RFESTNECQPPNT

SEQ ID NO: 2773033 - protein, 5 aa, Entamoeba invadens
RFGDS

SEQ ID NO: 2773034 - protein, 4 aa, Entamoeba invadens
RFKP

SEQ ID NO: 2773035 - protein, 5 aa, Entamoeba invadens
RFNTP

SEQ ID NO: 2773036 - protein, 5 aa, Entamoeba invadens
RFPSE

SEQ ID NO: 2773037 - protein, 7 aa, Entamoeba invadens
RFPTKKH

SEQ ID NO: 2773038 - protein, 10 aa, Entamoeba invadens
RFRGESGLTS

SEQ ID NO: 2773039 - protein, 4 aa, Entamoeba invadens
RFSE

SEQ ID NO: 2773040 - protein, 12 aa, Entamoeba invadens
RFSSVENYRKRQ

SEQ ID NO: 2773041 - protein, 4 aa, Entamoeba invadens
RGAN

SEQ ID NO: 2773042 - protein, 9 aa, Entamoeba invadens
RGATDEGCK

SEQ ID NO: 2773043 - protein, 8 aa, Entamoeba invadens
RGATYEEV

SEQ ID NO: 2773044 - protein, 17 aa, Entamoeba invadens
RGCQKQDDKSYSSVNST

SEQ ID NO: 2773045 - protein, 10 aa, Entamoeba invadens
RGCSDKSDFI

SEQ ID NO: 2773046 - protein, 9 aa, Entamoeba invadens
RGCSKCNNN

SEQ ID NO: 2773047 - protein, 7 aa, Entamoeba invadens
RGCSSQP

SEQ ID NO: 2773048 - protein, 6 aa, Entamoeba invadens
RGDALK

SEQ ID NO: 2773049 - protein, 9 aa, Entamoeba invadens
RGDENKQYD

SEQ ID NO: 2773050 - protein, 8 aa, Entamoeba invadens
RGDERDAW

SEQ ID NO: 2773051 - protein, 6 aa, Entamoeba invadens
RGDETA

SEQ ID NO: 2773052 - protein, 8 aa, Entamoeba invadens
RGDGELSK

SEQ ID NO: 2773053 - protein, 15 aa, Entamoeba invadens
RGDIDDNKTNNKLSV

SEQ ID NO: 2773054 - protein, 5 aa, Entamoeba invadens
RGDIS

SEQ ID NO: 2773055 - protein, 9 aa, Entamoeba invadens
RGDTNNQTM

SEQ ID NO: 2773056 - protein, 6 aa, Entamoeba invadens
RGDTTG

SEQ ID NO: 2773057 - protein, 11 aa, Entamoeba invadens
RGEDEDGNETF

SEQ ID NO: 2773058 - protein, 7 aa, Entamoeba invadens
RGEEGDM

SEQ ID NO: 2773059 - protein, 8 aa, Entamoeba invadens
RGEEKSYE

SEQ ID NO: 2773060 - protein, 12 aa, Entamoeba invadens
RGEITNESNDGC

SEQ ID NO: 2773061 - protein, 8 aa, Entamoeba invadens
RGENDKKV

SEQ ID NO: 2773062 - protein, 8 aa, Entamoeba invadens
RGENDQKV

SEQ ID NO: 2773063 - protein, 15 aa, Entamoeba invadens
RGERLEKTSSMSNEQ

SEQ ID NO: 2773064 - protein, 16 aa, Entamoeba invadens
RGERPTIELGDGEQKA

SEQ ID NO: 2773065 - protein, 5 aa, Entamoeba invadens
RGESS

SEQ ID NO: 2773066 - protein, 6 aa, Entamoeba invadens
RGESSL

SEQ ID NO: 2773067 - protein, 4 aa, Entamoeba invadens
RGFT

SEQ ID NO: 2773068 - protein, 12 aa, Entamoeba invadens
RGGKYPKDGVNC

SEQ ID NO: 2773069 - protein, 10 aa, Entamoeba invadens
RGIKTTTDPE

SEQ ID NO: 2773070 - protein, 6 aa, Entamoeba invadens
RGIPEG

SEQ ID NO: 2773071 - protein, 10 aa, Entamoeba invadens
RGIPKGMEVT

SEQ ID NO: 2773072 - protein, 6 aa, Entamoeba invadens
RGIPQE

SEQ ID NO: 2773073 - protein, 5 aa, Entamoeba invadens
RGKAQ

SEQ ID NO: 2773074 - protein, 7 aa, Entamoeba invadens
RGKDTSC

SEQ ID NO: 2773075 - protein, 6 aa, Entamoeba invadens
RGKERY

SEQ ID NO: 2773076 - protein, 12 aa, Entamoeba invadens
RGKGKSFRGGIT

SEQ ID NO: 2773077 - protein, 6 aa, Entamoeba invadens
RGKPVT

SEQ ID NO: 2773078 - protein, 9 aa, Entamoeba invadens
RGKYKKPAD

SEQ ID NO: 2773079 - protein, 6 aa, Entamoeba invadens
RGMSNC

SEQ ID NO: 2773080 - protein, 6 aa, Entamoeba invadens
RGNLTQ

SEQ ID NO: 2773081 - protein, 9 aa, Entamoeba invadens
RGNNNFNNN

SEQ ID NO: 2773082 - protein, 10 aa, Entamoeba invadens
RGNSSYGYRG

SEQ ID NO: 2773083 - protein, 9 aa, Entamoeba invadens
RGPNSGSTI

SEQ ID NO: 2773084 - protein, 7 aa, Entamoeba invadens
RGPNSPY

SEQ ID NO: 2773085 - protein, 5 aa, Entamoeba invadens
RGPPG

SEQ ID NO: 2773086 - protein, 18 aa, Entamoeba invadens
RGPSHTHSATGQPEKAKS

SEQ ID NO: 2773087 - protein, 7 aa, Entamoeba invadens
RGPSLDG

SEQ ID NO: 2773088 - protein, 11 aa, Entamoeba invadens
RGQKSREKTQL

SEQ ID NO: 2773089 - protein, 6 aa, Entamoeba invadens
RGQSEL

SEQ ID NO: 2773090 - protein, 6 aa, Entamoeba invadens
RGQTLT

SEQ ID NO: 2773091 - protein, 4 aa, Entamoeba invadens
RGRC

SEQ ID NO: 2773092 - protein, 5 aa, Entamoeba invadens
RGRYS

SEQ ID NO: 2773093 - protein, 6 aa, Entamoeba invadens
RGSAIN

SEQ ID NO: 2773094 - protein, 11 aa, Entamoeba invadens
RGSAVTEDQLK

SEQ ID NO: 2773095 - protein, 8 aa, Entamoeba invadens
RGSAYDSI

SEQ ID NO: 2773096 - protein, 4 aa, Entamoeba invadens
RGSD

SEQ ID NO: 2773097 - protein, 12 aa, Entamoeba invadens
RGSINRERVSSA

SEQ ID NO: 2773098 - protein, 15 aa, Entamoeba invadens
RGSKEGALRKEGITD

SEQ ID NO: 2773099 - protein, 7 aa, Entamoeba invadens
RGSSSLT

SEQ ID NO: 2773100 - protein, 8 aa, Entamoeba invadens
RGSVETQA

SEQ ID NO: 2773101 - protein, 7 aa, Entamoeba invadens
RGSYNNT

SEQ ID NO: 2773102 - protein, 4 aa, Entamoeba invadens
RGTA

SEQ ID NO: 2773103 - protein, 6 aa, Entamoeba invadens
RGTAAG

SEQ ID NO: 2773104 - protein, 11 aa, Entamoeba invadens
RGTDDSSQYAI

SEQ ID NO: 2773105 - protein, 11 aa, Entamoeba invadens
RGTEGYGYPSD

SEQ ID NO: 2773106 - protein, 18 aa, Entamoeba invadens
RGTFTDPHTIGVDSHTTV

SEQ ID NO: 2773107 - protein, 4 aa, Entamoeba invadens
RGTL

SEQ ID NO: 2773108 - protein, 7 aa, Entamoeba invadens
RGTLNLN

SEQ ID NO: 2773109 - protein, 10 aa, Entamoeba invadens
RGTPSKRGYH

SEQ ID NO: 2773110 - protein, 5 aa, Entamoeba invadens
RGTYC

SEQ ID NO: 2773111 - protein, 5 aa, Entamoeba invadens
RGTYD

SEQ ID NO: 2773112 - protein, 5 aa, Entamoeba invadens
RGTYI

SEQ ID NO: 2773113 - protein, 7 aa, Entamoeba invadens
RGVDDPI

SEQ ID NO: 2773114 - protein, 8 aa, Entamoeba invadens
RGVDPCEN

SEQ ID NO: 2773115 - protein, 7 aa, Entamoeba invadens
RGVDSNG

SEQ ID NO: 2773116 - protein, 6 aa, Entamoeba invadens
RGVDYK

SEQ ID NO: 2773117 - protein, 7 aa, Entamoeba invadens
RGVEKEV

SEQ ID NO: 2773118 - protein, 7 aa, Entamoeba invadens
RGVGTPS

SEQ ID NO: 2773119 - protein, 8 aa, Entamoeba invadens
RGVGTPSF

SEQ ID NO: 2773120 - protein, 4 aa, Entamoeba invadens
RGVI

SEQ ID NO: 2773121 - protein, 7 aa, Entamoeba invadens
RGYKNAD

SEQ ID NO: 2773122 - protein, 4 aa, Entamoeba invadens
RGYP

SEQ ID NO: 2773123 - protein, 7 aa, Entamoeba invadens
RGYRESD

SEQ ID NO: 2773124 - protein, 11 aa, Entamoeba invadens
RHEDEVGTYTP

SEQ ID NO: 2773125 - protein, 13 aa, Entamoeba invadens
RHFSDRRTNNTKY

SEQ ID NO: 2773126 - protein, 9 aa, Entamoeba invadens
RHKSDKMTN

SEQ ID NO: 2773127 - protein, 9 aa, Entamoeba invadens
RHKTEIRKT

SEQ ID NO: 2773128 - protein, 12 aa, Entamoeba invadens
RHQTRQLSCVFI

SEQ ID NO: 2773129 - protein, 6 aa, Entamoeba invadens
RHSPYA

SEQ ID NO: 2773130 - protein, 6 aa, Entamoeba invadens
RHTQHH

SEQ ID NO: 2773131 - protein, 4 aa, Entamoeba invadens
RHTY

SEQ ID NO: 2773132 - protein, 4 aa, Entamoeba invadens
RHVG

SEQ ID NO: 2773133 - protein, 6 aa, Entamoeba invadens
RIDQPN

SEQ ID NO: 2773134 - protein, 9 aa, Entamoeba invadens
RIEAKSGCA

SEQ ID NO: 2773135 - protein, 13 aa, Entamoeba invadens
RIEEGKSTAEEIN

SEQ ID NO: 2773136 - protein, 9 aa, Entamoeba invadens
RIEERKPQR

SEQ ID NO: 2773137 - protein, 6 aa, Entamoeba invadens
RIESAS

SEQ ID NO: 2773138 - protein, 5 aa, Entamoeba invadens
RIGQK

SEQ ID NO: 2773139 - protein, 16 aa, Entamoeba invadens
RIGTTTDVTDNDYSTA

SEQ ID NO: 2773140 - protein, 7 aa, Entamoeba invadens
RIKCESE

SEQ ID NO: 2773141 - protein, 10 aa, Entamoeba invadens
RIKKSEEDIP

SEQ ID NO: 2773142 - protein, 16 aa, Entamoeba invadens
RIKYQNPKNLPAYYSQ

SEQ ID NO: 2773143 - protein, 7 aa, Entamoeba invadens
RINAKDQ

SEQ ID NO: 2773144 - protein, 6 aa, Entamoeba invadens
RINNEK

SEQ ID NO: 2773145 - protein, 7 aa, Entamoeba invadens
RIPDPKK

SEQ ID NO: 2773146 - protein, 11 aa, Entamoeba invadens
RIPEKKNTSEI

SEQ ID NO: 2773147 - protein, 6 aa, Entamoeba invadens
RIPETS

SEQ ID NO: 2773148 - protein, 4 aa, Entamoeba invadens
RIPS

SEQ ID NO: 2773149 - protein, 7 aa, Entamoeba invadens
RIRPPRY

SEQ ID NO: 2773150 - protein, 6 aa, Entamoeba invadens
RISEST

SEQ ID NO: 2773151 - protein, 14 aa, Entamoeba invadens
RISKSSAIQTFNDK

SEQ ID NO: 2773152 - protein, 8 aa, Entamoeba invadens
RISKWSSA

SEQ ID NO: 2773153 - protein, 4 aa, Entamoeba invadens
RISP

SEQ ID NO: 2773154 - protein, 8 aa, Entamoeba invadens
RISQIDSD

SEQ ID NO: 2773155 - protein, 4 aa, Entamoeba invadens
RITP

SEQ ID NO: 2773156 - protein, 14 aa, Entamoeba invadens
RITSEEVVLKLEKV

SEQ ID NO: 2773157 - protein, 5 aa, Entamoeba invadens
RIVGT

SEQ ID NO: 2773158 - protein, 15 aa, Entamoeba invadens
RKAENETTDLEFEYV

SEQ ID NO: 2773159 - protein, 6 aa, Entamoeba invadens
RKAGNI

SEQ ID NO: 2773160 - protein, 11 aa, Entamoeba invadens
RKAKMKQEKEV

SEQ ID NO: 2773161 - protein, 6 aa, Entamoeba invadens
RKANSF

SEQ ID NO: 2773162 - protein, 4 aa, Entamoeba invadens
RKCD

SEQ ID NO: 2773163 - protein, 12 aa, Entamoeba invadens
RKCKECTKERCS

SEQ ID NO: 2773164 - protein, 17 aa, Entamoeba invadens
RKCPTGCTTCTDTPTCN

SEQ ID NO: 2773165 - protein, 4 aa, Entamoeba invadens
RKCQ

SEQ ID NO: 2773166 - protein, 12 aa, Entamoeba invadens
RKCSEGYYTSST

SEQ ID NO: 2773167 - protein, 9 aa, Entamoeba invadens
RKCSPEGRC

SEQ ID NO: 2773168 - protein, 11 aa, Entamoeba invadens
RKCSQGYFSTQ

SEQ ID NO: 2773169 - protein, 7 aa, Entamoeba invadens
RKDDGTI

SEQ ID NO: 2773170 - protein, 8 aa, Entamoeba invadens
RKDGVQED

SEQ ID NO: 2773171 - protein, 7 aa, Entamoeba invadens
RKDLNRT

SEQ ID NO: 2773172 - protein, 7 aa, Entamoeba invadens
RKDRDEH

SEQ ID NO: 2773173 - protein, 5 aa, Entamoeba invadens
RKEAE

SEQ ID NO: 2773174 - protein, 5 aa, Entamoeba invadens
RKEEK

SEQ ID NO: 2773175 - protein, 9 aa, Entamoeba invadens
RKEEPYKHK

SEQ ID NO: 2773176 - protein, 13 aa, Entamoeba invadens
RKEFGPESTTTPY

SEQ ID NO: 2773177 - protein, 5 aa, Entamoeba invadens
RKEGT

SEQ ID NO: 2773178 - protein, 6 aa, Entamoeba invadens
RKEIEK

SEQ ID NO: 2773179 - protein, 4 aa, Entamoeba invadens
RKEK

SEQ ID NO: 2773180 - protein, 20 aa, Entamoeba invadens
RKEKDDLSKQVKENSTKIAE

SEQ ID NO: 2773181 - protein, 9 aa, Entamoeba invadens
RKENKTHKV

SEQ ID NO: 2773182 - protein, 6 aa, Entamoeba invadens
RKERIT

SEQ ID NO: 2773183 - protein, 8 aa, Entamoeba invadens
RKERITRE

SEQ ID NO: 2773184 - protein, 9 aa, Entamoeba invadens
RKERKKKER

SEQ ID NO: 2773185 - protein, 10 aa, Entamoeba invadens
RKETAESKHP

SEQ ID NO: 2773186 - protein, 18 aa, Entamoeba invadens
RKETPSAFIPTDRNLYTV

SEQ ID NO: 2773187 - protein, 9 aa, Entamoeba invadens
RKEYQSKDN

SEQ ID NO: 2773188 - protein, 16 aa, Entamoeba invadens
RKEYSGDQSATTPFEI

SEQ ID NO: 2773189 - protein, 6 aa, Entamoeba invadens
RKFESS

SEQ ID NO: 2773190 - protein, 10 aa, Entamoeba invadens
RKFKQKNSIE

SEQ ID NO: 2773191 - protein, 4 aa, Entamoeba invadens
RKGE

SEQ ID NO: 2773192 - protein, 8 aa, Entamoeba invadens
RKGEADDM

SEQ ID NO: 2773193 - protein, 6 aa, Entamoeba invadens
RKGENQ

SEQ ID NO: 2773194 - protein, 7 aa, Entamoeba invadens
RKGETKS

SEQ ID NO: 2773195 - protein, 6 aa, Entamoeba invadens
RKGIEG

SEQ ID NO: 2773196 - protein, 8 aa, Entamoeba invadens
RKGKDYEI

SEQ ID NO: 2773197 - protein, 9 aa, Entamoeba invadens
RKGKSVSTR

SEQ ID NO: 2773198 - protein, 6 aa, Entamoeba invadens
RKGNDY

SEQ ID NO: 2773199 - protein, 10 aa, Entamoeba invadens
RKGNKKASVK

SEQ ID NO: 2773200 - protein, 8 aa, Entamoeba invadens
RKGNPVTQ

SEQ ID NO: 2773201 - protein, 8 aa, Entamoeba invadens
RKGQSNDE

SEQ ID NO: 2773202 - protein, 7 aa, Entamoeba invadens
RKGSVSG

SEQ ID NO: 2773203 - protein, 4 aa, Entamoeba invadens
RKGT

SEQ ID NO: 2773204 - protein, 20 aa, Entamoeba invadens
RKHAGTEGADAYMKINDATV

SEQ ID NO: 2773205 - protein, 14 aa, Entamoeba invadens
RKHKKDSKKEEVLL

SEQ ID NO: 2773206 - protein, 4 aa, Entamoeba invadens
RKIA

SEQ ID NO: 2773207 - protein, 5 aa, Entamoeba invadens
RKIEE

SEQ ID NO: 2773208 - protein, 7 aa, Entamoeba invadens
RKITDTN

SEQ ID NO: 2773209 - protein, 7 aa, Entamoeba invadens
RKITGAS

SEQ ID NO: 2773210 - protein, 9 aa, Entamoeba invadens
RKKEHKNRK

SEQ ID NO: 2773211 - protein, 19 aa, Entamoeba invadens
RKKELGQKNMNKPIEVSKK

SEQ ID NO: 2773212 - protein, 5 aa, Entamoeba invadens
RKKEN

SEQ ID NO: 2773213 - protein, 7 aa, Entamoeba invadens
RKKEVEK

SEQ ID NO: 2773214 - protein, 6 aa, Entamoeba invadens
RKKHSI

SEQ ID NO: 2773215 - protein, 8 aa, Entamoeba invadens
RKKKTNSI

SEQ ID NO: 2773216 - protein, 9 aa, Entamoeba invadens
RKKLGEKGR

SEQ ID NO: 2773217 - protein, 5 aa, Entamoeba invadens
RKKMM

SEQ ID NO: 2773218 - protein, 33 aa, Entamoeba invadens
RKKSAEEDLVNGEEEEEEMESDDVESSEDAKKD

SEQ ID NO: 2773219 - protein, 8 aa, Entamoeba invadens
RKKSPETF

SEQ ID NO: 2773220 - protein, 8 aa, Entamoeba invadens
RKKSSEVD

SEQ ID NO: 2773221 - protein, 12 aa, Entamoeba invadens
RKKTRNNNQNRL

SEQ ID NO: 2773222 - protein, 21 aa, Entamoeba invadens
RKKVTNENKTVSSPSQKCYST

SEQ ID NO: 2773223 - protein, 9 aa, Entamoeba invadens
RKKYKKAAD

SEQ ID NO: 2773224 - protein, 9 aa, Entamoeba invadens
RKKYKKPAD

SEQ ID NO: 2773225 - protein, 10 aa, Entamoeba invadens
RKKYKKSSDV

SEQ ID NO: 2773226 - protein, 16 aa, Entamoeba invadens
RKLENDKVKDEKRKEA

SEQ ID NO: 2773227 - protein, 4 aa, Entamoeba invadens
RKLR

SEQ ID NO: 2773228 - protein, 17 aa, Entamoeba invadens
RKLSGGRNENTEDAKKI

SEQ ID NO: 2773229 - protein, 9 aa, Entamoeba invadens
RKLTGFDRR

SEQ ID NO: 2773230 - protein, 10 aa, Entamoeba invadens
RKMNGDKKNG

SEQ ID NO: 2773231 - protein, 10 aa, Entamoeba invadens
RKMNKNPTTT

SEQ ID NO: 2773232 - protein, 7 aa, Entamoeba invadens
RKNDPID

SEQ ID NO: 2773233 - protein, 7 aa, Entamoeba invadens
RKNGIET

SEQ ID NO: 2773234 - protein, 8 aa, Entamoeba invadens
RKNGQKIL

SEQ ID NO: 2773235 - protein, 5 aa, Entamoeba invadens
RKNGT

SEQ ID NO: 2773236 - protein, 9 aa, Entamoeba invadens
RKNKATQAR

SEQ ID NO: 2773237 - protein, 8 aa, Entamoeba invadens
RKNKEIGE

SEQ ID NO: 2773238 - protein, 16 aa, Entamoeba invadens
RKNNDYHVTRQDADGD

SEQ ID NO: 2773239 - protein, 7 aa, Entamoeba invadens
RKNNKVF

SEQ ID NO: 2773240 - protein, 5 aa, Entamoeba invadens
RKNNR

SEQ ID NO: 2773241 - protein, 9 aa, Entamoeba invadens
RKNSREDLS

SEQ ID NO: 2773242 - protein, 7 aa, Entamoeba invadens
RKPFPSK

SEQ ID NO: 2773243 - protein, 16 aa, Entamoeba invadens
RKPHNKEKEITDEKKE

SEQ ID NO: 2773244 - protein, 6 aa, Entamoeba invadens
RKPKNY

SEQ ID NO: 2773245 - protein, 5 aa, Entamoeba invadens
RKPLV

SEQ ID NO: 2773246 - protein, 9 aa, Entamoeba invadens
RKPNTKAKF

SEQ ID NO: 2773247 - protein, 10 aa, Entamoeba invadens
RKPPDQDELE

SEQ ID NO: 2773248 - protein, 4 aa, Entamoeba invadens
RKPR

SEQ ID NO: 2773249 - protein, 9 aa, Entamoeba invadens
RKPRFQKSP

SEQ ID NO: 2773250 - protein, 9 aa, Entamoeba invadens
RKPRNPNDG

SEQ ID NO: 2773251 - protein, 14 aa, Entamoeba invadens
RKPVPGNKCEGCND

SEQ ID NO: 2773252 - protein, 8 aa, Entamoeba invadens
RKPYGKYD

SEQ ID NO: 2773253 - protein, 14 aa, Entamoeba invadens
RKQKKLNYNDLSNT

SEQ ID NO: 2773254 - protein, 9 aa, Entamoeba invadens
RKQKPNDYI

SEQ ID NO: 2773255 - protein, 8 aa, Entamoeba invadens
RKQMPDDM

SEQ ID NO: 2773256 - protein, 6 aa, Entamoeba invadens
RKQNGY

SEQ ID NO: 2773257 - protein, 23 aa, Entamoeba invadens
RKQNNQIESKEKNPDSFEEPNEE

SEQ ID NO: 2773258 - protein, 14 aa, Entamoeba invadens
RKQQKLNYNDLSNT

SEQ ID NO: 2773259 - protein, 14 aa, Entamoeba invadens
RKQQRYTESGYDYK

SEQ ID NO: 2773260 - protein, 17 aa, Entamoeba invadens
RKRDIKNEKERRAAEKL

SEQ ID NO: 2773261 - protein, 5 aa, Entamoeba invadens
RKREE

SEQ ID NO: 2773262 - protein, 10 aa, Entamoeba invadens
RKRKEKNDAK

SEQ ID NO: 2773263 - protein, 12 aa, Entamoeba invadens
RKRKITPNTETY

SEQ ID NO: 2773264 - protein, 5 aa, Entamoeba invadens
RKRLS

SEQ ID NO: 2773265 - protein, 5 aa, Entamoeba invadens
RKRQI

SEQ ID NO: 2773266 - protein, 11 aa, Entamoeba invadens
RKRRKIQEKNT

SEQ ID NO: 2773267 - protein, 6 aa, Entamoeba invadens
RKRSSY

SEQ ID NO: 2773268 - protein, 10 aa, Entamoeba invadens
RKSAKSMKHK

SEQ ID NO: 2773269 - protein, 12 aa, Entamoeba invadens
RKSAKTENKEIR

SEQ ID NO: 2773270 - protein, 15 aa, Entamoeba invadens
RKSDHSKDLRPRTTL

SEQ ID NO: 2773271 - protein, 7 aa, Entamoeba invadens
RKSEIES

SEQ ID NO: 2773272 - protein, 8 aa, Entamoeba invadens
RKSEQIPP

SEQ ID NO: 2773273 - protein, 12 aa, Entamoeba invadens
RKSEQIPPMKIR

SEQ ID NO: 2773274 - protein, 7 aa, Entamoeba invadens
RKSETSV

SEQ ID NO: 2773275 - protein, 6 aa, Entamoeba invadens
RKSFKI

SEQ ID NO: 2773276 - protein, 9 aa, Entamoeba invadens
RKSGYSTKS

SEQ ID NO: 2773277 - protein, 5 aa, Entamoeba invadens
RKSIG

SEQ ID NO: 2773278 - protein, 10 aa, Entamoeba invadens
RKSKKTKNTI

SEQ ID NO: 2773279 - protein, 8 aa, Entamoeba invadens
RKSNEGGF

SEQ ID NO: 2773280 - protein, 8 aa, Entamoeba invadens
RKSNGTNA

SEQ ID NO: 2773281 - protein, 9 aa, Entamoeba invadens
RKSPDAQAR

SEQ ID NO: 2773282 - protein, 16 aa, Entamoeba invadens
RKSPQNPFSDEGEKKF

SEQ ID NO: 2773283 - protein, 21 aa, Entamoeba invadens
RKSSSLSLTRSSLQRRSSSKL

SEQ ID NO: 2773284 - protein, 5 aa, Entamoeba invadens
RKSTE

SEQ ID NO: 2773285 - protein, 9 aa, Entamoeba invadens
RKSTEQDEN

SEQ ID NO: 2773286 - protein, 9 aa, Entamoeba invadens
RKTDQNGQI

SEQ ID NO: 2773287 - protein, 15 aa, Entamoeba invadens
RKTEDKAKTYKLNGT

SEQ ID NO: 2773288 - protein, 12 aa, Entamoeba invadens
RKTEEQTAVSEL

SEQ ID NO: 2773289 - protein, 5 aa, Entamoeba invadens
RKTFG

SEQ ID NO: 2773290 - protein, 14 aa, Entamoeba invadens
RKTGGPEEDESSDR

SEQ ID NO: 2773291 - protein, 7 aa, Entamoeba invadens
RKTGGVA

SEQ ID NO: 2773292 - protein, 6 aa, Entamoeba invadens
RKTGTK

SEQ ID NO: 2773293 - protein, 18 aa, Entamoeba invadens
RKTIEQRKESLSCSCPPQ

SEQ ID NO: 2773294 - protein, 5 aa, Entamoeba invadens
RKTKD

SEQ ID NO: 2773295 - protein, 11 aa, Entamoeba invadens
RKTKLAKKTVQ

SEQ ID NO: 2773296 - protein, 6 aa, Entamoeba invadens
RKTLPG

SEQ ID NO: 2773297 - protein, 5 aa, Entamoeba invadens
RKTLT

SEQ ID NO: 2773298 - protein, 14 aa, Entamoeba invadens
RKTMKEREKEIKPF

SEQ ID NO: 2773299 - protein, 6 aa, Entamoeba invadens
RKTPSI

SEQ ID NO: 2773300 - protein, 5 aa, Entamoeba invadens
RKTQD

SEQ ID NO: 2773301 - protein, 6 aa, Entamoeba invadens
RKTRNM

SEQ ID NO: 2773302 - protein, 10 aa, Entamoeba invadens
RKTTNQPTVD

SEQ ID NO: 2773303 - protein, 11 aa, Entamoeba invadens
RKTVSRNAESA

SEQ ID NO: 2773304 - protein, 4 aa, Entamoeba invadens
RKTW

SEQ ID NO: 2773305 - protein, 10 aa, Entamoeba invadens
RKVDEHAVQS

SEQ ID NO: 2773306 - protein, 5 aa, Entamoeba invadens
RKVDL

SEQ ID NO: 2773307 - protein, 8 aa, Entamoeba invadens
RKVGEGSF

SEQ ID NO: 2773308 - protein, 10 aa, Entamoeba invadens
RKVNENEEPI

SEQ ID NO: 2773309 - protein, 8 aa, Entamoeba invadens
RKVPNGNG

SEQ ID NO: 2773310 - protein, 11 aa, Entamoeba invadens
RKWAGNANDPL

SEQ ID NO: 2773311 - protein, 8 aa, Entamoeba invadens
RKWRDGDT

SEQ ID NO: 2773312 - protein, 12 aa, Entamoeba invadens
RKYKNSQKLGSI

SEQ ID NO: 2773313 - protein, 27 aa, Entamoeba invadens
RKYPNDSNKACQDCDSTCNGDCNTSSG

SEQ ID NO: 2773314 - protein, 5 aa, Entamoeba invadens
RKYRT

SEQ ID NO: 2773315 - protein, 5 aa, Entamoeba invadens
RLCQT

SEQ ID NO: 2773316 - protein, 5 aa, Entamoeba invadens
RLDES

SEQ ID NO: 2773317 - protein, 13 aa, Entamoeba invadens
RLDKKDDMSDNSY

SEQ ID NO: 2773318 - protein, 12 aa, Entamoeba invadens
RLDKKESMSDNS

SEQ ID NO: 2773319 - protein, 11 aa, Entamoeba invadens
RLDKPAGVPEN

SEQ ID NO: 2773320 - protein, 10 aa, Entamoeba invadens
RLDKPNGIPE

SEQ ID NO: 2773321 - protein, 11 aa, Entamoeba invadens
RLDKPSGVPEN

SEQ ID NO: 2773322 - protein, 12 aa, Entamoeba invadens
RLDNQGVNNDDC

SEQ ID NO: 2773323 - protein, 17 aa, Entamoeba invadens
RLDPDELRNEKKLGEGG

SEQ ID NO: 2773324 - protein, 17 aa, Entamoeba invadens
RLDPNEIQEEKKLGEGG

SEQ ID NO: 2773325 - protein, 17 aa, Entamoeba invadens
RLDPNELNEEKQIGEGG

SEQ ID NO: 2773326 - protein, 12 aa, Entamoeba invadens
RLEKNENMSEGQ

SEQ ID NO: 2773327 - protein, 9 aa, Entamoeba invadens
RLEKPEEMD

SEQ ID NO: 2773328 - protein, 10 aa, Entamoeba invadens
RLEKPEGCPD

SEQ ID NO: 2773329 - protein, 9 aa, Entamoeba invadens
RLEKPESMN

SEQ ID NO: 2773330 - protein, 11 aa, Entamoeba invadens
RLEKPKDVSQD

SEQ ID NO: 2773331 - protein, 10 aa, Entamoeba invadens
RLEKPKELTE

SEQ ID NO: 2773332 - protein, 7 aa, Entamoeba invadens
RLEKPMD

SEQ ID NO: 2773333 - protein, 8 aa, Entamoeba invadens
RLEKPREM

SEQ ID NO: 2773334 - protein, 31 aa, Entamoeba invadens
RLENEVKEEKEKAESVKKENEELKEKEKGIQ

SEQ ID NO: 2773335 - protein, 7 aa, Entamoeba invadens
RLENTGI

SEQ ID NO: 2773336 - protein, 10 aa, Entamoeba invadens
RLERKENIPE

SEQ ID NO: 2773337 - protein, 10 aa, Entamoeba invadens
RLERKENIQE

SEQ ID NO: 2773338 - protein, 10 aa, Entamoeba invadens
RLERKENITE

SEQ ID NO: 2773339 - protein, 11 aa, Entamoeba invadens
RLERKESMSEN

SEQ ID NO: 2773340 - protein, 12 aa, Entamoeba invadens
RLERNENMSEGQ

SEQ ID NO: 2773341 - protein, 11 aa, Entamoeba invadens
RLERPKETPDY

SEQ ID NO: 2773342 - protein, 6 aa, Entamoeba invadens
RLERRE

SEQ ID NO: 2773343 - protein, 7 aa, Entamoeba invadens
RLERREN

SEQ ID NO: 2773344 - protein, 8 aa, Entamoeba invadens
RLERRENI

SEQ ID NO: 2773345 - protein, 10 aa, Entamoeba invadens
RLERTEGMPD

SEQ ID NO: 2773346 - protein, 4 aa, Entamoeba invadens
RLGQ

SEQ ID NO: 2773347 - protein, 4 aa, Entamoeba invadens
RLGT

SEQ ID NO: 2773348 - protein, 4 aa, Entamoeba invadens
RLKE

SEQ ID NO: 2773349 - protein, 10 aa, Entamoeba invadens
RLKKPANLND

SEQ ID NO: 2773350 - protein, 8 aa, Entamoeba invadens
RLKKPSYL

SEQ ID NO: 2773351 - protein, 12 aa, Entamoeba invadens
RLKPKKKYETDI

SEQ ID NO: 2773352 - protein, 6 aa, Entamoeba invadens
RLNNEE

SEQ ID NO: 2773353 - protein, 9 aa, Entamoeba invadens
RLNQPNEMP

SEQ ID NO: 2773354 - protein, 6 aa, Entamoeba invadens
RLNTTL

SEQ ID NO: 2773355 - protein, 6 aa, Entamoeba invadens
RLPAQI

SEQ ID NO: 2773356 - protein, 14 aa, Entamoeba invadens
RLPGSNESVVSETS

SEQ ID NO: 2773357 - protein, 9 aa, Entamoeba invadens
RLPKPSSMP

SEQ ID NO: 2773358 - protein, 10 aa, Entamoeba invadens
RLPKYTKGAW

SEQ ID NO: 2773359 - protein, 8 aa, Entamoeba invadens
RLPPPAEW

SEQ ID NO: 2773360 - protein, 9 aa, Entamoeba invadens
RLPPSTDKL

SEQ ID NO: 2773361 - protein, 9 aa, Entamoeba invadens
RLPRPTGMN

SEQ ID NO: 2773362 - protein, 7 aa, Entamoeba invadens
RLPSALR

SEQ ID NO: 2773363 - protein, 21 aa, Entamoeba invadens
RLPSQDEVEEFKENSKEKMQD

SEQ ID NO: 2773364 - protein, 8 aa, Entamoeba invadens
RLPTPEEL

SEQ ID NO: 2773365 - protein, 12 aa, Entamoeba invadens
RLQGGNCEKCND

SEQ ID NO: 2773366 - protein, 11 aa, Entamoeba invadens
RLQKPNNVSDE

SEQ ID NO: 2773367 - protein, 10 aa, Entamoeba invadens
RLQRKENIPE

SEQ ID NO: 2773368 - protein, 6 aa, Entamoeba invadens
RLSEEV

SEQ ID NO: 2773369 - protein, 10 aa, Entamoeba invadens
RLSKPSDVDE

SEQ ID NO: 2773370 - protein, 8 aa, Entamoeba invadens
RLSKRDMM

SEQ ID NO: 2773371 - protein, 5 aa, Entamoeba invadens
RLSKS

SEQ ID NO: 2773372 - protein, 8 aa, Entamoeba invadens
RLSTSGDI

SEQ ID NO: 2773373 - protein, 6 aa, Entamoeba invadens
RLTDDV

SEQ ID NO: 2773374 - protein, 11 aa, Entamoeba invadens
RLTKPRKSVPV

SEQ ID NO: 2773375 - protein, 5 aa, Entamoeba invadens
RLTNN

SEQ ID NO: 2773376 - protein, 8 aa, Entamoeba invadens
RLTQPDKM

SEQ ID NO: 2773377 - protein, 8 aa, Entamoeba invadens
RLTQPRKM

SEQ ID NO: 2773378 - protein, 7 aa, Entamoeba invadens
RLTTDGS

SEQ ID NO: 2773379 - protein, 9 aa, Entamoeba invadens
RLYDQKETT

SEQ ID NO: 2773380 - protein, 52 aa, Entamoeba invadens
RMEEKGDEDVAQEISEESEGSEEIRSEDDEEEKEEHAKSTAIAKPTPIRRGK

SEQ ID NO: 2773381 - protein, 8 aa, Entamoeba invadens
RMERARTG

SEQ ID NO: 2773382 - protein, 11 aa, Entamoeba invadens
RMKQPDDTSSY

SEQ ID NO: 2773383 - protein, 9 aa, Entamoeba invadens
RMNEQGYGK

SEQ ID NO: 2773384 - protein, 10 aa, Entamoeba invadens
RMTSSQGEKI

SEQ ID NO: 2773385 - protein, 6 aa, Entamoeba invadens
RNAETG

SEQ ID NO: 2773386 - protein, 6 aa, Entamoeba invadens
RNANIQ

SEQ ID NO: 2773387 - protein, 7 aa, Entamoeba invadens
RNAQHRK

SEQ ID NO: 2773388 - protein, 8 aa, Entamoeba invadens
RNAVETSQ

SEQ ID NO: 2773389 - protein, 13 aa, Entamoeba invadens
RNAYDADEKFNQP

SEQ ID NO: 2773390 - protein, 7 aa, Entamoeba invadens
RNCGESI

SEQ ID NO: 2773391 - protein, 15 aa, Entamoeba invadens
RNCKATYEDKCGTSE

SEQ ID NO: 2773392 - protein, 7 aa, Entamoeba invadens
RNCTNEI

SEQ ID NO: 2773393 - protein, 9 aa, Entamoeba invadens
RNDDSSVAT

SEQ ID NO: 2773394 - protein, 10 aa, Entamoeba invadens
RNDETVKPRY

SEQ ID NO: 2773395 - protein, 9 aa, Entamoeba invadens
RNDGCGKGS

SEQ ID NO: 2773396 - protein, 9 aa, Entamoeba invadens
RNDKGKCEK

SEQ ID NO: 2773397 - protein, 21 aa, Entamoeba invadens
RNDKGQCENCTDNCDECNQKN

SEQ ID NO: 2773398 - protein, 9 aa, Entamoeba invadens
RNDKGQCQN

SEQ ID NO: 2773399 - protein, 7 aa, Entamoeba invadens
RNDNGTL

SEQ ID NO: 2773400 - protein, 7 aa, Entamoeba invadens
RNDQVNA

SEQ ID NO: 2773401 - protein, 14 aa, Entamoeba invadens
RNDRVARQMRDLSN

SEQ ID NO: 2773402 - protein, 15 aa, Entamoeba invadens
RNEESERVKEKYVEP

SEQ ID NO: 2773403 - protein, 5 aa, Entamoeba invadens
RNEIE

SEQ ID NO: 2773404 - protein, 7 aa, Entamoeba invadens
RNEITEK

SEQ ID NO: 2773405 - protein, 4 aa, Entamoeba invadens
RNEK

SEQ ID NO: 2773406 - protein, 9 aa, Entamoeba invadens
RNEKNQENV

SEQ ID NO: 2773407 - protein, 14 aa, Entamoeba invadens
RNEKYQLFETSTPT

SEQ ID NO: 2773408 - protein, 27 aa, Entamoeba invadens
RNENESDIINTDTPNTSNENKENNEHT

SEQ ID NO: 2773409 - protein, 7 aa, Entamoeba invadens
RNEPRQQ

SEQ ID NO: 2773410 - protein, 6 aa, Entamoeba invadens
RNESAS

SEQ ID NO: 2773411 - protein, 9 aa, Entamoeba invadens
RNESEKYEH

SEQ ID NO: 2773412 - protein, 18 aa, Entamoeba invadens
RNEVPERTKFTKNGSISS

SEQ ID NO: 2773413 - protein, 22 aa, Entamoeba invadens
RNGDIGNGDECKLDTEGCDGGC

SEQ ID NO: 2773414 - protein, 10 aa, Entamoeba invadens
RNGDSCETCR

SEQ ID NO: 2773415 - protein, 6 aa, Entamoeba invadens
RNGEQE

SEQ ID NO: 2773416 - protein, 4 aa, Entamoeba invadens
RNGG

SEQ ID NO: 2773417 - protein, 9 aa, Entamoeba invadens
RNGKYPKYG

SEQ ID NO: 2773418 - protein, 9 aa, Entamoeba invadens
RNGNSRRGR

SEQ ID NO: 2773419 - protein, 8 aa, Entamoeba invadens
RNHDIPKQ

SEQ ID NO: 2773420 - protein, 4 aa, Entamoeba invadens
RNKA

SEQ ID NO: 2773421 - protein, 14 aa, Entamoeba invadens
RNKEKKEKEKKHEK

SEQ ID NO: 2773422 - protein, 10 aa, Entamoeba invadens
RNKKIPDTNY

SEQ ID NO: 2773423 - protein, 4 aa, Entamoeba invadens
RNKN

SEQ ID NO: 2773424 - protein, 10 aa, Entamoeba invadens
RNKPTERPTF

SEQ ID NO: 2773425 - protein, 10 aa, Entamoeba invadens
RNKRSFEDSN

SEQ ID NO: 2773426 - protein, 5 aa, Entamoeba invadens
RNLNS

SEQ ID NO: 2773427 - protein, 8 aa, Entamoeba invadens
RNLPGENM

SEQ ID NO: 2773428 - protein, 11 aa, Entamoeba invadens
RNLTPEQEKEF

SEQ ID NO: 2773429 - protein, 8 aa, Entamoeba invadens
RNNEISKG

SEQ ID NO: 2773430 - protein, 11 aa, Entamoeba invadens
RNNFQERKQEI

SEQ ID NO: 2773431 - protein, 5 aa, Entamoeba invadens
RNNHT

SEQ ID NO: 2773432 - protein, 8 aa, Entamoeba invadens
RNNKGCER

SEQ ID NO: 2773433 - protein, 12 aa, Entamoeba invadens
RNNKGCERCSSG

SEQ ID NO: 2773434 - protein, 8 aa, Entamoeba invadens
RNNKGCQR

SEQ ID NO: 2773435 - protein, 4 aa, Entamoeba invadens
RNNL

SEQ ID NO: 2773436 - protein, 10 aa, Entamoeba invadens
RNNNKYTYSQ

SEQ ID NO: 2773437 - protein, 5 aa, Entamoeba invadens
RNNPR

SEQ ID NO: 2773438 - protein, 8 aa, Entamoeba invadens
RNNQNTNS

SEQ ID NO: 2773439 - protein, 20 aa, Entamoeba invadens
RNNYKNERITSDDGTNETEI

SEQ ID NO: 2773440 - protein, 9 aa, Entamoeba invadens
RNPLTKAEF

SEQ ID NO: 2773441 - protein, 9 aa, Entamoeba invadens
RNPTRVESF

SEQ ID NO: 2773442 - protein, 6 aa, Entamoeba invadens
RNQKTV

SEQ ID NO: 2773443 - protein, 15 aa, Entamoeba invadens
RNQRLRKNLDEIQKD

SEQ ID NO: 2773444 - protein, 5 aa, Entamoeba invadens
RNQRR

SEQ ID NO: 2773445 - protein, 6 aa, Entamoeba invadens
RNRDQN

SEQ ID NO: 2773446 - protein, 4 aa, Entamoeba invadens
RNRE

SEQ ID NO: 2773447 - protein, 4 aa, Entamoeba invadens
RNRK

SEQ ID NO: 2773448 - protein, 13 aa, Entamoeba invadens
RNRNTEQKAMQAE

SEQ ID NO: 2773449 - protein, 4 aa, Entamoeba invadens
RNRQ

SEQ ID NO: 2773450 - protein, 7 aa, Entamoeba invadens
RNRTKLE

SEQ ID NO: 2773451 - protein, 9 aa, Entamoeba invadens
RNSEGCSSS

SEQ ID NO: 2773452 - protein, 7 aa, Entamoeba invadens
RNSGAKD

SEQ ID NO: 2773453 - protein, 8 aa, Entamoeba invadens
RNSGCSNK

SEQ ID NO: 2773454 - protein, 9 aa, Entamoeba invadens
RNSKDVQAR

SEQ ID NO: 2773455 - protein, 8 aa, Entamoeba invadens
RNSPTDMT

SEQ ID NO: 2773456 - protein, 7 aa, Entamoeba invadens
RNSSKGV

SEQ ID NO: 2773457 - protein, 4 aa, Entamoeba invadens
RNST

SEQ ID NO: 2773458 - protein, 7 aa, Entamoeba invadens
RNSTVSQ

SEQ ID NO: 2773459 - protein, 9 aa, Entamoeba invadens
RNSTYQSGY

SEQ ID NO: 2773460 - protein, 9 aa, Entamoeba invadens
RNTDNSPVP

SEQ ID NO: 2773461 - protein, 4 aa, Entamoeba invadens
RNTL

SEQ ID NO: 2773462 - protein, 9 aa, Entamoeba invadens
RNTNTEDNS

SEQ ID NO: 2773463 - protein, 7 aa, Entamoeba invadens
RNTNTSL

SEQ ID NO: 2773464 - protein, 9 aa, Entamoeba invadens
RNTQKCSDF

SEQ ID NO: 2773465 - protein, 6 aa, Entamoeba invadens
RNTTEL

SEQ ID NO: 2773466 - protein, 12 aa, Entamoeba invadens
RNVLTPDERIQY

SEQ ID NO: 2773467 - protein, 5 aa, Entamoeba invadens
RNVVE

SEQ ID NO: 2773468 - protein, 11 aa, Entamoeba invadens
RPARNKDQTTF

SEQ ID NO: 2773469 - protein, 19 aa, Entamoeba invadens
RPDTQERDNDKDDEKDPYN

SEQ ID NO: 2773470 - protein, 6 aa, Entamoeba invadens
RPEKAK

SEQ ID NO: 2773471 - protein, 15 aa, Entamoeba invadens
RPEKIPKLTEQNARF

SEQ ID NO: 2773472 - protein, 9 aa, Entamoeba invadens
RPELEDRKN

SEQ ID NO: 2773473 - protein, 8 aa, Entamoeba invadens
RPENTMNR

SEQ ID NO: 2773474 - protein, 6 aa, Entamoeba invadens
RPEQSD

SEQ ID NO: 2773475 - protein, 6 aa, Entamoeba invadens
RPERMA

SEQ ID NO: 2773476 - protein, 5 aa, Entamoeba invadens
RPGHV

SEQ ID NO: 2773477 - protein, 4 aa, Entamoeba invadens
RPGK

SEQ ID NO: 2773478 - protein, 16 aa, Entamoeba invadens
RPISDTFANTKAVSTR

SEQ ID NO: 2773479 - protein, 8 aa, Entamoeba invadens
RPKDASLS

SEQ ID NO: 2773480 - protein, 4 aa, Entamoeba invadens
RPKG

SEQ ID NO: 2773481 - protein, 6 aa, Entamoeba invadens
RPKNVA

SEQ ID NO: 2773482 - protein, 8 aa, Entamoeba invadens
RPKQSPTI

SEQ ID NO: 2773483 - protein, 5 aa, Entamoeba invadens
RPKQV

SEQ ID NO: 2773484 - protein, 7 aa, Entamoeba invadens
RPKREEL

SEQ ID NO: 2773485 - protein, 8 aa, Entamoeba invadens
RPKSEKDV

SEQ ID NO: 2773486 - protein, 9 aa, Entamoeba invadens
RPKSLTNGE

SEQ ID NO: 2773487 - protein, 4 aa, Entamoeba invadens
RPLI

SEQ ID NO: 2773488 - protein, 8 aa, Entamoeba invadens
RPLSDGKH

SEQ ID NO: 2773489 - protein, 21 aa, Entamoeba invadens
RPLSPHSPRFSPSSRALSSTE

SEQ ID NO: 2773490 - protein, 7 aa, Entamoeba invadens
RPMPPCA

SEQ ID NO: 2773491 - protein, 4 aa, Entamoeba invadens
RPNE

SEQ ID NO: 2773492 - protein, 5 aa, Entamoeba invadens
RPNET

SEQ ID NO: 2773493 - protein, 10 aa, Entamoeba invadens
RPNISSVDKD

SEQ ID NO: 2773494 - protein, 7 aa, Entamoeba invadens
RPNNDRD

SEQ ID NO: 2773495 - protein, 6 aa, Entamoeba invadens
RPNNKR

SEQ ID NO: 2773496 - protein, 5 aa, Entamoeba invadens
RPNNT

SEQ ID NO: 2773497 - protein, 6 aa, Entamoeba invadens
RPPATV

SEQ ID NO: 2773498 - protein, 8 aa, Entamoeba invadens
RPPLNGNC

SEQ ID NO: 2773499 - protein, 11 aa, Entamoeba invadens
RPPSQSNLNED

SEQ ID NO: 2773500 - protein, 4 aa, Entamoeba invadens
RPQF

SEQ ID NO: 2773501 - protein, 6 aa, Entamoeba invadens
RPQPHV

SEQ ID NO: 2773502 - protein, 4 aa, Entamoeba invadens
RPRP

SEQ ID NO: 2773503 - protein, 4 aa, Entamoeba invadens
RPSI

SEQ ID NO: 2773504 - protein, 11 aa, Entamoeba invadens
RPSKQAKITTQ

SEQ ID NO: 2773505 - protein, 10 aa, Entamoeba invadens
RPSPAEKKRT

SEQ ID NO: 2773506 - protein, 7 aa, Entamoeba invadens
RPSPDGS

SEQ ID NO: 2773507 - protein, 7 aa, Entamoeba invadens
RPSPPFA

SEQ ID NO: 2773508 - protein, 4 aa, Entamoeba invadens
RPTC

SEQ ID NO: 2773509 - protein, 8 aa, Entamoeba invadens
RPTFSPPL

SEQ ID NO: 2773510 - protein, 11 aa, Entamoeba invadens
RPTRKTTTNVR

SEQ ID NO: 2773511 - protein, 6 aa, Entamoeba invadens
RPVNTH

SEQ ID NO: 2773512 - protein, 39 aa, Entamoeba invadens
RPVTERYSKADGENFDNITQKNEVQDAKINQSQNTTKIV

SEQ ID NO: 2773513 - protein, 5 aa, Entamoeba invadens
RPYPE

SEQ ID NO: 2773514 - protein, 6 aa, Entamoeba invadens
RPYSYN

SEQ ID NO: 2773515 - protein, 5 aa, Entamoeba invadens
RQAVP

SEQ ID NO: 2773516 - protein, 8 aa, Entamoeba invadens
RQCDGPDG

SEQ ID NO: 2773517 - protein, 7 aa, Entamoeba invadens
RQCRSGV

SEQ ID NO: 2773518 - protein, 9 aa, Entamoeba invadens
RQDGEGLSP

SEQ ID NO: 2773519 - protein, 5 aa, Entamoeba invadens
RQDID

SEQ ID NO: 2773520 - protein, 6 aa, Entamoeba invadens
RQDKED

SEQ ID NO: 2773521 - protein, 7 aa, Entamoeba invadens
RQDTPVC

SEQ ID NO: 2773522 - protein, 15 aa, Entamoeba invadens
RQEDANRKNEERVGM

SEQ ID NO: 2773523 - protein, 5 aa, Entamoeba invadens
RQEEE

SEQ ID NO: 2773524 - protein, 6 aa, Entamoeba invadens
RQEEER

SEQ ID NO: 2773525 - protein, 6 aa, Entamoeba invadens
RQEIDD

SEQ ID NO: 2773526 - protein, 11 aa, Entamoeba invadens
RQEKVGVNTKR

SEQ ID NO: 2773527 - protein, 5 aa, Entamoeba invadens
RQEND

SEQ ID NO: 2773528 - protein, 24 aa, Entamoeba invadens
RQENELKQMTSDVATAERAIDTVK

SEQ ID NO: 2773529 - protein, 9 aa, Entamoeba invadens
RQENKKQKT

SEQ ID NO: 2773530 - protein, 6 aa, Entamoeba invadens
RQGASN

SEQ ID NO: 2773531 - protein, 7 aa, Entamoeba invadens
RQGDAMT

SEQ ID NO: 2773532 - protein, 10 aa, Entamoeba invadens
RQGEDDKTCS

SEQ ID NO: 2773533 - protein, 4 aa, Entamoeba invadens
RQGI

SEQ ID NO: 2773534 - protein, 7 aa, Entamoeba invadens
RQGKEGV

SEQ ID NO: 2773535 - protein, 5 aa, Entamoeba invadens
RQGPA

SEQ ID NO: 2773536 - protein, 7 aa, Entamoeba invadens
RQIDAET

SEQ ID NO: 2773537 - protein, 7 aa, Entamoeba invadens
RQIGEGS

SEQ ID NO: 2773538 - protein, 10 aa, Entamoeba invadens
RQKDNQYIPS

SEQ ID NO: 2773539 - protein, 7 aa, Entamoeba invadens
RQKEEEI

SEQ ID NO: 2773540 - protein, 5 aa, Entamoeba invadens
RQKEI

SEQ ID NO: 2773541 - protein, 14 aa, Entamoeba invadens
RQKGKTEESEIEKG

SEQ ID NO: 2773542 - protein, 12 aa, Entamoeba invadens
RQKGQNADKFEK

SEQ ID NO: 2773543 - protein, 9 aa, Entamoeba invadens
RQKKDKDVL

SEQ ID NO: 2773544 - protein, 9 aa, Entamoeba invadens
RQKKIKKTA

SEQ ID NO: 2773545 - protein, 10 aa, Entamoeba invadens
RQKKTEKTRT

SEQ ID NO: 2773546 - protein, 5 aa, Entamoeba invadens
RQKNF

SEQ ID NO: 2773547 - protein, 9 aa, Entamoeba invadens
RQKNPLNRK

SEQ ID NO: 2773548 - protein, 10 aa, Entamoeba invadens
RQKPTGIGYG

SEQ ID NO: 2773549 - protein, 13 aa, Entamoeba invadens
RQKPYEKLKQPIK

SEQ ID NO: 2773550 - protein, 11 aa, Entamoeba invadens
RQKQKTPDCGY

SEQ ID NO: 2773551 - protein, 9 aa, Entamoeba invadens
RQKTKKEEA

SEQ ID NO: 2773552 - protein, 10 aa, Entamoeba invadens
RQKYKKSADV

SEQ ID NO: 2773553 - protein, 11 aa, Entamoeba invadens
RQLRNKTVSPL

SEQ ID NO: 2773554 - protein, 20 aa, Entamoeba invadens
RQMPKTLPDIKEKPKKTAKP

SEQ ID NO: 2773555 - protein, 8 aa, Entamoeba invadens
RQMQSTQQ

SEQ ID NO: 2773556 - protein, 25 aa, Entamoeba invadens
RQMSGDKEDSDSTTDDKDEDKTDLV

SEQ ID NO: 2773557 - protein, 15 aa, Entamoeba invadens
RQNESDEKREKNEKK

SEQ ID NO: 2773558 - protein, 32 aa, Entamoeba invadens
RQNETEEVKEKRRKSQRDHLREKRRNETIEEK

SEQ ID NO: 2773559 - protein, 7 aa, Entamoeba invadens
RQNQTAK

SEQ ID NO: 2773560 - protein, 10 aa, Entamoeba invadens
RQPGENVKHI

SEQ ID NO: 2773561 - protein, 40 aa, Entamoeba invadens
RQQAQQQQQQNNGSNTTTQNTQQNVTQNQPAAHPQRQEST

SEQ ID NO: 2773562 - protein, 5 aa, Entamoeba invadens
RQQIS

SEQ ID NO: 2773563 - protein, 6 aa, Entamoeba invadens
RQQPEV

SEQ ID NO: 2773564 - protein, 14 aa, Entamoeba invadens
RQQPPKKETAAPSV

SEQ ID NO: 2773565 - protein, 13 aa, Entamoeba invadens
RQQRDMANREYTD

SEQ ID NO: 2773566 - protein, 8 aa, Entamoeba invadens
RQQRTNQV

SEQ ID NO: 2773567 - protein, 4 aa, Entamoeba invadens
RQRC

SEQ ID NO: 2773568 - protein, 6 aa, Entamoeba invadens
RQRDVQ

SEQ ID NO: 2773569 - protein, 8 aa, Entamoeba invadens
RQSGGKTI

SEQ ID NO: 2773570 - protein, 11 aa, Entamoeba invadens
RQSKRANPTDV

SEQ ID NO: 2773571 - protein, 7 aa, Entamoeba invadens
RQTAQKT

SEQ ID NO: 2773572 - protein, 5 aa, Entamoeba invadens
RQTDE

SEQ ID NO: 2773573 - protein, 16 aa, Entamoeba invadens
RQTETGGLNGRPEKLP

SEQ ID NO: 2773574 - protein, 5 aa, Entamoeba invadens
RQTLT

SEQ ID NO: 2773575 - protein, 14 aa, Entamoeba invadens
RQTMKEREKEIKPF

SEQ ID NO: 2773576 - protein, 6 aa, Entamoeba invadens
RQTNET

SEQ ID NO: 2773577 - protein, 4 aa, Entamoeba invadens
RQVP

SEQ ID NO: 2773578 - protein, 6 aa, Entamoeba invadens
RQVSER

SEQ ID NO: 2773579 - protein, 6 aa, Entamoeba invadens
RQYSPE

SEQ ID NO: 2773580 - protein, 13 aa, Entamoeba invadens
RRAEYHSDTIPNP

SEQ ID NO: 2773581 - protein, 12 aa, Entamoeba invadens
RRAGVGASDLKK

SEQ ID NO: 2773582 - protein, 34 aa, Entamoeba invadens
  misc_feature (17)..(18): Xaa can be any naturally occurring amino acid
RRAPTQPLQQPYQSNPXXENQSEGICAVNERASK

SEQ ID NO: 2773583 - protein, 5 aa, Entamoeba invadens
RRCSS

SEQ ID NO: 2773584 - protein, 13 aa, Entamoeba invadens
RRDAPVENQKRER

SEQ ID NO: 2773585 - protein, 5 aa, Entamoeba invadens
RRDEY

SEQ ID NO: 2773586 - protein, 6 aa, Entamoeba invadens
RRDRNM

SEQ ID NO: 2773587 - protein, 8 aa, Entamoeba invadens
RRDVPPHE

SEQ ID NO: 2773588 - protein, 4 aa, Entamoeba invadens
RREA

SEQ ID NO: 2773589 - protein, 11 aa, Entamoeba invadens
RREQKQRETEI

SEQ ID NO: 2773590 - protein, 10 aa, Entamoeba invadens
RRESGKGLYT

SEQ ID NO: 2773591 - protein, 6 aa, Entamoeba invadens
RRETQE

SEQ ID NO: 2773592 - protein, 5 aa, Entamoeba invadens
RRGDT

SEQ ID NO: 2773593 - protein, 8 aa, Entamoeba invadens
RRGETQSE

SEQ ID NO: 2773594 - protein, 7 aa, Entamoeba invadens
RRGNMET

SEQ ID NO: 2773595 - protein, 7 aa, Entamoeba invadens
RRIKPED

SEQ ID NO: 2773596 - protein, 7 aa, Entamoeba invadens
RRKGREM

SEQ ID NO: 2773597 - protein, 8 aa, Entamoeba invadens
RRKKAQKE

SEQ ID NO: 2773598 - protein, 5 aa, Entamoeba invadens
RRKKE

SEQ ID NO: 2773599 - protein, 6 aa, Entamoeba invadens
RRKKYT

SEQ ID NO: 2773600 - protein, 4 aa, Entamoeba invadens
RRKN

SEQ ID NO: 2773601 - protein, 10 aa, Entamoeba invadens
RRMDSKKEYF

SEQ ID NO: 2773602 - protein, 20 aa, Entamoeba invadens
RRMEEENTRQKKKKNFGSRD

SEQ ID NO: 2773603 - protein, 9 aa, Entamoeba invadens
RRMTPAEKQ

SEQ ID NO: 2773604 - protein, 4 aa, Entamoeba invadens
RRND

SEQ ID NO: 2773605 - protein, 4 aa, Entamoeba invadens
RRNS

SEQ ID NO: 2773606 - protein, 13 aa, Entamoeba invadens
RRNSTNATHADPF

SEQ ID NO: 2773607 - protein, 11 aa, Entamoeba invadens
RRPHLTPEQVR

SEQ ID NO: 2773608 - protein, 14 aa, Entamoeba invadens
RRPSDNMKSDEAKG

SEQ ID NO: 2773609 - protein, 4 aa, Entamoeba invadens
RRPT

SEQ ID NO: 2773610 - protein, 40 aa, Entamoeba invadens
RRPVPKKSKKSSKVVGNVTTQNEIKTKKPANNEQKNKTDL

SEQ ID NO: 2773611 - protein, 4 aa, Entamoeba invadens
RRQK

SEQ ID NO: 2773612 - protein, 4 aa, Entamoeba invadens
RRSE

SEQ ID NO: 2773613 - protein, 7 aa, Entamoeba invadens
RRSFSNG

SEQ ID NO: 2773614 - protein, 13 aa, Entamoeba invadens
RRSKDITSTVHHE

SEQ ID NO: 2773615 - protein, 9 aa, Entamoeba invadens
RRSQHSAEV

SEQ ID NO: 2773616 - protein, 5 aa, Entamoeba invadens
RRSRM

SEQ ID NO: 2773617 - protein, 11 aa, Entamoeba invadens
RRTEKERETEI

SEQ ID NO: 2773618 - protein, 10 aa, Entamoeba invadens
RRTKTSDPAM

SEQ ID NO: 2773619 - protein, 15 aa, Entamoeba invadens
RRTNADEYGNYIYFS

SEQ ID NO: 2773620 - protein, 25 aa, Entamoeba invadens
RRVSSDKIYETGYEPAQPTKTSEEN

SEQ ID NO: 2773621 - protein, 14 aa, Entamoeba invadens
RRVTVNNGELSCDG

SEQ ID NO: 2773622 - protein, 9 aa, Entamoeba invadens
RSANGQDHF

SEQ ID NO: 2773623 - protein, 9 aa, Entamoeba invadens
RSASEYTPT

SEQ ID NO: 2773624 - protein, 9 aa, Entamoeba invadens
RSASGKTRI

SEQ ID NO: 2773625 - protein, 7 aa, Entamoeba invadens
RSASPNA

SEQ ID NO: 2773626 - protein, 13 aa, Entamoeba invadens
RSASSTQASYSIA

SEQ ID NO: 2773627 - protein, 7 aa, Entamoeba invadens
RSAVTPN

SEQ ID NO: 2773628 - protein, 30 aa, Entamoeba invadens
RSCKKCKDGYSPYYKSSSPNTVRCSKDDGK

SEQ ID NO: 2773629 - protein, 11 aa, Entamoeba invadens
RSCSDNYDQDN

SEQ ID NO: 2773630 - protein, 9 aa, Entamoeba invadens
RSDARVKEN

SEQ ID NO: 2773631 - protein, 10 aa, Entamoeba invadens
RSDARYKRDI

SEQ ID NO: 2773632 - protein, 11 aa, Entamoeba invadens
RSDEKSKTHFQ

SEQ ID NO: 2773633 - protein, 12 aa, Entamoeba invadens
RSDHKSTQKGEH

SEQ ID NO: 2773634 - protein, 14 aa, Entamoeba invadens
RSDNFDDPKTGERI

SEQ ID NO: 2773635 - protein, 8 aa, Entamoeba invadens
RSDRKNVP

SEQ ID NO: 2773636 - protein, 7 aa, Entamoeba invadens
RSDRRFK

SEQ ID NO: 2773637 - protein, 7 aa, Entamoeba invadens
RSDSTYY

SEQ ID NO: 2773638 - protein, 8 aa, Entamoeba invadens
RSDTDPSL

SEQ ID NO: 2773639 - protein, 13 aa, Entamoeba invadens
RSDTTSDSTCQSN

SEQ ID NO: 2773640 - protein, 7 aa, Entamoeba invadens
RSEDSNL

SEQ ID NO: 2773641 - protein, 13 aa, Entamoeba invadens
RSEEKEKIDNAEK

SEQ ID NO: 2773642 - protein, 18 aa, Entamoeba invadens
RSEEKRAPTVDTESQQFN

SEQ ID NO: 2773643 - protein, 16 aa, Entamoeba invadens
RSEFNTKNDENKPLTI

SEQ ID NO: 2773644 - protein, 4 aa, Entamoeba invadens
RSEG

SEQ ID NO: 2773645 - protein, 12 aa, Entamoeba invadens
RSEKEKVGGRTD

SEQ ID NO: 2773646 - protein, 6 aa, Entamoeba invadens
RSEMPK

SEQ ID NO: 2773647 - protein, 4 aa, Entamoeba invadens
RSEN

SEQ ID NO: 2773648 - protein, 5 aa, Entamoeba invadens
RSEPS

SEQ ID NO: 2773649 - protein, 12 aa, Entamoeba invadens
RSERVKRSLHEI

SEQ ID NO: 2773650 - protein, 15 aa, Entamoeba invadens
RSFKTDEQFATSPSF

SEQ ID NO: 2773651 - protein, 4 aa, Entamoeba invadens
RSFN

SEQ ID NO: 2773652 - protein, 4 aa, Entamoeba invadens
RSGA

SEQ ID NO: 2773653 - protein, 16 aa, Entamoeba invadens
RSGEIGRQFLKKTTSN

SEQ ID NO: 2773654 - protein, 11 aa, Entamoeba invadens
RSGKNNETTSY

SEQ ID NO: 2773655 - protein, 8 aa, Entamoeba invadens
RSGNISTS

SEQ ID NO: 2773656 - protein, 5 aa, Entamoeba invadens
RSGQY

SEQ ID NO: 2773657 - protein, 4 aa, Entamoeba invadens
RSGT

SEQ ID NO: 2773658 - protein, 5 aa, Entamoeba invadens
RSGTM

SEQ ID NO: 2773659 - protein, 7 aa, Entamoeba invadens
RSGVGET

SEQ ID NO: 2773660 - protein, 7 aa, Entamoeba invadens
RSGVSSI

SEQ ID NO: 2773661 - protein, 4 aa, Entamoeba invadens
RSIG

SEQ ID NO: 2773662 - protein, 5 aa, Entamoeba invadens
RSKDL

SEQ ID NO: 2773663 - protein, 9 aa, Entamoeba invadens
RSKEYKNSV

SEQ ID NO: 2773664 - protein, 7 aa, Entamoeba invadens
RSKKALS

SEQ ID NO: 2773665 - protein, 11 aa, Entamoeba invadens
RSKREKQIESV

SEQ ID NO: 2773666 - protein, 5 aa, Entamoeba invadens
RSKSG

SEQ ID NO: 2773667 - protein, 8 aa, Entamoeba invadens
RSKTPVST

SEQ ID NO: 2773668 - protein, 7 aa, Entamoeba invadens
RSLTSAK

SEQ ID NO: 2773669 - protein, 4 aa, Entamoeba invadens
RSMP

SEQ ID NO: 2773670 - protein, 10 aa, Entamoeba invadens
RSMSDHDTDK

SEQ ID NO: 2773671 - protein, 7 aa, Entamoeba invadens
RSNAIAK

SEQ ID NO: 2773672 - protein, 8 aa, Entamoeba invadens
RSNEGTCE

SEQ ID NO: 2773673 - protein, 6 aa, Entamoeba invadens
RSNGTC

SEQ ID NO: 2773674 - protein, 6 aa, Entamoeba invadens
RSNKHV

SEQ ID NO: 2773675 - protein, 9 aa, Entamoeba invadens
RSNLDKDEC

SEQ ID NO: 2773676 - protein, 7 aa, Entamoeba invadens
RSNQHVG

SEQ ID NO: 2773677 - protein, 20 aa, Entamoeba invadens
RSNSSSSPKTRNTPSPRQQQ

SEQ ID NO: 2773678 - protein, 9 aa, Entamoeba invadens
RSNTEKAKN

SEQ ID NO: 2773679 - protein, 10 aa, Entamoeba invadens
RSNTSKCSSG

SEQ ID NO: 2773680 - protein, 22 aa, Entamoeba invadens
RSNYSKNGVLTKKTEINYNDST

SEQ ID NO: 2773681 - protein, 5 aa, Entamoeba invadens
RSPDI

SEQ ID NO: 2773682 - protein, 17 aa, Entamoeba invadens
RSPLVSSTSNLANDVRG

SEQ ID NO: 2773683 - protein, 29 aa, Entamoeba invadens
RSPVGAGMKEDKPIQKVEEKKEEKNEEVK

SEQ ID NO: 2773684 - protein, 7 aa, Entamoeba invadens
RSQEKTV

SEQ ID NO: 2773685 - protein, 15 aa, Entamoeba invadens
RSQNQEEEKKTVEKE

SEQ ID NO: 2773686 - protein, 6 aa, Entamoeba invadens
RSQQLN

SEQ ID NO: 2773687 - protein, 5 aa, Entamoeba invadens
RSQRR

SEQ ID NO: 2773688 - protein, 5 aa, Entamoeba invadens
RSQSI

SEQ ID NO: 2773689 - protein, 7 aa, Entamoeba invadens
RSQTDGV

SEQ ID NO: 2773690 - protein, 6 aa, Entamoeba invadens
RSRCDG

SEQ ID NO: 2773691 - protein, 8 aa, Entamoeba invadens
RSRNVGQS

SEQ ID NO: 2773692 - protein, 9 aa, Entamoeba invadens
RSRRNFSGS

SEQ ID NO: 2773693 - protein, 5 aa, Entamoeba invadens
RSRSC

SEQ ID NO: 2773694 - protein, 7 aa, Entamoeba invadens
RSSCTNT

SEQ ID NO: 2773695 - protein, 6 aa, Entamoeba invadens
RSSDGY

SEQ ID NO: 2773696 - protein, 7 aa, Entamoeba invadens
RSSDMSG

SEQ ID NO: 2773697 - protein, 14 aa, Entamoeba invadens
RSSDSKQIDDNSPE

SEQ ID NO: 2773698 - protein, 7 aa, Entamoeba invadens
RSSDTKQ

SEQ ID NO: 2773699 - protein, 19 aa, Entamoeba invadens
RSSELSAIETRTSTGAGLV

SEQ ID NO: 2773700 - protein, 5 aa, Entamoeba invadens
RSSGV

SEQ ID NO: 2773701 - protein, 9 aa, Entamoeba invadens
RSSKSSKKM

SEQ ID NO: 2773702 - protein, 17 aa, Entamoeba invadens
RSSMATNVSSNDTSEIV

SEQ ID NO: 2773703 - protein, 5 aa, Entamoeba invadens
RSSMG

SEQ ID NO: 2773704 - protein, 5 aa, Entamoeba invadens
RSSMP

SEQ ID NO: 2773705 - protein, 4 aa, Entamoeba invadens
RSSN

SEQ ID NO: 2773706 - protein, 17 aa, Entamoeba invadens
RSSPKLTKKFEKTKSLQ

SEQ ID NO: 2773707 - protein, 15 aa, Entamoeba invadens
RSSPNRGKSCPDASP

SEQ ID NO: 2773708 - protein, 6 aa, Entamoeba invadens
RSSPTL

SEQ ID NO: 2773709 - protein, 4 aa, Entamoeba invadens
RSSS

SEQ ID NO: 2773710 - protein, 8 aa, Entamoeba invadens
RSSTNKFP

SEQ ID NO: 2773711 - protein, 19 aa, Entamoeba invadens
RSSYKYSTQLSQIDADDPI

SEQ ID NO: 2773712 - protein, 9 aa, Entamoeba invadens
RSTDGRTCE

SEQ ID NO: 2773713 - protein, 4 aa, Entamoeba invadens
RSTG

SEQ ID NO: 2773714 - protein, 12 aa, Entamoeba invadens
RSTIQEINTNRR

SEQ ID NO: 2773715 - protein, 10 aa, Entamoeba invadens
RSTKDISKVD

SEQ ID NO: 2773716 - protein, 7 aa, Entamoeba invadens
RSTKSLS

SEQ ID NO: 2773717 - protein, 4 aa, Entamoeba invadens
RSTL

SEQ ID NO: 2773718 - protein, 5 aa, Entamoeba invadens
RSTNI

SEQ ID NO: 2773719 - protein, 6 aa, Entamoeba invadens
RSTPNV

SEQ ID NO: 2773720 - protein, 10 aa, Entamoeba invadens
RSTQRESAYT

SEQ ID NO: 2773721 - protein, 5 aa, Entamoeba invadens
RSTYD

SEQ ID NO: 2773722 - protein, 5 aa, Entamoeba invadens
RSVGA

SEQ ID NO: 2773723 - protein, 5 aa, Entamoeba invadens
RSVGG

SEQ ID NO: 2773724 - protein, 7 aa, Entamoeba invadens
RSVQTRA

SEQ ID NO: 2773725 - protein, 8 aa, Entamoeba invadens
RSVRTTPY

SEQ ID NO: 2773726 - protein, 7 aa, Entamoeba invadens
RSVSQNA

SEQ ID NO: 2773727 - protein, 7 aa, Entamoeba invadens
RSVTPSK

SEQ ID NO: 2773728 - protein, 10 aa, Entamoeba invadens
RSYKKNGVYT

SEQ ID NO: 2773729 - protein, 24 aa, Entamoeba invadens
RSYQRSRYSTTSRHSVTQGILLKL

SEQ ID NO: 2773730 - protein, 4 aa, Entamoeba invadens
RTAE

SEQ ID NO: 2773731 - protein, 11 aa, Entamoeba invadens
RTAGFSSDARK

SEQ ID NO: 2773732 - protein, 27 aa, Entamoeba invadens
RTAGTKTLKQIQNSLNAKTETEETVTP

SEQ ID NO: 2773733 - protein, 20 aa, Entamoeba invadens
RTAKGGEYAQMSDSEQTESP

SEQ ID NO: 2773734 - protein, 6 aa, Entamoeba invadens
RTANDF

SEQ ID NO: 2773735 - protein, 7 aa, Entamoeba invadens
RTAQDGM

SEQ ID NO: 2773736 - protein, 5 aa, Entamoeba invadens
RTCEK

SEQ ID NO: 2773737 - protein, 10 aa, Entamoeba invadens
RTCGNSPSQC

SEQ ID NO: 2773738 - protein, 6 aa, Entamoeba invadens
RTCQSA

SEQ ID NO: 2773739 - protein, 8 aa, Entamoeba invadens
RTDDGGAS

SEQ ID NO: 2773740 - protein, 6 aa, Entamoeba invadens
RTDHRH

SEQ ID NO: 2773741 - protein, 16 aa, Entamoeba invadens
RTDKDYQAQFNSKTLQ

SEQ ID NO: 2773742 - protein, 4 aa, Entamoeba invadens
RTDL

SEQ ID NO: 2773743 - protein, 7 aa, Entamoeba invadens
RTDNPYG

SEQ ID NO: 2773744 - protein, 11 aa, Entamoeba invadens
RTDPKNRPTAE

SEQ ID NO: 2773745 - protein, 9 aa, Entamoeba invadens
RTDPYDNNS

SEQ ID NO: 2773746 - protein, 8 aa, Entamoeba invadens
RTEDNTQY

SEQ ID NO: 2773747 - protein, 7 aa, Entamoeba invadens
RTEHCDK

SEQ ID NO: 2773748 - protein, 5 aa, Entamoeba invadens
RTEIE

SEQ ID NO: 2773749 - protein, 14 aa, Entamoeba invadens
RTEKMQKQINELYR

SEQ ID NO: 2773750 - protein, 31 aa, Entamoeba invadens
RTENSNEEVANKTDITIKEEKSSKSSSDSTP

SEQ ID NO: 2773751 - protein, 14 aa, Entamoeba invadens
RTEPQIASIPKKKA

SEQ ID NO: 2773752 - protein, 11 aa, Entamoeba invadens
RTEQNSYISTK

SEQ ID NO: 2773753 - protein, 6 aa, Entamoeba invadens
RTERIE

SEQ ID NO: 2773754 - protein, 11 aa, Entamoeba invadens
RTESCDNGTHC

SEQ ID NO: 2773755 - protein, 5 aa, Entamoeba invadens
RTETE

SEQ ID NO: 2773756 - protein, 12 aa, Entamoeba invadens
RTETNRDDAFEE

SEQ ID NO: 2773757 - protein, 7 aa, Entamoeba invadens
RTETRNV

SEQ ID NO: 2773758 - protein, 7 aa, Entamoeba invadens
RTFEDSK

SEQ ID NO: 2773759 - protein, 11 aa, Entamoeba invadens
RTFPNDPLMTE

SEQ ID NO: 2773760 - protein, 5 aa, Entamoeba invadens
RTGGI

SEQ ID NO: 2773761 - protein, 10 aa, Entamoeba invadens
RTGKATEMTK

SEQ ID NO: 2773762 - protein, 34 aa, Entamoeba invadens
RTGKKDNNNDMPNSPKDSKLCEQAKGVNESENVP

SEQ ID NO: 2773763 - protein, 10 aa, Entamoeba invadens
RTGKRFETNK

SEQ ID NO: 2773764 - protein, 8 aa, Entamoeba invadens
RTGPINTR

SEQ ID NO: 2773765 - protein, 7 aa, Entamoeba invadens
RTHKSSA

SEQ ID NO: 2773766 - protein, 20 aa, Entamoeba invadens
RTHSSKGDEDKEQDKKSCED

SEQ ID NO: 2773767 - protein, 4 aa, Entamoeba invadens
RTIQ

SEQ ID NO: 2773768 - protein, 9 aa, Entamoeba invadens
RTIRENDPD

SEQ ID NO: 2773769 - protein, 9 aa, Entamoeba invadens
RTKETTTNC

SEQ ID NO: 2773770 - protein, 7 aa, Entamoeba invadens
RTKNSQE

SEQ ID NO: 2773771 - protein, 8 aa, Entamoeba invadens
RTKSSETA

SEQ ID NO: 2773772 - protein, 4 aa, Entamoeba invadens
RTLA

SEQ ID NO: 2773773 - protein, 12 aa, Entamoeba invadens
RTLNNDGTPTDT

SEQ ID NO: 2773774 - protein, 4 aa, Entamoeba invadens
RTNE

SEQ ID NO: 2773775 - protein, 6 aa, Entamoeba invadens
RTNEEL

SEQ ID NO: 2773776 - protein, 7 aa, Entamoeba invadens
RTNEQRL

SEQ ID NO: 2773777 - protein, 5 aa, Entamoeba invadens
RTNHS

SEQ ID NO: 2773778 - protein, 12 aa, Entamoeba invadens
RTNQSDETKTEI

SEQ ID NO: 2773779 - protein, 13 aa, Entamoeba invadens
RTNRIQKQINSFS

SEQ ID NO: 2773780 - protein, 13 aa, Entamoeba invadens
RTNSESTEYGTGD

SEQ ID NO: 2773781 - protein, 9 aa, Entamoeba invadens
RTPGSQEWK

SEQ ID NO: 2773782 - protein, 6 aa, Entamoeba invadens
RTPNQF

SEQ ID NO: 2773783 - protein, 5 aa, Entamoeba invadens
RTPPD

SEQ ID NO: 2773784 - protein, 5 aa, Entamoeba invadens
RTPRI

SEQ ID NO: 2773785 - protein, 6 aa, Entamoeba invadens
RTPSSK

SEQ ID NO: 2773786 - protein, 6 aa, Entamoeba invadens
RTPSSL

SEQ ID NO: 2773787 - protein, 12 aa, Entamoeba invadens
RTPTRSDEEIID

SEQ ID NO: 2773788 - protein, 5 aa, Entamoeba invadens
RTPTY

SEQ ID NO: 2773789 - protein, 8 aa, Entamoeba invadens
RTPTYNNE

SEQ ID NO: 2773790 - protein, 6 aa, Entamoeba invadens
RTPTYT

SEQ ID NO: 2773791 - protein, 13 aa, Entamoeba invadens
RTPYSEQRSNDAF

SEQ ID NO: 2773792 - protein, 6 aa, Entamoeba invadens
RTPYTD

SEQ ID NO: 2773793 - protein, 5 aa, Entamoeba invadens
RTQHD

SEQ ID NO: 2773794 - protein, 7 aa, Entamoeba invadens
RTQNEIT

SEQ ID NO: 2773795 - protein, 14 aa, Entamoeba invadens
RTQRMQKQLNDISR

SEQ ID NO: 2773796 - protein, 8 aa, Entamoeba invadens
RTRETQTK

SEQ ID NO: 2773797 - protein, 45 aa, Entamoeba invadens
RTRQKSTTSQITVSPTPTSGAASSVPSNPKVSQSSSEDHSSLSNV

SEQ ID NO: 2773798 - protein, 11 aa, Entamoeba invadens
RTRTRPCKYKN

SEQ ID NO: 2773799 - protein, 8 aa, Entamoeba invadens
RTSDDEMK

SEQ ID NO: 2773800 - protein, 6 aa, Entamoeba invadens
RTSENV

SEQ ID NO: 2773801 - protein, 6 aa, Entamoeba invadens
RTSEYD

SEQ ID NO: 2773802 - protein, 5 aa, Entamoeba invadens
RTSFN

SEQ ID NO: 2773803 - protein, 16 aa, Entamoeba invadens
RTSFSSHTTFVPLVIV

SEQ ID NO: 2773804 - protein, 26 aa, Entamoeba invadens
RTSGPVSATKSGVRLTPNGRGKSGFF

SEQ ID NO: 2773805 - protein, 8 aa, Entamoeba invadens
RTSLEKAS

SEQ ID NO: 2773806 - protein, 27 aa, Entamoeba invadens
RTSNDKGFARNRADEVFEEDERVTTRG

SEQ ID NO: 2773807 - protein, 8 aa, Entamoeba invadens
RTSPESKL

SEQ ID NO: 2773808 - protein, 6 aa, Entamoeba invadens
RTSPNI

SEQ ID NO: 2773809 - protein, 5 aa, Entamoeba invadens
RTSPQ

SEQ ID NO: 2773810 - protein, 4 aa, Entamoeba invadens
RTSQ

SEQ ID NO: 2773811 - protein, 4 aa, Entamoeba invadens
RTSS

SEQ ID NO: 2773812 - protein, 10 aa, Entamoeba invadens
RTSSANSITN

SEQ ID NO: 2773813 - protein, 13 aa, Entamoeba invadens
RTSSSAFMPDAQE

SEQ ID NO: 2773814 - protein, 11 aa, Entamoeba invadens
RTSTEKQTEIT

SEQ ID NO: 2773815 - protein, 9 aa, Entamoeba invadens
RTTAYENAR

SEQ ID NO: 2773816 - protein, 4 aa, Entamoeba invadens
RTTF

SEQ ID NO: 2773817 - protein, 9 aa, Entamoeba invadens
RTTGHRKDH

SEQ ID NO: 2773818 - protein, 6 aa, Entamoeba invadens
RTTGMV

SEQ ID NO: 2773819 - protein, 6 aa, Entamoeba invadens
RTTKIE

SEQ ID NO: 2773820 - protein, 8 aa, Entamoeba invadens
RTTNVNAQ

SEQ ID NO: 2773821 - protein, 6 aa, Entamoeba invadens
RTTPSF

SEQ ID NO: 2773822 - protein, 4 aa, Entamoeba invadens
RTTR

SEQ ID NO: 2773823 - protein, 6 aa, Entamoeba invadens
RTTTDS

SEQ ID NO: 2773824 - protein, 5 aa, Entamoeba invadens
RTTVE

SEQ ID NO: 2773825 - protein, 4 aa, Entamoeba invadens
RTVA

SEQ ID NO: 2773826 - protein, 7 aa, Entamoeba invadens
RTVERNR

SEQ ID NO: 2773827 - protein, 10 aa, Entamoeba invadens
RTVGESPTAV

SEQ ID NO: 2773828 - protein, 10 aa, Entamoeba invadens
RTVGESPTGI

SEQ ID NO: 2773829 - protein, 5 aa, Entamoeba invadens
RTVKL

SEQ ID NO: 2773830 - protein, 4 aa, Entamoeba invadens
RTVN

SEQ ID NO: 2773831 - protein, 7 aa, Entamoeba invadens
RTVYNSR

SEQ ID NO: 2773832 - protein, 7 aa, Entamoeba invadens
RTYGGAP

SEQ ID NO: 2773833 - protein, 5 aa, Entamoeba invadens
RTYGP

SEQ ID NO: 2773834 - protein, 14 aa, Entamoeba invadens
RVAEGGDNFLWVKD

SEQ ID NO: 2773835 - protein, 10 aa, Entamoeba invadens
RVAKPGEVIS

SEQ ID NO: 2773836 - protein, 6 aa, Entamoeba invadens
RVASKE

SEQ ID NO: 2773837 - protein, 4 aa, Entamoeba invadens
RVCP

SEQ ID NO: 2773838 - protein, 7 aa, Entamoeba invadens
RVDNSTE

SEQ ID NO: 2773839 - protein, 14 aa, Entamoeba invadens
RVDPKQYQSKDNDF

SEQ ID NO: 2773840 - protein, 46 aa, Entamoeba invadens
RVDQQESEESDEQSIPDEKEKEQVHKEEDVDESSSSSSDDDYEDED

SEQ ID NO: 2773841 - protein, 7 aa, Entamoeba invadens
RVEESNS

SEQ ID NO: 2773842 - protein, 6 aa, Entamoeba invadens
RVEKRK

SEQ ID NO: 2773843 - protein, 5 aa, Entamoeba invadens
RVEPD

SEQ ID NO: 2773844 - protein, 17 aa, Entamoeba invadens
RVESESDITVDGKATYM

SEQ ID NO: 2773845 - protein, 12 aa, Entamoeba invadens
RVFPSKEAKYKI

SEQ ID NO: 2773846 - protein, 4 aa, Entamoeba invadens
RVGI

SEQ ID NO: 2773847 - protein, 5 aa, Entamoeba invadens
RVGND

SEQ ID NO: 2773848 - protein, 4 aa, Entamoeba invadens
RVGS

SEQ ID NO: 2773849 - protein, 9 aa, Entamoeba invadens
RVKKNAGNL

SEQ ID NO: 2773850 - protein, 6 aa, Entamoeba invadens
RVKPAE

SEQ ID NO: 2773851 - protein, 5 aa, Entamoeba invadens
RVLGT

SEQ ID NO: 2773852 - protein, 5 aa, Entamoeba invadens
RVNAG

SEQ ID NO: 2773853 - protein, 8 aa, Entamoeba invadens
RVNDGEYN

SEQ ID NO: 2773854 - protein, 8 aa, Entamoeba invadens
RVNEQSKW

SEQ ID NO: 2773855 - protein, 14 aa, Entamoeba invadens
RVPPSKPGKGQIVK

SEQ ID NO: 2773856 - protein, 9 aa, Entamoeba invadens
RVPSYDRGI

SEQ ID NO: 2773857 - protein, 8 aa, Entamoeba invadens
RVPTSDDK

SEQ ID NO: 2773858 - protein, 4 aa, Entamoeba invadens
RVQQ

SEQ ID NO: 2773859 - protein, 11 aa, Entamoeba invadens
RVQRAKAGRVK

SEQ ID NO: 2773860 - protein, 16 aa, Entamoeba invadens
RVQSSGNFSSTGGTFT

SEQ ID NO: 2773861 - protein, 9 aa, Entamoeba invadens
RVREDNERD

SEQ ID NO: 2773862 - protein, 10 aa, Entamoeba invadens
RVSDKQRKYK

SEQ ID NO: 2773863 - protein, 11 aa, Entamoeba invadens
RVSNSKVKGQS

SEQ ID NO: 2773864 - protein, 9 aa, Entamoeba invadens
RVSRPEEVD

SEQ ID NO: 2773865 - protein, 4 aa, Entamoeba invadens
RVSY

SEQ ID NO: 2773866 - protein, 5 aa, Entamoeba invadens
RVTED

SEQ ID NO: 2773867 - protein, 7 aa, Entamoeba invadens
RVTKSNG

SEQ ID NO: 2773868 - protein, 10 aa, Entamoeba invadens
RVTQTDNDFV

SEQ ID NO: 2773869 - protein, 13 aa, Entamoeba invadens
RVTRATKVTKRDK

SEQ ID NO: 2773870 - protein, 11 aa, Entamoeba invadens
RVVGNTGSSFR

SEQ ID NO: 2773871 - protein, 8 aa, Entamoeba invadens
RVVPPHPI

SEQ ID NO: 2773872 - protein, 4 aa, Entamoeba invadens
RVYE

SEQ ID NO: 2773873 - protein, 6 aa, Entamoeba invadens
RWEEQD

SEQ ID NO: 2773874 - protein, 14 aa, Entamoeba invadens
RYAQYGQNKYPDPV

SEQ ID NO: 2773875 - protein, 14 aa, Entamoeba invadens
RYDTSGCPEPGSHH

SEQ ID NO: 2773876 - protein, 4 aa, Entamoeba invadens
RYEG

SEQ ID NO: 2773877 - protein, 5 aa, Entamoeba invadens
RYEKR

SEQ ID NO: 2773878 - protein, 7 aa, Entamoeba invadens
RYGDTQQ

SEQ ID NO: 2773879 - protein, 4 aa, Entamoeba invadens
RYGN

SEQ ID NO: 2773880 - protein, 5 aa, Entamoeba invadens
RYGTS

SEQ ID NO: 2773881 - protein, 9 aa, Entamoeba invadens
RYGTTEDSH

SEQ ID NO: 2773882 - protein, 9 aa, Entamoeba invadens
RYGTTENSH

SEQ ID NO: 2773883 - protein, 9 aa, Entamoeba invadens
RYISPPEDT

SEQ ID NO: 2773884 - protein, 12 aa, Entamoeba invadens
RYKDNEKVHHDS

SEQ ID NO: 2773885 - protein, 7 aa, Entamoeba invadens
RYKNNSV

SEQ ID NO: 2773886 - protein, 5 aa, Entamoeba invadens
RYLSN

SEQ ID NO: 2773887 - protein, 4 aa, Entamoeba invadens
RYNK

SEQ ID NO: 2773888 - protein, 6 aa, Entamoeba invadens
RYNKTP

SEQ ID NO: 2773889 - protein, 9 aa, Entamoeba invadens
RYNRTGNGC

SEQ ID NO: 2773890 - protein, 17 aa, Entamoeba invadens
RYPNKDVTSNDNKTDSI

SEQ ID NO: 2773891 - protein, 9 aa, Entamoeba invadens
RYQEGDEEF

SEQ ID NO: 2773892 - protein, 5 aa, Entamoeba invadens
RYQMP

SEQ ID NO: 2773893 - protein, 9 aa, Entamoeba invadens
RYQNKTNWG

SEQ ID NO: 2773894 - protein, 12 aa, Entamoeba invadens
RYQTTSIPLSEN

SEQ ID NO: 2773895 - protein, 6 aa, Entamoeba invadens
RYRDKN

SEQ ID NO: 2773896 - protein, 5 aa, Entamoeba invadens
RYREL

SEQ ID NO: 2773897 - protein, 13 aa, Entamoeba invadens
RYSADNKANGKKY

SEQ ID NO: 2773898 - protein, 8 aa, Entamoeba invadens
RYSANNNK

SEQ ID NO: 2773899 - protein, 7 aa, Entamoeba invadens
RYSASTA

SEQ ID NO: 2773900 - protein, 8 aa, Entamoeba invadens
RYSEEENQ

SEQ ID NO: 2773901 - protein, 12 aa, Entamoeba invadens
RYSETSQTTSNC

SEQ ID NO: 2773902 - protein, 5 aa, Entamoeba invadens
RYSGS

SEQ ID NO: 2773903 - protein, 4 aa, Entamoeba invadens
RYSP

SEQ ID NO: 2773904 - protein, 12 aa, Entamoeba invadens
RYSSGDDDEEVQ

SEQ ID NO: 2773905 - protein, 10 aa, Entamoeba invadens
RYSTQQIPQQ

SEQ ID NO: 2773906 - protein, 6 aa, Entamoeba invadens
RYTDGS

SEQ ID NO: 2773907 - protein, 10 aa, Entamoeba invadens
RYTDTYNGPL

SEQ ID NO: 2773908 - protein, 14 aa, Entamoeba invadens
RYTRTSNDVTKCTQ

SEQ ID NO: 2773909 - protein, 5 aa, Entamoeba invadens
RYTSN

SEQ ID NO: 2773910 - protein, 6 aa, Entamoeba invadens
RYTTNT

SEQ ID NO: 2773911 - protein, 7 aa, Entamoeba invadens
RYVNSSQ

SEQ ID NO: 2773912 - protein, 9 aa, Entamoeba invadens
RYVSENSKI

SEQ ID NO: 2773913 - protein, 10 aa, Entamoeba invadens
RYYQKDGNCT

SEQ ID NO: 2773914 - protein, 7 aa, Entamoeba invadens
SAAADDY

SEQ ID NO: 2773915 - protein, 6 aa, Entamoeba invadens
SAAEAE

SEQ ID NO: 2773916 - protein, 8 aa, Entamoeba invadens
SAAERNQL

SEQ ID NO: 2773917 - protein, 8 aa, Entamoeba invadens
SAAHQEDL

SEQ ID NO: 2773918 - protein, 6 aa, Entamoeba invadens
SAAIGE

SEQ ID NO: 2773919 - protein, 8 aa, Entamoeba invadens
SAAPEYMG

SEQ ID NO: 2773920 - protein, 8 aa, Entamoeba invadens
SAASSGNL

SEQ ID NO: 2773921 - protein, 13 aa, Entamoeba invadens
SACDDANTCTDCS

SEQ ID NO: 2773922 - protein, 5 aa, Entamoeba invadens
SACDS

SEQ ID NO: 2773923 - protein, 7 aa, Entamoeba invadens
SACGDCT

SEQ ID NO: 2773924 - protein, 10 aa, Entamoeba invadens
SACKSKQLSS

SEQ ID NO: 2773925 - protein, 7 aa, Entamoeba invadens
SACREPN

SEQ ID NO: 2773926 - protein, 7 aa, Entamoeba invadens
SACTSST

SEQ ID NO: 2773927 - protein, 66 aa, Entamoeba invadens
SADADKKLLGSEGSSSTSVPSSAQEHSTSNSQNIPSKSEEHTSGSDKKSSNKSSIKLEENKPGELK

SEQ ID NO: 2773928 - protein, 9 aa, Entamoeba invadens
SADAIGPKE

SEQ ID NO: 2773929 - protein, 13 aa, Entamoeba invadens
SADAYKSASDVNT

SEQ ID NO: 2773930 - protein, 7 aa, Entamoeba invadens
SADCSKY

SEQ ID NO: 2773931 - protein, 10 aa, Entamoeba invadens
SADCSSLSPA

SEQ ID NO: 2773932 - protein, 7 aa, Entamoeba invadens
SADDEGT

SEQ ID NO: 2773933 - protein, 9 aa, Entamoeba invadens
SADENKLEE

SEQ ID NO: 2773934 - protein, 8 aa, Entamoeba invadens
SADGGGAD

SEQ ID NO: 2773935 - protein, 8 aa, Entamoeba invadens
SADGKDCE

SEQ ID NO: 2773936 - protein, 11 aa, Entamoeba invadens
SADIGTADSTL

SEQ ID NO: 2773937 - protein, 28 aa, Entamoeba invadens
SADNSKCTSCEGSNKVSDDGESCVSKTN

SEQ ID NO: 2773938 - protein, 7 aa, Entamoeba invadens
SADSRLS

SEQ ID NO: 2773939 - protein, 18 aa, Entamoeba invadens
SAEANSLAEQTVGAARTV

SEQ ID NO: 2773940 - protein, 4 aa, Entamoeba invadens
SAED

SEQ ID NO: 2773941 - protein, 8 aa, Entamoeba invadens
SAEELTPN

SEQ ID NO: 2773942 - protein, 8 aa, Entamoeba invadens
SAEGDAEC

SEQ ID NO: 2773943 - protein, 13 aa, Entamoeba invadens
SAEGEQPKTDDFK

SEQ ID NO: 2773944 - protein, 8 aa, Entamoeba invadens
SAEPINET

SEQ ID NO: 2773945 - protein, 4 aa, Entamoeba invadens
SAER

SEQ ID NO: 2773946 - protein, 6 aa, Entamoeba invadens
SAFAGG

SEQ ID NO: 2773947 - protein, 9 aa, Entamoeba invadens
SAFNKGDRI

SEQ ID NO: 2773948 - protein, 6 aa, Entamoeba invadens
SAFQET

SEQ ID NO: 2773949 - protein, 27 aa, Entamoeba invadens
SAFQSSTITSITSEAGFSTIGNSAFQE

SEQ ID NO: 2773950 - protein, 12 aa, Entamoeba invadens
SAFTAKAGIKTI

SEQ ID NO: 2773951 - protein, 12 aa, Entamoeba invadens
SAFTTKNGIKTI

SEQ ID NO: 2773952 - protein, 7 aa, Entamoeba invadens
SAGARTI

SEQ ID NO: 2773953 - protein, 6 aa, Entamoeba invadens
SAGCSK

SEQ ID NO: 2773954 - protein, 11 aa, Entamoeba invadens
SAGECGENCNT

SEQ ID NO: 2773955 - protein, 6 aa, Entamoeba invadens
SAGPIS

SEQ ID NO: 2773956 - protein, 5 aa, Entamoeba invadens
SAGPL

SEQ ID NO: 2773957 - protein, 12 aa, Entamoeba invadens
SAGSACERDGDS

SEQ ID NO: 2773958 - protein, 13 aa, Entamoeba invadens
SAGSKDVNPESKH

SEQ ID NO: 2773959 - protein, 129 aa, Entamoeba invadens
SAGTYGPSSGASSCYSCSPGTYSSSGSTSCSSCPAGKSSNGGASSCTPCSAGTYSSSSGSTSCGTCSPGTYSSSGSTSCSSCPKGTFSNYGSSSCSNCPAGTYGSTTGLSSCPSCSAGYYSSSGSTSCS

SEQ ID NO: 2773960 - protein, 6 aa, Entamoeba invadens
SAGVGK

SEQ ID NO: 2773961 - protein, 12 aa, Entamoeba invadens
SAGYRSAYKPSD

SEQ ID NO: 2773962 - protein, 5 aa, Entamoeba invadens
SAHKE

SEQ ID NO: 2773963 - protein, 7 aa, Entamoeba invadens
SAHNSRC

SEQ ID NO: 2773964 - protein, 4 aa, Entamoeba invadens
SAHT

SEQ ID NO: 2773965 - protein, 7 aa, Entamoeba invadens
SAIDSTK

SEQ ID NO: 2773966 - protein, 11 aa, Entamoeba invadens
SAIDSTKKTCT

SEQ ID NO: 2773967 - protein, 8 aa, Entamoeba invadens
SAIKSNPV

SEQ ID NO: 2773968 - protein, 8 aa, Entamoeba invadens
SAISGATG

SEQ ID NO: 2773969 - protein, 6 aa, Entamoeba invadens
SAISRL

SEQ ID NO: 2773970 - protein, 21 aa, Entamoeba invadens
SAKCTTCAAGTRSEYPTSSTK

SEQ ID NO: 2773971 - protein, 8 aa, Entamoeba invadens
SAKDNTLK

SEQ ID NO: 2773972 - protein, 7 aa, Entamoeba invadens
SAKEMKR

SEQ ID NO: 2773973 - protein, 10 aa, Entamoeba invadens
SAKGNSYKYS

SEQ ID NO: 2773974 - protein, 28 aa, Entamoeba invadens
SAKKKEVKTQGKSPKTRTPLMSQSPKMK

SEQ ID NO: 2773975 - protein, 4 aa, Entamoeba invadens
SAKN

SEQ ID NO: 2773976 - protein, 16 aa, Entamoeba invadens
SAKNGQCVSDKCGNGV

SEQ ID NO: 2773977 - protein, 8 aa, Entamoeba invadens
SAKNNTNL

SEQ ID NO: 2773978 - protein, 7 aa, Entamoeba invadens
SAKNSKC

SEQ ID NO: 2773979 - protein, 5 aa, Entamoeba invadens
SAKRS

SEQ ID NO: 2773980 - protein, 7 aa, Entamoeba invadens
SAKSNIN

SEQ ID NO: 2773981 - protein, 8 aa, Entamoeba invadens
SAKTQLTT

SEQ ID NO: 2773982 - protein, 9 aa, Entamoeba invadens
SAKVTKSVR

SEQ ID NO: 2773983 - protein, 8 aa, Entamoeba invadens
SALENEAK

SEQ ID NO: 2773984 - protein, 12 aa, Entamoeba invadens
SALKNEKSFKEI

SEQ ID NO: 2773985 - protein, 6 aa, Entamoeba invadens
SALSTR

SEQ ID NO: 2773986 - protein, 9 aa, Entamoeba invadens
SALTQEDKE

SEQ ID NO: 2773987 - protein, 4 aa, Entamoeba invadens
SAME

SEQ ID NO: 2773988 - protein, 8 aa, Entamoeba invadens
SAMKQEGE

SEQ ID NO: 2773989 - protein, 8 aa, Entamoeba invadens
SANEQAES

SEQ ID NO: 2773990 - protein, 6 aa, Entamoeba invadens
SANESY

SEQ ID NO: 2773991 - protein, 9 aa, Entamoeba invadens
SANFSNQNG

SEQ ID NO: 2773992 - protein, 7 aa, Entamoeba invadens
SANPNFT

SEQ ID NO: 2773993 - protein, 9 aa, Entamoeba invadens
SANQKCGKC

SEQ ID NO: 2773994 - protein, 17 aa, Entamoeba invadens
SANRAASANSPSENTGN

SEQ ID NO: 2773995 - protein, 11 aa, Entamoeba invadens
SANTAKGQTSE

SEQ ID NO: 2773996 - protein, 12 aa, Entamoeba invadens
SANTSQSDIGCA

SEQ ID NO: 2773997 - protein, 13 aa, Entamoeba invadens
SANVNNLNNTNNV

SEQ ID NO: 2773998 - protein, 4 aa, Entamoeba invadens
SAPF

SEQ ID NO: 2773999 - protein, 5 aa, Entamoeba invadens
SAPID

SEQ ID NO: 2774000 - protein, 15 aa, Entamoeba invadens
SAQEPKQELQNEVPS

SEQ ID NO: 2774001 - protein, 6 aa, Entamoeba invadens
SAQHTT

SEQ ID NO: 2774002 - protein, 6 aa, Entamoeba invadens
SAQIPT

SEQ ID NO: 2774003 - protein, 8 aa, Entamoeba invadens
SAQLPTDD

SEQ ID NO: 2774004 - protein, 7 aa, Entamoeba invadens
SAQMEPS

SEQ ID NO: 2774005 - protein, 17 aa, Entamoeba invadens
SAQNCNSPSSLSPASCD

SEQ ID NO: 2774006 - protein, 10 aa, Entamoeba invadens
SAQNDKCTKC

SEQ ID NO: 2774007 - protein, 13 aa, Entamoeba invadens
SAQNNIKKSTTQY

SEQ ID NO: 2774008 - protein, 6 aa, Entamoeba invadens
SAQNSK

SEQ ID NO: 2774009 - protein, 8 aa, Entamoeba invadens
SAQPTYAK

SEQ ID NO: 2774010 - protein, 7 aa, Entamoeba invadens
SAQSEIF

SEQ ID NO: 2774011 - protein, 5 aa, Entamoeba invadens
SAQTD

SEQ ID NO: 2774012 - protein, 14 aa, Entamoeba invadens
SARDSGNKYQYANA

SEQ ID NO: 2774013 - protein, 5 aa, Entamoeba invadens
SARKR

SEQ ID NO: 2774014 - protein, 10 aa, Entamoeba invadens
SARNQEDNSC

SEQ ID NO: 2774015 - protein, 7 aa, Entamoeba invadens
SARQEKT

SEQ ID NO: 2774016 - protein, 5 aa, Entamoeba invadens
SARSA

SEQ ID NO: 2774017 - protein, 25 aa, Entamoeba invadens
SARSKLSTRLDPDDLKEEKKIGEGS

SEQ ID NO: 2774018 - protein, 8 aa, Entamoeba invadens
SARYGPNE

SEQ ID NO: 2774019 - protein, 8 aa, Entamoeba invadens
SASAEWPR

SEQ ID NO: 2774020 - protein, 24 aa, Entamoeba invadens
SASDGVCTSCSENKAVSSDGLSCE

SEQ ID NO: 2774021 - protein, 13 aa, Entamoeba invadens
SASDSTKCESCST

SEQ ID NO: 2774022 - protein, 5 aa, Entamoeba invadens
SASDV

SEQ ID NO: 2774023 - protein, 6 aa, Entamoeba invadens
SASEED

SEQ ID NO: 2774024 - protein, 6 aa, Entamoeba invadens
SASGFS

SEQ ID NO: 2774025 - protein, 5 aa, Entamoeba invadens
SASHL

SEQ ID NO: 2774026 - protein, 6 aa, Entamoeba invadens
SASIPH

SEQ ID NO: 2774027 - protein, 6 aa, Entamoeba invadens
SASLTG

SEQ ID NO: 2774028 - protein, 13 aa, Entamoeba invadens
SASMDKTDGVTLS

SEQ ID NO: 2774029 - protein, 9 aa, Entamoeba invadens
SASNNKCAQ

SEQ ID NO: 2774030 - protein, 18 aa, Entamoeba invadens
SASNNKCSACSKSYKLDE

SEQ ID NO: 2774031 - protein, 5 aa, Entamoeba invadens
SASPL

SEQ ID NO: 2774032 - protein, 7 aa, Entamoeba invadens
SASPSQR

SEQ ID NO: 2774033 - protein, 6 aa, Entamoeba invadens
SASPTV

SEQ ID NO: 2774034 - protein, 7 aa, Entamoeba invadens
SASSATI

SEQ ID NO: 2774035 - protein, 10 aa, Entamoeba invadens
SASSGATGLG

SEQ ID NO: 2774036 - protein, 12 aa, Entamoeba invadens
SASSGNDSDSHQ

SEQ ID NO: 2774037 - protein, 11 aa, Entamoeba invadens
SASSNKCDKCA

SEQ ID NO: 2774038 - protein, 7 aa, Entamoeba invadens
SASSYEH

SEQ ID NO: 2774039 - protein, 7 aa, Entamoeba invadens
SASTNKH

SEQ ID NO: 2774040 - protein, 16 aa, Entamoeba invadens
SASTPTSKISPDAGSI

SEQ ID NO: 2774041 - protein, 7 aa, Entamoeba invadens
SASTSGI

SEQ ID NO: 2774042 - protein, 11 aa, Entamoeba invadens
SASTSQSIKSE

SEQ ID NO: 2774043 - protein, 15 aa, Entamoeba invadens
SASTYNTQDKPKPFP

SEQ ID NO: 2774044 - protein, 5 aa, Entamoeba invadens
SASYS

SEQ ID NO: 2774045 - protein, 6 aa, Entamoeba invadens
SATAKG

SEQ ID NO: 2774046 - protein, 4 aa, Entamoeba invadens
SATC

SEQ ID NO: 2774047 - protein, 14 aa, Entamoeba invadens
SATCSKDGKCSQCE

SEQ ID NO: 2774048 - protein, 5 aa, Entamoeba invadens
SATCT

SEQ ID NO: 2774049 - protein, 4 aa, Entamoeba invadens
SATE

SEQ ID NO: 2774050 - protein, 6 aa, Entamoeba invadens
SATEAL

SEQ ID NO: 2774051 - protein, 16 aa, Entamoeba invadens
SATETKCLDRTNKGCQ

SEQ ID NO: 2774052 - protein, 10 aa, Entamoeba invadens
SATGCEKQPK

SEQ ID NO: 2774053 - protein, 7 aa, Entamoeba invadens
SATGIYP

SEQ ID NO: 2774054 - protein, 10 aa, Entamoeba invadens
SATITGTTTI

SEQ ID NO: 2774055 - protein, 29 aa, Entamoeba invadens
SATKGSKTLKRAKSSEMKNKKGIGSRTSI

SEQ ID NO: 2774056 - protein, 5 aa, Entamoeba invadens
SATLS

SEQ ID NO: 2774057 - protein, 6 aa, Entamoeba invadens
SATNGL

SEQ ID NO: 2774058 - protein, 7 aa, Entamoeba invadens
SATNPVT

SEQ ID NO: 2774059 - protein, 7 aa, Entamoeba invadens
SATPLTK

SEQ ID NO: 2774060 - protein, 9 aa, Entamoeba invadens
SATPSYYDK

SEQ ID NO: 2774061 - protein, 40 aa, Entamoeba invadens
SATQTSNSSFGQQNETTVKRKKSEENETQQRRDKPEATEI

SEQ ID NO: 2774062 - protein, 7 aa, Entamoeba invadens
SATRAQT

SEQ ID NO: 2774063 - protein, 20 aa, Entamoeba invadens
SATSKLTTRLDPDELIEDKK

SEQ ID NO: 2774064 - protein, 4 aa, Entamoeba invadens
SATT

SEQ ID NO: 2774065 - protein, 5 aa, Entamoeba invadens
SATTT

SEQ ID NO: 2774066 - protein, 5 aa, Entamoeba invadens
SATTV

SEQ ID NO: 2774067 - protein, 6 aa, Entamoeba invadens
SATVPG

SEQ ID NO: 2774068 - protein, 6 aa, Entamoeba invadens
SATVSE

SEQ ID NO: 2774069 - protein, 10 aa, Entamoeba invadens
SAVSEKERNN

SEQ ID NO: 2774070 - protein, 9 aa, Entamoeba invadens
SAVSKHQKS

SEQ ID NO: 2774071 - protein, 14 aa, Entamoeba invadens
SAVTESQRGQRKNC

SEQ ID NO: 2774072 - protein, 7 aa, Entamoeba invadens
SAYDPPL

SEQ ID NO: 2774073 - protein, 6 aa, Entamoeba invadens
SAYSGS

SEQ ID NO: 2774074 - protein, 7 aa, Entamoeba invadens
SAYTNSS

SEQ ID NO: 2774075 - protein, 7 aa, Entamoeba invadens
SCAGSVE

SEQ ID NO: 2774076 - protein, 9 aa, Entamoeba invadens
SCATSNSGS

SEQ ID NO: 2774077 - protein, 8 aa, Entamoeba invadens
SCATTSSN

SEQ ID NO: 2774078 - protein, 7 aa, Entamoeba invadens
SCDAKSG

SEQ ID NO: 2774079 - protein, 8 aa, Entamoeba invadens
SCDDDSLD

SEQ ID NO: 2774080 - protein, 12 aa, Entamoeba invadens
SCDGTSTNCTNC

SEQ ID NO: 2774081 - protein, 9 aa, Entamoeba invadens
SCDISNQDG

SEQ ID NO: 2774082 - protein, 9 aa, Entamoeba invadens
SCDKSGTCT

SEQ ID NO: 2774083 - protein, 22 aa, Entamoeba invadens
SCDKTQSTSCKTNYYANSDGEC

SEQ ID NO: 2774084 - protein, 5 aa, Entamoeba invadens
SCDNE

SEQ ID NO: 2774085 - protein, 12 aa, Entamoeba invadens
SCDPNGGQCNQC

SEQ ID NO: 2774086 - protein, 5 aa, Entamoeba invadens
SCDQD

SEQ ID NO: 2774087 - protein, 4 aa, Entamoeba invadens
SCDS

SEQ ID NO: 2774088 - protein, 9 aa, Entamoeba invadens
SCDSEDGDI

SEQ ID NO: 2774089 - protein, 7 aa, Entamoeba invadens
SCDTCTK

SEQ ID NO: 2774090 - protein, 7 aa, Entamoeba invadens
SCDTQDK

SEQ ID NO: 2774091 - protein, 7 aa, Entamoeba invadens
SCDTTGK

SEQ ID NO: 2774092 - protein, 7 aa, Entamoeba invadens
SCEASDS

SEQ ID NO: 2774093 - protein, 7 aa, Entamoeba invadens
SCEDCST

SEQ ID NO: 2774094 - protein, 5 aa, Entamoeba invadens
SCEEC

SEQ ID NO: 2774095 - protein, 4 aa, Entamoeba invadens
SCEI

SEQ ID NO: 2774096 - protein, 4 aa, Entamoeba invadens
SCEK

SEQ ID NO: 2774097 - protein, 25 aa, Entamoeba invadens
SCEKEENDEKDENGVCEKGKENCKT

SEQ ID NO: 2774098 - protein, 6 aa, Entamoeba invadens
SCEKTT

SEQ ID NO: 2774099 - protein, 7 aa, Entamoeba invadens
SCEKTTH

SEQ ID NO: 2774100 - protein, 11 aa, Entamoeba invadens
SCELKDNNSQP

SEQ ID NO: 2774101 - protein, 8 aa, Entamoeba invadens
SCETADPN

SEQ ID NO: 2774102 - protein, 15 aa, Entamoeba invadens
SCETDDQTKCETCEG

SEQ ID NO: 2774103 - protein, 4 aa, Entamoeba invadens
SCGE

SEQ ID NO: 2774104 - protein, 12 aa, Entamoeba invadens
SCGEECKTCDPT

SEQ ID NO: 2774105 - protein, 11 aa, Entamoeba invadens
SCGEECKTCDS

SEQ ID NO: 2774106 - protein, 10 aa, Entamoeba invadens
SCGGDTSGES

SEQ ID NO: 2774107 - protein, 10 aa, Entamoeba invadens
SCGGQTSTTS

SEQ ID NO: 2774108 - protein, 12 aa, Entamoeba invadens
SCGKAKQNCAIS

SEQ ID NO: 2774109 - protein, 13 aa, Entamoeba invadens
SCGKAKQNCETSH

SEQ ID NO: 2774110 - protein, 13 aa, Entamoeba invadens
SCGKANQNCETSH

SEQ ID NO: 2774111 - protein, 11 aa, Entamoeba invadens
SCGKCSTTTNS

SEQ ID NO: 2774112 - protein, 8 aa, Entamoeba invadens
SCGSADDY

SEQ ID NO: 2774113 - protein, 5 aa, Entamoeba invadens
SCGSK

SEQ ID NO: 2774114 - protein, 6 aa, Entamoeba invadens
SCGTCK

SEQ ID NO: 2774115 - protein, 11 aa, Entamoeba invadens
SCGTCKDKDNC

SEQ ID NO: 2774116 - protein, 7 aa, Entamoeba invadens
SCHDNNK

SEQ ID NO: 2774117 - protein, 13 aa, Entamoeba invadens
SCIKTSHNNNSTN

SEQ ID NO: 2774118 - protein, 11 aa, Entamoeba invadens
SCIPTKEDGCQ

SEQ ID NO: 2774119 - protein, 6 aa, Entamoeba invadens
SCISPK

SEQ ID NO: 2774120 - protein, 10 aa, Entamoeba invadens
SCITAPDNSS

SEQ ID NO: 2774121 - protein, 23 aa, Entamoeba invadens
SCKATNQLKRDENASDGCNIKTT

SEQ ID NO: 2774122 - protein, 24 aa, Entamoeba invadens
SCKATNQLKRDENASDGCNIKTTK

SEQ ID NO: 2774123 - protein, 5 aa, Entamoeba invadens
SCKES

SEQ ID NO: 2774124 - protein, 5 aa, Entamoeba invadens
SCKNI

SEQ ID NO: 2774125 - protein, 5 aa, Entamoeba invadens
SCKPE

SEQ ID NO: 2774126 - protein, 13 aa, Entamoeba invadens
SCKPPMSLTNSDE

SEQ ID NO: 2774127 - protein, 14 aa, Entamoeba invadens
SCKPTFKPSQSGKC

SEQ ID NO: 2774128 - protein, 5 aa, Entamoeba invadens
SCKSG

SEQ ID NO: 2774129 - protein, 12 aa, Entamoeba invadens
SCKSNTCGNNQI

SEQ ID NO: 2774130 - protein, 11 aa, Entamoeba invadens
SCKTCDQTNGN

SEQ ID NO: 2774131 - protein, 12 aa, Entamoeba invadens
SCKTCDQTNGNC

SEQ ID NO: 2774132 - protein, 12 aa, Entamoeba invadens
SCKTCSNDGDYR

SEQ ID NO: 2774133 - protein, 12 aa, Entamoeba invadens
SCKTETACSQCK

SEQ ID NO: 2774134 - protein, 8 aa, Entamoeba invadens
SCKTYNDK

SEQ ID NO: 2774135 - protein, 5 aa, Entamoeba invadens
SCLSN

SEQ ID NO: 2774136 - protein, 6 aa, Entamoeba invadens
SCNATN

SEQ ID NO: 2774137 - protein, 7 aa, Entamoeba invadens
SCNATSQ

SEQ ID NO: 2774138 - protein, 8 aa, Entamoeba invadens
SCNGKNSR

SEQ ID NO: 2774139 - protein, 11 aa, Entamoeba invadens
SCNGQCNTATG

SEQ ID NO: 2774140 - protein, 12 aa, Entamoeba invadens
SCNGQCNTSTGV

SEQ ID NO: 2774141 - protein, 6 aa, Entamoeba invadens
SCNKCE

SEQ ID NO: 2774142 - protein, 11 aa, Entamoeba invadens
SCNKEDSKGYA

SEQ ID NO: 2774143 - protein, 4 aa, Entamoeba invadens
SCNP

SEQ ID NO: 2774144 - protein, 8 aa, Entamoeba invadens
SCNQTECD

SEQ ID NO: 2774145 - protein, 8 aa, Entamoeba invadens
SCNQTQKE

SEQ ID NO: 2774146 - protein, 4 aa, Entamoeba invadens
SCNS

SEQ ID NO: 2774147 - protein, 8 aa, Entamoeba invadens
SCNSDNNC

SEQ ID NO: 2774148 - protein, 9 aa, Entamoeba invadens
SCNSGSDKC

SEQ ID NO: 2774149 - protein, 8 aa, Entamoeba invadens
SCNSRENK

SEQ ID NO: 2774150 - protein, 4 aa, Entamoeba invadens
SCNT

SEQ ID NO: 2774151 - protein, 5 aa, Entamoeba invadens
SCNTC

SEQ ID NO: 2774152 - protein, 7 aa, Entamoeba invadens
SCNTNNV

SEQ ID NO: 2774153 - protein, 9 aa, Entamoeba invadens
SCPATDVPC

SEQ ID NO: 2774154 - protein, 4 aa, Entamoeba invadens
SCPD

SEQ ID NO: 2774155 - protein, 11 aa, Entamoeba invadens
SCPNDTCERCE

SEQ ID NO: 2774156 - protein, 8 aa, Entamoeba invadens
SCPNGGAT

SEQ ID NO: 2774157 - protein, 9 aa, Entamoeba invadens
SCPRTNQYV

SEQ ID NO: 2774158 - protein, 6 aa, Entamoeba invadens
SCPRTT

SEQ ID NO: 2774159 - protein, 15 aa, Entamoeba invadens
SCPSGSYKNTETSCE

SEQ ID NO: 2774160 - protein, 5 aa, Entamoeba invadens
SCPSN

SEQ ID NO: 2774161 - protein, 6 aa, Entamoeba invadens
SCPTSP

SEQ ID NO: 2774162 - protein, 4 aa, Entamoeba invadens
SCQE

SEQ ID NO: 2774163 - protein, 4 aa, Entamoeba invadens
SCQL

SEQ ID NO: 2774164 - protein, 5 aa, Entamoeba invadens
SCQMT

SEQ ID NO: 2774165 - protein, 10 aa, Entamoeba invadens
SCQPDTEYLG

SEQ ID NO: 2774166 - protein, 4 aa, Entamoeba invadens
SCQS

SEQ ID NO: 2774167 - protein, 5 aa, Entamoeba invadens
SCQTP

SEQ ID NO: 2774168 - protein, 6 aa, Entamoeba invadens
SCQTYS

SEQ ID NO: 2774169 - protein, 5 aa, Entamoeba invadens
SCRGT

SEQ ID NO: 2774170 - protein, 30 aa, Entamoeba invadens
SCSAGTYSANGASSCTACSAGQYAPSSNSV

SEQ ID NO: 2774171 - protein, 7 aa, Entamoeba invadens
SCSASYE

SEQ ID NO: 2774172 - protein, 7 aa, Entamoeba invadens
SCSDSTT

SEQ ID NO: 2774173 - protein, 29 aa, Entamoeba invadens
SCSEKSEKSPKSDSFEQTEKEKIETETKE

SEQ ID NO: 2774174 - protein, 7 aa, Entamoeba invadens
SCSENCS

SEQ ID NO: 2774175 - protein, 12 aa, Entamoeba invadens
SCSKCKNSISCD

SEQ ID NO: 2774176 - protein, 6 aa, Entamoeba invadens
SCSKQC

SEQ ID NO: 2774177 - protein, 9 aa, Entamoeba invadens
SCSKQENQR

SEQ ID NO: 2774178 - protein, 5 aa, Entamoeba invadens
SCSNG

SEQ ID NO: 2774179 - protein, 6 aa, Entamoeba invadens
SCSNST

SEQ ID NO: 2774180 - protein, 6 aa, Entamoeba invadens
SCSNYN

SEQ ID NO: 2774181 - protein, 7 aa, Entamoeba invadens
SCSPKYD

SEQ ID NO: 2774182 - protein, 10 aa, Entamoeba invadens
SCSQNCNGTT

SEQ ID NO: 2774183 - protein, 8 aa, Entamoeba invadens
SCSQNHYK

SEQ ID NO: 2774184 - protein, 7 aa, Entamoeba invadens
SCSQSDK

SEQ ID NO: 2774185 - protein, 8 aa, Entamoeba invadens
SCSRTTST

SEQ ID NO: 2774186 - protein, 10 aa, Entamoeba invadens
SCSSCEPNGG

SEQ ID NO: 2774187 - protein, 7 aa, Entamoeba invadens
SCSSCTP

SEQ ID NO: 2774188 - protein, 10 aa, Entamoeba invadens
SCSSGCSTTT

SEQ ID NO: 2774189 - protein, 12 aa, Entamoeba invadens
SCSSGCSTTTGN

SEQ ID NO: 2774190 - protein, 15 aa, Entamoeba invadens
SCSSGSYKNTETSCE

SEQ ID NO: 2774191 - protein, 12 aa, Entamoeba invadens
SCSSKCSTTTGN

SEQ ID NO: 2774192 - protein, 5 aa, Entamoeba invadens
SCSSP

SEQ ID NO: 2774193 - protein, 21 aa, Entamoeba invadens
SCSSTNPMNCEENKCSTTSSL

SEQ ID NO: 2774194 - protein, 7 aa, Entamoeba invadens
SCSSTSD

SEQ ID NO: 2774195 - protein, 7 aa, Entamoeba invadens
SCSTCKN

SEQ ID NO: 2774196 - protein, 6 aa, Entamoeba invadens
SCSTKQ

SEQ ID NO: 2774197 - protein, 7 aa, Entamoeba invadens
SCSTTGD

SEQ ID NO: 2774198 - protein, 8 aa, Entamoeba invadens
SCSTTNSI

SEQ ID NO: 2774199 - protein, 17 aa, Entamoeba invadens
SCSTTQTYGSCSQCENG

SEQ ID NO: 2774200 - protein, 11 aa, Entamoeba invadens
SCTASSNSKCT

SEQ ID NO: 2774201 - protein, 12 aa, Entamoeba invadens
SCTGNCGNTDGY

SEQ ID NO: 2774202 - protein, 4 aa, Entamoeba invadens
SCTK

SEQ ID NO: 2774203 - protein, 5 aa, Entamoeba invadens
SCTKE

SEQ ID NO: 2774204 - protein, 8 aa, Entamoeba invadens
SCTKTSCT

SEQ ID NO: 2774205 - protein, 6 aa, Entamoeba invadens
SCTKVD

SEQ ID NO: 2774206 - protein, 6 aa, Entamoeba invadens
SCTNEG

SEQ ID NO: 2774207 - protein, 6 aa, Entamoeba invadens
SCTRCA

SEQ ID NO: 2774208 - protein, 8 aa, Entamoeba invadens
SCTRCETG

SEQ ID NO: 2774209 - protein, 12 aa, Entamoeba invadens
SCTSCSNKYEHS

SEQ ID NO: 2774210 - protein, 12 aa, Entamoeba invadens
SCTSSSTCSGCK

SEQ ID NO: 2774211 - protein, 8 aa, Entamoeba invadens
SCTSTNGV

SEQ ID NO: 2774212 - protein, 5 aa, Entamoeba invadens
SCTTD

SEQ ID NO: 2774213 - protein, 12 aa, Entamoeba invadens
SCTTGKPVETPI

SEQ ID NO: 2774214 - protein, 12 aa, Entamoeba invadens
SCTTGKPVETPV

SEQ ID NO: 2774215 - protein, 16 aa, Entamoeba invadens
SCTTKPNCEKCSTTEN

SEQ ID NO: 2774216 - protein, 11 aa, Entamoeba invadens
SCTTSSSGDPI

SEQ ID NO: 2774217 - protein, 5 aa, Entamoeba invadens
SCTTY

SEQ ID NO: 2774218 - protein, 17 aa, Entamoeba invadens
SCTYSETEGTCTTTENS

SEQ ID NO: 2774219 - protein, 14 aa, Entamoeba invadens
SCVKTSQNNNSTNC

SEQ ID NO: 2774220 - protein, 22 aa, Entamoeba invadens
SCVTGERKCTKCSTPNMYPDDT

SEQ ID NO: 2774221 - protein, 8 aa, Entamoeba invadens
SCYPPNVG

SEQ ID NO: 2774222 - protein, 10 aa, Entamoeba invadens
SDAAPVKIDP

SEQ ID NO: 2774223 - protein, 5 aa, Entamoeba invadens
SDACN

SEQ ID NO: 2774224 - protein, 7 aa, Entamoeba invadens
SDADKTM

SEQ ID NO: 2774225 - protein, 10 aa, Entamoeba invadens
SDAFSGDEKV

SEQ ID NO: 2774226 - protein, 5 aa, Entamoeba invadens
SDAIS

SEQ ID NO: 2774227 - protein, 5 aa, Entamoeba invadens
SDANE

SEQ ID NO: 2774228 - protein, 6 aa, Entamoeba invadens
SDAPTF

SEQ ID NO: 2774229 - protein, 11 aa, Entamoeba invadens
SDARSKTDIKR

SEQ ID NO: 2774230 - protein, 17 aa, Entamoeba invadens
SDASCTKIREEKREVGK

SEQ ID NO: 2774231 - protein, 6 aa, Entamoeba invadens
SDASRK

SEQ ID NO: 2774232 - protein, 5 aa, Entamoeba invadens
SDCAP

SEQ ID NO: 2774233 - protein, 9 aa, Entamoeba invadens
SDCATRSDH

SEQ ID NO: 2774234 - protein, 6 aa, Entamoeba invadens
SDCDSS

SEQ ID NO: 2774235 - protein, 12 aa, Entamoeba invadens
SDCKDNAAKCKY

SEQ ID NO: 2774236 - protein, 7 aa, Entamoeba invadens
SDCQSAV

SEQ ID NO: 2774237 - protein, 10 aa, Entamoeba invadens
SDCQSIGSNC

SEQ ID NO: 2774238 - protein, 8 aa, Entamoeba invadens
SDCQSTVS

SEQ ID NO: 2774239 - protein, 7 aa, Entamoeba invadens
SDCSPVA

SEQ ID NO: 2774240 - protein, 7 aa, Entamoeba invadens
SDDCQPC

SEQ ID NO: 2774241 - protein, 54 aa, Entamoeba invadens
SDDDSSEESDMSESSNDSEESDVETESSVTASGSEQGVDDTEQTMEPKTPNTTK

SEQ ID NO: 2774242 - protein, 6 aa, Entamoeba invadens
SDDEMK

SEQ ID NO: 2774243 - protein, 5 aa, Entamoeba invadens
SDDGK

SEQ ID NO: 2774244 - protein, 6 aa, Entamoeba invadens
SDDKER

SEQ ID NO: 2774245 - protein, 6 aa, Entamoeba invadens
SDDKGK

SEQ ID NO: 2774246 - protein, 9 aa, Entamoeba invadens
SDDKKDQVV

SEQ ID NO: 2774247 - protein, 11 aa, Entamoeba invadens
SDDKTSCKSEM

SEQ ID NO: 2774248 - protein, 20 aa, Entamoeba invadens
SDDQIKAKESQWKREKDLRK

SEQ ID NO: 2774249 - protein, 7 aa, Entamoeba invadens
SDDQLSC

SEQ ID NO: 2774250 - protein, 7 aa, Entamoeba invadens
SDDRQQV

SEQ ID NO: 2774251 - protein, 18 aa, Entamoeba invadens
SDDSKNSEGNKKDQIQNE

SEQ ID NO: 2774252 - protein, 6 aa, Entamoeba invadens
SDDSTK

SEQ ID NO: 2774253 - protein, 9 aa, Entamoeba invadens
SDDTHGTCY

SEQ ID NO: 2774254 - protein, 7 aa, Entamoeba invadens
SDDTNST

SEQ ID NO: 2774255 - protein, 8 aa, Entamoeba invadens
SDDTVSST

SEQ ID NO: 2774256 - protein, 7 aa, Entamoeba invadens
SDDVKEI

SEQ ID NO: 2774257 - protein, 15 aa, Entamoeba invadens
SDEALTRKALKEKKK

SEQ ID NO: 2774258 - protein, 9 aa, Entamoeba invadens
SDECTASTA

SEQ ID NO: 2774259 - protein, 4 aa, Entamoeba invadens
SDED

SEQ ID NO: 2774260 - protein, 14 aa, Entamoeba invadens
SDEDGKIGVKSESK

SEQ ID NO: 2774261 - protein, 20 aa, Entamoeba invadens
SDEDVENQRTVARQRLGNPQ

SEQ ID NO: 2774262 - protein, 4 aa, Entamoeba invadens
SDEE

SEQ ID NO: 2774263 - protein, 9 aa, Entamoeba invadens
SDEENSSSV

SEQ ID NO: 2774264 - protein, 13 aa, Entamoeba invadens
SDEFGNGAENSAL

SEQ ID NO: 2774265 - protein, 7 aa, Entamoeba invadens
SDEGDCA

SEQ ID NO: 2774266 - protein, 5 aa, Entamoeba invadens
SDEKM

SEQ ID NO: 2774267 - protein, 8 aa, Entamoeba invadens
SDEKYNES

SEQ ID NO: 2774268 - protein, 5 aa, Entamoeba invadens
SDELD

SEQ ID NO: 2774269 - protein, 5 aa, Entamoeba invadens
SDELS

SEQ ID NO: 2774270 - protein, 9 aa, Entamoeba invadens
SDENSAFSL

SEQ ID NO: 2774271 - protein, 6 aa, Entamoeba invadens
SDENSI

SEQ ID NO: 2774272 - protein, 5 aa, Entamoeba invadens
SDENV

SEQ ID NO: 2774273 - protein, 8 aa, Entamoeba invadens
SDEQKEEY

SEQ ID NO: 2774274 - protein, 7 aa, Entamoeba invadens
SDEREAV

SEQ ID NO: 2774275 - protein, 6 aa, Entamoeba invadens
SDERTK

SEQ ID NO: 2774276 - protein, 7 aa, Entamoeba invadens
SDETNVG

SEQ ID NO: 2774277 - protein, 7 aa, Entamoeba invadens
SDETRRK

SEQ ID NO: 2774278 - protein, 16 aa, Entamoeba invadens
SDETWRSSHKKFNQKF

SEQ ID NO: 2774279 - protein, 7 aa, Entamoeba invadens
SDEYNNT

SEQ ID NO: 2774280 - protein, 14 aa, Entamoeba invadens
SDEYSSPEVDKIEE

SEQ ID NO: 2774281 - protein, 18 aa, Entamoeba invadens
SDFDSNCETCSKTSRKCD

SEQ ID NO: 2774282 - protein, 13 aa, Entamoeba invadens
SDFDSNCNTCASD

SEQ ID NO: 2774283 - protein, 10 aa, Entamoeba invadens
SDFGSSKYTV

SEQ ID NO: 2774284 - protein, 5 aa, Entamoeba invadens
SDFGT

SEQ ID NO: 2774285 - protein, 8 aa, Entamoeba invadens
SDFGTSQS

SEQ ID NO: 2774286 - protein, 7 aa, Entamoeba invadens
SDFGTSR

SEQ ID NO: 2774287 - protein, 8 aa, Entamoeba invadens
SDFRTNGR

SEQ ID NO: 2774288 - protein, 7 aa, Entamoeba invadens
SDFSNQS

SEQ ID NO: 2774289 - protein, 4 aa, Entamoeba invadens
SDFT

SEQ ID NO: 2774290 - protein, 7 aa, Entamoeba invadens
SDGASIN

SEQ ID NO: 2774291 - protein, 6 aa, Entamoeba invadens
SDGCNE

SEQ ID NO: 2774292 - protein, 22 aa, Entamoeba invadens
SDGDASGFQNGWGSTSTTFSGN

SEQ ID NO: 2774293 - protein, 5 aa, Entamoeba invadens
SDGDD

SEQ ID NO: 2774294 - protein, 4 aa, Entamoeba invadens
SDGF

SEQ ID NO: 2774295 - protein, 12 aa, Entamoeba invadens
SDGISGKSFGQI

SEQ ID NO: 2774296 - protein, 9 aa, Entamoeba invadens
SDGKKMSKR

SEQ ID NO: 2774297 - protein, 13 aa, Entamoeba invadens
SDGKRLDKPSYLS

SEQ ID NO: 2774298 - protein, 6 aa, Entamoeba invadens
SDGKSC

SEQ ID NO: 2774299 - protein, 4 aa, Entamoeba invadens
SDGL

SEQ ID NO: 2774300 - protein, 4 aa, Entamoeba invadens
SDGN

SEQ ID NO: 2774301 - protein, 5 aa, Entamoeba invadens
SDGQI

SEQ ID NO: 2774302 - protein, 15 aa, Entamoeba invadens
SDGRRQPKLNLTNEE

SEQ ID NO: 2774303 - protein, 7 aa, Entamoeba invadens
SDGSEAK

SEQ ID NO: 2774304 - protein, 5 aa, Entamoeba invadens
SDGSI

SEQ ID NO: 2774305 - protein, 7 aa, Entamoeba invadens
SDGSITM

SEQ ID NO: 2774306 - protein, 6 aa, Entamoeba invadens
SDGSRK

SEQ ID NO: 2774307 - protein, 7 aa, Entamoeba invadens
SDGSSCS

SEQ ID NO: 2774308 - protein, 5 aa, Entamoeba invadens
SDGSV

SEQ ID NO: 2774309 - protein, 10 aa, Entamoeba invadens
SDGTLVSNNK

SEQ ID NO: 2774310 - protein, 19 aa, Entamoeba invadens
SDGTSCTTCKATNKKTEDT

SEQ ID NO: 2774311 - protein, 19 aa, Entamoeba invadens
SDGTSCTTCTATNKKTEDT

SEQ ID NO: 2774312 - protein, 5 aa, Entamoeba invadens
SDGTY

SEQ ID NO: 2774313 - protein, 15 aa, Entamoeba invadens
SDGTYSNIKGSQKCQ

SEQ ID NO: 2774314 - protein, 6 aa, Entamoeba invadens
SDGVGT

SEQ ID NO: 2774315 - protein, 16 aa, Entamoeba invadens
SDGYFNSNNVQRQKCS

SEQ ID NO: 2774316 - protein, 9 aa, Entamoeba invadens
SDGYTPKLT

SEQ ID NO: 2774317 - protein, 12 aa, Entamoeba invadens
SDGYYKKDKTCT

SEQ ID NO: 2774318 - protein, 7 aa, Entamoeba invadens
SDGYYKN

SEQ ID NO: 2774319 - protein, 11 aa, Entamoeba invadens
SDHSYSTGHTT

SEQ ID NO: 2774320 - protein, 4 aa, Entamoeba invadens
SDHY

SEQ ID NO: 2774321 - protein, 4 aa, Entamoeba invadens
SDIE

SEQ ID NO: 2774322 - protein, 12 aa, Entamoeba invadens
SDINIPSSVTSI

SEQ ID NO: 2774323 - protein, 8 aa, Entamoeba invadens
SDIPRTRR

SEQ ID NO: 2774324 - protein, 4 aa, Entamoeba invadens
SDIS

SEQ ID NO: 2774325 - protein, 4 aa, Entamoeba invadens
SDIT

SEQ ID NO: 2774326 - protein, 5 aa, Entamoeba invadens
SDIYE

SEQ ID NO: 2774327 - protein, 4 aa, Entamoeba invadens
SDKA

SEQ ID NO: 2774328 - protein, 8 aa, Entamoeba invadens
SDKCATPE

SEQ ID NO: 2774329 - protein, 8 aa, Entamoeba invadens
SDKCNSTS

SEQ ID NO: 2774330 - protein, 8 aa, Entamoeba invadens
SDKDASLY

SEQ ID NO: 2774331 - protein, 6 aa, Entamoeba invadens
SDKEFT

SEQ ID NO: 2774332 - protein, 17 aa, Entamoeba invadens
SDKEKSKYLSNKMENNK

SEQ ID NO: 2774333 - protein, 14 aa, Entamoeba invadens
SDKESLKTFSKESF

SEQ ID NO: 2774334 - protein, 11 aa, Entamoeba invadens
SDKEYDDAIDE

SEQ ID NO: 2774335 - protein, 20 aa, Entamoeba invadens
SDKIPSTVGCNTTSQKQGGW

SEQ ID NO: 2774336 - protein, 6 aa, Entamoeba invadens
SDKKEC

SEQ ID NO: 2774337 - protein, 6 aa, Entamoeba invadens
SDKKQY

SEQ ID NO: 2774338 - protein, 7 aa, Entamoeba invadens
SDKKQYV

SEQ ID NO: 2774339 - protein, 4 aa, Entamoeba invadens
SDKL

SEQ ID NO: 2774340 - protein, 10 aa, Entamoeba invadens
SDKLQTKKAY

SEQ ID NO: 2774341 - protein, 4 aa, Entamoeba invadens
SDKN

SEQ ID NO: 2774342 - protein, 7 aa, Entamoeba invadens
SDKNEEL

SEQ ID NO: 2774343 - protein, 9 aa, Entamoeba invadens
SDKNVKSSF

SEQ ID NO: 2774344 - protein, 17 aa, Entamoeba invadens
SDKPIAEGAMGRVYMGS

SEQ ID NO: 2774345 - protein, 7 aa, Entamoeba invadens
SDKSNKA

SEQ ID NO: 2774346 - protein, 14 aa, Entamoeba invadens
SDKSPTEVGMTNKD

SEQ ID NO: 2774347 - protein, 7 aa, Entamoeba invadens
SDKSTAI

SEQ ID NO: 2774348 - protein, 9 aa, Entamoeba invadens
SDKTAYRKT

SEQ ID NO: 2774349 - protein, 8 aa, Entamoeba invadens
SDKTGKTI

SEQ ID NO: 2774350 - protein, 8 aa, Entamoeba invadens
SDKTGTLT

SEQ ID NO: 2774351 - protein, 8 aa, Entamoeba invadens
SDKTGTVT

SEQ ID NO: 2774352 - protein, 7 aa, Entamoeba invadens
SDKTQFG

SEQ ID NO: 2774353 - protein, 9 aa, Entamoeba invadens
SDKTTKEQY

SEQ ID NO: 2774354 - protein, 9 aa, Entamoeba invadens
SDKYNQLNT

SEQ ID NO: 2774355 - protein, 4 aa, Entamoeba invadens
SDLA

SEQ ID NO: 2774356 - protein, 4 aa, Entamoeba invadens
SDLD

SEQ ID NO: 2774357 - protein, 10 aa, Entamoeba invadens
SDLEQQKEIL

SEQ ID NO: 2774358 - protein, 11 aa, Entamoeba invadens
SDLKNRKSDGQ

SEQ ID NO: 2774359 - protein, 5 aa, Entamoeba invadens
SDLNS

SEQ ID NO: 2774360 - protein, 6 aa, Entamoeba invadens
SDLNTP

SEQ ID NO: 2774361 - protein, 4 aa, Entamoeba invadens
SDLQ

SEQ ID NO: 2774362 - protein, 8 aa, Entamoeba invadens
SDLQNTLY

SEQ ID NO: 2774363 - protein, 13 aa, Entamoeba invadens
SDLSPDSISFGKG

SEQ ID NO: 2774364 - protein, 6 aa, Entamoeba invadens
SDLSQE

SEQ ID NO: 2774365 - protein, 5 aa, Entamoeba invadens
SDLSS

SEQ ID NO: 2774366 - protein, 7 aa, Entamoeba invadens
SDLTGKT

SEQ ID NO: 2774367 - protein, 6 aa, Entamoeba invadens
SDLTTD

SEQ ID NO: 2774368 - protein, 6 aa, Entamoeba invadens
SDLTTN

SEQ ID NO: 2774369 - protein, 4 aa, Entamoeba invadens
SDMS

SEQ ID NO: 2774370 - protein, 7 aa, Entamoeba invadens
SDNDMDM

SEQ ID NO: 2774371 - protein, 6 aa, Entamoeba invadens
SDNDPD

SEQ ID NO: 2774372 - protein, 25 aa, Entamoeba invadens
SDNDSKESSIEITNNQYKDTQSPKL

SEQ ID NO: 2774373 - protein, 34 aa, Entamoeba invadens
SDNEETSIDKSDYSNNEETSFDKSNYSNNPNETI

SEQ ID NO: 2774374 - protein, 6 aa, Entamoeba invadens
SDNESY

SEQ ID NO: 2774375 - protein, 4 aa, Entamoeba invadens
SDNF

SEQ ID NO: 2774376 - protein, 8 aa, Entamoeba invadens
SDNGHEGD

SEQ ID NO: 2774377 - protein, 5 aa, Entamoeba invadens
SDNGK

SEQ ID NO: 2774378 - protein, 15 aa, Entamoeba invadens
SDNGKVTATNITSGD

SEQ ID NO: 2774379 - protein, 5 aa, Entamoeba invadens
SDNIG

SEQ ID NO: 2774380 - protein, 4 aa, Entamoeba invadens
SDNK

SEQ ID NO: 2774381 - protein, 6 aa, Entamoeba invadens
SDNKCG

SEQ ID NO: 2774382 - protein, 6 aa, Entamoeba invadens
SDNKKC

SEQ ID NO: 2774383 - protein, 9 aa, Entamoeba invadens
SDNKPIPVN

SEQ ID NO: 2774384 - protein, 7 aa, Entamoeba invadens
SDNLPDG

SEQ ID NO: 2774385 - protein, 7 aa, Entamoeba invadens
SDNPLQK

SEQ ID NO: 2774386 - protein, 11 aa, Entamoeba invadens
SDNPTSCGKKT

SEQ ID NO: 2774387 - protein, 8 aa, Entamoeba invadens
SDNQMASQ

SEQ ID NO: 2774388 - protein, 9 aa, Entamoeba invadens
SDNRSDSEI

SEQ ID NO: 2774389 - protein, 6 aa, Entamoeba invadens
SDNSKC

SEQ ID NO: 2774390 - protein, 9 aa, Entamoeba invadens
SDNSLGKLS

SEQ ID NO: 2774391 - protein, 8 aa, Entamoeba invadens
SDNSNNTL

SEQ ID NO: 2774392 - protein, 6 aa, Entamoeba invadens
SDNSRL

SEQ ID NO: 2774393 - protein, 7 aa, Entamoeba invadens
SDNTEVS

SEQ ID NO: 2774394 - protein, 7 aa, Entamoeba invadens
SDNTGCH

SEQ ID NO: 2774395 - protein, 15 aa, Entamoeba invadens
SDNTYTYKSTTPTPI

SEQ ID NO: 2774396 - protein, 26 aa, Entamoeba invadens
SDNVQPQLTDPQQLAEDSKKKNKPLS

SEQ ID NO: 2774397 - protein, 7 aa, Entamoeba invadens
SDPAGNN

SEQ ID NO: 2774398 - protein, 19 aa, Entamoeba invadens
SDPDMKEQNEKDEGKTGDE

SEQ ID NO: 2774399 - protein, 9 aa, Entamoeba invadens
SDPDNTDND

SEQ ID NO: 2774400 - protein, 10 aa, Entamoeba invadens
SDPKDRPSFD

SEQ ID NO: 2774401 - protein, 7 aa, Entamoeba invadens
SDPKEFK

SEQ ID NO: 2774402 - protein, 7 aa, Entamoeba invadens
SDPKWRN

SEQ ID NO: 2774403 - protein, 9 aa, Entamoeba invadens
SDPKWRSSL

SEQ ID NO: 2774404 - protein, 7 aa, Entamoeba invadens
SDPLKTR

SEQ ID NO: 2774405 - protein, 8 aa, Entamoeba invadens
SDPLNEFS

SEQ ID NO: 2774406 - protein, 8 aa, Entamoeba invadens
SDPRANGF

SEQ ID NO: 2774407 - protein, 8 aa, Entamoeba invadens
SDPTEITE

SEQ ID NO: 2774408 - protein, 13 aa, Entamoeba invadens
SDPYPPAKFPDSD

SEQ ID NO: 2774409 - protein, 5 aa, Entamoeba invadens
SDQDD

SEQ ID NO: 2774410 - protein, 7 aa, Entamoeba invadens
SDQELQS

SEQ ID NO: 2774411 - protein, 4 aa, Entamoeba invadens
SDQH

SEQ ID NO: 2774412 - protein, 6 aa, Entamoeba invadens
SDQKNL

SEQ ID NO: 2774413 - protein, 18 aa, Entamoeba invadens
SDQSSNNDNTSSEEDNNV

SEQ ID NO: 2774414 - protein, 8 aa, Entamoeba invadens
SDQVSVDS

SEQ ID NO: 2774415 - protein, 9 aa, Entamoeba invadens
SDRGCGSNA

SEQ ID NO: 2774416 - protein, 7 aa, Entamoeba invadens
SDRKRMS

SEQ ID NO: 2774417 - protein, 7 aa, Entamoeba invadens
SDRKRQS

SEQ ID NO: 2774418 - protein, 5 aa, Entamoeba invadens
SDRNN

SEQ ID NO: 2774419 - protein, 9 aa, Entamoeba invadens
SDRRDYEDS

SEQ ID NO: 2774420 - protein, 5 aa, Entamoeba invadens
SDRRR

SEQ ID NO: 2774421 - protein, 4 aa, Entamoeba invadens
SDRS

SEQ ID NO: 2774422 - protein, 9 aa, Entamoeba invadens
SDSDMPESV

SEQ ID NO: 2774423 - protein, 10 aa, Entamoeba invadens
SDSDPTVATD

SEQ ID NO: 2774424 - protein, 8 aa, Entamoeba invadens
SDSDTTNV

SEQ ID NO: 2774425 - protein, 4 aa, Entamoeba invadens
SDSE

SEQ ID NO: 2774426 - protein, 8 aa, Entamoeba invadens
SDSECDYC

SEQ ID NO: 2774427 - protein, 12 aa, Entamoeba invadens
SDSECKNDETLA

SEQ ID NO: 2774428 - protein, 4 aa, Entamoeba invadens
SDSF

SEQ ID NO: 2774429 - protein, 7 aa, Entamoeba invadens
SDSFDAG

SEQ ID NO: 2774430 - protein, 9 aa, Entamoeba invadens
SDSGRKPYP

SEQ ID NO: 2774431 - protein, 5 aa, Entamoeba invadens
SDSGS

SEQ ID NO: 2774432 - protein, 13 aa, Entamoeba invadens
SDSGVLTASGNAK

SEQ ID NO: 2774433 - protein, 8 aa, Entamoeba invadens
SDSIEDEF

SEQ ID NO: 2774434 - protein, 4 aa, Entamoeba invadens
SDSK

SEQ ID NO: 2774435 - protein, 6 aa, Entamoeba invadens
SDSKAY

SEQ ID NO: 2774436 - protein, 6 aa, Entamoeba invadens
SDSKCS

SEQ ID NO: 2774437 - protein, 6 aa, Entamoeba invadens
SDSKKC

SEQ ID NO: 2774438 - protein, 4 aa, Entamoeba invadens
SDSN

SEQ ID NO: 2774439 - protein, 7 aa, Entamoeba invadens
SDSPEGV

SEQ ID NO: 2774440 - protein, 16 aa, Entamoeba invadens
SDSPESRTNVATSIVK

SEQ ID NO: 2774441 - protein, 30 aa, Entamoeba invadens
SDSPRPGIDSPKQTQEKVPKKNRVVRKDLL

SEQ ID NO: 2774442 - protein, 20 aa, Entamoeba invadens
SDSQDDDSENSENGNMEYAD

SEQ ID NO: 2774443 - protein, 5 aa, Entamoeba invadens
SDSQF

SEQ ID NO: 2774444 - protein, 18 aa, Entamoeba invadens
SDSQQAESCKSDEKCTTY

SEQ ID NO: 2774445 - protein, 4 aa, Entamoeba invadens
SDSR

SEQ ID NO: 2774446 - protein, 9 aa, Entamoeba invadens
SDSRNSENF

SEQ ID NO: 2774447 - protein, 16 aa, Entamoeba invadens
SDSSCRSQSQLCEKDD

SEQ ID NO: 2774448 - protein, 6 aa, Entamoeba invadens
SDSSID

SEQ ID NO: 2774449 - protein, 12 aa, Entamoeba invadens
SDSTELPVNTES

SEQ ID NO: 2774450 - protein, 4 aa, Entamoeba invadens
SDSV

SEQ ID NO: 2774451 - protein, 5 aa, Entamoeba invadens
SDSVG

SEQ ID NO: 2774452 - protein, 25 aa, Entamoeba invadens
SDSVGQNCKASQTTSTSPKGNHGTA

SEQ ID NO: 2774453 - protein, 4 aa, Entamoeba invadens
SDSY

SEQ ID NO: 2774454 - protein, 4 aa, Entamoeba invadens
SDTC

SEQ ID NO: 2774455 - protein, 8 aa, Entamoeba invadens
SDTDQSRC

SEQ ID NO: 2774456 - protein, 15 aa, Entamoeba invadens
SDTDVDSCDSSLKKI

SEQ ID NO: 2774457 - protein, 13 aa, Entamoeba invadens
SDTEKCTQTDEQQ

SEQ ID NO: 2774458 - protein, 13 aa, Entamoeba invadens
SDTIKESLNNSTY

SEQ ID NO: 2774459 - protein, 23 aa, Entamoeba invadens
SDTKLSLNQTKPRLKKSTTNSRF

SEQ ID NO: 2774460 - protein, 5 aa, Entamoeba invadens
SDTLA

SEQ ID NO: 2774461 - protein, 6 aa, Entamoeba invadens
SDTLPN

SEQ ID NO: 2774462 - protein, 6 aa, Entamoeba invadens
SDTLTG

SEQ ID NO: 2774463 - protein, 4 aa, Entamoeba invadens
SDTM

SEQ ID NO: 2774464 - protein, 16 aa, Entamoeba invadens
SDTNENSEISVDEETR

SEQ ID NO: 2774465 - protein, 6 aa, Entamoeba invadens
SDTNFG

SEQ ID NO: 2774466 - protein, 6 aa, Entamoeba invadens
SDTNNQ

SEQ ID NO: 2774467 - protein, 8 aa, Entamoeba invadens
SDTNYPCK

SEQ ID NO: 2774468 - protein, 4 aa, Entamoeba invadens
SDTP

SEQ ID NO: 2774469 - protein, 16 aa, Entamoeba invadens
SDTPGKYQKSKVESDK

SEQ ID NO: 2774470 - protein, 8 aa, Entamoeba invadens
SDTPNRST

SEQ ID NO: 2774471 - protein, 5 aa, Entamoeba invadens
SDTQT

SEQ ID NO: 2774472 - protein, 8 aa, Entamoeba invadens
SDTSSLSE

SEQ ID NO: 2774473 - protein, 6 aa, Entamoeba invadens
SDTTIV

SEQ ID NO: 2774474 - protein, 7 aa, Entamoeba invadens
SDTTKDY

SEQ ID NO: 2774475 - protein, 5 aa, Entamoeba invadens
SDTYS

SEQ ID NO: 2774476 - protein, 9 aa, Entamoeba invadens
SDVAPAAKI

SEQ ID NO: 2774477 - protein, 7 aa, Entamoeba invadens
SDVATSK

SEQ ID NO: 2774478 - protein, 7 aa, Entamoeba invadens
SDVDEME

SEQ ID NO: 2774479 - protein, 5 aa, Entamoeba invadens
SDVDV

SEQ ID NO: 2774480 - protein, 6 aa, Entamoeba invadens
SDVDYE

SEQ ID NO: 2774481 - protein, 6 aa, Entamoeba invadens
SDVPGH

SEQ ID NO: 2774482 - protein, 5 aa, Entamoeba invadens
SDVPR

SEQ ID NO: 2774483 - protein, 6 aa, Entamoeba invadens
SDVSDI

SEQ ID NO: 2774484 - protein, 6 aa, Entamoeba invadens
SDVSGS

SEQ ID NO: 2774485 - protein, 9 aa, Entamoeba invadens
SDYCNTTSV

SEQ ID NO: 2774486 - protein, 7 aa, Entamoeba invadens
SDYEDYY

SEQ ID NO: 2774487 - protein, 6 aa, Entamoeba invadens
SDYETG

SEQ ID NO: 2774488 - protein, 10 aa, Entamoeba invadens
SDYKSTTAAY

SEQ ID NO: 2774489 - protein, 7 aa, Entamoeba invadens
SDYSEPY

SEQ ID NO: 2774490 - protein, 24 aa, Entamoeba invadens
SDYSESSNQPEKQLTEEASQSSSG

SEQ ID NO: 2774491 - protein, 6 aa, Entamoeba invadens
SDYSKK

SEQ ID NO: 2774492 - protein, 6 aa, Entamoeba invadens
SDYSQK

SEQ ID NO: 2774493 - protein, 6 aa, Entamoeba invadens
SDYSQT

SEQ ID NO: 2774494 - protein, 5 aa, Entamoeba invadens
SDYSR

SEQ ID NO: 2774495 - protein, 8 aa, Entamoeba invadens
SDYSRKCT

SEQ ID NO: 2774496 - protein, 8 aa, Entamoeba invadens
SDYSTMTH

SEQ ID NO: 2774497 - protein, 12 aa, Entamoeba invadens
SEAAKNHADKLS

SEQ ID NO: 2774498 - protein, 4 aa, Entamoeba invadens
SEAF

SEQ ID NO: 2774499 - protein, 4 aa, Entamoeba invadens
SEAN

SEQ ID NO: 2774500 - protein, 8 aa, Entamoeba invadens
SEAVSRHD

SEQ ID NO: 2774501 - protein, 11 aa, Entamoeba invadens
SECATSGNNER

SEQ ID NO: 2774502 - protein, 13 aa, Entamoeba invadens
SECDQTKAECTKC

SEQ ID NO: 2774503 - protein, 12 aa, Entamoeba invadens
SECENGMKKDSG

SEQ ID NO: 2774504 - protein, 4 aa, Entamoeba invadens
SECI

SEQ ID NO: 2774505 - protein, 4 aa, Entamoeba invadens
SECN

SEQ ID NO: 2774506 - protein, 5 aa, Entamoeba invadens
SECNK

SEQ ID NO: 2774507 - protein, 6 aa, Entamoeba invadens
SECTAC

SEQ ID NO: 2774508 - protein, 12 aa, Entamoeba invadens
SECTSNEENDCS

SEQ ID NO: 2774509 - protein, 7 aa, Entamoeba invadens
SEDADKD

SEQ ID NO: 2774510 - protein, 11 aa, Entamoeba invadens
SEDATGCISPQ

SEQ ID NO: 2774511 - protein, 4 aa, Entamoeba invadens
SEDE

SEQ ID NO: 2774512 - protein, 9 aa, Entamoeba invadens
SEDEEGGLS

SEQ ID NO: 2774513 - protein, 18 aa, Entamoeba invadens
SEDEEHDPVAQDWQIHEV

SEQ ID NO: 2774514 - protein, 10 aa, Entamoeba invadens
SEDESGEIPV

SEQ ID NO: 2774515 - protein, 7 aa, Entamoeba invadens
SEDETTV

SEQ ID NO: 2774516 - protein, 9 aa, Entamoeba invadens
SEDGTDVTK

SEQ ID NO: 2774517 - protein, 12 aa, Entamoeba invadens
SEDGVYEGREQI

SEQ ID NO: 2774518 - protein, 9 aa, Entamoeba invadens
SEDKTSCDK

SEQ ID NO: 2774519 - protein, 5 aa, Entamoeba invadens
SEDLE

SEQ ID NO: 2774520 - protein, 4 aa, Entamoeba invadens
SEDN

SEQ ID NO: 2774521 - protein, 6 aa, Entamoeba invadens
SEDNEI

SEQ ID NO: 2774522 - protein, 13 aa, Entamoeba invadens
SEDTKIKLLRFSS

SEQ ID NO: 2774523 - protein, 7 aa, Entamoeba invadens
SEDVGCE

SEQ ID NO: 2774524 - protein, 5 aa, Entamoeba invadens
SEECA

SEQ ID NO: 2774525 - protein, 7 aa, Entamoeba invadens
SEECPKT

SEQ ID NO: 2774526 - protein, 13 aa, Entamoeba invadens
SEEDKHPETTQLQ

SEQ ID NO: 2774527 - protein, 13 aa, Entamoeba invadens
SEEDKVSDRTRSY

SEQ ID NO: 2774528 - protein, 8 aa, Entamoeba invadens
SEEESLCQ

SEQ ID NO: 2774529 - protein, 7 aa, Entamoeba invadens
SEEETKK

SEQ ID NO: 2774530 - protein, 4 aa, Entamoeba invadens
SEEF

SEQ ID NO: 2774531 - protein, 9 aa, Entamoeba invadens
SEEGKEGRN

SEQ ID NO: 2774532 - protein, 11 aa, Entamoeba invadens
SEEIRKDQSHF

SEQ ID NO: 2774533 - protein, 9 aa, Entamoeba invadens
SEEKCGDKT

SEQ ID NO: 2774534 - protein, 8 aa, Entamoeba invadens
SEEKPSGV

SEQ ID NO: 2774535 - protein, 6 aa, Entamoeba invadens
SEEKSL

SEQ ID NO: 2774536 - protein, 12 aa, Entamoeba invadens
SEEKSPVTQEEL

SEQ ID NO: 2774537 - protein, 5 aa, Entamoeba invadens
SEEKW

SEQ ID NO: 2774538 - protein, 7 aa, Entamoeba invadens
SEENYNQ

SEQ ID NO: 2774539 - protein, 8 aa, Entamoeba invadens
SEEPSDRI

SEQ ID NO: 2774540 - protein, 25 aa, Entamoeba invadens
SEEQNAQHQQSETNDAEKVNEDNKD

SEQ ID NO: 2774541 - protein, 4 aa, Entamoeba invadens
SEES

SEQ ID NO: 2774542 - protein, 11 aa, Entamoeba invadens
SEESAKSYSNV

SEQ ID NO: 2774543 - protein, 17 aa, Entamoeba invadens
SEESNQIKVTTRNHADA

SEQ ID NO: 2774544 - protein, 8 aa, Entamoeba invadens
SEESVGNT

SEQ ID NO: 2774545 - protein, 5 aa, Entamoeba invadens
SEESY

SEQ ID NO: 2774546 - protein, 9 aa, Entamoeba invadens
SEESYDGET

SEQ ID NO: 2774547 - protein, 8 aa, Entamoeba invadens
SEETINDE

SEQ ID NO: 2774548 - protein, 6 aa, Entamoeba invadens
SEETKV

SEQ ID NO: 2774549 - protein, 14 aa, Entamoeba invadens
SEEVEKQRRKEITD

SEQ ID NO: 2774550 - protein, 4 aa, Entamoeba invadens
SEEY

SEQ ID NO: 2774551 - protein, 12 aa, Entamoeba invadens
SEFDRFSGADRT

SEQ ID NO: 2774552 - protein, 4 aa, Entamoeba invadens
SEGC

SEQ ID NO: 2774553 - protein, 5 aa, Entamoeba invadens
SEGCG

SEQ ID NO: 2774554 - protein, 10 aa, Entamoeba invadens
SEGCSNTTGN

SEQ ID NO: 2774555 - protein, 4 aa, Entamoeba invadens
SEGF

SEQ ID NO: 2774556 - protein, 10 aa, Entamoeba invadens
SEGGNTEESM

SEQ ID NO: 2774557 - protein, 7 aa, Entamoeba invadens
SEGITLP

SEQ ID NO: 2774558 - protein, 4 aa, Entamoeba invadens
SEGK

SEQ ID NO: 2774559 - protein, 5 aa, Entamoeba invadens
SEGKK

SEQ ID NO: 2774560 - protein, 18 aa, Entamoeba invadens
SEGKQLSDDRKSCEDTTN

SEQ ID NO: 2774561 - protein, 5 aa, Entamoeba invadens
SEGKR

SEQ ID NO: 2774562 - protein, 7 aa, Entamoeba invadens
SEGKRRQ

SEQ ID NO: 2774563 - protein, 4 aa, Entamoeba invadens
SEGN

SEQ ID NO: 2774564 - protein, 5 aa, Entamoeba invadens
SEGRC

SEQ ID NO: 2774565 - protein, 6 aa, Entamoeba invadens
SEGRSA

SEQ ID NO: 2774566 - protein, 43 aa, Entamoeba invadens
SEGSESKENNAENGDKKNLKSDDESVSMKENVPEINKENMLIL

SEQ ID NO: 2774567 - protein, 9 aa, Entamoeba invadens
SEGSYKSDY

SEQ ID NO: 2774568 - protein, 16 aa, Entamoeba invadens
SEGTYPSGVGKCSSCN

SEQ ID NO: 2774569 - protein, 12 aa, Entamoeba invadens
SEGYMTDETTNK

SEQ ID NO: 2774570 - protein, 7 aa, Entamoeba invadens
SEGYTTH

SEQ ID NO: 2774571 - protein, 5 aa, Entamoeba invadens
SEHHD

SEQ ID NO: 2774572 - protein, 5 aa, Entamoeba invadens
SEHKV

SEQ ID NO: 2774573 - protein, 6 aa, Entamoeba invadens
SEHNSA

SEQ ID NO: 2774574 - protein, 7 aa, Entamoeba invadens
SEHPADC

SEQ ID NO: 2774575 - protein, 8 aa, Entamoeba invadens
SEHQPSSW

SEQ ID NO: 2774576 - protein, 9 aa, Entamoeba invadens
SEHSHDNNE

SEQ ID NO: 2774577 - protein, 5 aa, Entamoeba invadens
SEIDR

SEQ ID NO: 2774578 - protein, 8 aa, Entamoeba invadens
SEIDTTKE

SEQ ID NO: 2774579 - protein, 5 aa, Entamoeba invadens
SEIEI

SEQ ID NO: 2774580 - protein, 37 aa, Entamoeba invadens
SEIKEKPIEEVKPEADHIEQAPTESLNTPTTEEGPIS

SEQ ID NO: 2774581 - protein, 9 aa, Entamoeba invadens
SEIPVNEES

SEQ ID NO: 2774582 - protein, 4 aa, Entamoeba invadens
SEIS

SEQ ID NO: 2774583 - protein, 6 aa, Entamoeba invadens
SEISIQ

SEQ ID NO: 2774584 - protein, 6 aa, Entamoeba invadens
SEITKD

SEQ ID NO: 2774585 - protein, 7 aa, Entamoeba invadens
SEITKTS

SEQ ID NO: 2774586 - protein, 5 aa, Entamoeba invadens
SEITT

SEQ ID NO: 2774587 - protein, 10 aa, Entamoeba invadens
SEKAIDTEGT

SEQ ID NO: 2774588 - protein, 15 aa, Entamoeba invadens
SEKCEAGYYQSDGKC

SEQ ID NO: 2774589 - protein, 11 aa, Entamoeba invadens
SEKDGAYSYTQ

SEQ ID NO: 2774590 - protein, 6 aa, Entamoeba invadens
SEKDYE

SEQ ID NO: 2774591 - protein, 8 aa, Entamoeba invadens
SEKEGEYV

SEQ ID NO: 2774592 - protein, 8 aa, Entamoeba invadens
SEKEPENC

SEQ ID NO: 2774593 - protein, 8 aa, Entamoeba invadens
SEKESEID

SEQ ID NO: 2774594 - protein, 6 aa, Entamoeba invadens
SEKGLD

SEQ ID NO: 2774595 - protein, 14 aa, Entamoeba invadens
SEKGSNLSGGQRQR

SEQ ID NO: 2774596 - protein, 5 aa, Entamoeba invadens
SEKGV

SEQ ID NO: 2774597 - protein, 5 aa, Entamoeba invadens
SEKIG

SEQ ID NO: 2774598 - protein, 10 aa, Entamoeba invadens
SEKKTRDTHV

SEQ ID NO: 2774599 - protein, 4 aa, Entamoeba invadens
SEKN

SEQ ID NO: 2774600 - protein, 7 aa, Entamoeba invadens
SEKNEQI

SEQ ID NO: 2774601 - protein, 9 aa, Entamoeba invadens
SEKPFAEGA

SEQ ID NO: 2774602 - protein, 12 aa, Entamoeba invadens
SEKPIARGPTSD

SEQ ID NO: 2774603 - protein, 7 aa, Entamoeba invadens
SEKPLED

SEQ ID NO: 2774604 - protein, 7 aa, Entamoeba invadens
SEKQEEE

SEQ ID NO: 2774605 - protein, 72 aa, Entamoeba invadens
SEKRKREEEARRGSEKRKREEEARRGSEKRKREEEARRGSEKRKREEEARRGSEKRKREEEARRGSEKRKRK

SEQ ID NO: 2774606 - protein, 17 aa, Entamoeba invadens
SEKSDDHKETEEDTNFV

SEQ ID NO: 2774607 - protein, 18 aa, Entamoeba invadens
SEKSLDDFKKENINKGNL

SEQ ID NO: 2774608 - protein, 9 aa, Entamoeba invadens
SEKSSHLDA

SEQ ID NO: 2774609 - protein, 68 aa, Entamoeba invadens
SEKSSSQQNEESPLHKTHTQNETISPTTTSSQRPSQLESQTSSQVRSTHSKNGQKSKKDTDDDSQEYV

SEQ ID NO: 2774610 - protein, 6 aa, Entamoeba invadens
SEKTTD

SEQ ID NO: 2774611 - protein, 6 aa, Entamoeba invadens
SEKVGM

SEQ ID NO: 2774612 - protein, 7 aa, Entamoeba invadens
SEKVNAK

SEQ ID NO: 2774613 - protein, 9 aa, Entamoeba invadens
SEKYCRPQS

SEQ ID NO: 2774614 - protein, 8 aa, Entamoeba invadens
SEKYGGED

SEQ ID NO: 2774615 - protein, 7 aa, Entamoeba invadens
SEKYSGF

SEQ ID NO: 2774616 - protein, 7 aa, Entamoeba invadens
SELDERT

SEQ ID NO: 2774617 - protein, 10 aa, Entamoeba invadens
SELDRNINEA

SEQ ID NO: 2774618 - protein, 4 aa, Entamoeba invadens
SELK

SEQ ID NO: 2774619 - protein, 7 aa, Entamoeba invadens
SELKTRS

SEQ ID NO: 2774620 - protein, 12 aa, Entamoeba invadens
SELNDTQEYTNE

SEQ ID NO: 2774621 - protein, 13 aa, Entamoeba invadens
SELQEERCNGTKS

SEQ ID NO: 2774622 - protein, 19 aa, Entamoeba invadens
SELRATRPTKSFDKITPKE

SEQ ID NO: 2774623 - protein, 11 aa, Entamoeba invadens
SELSSRLDPEE

SEQ ID NO: 2774624 - protein, 4 aa, Entamoeba invadens
SELT

SEQ ID NO: 2774625 - protein, 5 aa, Entamoeba invadens
SEMGT

SEQ ID NO: 2774626 - protein, 6 aa, Entamoeba invadens
SEMHSN

SEQ ID NO: 2774627 - protein, 10 aa, Entamoeba invadens
SEMKNAKGKV

SEQ ID NO: 2774628 - protein, 11 aa, Entamoeba invadens
SEMTEDEKENL

SEQ ID NO: 2774629 - protein, 11 aa, Entamoeba invadens
SEMYTSSAKSS

SEQ ID NO: 2774630 - protein, 20 aa, Entamoeba invadens
SENCEEGSVVKESKCTQNSV

SEQ ID NO: 2774631 - protein, 9 aa, Entamoeba invadens
SENCTEDDL

SEQ ID NO: 2774632 - protein, 8 aa, Entamoeba invadens
SENEKAGA

SEQ ID NO: 2774633 - protein, 6 aa, Entamoeba invadens
SENENV

SEQ ID NO: 2774634 - protein, 7 aa, Entamoeba invadens
SENERTA

SEQ ID NO: 2774635 - protein, 6 aa, Entamoeba invadens
SENGEC

SEQ ID NO: 2774636 - protein, 5 aa, Entamoeba invadens
SENGK

SEQ ID NO: 2774637 - protein, 11 aa, Entamoeba invadens
SENHELSSDKL

SEQ ID NO: 2774638 - protein, 4 aa, Entamoeba invadens
SENI

SEQ ID NO: 2774639 - protein, 5 aa, Entamoeba invadens
SENIQ

SEQ ID NO: 2774640 - protein, 9 aa, Entamoeba invadens
SENKITDVT

SEQ ID NO: 2774641 - protein, 7 aa, Entamoeba invadens
SENKPIV

SEQ ID NO: 2774642 - protein, 4 aa, Entamoeba invadens
SENN

SEQ ID NO: 2774643 - protein, 5 aa, Entamoeba invadens
SENNA

SEQ ID NO: 2774644 - protein, 12 aa, Entamoeba invadens
SENNSTNSSNNL

SEQ ID NO: 2774645 - protein, 7 aa, Entamoeba invadens
SENPEKR

SEQ ID NO: 2774646 - protein, 8 aa, Entamoeba invadens
SENPIAEG

SEQ ID NO: 2774647 - protein, 8 aa, Entamoeba invadens
SENPKCQK

SEQ ID NO: 2774648 - protein, 24 aa, Entamoeba invadens
SENPLESYATETACKEPKNVTDSY

SEQ ID NO: 2774649 - protein, 8 aa, Entamoeba invadens
SENRNARF

SEQ ID NO: 2774650 - protein, 6 aa, Entamoeba invadens
SENSKS

SEQ ID NO: 2774651 - protein, 8 aa, Entamoeba invadens
SENSPEEV

SEQ ID NO: 2774652 - protein, 5 aa, Entamoeba invadens
SENST

SEQ ID NO: 2774653 - protein, 8 aa, Entamoeba invadens
SENTCTPC

SEQ ID NO: 2774654 - protein, 5 aa, Entamoeba invadens
SENTF

SEQ ID NO: 2774655 - protein, 6 aa, Entamoeba invadens
SENTMI

SEQ ID NO: 2774656 - protein, 9 aa, Entamoeba invadens
SENYYTDGQ

SEQ ID NO: 2774657 - protein, 87 aa, Entamoeba invadens
SEPEPKPQEDKVKSPKSPKSSKRTSINKTPTQNEEIENTPQAQSPKVTPLDKPEPVFSRKSDGNGEEKKEKKRQRTPHLSRDTTPPL

SEQ ID NO: 2774658 - protein, 7 aa, Entamoeba invadens
SEPGGTI

SEQ ID NO: 2774659 - protein, 5 aa, Entamoeba invadens
SEPIL

SEQ ID NO: 2774660 - protein, 8 aa, Entamoeba invadens
SEPKRYGT

SEQ ID NO: 2774661 - protein, 7 aa, Entamoeba invadens
SEPKWRD

SEQ ID NO: 2774662 - protein, 5 aa, Entamoeba invadens
SEPPL

SEQ ID NO: 2774663 - protein, 5 aa, Entamoeba invadens
SEPQN

SEQ ID NO: 2774664 - protein, 20 aa, Entamoeba invadens
SEPTLKSRVPEKISDRYPGI

SEQ ID NO: 2774665 - protein, 9 aa, Entamoeba invadens
SEPTPPESI

SEQ ID NO: 2774666 - protein, 4 aa, Entamoeba invadens
SEQD

SEQ ID NO: 2774667 - protein, 5 aa, Entamoeba invadens
SEQDR

SEQ ID NO: 2774668 - protein, 7 aa, Entamoeba invadens
SEQEGRL

SEQ ID NO: 2774669 - protein, 15 aa, Entamoeba invadens
SEQIKSDPLCSPGCS

SEQ ID NO: 2774670 - protein, 12 aa, Entamoeba invadens
SEQKETDKITEE

SEQ ID NO: 2774671 - protein, 9 aa, Entamoeba invadens
SEQLNQCEN

SEQ ID NO: 2774672 - protein, 10 aa, Entamoeba invadens
SEQLTPCENN

SEQ ID NO: 2774673 - protein, 24 aa, Entamoeba invadens
SEQNAPSCTSCGDGTYSKEGATRC

SEQ ID NO: 2774674 - protein, 5 aa, Entamoeba invadens
SEQNI

SEQ ID NO: 2774675 - protein, 8 aa, Entamoeba invadens
SEQPNEDS

SEQ ID NO: 2774676 - protein, 6 aa, Entamoeba invadens
SEQQHS

SEQ ID NO: 2774677 - protein, 9 aa, Entamoeba invadens
SEQTSRQER

SEQ ID NO: 2774678 - protein, 6 aa, Entamoeba invadens
SEREEI

SEQ ID NO: 2774679 - protein, 15 aa, Entamoeba invadens
SERGANLSGGQRQRV

SEQ ID NO: 2774680 - protein, 29 aa, Entamoeba invadens
SERGITEDDPTVTGRVGPNWPEQRVSGHW

SEQ ID NO: 2774681 - protein, 12 aa, Entamoeba invadens
SERGKTMQQTGE

SEQ ID NO: 2774682 - protein, 6 aa, Entamoeba invadens
SERHGA

SEQ ID NO: 2774683 - protein, 4 aa, Entamoeba invadens
SERK

SEQ ID NO: 2774684 - protein, 6 aa, Entamoeba invadens
SERLDG

SEQ ID NO: 2774685 - protein, 4 aa, Entamoeba invadens
SERN

SEQ ID NO: 2774686 - protein, 20 aa, Entamoeba invadens
SERNLASKALSQGIGTPTYM

SEQ ID NO: 2774687 - protein, 9 aa, Entamoeba invadens
SERPIAEGA

SEQ ID NO: 2774688 - protein, 7 aa, Entamoeba invadens
SERRNDY

SEQ ID NO: 2774689 - protein, 19 aa, Entamoeba invadens
SERSLQSKALSQGIGTPTY

SEQ ID NO: 2774690 - protein, 20 aa, Entamoeba invadens
SERSLSAKALTQGIGTPNYM

SEQ ID NO: 2774691 - protein, 10 aa, Entamoeba invadens
SERVSDPETL

SEQ ID NO: 2774692 - protein, 9 aa, Entamoeba invadens
SESAAISES

SEQ ID NO: 2774693 - protein, 16 aa, Entamoeba invadens
SESDSGDDESDSEDQI

SEQ ID NO: 2774694 - protein, 4 aa, Entamoeba invadens
SESE

SEQ ID NO: 2774695 - protein, 6 aa, Entamoeba invadens
SESEIR

SEQ ID NO: 2774696 - protein, 8 aa, Entamoeba invadens
SESEVNCG

SEQ ID NO: 2774697 - protein, 13 aa, Entamoeba invadens
SESFNPQSANQQE

SEQ ID NO: 2774698 - protein, 7 aa, Entamoeba invadens
SESFRST

SEQ ID NO: 2774699 - protein, 4 aa, Entamoeba invadens
SESG

SEQ ID NO: 2774700 - protein, 7 aa, Entamoeba invadens
SESGSLK

SEQ ID NO: 2774701 - protein, 7 aa, Entamoeba invadens
SESGWCE

SEQ ID NO: 2774702 - protein, 13 aa, Entamoeba invadens
SESKLENSSREHN

SEQ ID NO: 2774703 - protein, 10 aa, Entamoeba invadens
SESMRARTGV

SEQ ID NO: 2774704 - protein, 10 aa, Entamoeba invadens
SESNSGYVKP

SEQ ID NO: 2774705 - protein, 5 aa, Entamoeba invadens
SESPI

SEQ ID NO: 2774706 - protein, 9 aa, Entamoeba invadens
SESPIAEGA

SEQ ID NO: 2774707 - protein, 8 aa, Entamoeba invadens
SESQHTAA

SEQ ID NO: 2774708 - protein, 7 aa, Entamoeba invadens
SESQIGC

SEQ ID NO: 2774709 - protein, 10 aa, Entamoeba invadens
SESQSQESYE

SEQ ID NO: 2774710 - protein, 16 aa, Entamoeba invadens
SESQTPRISEEKGEAH

SEQ ID NO: 2774711 - protein, 7 aa, Entamoeba invadens
SESSQEF

SEQ ID NO: 2774712 - protein, 6 aa, Entamoeba invadens
SESSSR

SEQ ID NO: 2774713 - protein, 11 aa, Entamoeba invadens
SESSSSSDYIG

SEQ ID NO: 2774714 - protein, 9 aa, Entamoeba invadens
SESSSSWDY

SEQ ID NO: 2774715 - protein, 4 aa, Entamoeba invadens
SEST

SEQ ID NO: 2774716 - protein, 16 aa, Entamoeba invadens
SESTNKNAKTFGYNND

SEQ ID NO: 2774717 - protein, 6 aa, Entamoeba invadens
SESTSL

SEQ ID NO: 2774718 - protein, 9 aa, Entamoeba invadens
SESVSIGST

SEQ ID NO: 2774719 - protein, 5 aa, Entamoeba invadens
SESVV

SEQ ID NO: 2774720 - protein, 6 aa, Entamoeba invadens
SETAPT

SEQ ID NO: 2774721 - protein, 6 aa, Entamoeba invadens
SETCTH

SEQ ID NO: 2774722 - protein, 6 aa, Entamoeba invadens
SETDKM

SEQ ID NO: 2774723 - protein, 5 aa, Entamoeba invadens
SETDN

SEQ ID NO: 2774724 - protein, 8 aa, Entamoeba invadens
SETNATER

SEQ ID NO: 2774725 - protein, 8 aa, Entamoeba invadens
SETNDAGF

SEQ ID NO: 2774726 - protein, 13 aa, Entamoeba invadens
SETNGKQSCSEEV

SEQ ID NO: 2774727 - protein, 5 aa, Entamoeba invadens
SETNL

SEQ ID NO: 2774728 - protein, 5 aa, Entamoeba invadens
SETNN

SEQ ID NO: 2774729 - protein, 8 aa, Entamoeba invadens
SETNPKQC

SEQ ID NO: 2774730 - protein, 4 aa, Entamoeba invadens
SETP

SEQ ID NO: 2774731 - protein, 9 aa, Entamoeba invadens
SETPIAEGA

SEQ ID NO: 2774732 - protein, 8 aa, Entamoeba invadens
SETQLNQS

SEQ ID NO: 2774733 - protein, 14 aa, Entamoeba invadens
SETQQAHSPPSETF

SEQ ID NO: 2774734 - protein, 6 aa, Entamoeba invadens
SETRKN

SEQ ID NO: 2774735 - protein, 5 aa, Entamoeba invadens
SETSG

SEQ ID NO: 2774736 - protein, 8 aa, Entamoeba invadens
SETSPYKY

SEQ ID NO: 2774737 - protein, 27 aa, Entamoeba invadens
SETTEDSTVPPPFTPNDKDHIPRDRSN

SEQ ID NO: 2774738 - protein, 7 aa, Entamoeba invadens
SETTNNS

SEQ ID NO: 2774739 - protein, 6 aa, Entamoeba invadens
SETTTN

SEQ ID NO: 2774740 - protein, 6 aa, Entamoeba invadens
SETTYS

SEQ ID NO: 2774741 - protein, 4 aa, Entamoeba invadens
SETV

SEQ ID NO: 2774742 - protein, 6 aa, Entamoeba invadens
SETVNR

SEQ ID NO: 2774743 - protein, 7 aa, Entamoeba invadens
SETYNNE

SEQ ID NO: 2774744 - protein, 6 aa, Entamoeba invadens
SEVDKN

SEQ ID NO: 2774745 - protein, 5 aa, Entamoeba invadens
SEVED

SEQ ID NO: 2774746 - protein, 8 aa, Entamoeba invadens
SEVGEGNF

SEQ ID NO: 2774747 - protein, 5 aa, Entamoeba invadens
SEVGG

SEQ ID NO: 2774748 - protein, 6 aa, Entamoeba invadens
SEVHEE

SEQ ID NO: 2774749 - protein, 9 aa, Entamoeba invadens
SEVNKKNQK

SEQ ID NO: 2774750 - protein, 6 aa, Entamoeba invadens
SEVPHN

SEQ ID NO: 2774751 - protein, 8 aa, Entamoeba invadens
SEVPPKLE

SEQ ID NO: 2774752 - protein, 14 aa, Entamoeba invadens
SEVPSQHKEGEAQF

SEQ ID NO: 2774753 - protein, 13 aa, Entamoeba invadens
SEVRSSAQFREKY

SEQ ID NO: 2774754 - protein, 5 aa, Entamoeba invadens
SEVSD

SEQ ID NO: 2774755 - protein, 7 aa, Entamoeba invadens
SEVSKSG

SEQ ID NO: 2774756 - protein, 8 aa, Entamoeba invadens
SEYAIEGN

SEQ ID NO: 2774757 - protein, 8 aa, Entamoeba invadens
SEYITGSN

SEQ ID NO: 2774758 - protein, 5 aa, Entamoeba invadens
SEYNF

SEQ ID NO: 2774759 - protein, 6 aa, Entamoeba invadens
SEYNGF

SEQ ID NO: 2774760 - protein, 8 aa, Entamoeba invadens
SEYNGGEF

SEQ ID NO: 2774761 - protein, 6 aa, Entamoeba invadens
SEYNGQ

SEQ ID NO: 2774762 - protein, 6 aa, Entamoeba invadens
SEYSGK

SEQ ID NO: 2774763 - protein, 4 aa, Entamoeba invadens
SEYT

SEQ ID NO: 2774764 - protein, 6 aa, Entamoeba invadens
SEYYKD

SEQ ID NO: 2774765 - protein, 4 aa, Entamoeba invadens
SFAP

SEQ ID NO: 2774766 - protein, 6 aa, Entamoeba invadens
SFASNT

SEQ ID NO: 2774767 - protein, 11 aa, Entamoeba invadens
SFDAGNSPTPV

SEQ ID NO: 2774768 - protein, 13 aa, Entamoeba invadens
SFDENCETCSTDQ

SEQ ID NO: 2774769 - protein, 11 aa, Entamoeba invadens
SFDNCQPGQYY

SEQ ID NO: 2774770 - protein, 9 aa, Entamoeba invadens
SFDQKGEME

SEQ ID NO: 2774771 - protein, 10 aa, Entamoeba invadens
SFDSNCETCA

SEQ ID NO: 2774772 - protein, 7 aa, Entamoeba invadens
SFDSNCS

SEQ ID NO: 2774773 - protein, 5 aa, Entamoeba invadens
SFEDN

SEQ ID NO: 2774774 - protein, 6 aa, Entamoeba invadens
SFEENF

SEQ ID NO: 2774775 - protein, 7 aa, Entamoeba invadens
SFEEQTQ

SEQ ID NO: 2774776 - protein, 7 aa, Entamoeba invadens
SFEERER

SEQ ID NO: 2774777 - protein, 12 aa, Entamoeba invadens
SFEEWSTEDQRS

SEQ ID NO: 2774778 - protein, 10 aa, Entamoeba invadens
SFEGETGDAS

SEQ ID NO: 2774779 - protein, 5 aa, Entamoeba invadens
SFEIA

SEQ ID NO: 2774780 - protein, 10 aa, Entamoeba invadens
SFEKEGGINE

SEQ ID NO: 2774781 - protein, 5 aa, Entamoeba invadens
SFEKN

SEQ ID NO: 2774782 - protein, 6 aa, Entamoeba invadens
SFEKNK

SEQ ID NO: 2774783 - protein, 17 aa, Entamoeba invadens
SFEKSPKPKQTTGDTEL

SEQ ID NO: 2774784 - protein, 6 aa, Entamoeba invadens
SFENTQ

SEQ ID NO: 2774785 - protein, 14 aa, Entamoeba invadens
SFENWTEDDRKKME

SEQ ID NO: 2774786 - protein, 14 aa, Entamoeba invadens
SFENWTNDDEKKMT

SEQ ID NO: 2774787 - protein, 14 aa, Entamoeba invadens
SFENWTNSDEKKME

SEQ ID NO: 2774788 - protein, 6 aa, Entamoeba invadens
SFEPDT

SEQ ID NO: 2774789 - protein, 5 aa, Entamoeba invadens
SFESN

SEQ ID NO: 2774790 - protein, 8 aa, Entamoeba invadens
SFESTTLT

SEQ ID NO: 2774791 - protein, 4 aa, Entamoeba invadens
SFET

SEQ ID NO: 2774792 - protein, 11 aa, Entamoeba invadens
SFETWSDDDEK

SEQ ID NO: 2774793 - protein, 6 aa, Entamoeba invadens
SFGAED

SEQ ID NO: 2774794 - protein, 13 aa, Entamoeba invadens
SFGDSSFSKTAMP

SEQ ID NO: 2774795 - protein, 5 aa, Entamoeba invadens
SFGEI

SEQ ID NO: 2774796 - protein, 4 aa, Entamoeba invadens
SFGF

SEQ ID NO: 2774797 - protein, 9 aa, Entamoeba invadens
SFGGESCET

SEQ ID NO: 2774798 - protein, 5 aa, Entamoeba invadens
SFGGN

SEQ ID NO: 2774799 - protein, 10 aa, Entamoeba invadens
SFGGPGNCRT

SEQ ID NO: 2774800 - protein, 5 aa, Entamoeba invadens
SFGGT

SEQ ID NO: 2774801 - protein, 4 aa, Entamoeba invadens
SFGP

SEQ ID NO: 2774802 - protein, 11 aa, Entamoeba invadens
SFGREQSTQVT

SEQ ID NO: 2774803 - protein, 5 aa, Entamoeba invadens
SFGSE

SEQ ID NO: 2774804 - protein, 15 aa, Entamoeba invadens
SFGTESGKTEHCATA

SEQ ID NO: 2774805 - protein, 4 aa, Entamoeba invadens
SFHS

SEQ ID NO: 2774806 - protein, 9 aa, Entamoeba invadens
SFKDSKDIT

SEQ ID NO: 2774807 - protein, 8 aa, Entamoeba invadens
SFKEETID

SEQ ID NO: 2774808 - protein, 15 aa, Entamoeba invadens
SFKGGSTERPSESGI

SEQ ID NO: 2774809 - protein, 9 aa, Entamoeba invadens
SFKRNEKYD

SEQ ID NO: 2774810 - protein, 57 aa, Entamoeba invadens
SFNSFPSDHSPMSSNNVSSVNVSSPIDHSSTSPTGVQQDSHTNSNGSQPNTANASEI

SEQ ID NO: 2774811 - protein, 11 aa, Entamoeba invadens
SFNTKEGKEKG

SEQ ID NO: 2774812 - protein, 4 aa, Entamoeba invadens
SFPE

SEQ ID NO: 2774813 - protein, 16 aa, Entamoeba invadens
SFPNDSYEQIKAPPEF

SEQ ID NO: 2774814 - protein, 12 aa, Entamoeba invadens
SFPPTNQAPTFP

SEQ ID NO: 2774815 - protein, 7 aa, Entamoeba invadens
SFPQKRN

SEQ ID NO: 2774816 - protein, 12 aa, Entamoeba invadens
SFPSGHSAASFN

SEQ ID NO: 2774817 - protein, 9 aa, Entamoeba invadens
SFPSGHSST

SEQ ID NO: 2774818 - protein, 7 aa, Entamoeba invadens
SFQSAAG

SEQ ID NO: 2774819 - protein, 11 aa, Entamoeba invadens
SFQTPLRAEKN

SEQ ID NO: 2774820 - protein, 4 aa, Entamoeba invadens
SFRD

SEQ ID NO: 2774821 - protein, 17 aa, Entamoeba invadens
SFRETNEVTKEEQNSKT

SEQ ID NO: 2774822 - protein, 8 aa, Entamoeba invadens
SFRPSRSY

SEQ ID NO: 2774823 - protein, 17 aa, Entamoeba invadens
SFRSDEPQEQKTPDDKH

SEQ ID NO: 2774824 - protein, 11 aa, Entamoeba invadens
SFSDKEGEAKG

SEQ ID NO: 2774825 - protein, 11 aa, Entamoeba invadens
SFSEQSPDAYI

SEQ ID NO: 2774826 - protein, 10 aa, Entamoeba invadens
SFSETKGIEI

SEQ ID NO: 2774827 - protein, 6 aa, Entamoeba invadens
SFSKSG

SEQ ID NO: 2774828 - protein, 6 aa, Entamoeba invadens
SFSPEA

SEQ ID NO: 2774829 - protein, 6 aa, Entamoeba invadens
SFSPTG

SEQ ID NO: 2774830 - protein, 9 aa, Entamoeba invadens
SFSSTNDVT

SEQ ID NO: 2774831 - protein, 13 aa, Entamoeba invadens
SFSTSSRDNVDPP

SEQ ID NO: 2774832 - protein, 7 aa, Entamoeba invadens
SFTEGEM

SEQ ID NO: 2774833 - protein, 4 aa, Entamoeba invadens
SFTG

SEQ ID NO: 2774834 - protein, 6 aa, Entamoeba invadens
SFTPPP

SEQ ID NO: 2774835 - protein, 5 aa, Entamoeba invadens
SFTQP

SEQ ID NO: 2774836 - protein, 4 aa, Entamoeba invadens
SFTS

SEQ ID NO: 2774837 - protein, 7 aa, Entamoeba invadens
SFTSDDL

SEQ ID NO: 2774838 - protein, 6 aa, Entamoeba invadens
SFTSSQ

SEQ ID NO: 2774839 - protein, 11 aa, Entamoeba invadens
SFTSTTLTQGA

SEQ ID NO: 2774840 - protein, 7 aa, Entamoeba invadens
SFTTGDS

SEQ ID NO: 2774841 - protein, 6 aa, Entamoeba invadens
SFTTQY

SEQ ID NO: 2774842 - protein, 4 aa, Entamoeba invadens
SFVQ

SEQ ID NO: 2774843 - protein, 14 aa, Entamoeba invadens
SFVSSSTHECETND

SEQ ID NO: 2774844 - protein, 5 aa, Entamoeba invadens
SFYSD

SEQ ID NO: 2774845 - protein, 5 aa, Entamoeba invadens
SGAPK

SEQ ID NO: 2774846 - protein, 6 aa, Entamoeba invadens
SGAQIS

SEQ ID NO: 2774847 - protein, 7 aa, Entamoeba invadens
SGAQVSV

SEQ ID NO: 2774848 - protein, 7 aa, Entamoeba invadens
SGASKFK

SEQ ID NO: 2774849 - protein, 6 aa, Entamoeba invadens
SGASVT

SEQ ID NO: 2774850 - protein, 10 aa, Entamoeba invadens
SGATEALKTV

SEQ ID NO: 2774851 - protein, 9 aa, Entamoeba invadens
SGATEIPAN

SEQ ID NO: 2774852 - protein, 13 aa, Entamoeba invadens
SGATKIDGYGDNR

SEQ ID NO: 2774853 - protein, 6 aa, Entamoeba invadens
SGAYPE

SEQ ID NO: 2774854 - protein, 9 aa, Entamoeba invadens
SGCAGEPTT

SEQ ID NO: 2774855 - protein, 13 aa, Entamoeba invadens
SGCDEIKDRQGSW

SEQ ID NO: 2774856 - protein, 12 aa, Entamoeba invadens
SGCGAATSTHET

SEQ ID NO: 2774857 - protein, 11 aa, Entamoeba invadens
SGCGEDENRGY

SEQ ID NO: 2774858 - protein, 6 aa, Entamoeba invadens
SGCGKS

SEQ ID NO: 2774859 - protein, 12 aa, Entamoeba invadens
SGCGKSAKTLAK

SEQ ID NO: 2774860 - protein, 9 aa, Entamoeba invadens
SGCGKSTGI

SEQ ID NO: 2774861 - protein, 9 aa, Entamoeba invadens
SGCGKSTTV

SEQ ID NO: 2774862 - protein, 6 aa, Entamoeba invadens
SGCIKA

SEQ ID NO: 2774863 - protein, 9 aa, Entamoeba invadens
SGCNKNTGI

SEQ ID NO: 2774864 - protein, 10 aa, Entamoeba invadens
SGCSDKSDFI

SEQ ID NO: 2774865 - protein, 10 aa, Entamoeba invadens
SGCTQTRNSY

SEQ ID NO: 2774866 - protein, 7 aa, Entamoeba invadens
SGDANPN

SEQ ID NO: 2774867 - protein, 14 aa, Entamoeba invadens
SGDCGAAKDNCGRT

SEQ ID NO: 2774868 - protein, 10 aa, Entamoeba invadens
SGDCKSQSSL

SEQ ID NO: 2774869 - protein, 16 aa, Entamoeba invadens
SGDDNTLYGSSTTINK

SEQ ID NO: 2774870 - protein, 9 aa, Entamoeba invadens
SGDDPTAVA

SEQ ID NO: 2774871 - protein, 6 aa, Entamoeba invadens
SGDDSM

SEQ ID NO: 2774872 - protein, 5 aa, Entamoeba invadens
SGDDW

SEQ ID NO: 2774873 - protein, 4 aa, Entamoeba invadens
SGDG

SEQ ID NO: 2774874 - protein, 7 aa, Entamoeba invadens
SGDGISC

SEQ ID NO: 2774875 - protein, 7 aa, Entamoeba invadens
SGDIEID

SEQ ID NO: 2774876 - protein, 4 aa, Entamoeba invadens
SGDN

SEQ ID NO: 2774877 - protein, 8 aa, Entamoeba invadens
SGDPEGDI

SEQ ID NO: 2774878 - protein, 6 aa, Entamoeba invadens
SGDSAI

SEQ ID NO: 2774879 - protein, 8 aa, Entamoeba invadens
SGDSKGLC

SEQ ID NO: 2774880 - protein, 6 aa, Entamoeba invadens
SGDSLQ

SEQ ID NO: 2774881 - protein, 4 aa, Entamoeba invadens
SGDT

SEQ ID NO: 2774882 - protein, 5 aa, Entamoeba invadens
SGDTC

SEQ ID NO: 2774883 - protein, 15 aa, Entamoeba invadens
SGDTEISTSIDPDEL

SEQ ID NO: 2774884 - protein, 6 aa, Entamoeba invadens
SGDVET

SEQ ID NO: 2774885 - protein, 7 aa, Entamoeba invadens
SGDVPED

SEQ ID NO: 2774886 - protein, 7 aa, Entamoeba invadens
SGDVQTV

SEQ ID NO: 2774887 - protein, 12 aa, Entamoeba invadens
SGDYPPADTPVD

SEQ ID NO: 2774888 - protein, 5 aa, Entamoeba invadens
SGECG

SEQ ID NO: 2774889 - protein, 24 aa, Entamoeba invadens
SGECTTCQSGNKQVTNQNTGNKEC

SEQ ID NO: 2774890 - protein, 11 aa, Entamoeba invadens
SGEDGCGEYEA

SEQ ID NO: 2774891 - protein, 6 aa, Entamoeba invadens
SGEDKV

SEQ ID NO: 2774892 - protein, 5 aa, Entamoeba invadens
SGEDL

SEQ ID NO: 2774893 - protein, 5 aa, Entamoeba invadens
SGEDV

SEQ ID NO: 2774894 - protein, 8 aa, Entamoeba invadens
SGEELKRT

SEQ ID NO: 2774895 - protein, 9 aa, Entamoeba invadens
SGEENKEYD

SEQ ID NO: 2774896 - protein, 9 aa, Entamoeba invadens
SGEENKQYD

SEQ ID NO: 2774897 - protein, 5 aa, Entamoeba invadens
SGEFD

SEQ ID NO: 2774898 - protein, 4 aa, Entamoeba invadens
SGEI

SEQ ID NO: 2774899 - protein, 7 aa, Entamoeba invadens
SGEIERN

SEQ ID NO: 2774900 - protein, 6 aa, Entamoeba invadens
SGEITS

SEQ ID NO: 2774901 - protein, 19 aa, Entamoeba invadens
SGEKEEKKTIRPTKVSSDI

SEQ ID NO: 2774902 - protein, 6 aa, Entamoeba invadens
SGEKFE

SEQ ID NO: 2774903 - protein, 6 aa, Entamoeba invadens
SGELRK

SEQ ID NO: 2774904 - protein, 8 aa, Entamoeba invadens
SGELTSRI

SEQ ID NO: 2774905 - protein, 8 aa, Entamoeba invadens
SGEMVDDN

SEQ ID NO: 2774906 - protein, 22 aa, Entamoeba invadens
SGENNENVSQTRLKTKYSTAFE

SEQ ID NO: 2774907 - protein, 5 aa, Entamoeba invadens
SGENT

SEQ ID NO: 2774908 - protein, 5 aa, Entamoeba invadens
SGEQI

SEQ ID NO: 2774909 - protein, 5 aa, Entamoeba invadens
SGEQK

SEQ ID NO: 2774910 - protein, 7 aa, Entamoeba invadens
SGEQSIS

SEQ ID NO: 2774911 - protein, 9 aa, Entamoeba invadens
SGEQTTEKL

SEQ ID NO: 2774912 - protein, 9 aa, Entamoeba invadens
SGEQTTEKM

SEQ ID NO: 2774913 - protein, 4 aa, Entamoeba invadens
SGER

SEQ ID NO: 2774914 - protein, 5 aa, Entamoeba invadens
SGETC

SEQ ID NO: 2774915 - protein, 5 aa, Entamoeba invadens
SGEVC

SEQ ID NO: 2774916 - protein, 8 aa, Entamoeba invadens
SGEVEERK

SEQ ID NO: 2774917 - protein, 8 aa, Entamoeba invadens
SGEYLSNT

SEQ ID NO: 2774918 - protein, 6 aa, Entamoeba invadens
SGEYTG

SEQ ID NO: 2774919 - protein, 6 aa, Entamoeba invadens
SGFDGG

SEQ ID NO: 2774920 - protein, 8 aa, Entamoeba invadens
SGFEPYKE

SEQ ID NO: 2774921 - protein, 4 aa, Entamoeba invadens
SGFR

SEQ ID NO: 2774922 - protein, 4 aa, Entamoeba invadens
SGFS

SEQ ID NO: 2774923 - protein, 7 aa, Entamoeba invadens
SGFVGNN

SEQ ID NO: 2774924 - protein, 5 aa, Entamoeba invadens
SGFYP

SEQ ID NO: 2774925 - protein, 10 aa, Entamoeba invadens
SGGADGDVGG

SEQ ID NO: 2774926 - protein, 7 aa, Entamoeba invadens
SGGCSAC

SEQ ID NO: 2774927 - protein, 10 aa, Entamoeba invadens
SGGEQISEKN

SEQ ID NO: 2774928 - protein, 12 aa, Entamoeba invadens
SGGFDANEQSIF

SEQ ID NO: 2774929 - protein, 6 aa, Entamoeba invadens
SGGHTS

SEQ ID NO: 2774930 - protein, 7 aa, Entamoeba invadens
SGGINYT

SEQ ID NO: 2774931 - protein, 6 aa, Entamoeba invadens
SGGKRL

SEQ ID NO: 2774932 - protein, 12 aa, Entamoeba invadens
SGGKTRQNSKLT

SEQ ID NO: 2774933 - protein, 6 aa, Entamoeba invadens
SGGNRD

SEQ ID NO: 2774934 - protein, 14 aa, Entamoeba invadens
SGGNVKTDVKREKV

SEQ ID NO: 2774935 - protein, 7 aa, Entamoeba invadens
SGGNYSY

SEQ ID NO: 2774936 - protein, 13 aa, Entamoeba invadens
SGGQNTVTVGSYD

SEQ ID NO: 2774937 - protein, 16 aa, Entamoeba invadens
SGGRRLAQSSRITDDE

SEQ ID NO: 2774938 - protein, 9 aa, Entamoeba invadens
SGGSDDIAQ

SEQ ID NO: 2774939 - protein, 9 aa, Entamoeba invadens
SGGTAPSDE

SEQ ID NO: 2774940 - protein, 10 aa, Entamoeba invadens
SGGTAPTDEC

SEQ ID NO: 2774941 - protein, 5 aa, Entamoeba invadens
SGGTC

SEQ ID NO: 2774942 - protein, 5 aa, Entamoeba invadens
SGGVR

SEQ ID NO: 2774943 - protein, 4 aa, Entamoeba invadens
SGGY

SEQ ID NO: 2774944 - protein, 5 aa, Entamoeba invadens
SGGYG

SEQ ID NO: 2774945 - protein, 6 aa, Entamoeba invadens
SGHKQM

SEQ ID NO: 2774946 - protein, 5 aa, Entamoeba invadens
SGHTL

SEQ ID NO: 2774947 - protein, 7 aa, Entamoeba invadens
SGHTSSL

SEQ ID NO: 2774948 - protein, 17 aa, Entamoeba invadens
SGHYKDVDGCKEKTGAL

SEQ ID NO: 2774949 - protein, 5 aa, Entamoeba invadens
SGIDE

SEQ ID NO: 2774950 - protein, 7 aa, Entamoeba invadens
SGIEETC

SEQ ID NO: 2774951 - protein, 5 aa, Entamoeba invadens
SGIGG

SEQ ID NO: 2774952 - protein, 6 aa, Entamoeba invadens
SGIGGA

SEQ ID NO: 2774953 - protein, 7 aa, Entamoeba invadens
SGIKEGK

SEQ ID NO: 2774954 - protein, 10 aa, Entamoeba invadens
SGIKEKDFSK

SEQ ID NO: 2774955 - protein, 5 aa, Entamoeba invadens
SGINQ

SEQ ID NO: 2774956 - protein, 8 aa, Entamoeba invadens
SGIQTTQK

SEQ ID NO: 2774957 - protein, 4 aa, Entamoeba invadens
SGIR

SEQ ID NO: 2774958 - protein, 18 aa, Entamoeba invadens
SGIRPQYTDNINENQKSL

SEQ ID NO: 2774959 - protein, 8 aa, Entamoeba invadens
SGISLGGD

SEQ ID NO: 2774960 - protein, 16 aa, Entamoeba invadens
SGISNAQTGGHKQRGY

SEQ ID NO: 2774961 - protein, 14 aa, Entamoeba invadens
SGISTQCSGKTESP

SEQ ID NO: 2774962 - protein, 7 aa, Entamoeba invadens
SGITAET

SEQ ID NO: 2774963 - protein, 8 aa, Entamoeba invadens
SGITKETQ

SEQ ID NO: 2774964 - protein, 4 aa, Entamoeba invadens
SGKA

SEQ ID NO: 2774965 - protein, 6 aa, Entamoeba invadens
SGKCYS

SEQ ID NO: 2774966 - protein, 5 aa, Entamoeba invadens
SGKEA

SEQ ID NO: 2774967 - protein, 5 aa, Entamoeba invadens
SGKEC

SEQ ID NO: 2774968 - protein, 10 aa, Entamoeba invadens
SGKEETGINH

SEQ ID NO: 2774969 - protein, 9 aa, Entamoeba invadens
SGKESVNGC

SEQ ID NO: 2774970 - protein, 4 aa, Entamoeba invadens
SGKG

SEQ ID NO: 2774971 - protein, 8 aa, Entamoeba invadens
SGKGRTGL

SEQ ID NO: 2774972 - protein, 8 aa, Entamoeba invadens
SGKHLEKD

SEQ ID NO: 2774973 - protein, 15 aa, Entamoeba invadens
SGKHLEKNQNIGNEE

SEQ ID NO: 2774974 - protein, 16 aa, Entamoeba invadens
SGKHSFSKHKKAQEMT

SEQ ID NO: 2774975 - protein, 8 aa, Entamoeba invadens
SGKITQND

SEQ ID NO: 2774976 - protein, 13 aa, Entamoeba invadens
SGKKAINTDMKDN

SEQ ID NO: 2774977 - protein, 10 aa, Entamoeba invadens
SGKKLERPQN

SEQ ID NO: 2774978 - protein, 14 aa, Entamoeba invadens
SGKNLDKNANLTKE

SEQ ID NO: 2774979 - protein, 9 aa, Entamoeba invadens
SGKNTSEIE

SEQ ID NO: 2774980 - protein, 16 aa, Entamoeba invadens
SGKPTIITNGTTVKST

SEQ ID NO: 2774981 - protein, 11 aa, Entamoeba invadens
SGKPTITTTGT

SEQ ID NO: 2774982 - protein, 17 aa, Entamoeba invadens
SGKQQVKDISEYNEGSS

SEQ ID NO: 2774983 - protein, 12 aa, Entamoeba invadens
SGKRFDKPEEIP

SEQ ID NO: 2774984 - protein, 12 aa, Entamoeba invadens
SGKRFENTQNIS

SEQ ID NO: 2774985 - protein, 13 aa, Entamoeba invadens
SGKRIGKPDNMEN

SEQ ID NO: 2774986 - protein, 7 aa, Entamoeba invadens
SGKRLNI

SEQ ID NO: 2774987 - protein, 13 aa, Entamoeba invadens
SGKRPERTPNVPQ

SEQ ID NO: 2774988 - protein, 15 aa, Entamoeba invadens
SGKRRERTEQIREEE

SEQ ID NO: 2774989 - protein, 11 aa, Entamoeba invadens
SGKRRQKPDFV

SEQ ID NO: 2774990 - protein, 11 aa, Entamoeba invadens
SGKRRQKPGFV

SEQ ID NO: 2774991 - protein, 18 aa, Entamoeba invadens
SGKSQGQATLSFSSESTY

SEQ ID NO: 2774992 - protein, 14 aa, Entamoeba invadens
SGKSTSACYSTPKT

SEQ ID NO: 2774993 - protein, 10 aa, Entamoeba invadens
SGKTAPSDEC

SEQ ID NO: 2774994 - protein, 9 aa, Entamoeba invadens
SGKTTNEKV

SEQ ID NO: 2774995 - protein, 20 aa, Entamoeba invadens
SGKYGGNSCDNSDKKEKQKV

SEQ ID NO: 2774996 - protein, 9 aa, Entamoeba invadens
SGKYTTETA

SEQ ID NO: 2774997 - protein, 5 aa, Entamoeba invadens
SGLAN

SEQ ID NO: 2774998 - protein, 8 aa, Entamoeba invadens
SGLEKGKP

SEQ ID NO: 2774999 - protein, 7 aa, Entamoeba invadens
SGLENSE

SEQ ID NO: 2775000 - protein, 7 aa, Entamoeba invadens
SGLGYSN

SEQ ID NO: 2775001 - protein, 7 aa, Entamoeba invadens
SGLKEGK

SEQ ID NO: 2775002 - protein, 7 aa, Entamoeba invadens
SGLSSWN

SEQ ID NO: 2775003 - protein, 13 aa, Entamoeba invadens
SGLSSWNKNGQCI

SEQ ID NO: 2775004 - protein, 9 aa, Entamoeba invadens
SGLTDPKRF

SEQ ID NO: 2775005 - protein, 13 aa, Entamoeba invadens
SGLTDRYKQTLTN

SEQ ID NO: 2775006 - protein, 9 aa, Entamoeba invadens
SGLTNSNET

SEQ ID NO: 2775007 - protein, 14 aa, Entamoeba invadens
SGMGGTEDGISYGN

SEQ ID NO: 2775008 - protein, 6 aa, Entamoeba invadens
SGMGIS

SEQ ID NO: 2775009 - protein, 7 aa, Entamoeba invadens
SGMGITT

SEQ ID NO: 2775010 - protein, 6 aa, Entamoeba invadens
SGMKTA

SEQ ID NO: 2775011 - protein, 9 aa, Entamoeba invadens
SGMNGCETC

SEQ ID NO: 2775012 - protein, 10 aa, Entamoeba invadens
SGMTKSETNT

SEQ ID NO: 2775013 - protein, 28 aa, Entamoeba invadens
SGMYPDESTKKCKSCSTTCNGNCDQTSG

SEQ ID NO: 2775014 - protein, 28 aa, Entamoeba invadens
SGMYPDESTKKCKSCSTTCNGNCNQTSG

SEQ ID NO: 2775015 - protein, 10 aa, Entamoeba invadens
SGMYPSESTY

SEQ ID NO: 2775016 - protein, 12 aa, Entamoeba invadens
SGNAVNTKIKSL

SEQ ID NO: 2775017 - protein, 4 aa, Entamoeba invadens
SGNC

SEQ ID NO: 2775018 - protein, 6 aa, Entamoeba invadens
SGNCKS

SEQ ID NO: 2775019 - protein, 10 aa, Entamoeba invadens
SGNENNLPPQ

SEQ ID NO: 2775020 - protein, 8 aa, Entamoeba invadens
SGNGYRTL

SEQ ID NO: 2775021 - protein, 4 aa, Entamoeba invadens
SGNH

SEQ ID NO: 2775022 - protein, 5 aa, Entamoeba invadens
SGNIE

SEQ ID NO: 2775023 - protein, 9 aa, Entamoeba invadens
SGNITQSKK

SEQ ID NO: 2775024 - protein, 5 aa, Entamoeba invadens
SGNKM

SEQ ID NO: 2775025 - protein, 7 aa, Entamoeba invadens
SGNLSCK

SEQ ID NO: 2775026 - protein, 8 aa, Entamoeba invadens
SGNNPVDI

SEQ ID NO: 2775027 - protein, 16 aa, Entamoeba invadens
SGNNSQVNCKETTKYG

SEQ ID NO: 2775028 - protein, 7 aa, Entamoeba invadens
SGNNVDP

SEQ ID NO: 2775029 - protein, 9 aa, Entamoeba invadens
SGNSDHFGR

SEQ ID NO: 2775030 - protein, 9 aa, Entamoeba invadens
SGNSEVEKI

SEQ ID NO: 2775031 - protein, 5 aa, Entamoeba invadens
SGNSK

SEQ ID NO: 2775032 - protein, 10 aa, Entamoeba invadens
SGNSNGDLPS

SEQ ID NO: 2775033 - protein, 6 aa, Entamoeba invadens
SGNTGL

SEQ ID NO: 2775034 - protein, 5 aa, Entamoeba invadens
SGNTV

SEQ ID NO: 2775035 - protein, 6 aa, Entamoeba invadens
SGNTYK

SEQ ID NO: 2775036 - protein, 11 aa, Entamoeba invadens
SGNVFNEPKEN

SEQ ID NO: 2775037 - protein, 7 aa, Entamoeba invadens
SGNVNQP

SEQ ID NO: 2775038 - protein, 8 aa, Entamoeba invadens
SGNYQNRN

SEQ ID NO: 2775039 - protein, 5 aa, Entamoeba invadens
SGPGL

SEQ ID NO: 2775040 - protein, 11 aa, Entamoeba invadens
SGPGSNQCSAC

SEQ ID NO: 2775041 - protein, 9 aa, Entamoeba invadens
SGPITQSGC

SEQ ID NO: 2775042 - protein, 10 aa, Entamoeba invadens
SGPNSNQCTS

SEQ ID NO: 2775043 - protein, 7 aa, Entamoeba invadens
SGPTESV

SEQ ID NO: 2775044 - protein, 4 aa, Entamoeba invadens
SGQE

SEQ ID NO: 2775045 - protein, 7 aa, Entamoeba invadens
SGQETYK

SEQ ID NO: 2775046 - protein, 5 aa, Entamoeba invadens
SGQNL

SEQ ID NO: 2775047 - protein, 10 aa, Entamoeba invadens
SGQNMYPAPP

SEQ ID NO: 2775048 - protein, 8 aa, Entamoeba invadens
SGQPYNTK

SEQ ID NO: 2775049 - protein, 5 aa, Entamoeba invadens
SGQTM

SEQ ID NO: 2775050 - protein, 6 aa, Entamoeba invadens
SGQTTL

SEQ ID NO: 2775051 - protein, 13 aa, Entamoeba invadens
SGQYNGNCKTCTE

SEQ ID NO: 2775052 - protein, 9 aa, Entamoeba invadens
SGQYQSGNS

SEQ ID NO: 2775053 - protein, 5 aa, Entamoeba invadens
SGRCE

SEQ ID NO: 2775054 - protein, 7 aa, Entamoeba invadens
SGRCERC

SEQ ID NO: 2775055 - protein, 6 aa, Entamoeba invadens
SGREVS

SEQ ID NO: 2775056 - protein, 12 aa, Entamoeba invadens
SGRGGSHNVTTG

SEQ ID NO: 2775057 - protein, 7 aa, Entamoeba invadens
SGRINGA

SEQ ID NO: 2775058 - protein, 5 aa, Entamoeba invadens
SGRIR

SEQ ID NO: 2775059 - protein, 4 aa, Entamoeba invadens
SGRQ

SEQ ID NO: 2775060 - protein, 10 aa, Entamoeba invadens
SGRQTPNDIS

SEQ ID NO: 2775061 - protein, 6 aa, Entamoeba invadens
SGRSGD

SEQ ID NO: 2775062 - protein, 5 aa, Entamoeba invadens
SGRYF

SEQ ID NO: 2775063 - protein, 6 aa, Entamoeba invadens
SGSAKE

SEQ ID NO: 2775064 - protein, 8 aa, Entamoeba invadens
SGSASVDV

SEQ ID NO: 2775065 - protein, 10 aa, Entamoeba invadens
SGSCKTDGCT

SEQ ID NO: 2775066 - protein, 7 aa, Entamoeba invadens
SGSCSSC

SEQ ID NO: 2775067 - protein, 5 aa, Entamoeba invadens
SGSCT

SEQ ID NO: 2775068 - protein, 7 aa, Entamoeba invadens
SGSCTEC

SEQ ID NO: 2775069 - protein, 7 aa, Entamoeba invadens
SGSCTKC

SEQ ID NO: 2775070 - protein, 24 aa, Entamoeba invadens
SGSCTQCNSTCKTCDNTNGNCSTC

SEQ ID NO: 2775071 - protein, 18 aa, Entamoeba invadens
SGSCTSCSPGTFSNTTRL

SEQ ID NO: 2775072 - protein, 7 aa, Entamoeba invadens
SGSDEEI

SEQ ID NO: 2775073 - protein, 13 aa, Entamoeba invadens
SGSETGKVYLSNI

SEQ ID NO: 2775074 - protein, 14 aa, Entamoeba invadens
SGSFSEDPQAEGTF

SEQ ID NO: 2775075 - protein, 8 aa, Entamoeba invadens
SGSGKSVV

SEQ ID NO: 2775076 - protein, 5 aa, Entamoeba invadens
SGSGS

SEQ ID NO: 2775077 - protein, 23 aa, Entamoeba invadens
SGSGYFDSSTHWSPQGIPDSGDT

SEQ ID NO: 2775078 - protein, 17 aa, Entamoeba invadens
SGSIDTATNCYSTKEGC

SEQ ID NO: 2775079 - protein, 7 aa, Entamoeba invadens
SGSIEPN

SEQ ID NO: 2775080 - protein, 21 aa, Entamoeba invadens
SGSIPNSLKSGCDQCQAGTYA

SEQ ID NO: 2775081 - protein, 10 aa, Entamoeba invadens
SGSMRSDEQC

SEQ ID NO: 2775082 - protein, 8 aa, Entamoeba invadens
SGSNAQMS

SEQ ID NO: 2775083 - protein, 6 aa, Entamoeba invadens
SGSNKV

SEQ ID NO: 2775084 - protein, 13 aa, Entamoeba invadens
SGSNTCSSCSSSC

SEQ ID NO: 2775085 - protein, 4 aa, Entamoeba invadens
SGSP

SEQ ID NO: 2775086 - protein, 5 aa, Entamoeba invadens
SGSPS

SEQ ID NO: 2775087 - protein, 5 aa, Entamoeba invadens
SGSST

SEQ ID NO: 2775088 - protein, 16 aa, Entamoeba invadens
SGSSTVPTATTYNGNT

SEQ ID NO: 2775089 - protein, 6 aa, Entamoeba invadens
SGSTDI

SEQ ID NO: 2775090 - protein, 6 aa, Entamoeba invadens
SGSTEV

SEQ ID NO: 2775091 - protein, 7 aa, Entamoeba invadens
SGSTIAE

SEQ ID NO: 2775092 - protein, 14 aa, Entamoeba invadens
SGSTLTATQGSEIT

SEQ ID NO: 2775093 - protein, 13 aa, Entamoeba invadens
SGSTNKGPDDDAK

SEQ ID NO: 2775094 - protein, 6 aa, Entamoeba invadens
SGSTQH

SEQ ID NO: 2775095 - protein, 6 aa, Entamoeba invadens
SGSTRC

SEQ ID NO: 2775096 - protein, 21 aa, Entamoeba invadens
SGSTSIRKGNTTTFVLPEQYI

SEQ ID NO: 2775097 - protein, 30 aa, Entamoeba invadens
SGSVDGEVNGDDCTACESQMSSVDGVSDEC

SEQ ID NO: 2775098 - protein, 9 aa, Entamoeba invadens
SGSVSGNAV

SEQ ID NO: 2775099 - protein, 11 aa, Entamoeba invadens
SGSYKNTETSC

SEQ ID NO: 2775100 - protein, 8 aa, Entamoeba invadens
SGSYLSGT

SEQ ID NO: 2775101 - protein, 6 aa, Entamoeba invadens
SGSYQY

SEQ ID NO: 2775102 - protein, 9 aa, Entamoeba invadens
SGTAKEPKG

SEQ ID NO: 2775103 - protein, 10 aa, Entamoeba invadens
SGTAKSPKGV

SEQ ID NO: 2775104 - protein, 7 aa, Entamoeba invadens
SGTANGE

SEQ ID NO: 2775105 - protein, 7 aa, Entamoeba invadens
SGTCSSC

SEQ ID NO: 2775106 - protein, 5 aa, Entamoeba invadens
SGTDA

SEQ ID NO: 2775107 - protein, 5 aa, Entamoeba invadens
SGTDK

SEQ ID NO: 2775108 - protein, 8 aa, Entamoeba invadens
SGTEQTSS

SEQ ID NO: 2775109 - protein, 6 aa, Entamoeba invadens
SGTEVT

SEQ ID NO: 2775110 - protein, 15 aa, Entamoeba invadens
SGTFSSSEGSTSCQK

SEQ ID NO: 2775111 - protein, 8 aa, Entamoeba invadens
SGTGEVTN

SEQ ID NO: 2775112 - protein, 5 aa, Entamoeba invadens
SGTGL

SEQ ID NO: 2775113 - protein, 5 aa, Entamoeba invadens
SGTGY

SEQ ID NO: 2775114 - protein, 6 aa, Entamoeba invadens
SGTINT

SEQ ID NO: 2775115 - protein, 6 aa, Entamoeba invadens
SGTLEK

SEQ ID NO: 2775116 - protein, 5 aa, Entamoeba invadens
SGTLS

SEQ ID NO: 2775117 - protein, 31 aa, Entamoeba invadens
SGTMENQTTNKCDTCKAGTYAGEGSSECKSC

SEQ ID NO: 2775118 - protein, 4 aa, Entamoeba invadens
SGTN

SEQ ID NO: 2775119 - protein, 11 aa, Entamoeba invadens
SGTNSTTYISH

SEQ ID NO: 2775120 - protein, 10 aa, Entamoeba invadens
SGTPKPNQDI

SEQ ID NO: 2775121 - protein, 29 aa, Entamoeba invadens
SGTPPICTSKSGACGDGYYGEAGKCQKCS

SEQ ID NO: 2775122 - protein, 7 aa, Entamoeba invadens
SGTPQDL

SEQ ID NO: 2775123 - protein, 16 aa, Entamoeba invadens
SGTPVTPTPEPEPDNA

SEQ ID NO: 2775124 - protein, 5 aa, Entamoeba invadens
SGTQK

SEQ ID NO: 2775125 - protein, 5 aa, Entamoeba invadens
SGTSA

SEQ ID NO: 2775126 - protein, 8 aa, Entamoeba invadens
SGTSIYPG

SEQ ID NO: 2775127 - protein, 5 aa, Entamoeba invadens
SGTSS

SEQ ID NO: 2775128 - protein, 6 aa, Entamoeba invadens
SGTTFP

SEQ ID NO: 2775129 - protein, 11 aa, Entamoeba invadens
SGTTGNPKGVP

SEQ ID NO: 2775130 - protein, 12 aa, Entamoeba invadens
SGTTKNDQYVPP

SEQ ID NO: 2775131 - protein, 7 aa, Entamoeba invadens
SGTTPLK

SEQ ID NO: 2775132 - protein, 8 aa, Entamoeba invadens
SGVEECDG

SEQ ID NO: 2775133 - protein, 15 aa, Entamoeba invadens
SGVESNAKLTDFGAS

SEQ ID NO: 2775134 - protein, 13 aa, Entamoeba invadens
SGVETKAGTPEGV

SEQ ID NO: 2775135 - protein, 5 aa, Entamoeba invadens
SGVGT

SEQ ID NO: 2775136 - protein, 10 aa, Entamoeba invadens
SGVPDSTIKS

SEQ ID NO: 2775137 - protein, 5 aa, Entamoeba invadens
SGVPQ

SEQ ID NO: 2775138 - protein, 8 aa, Entamoeba invadens
SGVQSTFK

SEQ ID NO: 2775139 - protein, 8 aa, Entamoeba invadens
SGVSEEKI

SEQ ID NO: 2775140 - protein, 10 aa, Entamoeba invadens
SGVSKPSTFG

SEQ ID NO: 2775141 - protein, 7 aa, Entamoeba invadens
SGVSNGI

SEQ ID NO: 2775142 - protein, 9 aa, Entamoeba invadens
SGVTEDGSV

SEQ ID NO: 2775143 - protein, 8 aa, Entamoeba invadens
SGVTETNN

SEQ ID NO: 2775144 - protein, 7 aa, Entamoeba invadens
SGVTIPS

SEQ ID NO: 2775145 - protein, 5 aa, Entamoeba invadens
SGVTL

SEQ ID NO: 2775146 - protein, 6 aa, Entamoeba invadens
SGWATA

SEQ ID NO: 2775147 - protein, 13 aa, Entamoeba invadens
SGWKNDSKHGKTI

SEQ ID NO: 2775148 - protein, 10 aa, Entamoeba invadens
SGWNRPSDDG

SEQ ID NO: 2775149 - protein, 6 aa, Entamoeba invadens
SGYELD

SEQ ID NO: 2775150 - protein, 14 aa, Entamoeba invadens
SGYEPSSGYCKESS

SEQ ID NO: 2775151 - protein, 14 aa, Entamoeba invadens
SGYETPYVEGERRK

SEQ ID NO: 2775152 - protein, 7 aa, Entamoeba invadens
SGYGGDD

SEQ ID NO: 2775153 - protein, 6 aa, Entamoeba invadens
SGYGGE

SEQ ID NO: 2775154 - protein, 24 aa, Entamoeba invadens
SGYKSDGQTCVKNDTSECKSGEVS

SEQ ID NO: 2775155 - protein, 8 aa, Entamoeba invadens
SGYKSKNG

SEQ ID NO: 2775156 - protein, 12 aa, Entamoeba invadens
SGYKTNSNNCQK

SEQ ID NO: 2775157 - protein, 11 aa, Entamoeba invadens
SGYLQRSDARF

SEQ ID NO: 2775158 - protein, 4 aa, Entamoeba invadens
SGYN

SEQ ID NO: 2775159 - protein, 6 aa, Entamoeba invadens
SGYNEN

SEQ ID NO: 2775160 - protein, 6 aa, Entamoeba invadens
SGYNTQ

SEQ ID NO: 2775161 - protein, 5 aa, Entamoeba invadens
SGYSR

SEQ ID NO: 2775162 - protein, 5 aa, Entamoeba invadens
SGYVE

SEQ ID NO: 2775163 - protein, 7 aa, Entamoeba invadens
SGYVPDS

SEQ ID NO: 2775164 - protein, 12 aa, Entamoeba invadens
SGYVPTSPITNK

SEQ ID NO: 2775165 - protein, 10 aa, Entamoeba invadens
SGYVPYNPQQ

SEQ ID NO: 2775166 - protein, 8 aa, Entamoeba invadens
SGYVTKSQ

SEQ ID NO: 2775167 - protein, 4 aa, Entamoeba invadens
SGYY

SEQ ID NO: 2775168 - protein, 5 aa, Entamoeba invadens
SGYYG

SEQ ID NO: 2775169 - protein, 8 aa, Entamoeba invadens
SGYYKSGK

SEQ ID NO: 2775170 - protein, 12 aa, Entamoeba invadens
SGYYKSSDGKQC

SEQ ID NO: 2775171 - protein, 9 aa, Entamoeba invadens
SGYYPDSNG

SEQ ID NO: 2775172 - protein, 9 aa, Entamoeba invadens
SGYYPKTVD

SEQ ID NO: 2775173 - protein, 7 aa, Entamoeba invadens
SGYYPSN

SEQ ID NO: 2775174 - protein, 10 aa, Entamoeba invadens
SGYYPSSSTD

SEQ ID NO: 2775175 - protein, 8 aa, Entamoeba invadens
SGYYPTSN

SEQ ID NO: 2775176 - protein, 8 aa, Entamoeba invadens
SGYYQGED

SEQ ID NO: 2775177 - protein, 5 aa, Entamoeba invadens
SGYYR

SEQ ID NO: 2775178 - protein, 9 aa, Entamoeba invadens
SGYYSENGA

SEQ ID NO: 2775179 - protein, 11 aa, Entamoeba invadens
SGYYSNIGSSS

SEQ ID NO: 2775180 - protein, 6 aa, Entamoeba invadens
SGYYST

SEQ ID NO: 2775181 - protein, 15 aa, Entamoeba invadens
SGYYTTRQDSVEPCS

SEQ ID NO: 2775182 - protein, 7 aa, Entamoeba invadens
SHAGGKE

SEQ ID NO: 2775183 - protein, 9 aa, Entamoeba invadens
SHASTEGSL

SEQ ID NO: 2775184 - protein, 11 aa, Entamoeba invadens
SHCDSSEDIKT

SEQ ID NO: 2775185 - protein, 4 aa, Entamoeba invadens
SHCE

SEQ ID NO: 2775186 - protein, 5 aa, Entamoeba invadens
SHDGI

SEQ ID NO: 2775187 - protein, 11 aa, Entamoeba invadens
SHDSNFGTYGN

SEQ ID NO: 2775188 - protein, 14 aa, Entamoeba invadens
SHDVNDKEEEEEVP

SEQ ID NO: 2775189 - protein, 10 aa, Entamoeba invadens
SHEGADKVTY

SEQ ID NO: 2775190 - protein, 4 aa, Entamoeba invadens
SHEN

SEQ ID NO: 2775191 - protein, 6 aa, Entamoeba invadens
SHENNQ

SEQ ID NO: 2775192 - protein, 16 aa, Entamoeba invadens
SHENSENHSKTKGDQN

SEQ ID NO: 2775193 - protein, 5 aa, Entamoeba invadens
SHESE

SEQ ID NO: 2775194 - protein, 30 aa, Entamoeba invadens
SHETEDDSGSSDAPENKTDSGSKNEKGEIN

SEQ ID NO: 2775195 - protein, 5 aa, Entamoeba invadens
SHGSL

SEQ ID NO: 2775196 - protein, 38 aa, Entamoeba invadens
SHIESATIKEDDHSHSHDDHDHEHDHGHNEKEHHGHGS

SEQ ID NO: 2775197 - protein, 4 aa, Entamoeba invadens
SHIK

SEQ ID NO: 2775198 - protein, 6 aa, Entamoeba invadens
SHINRK

SEQ ID NO: 2775199 - protein, 8 aa, Entamoeba invadens
SHKTDYSR

SEQ ID NO: 2775200 - protein, 25 aa, Entamoeba invadens
SHLPQNKRDEQNNATPVEQKVQSTY

SEQ ID NO: 2775201 - protein, 18 aa, Entamoeba invadens
SHMEGKNNIQVTNGGRIT

SEQ ID NO: 2775202 - protein, 4 aa, Entamoeba invadens
SHMV

SEQ ID NO: 2775203 - protein, 10 aa, Entamoeba invadens
SHNQAERPKV

SEQ ID NO: 2775204 - protein, 10 aa, Entamoeba invadens
SHPPNSEKDY

SEQ ID NO: 2775205 - protein, 10 aa, Entamoeba invadens
SHPSNGSFED

SEQ ID NO: 2775206 - protein, 31 aa, Entamoeba invadens
SHQANRSDGMSKSQSDPEEENNEKRNYQIDP

SEQ ID NO: 2775207 - protein, 7 aa, Entamoeba invadens
SHQTNSS

SEQ ID NO: 2775208 - protein, 26 aa, Entamoeba invadens
SHSEETSEAQTSETPRTQDESKKVDV

SEQ ID NO: 2775209 - protein, 5 aa, Entamoeba invadens
SHSNS

SEQ ID NO: 2775210 - protein, 4 aa, Entamoeba invadens
SHSQ

SEQ ID NO: 2775211 - protein, 56 aa, Entamoeba invadens
SHSSQNSEMSHDSKSKSSSLANSRNTRNKSFVKETDKSKSKSKSQDKKKVQPKTPN

SEQ ID NO: 2775212 - protein, 6 aa, Entamoeba invadens
SHSTCY

SEQ ID NO: 2775213 - protein, 6 aa, Entamoeba invadens
SHTGAA

SEQ ID NO: 2775214 - protein, 4 aa, Entamoeba invadens
SHTN

SEQ ID NO: 2775215 - protein, 5 aa, Entamoeba invadens
SHVAT

SEQ ID NO: 2775216 - protein, 5 aa, Entamoeba invadens
SHYLD

SEQ ID NO: 2775217 - protein, 5 aa, Entamoeba invadens
SHYRE

SEQ ID NO: 2775218 - protein, 8 aa, Entamoeba invadens
SIAEQSKG

SEQ ID NO: 2775219 - protein, 4 aa, Entamoeba invadens
SIAS

SEQ ID NO: 2775220 - protein, 7 aa, Entamoeba invadens
SIASANQ

SEQ ID NO: 2775221 - protein, 6 aa, Entamoeba invadens
SIASIK

SEQ ID NO: 2775222 - protein, 10 aa, Entamoeba invadens
SIATRDKSGL

SEQ ID NO: 2775223 - protein, 9 aa, Entamoeba invadens
SICDPSKPE

SEQ ID NO: 2775224 - protein, 5 aa, Entamoeba invadens
SICSN

SEQ ID NO: 2775225 - protein, 5 aa, Entamoeba invadens
SIDCG

SEQ ID NO: 2775226 - protein, 5 aa, Entamoeba invadens
SIDDE

SEQ ID NO: 2775227 - protein, 7 aa, Entamoeba invadens
SIDGSSC

SEQ ID NO: 2775228 - protein, 14 aa, Entamoeba invadens
SIDNDGYSTKIKDV

SEQ ID NO: 2775229 - protein, 9 aa, Entamoeba invadens
SIDNNSSTI

SEQ ID NO: 2775230 - protein, 7 aa, Entamoeba invadens
SIDQKDE

SEQ ID NO: 2775231 - protein, 7 aa, Entamoeba invadens
SIDTEKG

SEQ ID NO: 2775232 - protein, 10 aa, Entamoeba invadens
SIEEGEKLAE

SEQ ID NO: 2775233 - protein, 19 aa, Entamoeba invadens
SIENKEKLLKNKDENLASE

SEQ ID NO: 2775234 - protein, 10 aa, Entamoeba invadens
SIEPSKGKVD

SEQ ID NO: 2775235 - protein, 6 aa, Entamoeba invadens
SIEQGY

SEQ ID NO: 2775236 - protein, 6 aa, Entamoeba invadens
SIEQKD

SEQ ID NO: 2775237 - protein, 5 aa, Entamoeba invadens
SIESG

SEQ ID NO: 2775238 - protein, 11 aa, Entamoeba invadens
SIESGDETVNN

SEQ ID NO: 2775239 - protein, 6 aa, Entamoeba invadens
SIEYTN

SEQ ID NO: 2775240 - protein, 10 aa, Entamoeba invadens
SIFPNGSQFE

SEQ ID NO: 2775241 - protein, 10 aa, Entamoeba invadens
SIGAEASDCT

SEQ ID NO: 2775242 - protein, 8 aa, Entamoeba invadens
SIGATTGL

SEQ ID NO: 2775243 - protein, 5 aa, Entamoeba invadens
SIGEE

SEQ ID NO: 2775244 - protein, 5 aa, Entamoeba invadens
SIGGG

SEQ ID NO: 2775245 - protein, 6 aa, Entamoeba invadens
SIGGGS

SEQ ID NO: 2775246 - protein, 13 aa, Entamoeba invadens
SIGGKSKCSKCQT

SEQ ID NO: 2775247 - protein, 5 aa, Entamoeba invadens
SIGGT

SEQ ID NO: 2775248 - protein, 7 aa, Entamoeba invadens
SIGGTSK

SEQ ID NO: 2775249 - protein, 25 aa, Entamoeba invadens
SIGGTSSCSKCPSNTYSLEKSSECL

SEQ ID NO: 2775250 - protein, 6 aa, Entamoeba invadens
SIGIGT

SEQ ID NO: 2775251 - protein, 7 aa, Entamoeba invadens
SIGKDAF

SEQ ID NO: 2775252 - protein, 5 aa, Entamoeba invadens
SIGSD

SEQ ID NO: 2775253 - protein, 5 aa, Entamoeba invadens
SIGSK

SEQ ID NO: 2775254 - protein, 5 aa, Entamoeba invadens
SIGSY

SEQ ID NO: 2775255 - protein, 7 aa, Entamoeba invadens
SIGTPAY

SEQ ID NO: 2775256 - protein, 7 aa, Entamoeba invadens
SIGTPKY

SEQ ID NO: 2775257 - protein, 7 aa, Entamoeba invadens
SIGTPTY

SEQ ID NO: 2775258 - protein, 13 aa, Entamoeba invadens
SIGVYKESNSNYT

SEQ ID NO: 2775259 - protein, 20 aa, Entamoeba invadens
SIHPPPSDSAEHINPKTQKM

SEQ ID NO: 2775260 - protein, 13 aa, Entamoeba invadens
SIKEDENCEEQNS

SEQ ID NO: 2775261 - protein, 18 aa, Entamoeba invadens
SIKEEVKDREKEIGREEK

SEQ ID NO: 2775262 - protein, 10 aa, Entamoeba invadens
SIKEQNHKDT

SEQ ID NO: 2775263 - protein, 12 aa, Entamoeba invadens
SIKESLETILDV

SEQ ID NO: 2775264 - protein, 25 aa, Entamoeba invadens
SIKKETIPDERVSPNTSTVPPQTEA

SEQ ID NO: 2775265 - protein, 25 aa, Entamoeba invadens
SIKNEGTTTMNDNTKIEANQCSLSS

SEQ ID NO: 2775266 - protein, 11 aa, Entamoeba invadens
SIKNKEKGDAI

SEQ ID NO: 2775267 - protein, 5 aa, Entamoeba invadens
SIKSE

SEQ ID NO: 2775268 - protein, 6 aa, Entamoeba invadens
SIKSEK

SEQ ID NO: 2775269 - protein, 7 aa, Entamoeba invadens
SIKSGEE

SEQ ID NO: 2775270 - protein, 7 aa, Entamoeba invadens
SILRSQE

SEQ ID NO: 2775271 - protein, 10 aa, Entamoeba invadens
SINENGEEIH

SEQ ID NO: 2775272 - protein, 6 aa, Entamoeba invadens
SINETN

SEQ ID NO: 2775273 - protein, 5 aa, Entamoeba invadens
SINGN

SEQ ID NO: 2775274 - protein, 8 aa, Entamoeba invadens
SINKEGKY

SEQ ID NO: 2775275 - protein, 19 aa, Entamoeba invadens
SINLNGNAKVTVTKSSEIA

SEQ ID NO: 2775276 - protein, 4 aa, Entamoeba invadens
SINN

SEQ ID NO: 2775277 - protein, 11 aa, Entamoeba invadens
SINNNNISVSN

SEQ ID NO: 2775278 - protein, 8 aa, Entamoeba invadens
SINNPKRL

SEQ ID NO: 2775279 - protein, 7 aa, Entamoeba invadens
SINPYDG

SEQ ID NO: 2775280 - protein, 4 aa, Entamoeba invadens
SINS

SEQ ID NO: 2775281 - protein, 8 aa, Entamoeba invadens
SINSNSQS

SEQ ID NO: 2775282 - protein, 9 aa, Entamoeba invadens
SINSPSDVE

SEQ ID NO: 2775283 - protein, 4 aa, Entamoeba invadens
SINT

SEQ ID NO: 2775284 - protein, 14 aa, Entamoeba invadens
SINTHQKYDEVEEE

SEQ ID NO: 2775285 - protein, 7 aa, Entamoeba invadens
SIPAPTS

SEQ ID NO: 2775286 - protein, 9 aa, Entamoeba invadens
SIPDDSQIK

SEQ ID NO: 2775287 - protein, 8 aa, Entamoeba invadens
SIPGGKAA

SEQ ID NO: 2775288 - protein, 4 aa, Entamoeba invadens
SIPH

SEQ ID NO: 2775289 - protein, 5 aa, Entamoeba invadens
SIPHA

SEQ ID NO: 2775290 - protein, 7 aa, Entamoeba invadens
SIPKKDG

SEQ ID NO: 2775291 - protein, 6 aa, Entamoeba invadens
SIPKST

SEQ ID NO: 2775292 - protein, 7 aa, Entamoeba invadens
SIPLNDS

SEQ ID NO: 2775293 - protein, 6 aa, Entamoeba invadens
SIPNMK

SEQ ID NO: 2775294 - protein, 15 aa, Entamoeba invadens
SIPPDDSYKEGRDEL

SEQ ID NO: 2775295 - protein, 10 aa, Entamoeba invadens
SIPQEKWSHE

SEQ ID NO: 2775296 - protein, 7 aa, Entamoeba invadens
SIPSKKD

SEQ ID NO: 2775297 - protein, 7 aa, Entamoeba invadens
SIPTESS

SEQ ID NO: 2775298 - protein, 7 aa, Entamoeba invadens
SIPTPLT

SEQ ID NO: 2775299 - protein, 5 aa, Entamoeba invadens
SIPTS

SEQ ID NO: 2775300 - protein, 4 aa, Entamoeba invadens
SIPV

SEQ ID NO: 2775301 - protein, 4 aa, Entamoeba invadens
SIQI

SEQ ID NO: 2775302 - protein, 5 aa, Entamoeba invadens
SIQKA

SEQ ID NO: 2775303 - protein, 5 aa, Entamoeba invadens
SIQVY

SEQ ID NO: 2775304 - protein, 16 aa, Entamoeba invadens
SIRATDNNKKTSKQLQ

SEQ ID NO: 2775305 - protein, 11 aa, Entamoeba invadens
SIREGSAPQDL

SEQ ID NO: 2775306 - protein, 7 aa, Entamoeba invadens
SIRNDNE

SEQ ID NO: 2775307 - protein, 4 aa, Entamoeba invadens
SIRP

SEQ ID NO: 2775308 - protein, 9 aa, Entamoeba invadens
SIRPGQSAE

SEQ ID NO: 2775309 - protein, 4 aa, Entamoeba invadens
SIRS

SEQ ID NO: 2775310 - protein, 9 aa, Entamoeba invadens
SIRSNGEAA

SEQ ID NO: 2775311 - protein, 5 aa, Entamoeba invadens
SIRTE

SEQ ID NO: 2775312 - protein, 23 aa, Entamoeba invadens
SIRYEDDKLQTAQKNEKKKGYKT

SEQ ID NO: 2775313 - protein, 21 aa, Entamoeba invadens
SISAGKGLDKCEGNITQSGCS

SEQ ID NO: 2775314 - protein, 12 aa, Entamoeba invadens
SISAKTKKNVLV

SEQ ID NO: 2775315 - protein, 8 aa, Entamoeba invadens
SISDFNNT

SEQ ID NO: 2775316 - protein, 9 aa, Entamoeba invadens
SISDYSKQK

SEQ ID NO: 2775317 - protein, 9 aa, Entamoeba invadens
SISEEQNSF

SEQ ID NO: 2775318 - protein, 6 aa, Entamoeba invadens
SISEGN

SEQ ID NO: 2775319 - protein, 5 aa, Entamoeba invadens
SISEN

SEQ ID NO: 2775320 - protein, 4 aa, Entamoeba invadens
SISG

SEQ ID NO: 2775321 - protein, 5 aa, Entamoeba invadens
SISGS

SEQ ID NO: 2775322 - protein, 25 aa, Entamoeba invadens
SISGSTGCSDCPAGTMSTEKSGSCT

SEQ ID NO: 2775323 - protein, 6 aa, Entamoeba invadens
SISIAK

SEQ ID NO: 2775324 - protein, 10 aa, Entamoeba invadens
SISIDGKKGT

SEQ ID NO: 2775325 - protein, 9 aa, Entamoeba invadens
SISKNDKYS

SEQ ID NO: 2775326 - protein, 12 aa, Entamoeba invadens
SISKSEEPTYSN

SEQ ID NO: 2775327 - protein, 16 aa, Entamoeba invadens
SISNANPQPRNPCEDA

SEQ ID NO: 2775328 - protein, 5 aa, Entamoeba invadens
SISNE

SEQ ID NO: 2775329 - protein, 9 aa, Entamoeba invadens
SISPKDQKL

SEQ ID NO: 2775330 - protein, 16 aa, Entamoeba invadens
SISQEQARKVAKILKE

SEQ ID NO: 2775331 - protein, 9 aa, Entamoeba invadens
SISQNEIES

SEQ ID NO: 2775332 - protein, 11 aa, Entamoeba invadens
SISRESDPSNA

SEQ ID NO: 2775333 - protein, 11 aa, Entamoeba invadens
SISRESSASDA

SEQ ID NO: 2775334 - protein, 5 aa, Entamoeba invadens
SISRP

SEQ ID NO: 2775335 - protein, 11 aa, Entamoeba invadens
SISSQNLANNT

SEQ ID NO: 2775336 - protein, 7 aa, Entamoeba invadens
SISSSTL

SEQ ID NO: 2775337 - protein, 7 aa, Entamoeba invadens
SISSTRA

SEQ ID NO: 2775338 - protein, 4 aa, Entamoeba invadens
SIST

SEQ ID NO: 2775339 - protein, 6 aa, Entamoeba invadens
SISTPI

SEQ ID NO: 2775340 - protein, 4 aa, Entamoeba invadens
SITA

SEQ ID NO: 2775341 - protein, 6 aa, Entamoeba invadens
SITASD

SEQ ID NO: 2775342 - protein, 10 aa, Entamoeba invadens
SITATQGASV

SEQ ID NO: 2775343 - protein, 5 aa, Entamoeba invadens
SITEE

SEQ ID NO: 2775344 - protein, 19 aa, Entamoeba invadens
SITGSQTTRIGTKNGKTYY

SEQ ID NO: 2775345 - protein, 11 aa, Entamoeba invadens
SITKESPIYTE

SEQ ID NO: 2775346 - protein, 4 aa, Entamoeba invadens
SITN

SEQ ID NO: 2775347 - protein, 4 aa, Entamoeba invadens
SITP

SEQ ID NO: 2775348 - protein, 14 aa, Entamoeba invadens
SITPKENKNEVSIK

SEQ ID NO: 2775349 - protein, 7 aa, Entamoeba invadens
SITPKSQ

SEQ ID NO: 2775350 - protein, 5 aa, Entamoeba invadens
SITPQ

SEQ ID NO: 2775351 - protein, 8 aa, Entamoeba invadens
SITQNTND

SEQ ID NO: 2775352 - protein, 17 aa, Entamoeba invadens
SITSEDKKITGEAVSNE

SEQ ID NO: 2775353 - protein, 16 aa, Entamoeba invadens
SITSLKSASSQATPGD

SEQ ID NO: 2775354 - protein, 8 aa, Entamoeba invadens
SITSNQSI

SEQ ID NO: 2775355 - protein, 12 aa, Entamoeba invadens
SITSPQSSVISG

SEQ ID NO: 2775356 - protein, 12 aa, Entamoeba invadens
SITTEDTIDTST

SEQ ID NO: 2775357 - protein, 9 aa, Entamoeba invadens
SITTEPDLP

SEQ ID NO: 2775358 - protein, 6 aa, Entamoeba invadens
SITTSC

SEQ ID NO: 2775359 - protein, 7 aa, Entamoeba invadens
SITTSPK

SEQ ID NO: 2775360 - protein, 12 aa, Entamoeba invadens
SIVNKTSNRLGR

SEQ ID NO: 2775361 - protein, 4 aa, Entamoeba invadens
SIYN

SEQ ID NO: 2775362 - protein, 9 aa, Entamoeba invadens
SIYSSENGT

SEQ ID NO: 2775363 - protein, 12 aa, Entamoeba invadens
SIYTKDDGMNTY

SEQ ID NO: 2775364 - protein, 7 aa, Entamoeba invadens
SKAADEA

SEQ ID NO: 2775365 - protein, 10 aa, Entamoeba invadens
SKAGFESLNS

SEQ ID NO: 2775366 - protein, 8 aa, Entamoeba invadens
SKAGLSSH

SEQ ID NO: 2775367 - protein, 5 aa, Entamoeba invadens
SKAKG

SEQ ID NO: 2775368 - protein, 6 aa, Entamoeba invadens
SKAKTV

SEQ ID NO: 2775369 - protein, 9 aa, Entamoeba invadens
SKAKTVTFS

SEQ ID NO: 2775370 - protein, 11 aa, Entamoeba invadens
SKALEESERLE

SEQ ID NO: 2775371 - protein, 12 aa, Entamoeba invadens
SKALPQQIESNN

SEQ ID NO: 2775372 - protein, 9 aa, Entamoeba invadens
SKANYNNQS

SEQ ID NO: 2775373 - protein, 9 aa, Entamoeba invadens
SKAQNPDIA

SEQ ID NO: 2775374 - protein, 7 aa, Entamoeba invadens
SKASENI

SEQ ID NO: 2775375 - protein, 6 aa, Entamoeba invadens
SKASQQ

SEQ ID NO: 2775376 - protein, 8 aa, Entamoeba invadens
SKATLSSP

SEQ ID NO: 2775377 - protein, 9 aa, Entamoeba invadens
SKATPFDCG

SEQ ID NO: 2775378 - protein, 5 aa, Entamoeba invadens
SKATT

SEQ ID NO: 2775379 - protein, 6 aa, Entamoeba invadens
SKAVGG

SEQ ID NO: 2775380 - protein, 10 aa, Entamoeba invadens
SKAVTYPEGN

SEQ ID NO: 2775381 - protein, 4 aa, Entamoeba invadens
SKCE

SEQ ID NO: 2775382 - protein, 8 aa, Entamoeba invadens
SKCEPCST

SEQ ID NO: 2775383 - protein, 5 aa, Entamoeba invadens
SKCEQ

SEQ ID NO: 2775384 - protein, 7 aa, Entamoeba invadens
SKCETEN

SEQ ID NO: 2775385 - protein, 30 aa, Entamoeba invadens
SKCKDGNTYKTPCYSDDKECNKCATPSQDA

SEQ ID NO: 2775386 - protein, 8 aa, Entamoeba invadens
SKCKEGYG

SEQ ID NO: 2775387 - protein, 15 aa, Entamoeba invadens
SKCKTETECKDSAMG

SEQ ID NO: 2775388 - protein, 7 aa, Entamoeba invadens
SKCNNKE

SEQ ID NO: 2775389 - protein, 6 aa, Entamoeba invadens
SKCPVS

SEQ ID NO: 2775390 - protein, 16 aa, Entamoeba invadens
SKCQNGTFKDNKSGFC

SEQ ID NO: 2775391 - protein, 22 aa, Entamoeba invadens
SKCSDGYKLSGDKLECSKKTNY

SEQ ID NO: 2775392 - protein, 6 aa, Entamoeba invadens
SKCSEG

SEQ ID NO: 2775393 - protein, 7 aa, Entamoeba invadens
SKCSGAT

SEQ ID NO: 2775394 - protein, 6 aa, Entamoeba invadens
SKCSNC

SEQ ID NO: 2775395 - protein, 10 aa, Entamoeba invadens
SKCSQTEDKC

SEQ ID NO: 2775396 - protein, 8 aa, Entamoeba invadens
SKCSQTEY

SEQ ID NO: 2775397 - protein, 19 aa, Entamoeba invadens
SKCSSTCSTCTNAEDQCDN

SEQ ID NO: 2775398 - protein, 16 aa, Entamoeba invadens
SKCSTCTSGDKCNTCQ

SEQ ID NO: 2775399 - protein, 4 aa, Entamoeba invadens
SKCT

SEQ ID NO: 2775400 - protein, 6 aa, Entamoeba invadens
SKCTDC

SEQ ID NO: 2775401 - protein, 7 aa, Entamoeba invadens
SKCTPQM

SEQ ID NO: 2775402 - protein, 6 aa, Entamoeba invadens
SKCTSQ

SEQ ID NO: 2775403 - protein, 16 aa, Entamoeba invadens
SKCTTEPGSCSSNYTR

SEQ ID NO: 2775404 - protein, 10 aa, Entamoeba invadens
SKDDKPAKLG

SEQ ID NO: 2775405 - protein, 8 aa, Entamoeba invadens
SKDDNNIS

SEQ ID NO: 2775406 - protein, 10 aa, Entamoeba invadens
SKDDSAIGDE

SEQ ID NO: 2775407 - protein, 7 aa, Entamoeba invadens
SKDDTGC

SEQ ID NO: 2775408 - protein, 9 aa, Entamoeba invadens
SKDEKKVNA

SEQ ID NO: 2775409 - protein, 8 aa, Entamoeba invadens
SKDEKNVN

SEQ ID NO: 2775410 - protein, 8 aa, Entamoeba invadens
SKDEMKQD

SEQ ID NO: 2775411 - protein, 10 aa, Entamoeba invadens
SKDERLKPEK

SEQ ID NO: 2775412 - protein, 12 aa, Entamoeba invadens
SKDGEYKSIEGE

SEQ ID NO: 2775413 - protein, 8 aa, Entamoeba invadens
SKDGVNAK

SEQ ID NO: 2775414 - protein, 14 aa, Entamoeba invadens
SKDNESCTPQSNSL

SEQ ID NO: 2775415 - protein, 7 aa, Entamoeba invadens
SKDPQSI

SEQ ID NO: 2775416 - protein, 7 aa, Entamoeba invadens
SKDPRQT

SEQ ID NO: 2775417 - protein, 9 aa, Entamoeba invadens
SKDPSVSYD

SEQ ID NO: 2775418 - protein, 8 aa, Entamoeba invadens
SKDPTQYN

SEQ ID NO: 2775419 - protein, 7 aa, Entamoeba invadens
SKDSGIV

SEQ ID NO: 2775420 - protein, 7 aa, Entamoeba invadens
SKDSRVQ

SEQ ID NO: 2775421 - protein, 16 aa, Entamoeba invadens
SKDTANNCFLRRGELK

SEQ ID NO: 2775422 - protein, 11 aa, Entamoeba invadens
SKDYKLSSDGL

SEQ ID NO: 2775423 - protein, 20 aa, Entamoeba invadens
SKEAMDKATIADNNHEKNKT

SEQ ID NO: 2775424 - protein, 7 aa, Entamoeba invadens
SKEASVR

SEQ ID NO: 2775425 - protein, 4 aa, Entamoeba invadens
SKED

SEQ ID NO: 2775426 - protein, 7 aa, Entamoeba invadens
SKEDEVT

SEQ ID NO: 2775427 - protein, 5 aa, Entamoeba invadens
SKEDF

SEQ ID NO: 2775428 - protein, 9 aa, Entamoeba invadens
SKEDGTSCF

SEQ ID NO: 2775429 - protein, 6 aa, Entamoeba invadens
SKEDKL

SEQ ID NO: 2775430 - protein, 6 aa, Entamoeba invadens
SKEDLP

SEQ ID NO: 2775431 - protein, 9 aa, Entamoeba invadens
SKEDNNSNA

SEQ ID NO: 2775432 - protein, 7 aa, Entamoeba invadens
SKEDTFP

SEQ ID NO: 2775433 - protein, 7 aa, Entamoeba invadens
SKEDTTT

SEQ ID NO: 2775434 - protein, 19 aa, Entamoeba invadens
SKEDVTSQEKATKTRKINS

SEQ ID NO: 2775435 - protein, 20 aa, Entamoeba invadens
SKEDVTSQEKATKTRKINSF

SEQ ID NO: 2775436 - protein, 16 aa, Entamoeba invadens
SKEEKKPEKKNEKGIS

SEQ ID NO: 2775437 - protein, 10 aa, Entamoeba invadens
SKEEQSKENV

SEQ ID NO: 2775438 - protein, 9 aa, Entamoeba invadens
SKEEQTPYS

SEQ ID NO: 2775439 - protein, 7 aa, Entamoeba invadens
SKEFKDQ

SEQ ID NO: 2775440 - protein, 9 aa, Entamoeba invadens
SKEGKSVEQ

SEQ ID NO: 2775441 - protein, 11 aa, Entamoeba invadens
SKEGTGYGPSY

SEQ ID NO: 2775442 - protein, 8 aa, Entamoeba invadens
SKEHLSQG

SEQ ID NO: 2775443 - protein, 9 aa, Entamoeba invadens
SKEHNDGSV

SEQ ID NO: 2775444 - protein, 5 aa, Entamoeba invadens
SKEIE

SEQ ID NO: 2775445 - protein, 11 aa, Entamoeba invadens
SKEIGDTVGER

SEQ ID NO: 2775446 - protein, 19 aa, Entamoeba invadens
SKEIKTVRGISSRKKYQEF

SEQ ID NO: 2775447 - protein, 17 aa, Entamoeba invadens
SKEKERNKKDDDFEEKN

SEQ ID NO: 2775448 - protein, 9 aa, Entamoeba invadens
SKEKGLEKG

SEQ ID NO: 2775449 - protein, 4 aa, Entamoeba invadens
SKEL

SEQ ID NO: 2775450 - protein, 6 aa, Entamoeba invadens
SKEMKS

SEQ ID NO: 2775451 - protein, 9 aa, Entamoeba invadens
SKENNTTQW

SEQ ID NO: 2775452 - protein, 9 aa, Entamoeba invadens
SKENRRPAF

SEQ ID NO: 2775453 - protein, 9 aa, Entamoeba invadens
SKENTKKQL

SEQ ID NO: 2775454 - protein, 8 aa, Entamoeba invadens
SKEPIAGS

SEQ ID NO: 2775455 - protein, 8 aa, Entamoeba invadens
SKEPRDEN

SEQ ID NO: 2775456 - protein, 13 aa, Entamoeba invadens
SKEPTEAANTISE

SEQ ID NO: 2775457 - protein, 8 aa, Entamoeba invadens
SKEQQTRY

SEQ ID NO: 2775458 - protein, 7 aa, Entamoeba invadens
SKEQVTA

SEQ ID NO: 2775459 - protein, 7 aa, Entamoeba invadens
SKEQYPN

SEQ ID NO: 2775460 - protein, 13 aa, Entamoeba invadens
SKESEANSRAKNL

SEQ ID NO: 2775461 - protein, 8 aa, Entamoeba invadens
SKESEKVN

SEQ ID NO: 2775462 - protein, 5 aa, Entamoeba invadens
SKESG

SEQ ID NO: 2775463 - protein, 34 aa, Entamoeba invadens
SKESGQEEDSESSDSSISEGPTEHKKLLAVEKEE

SEQ ID NO: 2775464 - protein, 4 aa, Entamoeba invadens
SKET

SEQ ID NO: 2775465 - protein, 7 aa, Entamoeba invadens
SKETETN

SEQ ID NO: 2775466 - protein, 5 aa, Entamoeba invadens
SKETH

SEQ ID NO: 2775467 - protein, 11 aa, Entamoeba invadens
SKETRQRCKTI

SEQ ID NO: 2775468 - protein, 73 aa, Entamoeba invadens
SKETSEKGDRRKNESESQIEARRKSERERSRTKRQNETEEERLKRRENERQRMREKRRNLPEDEKKKRREQMK

SEQ ID NO: 2775469 - protein, 4 aa, Entamoeba invadens
SKEY

SEQ ID NO: 2775470 - protein, 4 aa, Entamoeba invadens
SKFA

SEQ ID NO: 2775471 - protein, 6 aa, Entamoeba invadens
SKFGEV

SEQ ID NO: 2775472 - protein, 6 aa, Entamoeba invadens
SKFNLE

SEQ ID NO: 2775473 - protein, 7 aa, Entamoeba invadens
SKFSKRN

SEQ ID NO: 2775474 - protein, 6 aa, Entamoeba invadens
SKFSSI

SEQ ID NO: 2775475 - protein, 6 aa, Entamoeba invadens
SKFYSK

SEQ ID NO: 2775476 - protein, 4 aa, Entamoeba invadens
SKGA

SEQ ID NO: 2775477 - protein, 6 aa, Entamoeba invadens
SKGAPE

SEQ ID NO: 2775478 - protein, 8 aa, Entamoeba invadens
SKGCPVDS

SEQ ID NO: 2775479 - protein, 9 aa, Entamoeba invadens
SKGCQQCSS

SEQ ID NO: 2775480 - protein, 5 aa, Entamoeba invadens
SKGCS

SEQ ID NO: 2775481 - protein, 6 aa, Entamoeba invadens
SKGDDN

SEQ ID NO: 2775482 - protein, 7 aa, Entamoeba invadens
SKGEEYT

SEQ ID NO: 2775483 - protein, 7 aa, Entamoeba invadens
SKGEQMS

SEQ ID NO: 2775484 - protein, 17 aa, Entamoeba invadens
SKGERPAIELGDGKQKA

SEQ ID NO: 2775485 - protein, 5 aa, Entamoeba invadens
SKGFS

SEQ ID NO: 2775486 - protein, 4 aa, Entamoeba invadens
SKGI

SEQ ID NO: 2775487 - protein, 11 aa, Entamoeba invadens
SKGKPPKQNIT

SEQ ID NO: 2775488 - protein, 5 aa, Entamoeba invadens
SKGKV

SEQ ID NO: 2775489 - protein, 15 aa, Entamoeba invadens
SKGLDKRTCKKEGEV

SEQ ID NO: 2775490 - protein, 9 aa, Entamoeba invadens
SKGLGEYSI

SEQ ID NO: 2775491 - protein, 8 aa, Entamoeba invadens
SKGLPEKV

SEQ ID NO: 2775492 - protein, 5 aa, Entamoeba invadens
SKGNH

SEQ ID NO: 2775493 - protein, 13 aa, Entamoeba invadens
SKGNRLERPQNVD

SEQ ID NO: 2775494 - protein, 5 aa, Entamoeba invadens
SKGQL

SEQ ID NO: 2775495 - protein, 14 aa, Entamoeba invadens
SKGQRPKINIENGE

SEQ ID NO: 2775496 - protein, 13 aa, Entamoeba invadens
SKGRTETPTEWSQ

SEQ ID NO: 2775497 - protein, 8 aa, Entamoeba invadens
SKGSEEMM

SEQ ID NO: 2775498 - protein, 13 aa, Entamoeba invadens
SKGSNNKPVQQIV

SEQ ID NO: 2775499 - protein, 15 aa, Entamoeba invadens
SKGSNSAKDDGYTLA

SEQ ID NO: 2775500 - protein, 15 aa, Entamoeba invadens
SKGTAVTISNTEASS

SEQ ID NO: 2775501 - protein, 18 aa, Entamoeba invadens
SKGTSKFYNAKRAENIAT

SEQ ID NO: 2775502 - protein, 4 aa, Entamoeba invadens
SKGV

SEQ ID NO: 2775503 - protein, 18 aa, Entamoeba invadens
SKGVVNNKKSNKKELNTQ

SEQ ID NO: 2775504 - protein, 9 aa, Entamoeba invadens
SKHEDFPTN

SEQ ID NO: 2775505 - protein, 4 aa, Entamoeba invadens
SKHH

SEQ ID NO: 2775506 - protein, 8 aa, Entamoeba invadens
SKHHEKIS

SEQ ID NO: 2775507 - protein, 5 aa, Entamoeba invadens
SKHPK

SEQ ID NO: 2775508 - protein, 15 aa, Entamoeba invadens
SKHSGLFNSSAAENF

SEQ ID NO: 2775509 - protein, 19 aa, Entamoeba invadens
SKHTDMKEQNGIKPYNSVE

SEQ ID NO: 2775510 - protein, 6 aa, Entamoeba invadens
SKHVNS

SEQ ID NO: 2775511 - protein, 4 aa, Entamoeba invadens
SKID

SEQ ID NO: 2775512 - protein, 7 aa, Entamoeba invadens
SKIDKTN

SEQ ID NO: 2775513 - protein, 7 aa, Entamoeba invadens
SKIDPQI

SEQ ID NO: 2775514 - protein, 4 aa, Entamoeba invadens
SKIE

SEQ ID NO: 2775515 - protein, 6 aa, Entamoeba invadens
SKIEKV

SEQ ID NO: 2775516 - protein, 6 aa, Entamoeba invadens
SKIPEF

SEQ ID NO: 2775517 - protein, 5 aa, Entamoeba invadens
SKISI

SEQ ID NO: 2775518 - protein, 13 aa, Entamoeba invadens
SKISTGVASAFTD

SEQ ID NO: 2775519 - protein, 6 aa, Entamoeba invadens
SKISTQ

SEQ ID NO: 2775520 - protein, 6 aa, Entamoeba invadens
SKITEK

SEQ ID NO: 2775521 - protein, 19 aa, Entamoeba invadens
SKITFEGSSKSTSLNNTNI

SEQ ID NO: 2775522 - protein, 6 aa, Entamoeba invadens
SKITIQ

SEQ ID NO: 2775523 - protein, 6 aa, Entamoeba invadens
SKIYQD

SEQ ID NO: 2775524 - protein, 8 aa, Entamoeba invadens
SKKAENRV

SEQ ID NO: 2775525 - protein, 7 aa, Entamoeba invadens
SKKCESR

SEQ ID NO: 2775526 - protein, 16 aa, Entamoeba invadens
SKKCSQSCPSGFYSDN

SEQ ID NO: 2775527 - protein, 13 aa, Entamoeba invadens
SKKDAAKNEALEE

SEQ ID NO: 2775528 - protein, 9 aa, Entamoeba invadens
SKKDDKTVN

SEQ ID NO: 2775529 - protein, 18 aa, Entamoeba invadens
SKKDTEEEFKTTDPSDAD

SEQ ID NO: 2775530 - protein, 9 aa, Entamoeba invadens
SKKDTTKID

SEQ ID NO: 2775531 - protein, 7 aa, Entamoeba invadens
SKKGVVR

SEQ ID NO: 2775532 - protein, 4 aa, Entamoeba invadens
SKKI

SEQ ID NO: 2775533 - protein, 9 aa, Entamoeba invadens
SKKIQNRTN

SEQ ID NO: 2775534 - protein, 10 aa, Entamoeba invadens
SKKIYKNEST

SEQ ID NO: 2775535 - protein, 8 aa, Entamoeba invadens
SKKKAFRT

SEQ ID NO: 2775536 - protein, 7 aa, Entamoeba invadens
SKKKFTD

SEQ ID NO: 2775537 - protein, 11 aa, Entamoeba invadens
SKKMGKKMTTN

SEQ ID NO: 2775538 - protein, 8 aa, Entamoeba invadens
SKKNKNVF

SEQ ID NO: 2775539 - protein, 7 aa, Entamoeba invadens
SKKNQYV

SEQ ID NO: 2775540 - protein, 5 aa, Entamoeba invadens
SKKPV

SEQ ID NO: 2775541 - protein, 20 aa, Entamoeba invadens
SKKQTDENFNKRRKRAERKM

SEQ ID NO: 2775542 - protein, 18 aa, Entamoeba invadens
SKKQTVVDPNNYKNFAKG

SEQ ID NO: 2775543 - protein, 4 aa, Entamoeba invadens
SKKS

SEQ ID NO: 2775544 - protein, 8 aa, Entamoeba invadens
SKKSKSLK

SEQ ID NO: 2775545 - protein, 10 aa, Entamoeba invadens
SKKSNEFKET

SEQ ID NO: 2775546 - protein, 7 aa, Entamoeba invadens
SKKSSKC

SEQ ID NO: 2775547 - protein, 8 aa, Entamoeba invadens
SKKTEKNR

SEQ ID NO: 2775548 - protein, 10 aa, Entamoeba invadens
SKKTGELRPL

SEQ ID NO: 2775549 - protein, 7 aa, Entamoeba invadens
SKKTLEK

SEQ ID NO: 2775550 - protein, 7 aa, Entamoeba invadens
SKKTLQQ

SEQ ID NO: 2775551 - protein, 7 aa, Entamoeba invadens
SKKTPGM

SEQ ID NO: 2775552 - protein, 7 aa, Entamoeba invadens
SKKTTNK

SEQ ID NO: 2775553 - protein, 9 aa, Entamoeba invadens
SKKTTPSGI

SEQ ID NO: 2775554 - protein, 11 aa, Entamoeba invadens
SKKVLKKEDSE

SEQ ID NO: 2775555 - protein, 5 aa, Entamoeba invadens
SKKWD

SEQ ID NO: 2775556 - protein, 57 aa, Entamoeba invadens
SKLDEEERKIQEQMEAENKRRKKKEHHKWSKKSRNIKIDKTSKNSTNTTDATTSNSL

SEQ ID NO: 2775557 - protein, 21 aa, Entamoeba invadens
SKLDPDELEEEKKIGEGSCNK

SEQ ID NO: 2775558 - protein, 9 aa, Entamoeba invadens
SKLDPEEIK

SEQ ID NO: 2775559 - protein, 12 aa, Entamoeba invadens
SKLEKEKTISMQ

SEQ ID NO: 2775560 - protein, 7 aa, Entamoeba invadens
SKLEQKS

SEQ ID NO: 2775561 - protein, 13 aa, Entamoeba invadens
SKLGEDAYSLRTE

SEQ ID NO: 2775562 - protein, 27 aa, Entamoeba invadens
SKLHSENSTIELTQQSGTHIEDDSPIQ

SEQ ID NO: 2775563 - protein, 8 aa, Entamoeba invadens
SKLMESSD

SEQ ID NO: 2775564 - protein, 9 aa, Entamoeba invadens
SKLNTKANN

SEQ ID NO: 2775565 - protein, 4 aa, Entamoeba invadens
SKLP

SEQ ID NO: 2775566 - protein, 7 aa, Entamoeba invadens
SKLQNGV

SEQ ID NO: 2775567 - protein, 7 aa, Entamoeba invadens
SKLRGVA

SEQ ID NO: 2775568 - protein, 7 aa, Entamoeba invadens
SKLSEGT

SEQ ID NO: 2775569 - protein, 10 aa, Entamoeba invadens
SKLSEYKSCN

SEQ ID NO: 2775570 - protein, 7 aa, Entamoeba invadens
SKLSGQT

SEQ ID NO: 2775571 - protein, 6 aa, Entamoeba invadens
SKLYTD

SEQ ID NO: 2775572 - protein, 14 aa, Entamoeba invadens
SKMDEKEVKVTKER

SEQ ID NO: 2775573 - protein, 7 aa, Entamoeba invadens
SKMETNK

SEQ ID NO: 2775574 - protein, 10 aa, Entamoeba invadens
SKMNANGKCE

SEQ ID NO: 2775575 - protein, 8 aa, Entamoeba invadens
SKMSGQSE

SEQ ID NO: 2775576 - protein, 5 aa, Entamoeba invadens
SKMTT

SEQ ID NO: 2775577 - protein, 4 aa, Entamoeba invadens
SKNA

SEQ ID NO: 2775578 - protein, 8 aa, Entamoeba invadens
SKNAETKV

SEQ ID NO: 2775579 - protein, 9 aa, Entamoeba invadens
SKNCSSCPS

SEQ ID NO: 2775580 - protein, 7 aa, Entamoeba invadens
SKNDKCT

SEQ ID NO: 2775581 - protein, 10 aa, Entamoeba invadens
SKNECKPQSD

SEQ ID NO: 2775582 - protein, 10 aa, Entamoeba invadens
SKNETKISKN

SEQ ID NO: 2775583 - protein, 6 aa, Entamoeba invadens
SKNEYK

SEQ ID NO: 2775584 - protein, 15 aa, Entamoeba invadens
SKNFEKTTKYNFPTY

SEQ ID NO: 2775585 - protein, 7 aa, Entamoeba invadens
SKNGSIV

SEQ ID NO: 2775586 - protein, 6 aa, Entamoeba invadens
SKNGVV

SEQ ID NO: 2775587 - protein, 6 aa, Entamoeba invadens
SKNGYY

SEQ ID NO: 2775588 - protein, 7 aa, Entamoeba invadens
SKNIEGK

SEQ ID NO: 2775589 - protein, 5 aa, Entamoeba invadens
SKNIT

SEQ ID NO: 2775590 - protein, 7 aa, Entamoeba invadens
SKNKISR

SEQ ID NO: 2775591 - protein, 7 aa, Entamoeba invadens
SKNKQKI

SEQ ID NO: 2775592 - protein, 8 aa, Entamoeba invadens
SKNKQKIQ

SEQ ID NO: 2775593 - protein, 5 aa, Entamoeba invadens
SKNKT

SEQ ID NO: 2775594 - protein, 7 aa, Entamoeba invadens
SKNNFDR

SEQ ID NO: 2775595 - protein, 6 aa, Entamoeba invadens
SKNNSY

SEQ ID NO: 2775596 - protein, 9 aa, Entamoeba invadens
SKNNTCTPI

SEQ ID NO: 2775597 - protein, 8 aa, Entamoeba invadens
SKNPNVMS

SEQ ID NO: 2775598 - protein, 5 aa, Entamoeba invadens
SKNPV

SEQ ID NO: 2775599 - protein, 8 aa, Entamoeba invadens
SKNQKNCK

SEQ ID NO: 2775600 - protein, 10 aa, Entamoeba invadens
SKNQSRATQY

SEQ ID NO: 2775601 - protein, 4 aa, Entamoeba invadens
SKNR

SEQ ID NO: 2775602 - protein, 6 aa, Entamoeba invadens
SKNSDE

SEQ ID NO: 2775603 - protein, 14 aa, Entamoeba invadens
SKNSFSQFKTSSCE

SEQ ID NO: 2775604 - protein, 5 aa, Entamoeba invadens
SKNSI

SEQ ID NO: 2775605 - protein, 8 aa, Entamoeba invadens
SKNSKCTK

SEQ ID NO: 2775606 - protein, 9 aa, Entamoeba invadens
SKNSTTPLQ

SEQ ID NO: 2775607 - protein, 5 aa, Entamoeba invadens
SKNSV

SEQ ID NO: 2775608 - protein, 8 aa, Entamoeba invadens
SKNTNKYD

SEQ ID NO: 2775609 - protein, 6 aa, Entamoeba invadens
SKNTQF

SEQ ID NO: 2775610 - protein, 17 aa, Entamoeba invadens
SKNTQPSEIKNEVKNGM

SEQ ID NO: 2775611 - protein, 5 aa, Entamoeba invadens
SKNTV

SEQ ID NO: 2775612 - protein, 5 aa, Entamoeba invadens
SKPDY

SEQ ID NO: 2775613 - protein, 13 aa, Entamoeba invadens
SKPEFINRGTSYN

SEQ ID NO: 2775614 - protein, 26 aa, Entamoeba invadens
SKPEKVAQKLEKKKKKKKQREAESEM

SEQ ID NO: 2775615 - protein, 6 aa, Entamoeba invadens
SKPEVT

SEQ ID NO: 2775616 - protein, 20 aa, Entamoeba invadens
SKPHKSDSTMDITTSTLNKS

SEQ ID NO: 2775617 - protein, 7 aa, Entamoeba invadens
SKPIGDC

SEQ ID NO: 2775618 - protein, 5 aa, Entamoeba invadens
SKPIH

SEQ ID NO: 2775619 - protein, 17 aa, Entamoeba invadens
SKPKKAKQAKMTQEYTP

SEQ ID NO: 2775620 - protein, 10 aa, Entamoeba invadens
SKPKKTKQAK

SEQ ID NO: 2775621 - protein, 25 aa, Entamoeba invadens
SKPKTEDYANPDCTHSSCTSCPTSA

SEQ ID NO: 2775622 - protein, 25 aa, Entamoeba invadens
SKPLPSLPHQPETELETVPPPSVEY

SEQ ID NO: 2775623 - protein, 6 aa, Entamoeba invadens
SKPNAK

SEQ ID NO: 2775624 - protein, 6 aa, Entamoeba invadens
SKPNNV

SEQ ID NO: 2775625 - protein, 7 aa, Entamoeba invadens
SKPPIKN

SEQ ID NO: 2775626 - protein, 7 aa, Entamoeba invadens
SKPPPCF

SEQ ID NO: 2775627 - protein, 9 aa, Entamoeba invadens
SKPQKKRID

SEQ ID NO: 2775628 - protein, 8 aa, Entamoeba invadens
SKPRDDSK

SEQ ID NO: 2775629 - protein, 7 aa, Entamoeba invadens
SKPSRRV

SEQ ID NO: 2775630 - protein, 4 aa, Entamoeba invadens
SKPT

SEQ ID NO: 2775631 - protein, 7 aa, Entamoeba invadens
SKPTFGK

SEQ ID NO: 2775632 - protein, 7 aa, Entamoeba invadens
SKPTSGK

SEQ ID NO: 2775633 - protein, 8 aa, Entamoeba invadens
SKPTVESG

SEQ ID NO: 2775634 - protein, 5 aa, Entamoeba invadens
SKPYN

SEQ ID NO: 2775635 - protein, 25 aa, Entamoeba invadens
SKPYVPKRKKQQEVEHEKEKVEEEV

SEQ ID NO: 2775636 - protein, 5 aa, Entamoeba invadens
SKQCF

SEQ ID NO: 2775637 - protein, 8 aa, Entamoeba invadens
SKQDPELC

SEQ ID NO: 2775638 - protein, 5 aa, Entamoeba invadens
SKQDQ

SEQ ID NO: 2775639 - protein, 8 aa, Entamoeba invadens
SKQEDKPL

SEQ ID NO: 2775640 - protein, 8 aa, Entamoeba invadens
SKQGDNKN

SEQ ID NO: 2775641 - protein, 5 aa, Entamoeba invadens
SKQGK

SEQ ID NO: 2775642 - protein, 4 aa, Entamoeba invadens
SKQI

SEQ ID NO: 2775643 - protein, 17 aa, Entamoeba invadens
SKQIDKIKQDAESNKES

SEQ ID NO: 2775644 - protein, 6 aa, Entamoeba invadens
SKQLKG

SEQ ID NO: 2775645 - protein, 8 aa, Entamoeba invadens
SKQLTKCG

SEQ ID NO: 2775646 - protein, 25 aa, Entamoeba invadens
SKQLTSQLSNDKKEVNVDDLNADEA

SEQ ID NO: 2775647 - protein, 7 aa, Entamoeba invadens
SKQPEMD

SEQ ID NO: 2775648 - protein, 9 aa, Entamoeba invadens
SKQPLPNGN

SEQ ID NO: 2775649 - protein, 9 aa, Entamoeba invadens
SKQPSESRL

SEQ ID NO: 2775650 - protein, 9 aa, Entamoeba invadens
SKQRGKAAE

SEQ ID NO: 2775651 - protein, 6 aa, Entamoeba invadens
SKQRQE

SEQ ID NO: 2775652 - protein, 4 aa, Entamoeba invadens
SKQS

SEQ ID NO: 2775653 - protein, 5 aa, Entamoeba invadens
SKQSS

SEQ ID NO: 2775654 - protein, 16 aa, Entamoeba invadens
SKQSTRQCDELQQKGL

SEQ ID NO: 2775655 - protein, 9 aa, Entamoeba invadens
SKQTTISGN

SEQ ID NO: 2775656 - protein, 10 aa, Entamoeba invadens
SKQVNPASPY

SEQ ID NO: 2775657 - protein, 6 aa, Entamoeba invadens
SKQVTI

SEQ ID NO: 2775658 - protein, 7 aa, Entamoeba invadens
SKQYEKE

SEQ ID NO: 2775659 - protein, 14 aa, Entamoeba invadens
SKRADEDGKKWDSA

SEQ ID NO: 2775660 - protein, 6 aa, Entamoeba invadens
SKRAQK

SEQ ID NO: 2775661 - protein, 16 aa, Entamoeba invadens
SKRCEKCSENCESCTD

SEQ ID NO: 2775662 - protein, 32 aa, Entamoeba invadens
SKRDKIDNKIDEEEMQSPPQNNDQNTEKQEVE

SEQ ID NO: 2775663 - protein, 13 aa, Entamoeba invadens
SKRDVPSKQSGYY

SEQ ID NO: 2775664 - protein, 6 aa, Entamoeba invadens
SKREVT

SEQ ID NO: 2775665 - protein, 9 aa, Entamoeba invadens
SKRGSTTGK

SEQ ID NO: 2775666 - protein, 7 aa, Entamoeba invadens
SKRISSN

SEQ ID NO: 2775667 - protein, 16 aa, Entamoeba invadens
SKRKALAKSLSETCST

SEQ ID NO: 2775668 - protein, 6 aa, Entamoeba invadens
SKRPTI

SEQ ID NO: 2775669 - protein, 8 aa, Entamoeba invadens
SKRQLPGK

SEQ ID NO: 2775670 - protein, 8 aa, Entamoeba invadens
SKRREDAL

SEQ ID NO: 2775671 - protein, 19 aa, Entamoeba invadens
SKRRESKHIKRDKTRSTKW

SEQ ID NO: 2775672 - protein, 7 aa, Entamoeba invadens
SKRRLRN

SEQ ID NO: 2775673 - protein, 6 aa, Entamoeba invadens
SKRRLT

SEQ ID NO: 2775674 - protein, 10 aa, Entamoeba invadens
SKRSADNTTK

SEQ ID NO: 2775675 - protein, 8 aa, Entamoeba invadens
SKRSCESC

SEQ ID NO: 2775676 - protein, 8 aa, Entamoeba invadens
SKRTHSSL

SEQ ID NO: 2775677 - protein, 31 aa, Entamoeba invadens
SKRVEENKTEKEKKEDQKKMVKKETQKSQKL

SEQ ID NO: 2775678 - protein, 9 aa, Entamoeba invadens
SKSAQNTSE

SEQ ID NO: 2775679 - protein, 6 aa, Entamoeba invadens
SKSCSK

SEQ ID NO: 2775680 - protein, 6 aa, Entamoeba invadens
SKSCSN

SEQ ID NO: 2775681 - protein, 15 aa, Entamoeba invadens
SKSDSTCSSTGKAAS

SEQ ID NO: 2775682 - protein, 11 aa, Entamoeba invadens
SKSEEDEEGVF

SEQ ID NO: 2775683 - protein, 9 aa, Entamoeba invadens
SKSEIQKDE

SEQ ID NO: 2775684 - protein, 8 aa, Entamoeba invadens
SKSENCDI

SEQ ID NO: 2775685 - protein, 6 aa, Entamoeba invadens
SKSENG

SEQ ID NO: 2775686 - protein, 10 aa, Entamoeba invadens
SKSEQPNKVS

SEQ ID NO: 2775687 - protein, 4 aa, Entamoeba invadens
SKSG

SEQ ID NO: 2775688 - protein, 8 aa, Entamoeba invadens
SKSGDATC

SEQ ID NO: 2775689 - protein, 10 aa, Entamoeba invadens
SKSGGESKFV

SEQ ID NO: 2775690 - protein, 14 aa, Entamoeba invadens
SKSGKNDDTTKTLT

SEQ ID NO: 2775691 - protein, 6 aa, Entamoeba invadens
SKSGYS

SEQ ID NO: 2775692 - protein, 5 aa, Entamoeba invadens
SKSKI

SEQ ID NO: 2775693 - protein, 10 aa, Entamoeba invadens
SKSKSHKHSQ

SEQ ID NO: 2775694 - protein, 8 aa, Entamoeba invadens
SKSKTTKA

SEQ ID NO: 2775695 - protein, 15 aa, Entamoeba invadens
SKSMRNMTPTAPRQI

SEQ ID NO: 2775696 - protein, 6 aa, Entamoeba invadens
SKSPAV

SEQ ID NO: 2775697 - protein, 10 aa, Entamoeba invadens
SKSPSGCTTC

SEQ ID NO: 2775698 - protein, 16 aa, Entamoeba invadens
SKSPSSKEKGSSVTPT

SEQ ID NO: 2775699 - protein, 10 aa, Entamoeba invadens
SKSQDTEKNT

SEQ ID NO: 2775700 - protein, 8 aa, Entamoeba invadens
SKSQPNFK

SEQ ID NO: 2775701 - protein, 6 aa, Entamoeba invadens
SKSRPL

SEQ ID NO: 2775702 - protein, 4 aa, Entamoeba invadens
SKSS

SEQ ID NO: 2775703 - protein, 17 aa, Entamoeba invadens
SKSSCSNSENSHKDTNG

SEQ ID NO: 2775704 - protein, 5 aa, Entamoeba invadens
SKSSI

SEQ ID NO: 2775705 - protein, 6 aa, Entamoeba invadens
SKSTLQ

SEQ ID NO: 2775706 - protein, 7 aa, Entamoeba invadens
SKSTLTN

SEQ ID NO: 2775707 - protein, 22 aa, Entamoeba invadens
SKSTPGNPLTLSKRDKGKTINS

SEQ ID NO: 2775708 - protein, 16 aa, Entamoeba invadens
SKSTSSKEEDSVDKDL

SEQ ID NO: 2775709 - protein, 9 aa, Entamoeba invadens
SKSTTCTSC

SEQ ID NO: 2775710 - protein, 10 aa, Entamoeba invadens
SKSTTGGSGV

SEQ ID NO: 2775711 - protein, 15 aa, Entamoeba invadens
SKSTYGGFDETDEAQ

SEQ ID NO: 2775712 - protein, 6 aa, Entamoeba invadens
SKSVKK

SEQ ID NO: 2775713 - protein, 8 aa, Entamoeba invadens
SKSWNGDT

SEQ ID NO: 2775714 - protein, 7 aa, Entamoeba invadens
SKSYDQF

SEQ ID NO: 2775715 - protein, 4 aa, Entamoeba invadens
SKTA

SEQ ID NO: 2775716 - protein, 9 aa, Entamoeba invadens
SKTAGECTS

SEQ ID NO: 2775717 - protein, 17 aa, Entamoeba invadens
SKTATLTPLSSCTKGRI

SEQ ID NO: 2775718 - protein, 8 aa, Entamoeba invadens
SKTATSCD

SEQ ID NO: 2775719 - protein, 8 aa, Entamoeba invadens
SKTCEAGY

SEQ ID NO: 2775720 - protein, 6 aa, Entamoeba invadens
SKTCKL

SEQ ID NO: 2775721 - protein, 9 aa, Entamoeba invadens
SKTDPTTRQ

SEQ ID NO: 2775722 - protein, 8 aa, Entamoeba invadens
SKTDQSAL

SEQ ID NO: 2775723 - protein, 28 aa, Entamoeba invadens
SKTDVPTPNEPDKCNPISNCDETEGLQD

SEQ ID NO: 2775724 - protein, 7 aa, Entamoeba invadens
SKTEEVN

SEQ ID NO: 2775725 - protein, 6 aa, Entamoeba invadens
SKTEGC

SEQ ID NO: 2775726 - protein, 6 aa, Entamoeba invadens
SKTETL

SEQ ID NO: 2775727 - protein, 10 aa, Entamoeba invadens
SKTETTSDTD

SEQ ID NO: 2775728 - protein, 5 aa, Entamoeba invadens
SKTFG

SEQ ID NO: 2775729 - protein, 8 aa, Entamoeba invadens
SKTFKEQR

SEQ ID NO: 2775730 - protein, 4 aa, Entamoeba invadens
SKTI

SEQ ID NO: 2775731 - protein, 8 aa, Entamoeba invadens
SKTIDSTK

SEQ ID NO: 2775732 - protein, 7 aa, Entamoeba invadens
SKTIENW

SEQ ID NO: 2775733 - protein, 7 aa, Entamoeba invadens
SKTINSD

SEQ ID NO: 2775734 - protein, 11 aa, Entamoeba invadens
SKTIVSSENGT

SEQ ID NO: 2775735 - protein, 10 aa, Entamoeba invadens
SKTKSKKSPR

SEQ ID NO: 2775736 - protein, 6 aa, Entamoeba invadens
SKTKTL

SEQ ID NO: 2775737 - protein, 5 aa, Entamoeba invadens
SKTMK

SEQ ID NO: 2775738 - protein, 6 aa, Entamoeba invadens
SKTNEK

SEQ ID NO: 2775739 - protein, 5 aa, Entamoeba invadens
SKTNS

SEQ ID NO: 2775740 - protein, 8 aa, Entamoeba invadens
SKTNTENC

SEQ ID NO: 2775741 - protein, 5 aa, Entamoeba invadens
SKTNW

SEQ ID NO: 2775742 - protein, 7 aa, Entamoeba invadens
SKTPERI

SEQ ID NO: 2775743 - protein, 6 aa, Entamoeba invadens
SKTPIK

SEQ ID NO: 2775744 - protein, 17 aa, Entamoeba invadens
SKTPKNKTLSFKSGGIT

SEQ ID NO: 2775745 - protein, 14 aa, Entamoeba invadens
SKTPKNKTSFLKSG

SEQ ID NO: 2775746 - protein, 8 aa, Entamoeba invadens
SKTPRKPT

SEQ ID NO: 2775747 - protein, 32 aa, Entamoeba invadens
SKTPTELNDGLDPEVENQYYQGKSMTSDGTYV

SEQ ID NO: 2775748 - protein, 9 aa, Entamoeba invadens
SKTQKALEN

SEQ ID NO: 2775749 - protein, 7 aa, Entamoeba invadens
SKTQKSV

SEQ ID NO: 2775750 - protein, 17 aa, Entamoeba invadens
SKTQRTSEGKCEEQNNS

SEQ ID NO: 2775751 - protein, 4 aa, Entamoeba invadens
SKTR

SEQ ID NO: 2775752 - protein, 8 aa, Entamoeba invadens
SKTRATPY

SEQ ID NO: 2775753 - protein, 5 aa, Entamoeba invadens
SKTRL

SEQ ID NO: 2775754 - protein, 6 aa, Entamoeba invadens
SKTRSV

SEQ ID NO: 2775755 - protein, 4 aa, Entamoeba invadens
SKTS

SEQ ID NO: 2775756 - protein, 5 aa, Entamoeba invadens
SKTSF

SEQ ID NO: 2775757 - protein, 7 aa, Entamoeba invadens
SKTSGNC

SEQ ID NO: 2775758 - protein, 7 aa, Entamoeba invadens
SKTSKTC

SEQ ID NO: 2775759 - protein, 14 aa, Entamoeba invadens
SKTSNGERPAFSPN

SEQ ID NO: 2775760 - protein, 5 aa, Entamoeba invadens
SKTST

SEQ ID NO: 2775761 - protein, 6 aa, Entamoeba invadens
SKTTCE

SEQ ID NO: 2775762 - protein, 9 aa, Entamoeba invadens
SKTTGECTS

SEQ ID NO: 2775763 - protein, 8 aa, Entamoeba invadens
SKTTKSCY

SEQ ID NO: 2775764 - protein, 6 aa, Entamoeba invadens
SKTTLH

SEQ ID NO: 2775765 - protein, 10 aa, Entamoeba invadens
SKTTNCETCN

SEQ ID NO: 2775766 - protein, 9 aa, Entamoeba invadens
SKTTNCTQC

SEQ ID NO: 2775767 - protein, 24 aa, Entamoeba invadens
SKTTQKADKYITSADGQAESTIGN

SEQ ID NO: 2775768 - protein, 7 aa, Entamoeba invadens
SKTTREK

SEQ ID NO: 2775769 - protein, 9 aa, Entamoeba invadens
SKTTRKCNK

SEQ ID NO: 2775770 - protein, 17 aa, Entamoeba invadens
SKTVSSSFAVTSKSDFD

SEQ ID NO: 2775771 - protein, 6 aa, Entamoeba invadens
SKTVYE

SEQ ID NO: 2775772 - protein, 4 aa, Entamoeba invadens
SKVD

SEQ ID NO: 2775773 - protein, 8 aa, Entamoeba invadens
SKVDSSKV

SEQ ID NO: 2775774 - protein, 7 aa, Entamoeba invadens
SKVELRN

SEQ ID NO: 2775775 - protein, 8 aa, Entamoeba invadens
SKVKIDTQ

SEQ ID NO: 2775776 - protein, 11 aa, Entamoeba invadens
SKVSANAFDNV

SEQ ID NO: 2775777 - protein, 8 aa, Entamoeba invadens
SKVSDATY

SEQ ID NO: 2775778 - protein, 10 aa, Entamoeba invadens
SKVSKSRDES

SEQ ID NO: 2775779 - protein, 6 aa, Entamoeba invadens
SKVSTK

SEQ ID NO: 2775780 - protein, 7 aa, Entamoeba invadens
SKVSTLE

SEQ ID NO: 2775781 - protein, 12 aa, Entamoeba invadens
SKVSTLESEQEG

SEQ ID NO: 2775782 - protein, 9 aa, Entamoeba invadens
SKVSTQKDF

SEQ ID NO: 2775783 - protein, 13 aa, Entamoeba invadens
SKWNCNGTEITQG

SEQ ID NO: 2775784 - protein, 8 aa, Entamoeba invadens
SKYADYQS

SEQ ID NO: 2775785 - protein, 5 aa, Entamoeba invadens
SKYAN

SEQ ID NO: 2775786 - protein, 9 aa, Entamoeba invadens
SKYATSDFG

SEQ ID NO: 2775787 - protein, 7 aa, Entamoeba invadens
SKYDPET

SEQ ID NO: 2775788 - protein, 9 aa, Entamoeba invadens
SKYDSERCG

SEQ ID NO: 2775789 - protein, 6 aa, Entamoeba invadens
SKYDSV

SEQ ID NO: 2775790 - protein, 4 aa, Entamoeba invadens
SKYG

SEQ ID NO: 2775791 - protein, 7 aa, Entamoeba invadens
SKYGAEG

SEQ ID NO: 2775792 - protein, 5 aa, Entamoeba invadens
SKYHS

SEQ ID NO: 2775793 - protein, 9 aa, Entamoeba invadens
SKYKKPADV

SEQ ID NO: 2775794 - protein, 12 aa, Entamoeba invadens
SKYNDPDSYDSL

SEQ ID NO: 2775795 - protein, 16 aa, Entamoeba invadens
SKYNGRDGGWGSGSTA

SEQ ID NO: 2775796 - protein, 8 aa, Entamoeba invadens
SKYNNSVT

SEQ ID NO: 2775797 - protein, 13 aa, Entamoeba invadens
SKYPPSNQTEAHR

SEQ ID NO: 2775798 - protein, 15 aa, Entamoeba invadens
SKYPQNNNQVSDQSI

SEQ ID NO: 2775799 - protein, 6 aa, Entamoeba invadens
SKYQRK

SEQ ID NO: 2775800 - protein, 11 aa, Entamoeba invadens
SKYSEYPAGNH

SEQ ID NO: 2775801 - protein, 8 aa, Entamoeba invadens
SKYSRSDC

SEQ ID NO: 2775802 - protein, 8 aa, Entamoeba invadens
SKYSYDGD

SEQ ID NO: 2775803 - protein, 8 aa, Entamoeba invadens
SKYSYDGN

SEQ ID NO: 2775804 - protein, 7 aa, Entamoeba invadens
SKYVSSK

SEQ ID NO: 2775805 - protein, 8 aa, Entamoeba invadens
SLASTSSQ

SEQ ID NO: 2775806 - protein, 10 aa, Entamoeba invadens
SLATLSSGKA

SEQ ID NO: 2775807 - protein, 5 aa, Entamoeba invadens
SLCQP

SEQ ID NO: 2775808 - protein, 6 aa, Entamoeba invadens
SLCRNQ

SEQ ID NO: 2775809 - protein, 5 aa, Entamoeba invadens
SLCSN

SEQ ID NO: 2775810 - protein, 6 aa, Entamoeba invadens
SLDGKS

SEQ ID NO: 2775811 - protein, 5 aa, Entamoeba invadens
SLDGV

SEQ ID NO: 2775812 - protein, 16 aa, Entamoeba invadens
SLDITTNSSLTFSPKI

SEQ ID NO: 2775813 - protein, 8 aa, Entamoeba invadens
SLDKDMET

SEQ ID NO: 2775814 - protein, 15 aa, Entamoeba invadens
SLDKQTISVSKSATK

SEQ ID NO: 2775815 - protein, 7 aa, Entamoeba invadens
SLDNKSL

SEQ ID NO: 2775816 - protein, 11 aa, Entamoeba invadens
SLDPNSEETSR

SEQ ID NO: 2775817 - protein, 8 aa, Entamoeba invadens
SLDSNEVT

SEQ ID NO: 2775818 - protein, 8 aa, Entamoeba invadens
SLDSSTVS

SEQ ID NO: 2775819 - protein, 11 aa, Entamoeba invadens
SLDTSNPPTCS

SEQ ID NO: 2775820 - protein, 4 aa, Entamoeba invadens
SLEA

SEQ ID NO: 2775821 - protein, 5 aa, Entamoeba invadens
SLEAN

SEQ ID NO: 2775822 - protein, 11 aa, Entamoeba invadens
SLEDQEQAIEE

SEQ ID NO: 2775823 - protein, 7 aa, Entamoeba invadens
SLEEKYE

SEQ ID NO: 2775824 - protein, 9 aa, Entamoeba invadens
SLEETTEAT

SEQ ID NO: 2775825 - protein, 6 aa, Entamoeba invadens
SLEGQK

SEQ ID NO: 2775826 - protein, 10 aa, Entamoeba invadens
SLEGSDAKNQ

SEQ ID NO: 2775827 - protein, 10 aa, Entamoeba invadens
SLENEGTTIM

SEQ ID NO: 2775828 - protein, 7 aa, Entamoeba invadens
SLENKEV

SEQ ID NO: 2775829 - protein, 8 aa, Entamoeba invadens
SLENPRKG

SEQ ID NO: 2775830 - protein, 6 aa, Entamoeba invadens
SLENTY

SEQ ID NO: 2775831 - protein, 4 aa, Entamoeba invadens
SLEP

SEQ ID NO: 2775832 - protein, 10 aa, Entamoeba invadens
SLEQTSKEEY

SEQ ID NO: 2775833 - protein, 5 aa, Entamoeba invadens
SLESE

SEQ ID NO: 2775834 - protein, 6 aa, Entamoeba invadens
SLESGK

SEQ ID NO: 2775835 - protein, 7 aa, Entamoeba invadens
SLESQEM

SEQ ID NO: 2775836 - protein, 6 aa, Entamoeba invadens
SLETTI

SEQ ID NO: 2775837 - protein, 15 aa, Entamoeba invadens
SLEVQKKTSKNRQTA

SEQ ID NO: 2775838 - protein, 10 aa, Entamoeba invadens
SLFDTKSSTI

SEQ ID NO: 2775839 - protein, 5 aa, Entamoeba invadens
SLGGA

SEQ ID NO: 2775840 - protein, 5 aa, Entamoeba invadens
SLGGG

SEQ ID NO: 2775841 - protein, 18 aa, Entamoeba invadens
SLGGNTHDLTRDESNQWE

SEQ ID NO: 2775842 - protein, 10 aa, Entamoeba invadens
SLGGTNTCTD

SEQ ID NO: 2775843 - protein, 9 aa, Entamoeba invadens
SLGGTTQCQ

SEQ ID NO: 2775844 - protein, 6 aa, Entamoeba invadens
SLGPSG

SEQ ID NO: 2775845 - protein, 5 aa, Entamoeba invadens
SLGSA

SEQ ID NO: 2775846 - protein, 8 aa, Entamoeba invadens
SLGSDNTT

SEQ ID NO: 2775847 - protein, 6 aa, Entamoeba invadens
SLGSTD

SEQ ID NO: 2775848 - protein, 13 aa, Entamoeba invadens
SLGTSNEGESICS

SEQ ID NO: 2775849 - protein, 7 aa, Entamoeba invadens
SLHAKTC

SEQ ID NO: 2775850 - protein, 6 aa, Entamoeba invadens
SLHTEK

SEQ ID NO: 2775851 - protein, 4 aa, Entamoeba invadens
SLID

SEQ ID NO: 2775852 - protein, 8 aa, Entamoeba invadens
SLKEDTKD

SEQ ID NO: 2775853 - protein, 5 aa, Entamoeba invadens
SLKGM

SEQ ID NO: 2775854 - protein, 5 aa, Entamoeba invadens
SLKLG

SEQ ID NO: 2775855 - protein, 9 aa, Entamoeba invadens
SLKNGEDCD

SEQ ID NO: 2775856 - protein, 8 aa, Entamoeba invadens
SLKPARRN

SEQ ID NO: 2775857 - protein, 11 aa, Entamoeba invadens
SLKPSVGMSEG

SEQ ID NO: 2775858 - protein, 4 aa, Entamoeba invadens
SLKQ

SEQ ID NO: 2775859 - protein, 10 aa, Entamoeba invadens
SLKRNVTGKV

SEQ ID NO: 2775860 - protein, 6 aa, Entamoeba invadens
SLKSAT

SEQ ID NO: 2775861 - protein, 5 aa, Entamoeba invadens
SLKSD

SEQ ID NO: 2775862 - protein, 14 aa, Entamoeba invadens
SLKSVGDNAFYSTP

SEQ ID NO: 2775863 - protein, 4 aa, Entamoeba invadens
SLKT

SEQ ID NO: 2775864 - protein, 6 aa, Entamoeba invadens
SLKTPL

SEQ ID NO: 2775865 - protein, 11 aa, Entamoeba invadens
SLKTSEEKYNN

SEQ ID NO: 2775866 - protein, 12 aa, Entamoeba invadens
SLNATKEAVEEF

SEQ ID NO: 2775867 - protein, 6 aa, Entamoeba invadens
SLNEKK

SEQ ID NO: 2775868 - protein, 8 aa, Entamoeba invadens
SLNESGKK

SEQ ID NO: 2775869 - protein, 4 aa, Entamoeba invadens
SLNG

SEQ ID NO: 2775870 - protein, 21 aa, Entamoeba invadens
SLNHPQDINPSPKPDDNSTSQ

SEQ ID NO: 2775871 - protein, 12 aa, Entamoeba invadens
SLNNSKTDDQSI

SEQ ID NO: 2775872 - protein, 7 aa, Entamoeba invadens
SLNPKSL

SEQ ID NO: 2775873 - protein, 35 aa, Entamoeba invadens
SLNPLSDDSSSSFDFSESTNFANTSSSETPTTEKC

SEQ ID NO: 2775874 - protein, 8 aa, Entamoeba invadens
SLNQGYAA

SEQ ID NO: 2775875 - protein, 4 aa, Entamoeba invadens
SLNS

SEQ ID NO: 2775876 - protein, 6 aa, Entamoeba invadens
SLNSGD

SEQ ID NO: 2775877 - protein, 9 aa, Entamoeba invadens
SLNTPKDIE

SEQ ID NO: 2775878 - protein, 4 aa, Entamoeba invadens
SLNV

SEQ ID NO: 2775879 - protein, 11 aa, Entamoeba invadens
SLNYTSKSGVC

SEQ ID NO: 2775880 - protein, 22 aa, Entamoeba invadens
SLPDDKGRCLNRDDDDNSSAGL

SEQ ID NO: 2775881 - protein, 5 aa, Entamoeba invadens
SLPRC

SEQ ID NO: 2775882 - protein, 12 aa, Entamoeba invadens
SLPTDPNAKPGD

SEQ ID NO: 2775883 - protein, 9 aa, Entamoeba invadens
SLPTSPQTI

SEQ ID NO: 2775884 - protein, 7 aa, Entamoeba invadens
SLPVDSK

SEQ ID NO: 2775885 - protein, 8 aa, Entamoeba invadens
SLQATGNA

SEQ ID NO: 2775886 - protein, 15 aa, Entamoeba invadens
SLQDQSKITSLENWL

SEQ ID NO: 2775887 - protein, 8 aa, Entamoeba invadens
SLQDSEDI

SEQ ID NO: 2775888 - protein, 4 aa, Entamoeba invadens
SLQN

SEQ ID NO: 2775889 - protein, 12 aa, Entamoeba invadens
SLQNVREKTISE

SEQ ID NO: 2775890 - protein, 11 aa, Entamoeba invadens
SLQPPQSPQIN

SEQ ID NO: 2775891 - protein, 10 aa, Entamoeba invadens
SLQRPSEESC

SEQ ID NO: 2775892 - protein, 10 aa, Entamoeba invadens
SLQSNSNSSV

SEQ ID NO: 2775893 - protein, 8 aa, Entamoeba invadens
SLQSSCGG

SEQ ID NO: 2775894 - protein, 4 aa, Entamoeba invadens
SLQT

SEQ ID NO: 2775895 - protein, 12 aa, Entamoeba invadens
SLRGKQERARDS

SEQ ID NO: 2775896 - protein, 8 aa, Entamoeba invadens
SLSDPNEI

SEQ ID NO: 2775897 - protein, 5 aa, Entamoeba invadens
SLSDY

SEQ ID NO: 2775898 - protein, 4 aa, Entamoeba invadens
SLSG

SEQ ID NO: 2775899 - protein, 12 aa, Entamoeba invadens
SLSGNDPQSDQM

SEQ ID NO: 2775900 - protein, 9 aa, Entamoeba invadens
SLSGSQSVS

SEQ ID NO: 2775901 - protein, 7 aa, Entamoeba invadens
SLSNEKN

SEQ ID NO: 2775902 - protein, 12 aa, Entamoeba invadens
SLSNGPRGGNIP

SEQ ID NO: 2775903 - protein, 5 aa, Entamoeba invadens
SLSNL

SEQ ID NO: 2775904 - protein, 7 aa, Entamoeba invadens
SLSNPSK

SEQ ID NO: 2775905 - protein, 15 aa, Entamoeba invadens
SLSNSVSQNAFENSG

SEQ ID NO: 2775906 - protein, 9 aa, Entamoeba invadens
SLSPDEEAL

SEQ ID NO: 2775907 - protein, 8 aa, Entamoeba invadens
SLSPQANK

SEQ ID NO: 2775908 - protein, 9 aa, Entamoeba invadens
SLSQANTKS

SEQ ID NO: 2775909 - protein, 23 aa, Entamoeba invadens
SLSQEEAFGKSYKENIQRTTKYN

SEQ ID NO: 2775910 - protein, 7 aa, Entamoeba invadens
SLSQVST

SEQ ID NO: 2775911 - protein, 12 aa, Entamoeba invadens
SLSSDSTCTSVK

SEQ ID NO: 2775912 - protein, 10 aa, Entamoeba invadens
SLSSDSTDRY

SEQ ID NO: 2775913 - protein, 7 aa, Entamoeba invadens
SLSSPSQ

SEQ ID NO: 2775914 - protein, 11 aa, Entamoeba invadens
SLSSSRNCTTC

SEQ ID NO: 2775915 - protein, 15 aa, Entamoeba invadens
SLSSSTSPNTLSGKS

SEQ ID NO: 2775916 - protein, 4 aa, Entamoeba invadens
SLST

SEQ ID NO: 2775917 - protein, 16 aa, Entamoeba invadens
SLSTDEVNKLDKKSDA

SEQ ID NO: 2775918 - protein, 9 aa, Entamoeba invadens
SLTAEGGNL

SEQ ID NO: 2775919 - protein, 6 aa, Entamoeba invadens
SLTFDD

SEQ ID NO: 2775920 - protein, 7 aa, Entamoeba invadens
SLTFNDT

SEQ ID NO: 2775921 - protein, 7 aa, Entamoeba invadens
SLTFSDE

SEQ ID NO: 2775922 - protein, 8 aa, Entamoeba invadens
SLTGESLE

SEQ ID NO: 2775923 - protein, 8 aa, Entamoeba invadens
SLTGNGLD

SEQ ID NO: 2775924 - protein, 8 aa, Entamoeba invadens
SLTNSSQC

SEQ ID NO: 2775925 - protein, 7 aa, Entamoeba invadens
SLTPDSS

SEQ ID NO: 2775926 - protein, 6 aa, Entamoeba invadens
SLTPLK

SEQ ID NO: 2775927 - protein, 4 aa, Entamoeba invadens
SLTQ

SEQ ID NO: 2775928 - protein, 34 aa, Entamoeba invadens
SLTSAKSGDIKGPKYDDDQKDGDVELKDEELHQD

SEQ ID NO: 2775929 - protein, 11 aa, Entamoeba invadens
SLTSEGRPITQ

SEQ ID NO: 2775930 - protein, 9 aa, Entamoeba invadens
SLTSNSVST

SEQ ID NO: 2775931 - protein, 13 aa, Entamoeba invadens
SLTSTADYPQTTI

SEQ ID NO: 2775932 - protein, 7 aa, Entamoeba invadens
SLTSTKA

SEQ ID NO: 2775933 - protein, 9 aa, Entamoeba invadens
SLVNATSSF

SEQ ID NO: 2775934 - protein, 6 aa, Entamoeba invadens
SLVNGK

SEQ ID NO: 2775935 - protein, 4 aa, Entamoeba invadens
SLVQ

SEQ ID NO: 2775936 - protein, 5 aa, Entamoeba invadens
SLVSQ

SEQ ID NO: 2775937 - protein, 20 aa, Entamoeba invadens
SLVTSQSSEYYNGNAKTSYV

SEQ ID NO: 2775938 - protein, 10 aa, Entamoeba invadens
SLYPKQPTRL

SEQ ID NO: 2775939 - protein, 4 aa, Entamoeba invadens
SMAC

SEQ ID NO: 2775940 - protein, 7 aa, Entamoeba invadens
SMANESE

SEQ ID NO: 2775941 - protein, 6 aa, Entamoeba invadens
SMATET

SEQ ID NO: 2775942 - protein, 11 aa, Entamoeba invadens
SMEPSLAGTAL

SEQ ID NO: 2775943 - protein, 6 aa, Entamoeba invadens
SMGESK

SEQ ID NO: 2775944 - protein, 7 aa, Entamoeba invadens
SMGVSTD

SEQ ID NO: 2775945 - protein, 15 aa, Entamoeba invadens
SMKDKTKLSSLRETA

SEQ ID NO: 2775946 - protein, 8 aa, Entamoeba invadens
SMKPNTTT

SEQ ID NO: 2775947 - protein, 12 aa, Entamoeba invadens
SMKSGESEEKQE

SEQ ID NO: 2775948 - protein, 12 aa, Entamoeba invadens
SMKTDEKGVEMK

SEQ ID NO: 2775949 - protein, 6 aa, Entamoeba invadens
SMNDNG

SEQ ID NO: 2775950 - protein, 6 aa, Entamoeba invadens
SMNDSN

SEQ ID NO: 2775951 - protein, 10 aa, Entamoeba invadens
SMNEGIENAT

SEQ ID NO: 2775952 - protein, 12 aa, Entamoeba invadens
SMNESQKRSVQH

SEQ ID NO: 2775953 - protein, 5 aa, Entamoeba invadens
SMNGN

SEQ ID NO: 2775954 - protein, 11 aa, Entamoeba invadens
SMNRPSNDSRI

SEQ ID NO: 2775955 - protein, 6 aa, Entamoeba invadens
SMPYGQ

SEQ ID NO: 2775956 - protein, 8 aa, Entamoeba invadens
SMQPEVKN

SEQ ID NO: 2775957 - protein, 6 aa, Entamoeba invadens
SMREKG

SEQ ID NO: 2775958 - protein, 5 aa, Entamoeba invadens
SMSAK

SEQ ID NO: 2775959 - protein, 4 aa, Entamoeba invadens
SMSC

SEQ ID NO: 2775960 - protein, 4 aa, Entamoeba invadens
SMSG

SEQ ID NO: 2775961 - protein, 5 aa, Entamoeba invadens
SMSNA

SEQ ID NO: 2775962 - protein, 7 aa, Entamoeba invadens
SMSPQQP

SEQ ID NO: 2775963 - protein, 106 aa, Entamoeba invadens
SMSSSASMSSSASMSSSASMSSMSSESSESSESSSASMSSSASMSSESSSASKQDSSVSSEQSSTSKQDSSMSSEHSSTSKQDSSMSSEQSSTSMSKEPTHDSLSD

SEQ ID NO: 2775964 - protein, 6 aa, Entamoeba invadens
SMSSTH

SEQ ID NO: 2775965 - protein, 8 aa, Entamoeba invadens
SMSSTTDA

SEQ ID NO: 2775966 - protein, 4 aa, Entamoeba invadens
SMST

SEQ ID NO: 2775967 - protein, 11 aa, Entamoeba invadens
SMSTDSGECGG

SEQ ID NO: 2775968 - protein, 16 aa, Entamoeba invadens
SMSTSSQQTPEEDIPV

SEQ ID NO: 2775969 - protein, 19 aa, Entamoeba invadens
SMTSESSIFGENANERGGA

SEQ ID NO: 2775970 - protein, 7 aa, Entamoeba invadens
SNAAGTQ

SEQ ID NO: 2775971 - protein, 34 aa, Entamoeba invadens
SNAANETSSGSSNSSESVENVSEGNMCSEEKKCD

SEQ ID NO: 2775972 - protein, 6 aa, Entamoeba invadens
SNADIK

SEQ ID NO: 2775973 - protein, 6 aa, Entamoeba invadens
SNAEDT

SEQ ID NO: 2775974 - protein, 16 aa, Entamoeba invadens
SNAGVETGGDFKINEN

SEQ ID NO: 2775975 - protein, 17 aa, Entamoeba invadens
SNAGVETSGDFKISENS

SEQ ID NO: 2775976 - protein, 23 aa, Entamoeba invadens
SNAHNTTVKGELNDNCKRRTPKG

SEQ ID NO: 2775977 - protein, 4 aa, Entamoeba invadens
SNAK

SEQ ID NO: 2775978 - protein, 7 aa, Entamoeba invadens
SNAMKGL

SEQ ID NO: 2775979 - protein, 9 aa, Entamoeba invadens
SNANDCQEC

SEQ ID NO: 2775980 - protein, 6 aa, Entamoeba invadens
SNANEK

SEQ ID NO: 2775981 - protein, 5 aa, Entamoeba invadens
SNANI

SEQ ID NO: 2775982 - protein, 10 aa, Entamoeba invadens
SNANTKNNEE

SEQ ID NO: 2775983 - protein, 8 aa, Entamoeba invadens
SNAQLNPA

SEQ ID NO: 2775984 - protein, 9 aa, Entamoeba invadens
SNASPSANC

SEQ ID NO: 2775985 - protein, 8 aa, Entamoeba invadens
SNATDCQE

SEQ ID NO: 2775986 - protein, 7 aa, Entamoeba invadens
SNCEKCN

SEQ ID NO: 2775987 - protein, 10 aa, Entamoeba invadens
SNCEKCNPNS

SEQ ID NO: 2775988 - protein, 19 aa, Entamoeba invadens
SNCETCPGGTAKKCATCKT

SEQ ID NO: 2775989 - protein, 16 aa, Entamoeba invadens
SNCGKNQYEDQTHGNS

SEQ ID NO: 2775990 - protein, 9 aa, Entamoeba invadens
SNCISTTNN

SEQ ID NO: 2775991 - protein, 13 aa, Entamoeba invadens
SNCKEKCDRNTGK

SEQ ID NO: 2775992 - protein, 5 aa, Entamoeba invadens
SNCKN

SEQ ID NO: 2775993 - protein, 10 aa, Entamoeba invadens
SNCKNCSSDF

SEQ ID NO: 2775994 - protein, 6 aa, Entamoeba invadens
SNCKNN

SEQ ID NO: 2775995 - protein, 7 aa, Entamoeba invadens
SNCKTCD

SEQ ID NO: 2775996 - protein, 10 aa, Entamoeba invadens
SNCKTCKSDF

SEQ ID NO: 2775997 - protein, 10 aa, Entamoeba invadens
SNCKTCSSTF

SEQ ID NO: 2775998 - protein, 11 aa, Entamoeba invadens
SNCQNGTFKEQ

SEQ ID NO: 2775999 - protein, 17 aa, Entamoeba invadens
SNCQTCSKTTRKCNTCK

SEQ ID NO: 2776000 - protein, 11 aa, Entamoeba invadens
SNCSATCDGRR

SEQ ID NO: 2776001 - protein, 6 aa, Entamoeba invadens
SNCSEC

SEQ ID NO: 2776002 - protein, 8 aa, Entamoeba invadens
SNCSEWDT

SEQ ID NO: 2776003 - protein, 7 aa, Entamoeba invadens
SNCSLTN

SEQ ID NO: 2776004 - protein, 15 aa, Entamoeba invadens
SNCSRCNGVNENNCT

SEQ ID NO: 2776005 - protein, 4 aa, Entamoeba invadens
SNCT

SEQ ID NO: 2776006 - protein, 5 aa, Entamoeba invadens
SNCTQ

SEQ ID NO: 2776007 - protein, 5 aa, Entamoeba invadens
SNCTS

SEQ ID NO: 2776008 - protein, 5 aa, Entamoeba invadens
SNCTT

SEQ ID NO: 2776009 - protein, 19 aa, Entamoeba invadens
SNCTTWDDTGACSKCSENY

SEQ ID NO: 2776010 - protein, 9 aa, Entamoeba invadens
SNCVGSNSR

SEQ ID NO: 2776011 - protein, 6 aa, Entamoeba invadens
SNDEKE

SEQ ID NO: 2776012 - protein, 14 aa, Entamoeba invadens
SNDGSLIQRSIIYF

SEQ ID NO: 2776013 - protein, 5 aa, Entamoeba invadens
SNDGV

SEQ ID NO: 2776014 - protein, 6 aa, Entamoeba invadens
SNDGYN

SEQ ID NO: 2776015 - protein, 8 aa, Entamoeba invadens
SNDIQHPK

SEQ ID NO: 2776016 - protein, 9 aa, Entamoeba invadens
SNDKLTEKC

SEQ ID NO: 2776017 - protein, 18 aa, Entamoeba invadens
SNDKVNAKLTDFGSARNV

SEQ ID NO: 2776018 - protein, 18 aa, Entamoeba invadens
SNDNAIDKAKRNESENTN

SEQ ID NO: 2776019 - protein, 11 aa, Entamoeba invadens
SNDQNGRCTTA

SEQ ID NO: 2776020 - protein, 4 aa, Entamoeba invadens
SNDS

SEQ ID NO: 2776021 - protein, 7 aa, Entamoeba invadens
SNDSSCS

SEQ ID NO: 2776022 - protein, 6 aa, Entamoeba invadens
SNDTTL

SEQ ID NO: 2776023 - protein, 7 aa, Entamoeba invadens
SNDTVNA

SEQ ID NO: 2776024 - protein, 11 aa, Entamoeba invadens
SNDVDVNNYGS

SEQ ID NO: 2776025 - protein, 5 aa, Entamoeba invadens
SNDVT

SEQ ID NO: 2776026 - protein, 5 aa, Entamoeba invadens
SNDYQ

SEQ ID NO: 2776027 - protein, 12 aa, Entamoeba invadens
SNDYQEDNEFDD

SEQ ID NO: 2776028 - protein, 4 aa, Entamoeba invadens
SNEA

SEQ ID NO: 2776029 - protein, 10 aa, Entamoeba invadens
SNECEKCDNN

SEQ ID NO: 2776030 - protein, 8 aa, Entamoeba invadens
SNECKENS

SEQ ID NO: 2776031 - protein, 24 aa, Entamoeba invadens
SNECQKCDDSCKTCSLTSNRCTSC

SEQ ID NO: 2776032 - protein, 15 aa, Entamoeba invadens
SNEDNKEISVNEESR

SEQ ID NO: 2776033 - protein, 5 aa, Entamoeba invadens
SNEEE

SEQ ID NO: 2776034 - protein, 7 aa, Entamoeba invadens
SNEEEIK

SEQ ID NO: 2776035 - protein, 10 aa, Entamoeba invadens
SNEEKEKQKV

SEQ ID NO: 2776036 - protein, 8 aa, Entamoeba invadens
SNEETTMT

SEQ ID NO: 2776037 - protein, 5 aa, Entamoeba invadens
SNEGI

SEQ ID NO: 2776038 - protein, 9 aa, Entamoeba invadens
SNEGYYSLS

SEQ ID NO: 2776039 - protein, 16 aa, Entamoeba invadens
SNEKVNAKLTDFGSAR

SEQ ID NO: 2776040 - protein, 5 aa, Entamoeba invadens
SNELY

SEQ ID NO: 2776041 - protein, 8 aa, Entamoeba invadens
SNENHLNT

SEQ ID NO: 2776042 - protein, 5 aa, Entamoeba invadens
SNENK

SEQ ID NO: 2776043 - protein, 4 aa, Entamoeba invadens
SNEP

SEQ ID NO: 2776044 - protein, 6 aa, Entamoeba invadens
SNEQNS

SEQ ID NO: 2776045 - protein, 9 aa, Entamoeba invadens
SNEQSDLEI

SEQ ID NO: 2776046 - protein, 6 aa, Entamoeba invadens
SNERSL

SEQ ID NO: 2776047 - protein, 6 aa, Entamoeba invadens
SNESVE

SEQ ID NO: 2776048 - protein, 5 aa, Entamoeba invadens
SNESY

SEQ ID NO: 2776049 - protein, 4 aa, Entamoeba invadens
SNET

SEQ ID NO: 2776050 - protein, 13 aa, Entamoeba invadens
SNETGVEKNEGDA

SEQ ID NO: 2776051 - protein, 9 aa, Entamoeba invadens
SNETSKCEL

SEQ ID NO: 2776052 - protein, 5 aa, Entamoeba invadens
SNEVK

SEQ ID NO: 2776053 - protein, 10 aa, Entamoeba invadens
SNEYETTSIE

SEQ ID NO: 2776054 - protein, 5 aa, Entamoeba invadens
SNEYG

SEQ ID NO: 2776055 - protein, 11 aa, Entamoeba invadens
SNEYYDTTTKS

SEQ ID NO: 2776056 - protein, 7 aa, Entamoeba invadens
SNFANSY

SEQ ID NO: 2776057 - protein, 11 aa, Entamoeba invadens
SNFEVSSTYQS

SEQ ID NO: 2776058 - protein, 14 aa, Entamoeba invadens
SNFGDPLPPLGSGY

SEQ ID NO: 2776059 - protein, 6 aa, Entamoeba invadens
SNFGTT

SEQ ID NO: 2776060 - protein, 18 aa, Entamoeba invadens
SNFKNSDGISLKGATEYA

SEQ ID NO: 2776061 - protein, 5 aa, Entamoeba invadens
SNFNF

SEQ ID NO: 2776062 - protein, 7 aa, Entamoeba invadens
SNFNYDG

SEQ ID NO: 2776063 - protein, 6 aa, Entamoeba invadens
SNFRSN

SEQ ID NO: 2776064 - protein, 4 aa, Entamoeba invadens
SNFS

SEQ ID NO: 2776065 - protein, 5 aa, Entamoeba invadens
SNFSP

SEQ ID NO: 2776066 - protein, 24 aa, Entamoeba invadens
SNFSTFGTTTLDDKSQISITGNSK

SEQ ID NO: 2776067 - protein, 7 aa, Entamoeba invadens
SNFTEEN

SEQ ID NO: 2776068 - protein, 5 aa, Entamoeba invadens
SNFTS

SEQ ID NO: 2776069 - protein, 11 aa, Entamoeba invadens
SNFTSKGSISF

SEQ ID NO: 2776070 - protein, 4 aa, Entamoeba invadens
SNGC

SEQ ID NO: 2776071 - protein, 8 aa, Entamoeba invadens
SNGCKEGT

SEQ ID NO: 2776072 - protein, 21 aa, Entamoeba invadens
SNGCTSCAKGYGLNNKNCTKC

SEQ ID NO: 2776073 - protein, 8 aa, Entamoeba invadens
SNGEDEGV

SEQ ID NO: 2776074 - protein, 10 aa, Entamoeba invadens
SNGERSYNSK

SEQ ID NO: 2776075 - protein, 5 aa, Entamoeba invadens
SNGEY

SEQ ID NO: 2776076 - protein, 8 aa, Entamoeba invadens
SNGGASQC

SEQ ID NO: 2776077 - protein, 5 aa, Entamoeba invadens
SNGGC

SEQ ID NO: 2776078 - protein, 6 aa, Entamoeba invadens
SNGGQS

SEQ ID NO: 2776079 - protein, 10 aa, Entamoeba invadens
SNGKRPDDKC

SEQ ID NO: 2776080 - protein, 17 aa, Entamoeba invadens
SNGKRPDDKCLSDDEKS

SEQ ID NO: 2776081 - protein, 10 aa, Entamoeba invadens
SNGKTTPSDF

SEQ ID NO: 2776082 - protein, 5 aa, Entamoeba invadens
SNGLH

SEQ ID NO: 2776083 - protein, 11 aa, Entamoeba invadens
SNGNCANTTDC

SEQ ID NO: 2776084 - protein, 8 aa, Entamoeba invadens
SNGNCEQC

SEQ ID NO: 2776085 - protein, 13 aa, Entamoeba invadens
SNGNCQDNSPKGC

SEQ ID NO: 2776086 - protein, 8 aa, Entamoeba invadens
SNGNCTNI

SEQ ID NO: 2776087 - protein, 8 aa, Entamoeba invadens
SNGNEIPT

SEQ ID NO: 2776088 - protein, 7 aa, Entamoeba invadens
SNGNQTG

SEQ ID NO: 2776089 - protein, 9 aa, Entamoeba invadens
SNGNTCEKC

SEQ ID NO: 2776090 - protein, 11 aa, Entamoeba invadens
SNGQSTLSPAN

SEQ ID NO: 2776091 - protein, 6 aa, Entamoeba invadens
SNGRCL

SEQ ID NO: 2776092 - protein, 7 aa, Entamoeba invadens
SNGSNPN

SEQ ID NO: 2776093 - protein, 23 aa, Entamoeba invadens
SNGTCTQCDPSCANNRCDKKTGI

SEQ ID NO: 2776094 - protein, 14 aa, Entamoeba invadens
SNGTCTSKQGLDNC

SEQ ID NO: 2776095 - protein, 5 aa, Entamoeba invadens
SNGTV

SEQ ID NO: 2776096 - protein, 16 aa, Entamoeba invadens
SNGTYQDSTGQSTCKP

SEQ ID NO: 2776097 - protein, 4 aa, Entamoeba invadens
SNGV

SEQ ID NO: 2776098 - protein, 6 aa, Entamoeba invadens
SNGVLN

SEQ ID NO: 2776099 - protein, 8 aa, Entamoeba invadens
SNGVTETP

SEQ ID NO: 2776100 - protein, 8 aa, Entamoeba invadens
SNHENTVR

SEQ ID NO: 2776101 - protein, 5 aa, Entamoeba invadens
SNHPH

SEQ ID NO: 2776102 - protein, 5 aa, Entamoeba invadens
SNHQD

SEQ ID NO: 2776103 - protein, 25 aa, Entamoeba invadens
SNIDEETPNTENKMKPIGELPDEPI

SEQ ID NO: 2776104 - protein, 13 aa, Entamoeba invadens
SNIENDGAIEDER

SEQ ID NO: 2776105 - protein, 8 aa, Entamoeba invadens
SNIGESAF

SEQ ID NO: 2776106 - protein, 9 aa, Entamoeba invadens
SNIGTKTIS

SEQ ID NO: 2776107 - protein, 11 aa, Entamoeba invadens
SNIKRLETNQI

SEQ ID NO: 2776108 - protein, 5 aa, Entamoeba invadens
SNINK

SEQ ID NO: 2776109 - protein, 5 aa, Entamoeba invadens
SNINM

SEQ ID NO: 2776110 - protein, 10 aa, Entamoeba invadens
SNINRDGTET

SEQ ID NO: 2776111 - protein, 4 aa, Entamoeba invadens
SNIP

SEQ ID NO: 2776112 - protein, 25 aa, Entamoeba invadens
SNIPGSEKCTQCSDGYYSNTPSSIS

SEQ ID NO: 2776113 - protein, 25 aa, Entamoeba invadens
SNIPGSEKCTQCSDGYYSNTTSSIS

SEQ ID NO: 2776114 - protein, 5 aa, Entamoeba invadens
SNIPL

SEQ ID NO: 2776115 - protein, 9 aa, Entamoeba invadens
SNIPVNEES

SEQ ID NO: 2776116 - protein, 5 aa, Entamoeba invadens
SNIQM

SEQ ID NO: 2776117 - protein, 7 aa, Entamoeba invadens
SNIQSHY

SEQ ID NO: 2776118 - protein, 14 aa, Entamoeba invadens
SNISEKDDISSMER

SEQ ID NO: 2776119 - protein, 7 aa, Entamoeba invadens
SNISISS

SEQ ID NO: 2776120 - protein, 16 aa, Entamoeba invadens
SNISQLNSDNTHPNKV

SEQ ID NO: 2776121 - protein, 7 aa, Entamoeba invadens
SNKCGTC

SEQ ID NO: 2776122 - protein, 21 aa, Entamoeba invadens
SNKCKKCNDGHCNDCTDNNGV

SEQ ID NO: 2776123 - protein, 6 aa, Entamoeba invadens
SNKCTS

SEQ ID NO: 2776124 - protein, 6 aa, Entamoeba invadens
SNKDGE

SEQ ID NO: 2776125 - protein, 7 aa, Entamoeba invadens
SNKDLSK

SEQ ID NO: 2776126 - protein, 9 aa, Entamoeba invadens
SNKDTDQDY

SEQ ID NO: 2776127 - protein, 9 aa, Entamoeba invadens
SNKDVSCDS

SEQ ID NO: 2776128 - protein, 4 aa, Entamoeba invadens
SNKE

SEQ ID NO: 2776129 - protein, 9 aa, Entamoeba invadens
SNKEKKISI

SEQ ID NO: 2776130 - protein, 7 aa, Entamoeba invadens
SNKENQA

SEQ ID NO: 2776131 - protein, 8 aa, Entamoeba invadens
SNKENRAQ

SEQ ID NO: 2776132 - protein, 6 aa, Entamoeba invadens
SNKGQI

SEQ ID NO: 2776133 - protein, 5 aa, Entamoeba invadens
SNKHK

SEQ ID NO: 2776134 - protein, 5 aa, Entamoeba invadens
SNKIT

SEQ ID NO: 2776135 - protein, 6 aa, Entamoeba invadens
SNKITC

SEQ ID NO: 2776136 - protein, 4 aa, Entamoeba invadens
SNKL

SEQ ID NO: 2776137 - protein, 9 aa, Entamoeba invadens
SNKNALEQA

SEQ ID NO: 2776138 - protein, 21 aa, Entamoeba invadens
SNKNEISFGDESDKIQIETES

SEQ ID NO: 2776139 - protein, 8 aa, Entamoeba invadens
SNKNNQIE

SEQ ID NO: 2776140 - protein, 13 aa, Entamoeba invadens
SNKNPGAKTHTGH

SEQ ID NO: 2776141 - protein, 4 aa, Entamoeba invadens
SNKP

SEQ ID NO: 2776142 - protein, 4 aa, Entamoeba invadens
SNKQ

SEQ ID NO: 2776143 - protein, 6 aa, Entamoeba invadens
SNKQCS

SEQ ID NO: 2776144 - protein, 11 aa, Entamoeba invadens
SNKQDDRWNQR

SEQ ID NO: 2776145 - protein, 4 aa, Entamoeba invadens
SNKS

SEQ ID NO: 2776146 - protein, 21 aa, Entamoeba invadens
SNKSKLTFKDDSDAIPVGEET

SEQ ID NO: 2776147 - protein, 9 aa, Entamoeba invadens
SNKSSIKES

SEQ ID NO: 2776148 - protein, 17 aa, Entamoeba invadens
SNKSTDDFRTGENATVT

SEQ ID NO: 2776149 - protein, 4 aa, Entamoeba invadens
SNKT

SEQ ID NO: 2776150 - protein, 8 aa, Entamoeba invadens
SNKTCAKC

SEQ ID NO: 2776151 - protein, 8 aa, Entamoeba invadens
SNKTCENC

SEQ ID NO: 2776152 - protein, 9 aa, Entamoeba invadens
SNKTCSKCD

SEQ ID NO: 2776153 - protein, 8 aa, Entamoeba invadens
SNKTIESV

SEQ ID NO: 2776154 - protein, 9 aa, Entamoeba invadens
SNKTSENSK

SEQ ID NO: 2776155 - protein, 7 aa, Entamoeba invadens
SNKVGQA

SEQ ID NO: 2776156 - protein, 15 aa, Entamoeba invadens
SNKVNTRIEESAALA

SEQ ID NO: 2776157 - protein, 16 aa, Entamoeba invadens
SNKYENDLKSSFAQGK

SEQ ID NO: 2776158 - protein, 6 aa, Entamoeba invadens
SNLDSS

SEQ ID NO: 2776159 - protein, 18 aa, Entamoeba invadens
SNLKEDNSYDYESKDANL

SEQ ID NO: 2776160 - protein, 13 aa, Entamoeba invadens
SNLKNSQTDCTRD

SEQ ID NO: 2776161 - protein, 4 aa, Entamoeba invadens
SNLN

SEQ ID NO: 2776162 - protein, 5 aa, Entamoeba invadens
SNLNI

SEQ ID NO: 2776163 - protein, 8 aa, Entamoeba invadens
SNLPNSQV

SEQ ID NO: 2776164 - protein, 5 aa, Entamoeba invadens
SNLPP

SEQ ID NO: 2776165 - protein, 5 aa, Entamoeba invadens
SNLQM

SEQ ID NO: 2776166 - protein, 4 aa, Entamoeba invadens
SNLT

SEQ ID NO: 2776167 - protein, 4 aa, Entamoeba invadens
SNMA

SEQ ID NO: 2776168 - protein, 19 aa, Entamoeba invadens
SNMGPNSNFDGCETKCPEG

SEQ ID NO: 2776169 - protein, 5 aa, Entamoeba invadens
SNMPY

SEQ ID NO: 2776170 - protein, 35 aa, Entamoeba invadens
SNMSQGISVSTTGTVDTKESVVESKQLEDDIRKET

SEQ ID NO: 2776171 - protein, 5 aa, Entamoeba invadens
SNMYP

SEQ ID NO: 2776172 - protein, 28 aa, Entamoeba invadens
SNMYPDTSTGKCQTCDTSCGGSCDTTNK

SEQ ID NO: 2776173 - protein, 8 aa, Entamoeba invadens
SNNANRGD

SEQ ID NO: 2776174 - protein, 5 aa, Entamoeba invadens
SNNCE

SEQ ID NO: 2776175 - protein, 13 aa, Entamoeba invadens
SNNCTKNEKCKYQ

SEQ ID NO: 2776176 - protein, 5 aa, Entamoeba invadens
SNNEN

SEQ ID NO: 2776177 - protein, 6 aa, Entamoeba invadens
SNNETH

SEQ ID NO: 2776178 - protein, 6 aa, Entamoeba invadens
SNNEVP

SEQ ID NO: 2776179 - protein, 4 aa, Entamoeba invadens
SNNF

SEQ ID NO: 2776180 - protein, 6 aa, Entamoeba invadens
SNNFSR

SEQ ID NO: 2776181 - protein, 4 aa, Entamoeba invadens
SNNG

SEQ ID NO: 2776182 - protein, 8 aa, Entamoeba invadens
SNNGDDPI

SEQ ID NO: 2776183 - protein, 10 aa, Entamoeba invadens
SNNGMTQGVG

SEQ ID NO: 2776184 - protein, 5 aa, Entamoeba invadens
SNNGN

SEQ ID NO: 2776185 - protein, 9 aa, Entamoeba invadens
SNNKDLKTK

SEQ ID NO: 2776186 - protein, 8 aa, Entamoeba invadens
SNNKISSL

SEQ ID NO: 2776187 - protein, 11 aa, Entamoeba invadens
SNNKNKKKTQN

SEQ ID NO: 2776188 - protein, 5 aa, Entamoeba invadens
SNNKV

SEQ ID NO: 2776189 - protein, 10 aa, Entamoeba invadens
SNNNCANTTK

SEQ ID NO: 2776190 - protein, 7 aa, Entamoeba invadens
SNNNEKS

SEQ ID NO: 2776191 - protein, 9 aa, Entamoeba invadens
SNNNFNEVP

SEQ ID NO: 2776192 - protein, 9 aa, Entamoeba invadens
SNNNHLEND

SEQ ID NO: 2776193 - protein, 7 aa, Entamoeba invadens
SNNNKAL

SEQ ID NO: 2776194 - protein, 7 aa, Entamoeba invadens
SNNNSEM

SEQ ID NO: 2776195 - protein, 22 aa, Entamoeba invadens
SNNNVPQSPVTTSPVNSPTDFI

SEQ ID NO: 2776196 - protein, 18 aa, Entamoeba invadens
SNNPHDQTTAKISDFGTS

SEQ ID NO: 2776197 - protein, 8 aa, Entamoeba invadens
SNNPTKCD

SEQ ID NO: 2776198 - protein, 4 aa, Entamoeba invadens
SNNS

SEQ ID NO: 2776199 - protein, 9 aa, Entamoeba invadens
SNNSFRPNE

SEQ ID NO: 2776200 - protein, 9 aa, Entamoeba invadens
SNNSNGITT

SEQ ID NO: 2776201 - protein, 8 aa, Entamoeba invadens
SNNSQGKF

SEQ ID NO: 2776202 - protein, 6 aa, Entamoeba invadens
SNNSQI

SEQ ID NO: 2776203 - protein, 10 aa, Entamoeba invadens
SNNTETEKDN

SEQ ID NO: 2776204 - protein, 5 aa, Entamoeba invadens
SNNTF

SEQ ID NO: 2776205 - protein, 37 aa, Entamoeba invadens
SNNTTSKSSSTSSSDSKKDLNTTKNVNEEKENQEVPA

SEQ ID NO: 2776206 - protein, 7 aa, Entamoeba invadens
SNNTVKD

SEQ ID NO: 2776207 - protein, 8 aa, Entamoeba invadens
SNNVKNSM

SEQ ID NO: 2776208 - protein, 8 aa, Entamoeba invadens
SNNYKGET

SEQ ID NO: 2776209 - protein, 6 aa, Entamoeba invadens
SNPDWK

SEQ ID NO: 2776210 - protein, 4 aa, Entamoeba invadens
SNPF

SEQ ID NO: 2776211 - protein, 8 aa, Entamoeba invadens
SNPGLERE

SEQ ID NO: 2776212 - protein, 33 aa, Entamoeba invadens
SNPITITSSGNAIEFSSTNVKNTITVNGTGSLK

SEQ ID NO: 2776213 - protein, 5 aa, Entamoeba invadens
SNPKI

SEQ ID NO: 2776214 - protein, 5 aa, Entamoeba invadens
SNPKN

SEQ ID NO: 2776215 - protein, 8 aa, Entamoeba invadens
SNPKSKSC

SEQ ID NO: 2776216 - protein, 6 aa, Entamoeba invadens
SNPKVG

SEQ ID NO: 2776217 - protein, 5 aa, Entamoeba invadens
SNPLK

SEQ ID NO: 2776218 - protein, 16 aa, Entamoeba invadens
SNPLNITNSTIKSQND

SEQ ID NO: 2776219 - protein, 8 aa, Entamoeba invadens
SNPPSSSC

SEQ ID NO: 2776220 - protein, 6 aa, Entamoeba invadens
SNPSFI

SEQ ID NO: 2776221 - protein, 6 aa, Entamoeba invadens
SNPTFG

SEQ ID NO: 2776222 - protein, 6 aa, Entamoeba invadens
SNPTVS

SEQ ID NO: 2776223 - protein, 4 aa, Entamoeba invadens
SNQA

SEQ ID NO: 2776224 - protein, 5 aa, Entamoeba invadens
SNQAI

SEQ ID NO: 2776225 - protein, 14 aa, Entamoeba invadens
SNQCQKCDDNCNTC

SEQ ID NO: 2776226 - protein, 14 aa, Entamoeba invadens
SNQCVPDENCKTAK

SEQ ID NO: 2776227 - protein, 14 aa, Entamoeba invadens
SNQCVTDDNCQTTK

SEQ ID NO: 2776228 - protein, 13 aa, Entamoeba invadens
SNQCVTNENCQTA

SEQ ID NO: 2776229 - protein, 8 aa, Entamoeba invadens
SNQDVPQT

SEQ ID NO: 2776230 - protein, 5 aa, Entamoeba invadens
SNQEI

SEQ ID NO: 2776231 - protein, 4 aa, Entamoeba invadens
SNQL

SEQ ID NO: 2776232 - protein, 4 aa, Entamoeba invadens
SNQN

SEQ ID NO: 2776233 - protein, 6 aa, Entamoeba invadens
SNQRES

SEQ ID NO: 2776234 - protein, 12 aa, Entamoeba invadens
SNQSAPDDQKAA

SEQ ID NO: 2776235 - protein, 7 aa, Entamoeba invadens
SNQTTNM

SEQ ID NO: 2776236 - protein, 4 aa, Entamoeba invadens
SNRD

SEQ ID NO: 2776237 - protein, 5 aa, Entamoeba invadens
SNRDC

SEQ ID NO: 2776238 - protein, 13 aa, Entamoeba invadens
SNRDGCESCDGTK

SEQ ID NO: 2776239 - protein, 10 aa, Entamoeba invadens
SNRGDAENEV

SEQ ID NO: 2776240 - protein, 10 aa, Entamoeba invadens
SNRGRRGVVN

SEQ ID NO: 2776241 - protein, 5 aa, Entamoeba invadens
SNRGT

SEQ ID NO: 2776242 - protein, 10 aa, Entamoeba invadens
SNRIQGANSN

SEQ ID NO: 2776243 - protein, 4 aa, Entamoeba invadens
SNRN

SEQ ID NO: 2776244 - protein, 28 aa, Entamoeba invadens
SNRTQYKLEEGATLSVGKQQKVEGTNGS

SEQ ID NO: 2776245 - protein, 11 aa, Entamoeba invadens
SNSAKAEDNLS

SEQ ID NO: 2776246 - protein, 8 aa, Entamoeba invadens
SNSASSGF

SEQ ID NO: 2776247 - protein, 9 aa, Entamoeba invadens
SNSCSQCSE

SEQ ID NO: 2776248 - protein, 25 aa, Entamoeba invadens
SNSCTKCKNGCSTCSDATKCTACTP

SEQ ID NO: 2776249 - protein, 7 aa, Entamoeba invadens
SNSCTPC

SEQ ID NO: 2776250 - protein, 7 aa, Entamoeba invadens
SNSCTSC

SEQ ID NO: 2776251 - protein, 12 aa, Entamoeba invadens
SNSDESAERSVG

SEQ ID NO: 2776252 - protein, 8 aa, Entamoeba invadens
SNSEEQQN

SEQ ID NO: 2776253 - protein, 8 aa, Entamoeba invadens
SNSEYGEC

SEQ ID NO: 2776254 - protein, 4 aa, Entamoeba invadens
SNSF

SEQ ID NO: 2776255 - protein, 18 aa, Entamoeba invadens
SNSGTLKFSEPTSSNEEE

SEQ ID NO: 2776256 - protein, 5 aa, Entamoeba invadens
SNSHT

SEQ ID NO: 2776257 - protein, 12 aa, Entamoeba invadens
SNSISNCEECSN

SEQ ID NO: 2776258 - protein, 6 aa, Entamoeba invadens
SNSKCG

SEQ ID NO: 2776259 - protein, 8 aa, Entamoeba invadens
SNSKGIDI

SEQ ID NO: 2776260 - protein, 6 aa, Entamoeba invadens
SNSKIY

SEQ ID NO: 2776261 - protein, 10 aa, Entamoeba invadens
SNSKRDEKYG

SEQ ID NO: 2776262 - protein, 13 aa, Entamoeba invadens
SNSKSTSNSTSPI

SEQ ID NO: 2776263 - protein, 7 aa, Entamoeba invadens
SNSKTTQ

SEQ ID NO: 2776264 - protein, 6 aa, Entamoeba invadens
SNSKVC

SEQ ID NO: 2776265 - protein, 7 aa, Entamoeba invadens
SNSKVSK

SEQ ID NO: 2776266 - protein, 5 aa, Entamoeba invadens
SNSLK

SEQ ID NO: 2776267 - protein, 5 aa, Entamoeba invadens
SNSLT

SEQ ID NO: 2776268 - protein, 5 aa, Entamoeba invadens
SNSMD

SEQ ID NO: 2776269 - protein, 6 aa, Entamoeba invadens
SNSNKC

SEQ ID NO: 2776270 - protein, 6 aa, Entamoeba invadens
SNSNTG

SEQ ID NO: 2776271 - protein, 9 aa, Entamoeba invadens
SNSNYSVNG

SEQ ID NO: 2776272 - protein, 6 aa, Entamoeba invadens
SNSPFR

SEQ ID NO: 2776273 - protein, 7 aa, Entamoeba invadens
SNSPGGF

SEQ ID NO: 2776274 - protein, 6 aa, Entamoeba invadens
SNSPKY

SEQ ID NO: 2776275 - protein, 6 aa, Entamoeba invadens
SNSQEV

SEQ ID NO: 2776276 - protein, 9 aa, Entamoeba invadens
SNSQGKTIQ

SEQ ID NO: 2776277 - protein, 16 aa, Entamoeba invadens
SNSSEITTQKSDDGEI

SEQ ID NO: 2776278 - protein, 15 aa, Entamoeba invadens
SNSSEITTQKVDQGE

SEQ ID NO: 2776279 - protein, 14 aa, Entamoeba invadens
SNSSINSTIQTTSN

SEQ ID NO: 2776280 - protein, 7 aa, Entamoeba invadens
SNSSPNS

SEQ ID NO: 2776281 - protein, 13 aa, Entamoeba invadens
SNSSRRGTDEDVR

SEQ ID NO: 2776282 - protein, 8 aa, Entamoeba invadens
SNSSTGYM

SEQ ID NO: 2776283 - protein, 4 aa, Entamoeba invadens
SNST

SEQ ID NO: 2776284 - protein, 9 aa, Entamoeba invadens
SNSTCKNCS

SEQ ID NO: 2776285 - protein, 6 aa, Entamoeba invadens
SNSTLC

SEQ ID NO: 2776286 - protein, 13 aa, Entamoeba invadens
SNSTNNNICGPTT

SEQ ID NO: 2776287 - protein, 8 aa, Entamoeba invadens
SNSTNSTC

SEQ ID NO: 2776288 - protein, 7 aa, Entamoeba invadens
SNSVFSE

SEQ ID NO: 2776289 - protein, 6 aa, Entamoeba invadens
SNSYGR

SEQ ID NO: 2776290 - protein, 10 aa, Entamoeba invadens
SNSYNNKGKC

SEQ ID NO: 2776291 - protein, 14 aa, Entamoeba invadens
SNTCAAESNENVGE

SEQ ID NO: 2776292 - protein, 8 aa, Entamoeba invadens
SNTCNKCS

SEQ ID NO: 2776293 - protein, 10 aa, Entamoeba invadens
SNTCSKCETP

SEQ ID NO: 2776294 - protein, 4 aa, Entamoeba invadens
SNTD

SEQ ID NO: 2776295 - protein, 5 aa, Entamoeba invadens
SNTDE

SEQ ID NO: 2776296 - protein, 6 aa, Entamoeba invadens
SNTDVG

SEQ ID NO: 2776297 - protein, 6 aa, Entamoeba invadens
SNTEAK

SEQ ID NO: 2776298 - protein, 6 aa, Entamoeba invadens
SNTEDT

SEQ ID NO: 2776299 - protein, 8 aa, Entamoeba invadens
SNTEINSN

SEQ ID NO: 2776300 - protein, 10 aa, Entamoeba invadens
SNTEMTKDYQ

SEQ ID NO: 2776301 - protein, 6 aa, Entamoeba invadens
SNTFYS

SEQ ID NO: 2776302 - protein, 12 aa, Entamoeba invadens
SNTGGQVDYPPI

SEQ ID NO: 2776303 - protein, 7 aa, Entamoeba invadens
SNTGTPI

SEQ ID NO: 2776304 - protein, 5 aa, Entamoeba invadens
SNTHT

SEQ ID NO: 2776305 - protein, 19 aa, Entamoeba invadens
SNTIGSTGICNNNDRNNEC

SEQ ID NO: 2776306 - protein, 15 aa, Entamoeba invadens
SNTINSNNLKNGNEY

SEQ ID NO: 2776307 - protein, 9 aa, Entamoeba invadens
SNTKFGGSY

SEQ ID NO: 2776308 - protein, 19 aa, Entamoeba invadens
SNTKLSHSDIKNAQQITTP

SEQ ID NO: 2776309 - protein, 9 aa, Entamoeba invadens
SNTKQNLNQ

SEQ ID NO: 2776310 - protein, 10 aa, Entamoeba invadens
SNTKSGKTSL

SEQ ID NO: 2776311 - protein, 5 aa, Entamoeba invadens
SNTLN

SEQ ID NO: 2776312 - protein, 6 aa, Entamoeba invadens
SNTLPL

SEQ ID NO: 2776313 - protein, 11 aa, Entamoeba invadens
SNTLTSPKAFS

SEQ ID NO: 2776314 - protein, 10 aa, Entamoeba invadens
SNTMRSGDST

SEQ ID NO: 2776315 - protein, 6 aa, Entamoeba invadens
SNTMYP

SEQ ID NO: 2776316 - protein, 14 aa, Entamoeba invadens
SNTNCRTSQYSNAN

SEQ ID NO: 2776317 - protein, 16 aa, Entamoeba invadens
SNTPQISFEGKQKEKN

SEQ ID NO: 2776318 - protein, 29 aa, Entamoeba invadens
SNTPSYTTHAGETPLNGKEYTLKGYDNAR

SEQ ID NO: 2776319 - protein, 4 aa, Entamoeba invadens
SNTQ

SEQ ID NO: 2776320 - protein, 5 aa, Entamoeba invadens
SNTRT

SEQ ID NO: 2776321 - protein, 6 aa, Entamoeba invadens
SNTSSA

SEQ ID NO: 2776322 - protein, 4 aa, Entamoeba invadens
SNTT

SEQ ID NO: 2776323 - protein, 10 aa, Entamoeba invadens
SNTTDSKFKE

SEQ ID NO: 2776324 - protein, 16 aa, Entamoeba invadens
SNTTGKCSACASGYKL

SEQ ID NO: 2776325 - protein, 6 aa, Entamoeba invadens
SNTTGL

SEQ ID NO: 2776326 - protein, 8 aa, Entamoeba invadens
SNTTNTEI

SEQ ID NO: 2776327 - protein, 7 aa, Entamoeba invadens
SNTTTHK

SEQ ID NO: 2776328 - protein, 5 aa, Entamoeba invadens
SNTTY

SEQ ID NO: 2776329 - protein, 4 aa, Entamoeba invadens
SNTV

SEQ ID NO: 2776330 - protein, 14 aa, Entamoeba invadens
SNTVSFSSSNNNYQ

SEQ ID NO: 2776331 - protein, 6 aa, Entamoeba invadens
SNTYYN

SEQ ID NO: 2776332 - protein, 5 aa, Entamoeba invadens
SNVDK

SEQ ID NO: 2776333 - protein, 15 aa, Entamoeba invadens
SNVEMTSSKSVTSCS

SEQ ID NO: 2776334 - protein, 6 aa, Entamoeba invadens
SNVGAL

SEQ ID NO: 2776335 - protein, 4 aa, Entamoeba invadens
SNVI

SEQ ID NO: 2776336 - protein, 7 aa, Entamoeba invadens
SNVIPNT

SEQ ID NO: 2776337 - protein, 4 aa, Entamoeba invadens
SNVN

SEQ ID NO: 2776338 - protein, 11 aa, Entamoeba invadens
SNVNNKNENNM

SEQ ID NO: 2776339 - protein, 8 aa, Entamoeba invadens
SNVNNLNG

SEQ ID NO: 2776340 - protein, 6 aa, Entamoeba invadens
SNVNTI

SEQ ID NO: 2776341 - protein, 6 aa, Entamoeba invadens
SNVPMQ

SEQ ID NO: 2776342 - protein, 6 aa, Entamoeba invadens
SNVPNV

SEQ ID NO: 2776343 - protein, 5 aa, Entamoeba invadens
SNVRG

SEQ ID NO: 2776344 - protein, 7 aa, Entamoeba invadens
SNVSGSE

SEQ ID NO: 2776345 - protein, 6 aa, Entamoeba invadens
SNVTMD

SEQ ID NO: 2776346 - protein, 6 aa, Entamoeba invadens
SNVTSS

SEQ ID NO: 2776347 - protein, 7 aa, Entamoeba invadens
SNVTTKT

SEQ ID NO: 2776348 - protein, 4 aa, Entamoeba invadens
SNVV

SEQ ID NO: 2776349 - protein, 10 aa, Entamoeba invadens
SNYAKKSGKR

SEQ ID NO: 2776350 - protein, 8 aa, Entamoeba invadens
SNYDDDNS

SEQ ID NO: 2776351 - protein, 11 aa, Entamoeba invadens
SNYDENRKQCT

SEQ ID NO: 2776352 - protein, 8 aa, Entamoeba invadens
SNYDTNDL

SEQ ID NO: 2776353 - protein, 7 aa, Entamoeba invadens
SNYENVN

SEQ ID NO: 2776354 - protein, 21 aa, Entamoeba invadens
SNYERKCTTCNTGYYPNADGK

SEQ ID NO: 2776355 - protein, 8 aa, Entamoeba invadens
SNYESSAR

SEQ ID NO: 2776356 - protein, 13 aa, Entamoeba invadens
SNYGAASDNHATC

SEQ ID NO: 2776357 - protein, 10 aa, Entamoeba invadens
SNYKQTSSCT

SEQ ID NO: 2776358 - protein, 15 aa, Entamoeba invadens
SNYKSEEGNVGDINN

SEQ ID NO: 2776359 - protein, 4 aa, Entamoeba invadens
SNYL

SEQ ID NO: 2776360 - protein, 4 aa, Entamoeba invadens
SNYN

SEQ ID NO: 2776361 - protein, 6 aa, Entamoeba invadens
SNYNTQ

SEQ ID NO: 2776362 - protein, 12 aa, Entamoeba invadens
SNYQIDTGECVS

SEQ ID NO: 2776363 - protein, 5 aa, Entamoeba invadens
SNYSG

SEQ ID NO: 2776364 - protein, 8 aa, Entamoeba invadens
SNYSTDDM

SEQ ID NO: 2776365 - protein, 11 aa, Entamoeba invadens
SNYTTSGEAYF

SEQ ID NO: 2776366 - protein, 12 aa, Entamoeba invadens
SNYTTSGEAYFN

SEQ ID NO: 2776367 - protein, 11 aa, Entamoeba invadens
SNYVKENLSNN

SEQ ID NO: 2776368 - protein, 7 aa, Entamoeba invadens
SNYYPNS

SEQ ID NO: 2776369 - protein, 11 aa, Entamoeba invadens
SPAAGGSGVSE

SEQ ID NO: 2776370 - protein, 6 aa, Entamoeba invadens
SPAIPP

SEQ ID NO: 2776371 - protein, 12 aa, Entamoeba invadens
SPANKCDTCPTN

SEQ ID NO: 2776372 - protein, 4 aa, Entamoeba invadens
SPAV

SEQ ID NO: 2776373 - protein, 7 aa, Entamoeba invadens
SPAVSKK

SEQ ID NO: 2776374 - protein, 8 aa, Entamoeba invadens
SPCDEEYN

SEQ ID NO: 2776375 - protein, 9 aa, Entamoeba invadens
SPCEKKTGN

SEQ ID NO: 2776376 - protein, 10 aa, Entamoeba invadens
SPCEKKTGNC

SEQ ID NO: 2776377 - protein, 6 aa, Entamoeba invadens
SPCETP

SEQ ID NO: 2776378 - protein, 13 aa, Entamoeba invadens
SPDCTTTNEHGCT

SEQ ID NO: 2776379 - protein, 6 aa, Entamoeba invadens
SPDEEA

SEQ ID NO: 2776380 - protein, 9 aa, Entamoeba invadens
SPDEKGTFC

SEQ ID NO: 2776381 - protein, 4 aa, Entamoeba invadens
SPDF

SEQ ID NO: 2776382 - protein, 5 aa, Entamoeba invadens
SPDGF

SEQ ID NO: 2776383 - protein, 8 aa, Entamoeba invadens
SPDGTEGN

SEQ ID NO: 2776384 - protein, 5 aa, Entamoeba invadens
SPDPL

SEQ ID NO: 2776385 - protein, 5 aa, Entamoeba invadens
SPDVC

SEQ ID NO: 2776386 - protein, 4 aa, Entamoeba invadens
SPDY

SEQ ID NO: 2776387 - protein, 14 aa, Entamoeba invadens
SPDYSEVAYSTSQW

SEQ ID NO: 2776388 - protein, 18 aa, Entamoeba invadens
SPEDKAEAMKENEAIDRN

SEQ ID NO: 2776389 - protein, 7 aa, Entamoeba invadens
SPEELSN

SEQ ID NO: 2776390 - protein, 6 aa, Entamoeba invadens
SPEEQV

SEQ ID NO: 2776391 - protein, 7 aa, Entamoeba invadens
SPEERYS

SEQ ID NO: 2776392 - protein, 4 aa, Entamoeba invadens
SPEF

SEQ ID NO: 2776393 - protein, 6 aa, Entamoeba invadens
SPEKPE

SEQ ID NO: 2776394 - protein, 11 aa, Entamoeba invadens
SPEKQTGSSQL

SEQ ID NO: 2776395 - protein, 10 aa, Entamoeba invadens
SPEKYPDSES

SEQ ID NO: 2776396 - protein, 5 aa, Entamoeba invadens
SPENC

SEQ ID NO: 2776397 - protein, 7 aa, Entamoeba invadens
SPENTQV

SEQ ID NO: 2776398 - protein, 5 aa, Entamoeba invadens
SPEQI

SEQ ID NO: 2776399 - protein, 7 aa, Entamoeba invadens
SPESPVD

SEQ ID NO: 2776400 - protein, 7 aa, Entamoeba invadens
SPESRGY

SEQ ID NO: 2776401 - protein, 10 aa, Entamoeba invadens
SPETRPTTKT

SEQ ID NO: 2776402 - protein, 4 aa, Entamoeba invadens
SPEV

SEQ ID NO: 2776403 - protein, 6 aa, Entamoeba invadens
SPEVEK

SEQ ID NO: 2776404 - protein, 6 aa, Entamoeba invadens
SPEYTQ

SEQ ID NO: 2776405 - protein, 5 aa, Entamoeba invadens
SPFDD

SEQ ID NO: 2776406 - protein, 13 aa, Entamoeba invadens
SPFFGEKTGECEV

SEQ ID NO: 2776407 - protein, 9 aa, Entamoeba invadens
SPFPDDTEN

SEQ ID NO: 2776408 - protein, 20 aa, Entamoeba invadens
SPFRSHSTQNVPQSPDITKG

SEQ ID NO: 2776409 - protein, 4 aa, Entamoeba invadens
SPFS

SEQ ID NO: 2776410 - protein, 6 aa, Entamoeba invadens
SPGCSS

SEQ ID NO: 2776411 - protein, 13 aa, Entamoeba invadens
SPGGLRQSNSSIT

SEQ ID NO: 2776412 - protein, 6 aa, Entamoeba invadens
SPGGVY

SEQ ID NO: 2776413 - protein, 10 aa, Entamoeba invadens
SPGKCSNTTG

SEQ ID NO: 2776414 - protein, 4 aa, Entamoeba invadens
SPGN

SEQ ID NO: 2776415 - protein, 7 aa, Entamoeba invadens
SPGNPPL

SEQ ID NO: 2776416 - protein, 14 aa, Entamoeba invadens
SPGTFSNSATNGSC

SEQ ID NO: 2776417 - protein, 21 aa, Entamoeba invadens
SPHCDKNSPKCAPEKKESQFG

SEQ ID NO: 2776418 - protein, 5 aa, Entamoeba invadens
SPHKT

SEQ ID NO: 2776419 - protein, 27 aa, Entamoeba invadens
SPHPEKVHSPAARTDSTRTSVELSRTS

SEQ ID NO: 2776420 - protein, 6 aa, Entamoeba invadens
SPHPNI

SEQ ID NO: 2776421 - protein, 8 aa, Entamoeba invadens
SPHSDTEV

SEQ ID NO: 2776422 - protein, 6 aa, Entamoeba invadens
SPIATS

SEQ ID NO: 2776423 - protein, 4 aa, Entamoeba invadens
SPID

SEQ ID NO: 2776424 - protein, 8 aa, Entamoeba invadens
SPIDEKID

SEQ ID NO: 2776425 - protein, 4 aa, Entamoeba invadens
SPIE

SEQ ID NO: 2776426 - protein, 5 aa, Entamoeba invadens
SPINT

SEQ ID NO: 2776427 - protein, 11 aa, Entamoeba invadens
SPIPSQQDFST

SEQ ID NO: 2776428 - protein, 13 aa, Entamoeba invadens
SPIPTRVSTTLSQ

SEQ ID NO: 2776429 - protein, 4 aa, Entamoeba invadens
SPIT

SEQ ID NO: 2776430 - protein, 6 aa, Entamoeba invadens
SPITNN

SEQ ID NO: 2776431 - protein, 5 aa, Entamoeba invadens
SPIYS

SEQ ID NO: 2776432 - protein, 8 aa, Entamoeba invadens
SPKCDTSV

SEQ ID NO: 2776433 - protein, 9 aa, Entamoeba invadens
SPKDPHKLS

SEQ ID NO: 2776434 - protein, 7 aa, Entamoeba invadens
SPKGDDP

SEQ ID NO: 2776435 - protein, 12 aa, Entamoeba invadens
SPKGEGNKKSIA

SEQ ID NO: 2776436 - protein, 5 aa, Entamoeba invadens
SPKKQ

SEQ ID NO: 2776437 - protein, 4 aa, Entamoeba invadens
SPKS

SEQ ID NO: 2776438 - protein, 4 aa, Entamoeba invadens
SPKT

SEQ ID NO: 2776439 - protein, 7 aa, Entamoeba invadens
SPKTAKN

SEQ ID NO: 2776440 - protein, 8 aa, Entamoeba invadens
SPKTGKLA

SEQ ID NO: 2776441 - protein, 7 aa, Entamoeba invadens
SPKTHGD

SEQ ID NO: 2776442 - protein, 4 aa, Entamoeba invadens
SPKV

SEQ ID NO: 2776443 - protein, 9 aa, Entamoeba invadens
SPKVPNSGL

SEQ ID NO: 2776444 - protein, 8 aa, Entamoeba invadens
SPKYGGDD

SEQ ID NO: 2776445 - protein, 9 aa, Entamoeba invadens
SPKYSDKQV

SEQ ID NO: 2776446 - protein, 4 aa, Entamoeba invadens
SPLD

SEQ ID NO: 2776447 - protein, 21 aa, Entamoeba invadens
SPLENAEQNQSQRTSAGQQIG

SEQ ID NO: 2776448 - protein, 10 aa, Entamoeba invadens
SPLGYENRNT

SEQ ID NO: 2776449 - protein, 6 aa, Entamoeba invadens
SPLNPK

SEQ ID NO: 2776450 - protein, 5 aa, Entamoeba invadens
SPLNS

SEQ ID NO: 2776451 - protein, 20 aa, Entamoeba invadens
SPLPQEESKVEKQEEKRDIV

SEQ ID NO: 2776452 - protein, 20 aa, Entamoeba invadens
SPLPRSRSRSYSRNNSVKNK

SEQ ID NO: 2776453 - protein, 6 aa, Entamoeba invadens
SPLPTP

SEQ ID NO: 2776454 - protein, 5 aa, Entamoeba invadens
SPLQQ

SEQ ID NO: 2776455 - protein, 7 aa, Entamoeba invadens
SPLSQDL

SEQ ID NO: 2776456 - protein, 7 aa, Entamoeba invadens
SPLSQKC

SEQ ID NO: 2776457 - protein, 7 aa, Entamoeba invadens
SPLSSDL

SEQ ID NO: 2776458 - protein, 8 aa, Entamoeba invadens
SPLSSSKI

SEQ ID NO: 2776459 - protein, 4 aa, Entamoeba invadens
SPMK

SEQ ID NO: 2776460 - protein, 9 aa, Entamoeba invadens
SPNAEGTLC

SEQ ID NO: 2776461 - protein, 9 aa, Entamoeba invadens
SPNAINDKG

SEQ ID NO: 2776462 - protein, 13 aa, Entamoeba invadens
SPNCKQTIPNAND

SEQ ID NO: 2776463 - protein, 7 aa, Entamoeba invadens
SPNDTYV

SEQ ID NO: 2776464 - protein, 7 aa, Entamoeba invadens
SPNGSFS

SEQ ID NO: 2776465 - protein, 16 aa, Entamoeba invadens
SPNHKVEQSTEIEMDE

SEQ ID NO: 2776466 - protein, 8 aa, Entamoeba invadens
SPNIEGKY

SEQ ID NO: 2776467 - protein, 4 aa, Entamoeba invadens
SPNK

SEQ ID NO: 2776468 - protein, 8 aa, Entamoeba invadens
SPNKDGVY

SEQ ID NO: 2776469 - protein, 13 aa, Entamoeba invadens
SPNKNGEVCDSQP

SEQ ID NO: 2776470 - protein, 8 aa, Entamoeba invadens
SPNLEGKC

SEQ ID NO: 2776471 - protein, 11 aa, Entamoeba invadens
SPNNSSHKTFN

SEQ ID NO: 2776472 - protein, 5 aa, Entamoeba invadens
SPNPH

SEQ ID NO: 2776473 - protein, 12 aa, Entamoeba invadens
SPNQQTSPSSID

SEQ ID NO: 2776474 - protein, 12 aa, Entamoeba invadens
SPNSSVDKGPCF

SEQ ID NO: 2776475 - protein, 8 aa, Entamoeba invadens
SPNSSYVN

SEQ ID NO: 2776476 - protein, 8 aa, Entamoeba invadens
SPNTDGTL

SEQ ID NO: 2776477 - protein, 9 aa, Entamoeba invadens
SPNYENDGS

SEQ ID NO: 2776478 - protein, 5 aa, Entamoeba invadens
SPPAT

SEQ ID NO: 2776479 - protein, 7 aa, Entamoeba invadens
SPPDDTF

SEQ ID NO: 2776480 - protein, 6 aa, Entamoeba invadens
SPPGTS

SEQ ID NO: 2776481 - protein, 14 aa, Entamoeba invadens
SPPKSIVRKGGNMN

SEQ ID NO: 2776482 - protein, 9 aa, Entamoeba invadens
SPPKSSEDI

SEQ ID NO: 2776483 - protein, 9 aa, Entamoeba invadens
SPPLGPING

SEQ ID NO: 2776484 - protein, 5 aa, Entamoeba invadens
SPPLS

SEQ ID NO: 2776485 - protein, 5 aa, Entamoeba invadens
SPPPK

SEQ ID NO: 2776486 - protein, 9 aa, Entamoeba invadens
SPPPSNLQP

SEQ ID NO: 2776487 - protein, 5 aa, Entamoeba invadens
SPPST

SEQ ID NO: 2776488 - protein, 7 aa, Entamoeba invadens
SPPSYKN

SEQ ID NO: 2776489 - protein, 8 aa, Entamoeba invadens
SPPTPVGS

SEQ ID NO: 2776490 - protein, 8 aa, Entamoeba invadens
SPPTYTDD

SEQ ID NO: 2776491 - protein, 13 aa, Entamoeba invadens
SPPVEDFKPKPED

SEQ ID NO: 2776492 - protein, 6 aa, Entamoeba invadens
SPPYSW

SEQ ID NO: 2776493 - protein, 4 aa, Entamoeba invadens
SPQC

SEQ ID NO: 2776494 - protein, 7 aa, Entamoeba invadens
SPQDDNV

SEQ ID NO: 2776495 - protein, 24 aa, Entamoeba invadens
SPQEKNTYARTDPLTSSDEKENIQ

SEQ ID NO: 2776496 - protein, 45 aa, Entamoeba invadens
SPQFTPRSAKDTPVDASTSYTPRRMDRKNDEENTLSKDENSYSDV

SEQ ID NO: 2776497 - protein, 19 aa, Entamoeba invadens
SPQHDEPQQCAQPPPHREE

SEQ ID NO: 2776498 - protein, 25 aa, Entamoeba invadens
SPQPDGSYKDENGDVDYSCPTNSTS

SEQ ID NO: 2776499 - protein, 6 aa, Entamoeba invadens
SPQQDF

SEQ ID NO: 2776500 - protein, 7 aa, Entamoeba invadens
SPQSNTF

SEQ ID NO: 2776501 - protein, 8 aa, Entamoeba invadens
SPQTCPPN

SEQ ID NO: 2776502 - protein, 5 aa, Entamoeba invadens
SPRDE

SEQ ID NO: 2776503 - protein, 5 aa, Entamoeba invadens
SPRKF

SEQ ID NO: 2776504 - protein, 10 aa, Entamoeba invadens
SPRNDNGSAW

SEQ ID NO: 2776505 - protein, 9 aa, Entamoeba invadens
SPRNNTDAY

SEQ ID NO: 2776506 - protein, 6 aa, Entamoeba invadens
SPRQKA

SEQ ID NO: 2776507 - protein, 8 aa, Entamoeba invadens
SPRQSKMP

SEQ ID NO: 2776508 - protein, 48 aa, Entamoeba invadens
SPRSDCKAPAIADGPSWSAKRTSMKGSVAPLSNSGATGNVNLPKEGYT

SEQ ID NO: 2776509 - protein, 5 aa, Entamoeba invadens
SPRTL

SEQ ID NO: 2776510 - protein, 6 aa, Entamoeba invadens
SPRYSQ

SEQ ID NO: 2776511 - protein, 8 aa, Entamoeba invadens
SPSCQSCT

SEQ ID NO: 2776512 - protein, 6 aa, Entamoeba invadens
SPSCVD

SEQ ID NO: 2776513 - protein, 10 aa, Entamoeba invadens
SPSDIDQGVN

SEQ ID NO: 2776514 - protein, 9 aa, Entamoeba invadens
SPSGSNGSV

SEQ ID NO: 2776515 - protein, 9 aa, Entamoeba invadens
SPSGTSCQS

SEQ ID NO: 2776516 - protein, 12 aa, Entamoeba invadens
SPSISDTKFSTA

SEQ ID NO: 2776517 - protein, 5 aa, Entamoeba invadens
SPSKE

SEQ ID NO: 2776518 - protein, 13 aa, Entamoeba invadens
SPSKKPSPDGTTC

SEQ ID NO: 2776519 - protein, 7 aa, Entamoeba invadens
SPSNDGS

SEQ ID NO: 2776520 - protein, 5 aa, Entamoeba invadens
SPSNL

SEQ ID NO: 2776521 - protein, 16 aa, Entamoeba invadens
SPSNSTAHCETEESGV

SEQ ID NO: 2776522 - protein, 7 aa, Entamoeba invadens
SPSPENV

SEQ ID NO: 2776523 - protein, 6 aa, Entamoeba invadens
SPSPLV

SEQ ID NO: 2776524 - protein, 10 aa, Entamoeba invadens
SPSPSQQVSP

SEQ ID NO: 2776525 - protein, 15 aa, Entamoeba invadens
SPSQPSQPTKTKKEL

SEQ ID NO: 2776526 - protein, 9 aa, Entamoeba invadens
SPSRLTEEI

SEQ ID NO: 2776527 - protein, 10 aa, Entamoeba invadens
SPSSDKTNCE

SEQ ID NO: 2776528 - protein, 8 aa, Entamoeba invadens
SPSSEGTY

SEQ ID NO: 2776529 - protein, 5 aa, Entamoeba invadens
SPSST

SEQ ID NO: 2776530 - protein, 8 aa, Entamoeba invadens
SPSTLEVT

SEQ ID NO: 2776531 - protein, 8 aa, Entamoeba invadens
SPSVDGTY

SEQ ID NO: 2776532 - protein, 8 aa, Entamoeba invadens
SPSVGKAY

SEQ ID NO: 2776533 - protein, 5 aa, Entamoeba invadens
SPTAQ

SEQ ID NO: 2776534 - protein, 10 aa, Entamoeba invadens
SPTDLDQGMN

SEQ ID NO: 2776535 - protein, 6 aa, Entamoeba invadens
SPTEEN

SEQ ID NO: 2776536 - protein, 6 aa, Entamoeba invadens
SPTHCK

SEQ ID NO: 2776537 - protein, 9 aa, Entamoeba invadens
SPTHPARSE

SEQ ID NO: 2776538 - protein, 13 aa, Entamoeba invadens
SPTIQEDNKVPYP

SEQ ID NO: 2776539 - protein, 10 aa, Entamoeba invadens
SPTKLETETF

SEQ ID NO: 2776540 - protein, 11 aa, Entamoeba invadens
SPTKNRKTEKV

SEQ ID NO: 2776541 - protein, 8 aa, Entamoeba invadens
SPTLSTSK

SEQ ID NO: 2776542 - protein, 13 aa, Entamoeba invadens
SPTNCEKCNENDA

SEQ ID NO: 2776543 - protein, 5 aa, Entamoeba invadens
SPTNM

SEQ ID NO: 2776544 - protein, 4 aa, Entamoeba invadens
SPTP

SEQ ID NO: 2776545 - protein, 7 aa, Entamoeba invadens
SPTPTSV

SEQ ID NO: 2776546 - protein, 5 aa, Entamoeba invadens
SPTSL

SEQ ID NO: 2776547 - protein, 8 aa, Entamoeba invadens
SPTSLKQE

SEQ ID NO: 2776548 - protein, 16 aa, Entamoeba invadens
SPTSSADQVTITDPEV

SEQ ID NO: 2776549 - protein, 9 aa, Entamoeba invadens
SPTTETPLI

SEQ ID NO: 2776550 - protein, 4 aa, Entamoeba invadens
SPTY

SEQ ID NO: 2776551 - protein, 7 aa, Entamoeba invadens
SPTYPRN

SEQ ID NO: 2776552 - protein, 7 aa, Entamoeba invadens
SPTYSIS

SEQ ID NO: 2776553 - protein, 8 aa, Entamoeba invadens
SPVATATL

SEQ ID NO: 2776554 - protein, 4 aa, Entamoeba invadens
SPVD

SEQ ID NO: 2776555 - protein, 4 aa, Entamoeba invadens
SPVK

SEQ ID NO: 2776556 - protein, 5 aa, Entamoeba invadens
SPVKA

SEQ ID NO: 2776557 - protein, 12 aa, Entamoeba invadens
SPVPCKANNTDS

SEQ ID NO: 2776558 - protein, 5 aa, Entamoeba invadens
SPVPK

SEQ ID NO: 2776559 - protein, 7 aa, Entamoeba invadens
SPVPSSK

SEQ ID NO: 2776560 - protein, 9 aa, Entamoeba invadens
SPVSEGSQR

SEQ ID NO: 2776561 - protein, 9 aa, Entamoeba invadens
SPVSPPSSA

SEQ ID NO: 2776562 - protein, 5 aa, Entamoeba invadens
SPVYA

SEQ ID NO: 2776563 - protein, 4 aa, Entamoeba invadens
SPWG

SEQ ID NO: 2776564 - protein, 6 aa, Entamoeba invadens
SPYDPD

SEQ ID NO: 2776565 - protein, 6 aa, Entamoeba invadens
SPYDPE

SEQ ID NO: 2776566 - protein, 15 aa, Entamoeba invadens
SPYGFGDSNNLERSN

SEQ ID NO: 2776567 - protein, 4 aa, Entamoeba invadens
SPYL

SEQ ID NO: 2776568 - protein, 5 aa, Entamoeba invadens
SPYNE

SEQ ID NO: 2776569 - protein, 6 aa, Entamoeba invadens
SPYQEN

SEQ ID NO: 2776570 - protein, 6 aa, Entamoeba invadens
SPYQRN

SEQ ID NO: 2776571 - protein, 30 aa, Entamoeba invadens
SPYSEKSKKGDTKKRKVSQREYQQDFPTPF

SEQ ID NO: 2776572 - protein, 32 aa, Entamoeba invadens
SPYSGSQEYSTNEGRDGSGAYKVSGVTSTAQV

SEQ ID NO: 2776573 - protein, 4 aa, Entamoeba invadens
SPYT

SEQ ID NO: 2776574 - protein, 5 aa, Entamoeba invadens
SPYTN

SEQ ID NO: 2776575 - protein, 8 aa, Entamoeba invadens
SQAKNNGL

SEQ ID NO: 2776576 - protein, 20 aa, Entamoeba invadens
SQAKQTESETDRCQIKSSKG

SEQ ID NO: 2776577 - protein, 22 aa, Entamoeba invadens
SQAPPTTDEQPQKSPSPQNKQY

SEQ ID NO: 2776578 - protein, 16 aa, Entamoeba invadens
SQAQTDALYTTKKTLS

SEQ ID NO: 2776579 - protein, 4 aa, Entamoeba invadens
SQAR

SEQ ID NO: 2776580 - protein, 8 aa, Entamoeba invadens
SQASDSTL

SEQ ID NO: 2776581 - protein, 4 aa, Entamoeba invadens
SQAV

SEQ ID NO: 2776582 - protein, 4 aa, Entamoeba invadens
SQCG

SEQ ID NO: 2776583 - protein, 22 aa, Entamoeba invadens
SQCGNGVYNDGEECEKTDDPYV

SEQ ID NO: 2776584 - protein, 4 aa, Entamoeba invadens
SQCN

SEQ ID NO: 2776585 - protein, 8 aa, Entamoeba invadens
SQCNSTTG

SEQ ID NO: 2776586 - protein, 7 aa, Entamoeba invadens
SQCPSEC

SEQ ID NO: 2776587 - protein, 17 aa, Entamoeba invadens
SQCQTGTFSSSTNTSNC

SEQ ID NO: 2776588 - protein, 4 aa, Entamoeba invadens
SQCS

SEQ ID NO: 2776589 - protein, 13 aa, Entamoeba invadens
SQCSKCDNGFKLS

SEQ ID NO: 2776590 - protein, 5 aa, Entamoeba invadens
SQCTK

SEQ ID NO: 2776591 - protein, 8 aa, Entamoeba invadens
SQDDKNIK

SEQ ID NO: 2776592 - protein, 7 aa, Entamoeba invadens
SQDEPTF

SEQ ID NO: 2776593 - protein, 7 aa, Entamoeba invadens
SQDGQLN

SEQ ID NO: 2776594 - protein, 4 aa, Entamoeba invadens
SQDK

SEQ ID NO: 2776595 - protein, 7 aa, Entamoeba invadens
SQDKNTK

SEQ ID NO: 2776596 - protein, 5 aa, Entamoeba invadens
SQDNA

SEQ ID NO: 2776597 - protein, 6 aa, Entamoeba invadens
SQDQNH

SEQ ID NO: 2776598 - protein, 6 aa, Entamoeba invadens
SQDRNE

SEQ ID NO: 2776599 - protein, 9 aa, Entamoeba invadens
SQDSENYKQ

SEQ ID NO: 2776600 - protein, 7 aa, Entamoeba invadens
SQDSEPY

SEQ ID NO: 2776601 - protein, 8 aa, Entamoeba invadens
SQDYKEAM

SEQ ID NO: 2776602 - protein, 15 aa, Entamoeba invadens
SQEASNCTSCKGENV

SEQ ID NO: 2776603 - protein, 5 aa, Entamoeba invadens
SQEDL

SEQ ID NO: 2776604 - protein, 5 aa, Entamoeba invadens
SQEEK

SEQ ID NO: 2776605 - protein, 6 aa, Entamoeba invadens
SQEITS

SEQ ID NO: 2776606 - protein, 5 aa, Entamoeba invadens
SQEIV

SEQ ID NO: 2776607 - protein, 34 aa, Entamoeba invadens
SQEKTNFEISEEDEALKKTKNGIYKNKEKKKCVL

SEQ ID NO: 2776608 - protein, 4 aa, Entamoeba invadens
SQEM

SEQ ID NO: 2776609 - protein, 11 aa, Entamoeba invadens
SQENTENTESK

SEQ ID NO: 2776610 - protein, 12 aa, Entamoeba invadens
SQESYQKELESG

SEQ ID NO: 2776611 - protein, 6 aa, Entamoeba invadens
SQETIS

SEQ ID NO: 2776612 - protein, 4 aa, Entamoeba invadens
SQEY

SEQ ID NO: 2776613 - protein, 6 aa, Entamoeba invadens
SQFNQS

SEQ ID NO: 2776614 - protein, 7 aa, Entamoeba invadens
SQGCGIG

SEQ ID NO: 2776615 - protein, 6 aa, Entamoeba invadens
SQGCTQ

SEQ ID NO: 2776616 - protein, 14 aa, Entamoeba invadens
SQGDEEERPPKKHP

SEQ ID NO: 2776617 - protein, 6 aa, Entamoeba invadens
SQGFVG

SEQ ID NO: 2776618 - protein, 18 aa, Entamoeba invadens
SQGKQLSDDRKLCEDTSN

SEQ ID NO: 2776619 - protein, 19 aa, Entamoeba invadens
SQGKQLSDDRKSCEDTPNT

SEQ ID NO: 2776620 - protein, 7 aa, Entamoeba invadens
SQGKTSF

SEQ ID NO: 2776621 - protein, 5 aa, Entamoeba invadens
SQGMT

SEQ ID NO: 2776622 - protein, 5 aa, Entamoeba invadens
SQGSF

SEQ ID NO: 2776623 - protein, 28 aa, Entamoeba invadens
SQHEKDGKTTNKENQRHKDEKDNTKQIT

SEQ ID NO: 2776624 - protein, 7 aa, Entamoeba invadens
SQHKFSS

SEQ ID NO: 2776625 - protein, 6 aa, Entamoeba invadens
SQIDTI

SEQ ID NO: 2776626 - protein, 7 aa, Entamoeba invadens
SQIDTNG

SEQ ID NO: 2776627 - protein, 4 aa, Entamoeba invadens
SQIE

SEQ ID NO: 2776628 - protein, 11 aa, Entamoeba invadens
SQIEEKGLGTP

SEQ ID NO: 2776629 - protein, 5 aa, Entamoeba invadens
SQIGF

SEQ ID NO: 2776630 - protein, 12 aa, Entamoeba invadens
SQIKNERIHDSN

SEQ ID NO: 2776631 - protein, 8 aa, Entamoeba invadens
SQINSINN

SEQ ID NO: 2776632 - protein, 6 aa, Entamoeba invadens
SQIPAG

SEQ ID NO: 2776633 - protein, 8 aa, Entamoeba invadens
SQIPPSYS

SEQ ID NO: 2776634 - protein, 5 aa, Entamoeba invadens
SQISD

SEQ ID NO: 2776635 - protein, 4 aa, Entamoeba invadens
SQIT

SEQ ID NO: 2776636 - protein, 14 aa, Entamoeba invadens
SQITDGPEVHDGSN

SEQ ID NO: 2776637 - protein, 9 aa, Entamoeba invadens
SQITGDTNG

SEQ ID NO: 2776638 - protein, 7 aa, Entamoeba invadens
SQITKEK

SEQ ID NO: 2776639 - protein, 7 aa, Entamoeba invadens
SQITSGE

SEQ ID NO: 2776640 - protein, 11 aa, Entamoeba invadens
SQITTKGVSAS

SEQ ID NO: 2776641 - protein, 23 aa, Entamoeba invadens
SQKCSKCNDGYSLNENGNECQKD

SEQ ID NO: 2776642 - protein, 9 aa, Entamoeba invadens
SQKDTNRNS

SEQ ID NO: 2776643 - protein, 16 aa, Entamoeba invadens
SQKGMRPDIPKDECEV

SEQ ID NO: 2776644 - protein, 4 aa, Entamoeba invadens
SQKI

SEQ ID NO: 2776645 - protein, 6 aa, Entamoeba invadens
SQKPQD

SEQ ID NO: 2776646 - protein, 6 aa, Entamoeba invadens
SQKPTI

SEQ ID NO: 2776647 - protein, 5 aa, Entamoeba invadens
SQKSF

SEQ ID NO: 2776648 - protein, 8 aa, Entamoeba invadens
SQKSSECL

SEQ ID NO: 2776649 - protein, 8 aa, Entamoeba invadens
SQKTIKVT

SEQ ID NO: 2776650 - protein, 7 aa, Entamoeba invadens
SQKTKEC

SEQ ID NO: 2776651 - protein, 5 aa, Entamoeba invadens
SQKVA

SEQ ID NO: 2776652 - protein, 11 aa, Entamoeba invadens
SQKVEKEEFEN

SEQ ID NO: 2776653 - protein, 7 aa, Entamoeba invadens
SQKYSKE

SEQ ID NO: 2776654 - protein, 8 aa, Entamoeba invadens
SQLDGETA

SEQ ID NO: 2776655 - protein, 5 aa, Entamoeba invadens
SQLDS

SEQ ID NO: 2776656 - protein, 7 aa, Entamoeba invadens
SQLENTD

SEQ ID NO: 2776657 - protein, 10 aa, Entamoeba invadens
SQLETTEREN

SEQ ID NO: 2776658 - protein, 12 aa, Entamoeba invadens
SQLQNSTQMIRD

SEQ ID NO: 2776659 - protein, 5 aa, Entamoeba invadens
SQLRD

SEQ ID NO: 2776660 - protein, 17 aa, Entamoeba invadens
SQLSIGGGLEVNSKTGY

SEQ ID NO: 2776661 - protein, 4 aa, Entamoeba invadens
SQLT

SEQ ID NO: 2776662 - protein, 13 aa, Entamoeba invadens
SQLYPPDYYKTHS

SEQ ID NO: 2776663 - protein, 10 aa, Entamoeba invadens
SQNAEDRPTF

SEQ ID NO: 2776664 - protein, 9 aa, Entamoeba invadens
SQNAKTQEF

SEQ ID NO: 2776665 - protein, 13 aa, Entamoeba invadens
SQNCQETPSASDL

SEQ ID NO: 2776666 - protein, 8 aa, Entamoeba invadens
SQNCSECN

SEQ ID NO: 2776667 - protein, 6 aa, Entamoeba invadens
SQNDVR

SEQ ID NO: 2776668 - protein, 13 aa, Entamoeba invadens
SQNERRNEKRKVS

SEQ ID NO: 2776669 - protein, 8 aa, Entamoeba invadens
SQNGECSG

SEQ ID NO: 2776670 - protein, 9 aa, Entamoeba invadens
SQNGNNCSI

SEQ ID NO: 2776671 - protein, 24 aa, Entamoeba invadens
SQNGSKSTSKRELNTDINNNKPDI

SEQ ID NO: 2776672 - protein, 5 aa, Entamoeba invadens
SQNID

SEQ ID NO: 2776673 - protein, 7 aa, Entamoeba invadens
SQNKKSA

SEQ ID NO: 2776674 - protein, 14 aa, Entamoeba invadens
SQNLERLGATTKSP

SEQ ID NO: 2776675 - protein, 6 aa, Entamoeba invadens
SQNMDG

SEQ ID NO: 2776676 - protein, 10 aa, Entamoeba invadens
SQNMNKDGIA

SEQ ID NO: 2776677 - protein, 10 aa, Entamoeba invadens
SQNPEDRPTF

SEQ ID NO: 2776678 - protein, 6 aa, Entamoeba invadens
SQNRTI

SEQ ID NO: 2776679 - protein, 5 aa, Entamoeba invadens
SQNSC

SEQ ID NO: 2776680 - protein, 19 aa, Entamoeba invadens
SQNSCTNCNSGYYAESGTC

SEQ ID NO: 2776681 - protein, 7 aa, Entamoeba invadens
SQNSDKF

SEQ ID NO: 2776682 - protein, 5 aa, Entamoeba invadens
SQNTC

SEQ ID NO: 2776683 - protein, 14 aa, Entamoeba invadens
SQNTCNKIESNELY

SEQ ID NO: 2776684 - protein, 14 aa, Entamoeba invadens
SQNTCNKIESNEMY

SEQ ID NO: 2776685 - protein, 11 aa, Entamoeba invadens
SQNTDSQATSL

SEQ ID NO: 2776686 - protein, 7 aa, Entamoeba invadens
SQNTIES

SEQ ID NO: 2776687 - protein, 12 aa, Entamoeba invadens
SQNTTECTGCGS

SEQ ID NO: 2776688 - protein, 21 aa, Entamoeba invadens
SQNTTTNQTTARNPRPQDEEV

SEQ ID NO: 2776689 - protein, 9 aa, Entamoeba invadens
SQNVNQSPN

SEQ ID NO: 2776690 - protein, 11 aa, Entamoeba invadens
SQNYTLTTRTN

SEQ ID NO: 2776691 - protein, 12 aa, Entamoeba invadens
SQNYTRENQQTL

SEQ ID NO: 2776692 - protein, 6 aa, Entamoeba invadens
SQPCSE

SEQ ID NO: 2776693 - protein, 7 aa, Entamoeba invadens
SQPCTSA

SEQ ID NO: 2776694 - protein, 6 aa, Entamoeba invadens
SQPEKR

SEQ ID NO: 2776695 - protein, 11 aa, Entamoeba invadens
SQPEPTTFRPK

SEQ ID NO: 2776696 - protein, 4 aa, Entamoeba invadens
SQPG

SEQ ID NO: 2776697 - protein, 22 aa, Entamoeba invadens
SQPHKTGSAVESTYQYKTSQNA

SEQ ID NO: 2776698 - protein, 13 aa, Entamoeba invadens
SQPSNDSSSFSSW

SEQ ID NO: 2776699 - protein, 8 aa, Entamoeba invadens
SQPTEISK

SEQ ID NO: 2776700 - protein, 31 aa, Entamoeba invadens
SQPTTQQNNGNAVEPEDTEQRSVDDDYDTDS

SEQ ID NO: 2776701 - protein, 4 aa, Entamoeba invadens
SQPY

SEQ ID NO: 2776702 - protein, 6 aa, Entamoeba invadens
SQQEGT

SEQ ID NO: 2776703 - protein, 19 aa, Entamoeba invadens
SQQPDDRPNINEVVNLLET

SEQ ID NO: 2776704 - protein, 10 aa, Entamoeba invadens
SQQPEDRPNI

SEQ ID NO: 2776705 - protein, 19 aa, Entamoeba invadens
SQQPKDRPNINEVVNFLKT

SEQ ID NO: 2776706 - protein, 8 aa, Entamoeba invadens
SQQQTGHY

SEQ ID NO: 2776707 - protein, 10 aa, Entamoeba invadens
SQQSNSQLDK

SEQ ID NO: 2776708 - protein, 14 aa, Entamoeba invadens
SQQTFNTPRDKVRT

SEQ ID NO: 2776709 - protein, 10 aa, Entamoeba invadens
SQRIRTSGQH

SEQ ID NO: 2776710 - protein, 16 aa, Entamoeba invadens
SQRKEKPETYSDFSPK

SEQ ID NO: 2776711 - protein, 15 aa, Entamoeba invadens
SQRNGLNDGNSNTSL

SEQ ID NO: 2776712 - protein, 19 aa, Entamoeba invadens
SQRPEDRPNIDEVVNNLKA

SEQ ID NO: 2776713 - protein, 18 aa, Entamoeba invadens
SQRQEDRPNIDKVVELLK

SEQ ID NO: 2776714 - protein, 8 aa, Entamoeba invadens
SQRQFRSD

SEQ ID NO: 2776715 - protein, 6 aa, Entamoeba invadens
SQRRID

SEQ ID NO: 2776716 - protein, 9 aa, Entamoeba invadens
SQRSQDNDT

SEQ ID NO: 2776717 - protein, 5 aa, Entamoeba invadens
SQRSS

SEQ ID NO: 2776718 - protein, 11 aa, Entamoeba invadens
SQRSVGKEFYS

SEQ ID NO: 2776719 - protein, 6 aa, Entamoeba invadens
SQRTLP

SEQ ID NO: 2776720 - protein, 6 aa, Entamoeba invadens
SQRYNP

SEQ ID NO: 2776721 - protein, 13 aa, Entamoeba invadens
SQSAQDDDKVTQT

SEQ ID NO: 2776722 - protein, 4 aa, Entamoeba invadens
SQSE

SEQ ID NO: 2776723 - protein, 6 aa, Entamoeba invadens
SQSHDE

SEQ ID NO: 2776724 - protein, 11 aa, Entamoeba invadens
SQSKKGVSAEM

SEQ ID NO: 2776725 - protein, 26 aa, Entamoeba invadens
SQSKTCVGCTSSQKYNKTTQKCDSSA

SEQ ID NO: 2776726 - protein, 8 aa, Entamoeba invadens
SQSKTCVS

SEQ ID NO: 2776727 - protein, 11 aa, Entamoeba invadens
SQSKVNCEDCG

SEQ ID NO: 2776728 - protein, 4 aa, Entamoeba invadens
SQSL

SEQ ID NO: 2776729 - protein, 5 aa, Entamoeba invadens
SQSMT

SEQ ID NO: 2776730 - protein, 53 aa, Entamoeba invadens
SQSNNSENTKQTSSLSKELSKTSANQSQNNSKSGKTPSVHSSNNKSKSKGTKI

SEQ ID NO: 2776731 - protein, 9 aa, Entamoeba invadens
SQSPADRPT

SEQ ID NO: 2776732 - protein, 9 aa, Entamoeba invadens
SQSPGTPIA

SEQ ID NO: 2776733 - protein, 4 aa, Entamoeba invadens
SQSQ

SEQ ID NO: 2776734 - protein, 5 aa, Entamoeba invadens
SQSQP

SEQ ID NO: 2776735 - protein, 12 aa, Entamoeba invadens
SQSQSSSSTEEE

SEQ ID NO: 2776736 - protein, 8 aa, Entamoeba invadens
SQSRSLTT

SEQ ID NO: 2776737 - protein, 21 aa, Entamoeba invadens
SQSTEENNTSSSFTNDTNVEE

SEQ ID NO: 2776738 - protein, 6 aa, Entamoeba invadens
SQSTRI

SEQ ID NO: 2776739 - protein, 9 aa, Entamoeba invadens
SQSTTRECI

SEQ ID NO: 2776740 - protein, 9 aa, Entamoeba invadens
SQSYTTRNG

SEQ ID NO: 2776741 - protein, 8 aa, Entamoeba invadens
SQTALGGE

SEQ ID NO: 2776742 - protein, 8 aa, Entamoeba invadens
SQTALKEG

SEQ ID NO: 2776743 - protein, 9 aa, Entamoeba invadens
SQTATTSKS

SEQ ID NO: 2776744 - protein, 7 aa, Entamoeba invadens
SQTCDGT

SEQ ID NO: 2776745 - protein, 9 aa, Entamoeba invadens
SQTDQQVPF

SEQ ID NO: 2776746 - protein, 5 aa, Entamoeba invadens
SQTED

SEQ ID NO: 2776747 - protein, 5 aa, Entamoeba invadens
SQTEE

SEQ ID NO: 2776748 - protein, 8 aa, Entamoeba invadens
SQTEEIDS

SEQ ID NO: 2776749 - protein, 5 aa, Entamoeba invadens
SQTEK

SEQ ID NO: 2776750 - protein, 8 aa, Entamoeba invadens
SQTEKKCT

SEQ ID NO: 2776751 - protein, 17 aa, Entamoeba invadens
SQTEKKFKTDNSDLGCG

SEQ ID NO: 2776752 - protein, 8 aa, Entamoeba invadens
SQTEKYQC

SEQ ID NO: 2776753 - protein, 6 aa, Entamoeba invadens
SQTESK

SEQ ID NO: 2776754 - protein, 6 aa, Entamoeba invadens
SQTIPP

SEQ ID NO: 2776755 - protein, 4 aa, Entamoeba invadens
SQTK

SEQ ID NO: 2776756 - protein, 18 aa, Entamoeba invadens
SQTKAERTIDLNKDGSVY

SEQ ID NO: 2776757 - protein, 15 aa, Entamoeba invadens
SQTKHASDKQEKTLG

SEQ ID NO: 2776758 - protein, 8 aa, Entamoeba invadens
SQTKMTRY

SEQ ID NO: 2776759 - protein, 4 aa, Entamoeba invadens
SQTN

SEQ ID NO: 2776760 - protein, 6 aa, Entamoeba invadens
SQTNKT

SEQ ID NO: 2776761 - protein, 6 aa, Entamoeba invadens
SQTNQD

SEQ ID NO: 2776762 - protein, 5 aa, Entamoeba invadens
SQTNW

SEQ ID NO: 2776763 - protein, 6 aa, Entamoeba invadens
SQTPEH

SEQ ID NO: 2776764 - protein, 5 aa, Entamoeba invadens
SQTPL

SEQ ID NO: 2776765 - protein, 6 aa, Entamoeba invadens
SQTQNC

SEQ ID NO: 2776766 - protein, 5 aa, Entamoeba invadens
SQTSS

SEQ ID NO: 2776767 - protein, 14 aa, Entamoeba invadens
SQTSSDKDIRSSYR

SEQ ID NO: 2776768 - protein, 5 aa, Entamoeba invadens
SQTTG

SEQ ID NO: 2776769 - protein, 7 aa, Entamoeba invadens
SQTTGKC

SEQ ID NO: 2776770 - protein, 6 aa, Entamoeba invadens
SQTTHP

SEQ ID NO: 2776771 - protein, 9 aa, Entamoeba invadens
SQTTNEKDL

SEQ ID NO: 2776772 - protein, 6 aa, Entamoeba invadens
SQTTPY

SEQ ID NO: 2776773 - protein, 6 aa, Entamoeba invadens
SQTTSI

SEQ ID NO: 2776774 - protein, 9 aa, Entamoeba invadens
SQTTVPSEG

SEQ ID NO: 2776775 - protein, 5 aa, Entamoeba invadens
SQVEF

SEQ ID NO: 2776776 - protein, 6 aa, Entamoeba invadens
SQVGET

SEQ ID NO: 2776777 - protein, 6 aa, Entamoeba invadens
SQVPPE

SEQ ID NO: 2776778 - protein, 6 aa, Entamoeba invadens
SQVPQT

SEQ ID NO: 2776779 - protein, 10 aa, Entamoeba invadens
SQVPRDDDTW

SEQ ID NO: 2776780 - protein, 4 aa, Entamoeba invadens
SQVR

SEQ ID NO: 2776781 - protein, 4 aa, Entamoeba invadens
SQVY

SEQ ID NO: 2776782 - protein, 4 aa, Entamoeba invadens
SQWE

SEQ ID NO: 2776783 - protein, 5 aa, Entamoeba invadens
SQYGF

SEQ ID NO: 2776784 - protein, 9 aa, Entamoeba invadens
SQYGHKGGY

SEQ ID NO: 2776785 - protein, 6 aa, Entamoeba invadens
SQYGTS

SEQ ID NO: 2776786 - protein, 5 aa, Entamoeba invadens
SQYNQ

SEQ ID NO: 2776787 - protein, 9 aa, Entamoeba invadens
SQYSQSAQD

SEQ ID NO: 2776788 - protein, 7 aa, Entamoeba invadens
SQYSSTS

SEQ ID NO: 2776789 - protein, 10 aa, Entamoeba invadens
SQYTDPTTVP

SEQ ID NO: 2776790 - protein, 9 aa, Entamoeba invadens
SQYTKKSGV

SEQ ID NO: 2776791 - protein, 6 aa, Entamoeba invadens
SQYVEQ

SEQ ID NO: 2776792 - protein, 10 aa, Entamoeba invadens
SQYYSSGNEC

SEQ ID NO: 2776793 - protein, 8 aa, Entamoeba invadens
SRAAGNTK

SEQ ID NO: 2776794 - protein, 22 aa, Entamoeba invadens
SRAIQNSTRPIESEVEKGTPVN

SEQ ID NO: 2776795 - protein, 10 aa, Entamoeba invadens
SRANAAGKRV

SEQ ID NO: 2776796 - protein, 7 aa, Entamoeba invadens
SRANNRV

SEQ ID NO: 2776797 - protein, 4 aa, Entamoeba invadens
SRAS

SEQ ID NO: 2776798 - protein, 7 aa, Entamoeba invadens
SRASTRL

SEQ ID NO: 2776799 - protein, 7 aa, Entamoeba invadens
SRCDTTG

SEQ ID NO: 2776800 - protein, 8 aa, Entamoeba invadens
SRCDTTGK

SEQ ID NO: 2776801 - protein, 9 aa, Entamoeba invadens
SRCSTTSPE

SEQ ID NO: 2776802 - protein, 6 aa, Entamoeba invadens
SRCTSK

SEQ ID NO: 2776803 - protein, 8 aa, Entamoeba invadens
SRDAFDPK

SEQ ID NO: 2776804 - protein, 6 aa, Entamoeba invadens
SRDKSI

SEQ ID NO: 2776805 - protein, 13 aa, Entamoeba invadens
SRDSNRASTQSDD

SEQ ID NO: 2776806 - protein, 11 aa, Entamoeba invadens
SRDVGPNVPTN

SEQ ID NO: 2776807 - protein, 13 aa, Entamoeba invadens
SREDDGNTHQGNG

SEQ ID NO: 2776808 - protein, 5 aa, Entamoeba invadens
SREEV

SEQ ID NO: 2776809 - protein, 6 aa, Entamoeba invadens
SREGLK

SEQ ID NO: 2776810 - protein, 49 aa, Entamoeba invadens
SREKLSRKRKGKTPNAVPEDHTKQEKKEISTQNEDHSLSSDEDGDEDIA

SEQ ID NO: 2776811 - protein, 19 aa, Entamoeba invadens
SRENVEQIRKNSETYRSQP

SEQ ID NO: 2776812 - protein, 8 aa, Entamoeba invadens
SRESDPVD

SEQ ID NO: 2776813 - protein, 6 aa, Entamoeba invadens
SRESTR

SEQ ID NO: 2776814 - protein, 4 aa, Entamoeba invadens
SRET

SEQ ID NO: 2776815 - protein, 14 aa, Entamoeba invadens
SRGEKQNRYRPEEY

SEQ ID NO: 2776816 - protein, 17 aa, Entamoeba invadens
SRGERPAIELGDGEQKA

SEQ ID NO: 2776817 - protein, 8 aa, Entamoeba invadens
SRGFDVEG

SEQ ID NO: 2776818 - protein, 9 aa, Entamoeba invadens
SRGGHGDEV

SEQ ID NO: 2776819 - protein, 8 aa, Entamoeba invadens
SRGGSPHE

SEQ ID NO: 2776820 - protein, 6 aa, Entamoeba invadens
SRGKTK

SEQ ID NO: 2776821 - protein, 6 aa, Entamoeba invadens
SRGLEG

SEQ ID NO: 2776822 - protein, 4 aa, Entamoeba invadens
SRGN

SEQ ID NO: 2776823 - protein, 11 aa, Entamoeba invadens
SRGTKGVTTCR

SEQ ID NO: 2776824 - protein, 6 aa, Entamoeba invadens
SRGTLN

SEQ ID NO: 2776825 - protein, 6 aa, Entamoeba invadens
SRGTTK

SEQ ID NO: 2776826 - protein, 8 aa, Entamoeba invadens
SRHAIDDQ

SEQ ID NO: 2776827 - protein, 8 aa, Entamoeba invadens
SRHCPGGG

SEQ ID NO: 2776828 - protein, 5 aa, Entamoeba invadens
SRHSE

SEQ ID NO: 2776829 - protein, 5 aa, Entamoeba invadens
SRIEY

SEQ ID NO: 2776830 - protein, 5 aa, Entamoeba invadens
SRIKT

SEQ ID NO: 2776831 - protein, 6 aa, Entamoeba invadens
SRINGS

SEQ ID NO: 2776832 - protein, 48 aa, Entamoeba invadens
SRIQNSKQRSFSVTSGSGISSNSSQSTGSGQQLSDGSSVVSSESCSTT

SEQ ID NO: 2776833 - protein, 8 aa, Entamoeba invadens
SRISGTGN

SEQ ID NO: 2776834 - protein, 8 aa, Entamoeba invadens
SRKCSDEF

SEQ ID NO: 2776835 - protein, 7 aa, Entamoeba invadens
SRKENMK

SEQ ID NO: 2776836 - protein, 8 aa, Entamoeba invadens
SRKETKEF

SEQ ID NO: 2776837 - protein, 9 aa, Entamoeba invadens
SRKETKELY

SEQ ID NO: 2776838 - protein, 9 aa, Entamoeba invadens
SRKGNRKEF

SEQ ID NO: 2776839 - protein, 4 aa, Entamoeba invadens
SRKN

SEQ ID NO: 2776840 - protein, 5 aa, Entamoeba invadens
SRKNN

SEQ ID NO: 2776841 - protein, 6 aa, Entamoeba invadens
SRKQQM

SEQ ID NO: 2776842 - protein, 9 aa, Entamoeba invadens
SRKSGKTIQ

SEQ ID NO: 2776843 - protein, 9 aa, Entamoeba invadens
SRKSNMKVD

SEQ ID NO: 2776844 - protein, 7 aa, Entamoeba invadens
SRKTLEQ

SEQ ID NO: 2776845 - protein, 8 aa, Entamoeba invadens
SRKVNGEH

SEQ ID NO: 2776846 - protein, 9 aa, Entamoeba invadens
SRKVNGEKD

SEQ ID NO: 2776847 - protein, 5 aa, Entamoeba invadens
SRKYF

SEQ ID NO: 2776848 - protein, 12 aa, Entamoeba invadens
SRLPKPDDMNQN

SEQ ID NO: 2776849 - protein, 11 aa, Entamoeba invadens
SRLPKPDEMNQ

SEQ ID NO: 2776850 - protein, 8 aa, Entamoeba invadens
SRLSLYGE

SEQ ID NO: 2776851 - protein, 5 aa, Entamoeba invadens
SRLSS

SEQ ID NO: 2776852 - protein, 18 aa, Entamoeba invadens
SRLTQNTEKTTERNNTTL

SEQ ID NO: 2776853 - protein, 4 aa, Entamoeba invadens
SRMR

SEQ ID NO: 2776854 - protein, 19 aa, Entamoeba invadens
SRNDELDEKYGDFSTQVSD

SEQ ID NO: 2776855 - protein, 10 aa, Entamoeba invadens
SRNEIKEDSM

SEQ ID NO: 2776856 - protein, 4 aa, Entamoeba invadens
SRNG

SEQ ID NO: 2776857 - protein, 10 aa, Entamoeba invadens
SRNGEEFEKY

SEQ ID NO: 2776858 - protein, 8 aa, Entamoeba invadens
SRNGTTNA

SEQ ID NO: 2776859 - protein, 7 aa, Entamoeba invadens
SRNKGDR

SEQ ID NO: 2776860 - protein, 7 aa, Entamoeba invadens
SRNKTEK

SEQ ID NO: 2776861 - protein, 6 aa, Entamoeba invadens
SRNNRD

SEQ ID NO: 2776862 - protein, 7 aa, Entamoeba invadens
SRNSSRI

SEQ ID NO: 2776863 - protein, 8 aa, Entamoeba invadens
SRPDERYQ

SEQ ID NO: 2776864 - protein, 5 aa, Entamoeba invadens
SRPKE

SEQ ID NO: 2776865 - protein, 5 aa, Entamoeba invadens
SRPNE

SEQ ID NO: 2776866 - protein, 15 aa, Entamoeba invadens
SRPNVEKFTDSSSSM

SEQ ID NO: 2776867 - protein, 4 aa, Entamoeba invadens
SRPQ

SEQ ID NO: 2776868 - protein, 8 aa, Entamoeba invadens
SRPQKRFS

SEQ ID NO: 2776869 - protein, 7 aa, Entamoeba invadens
SRQGQKL

SEQ ID NO: 2776870 - protein, 12 aa, Entamoeba invadens
SRQSVDQETDKM

SEQ ID NO: 2776871 - protein, 7 aa, Entamoeba invadens
SRQTANA

SEQ ID NO: 2776872 - protein, 7 aa, Entamoeba invadens
SRRETTH

SEQ ID NO: 2776873 - protein, 11 aa, Entamoeba invadens
SRRGLNEATNT

SEQ ID NO: 2776874 - protein, 9 aa, Entamoeba invadens
SRRKKPIDY

SEQ ID NO: 2776875 - protein, 6 aa, Entamoeba invadens
SRRSAR

SEQ ID NO: 2776876 - protein, 5 aa, Entamoeba invadens
SRRTL

SEQ ID NO: 2776877 - protein, 9 aa, Entamoeba invadens
SRRVNGETD

SEQ ID NO: 2776878 - protein, 6 aa, Entamoeba invadens
SRSADR

SEQ ID NO: 2776879 - protein, 4 aa, Entamoeba invadens
SRSI

SEQ ID NO: 2776880 - protein, 6 aa, Entamoeba invadens
SRSKTI

SEQ ID NO: 2776881 - protein, 9 aa, Entamoeba invadens
SRSNNSVNV

SEQ ID NO: 2776882 - protein, 18 aa, Entamoeba invadens
SRSSETKKKRNKSKLTKY

SEQ ID NO: 2776883 - protein, 15 aa, Entamoeba invadens
SRSSRLMQPETKMDE

SEQ ID NO: 2776884 - protein, 5 aa, Entamoeba invadens
SRSVR

SEQ ID NO: 2776885 - protein, 8 aa, Entamoeba invadens
SRSVYKST

SEQ ID NO: 2776886 - protein, 11 aa, Entamoeba invadens
SRTATKDVDLT

SEQ ID NO: 2776887 - protein, 9 aa, Entamoeba invadens
SRTDPEGSS

SEQ ID NO: 2776888 - protein, 5 aa, Entamoeba invadens
SRTEM

SEQ ID NO: 2776889 - protein, 7 aa, Entamoeba invadens
SRTENNR

SEQ ID NO: 2776890 - protein, 8 aa, Entamoeba invadens
SRTGNNKM

SEQ ID NO: 2776891 - protein, 5 aa, Entamoeba invadens
SRTIN

SEQ ID NO: 2776892 - protein, 29 aa, Entamoeba invadens
SRTPENEKPKETDTILEEEKNSTMAKKGE

SEQ ID NO: 2776893 - protein, 10 aa, Entamoeba invadens
SRTPSATGKR

SEQ ID NO: 2776894 - protein, 14 aa, Entamoeba invadens
SRTQKVATVGKDAF

SEQ ID NO: 2776895 - protein, 5 aa, Entamoeba invadens
SRTRE

SEQ ID NO: 2776896 - protein, 15 aa, Entamoeba invadens
SRTREGGIKETGSVN

SEQ ID NO: 2776897 - protein, 10 aa, Entamoeba invadens
SRTSDYYPSP

SEQ ID NO: 2776898 - protein, 5 aa, Entamoeba invadens
SRTSE

SEQ ID NO: 2776899 - protein, 6 aa, Entamoeba invadens
SRTSFE

SEQ ID NO: 2776900 - protein, 5 aa, Entamoeba invadens
SRTSP

SEQ ID NO: 2776901 - protein, 30 aa, Entamoeba invadens
SRTSSMEKTRDSMDSARALTSMDGNDNYRN

SEQ ID NO: 2776902 - protein, 8 aa, Entamoeba invadens
SRTTKSCY

SEQ ID NO: 2776903 - protein, 6 aa, Entamoeba invadens
SRTVNR

SEQ ID NO: 2776904 - protein, 13 aa, Entamoeba invadens
SRTVNRDTTNSDK

SEQ ID NO: 2776905 - protein, 13 aa, Entamoeba invadens
SRVENDINKNTNN

SEQ ID NO: 2776906 - protein, 8 aa, Entamoeba invadens
SRVETSKS

SEQ ID NO: 2776907 - protein, 6 aa, Entamoeba invadens
SRVEVK

SEQ ID NO: 2776908 - protein, 6 aa, Entamoeba invadens
SRVGSG

SEQ ID NO: 2776909 - protein, 12 aa, Entamoeba invadens
SRVSNRDLENTT

SEQ ID NO: 2776910 - protein, 5 aa, Entamoeba invadens
SRYED

SEQ ID NO: 2776911 - protein, 5 aa, Entamoeba invadens
SRYEM

SEQ ID NO: 2776912 - protein, 8 aa, Entamoeba invadens
SRYNGSLE

SEQ ID NO: 2776913 - protein, 6 aa, Entamoeba invadens
SRYSNT

SEQ ID NO: 2776914 - protein, 6 aa, Entamoeba invadens
SRYTGG

SEQ ID NO: 2776915 - protein, 11 aa, Entamoeba invadens
SSAAPPSGKMA

SEQ ID NO: 2776916 - protein, 16 aa, Entamoeba invadens
SSAAPPSGKMAEVTPK

SEQ ID NO: 2776917 - protein, 9 aa, Entamoeba invadens
SSADEMGGM

SEQ ID NO: 2776918 - protein, 6 aa, Entamoeba invadens
SSADIT

SEQ ID NO: 2776919 - protein, 7 aa, Entamoeba invadens
SSADYNS

SEQ ID NO: 2776920 - protein, 7 aa, Entamoeba invadens
SSAIGET

SEQ ID NO: 2776921 - protein, 9 aa, Entamoeba invadens
SSAKEIKYD

SEQ ID NO: 2776922 - protein, 7 aa, Entamoeba invadens
SSANKCG

SEQ ID NO: 2776923 - protein, 14 aa, Entamoeba invadens
SSANNEIPVNKETR

SEQ ID NO: 2776924 - protein, 14 aa, Entamoeba invadens
SSANNEITVNKETR

SEQ ID NO: 2776925 - protein, 9 aa, Entamoeba invadens
SSANQADSS

SEQ ID NO: 2776926 - protein, 5 aa, Entamoeba invadens
SSANT

SEQ ID NO: 2776927 - protein, 8 aa, Entamoeba invadens
SSAPNESI

SEQ ID NO: 2776928 - protein, 9 aa, Entamoeba invadens
SSAPQRKKF

SEQ ID NO: 2776929 - protein, 6 aa, Entamoeba invadens
SSASGR

SEQ ID NO: 2776930 - protein, 5 aa, Entamoeba invadens
SSASS

SEQ ID NO: 2776931 - protein, 4 aa, Entamoeba invadens
SSAT

SEQ ID NO: 2776932 - protein, 12 aa, Entamoeba invadens
SSATKINERVSQ

SEQ ID NO: 2776933 - protein, 6 aa, Entamoeba invadens
SSAVDP

SEQ ID NO: 2776934 - protein, 12 aa, Entamoeba invadens
SSAVTSVTTPKT

SEQ ID NO: 2776935 - protein, 14 aa, Entamoeba invadens
SSAYINSNTRTLRT

SEQ ID NO: 2776936 - protein, 6 aa, Entamoeba invadens
SSAYQT

SEQ ID NO: 2776937 - protein, 4 aa, Entamoeba invadens
SSCA

SEQ ID NO: 2776938 - protein, 21 aa, Entamoeba invadens
SSCDSTCDSCDRTNGNCTTCN

SEQ ID NO: 2776939 - protein, 21 aa, Entamoeba invadens
SSCDSTCGSCDRTNGNCTTCN

SEQ ID NO: 2776940 - protein, 13 aa, Entamoeba invadens
SSCESCNGPNSNN

SEQ ID NO: 2776941 - protein, 8 aa, Entamoeba invadens
SSCESGYK

SEQ ID NO: 2776942 - protein, 8 aa, Entamoeba invadens
SSCETCSE

SEQ ID NO: 2776943 - protein, 7 aa, Entamoeba invadens
SSCGADG

SEQ ID NO: 2776944 - protein, 11 aa, Entamoeba invadens
SSCGGGASGES

SEQ ID NO: 2776945 - protein, 12 aa, Entamoeba invadens
SSCGGSCDTTNG

SEQ ID NO: 2776946 - protein, 10 aa, Entamoeba invadens
SSCGGSCNGV

SEQ ID NO: 2776947 - protein, 9 aa, Entamoeba invadens
SSCGKTDGN

SEQ ID NO: 2776948 - protein, 9 aa, Entamoeba invadens
SSCGNGCDK

SEQ ID NO: 2776949 - protein, 17 aa, Entamoeba invadens
SSCGPNNVFSESDNKTC

SEQ ID NO: 2776950 - protein, 4 aa, Entamoeba invadens
SSCI

SEQ ID NO: 2776951 - protein, 21 aa, Entamoeba invadens
SSCKDGYKLSSGGSECRKETN

SEQ ID NO: 2776952 - protein, 11 aa, Entamoeba invadens
SSCKESESSTF

SEQ ID NO: 2776953 - protein, 4 aa, Entamoeba invadens
SSCL

SEQ ID NO: 2776954 - protein, 11 aa, Entamoeba invadens
SSCNGQCNVTT

SEQ ID NO: 2776955 - protein, 13 aa, Entamoeba invadens
SSCNKCNGTNPNN

SEQ ID NO: 2776956 - protein, 13 aa, Entamoeba invadens
SSCNKQCDQTNGY

SEQ ID NO: 2776957 - protein, 14 aa, Entamoeba invadens
SSCNKQCDQTNGYC

SEQ ID NO: 2776958 - protein, 13 aa, Entamoeba invadens
SSCNKQCDQTSGY

SEQ ID NO: 2776959 - protein, 8 aa, Entamoeba invadens
SSCNNKDN

SEQ ID NO: 2776960 - protein, 9 aa, Entamoeba invadens
SSCNNQNGN

SEQ ID NO: 2776961 - protein, 4 aa, Entamoeba invadens
SSCP

SEQ ID NO: 2776962 - protein, 6 aa, Entamoeba invadens
SSCPSC

SEQ ID NO: 2776963 - protein, 9 aa, Entamoeba invadens
SSCPSSPTL

SEQ ID NO: 2776964 - protein, 5 aa, Entamoeba invadens
SSCQD

SEQ ID NO: 2776965 - protein, 6 aa, Entamoeba invadens
SSCQSK

SEQ ID NO: 2776966 - protein, 17 aa, Entamoeba invadens
SSCQTAPTNPWDDENDV

SEQ ID NO: 2776967 - protein, 8 aa, Entamoeba invadens
SSCSECKD

SEQ ID NO: 2776968 - protein, 8 aa, Entamoeba invadens
SSCSPTSK

SEQ ID NO: 2776969 - protein, 13 aa, Entamoeba invadens
SSCSSCNGIGPSN

SEQ ID NO: 2776970 - protein, 35 aa, Entamoeba invadens
SSCSSGFKKVGDNCTSCASNGNCNSCDSNENESNR

SEQ ID NO: 2776971 - protein, 35 aa, Entamoeba invadens
SSCSSGFKKVGGECTSCASNGNCNTCDSDENESNR

SEQ ID NO: 2776972 - protein, 14 aa, Entamoeba invadens
SSCSSGKCESCKPN

SEQ ID NO: 2776973 - protein, 17 aa, Entamoeba invadens
SSCSSQTTNCSRCNQNG

SEQ ID NO: 2776974 - protein, 7 aa, Entamoeba invadens
SSCSTCK

SEQ ID NO: 2776975 - protein, 8 aa, Entamoeba invadens
SSCTDTTT

SEQ ID NO: 2776976 - protein, 6 aa, Entamoeba invadens
SSCTNF

SEQ ID NO: 2776977 - protein, 7 aa, Entamoeba invadens
SSCTSDG

SEQ ID NO: 2776978 - protein, 7 aa, Entamoeba invadens
SSCTSKE

SEQ ID NO: 2776979 - protein, 17 aa, Entamoeba invadens
SSCTSSSCSSCSSSCTC

SEQ ID NO: 2776980 - protein, 26 aa, Entamoeba invadens
SSCVTTSTSCSECSSTTYKDESGNCV

SEQ ID NO: 2776981 - protein, 7 aa, Entamoeba invadens
SSCYSSL

SEQ ID NO: 2776982 - protein, 6 aa, Entamoeba invadens
SSDAAI

SEQ ID NO: 2776983 - protein, 39 aa, Entamoeba invadens
SSDAEKDSDAPESNNVASQEETQKDVEQQNQNQETEEIQ

SEQ ID NO: 2776984 - protein, 9 aa, Entamoeba invadens
SSDCTGKPF

SEQ ID NO: 2776985 - protein, 9 aa, Entamoeba invadens
SSDDDNNTV

SEQ ID NO: 2776986 - protein, 7 aa, Entamoeba invadens
SSDDETF

SEQ ID NO: 2776987 - protein, 12 aa, Entamoeba invadens
SSDDTETSPNVG

SEQ ID NO: 2776988 - protein, 4 aa, Entamoeba invadens
SSDE

SEQ ID NO: 2776989 - protein, 6 aa, Entamoeba invadens
SSDECR

SEQ ID NO: 2776990 - protein, 9 aa, Entamoeba invadens
SSDEKNKYY

SEQ ID NO: 2776991 - protein, 9 aa, Entamoeba invadens
SSDENTPSI

SEQ ID NO: 2776992 - protein, 9 aa, Entamoeba invadens
SSDEVPSGY

SEQ ID NO: 2776993 - protein, 28 aa, Entamoeba invadens
SSDFETPKAPEPPKSETLKPSENTERYE

SEQ ID NO: 2776994 - protein, 19 aa, Entamoeba invadens
SSDFNENTSTDCLASNDDL

SEQ ID NO: 2776995 - protein, 7 aa, Entamoeba invadens
SSDGSYC

SEQ ID NO: 2776996 - protein, 8 aa, Entamoeba invadens
SSDHQTFD

SEQ ID NO: 2776997 - protein, 10 aa, Entamoeba invadens
SSDKDATMAK

SEQ ID NO: 2776998 - protein, 9 aa, Entamoeba invadens
SSDKQRSCT

SEQ ID NO: 2776999 - protein, 30 aa, Entamoeba invadens
SSDKYPKSTKGYKCGDCDSTCGNQCSGSTG

SEQ ID NO: 2777000 - protein, 4 aa, Entamoeba invadens
SSDL

SEQ ID NO: 2777001 - protein, 4 aa, Entamoeba invadens
SSDN

SEQ ID NO: 2777002 - protein, 8 aa, Entamoeba invadens
SSDNQVIQ

SEQ ID NO: 2777003 - protein, 8 aa, Entamoeba invadens
SSDNTQFN

SEQ ID NO: 2777004 - protein, 6 aa, Entamoeba invadens
SSDQAH

SEQ ID NO: 2777005 - protein, 10 aa, Entamoeba invadens
SSDRKRRPYD

SEQ ID NO: 2777006 - protein, 5 aa, Entamoeba invadens
SSDSE

SEQ ID NO: 2777007 - protein, 9 aa, Entamoeba invadens
SSDSRMTKT

SEQ ID NO: 2777008 - protein, 8 aa, Entamoeba invadens
SSDSSDPF

SEQ ID NO: 2777009 - protein, 7 aa, Entamoeba invadens
SSDSTHV

SEQ ID NO: 2777010 - protein, 10 aa, Entamoeba invadens
SSDSTRKCKQ

SEQ ID NO: 2777011 - protein, 6 aa, Entamoeba invadens
SSDTPL

SEQ ID NO: 2777012 - protein, 9 aa, Entamoeba invadens
SSDTRGAPP

SEQ ID NO: 2777013 - protein, 7 aa, Entamoeba invadens
SSDVDND

SEQ ID NO: 2777014 - protein, 7 aa, Entamoeba invadens
SSDVISK

SEQ ID NO: 2777015 - protein, 36 aa, Entamoeba invadens
SSDVSGDEFSESVEDEKSPNSLSSESIQNNINPQDL

SEQ ID NO: 2777016 - protein, 10 aa, Entamoeba invadens
SSDVSSNSNH

SEQ ID NO: 2777017 - protein, 12 aa, Entamoeba invadens
SSDYNSGNTEKY

SEQ ID NO: 2777018 - protein, 7 aa, Entamoeba invadens
SSDYSEA

SEQ ID NO: 2777019 - protein, 5 aa, Entamoeba invadens
SSDYV

SEQ ID NO: 2777020 - protein, 4 aa, Entamoeba invadens
SSEA

SEQ ID NO: 2777021 - protein, 14 aa, Entamoeba invadens
SSEASDDEKETLGK

SEQ ID NO: 2777022 - protein, 11 aa, Entamoeba invadens
SSECRKSTNNL

SEQ ID NO: 2777023 - protein, 14 aa, Entamoeba invadens
SSEDIEDDKTITIQ

SEQ ID NO: 2777024 - protein, 13 aa, Entamoeba invadens
SSEDNLEMSENGQ

SEQ ID NO: 2777025 - protein, 6 aa, Entamoeba invadens
SSEECR

SEQ ID NO: 2777026 - protein, 8 aa, Entamoeba invadens
SSEELPDS

SEQ ID NO: 2777027 - protein, 7 aa, Entamoeba invadens
SSEEQDV

SEQ ID NO: 2777028 - protein, 9 aa, Entamoeba invadens
SSEGRDAYS

SEQ ID NO: 2777029 - protein, 13 aa, Entamoeba invadens
SSEGTVLNENNNS

SEQ ID NO: 2777030 - protein, 7 aa, Entamoeba invadens
SSEGVTV

SEQ ID NO: 2777031 - protein, 4 aa, Entamoeba invadens
SSEH

SEQ ID NO: 2777032 - protein, 8 aa, Entamoeba invadens
SSEHTPSN

SEQ ID NO: 2777033 - protein, 6 aa, Entamoeba invadens
SSEITS

SEQ ID NO: 2777034 - protein, 8 aa, Entamoeba invadens
SSEKRADY

SEQ ID NO: 2777035 - protein, 11 aa, Entamoeba invadens
SSEKTTDTDEF

SEQ ID NO: 2777036 - protein, 7 aa, Entamoeba invadens
SSEKVEN

SEQ ID NO: 2777037 - protein, 4 aa, Entamoeba invadens
SSEN

SEQ ID NO: 2777038 - protein, 7 aa, Entamoeba invadens
SSENGTV

SEQ ID NO: 2777039 - protein, 6 aa, Entamoeba invadens
SSENKY

SEQ ID NO: 2777040 - protein, 6 aa, Entamoeba invadens
SSENSV

SEQ ID NO: 2777041 - protein, 9 aa, Entamoeba invadens
SSENTRKQM

SEQ ID NO: 2777042 - protein, 5 aa, Entamoeba invadens
SSEPK

SEQ ID NO: 2777043 - protein, 11 aa, Entamoeba invadens
SSEPVSQNGNP

SEQ ID NO: 2777044 - protein, 5 aa, Entamoeba invadens
SSEQI

SEQ ID NO: 2777045 - protein, 8 aa, Entamoeba invadens
SSERARSS

SEQ ID NO: 2777046 - protein, 9 aa, Entamoeba invadens
SSERNEKTI

SEQ ID NO: 2777047 - protein, 13 aa, Entamoeba invadens
SSERSTALDPDEL

SEQ ID NO: 2777048 - protein, 14 aa, Entamoeba invadens
SSESGCGDCNEKIT

SEQ ID NO: 2777049 - protein, 20 aa, Entamoeba invadens
SSESISTDMSSSPVISTPRY

SEQ ID NO: 2777050 - protein, 7 aa, Entamoeba invadens
SSESKHL

SEQ ID NO: 2777051 - protein, 14 aa, Entamoeba invadens
SSESLEKSEIEGTD

SEQ ID NO: 2777052 - protein, 4 aa, Entamoeba invadens
SSET

SEQ ID NO: 2777053 - protein, 9 aa, Entamoeba invadens
SSETCSASF

SEQ ID NO: 2777054 - protein, 13 aa, Entamoeba invadens
SSETCSASFTNPC

SEQ ID NO: 2777055 - protein, 6 aa, Entamoeba invadens
SSETIP

SEQ ID NO: 2777056 - protein, 6 aa, Entamoeba invadens
SSETNT

SEQ ID NO: 2777057 - protein, 5 aa, Entamoeba invadens
SSEVK

SEQ ID NO: 2777058 - protein, 10 aa, Entamoeba invadens
SSEVSQNRFG

SEQ ID NO: 2777059 - protein, 7 aa, Entamoeba invadens
SSEVTTV

SEQ ID NO: 2777060 - protein, 5 aa, Entamoeba invadens
SSEVV

SEQ ID NO: 2777061 - protein, 6 aa, Entamoeba invadens
SSEVVS

SEQ ID NO: 2777062 - protein, 9 aa, Entamoeba invadens
SSEYRESKE

SEQ ID NO: 2777063 - protein, 21 aa, Entamoeba invadens
SSEYSDQGEHVAKTNSPSVDS

SEQ ID NO: 2777064 - protein, 8 aa, Entamoeba invadens
SSFEESYK

SEQ ID NO: 2777065 - protein, 6 aa, Entamoeba invadens
SSFGSA

SEQ ID NO: 2777066 - protein, 4 aa, Entamoeba invadens
SSFH

SEQ ID NO: 2777067 - protein, 4 aa, Entamoeba invadens
SSFK

SEQ ID NO: 2777068 - protein, 6 aa, Entamoeba invadens
SSFNGL

SEQ ID NO: 2777069 - protein, 6 aa, Entamoeba invadens
SSFPET

SEQ ID NO: 2777070 - protein, 6 aa, Entamoeba invadens
SSFQNE

SEQ ID NO: 2777071 - protein, 14 aa, Entamoeba invadens
SSFRPNQKTTVKES

SEQ ID NO: 2777072 - protein, 6 aa, Entamoeba invadens
SSFTGS

SEQ ID NO: 2777073 - protein, 12 aa, Entamoeba invadens
SSFTGTSLVGKN

SEQ ID NO: 2777074 - protein, 5 aa, Entamoeba invadens
SSFTM

SEQ ID NO: 2777075 - protein, 4 aa, Entamoeba invadens
SSGA

SEQ ID NO: 2777076 - protein, 8 aa, Entamoeba invadens
SSGAFDSV

SEQ ID NO: 2777077 - protein, 6 aa, Entamoeba invadens
SSGAVE

SEQ ID NO: 2777078 - protein, 7 aa, Entamoeba invadens
SSGCKGD

SEQ ID NO: 2777079 - protein, 6 aa, Entamoeba invadens
SSGCQS

SEQ ID NO: 2777080 - protein, 9 aa, Entamoeba invadens
SSGCSQCKD

SEQ ID NO: 2777081 - protein, 6 aa, Entamoeba invadens
SSGECV

SEQ ID NO: 2777082 - protein, 13 aa, Entamoeba invadens
SSGERLENRRNIP

SEQ ID NO: 2777083 - protein, 19 aa, Entamoeba invadens
SSGIGTPTYMSPESLQGLT

SEQ ID NO: 2777084 - protein, 23 aa, Entamoeba invadens
SSGKCKKAVDDSFNTIRDENGLY

SEQ ID NO: 2777085 - protein, 12 aa, Entamoeba invadens
SSGKRKEKPIDM

SEQ ID NO: 2777086 - protein, 6 aa, Entamoeba invadens
SSGKRL

SEQ ID NO: 2777087 - protein, 10 aa, Entamoeba invadens
SSGKRLAKPD

SEQ ID NO: 2777088 - protein, 10 aa, Entamoeba invadens
SSGKRPEIPK

SEQ ID NO: 2777089 - protein, 12 aa, Entamoeba invadens
SSGKRPESIRTI

SEQ ID NO: 2777090 - protein, 17 aa, Entamoeba invadens
SSGKRPQIELEDEEQKA

SEQ ID NO: 2777091 - protein, 8 aa, Entamoeba invadens
SSGKSFND

SEQ ID NO: 2777092 - protein, 13 aa, Entamoeba invadens
SSGKYPKSTESYK

SEQ ID NO: 2777093 - protein, 14 aa, Entamoeba invadens
SSGKYPKSTESYKC

SEQ ID NO: 2777094 - protein, 33 aa, Entamoeba invadens
SSGKYPKSTESYKCGDCDSTCGSQCNTTNGQCT

SEQ ID NO: 2777095 - protein, 12 aa, Entamoeba invadens
SSGKYPNPTTCQ

SEQ ID NO: 2777096 - protein, 14 aa, Entamoeba invadens
SSGLLSSHQSQIRN

SEQ ID NO: 2777097 - protein, 8 aa, Entamoeba invadens
SSGNCGNE

SEQ ID NO: 2777098 - protein, 6 aa, Entamoeba invadens
SSGNTL

SEQ ID NO: 2777099 - protein, 5 aa, Entamoeba invadens
SSGNV

SEQ ID NO: 2777100 - protein, 9 aa, Entamoeba invadens
SSGQQITTS

SEQ ID NO: 2777101 - protein, 5 aa, Entamoeba invadens
SSGRS

SEQ ID NO: 2777102 - protein, 8 aa, Entamoeba invadens
SSGSCSSC

SEQ ID NO: 2777103 - protein, 9 aa, Entamoeba invadens
SSGSVPSLS

SEQ ID NO: 2777104 - protein, 20 aa, Entamoeba invadens
SSGTCSSCTTQTGCSECSSG

SEQ ID NO: 2777105 - protein, 6 aa, Entamoeba invadens
SSGTTL

SEQ ID NO: 2777106 - protein, 15 aa, Entamoeba invadens
SSGYYSSTTGATSCT

SEQ ID NO: 2777107 - protein, 5 aa, Entamoeba invadens
SSHDS

SEQ ID NO: 2777108 - protein, 6 aa, Entamoeba invadens
SSHKDT

SEQ ID NO: 2777109 - protein, 14 aa, Entamoeba invadens
SSHLPNGKCTSCND

SEQ ID NO: 2777110 - protein, 9 aa, Entamoeba invadens
SSHQTADNV

SEQ ID NO: 2777111 - protein, 13 aa, Entamoeba invadens
SSHRRASRDVGTP

SEQ ID NO: 2777112 - protein, 8 aa, Entamoeba invadens
SSIDNPKD

SEQ ID NO: 2777113 - protein, 7 aa, Entamoeba invadens
SSIDPNC

SEQ ID NO: 2777114 - protein, 14 aa, Entamoeba invadens
SSIDSNKHMPYKYS

SEQ ID NO: 2777115 - protein, 12 aa, Entamoeba invadens
SSIEHRKSEEFD

SEQ ID NO: 2777116 - protein, 7 aa, Entamoeba invadens
SSIGGKL

SEQ ID NO: 2777117 - protein, 7 aa, Entamoeba invadens
SSIKTDI

SEQ ID NO: 2777118 - protein, 25 aa, Entamoeba invadens
SSIKTEKNTFKSEDEFSNESVTIGN

SEQ ID NO: 2777119 - protein, 26 aa, Entamoeba invadens
SSIKYSSSQSKKYSNLAEPNTQFESS

SEQ ID NO: 2777120 - protein, 4 aa, Entamoeba invadens
SSIP

SEQ ID NO: 2777121 - protein, 10 aa, Entamoeba invadens
SSIPRTEQMR

SEQ ID NO: 2777122 - protein, 5 aa, Entamoeba invadens
SSIQT

SEQ ID NO: 2777123 - protein, 6 aa, Entamoeba invadens
SSIRID

SEQ ID NO: 2777124 - protein, 7 aa, Entamoeba invadens
SSISHAT

SEQ ID NO: 2777125 - protein, 4 aa, Entamoeba invadens
SSIT

SEQ ID NO: 2777126 - protein, 12 aa, Entamoeba invadens
SSIVSSSNIRTY

SEQ ID NO: 2777127 - protein, 6 aa, Entamoeba invadens
SSKAIV

SEQ ID NO: 2777128 - protein, 7 aa, Entamoeba invadens
SSKASDF

SEQ ID NO: 2777129 - protein, 4 aa, Entamoeba invadens
SSKC

SEQ ID NO: 2777130 - protein, 21 aa, Entamoeba invadens
SSKCTECAAGTRSEYTTSSTK

SEQ ID NO: 2777131 - protein, 8 aa, Entamoeba invadens
SSKDECDK

SEQ ID NO: 2777132 - protein, 12 aa, Entamoeba invadens
SSKDNTEKYTIR

SEQ ID NO: 2777133 - protein, 9 aa, Entamoeba invadens
SSKEDNYKY

SEQ ID NO: 2777134 - protein, 13 aa, Entamoeba invadens
SSKEETQKEISTV

SEQ ID NO: 2777135 - protein, 7 aa, Entamoeba invadens
SSKEFKG

SEQ ID NO: 2777136 - protein, 9 aa, Entamoeba invadens
SSKGDNYKY

SEQ ID NO: 2777137 - protein, 5 aa, Entamoeba invadens
SSKGI

SEQ ID NO: 2777138 - protein, 4 aa, Entamoeba invadens
SSKH

SEQ ID NO: 2777139 - protein, 4 aa, Entamoeba invadens
SSKI

SEQ ID NO: 2777140 - protein, 5 aa, Entamoeba invadens
SSKIE

SEQ ID NO: 2777141 - protein, 6 aa, Entamoeba invadens
SSKIED

SEQ ID NO: 2777142 - protein, 14 aa, Entamoeba invadens
SSKIEPSKLSKYDL

SEQ ID NO: 2777143 - protein, 10 aa, Entamoeba invadens
SSKIKRNKRY

SEQ ID NO: 2777144 - protein, 9 aa, Entamoeba invadens
SSKITTSSQ

SEQ ID NO: 2777145 - protein, 12 aa, Entamoeba invadens
SSKKEKYKKKNT

SEQ ID NO: 2777146 - protein, 8 aa, Entamoeba invadens
SSKKSFED

SEQ ID NO: 2777147 - protein, 15 aa, Entamoeba invadens
SSKKSKYSSLDAKVP

SEQ ID NO: 2777148 - protein, 7 aa, Entamoeba invadens
SSKLTKN

SEQ ID NO: 2777149 - protein, 9 aa, Entamoeba invadens
SSKNENSIK

SEQ ID NO: 2777150 - protein, 5 aa, Entamoeba invadens
SSKNK

SEQ ID NO: 2777151 - protein, 7 aa, Entamoeba invadens
SSKNNKL

SEQ ID NO: 2777152 - protein, 7 aa, Entamoeba invadens
SSKPITG

SEQ ID NO: 2777153 - protein, 16 aa, Entamoeba invadens
SSKPQKGDFHETGGDA

SEQ ID NO: 2777154 - protein, 7 aa, Entamoeba invadens
SSKQVTV

SEQ ID NO: 2777155 - protein, 14 aa, Entamoeba invadens
SSKRLEKLSSMSEE

SEQ ID NO: 2777156 - protein, 7 aa, Entamoeba invadens
SSKRLTT

SEQ ID NO: 2777157 - protein, 6 aa, Entamoeba invadens
SSKRSK

SEQ ID NO: 2777158 - protein, 4 aa, Entamoeba invadens
SSKS

SEQ ID NO: 2777159 - protein, 8 aa, Entamoeba invadens
SSKSAKYV

SEQ ID NO: 2777160 - protein, 10 aa, Entamoeba invadens
SSKTCESLGE

SEQ ID NO: 2777161 - protein, 12 aa, Entamoeba invadens
SSKTDNIGSEAV

SEQ ID NO: 2777162 - protein, 6 aa, Entamoeba invadens
SSKTNL

SEQ ID NO: 2777163 - protein, 22 aa, Entamoeba invadens
SSKTSKKFKRTSKRISKRTTTE

SEQ ID NO: 2777164 - protein, 7 aa, Entamoeba invadens
SSKTTSI

SEQ ID NO: 2777165 - protein, 8 aa, Entamoeba invadens
SSKVPLGG

SEQ ID NO: 2777166 - protein, 6 aa, Entamoeba invadens
SSKYTL

SEQ ID NO: 2777167 - protein, 6 aa, Entamoeba invadens
SSLCGG

SEQ ID NO: 2777168 - protein, 4 aa, Entamoeba invadens
SSLD

SEQ ID NO: 2777169 - protein, 17 aa, Entamoeba invadens
SSLDEISTDQTTRSMTE

SEQ ID NO: 2777170 - protein, 12 aa, Entamoeba invadens
SSLDKTTQSESL

SEQ ID NO: 2777171 - protein, 6 aa, Entamoeba invadens
SSLETS

SEQ ID NO: 2777172 - protein, 6 aa, Entamoeba invadens
SSLGVS

SEQ ID NO: 2777173 - protein, 9 aa, Entamoeba invadens
SSLKNGAAR

SEQ ID NO: 2777174 - protein, 4 aa, Entamoeba invadens
SSLN

SEQ ID NO: 2777175 - protein, 8 aa, Entamoeba invadens
SSLNSSYI

SEQ ID NO: 2777176 - protein, 14 aa, Entamoeba invadens
SSLPKIKKNTFSAS

SEQ ID NO: 2777177 - protein, 13 aa, Entamoeba invadens
SSLPKTDFTSEQC

SEQ ID NO: 2777178 - protein, 7 aa, Entamoeba invadens
SSLPQTD

SEQ ID NO: 2777179 - protein, 7 aa, Entamoeba invadens
SSLQKNT

SEQ ID NO: 2777180 - protein, 4 aa, Entamoeba invadens
SSLR

SEQ ID NO: 2777181 - protein, 6 aa, Entamoeba invadens
SSLRSN

SEQ ID NO: 2777182 - protein, 22 aa, Entamoeba invadens
SSLSESAQKRLKTHDIGSNYSP

SEQ ID NO: 2777183 - protein, 5 aa, Entamoeba invadens
SSLSI

SEQ ID NO: 2777184 - protein, 10 aa, Entamoeba invadens
SSLSKAAQNI

SEQ ID NO: 2777185 - protein, 6 aa, Entamoeba invadens
SSLSLE

SEQ ID NO: 2777186 - protein, 9 aa, Entamoeba invadens
SSLSPDEEA

SEQ ID NO: 2777187 - protein, 5 aa, Entamoeba invadens
SSLSQ

SEQ ID NO: 2777188 - protein, 13 aa, Entamoeba invadens
SSLSQVRTATTPI

SEQ ID NO: 2777189 - protein, 6 aa, Entamoeba invadens
SSLSTR

SEQ ID NO: 2777190 - protein, 4 aa, Entamoeba invadens
SSLT

SEQ ID NO: 2777191 - protein, 12 aa, Entamoeba invadens
SSLTDNTWTPYA

SEQ ID NO: 2777192 - protein, 11 aa, Entamoeba invadens
SSLTYNNHTTP

SEQ ID NO: 2777193 - protein, 7 aa, Entamoeba invadens
SSMGNEY

SEQ ID NO: 2777194 - protein, 26 aa, Entamoeba invadens
SSMSSSTLANAKQPLTLSTSTKKTPL

SEQ ID NO: 2777195 - protein, 7 aa, Entamoeba invadens
SSNAFQG

SEQ ID NO: 2777196 - protein, 22 aa, Entamoeba invadens
SSNASSDSRSESKSDFTDRSGY

SEQ ID NO: 2777197 - protein, 13 aa, Entamoeba invadens
SSNCLESANGQQC

SEQ ID NO: 2777198 - protein, 5 aa, Entamoeba invadens
SSNDI

SEQ ID NO: 2777199 - protein, 9 aa, Entamoeba invadens
SSNDTCQAC

SEQ ID NO: 2777200 - protein, 10 aa, Entamoeba invadens
SSNDTVKKMG

SEQ ID NO: 2777201 - protein, 4 aa, Entamoeba invadens
SSNE

SEQ ID NO: 2777202 - protein, 5 aa, Entamoeba invadens
SSNEC

SEQ ID NO: 2777203 - protein, 11 aa, Entamoeba invadens
SSNEGGKIPVN

SEQ ID NO: 2777204 - protein, 9 aa, Entamoeba invadens
SSNEKCTSC

SEQ ID NO: 2777205 - protein, 11 aa, Entamoeba invadens
SSNFEQSKKEK

SEQ ID NO: 2777206 - protein, 5 aa, Entamoeba invadens
SSNFQ

SEQ ID NO: 2777207 - protein, 6 aa, Entamoeba invadens
SSNGDV

SEQ ID NO: 2777208 - protein, 6 aa, Entamoeba invadens
SSNGDY

SEQ ID NO: 2777209 - protein, 10 aa, Entamoeba invadens
SSNGNCSSCT

SEQ ID NO: 2777210 - protein, 9 aa, Entamoeba invadens
SSNGTCEGD

SEQ ID NO: 2777211 - protein, 5 aa, Entamoeba invadens
SSNGY

SEQ ID NO: 2777212 - protein, 4 aa, Entamoeba invadens
SSNI

SEQ ID NO: 2777213 - protein, 13 aa, Entamoeba invadens
SSNIPPESNTRYT

SEQ ID NO: 2777214 - protein, 5 aa, Entamoeba invadens
SSNIS

SEQ ID NO: 2777215 - protein, 6 aa, Entamoeba invadens
SSNITS

SEQ ID NO: 2777216 - protein, 8 aa, Entamoeba invadens
SSNKCTSC

SEQ ID NO: 2777217 - protein, 9 aa, Entamoeba invadens
SSNKEDITI

SEQ ID NO: 2777218 - protein, 8 aa, Entamoeba invadens
SSNKHTAE

SEQ ID NO: 2777219 - protein, 6 aa, Entamoeba invadens
SSNKIN

SEQ ID NO: 2777220 - protein, 11 aa, Entamoeba invadens
SSNKRSGSTSV

SEQ ID NO: 2777221 - protein, 7 aa, Entamoeba invadens
SSNKSIC

SEQ ID NO: 2777222 - protein, 5 aa, Entamoeba invadens
SSNML

SEQ ID NO: 2777223 - protein, 9 aa, Entamoeba invadens
SSNNDKYEV

SEQ ID NO: 2777224 - protein, 5 aa, Entamoeba invadens
SSNNQ

SEQ ID NO: 2777225 - protein, 5 aa, Entamoeba invadens
SSNNV

SEQ ID NO: 2777226 - protein, 4 aa, Entamoeba invadens
SSNP

SEQ ID NO: 2777227 - protein, 6 aa, Entamoeba invadens
SSNPVQ

SEQ ID NO: 2777228 - protein, 4 aa, Entamoeba invadens
SSNR

SEQ ID NO: 2777229 - protein, 5 aa, Entamoeba invadens
SSNRD

SEQ ID NO: 2777230 - protein, 6 aa, Entamoeba invadens
SSNRMP

SEQ ID NO: 2777231 - protein, 10 aa, Entamoeba invadens
SSNSSSDIQH

SEQ ID NO: 2777232 - protein, 9 aa, Entamoeba invadens
SSNTDGCEE

SEQ ID NO: 2777233 - protein, 5 aa, Entamoeba invadens
SSNTI

SEQ ID NO: 2777234 - protein, 8 aa, Entamoeba invadens
SSNTINIP

SEQ ID NO: 2777235 - protein, 12 aa, Entamoeba invadens
SSNTPNSVSPTI

SEQ ID NO: 2777236 - protein, 5 aa, Entamoeba invadens
SSNTQ

SEQ ID NO: 2777237 - protein, 6 aa, Entamoeba invadens
SSNTQI

SEQ ID NO: 2777238 - protein, 12 aa, Entamoeba invadens
SSNTSNSVYDQN

SEQ ID NO: 2777239 - protein, 59 aa, Entamoeba invadens
SSNYGSSSCTQCSAGKYASGTGSTSCSTCAAGTYSLGGASQCTQCTPGHYSTSGASTCS

SEQ ID NO: 2777240 - protein, 16 aa, Entamoeba invadens
SSNYRTSNNECKPQSD

SEQ ID NO: 2777241 - protein, 6 aa, Entamoeba invadens
SSPDNC

SEQ ID NO: 2777242 - protein, 10 aa, Entamoeba invadens
SSPDTEPVSP

SEQ ID NO: 2777243 - protein, 8 aa, Entamoeba invadens
SSPEGNAL

SEQ ID NO: 2777244 - protein, 4 aa, Entamoeba invadens
SSPF

SEQ ID NO: 2777245 - protein, 17 aa, Entamoeba invadens
SSPFAPTHQSETTDVEI

SEQ ID NO: 2777246 - protein, 7 aa, Entamoeba invadens
SSPGDVE

SEQ ID NO: 2777247 - protein, 7 aa, Entamoeba invadens
SSPGVSN

SEQ ID NO: 2777248 - protein, 4 aa, Entamoeba invadens
SSPH

SEQ ID NO: 2777249 - protein, 15 aa, Entamoeba invadens
SSPHCKQTVPSSKTE

SEQ ID NO: 2777250 - protein, 4 aa, Entamoeba invadens
SSPI

SEQ ID NO: 2777251 - protein, 6 aa, Entamoeba invadens
SSPKGC

SEQ ID NO: 2777252 - protein, 7 aa, Entamoeba invadens
SSPKKRG

SEQ ID NO: 2777253 - protein, 17 aa, Entamoeba invadens
SSPKLKGSSPLVSPRTQ

SEQ ID NO: 2777254 - protein, 9 aa, Entamoeba invadens
SSPKQDVQN

SEQ ID NO: 2777255 - protein, 5 aa, Entamoeba invadens
SSPKR

SEQ ID NO: 2777256 - protein, 6 aa, Entamoeba invadens
SSPLQQ

SEQ ID NO: 2777257 - protein, 8 aa, Entamoeba invadens
SSPNAEGQ

SEQ ID NO: 2777258 - protein, 9 aa, Entamoeba invadens
SSPNEMDGK

SEQ ID NO: 2777259 - protein, 7 aa, Entamoeba invadens
SSPNGQL

SEQ ID NO: 2777260 - protein, 7 aa, Entamoeba invadens
SSPNPIT

SEQ ID NO: 2777261 - protein, 14 aa, Entamoeba invadens
SSPPKKWNDDTTNK

SEQ ID NO: 2777262 - protein, 5 aa, Entamoeba invadens
SSPQD

SEQ ID NO: 2777263 - protein, 6 aa, Entamoeba invadens
SSPQVK

SEQ ID NO: 2777264 - protein, 11 aa, Entamoeba invadens
SSPRDTSSSTA

SEQ ID NO: 2777265 - protein, 7 aa, Entamoeba invadens
SSPRKRG

SEQ ID NO: 2777266 - protein, 9 aa, Entamoeba invadens
SSPSALNPE

SEQ ID NO: 2777267 - protein, 19 aa, Entamoeba invadens
SSPTLQSAITGSVSGGKNP

SEQ ID NO: 2777268 - protein, 9 aa, Entamoeba invadens
SSPTNQLDN

SEQ ID NO: 2777269 - protein, 7 aa, Entamoeba invadens
SSPTSRV

SEQ ID NO: 2777270 - protein, 12 aa, Entamoeba invadens
SSPVTSSTKPSF

SEQ ID NO: 2777271 - protein, 7 aa, Entamoeba invadens
SSQALSH

SEQ ID NO: 2777272 - protein, 6 aa, Entamoeba invadens
SSQCES

SEQ ID NO: 2777273 - protein, 8 aa, Entamoeba invadens
SSQCPTSP

SEQ ID NO: 2777274 - protein, 8 aa, Entamoeba invadens
SSQCTSCK

SEQ ID NO: 2777275 - protein, 10 aa, Entamoeba invadens
SSQDGLDSRD

SEQ ID NO: 2777276 - protein, 13 aa, Entamoeba invadens
SSQDPQSDGINGI

SEQ ID NO: 2777277 - protein, 13 aa, Entamoeba invadens
SSQFSEELNEVSG

SEQ ID NO: 2777278 - protein, 7 aa, Entamoeba invadens
SSQGENV

SEQ ID NO: 2777279 - protein, 7 aa, Entamoeba invadens
SSQGYSE

SEQ ID NO: 2777280 - protein, 4 aa, Entamoeba invadens
SSQH

SEQ ID NO: 2777281 - protein, 5 aa, Entamoeba invadens
SSQIE

SEQ ID NO: 2777282 - protein, 15 aa, Entamoeba invadens
SSQIYNKTTQKCDNN

SEQ ID NO: 2777283 - protein, 16 aa, Entamoeba invadens
SSQIYNKTTQKCDSSA

SEQ ID NO: 2777284 - protein, 8 aa, Entamoeba invadens
SSQKSCDK

SEQ ID NO: 2777285 - protein, 5 aa, Entamoeba invadens
SSQLI

SEQ ID NO: 2777286 - protein, 10 aa, Entamoeba invadens
SSQNDVSASR

SEQ ID NO: 2777287 - protein, 12 aa, Entamoeba invadens
SSQNEKSNKYGF

SEQ ID NO: 2777288 - protein, 8 aa, Entamoeba invadens
SSQNNLAG

SEQ ID NO: 2777289 - protein, 7 aa, Entamoeba invadens
SSQNSEE

SEQ ID NO: 2777290 - protein, 7 aa, Entamoeba invadens
SSQNSVC

SEQ ID NO: 2777291 - protein, 12 aa, Entamoeba invadens
SSQNTPQTTNFD

SEQ ID NO: 2777292 - protein, 4 aa, Entamoeba invadens
SSQQ

SEQ ID NO: 2777293 - protein, 6 aa, Entamoeba invadens
SSQRTL

SEQ ID NO: 2777294 - protein, 4 aa, Entamoeba invadens
SSQS

SEQ ID NO: 2777295 - protein, 6 aa, Entamoeba invadens
SSQSAC

SEQ ID NO: 2777296 - protein, 16 aa, Entamoeba invadens
SSQSELTSCANKTTAG

SEQ ID NO: 2777297 - protein, 7 aa, Entamoeba invadens
SSQSNIC

SEQ ID NO: 2777298 - protein, 10 aa, Entamoeba invadens
SSQSVPTNVE

SEQ ID NO: 2777299 - protein, 4 aa, Entamoeba invadens
SSQT

SEQ ID NO: 2777300 - protein, 6 aa, Entamoeba invadens
SSQTEG

SEQ ID NO: 2777301 - protein, 5 aa, Entamoeba invadens
SSQTT

SEQ ID NO: 2777302 - protein, 6 aa, Entamoeba invadens
SSQVDS

SEQ ID NO: 2777303 - protein, 5 aa, Entamoeba invadens
SSQVS

SEQ ID NO: 2777304 - protein, 6 aa, Entamoeba invadens
SSQYDG

SEQ ID NO: 2777305 - protein, 4 aa, Entamoeba invadens
SSRI

SEQ ID NO: 2777306 - protein, 5 aa, Entamoeba invadens
SSRID

SEQ ID NO: 2777307 - protein, 6 aa, Entamoeba invadens
SSRKGR

SEQ ID NO: 2777308 - protein, 8 aa, Entamoeba invadens
SSRKSKFI

SEQ ID NO: 2777309 - protein, 4 aa, Entamoeba invadens
SSRN

SEQ ID NO: 2777310 - protein, 8 aa, Entamoeba invadens
SSRREEYN

SEQ ID NO: 2777311 - protein, 12 aa, Entamoeba invadens
SSRRSDIDNIRR

SEQ ID NO: 2777312 - protein, 6 aa, Entamoeba invadens
SSRSDE

SEQ ID NO: 2777313 - protein, 13 aa, Entamoeba invadens
SSRTSVTDGYQPQ

SEQ ID NO: 2777314 - protein, 7 aa, Entamoeba invadens
SSRVKSG

SEQ ID NO: 2777315 - protein, 21 aa, Entamoeba invadens
SSSCKKCTNGCSKCSDANTCT

SEQ ID NO: 2777316 - protein, 14 aa, Entamoeba invadens
SSSCKTGYDQTDSS

SEQ ID NO: 2777317 - protein, 20 aa, Entamoeba invadens
SSSCSECAGGKYSTEGSSTC

SEQ ID NO: 2777318 - protein, 24 aa, Entamoeba invadens
SSSCTKCKAGTYADEQGSSECKTC

SEQ ID NO: 2777319 - protein, 6 aa, Entamoeba invadens
SSSDCL

SEQ ID NO: 2777320 - protein, 7 aa, Entamoeba invadens
SSSDIGD

SEQ ID NO: 2777321 - protein, 5 aa, Entamoeba invadens
SSSED

SEQ ID NO: 2777322 - protein, 6 aa, Entamoeba invadens
SSSEGA

SEQ ID NO: 2777323 - protein, 9 aa, Entamoeba invadens
SSSEGRCSA

SEQ ID NO: 2777324 - protein, 5 aa, Entamoeba invadens
SSSEI

SEQ ID NO: 2777325 - protein, 11 aa, Entamoeba invadens
SSSERKSANNL

SEQ ID NO: 2777326 - protein, 4 aa, Entamoeba invadens
SSSF

SEQ ID NO: 2777327 - protein, 5 aa, Entamoeba invadens
SSSFE

SEQ ID NO: 2777328 - protein, 4 aa, Entamoeba invadens
SSSG

SEQ ID NO: 2777329 - protein, 13 aa, Entamoeba invadens
SSSGDEKKEERAR

SEQ ID NO: 2777330 - protein, 7 aa, Entamoeba invadens
SSSGDVE

SEQ ID NO: 2777331 - protein, 9 aa, Entamoeba invadens
SSSGQSVID

SEQ ID NO: 2777332 - protein, 9 aa, Entamoeba invadens
SSSGSTSCS

SEQ ID NO: 2777333 - protein, 5 aa, Entamoeba invadens
SSSIS

SEQ ID NO: 2777334 - protein, 4 aa, Entamoeba invadens
SSSK

SEQ ID NO: 2777335 - protein, 7 aa, Entamoeba invadens
SSSKERM

SEQ ID NO: 2777336 - protein, 19 aa, Entamoeba invadens
SSSKKGMNSAMTGTIGGTD

SEQ ID NO: 2777337 - protein, 7 aa, Entamoeba invadens
SSSKRAR

SEQ ID NO: 2777338 - protein, 8 aa, Entamoeba invadens
SSSKRGFK

SEQ ID NO: 2777339 - protein, 7 aa, Entamoeba invadens
SSSKRNV

SEQ ID NO: 2777340 - protein, 8 aa, Entamoeba invadens
SSSKTTQL

SEQ ID NO: 2777341 - protein, 13 aa, Entamoeba invadens
SSSLANSELCEDN

SEQ ID NO: 2777342 - protein, 7 aa, Entamoeba invadens
SSSLVEN

SEQ ID NO: 2777343 - protein, 9 aa, Entamoeba invadens
SSSNEQPKT

SEQ ID NO: 2777344 - protein, 7 aa, Entamoeba invadens
SSSNERD

SEQ ID NO: 2777345 - protein, 9 aa, Entamoeba invadens
SSSNHETPK

SEQ ID NO: 2777346 - protein, 5 aa, Entamoeba invadens
SSSNI

SEQ ID NO: 2777347 - protein, 21 aa, Entamoeba invadens
SSSNNTCSKCADGYSLSADNM

SEQ ID NO: 2777348 - protein, 15 aa, Entamoeba invadens
SSSNTIKSTLKGAGC

SEQ ID NO: 2777349 - protein, 10 aa, Entamoeba invadens
SSSNTRCDKA

SEQ ID NO: 2777350 - protein, 25 aa, Entamoeba invadens
SSSNVDPRTLPRPQGHYTPPPQQPN

SEQ ID NO: 2777351 - protein, 9 aa, Entamoeba invadens
SSSPKSLQC

SEQ ID NO: 2777352 - protein, 20 aa, Entamoeba invadens
SSSPTPATQLSAPSTPHKAS

SEQ ID NO: 2777353 - protein, 7 aa, Entamoeba invadens
SSSQIDQ

SEQ ID NO: 2777354 - protein, 6 aa, Entamoeba invadens
SSSQIY

SEQ ID NO: 2777355 - protein, 9 aa, Entamoeba invadens
SSSQNEIDE

SEQ ID NO: 2777356 - protein, 10 aa, Entamoeba invadens
SSSQQYFPTK

SEQ ID NO: 2777357 - protein, 6 aa, Entamoeba invadens
SSSQTI

SEQ ID NO: 2777358 - protein, 7 aa, Entamoeba invadens
SSSRVPD

SEQ ID NO: 2777359 - protein, 4 aa, Entamoeba invadens
SSSS

SEQ ID NO: 2777360 - protein, 7 aa, Entamoeba invadens
SSSSAKN

SEQ ID NO: 2777361 - protein, 15 aa, Entamoeba invadens
SSSSEIVGYEGSQLK

SEQ ID NO: 2777362 - protein, 11 aa, Entamoeba invadens
SSSSESVQGGV

SEQ ID NO: 2777363 - protein, 7 aa, Entamoeba invadens
SSSSETQ

SEQ ID NO: 2777364 - protein, 6 aa, Entamoeba invadens
SSSSHV

SEQ ID NO: 2777365 - protein, 7 aa, Entamoeba invadens
SSSSHVE

SEQ ID NO: 2777366 - protein, 14 aa, Entamoeba invadens
SSSSIKITGSATFE

SEQ ID NO: 2777367 - protein, 8 aa, Entamoeba invadens
SSSSISVS

SEQ ID NO: 2777368 - protein, 5 aa, Entamoeba invadens
SSSSL

SEQ ID NO: 2777369 - protein, 6 aa, Entamoeba invadens
SSSSLT

SEQ ID NO: 2777370 - protein, 10 aa, Entamoeba invadens
SSSSNTTDNF

SEQ ID NO: 2777371 - protein, 12 aa, Entamoeba invadens
SSSSSNPEEELA

SEQ ID NO: 2777372 - protein, 9 aa, Entamoeba invadens
SSSSSQYSF

SEQ ID NO: 2777373 - protein, 10 aa, Entamoeba invadens
SSSSSRNCTT

SEQ ID NO: 2777374 - protein, 5 aa, Entamoeba invadens
SSSST

SEQ ID NO: 2777375 - protein, 7 aa, Entamoeba invadens
SSSSVDY

SEQ ID NO: 2777376 - protein, 5 aa, Entamoeba invadens
SSSSY

SEQ ID NO: 2777377 - protein, 4 aa, Entamoeba invadens
SSST

SEQ ID NO: 2777378 - protein, 6 aa, Entamoeba invadens
SSSTFE

SEQ ID NO: 2777379 - protein, 18 aa, Entamoeba invadens
SSSTGTRKVSKGKGEETV

SEQ ID NO: 2777380 - protein, 5 aa, Entamoeba invadens
SSSTK

SEQ ID NO: 2777381 - protein, 6 aa, Entamoeba invadens
SSSTKR

SEQ ID NO: 2777382 - protein, 6 aa, Entamoeba invadens
SSSTNC

SEQ ID NO: 2777383 - protein, 9 aa, Entamoeba invadens
SSSTPEASL

SEQ ID NO: 2777384 - protein, 7 aa, Entamoeba invadens
SSSTQRI

SEQ ID NO: 2777385 - protein, 26 aa, Entamoeba invadens
SSSTSSLSSSSSSKSDKDNSVSLSPK

SEQ ID NO: 2777386 - protein, 9 aa, Entamoeba invadens
SSSTSTTQT

SEQ ID NO: 2777387 - protein, 5 aa, Entamoeba invadens
SSSTT

SEQ ID NO: 2777388 - protein, 27 aa, Entamoeba invadens
SSSTTSTSESEEEPAQSQPKLTEVKVA

SEQ ID NO: 2777389 - protein, 13 aa, Entamoeba invadens
SSSTWKPTGSDLE

SEQ ID NO: 2777390 - protein, 7 aa, Entamoeba invadens
SSSVDYR

SEQ ID NO: 2777391 - protein, 7 aa, Entamoeba invadens
SSSVEPN

SEQ ID NO: 2777392 - protein, 5 aa, Entamoeba invadens
SSSVK

SEQ ID NO: 2777393 - protein, 5 aa, Entamoeba invadens
SSSVN

SEQ ID NO: 2777394 - protein, 6 aa, Entamoeba invadens
SSSVNG

SEQ ID NO: 2777395 - protein, 6 aa, Entamoeba invadens
SSSVNV

SEQ ID NO: 2777396 - protein, 24 aa, Entamoeba invadens
SSSYGNGKNVSTSPATIATKETYT

SEQ ID NO: 2777397 - protein, 6 aa, Entamoeba invadens
SSSYND

SEQ ID NO: 2777398 - protein, 11 aa, Entamoeba invadens
SSSYSKCSQCA

SEQ ID NO: 2777399 - protein, 13 aa, Entamoeba invadens
SSTAKQNAIDNRA

SEQ ID NO: 2777400 - protein, 19 aa, Entamoeba invadens
SSTATKLSCNKDQKYDFNT

SEQ ID NO: 2777401 - protein, 18 aa, Entamoeba invadens
SSTCGGQCNTMSGECTGC

SEQ ID NO: 2777402 - protein, 6 aa, Entamoeba invadens
SSTCIS

SEQ ID NO: 2777403 - protein, 8 aa, Entamoeba invadens
SSTCNSCS

SEQ ID NO: 2777404 - protein, 5 aa, Entamoeba invadens
SSTCT

SEQ ID NO: 2777405 - protein, 6 aa, Entamoeba invadens
SSTDDL

SEQ ID NO: 2777406 - protein, 7 aa, Entamoeba invadens
SSTDGFA

SEQ ID NO: 2777407 - protein, 7 aa, Entamoeba invadens
SSTDPKK

SEQ ID NO: 2777408 - protein, 13 aa, Entamoeba invadens
SSTEQTIISTTDQ

SEQ ID NO: 2777409 - protein, 7 aa, Entamoeba invadens
SSTETTR

SEQ ID NO: 2777410 - protein, 13 aa, Entamoeba invadens
SSTFEKPTDYYST

SEQ ID NO: 2777411 - protein, 4 aa, Entamoeba invadens
SSTG

SEQ ID NO: 2777412 - protein, 5 aa, Entamoeba invadens
SSTGC

SEQ ID NO: 2777413 - protein, 7 aa, Entamoeba invadens
SSTGCRT

SEQ ID NO: 2777414 - protein, 8 aa, Entamoeba invadens
SSTGGESY

SEQ ID NO: 2777415 - protein, 21 aa, Entamoeba invadens
SSTGTEFEEDDCNSELMTDEN

SEQ ID NO: 2777416 - protein, 4 aa, Entamoeba invadens
SSTH

SEQ ID NO: 2777417 - protein, 4 aa, Entamoeba invadens
SSTI

SEQ ID NO: 2777418 - protein, 10 aa, Entamoeba invadens
SSTIGKITGT

SEQ ID NO: 2777419 - protein, 6 aa, Entamoeba invadens
SSTKDN

SEQ ID NO: 2777420 - protein, 5 aa, Entamoeba invadens
SSTKI

SEQ ID NO: 2777421 - protein, 7 aa, Entamoeba invadens
SSTKSNE

SEQ ID NO: 2777422 - protein, 6 aa, Entamoeba invadens
SSTKST

SEQ ID NO: 2777423 - protein, 8 aa, Entamoeba invadens
SSTKTGKC

SEQ ID NO: 2777424 - protein, 7 aa, Entamoeba invadens
SSTLETT

SEQ ID NO: 2777425 - protein, 7 aa, Entamoeba invadens
SSTLQTK

SEQ ID NO: 2777426 - protein, 5 aa, Entamoeba invadens
SSTLT

SEQ ID NO: 2777427 - protein, 23 aa, Entamoeba invadens
SSTLTQKPTATAEFKSENTAYIE

SEQ ID NO: 2777428 - protein, 16 aa, Entamoeba invadens
SSTNCTSCKDGSSYFS

SEQ ID NO: 2777429 - protein, 8 aa, Entamoeba invadens
SSTNDSYD

SEQ ID NO: 2777430 - protein, 6 aa, Entamoeba invadens
SSTNQN

SEQ ID NO: 2777431 - protein, 9 aa, Entamoeba invadens
SSTNTCNAC

SEQ ID NO: 2777432 - protein, 5 aa, Entamoeba invadens
SSTPL

SEQ ID NO: 2777433 - protein, 8 aa, Entamoeba invadens
SSTPPALN

SEQ ID NO: 2777434 - protein, 6 aa, Entamoeba invadens
SSTPSR

SEQ ID NO: 2777435 - protein, 7 aa, Entamoeba invadens
SSTPTIT

SEQ ID NO: 2777436 - protein, 11 aa, Entamoeba invadens
SSTQCTSCGNG

SEQ ID NO: 2777437 - protein, 6 aa, Entamoeba invadens
SSTQKI

SEQ ID NO: 2777438 - protein, 6 aa, Entamoeba invadens
SSTQTL

SEQ ID NO: 2777439 - protein, 11 aa, Entamoeba invadens
SSTSCNTSSGI

SEQ ID NO: 2777440 - protein, 9 aa, Entamoeba invadens
SSTSNNVNI

SEQ ID NO: 2777441 - protein, 12 aa, Entamoeba invadens
SSTSPDNTNNNK

SEQ ID NO: 2777442 - protein, 6 aa, Entamoeba invadens
SSTSSF

SEQ ID NO: 2777443 - protein, 8 aa, Entamoeba invadens
SSTSSNQC

SEQ ID NO: 2777444 - protein, 7 aa, Entamoeba invadens
SSTSTSI

SEQ ID NO: 2777445 - protein, 4 aa, Entamoeba invadens
SSTT

SEQ ID NO: 2777446 - protein, 10 aa, Entamoeba invadens
SSTTATKECD

SEQ ID NO: 2777447 - protein, 8 aa, Entamoeba invadens
SSTTCSSC

SEQ ID NO: 2777448 - protein, 7 aa, Entamoeba invadens
SSTTDGF

SEQ ID NO: 2777449 - protein, 7 aa, Entamoeba invadens
SSTTDIA

SEQ ID NO: 2777450 - protein, 7 aa, Entamoeba invadens
SSTTDND

SEQ ID NO: 2777451 - protein, 5 aa, Entamoeba invadens
SSTTK

SEQ ID NO: 2777452 - protein, 7 aa, Entamoeba invadens
SSTTKTF

SEQ ID NO: 2777453 - protein, 7 aa, Entamoeba invadens
SSTTNIN

SEQ ID NO: 2777454 - protein, 6 aa, Entamoeba invadens
SSTTQI

SEQ ID NO: 2777455 - protein, 8 aa, Entamoeba invadens
SSTTTNCA

SEQ ID NO: 2777456 - protein, 11 aa, Entamoeba invadens
SSTTTPTYTIE

SEQ ID NO: 2777457 - protein, 11 aa, Entamoeba invadens
SSTTTPTYTIS

SEQ ID NO: 2777458 - protein, 8 aa, Entamoeba invadens
SSTTTYHK

SEQ ID NO: 2777459 - protein, 5 aa, Entamoeba invadens
SSTVK

SEQ ID NO: 2777460 - protein, 10 aa, Entamoeba invadens
SSTVPPQSVK

SEQ ID NO: 2777461 - protein, 5 aa, Entamoeba invadens
SSTYL

SEQ ID NO: 2777462 - protein, 14 aa, Entamoeba invadens
SSTYSVVDNPSPEC

SEQ ID NO: 2777463 - protein, 7 aa, Entamoeba invadens
SSVASEV

SEQ ID NO: 2777464 - protein, 12 aa, Entamoeba invadens
SSVASKKTEREQ

SEQ ID NO: 2777465 - protein, 4 aa, Entamoeba invadens
SSVD

SEQ ID NO: 2777466 - protein, 8 aa, Entamoeba invadens
SSVDGTTI

SEQ ID NO: 2777467 - protein, 6 aa, Entamoeba invadens
SSVDKK

SEQ ID NO: 2777468 - protein, 10 aa, Entamoeba invadens
SSVDNNNNIN

SEQ ID NO: 2777469 - protein, 5 aa, Entamoeba invadens
SSVDT

SEQ ID NO: 2777470 - protein, 7 aa, Entamoeba invadens
SSVEEEY

SEQ ID NO: 2777471 - protein, 9 aa, Entamoeba invadens
SSVGNDVPK

SEQ ID NO: 2777472 - protein, 25 aa, Entamoeba invadens
SSVPKEVTEDKEKDGETDEKETQIV

SEQ ID NO: 2777473 - protein, 27 aa, Entamoeba invadens
SSVPSSGVSSVSTSVSSSARTSIDMES

SEQ ID NO: 2777474 - protein, 7 aa, Entamoeba invadens
SSVSDGC

SEQ ID NO: 2777475 - protein, 6 aa, Entamoeba invadens
SSVSEV

SEQ ID NO: 2777476 - protein, 6 aa, Entamoeba invadens
SSVSGQ

SEQ ID NO: 2777477 - protein, 5 aa, Entamoeba invadens
SSVSN

SEQ ID NO: 2777478 - protein, 4 aa, Entamoeba invadens
SSVT

SEQ ID NO: 2777479 - protein, 8 aa, Entamoeba invadens
SSVTAPTA

SEQ ID NO: 2777480 - protein, 8 aa, Entamoeba invadens
SSVTGGRQ

SEQ ID NO: 2777481 - protein, 4 aa, Entamoeba invadens
SSVV

SEQ ID NO: 2777482 - protein, 7 aa, Entamoeba invadens
SSYCTEG

SEQ ID NO: 2777483 - protein, 6 aa, Entamoeba invadens
SSYDKC

SEQ ID NO: 2777484 - protein, 7 aa, Entamoeba invadens
SSYEEYS

SEQ ID NO: 2777485 - protein, 20 aa, Entamoeba invadens
SSYEMKSNGLNGCKSTNEVP

SEQ ID NO: 2777486 - protein, 13 aa, Entamoeba invadens
SSYGKTIQKPIKS

SEQ ID NO: 2777487 - protein, 55 aa, Entamoeba invadens
SSYGSSSCTKCSAGKYASGTGSTSCSNCAAGTYSGTGDSSCTKCSAGYYSGTGAS

SEQ ID NO: 2777488 - protein, 5 aa, Entamoeba invadens
SSYKI

SEQ ID NO: 2777489 - protein, 5 aa, Entamoeba invadens
SSYKT

SEQ ID NO: 2777490 - protein, 7 aa, Entamoeba invadens
SSYPKDE

SEQ ID NO: 2777491 - protein, 5 aa, Entamoeba invadens
SSYPY

SEQ ID NO: 2777492 - protein, 9 aa, Entamoeba invadens
SSYPYPTSC

SEQ ID NO: 2777493 - protein, 4 aa, Entamoeba invadens
SSYS

SEQ ID NO: 2777494 - protein, 10 aa, Entamoeba invadens
SSYTKSPGDT

SEQ ID NO: 2777495 - protein, 10 aa, Entamoeba invadens
SSYTKSPSDT

SEQ ID NO: 2777496 - protein, 12 aa, Entamoeba invadens
SSYTPTNPVSST

SEQ ID NO: 2777497 - protein, 5 aa, Entamoeba invadens
SSYTT

SEQ ID NO: 2777498 - protein, 16 aa, Entamoeba invadens
SSYTTRDIQSPKVSPF

SEQ ID NO: 2777499 - protein, 4 aa, Entamoeba invadens
SSYV

SEQ ID NO: 2777500 - protein, 4 aa, Entamoeba invadens
STAA

SEQ ID NO: 2777501 - protein, 15 aa, Entamoeba invadens
STAASHQTNEKAKIR

SEQ ID NO: 2777502 - protein, 7 aa, Entamoeba invadens
STADKTT

SEQ ID NO: 2777503 - protein, 10 aa, Entamoeba invadens
STAEGQNTTG

SEQ ID NO: 2777504 - protein, 8 aa, Entamoeba invadens
STAKINRP

SEQ ID NO: 2777505 - protein, 8 aa, Entamoeba invadens
STAKLDQF

SEQ ID NO: 2777506 - protein, 9 aa, Entamoeba invadens
STAPPKSTL

SEQ ID NO: 2777507 - protein, 6 aa, Entamoeba invadens
STARDE

SEQ ID NO: 2777508 - protein, 8 aa, Entamoeba invadens
STARSQYS

SEQ ID NO: 2777509 - protein, 7 aa, Entamoeba invadens
STASGFS

SEQ ID NO: 2777510 - protein, 18 aa, Entamoeba invadens
STATKTNLQNNKYQSKPV

SEQ ID NO: 2777511 - protein, 8 aa, Entamoeba invadens
STATPRTF

SEQ ID NO: 2777512 - protein, 10 aa, Entamoeba invadens
STCAASGCTA

SEQ ID NO: 2777513 - protein, 7 aa, Entamoeba invadens
STCATTG

SEQ ID NO: 2777514 - protein, 12 aa, Entamoeba invadens
STCDNQCNTENG

SEQ ID NO: 2777515 - protein, 10 aa, Entamoeba invadens
STCDTNFGSE

SEQ ID NO: 2777516 - protein, 7 aa, Entamoeba invadens
STCEKNG

SEQ ID NO: 2777517 - protein, 5 aa, Entamoeba invadens
STCEN

SEQ ID NO: 2777518 - protein, 7 aa, Entamoeba invadens
STCEPDK

SEQ ID NO: 2777519 - protein, 11 aa, Entamoeba invadens
STCESNGCNTV

SEQ ID NO: 2777520 - protein, 11 aa, Entamoeba invadens
STCESNGCNTY

SEQ ID NO: 2777521 - protein, 9 aa, Entamoeba invadens
STCETCNQK

SEQ ID NO: 2777522 - protein, 12 aa, Entamoeba invadens
STCGGACNGVSG

SEQ ID NO: 2777523 - protein, 17 aa, Entamoeba invadens
STCGGKCEPTNGHCTGC

SEQ ID NO: 2777524 - protein, 13 aa, Entamoeba invadens
STCGGKCQNTTGY

SEQ ID NO: 2777525 - protein, 12 aa, Entamoeba invadens
STCGGNCNTTNG

SEQ ID NO: 2777526 - protein, 12 aa, Entamoeba invadens
STCGGSCDATNG

SEQ ID NO: 2777527 - protein, 16 aa, Entamoeba invadens
STCGNQCDGKDGHCTG

SEQ ID NO: 2777528 - protein, 6 aa, Entamoeba invadens
STCGNY

SEQ ID NO: 2777529 - protein, 17 aa, Entamoeba invadens
STCGSCDKTNGNCTTCN

SEQ ID NO: 2777530 - protein, 9 aa, Entamoeba invadens
STCGTNGQR

SEQ ID NO: 2777531 - protein, 9 aa, Entamoeba invadens
STCKEGSFS

SEQ ID NO: 2777532 - protein, 9 aa, Entamoeba invadens
STCKESNKC

SEQ ID NO: 2777533 - protein, 14 aa, Entamoeba invadens
STCKPNTCDSTSGF

SEQ ID NO: 2777534 - protein, 14 aa, Entamoeba invadens
STCKPNTCDSTSGI

SEQ ID NO: 2777535 - protein, 13 aa, Entamoeba invadens
STCKPNTCDSTTG

SEQ ID NO: 2777536 - protein, 14 aa, Entamoeba invadens
STCKPNTCNSTSGY

SEQ ID NO: 2777537 - protein, 39 aa, Entamoeba invadens
STCLSSSKKTCEECESGISSNGNCGEHPTNCKYNKKTKL

SEQ ID NO: 2777538 - protein, 11 aa, Entamoeba invadens
STCNATGNSII

SEQ ID NO: 2777539 - protein, 17 aa, Entamoeba invadens
STCNNDNIDENEECDGG

SEQ ID NO: 2777540 - protein, 8 aa, Entamoeba invadens
STCNNENS

SEQ ID NO: 2777541 - protein, 5 aa, Entamoeba invadens
STCNR

SEQ ID NO: 2777542 - protein, 22 aa, Entamoeba invadens
STCNSCDKTNGNCTTCNSGNIL

SEQ ID NO: 2777543 - protein, 7 aa, Entamoeba invadens
STCNTKS

SEQ ID NO: 2777544 - protein, 5 aa, Entamoeba invadens
STCQK

SEQ ID NO: 2777545 - protein, 15 aa, Entamoeba invadens
STCQSCDKTTGECTS

SEQ ID NO: 2777546 - protein, 4 aa, Entamoeba invadens
STCS

SEQ ID NO: 2777547 - protein, 12 aa, Entamoeba invadens
STCSADGQSCSV

SEQ ID NO: 2777548 - protein, 7 aa, Entamoeba invadens
STCSDKT

SEQ ID NO: 2777549 - protein, 9 aa, Entamoeba invadens
STCSKCDSN

SEQ ID NO: 2777550 - protein, 13 aa, Entamoeba invadens
STCTGAGSSNCNS

SEQ ID NO: 2777551 - protein, 6 aa, Entamoeba invadens
STCTGE

SEQ ID NO: 2777552 - protein, 13 aa, Entamoeba invadens
STCTITGTDFETK

SEQ ID NO: 2777553 - protein, 12 aa, Entamoeba invadens
STCVTEGKTPFG

SEQ ID NO: 2777554 - protein, 9 aa, Entamoeba invadens
STDDHKTEV

SEQ ID NO: 2777555 - protein, 15 aa, Entamoeba invadens
STDDQNTKETSCSYA

SEQ ID NO: 2777556 - protein, 5 aa, Entamoeba invadens
STDEN

SEQ ID NO: 2777557 - protein, 6 aa, Entamoeba invadens
STDFST

SEQ ID NO: 2777558 - protein, 6 aa, Entamoeba invadens
STDFTT

SEQ ID NO: 2777559 - protein, 9 aa, Entamoeba invadens
STDKQTSQV

SEQ ID NO: 2777560 - protein, 8 aa, Entamoeba invadens
STDNSRTC

SEQ ID NO: 2777561 - protein, 8 aa, Entamoeba invadens
STDNSRTY

SEQ ID NO: 2777562 - protein, 7 aa, Entamoeba invadens
STDPFEE

SEQ ID NO: 2777563 - protein, 6 aa, Entamoeba invadens
STDSDL

SEQ ID NO: 2777564 - protein, 10 aa, Entamoeba invadens
STDSKGTTLH

SEQ ID NO: 2777565 - protein, 8 aa, Entamoeba invadens
STDSSKDL

SEQ ID NO: 2777566 - protein, 16 aa, Entamoeba invadens
STDTGCVKSDNFATAT

SEQ ID NO: 2777567 - protein, 9 aa, Entamoeba invadens
STDTNDNTV

SEQ ID NO: 2777568 - protein, 20 aa, Entamoeba invadens
STDTPSCKNCKNDTATLDGD

SEQ ID NO: 2777569 - protein, 6 aa, Entamoeba invadens
STDYSC

SEQ ID NO: 2777570 - protein, 9 aa, Entamoeba invadens
STDYSVEEE

SEQ ID NO: 2777571 - protein, 42 aa, Entamoeba invadens
STEAEKKDMPPPAQNAPVDPQQEVQQPAAVENEDEKSKSSDS

SEQ ID NO: 2777572 - protein, 4 aa, Entamoeba invadens
STEC

SEQ ID NO: 2777573 - protein, 27 aa, Entamoeba invadens
STECKKCDKKSGACTSCEVGNKRVDNG

SEQ ID NO: 2777574 - protein, 13 aa, Entamoeba invadens
STECKKCDRKSGA

SEQ ID NO: 2777575 - protein, 28 aa, Entamoeba invadens
STECKKCDRKSGACTSCEAGNKRADNSC

SEQ ID NO: 2777576 - protein, 28 aa, Entamoeba invadens
STECKKCDRKSGACTSCEVGNKRADNSC

SEQ ID NO: 2777577 - protein, 27 aa, Entamoeba invadens
STECKKCDRKSGACTSCEVGNKRVNNS

SEQ ID NO: 2777578 - protein, 27 aa, Entamoeba invadens
STECKKCDRKSGGCTSCEVGNKRVNNS

SEQ ID NO: 2777579 - protein, 27 aa, Entamoeba invadens
STECKNCDRKSGACTSCEVGNKRVDNS

SEQ ID NO: 2777580 - protein, 6 aa, Entamoeba invadens
STEDKN

SEQ ID NO: 2777581 - protein, 8 aa, Entamoeba invadens
STEDPQFE

SEQ ID NO: 2777582 - protein, 8 aa, Entamoeba invadens
STEDTKKC

SEQ ID NO: 2777583 - protein, 17 aa, Entamoeba invadens
STEEATTMDDQVIPFYL

SEQ ID NO: 2777584 - protein, 7 aa, Entamoeba invadens
STEFARE

SEQ ID NO: 2777585 - protein, 9 aa, Entamoeba invadens
STEGKTVEK

SEQ ID NO: 2777586 - protein, 5 aa, Entamoeba invadens
STEIP

SEQ ID NO: 2777587 - protein, 5 aa, Entamoeba invadens
STEKC

SEQ ID NO: 2777588 - protein, 9 aa, Entamoeba invadens
STEKTLERG

SEQ ID NO: 2777589 - protein, 7 aa, Entamoeba invadens
STELSQS

SEQ ID NO: 2777590 - protein, 20 aa, Entamoeba invadens
STEPVQKDENGKCDLKQEQC

SEQ ID NO: 2777591 - protein, 6 aa, Entamoeba invadens
STERPV

SEQ ID NO: 2777592 - protein, 6 aa, Entamoeba invadens
STERTI

SEQ ID NO: 2777593 - protein, 11 aa, Entamoeba invadens
STESAVNGNSQ

SEQ ID NO: 2777594 - protein, 7 aa, Entamoeba invadens
STESECD

SEQ ID NO: 2777595 - protein, 16 aa, Entamoeba invadens
STESFDNSRGIGDFSD

SEQ ID NO: 2777596 - protein, 6 aa, Entamoeba invadens
STESKQ

SEQ ID NO: 2777597 - protein, 7 aa, Entamoeba invadens
STESSCR

SEQ ID NO: 2777598 - protein, 17 aa, Entamoeba invadens
STESTEISTASSEEEDC

SEQ ID NO: 2777599 - protein, 7 aa, Entamoeba invadens
STETDEL

SEQ ID NO: 2777600 - protein, 7 aa, Entamoeba invadens
STETEKC

SEQ ID NO: 2777601 - protein, 9 aa, Entamoeba invadens
STETPETRR

SEQ ID NO: 2777602 - protein, 20 aa, Entamoeba invadens
STEVTSENKELQKDAITNSD

SEQ ID NO: 2777603 - protein, 4 aa, Entamoeba invadens
STEY

SEQ ID NO: 2777604 - protein, 4 aa, Entamoeba invadens
STFE

SEQ ID NO: 2777605 - protein, 6 aa, Entamoeba invadens
STFEDQ

SEQ ID NO: 2777606 - protein, 25 aa, Entamoeba invadens
STFQAGTKSLKYTDWDADKSPMTYQ

SEQ ID NO: 2777607 - protein, 5 aa, Entamoeba invadens
STFTM

SEQ ID NO: 2777608 - protein, 6 aa, Entamoeba invadens
STFTMN

SEQ ID NO: 2777609 - protein, 8 aa, Entamoeba invadens
STGAAGEV

SEQ ID NO: 2777610 - protein, 7 aa, Entamoeba invadens
STGCERC

SEQ ID NO: 2777611 - protein, 6 aa, Entamoeba invadens
STGEAP

SEQ ID NO: 2777612 - protein, 5 aa, Entamoeba invadens
STGEI

SEQ ID NO: 2777613 - protein, 8 aa, Entamoeba invadens
STGEIAEL

SEQ ID NO: 2777614 - protein, 5 aa, Entamoeba invadens
STGEQ

SEQ ID NO: 2777615 - protein, 8 aa, Entamoeba invadens
STGERSEF

SEQ ID NO: 2777616 - protein, 5 aa, Entamoeba invadens
STGEW

SEQ ID NO: 2777617 - protein, 5 aa, Entamoeba invadens
STGEY

SEQ ID NO: 2777618 - protein, 4 aa, Entamoeba invadens
STGG

SEQ ID NO: 2777619 - protein, 5 aa, Entamoeba invadens
STGGM

SEQ ID NO: 2777620 - protein, 7 aa, Entamoeba invadens
STGGPNS

SEQ ID NO: 2777621 - protein, 6 aa, Entamoeba invadens
STGGVT

SEQ ID NO: 2777622 - protein, 11 aa, Entamoeba invadens
STGKEPDPHCS

SEQ ID NO: 2777623 - protein, 12 aa, Entamoeba invadens
STGKNDDHCESC

SEQ ID NO: 2777624 - protein, 10 aa, Entamoeba invadens
STGKRECTTC

SEQ ID NO: 2777625 - protein, 10 aa, Entamoeba invadens
STGKSVPPKI

SEQ ID NO: 2777626 - protein, 4 aa, Entamoeba invadens
STGL

SEQ ID NO: 2777627 - protein, 4 aa, Entamoeba invadens
STGN

SEQ ID NO: 2777628 - protein, 7 aa, Entamoeba invadens
STGNCQA

SEQ ID NO: 2777629 - protein, 17 aa, Entamoeba invadens
STGNNDCVTKVVATSSS

SEQ ID NO: 2777630 - protein, 5 aa, Entamoeba invadens
STGQN

SEQ ID NO: 2777631 - protein, 10 aa, Entamoeba invadens
STGRVTYTKR

SEQ ID NO: 2777632 - protein, 7 aa, Entamoeba invadens
STGSAQK

SEQ ID NO: 2777633 - protein, 16 aa, Entamoeba invadens
STGSPTYTINPTTSSK

SEQ ID NO: 2777634 - protein, 8 aa, Entamoeba invadens
STGSTSIS

SEQ ID NO: 2777635 - protein, 5 aa, Entamoeba invadens
STGTI

SEQ ID NO: 2777636 - protein, 11 aa, Entamoeba invadens
STGTNELSLSS

SEQ ID NO: 2777637 - protein, 14 aa, Entamoeba invadens
STGTYSSNENSDTC

SEQ ID NO: 2777638 - protein, 5 aa, Entamoeba invadens
STHFN

SEQ ID NO: 2777639 - protein, 5 aa, Entamoeba invadens
STHLD

SEQ ID NO: 2777640 - protein, 5 aa, Entamoeba invadens
STHQI

SEQ ID NO: 2777641 - protein, 19 aa, Entamoeba invadens
STHSGAVTLTDNSKLTKGY

SEQ ID NO: 2777642 - protein, 7 aa, Entamoeba invadens
STHSYSI

SEQ ID NO: 2777643 - protein, 10 aa, Entamoeba invadens
STHTCNDGQY

SEQ ID NO: 2777644 - protein, 4 aa, Entamoeba invadens
STIE

SEQ ID NO: 2777645 - protein, 5 aa, Entamoeba invadens
STIEE

SEQ ID NO: 2777646 - protein, 9 aa, Entamoeba invadens
STIENNGTM

SEQ ID NO: 2777647 - protein, 16 aa, Entamoeba invadens
STIESQGVSNAKKDID

SEQ ID NO: 2777648 - protein, 6 aa, Entamoeba invadens
STIKEE

SEQ ID NO: 2777649 - protein, 8 aa, Entamoeba invadens
STIKERSG

SEQ ID NO: 2777650 - protein, 6 aa, Entamoeba invadens
STINIT

SEQ ID NO: 2777651 - protein, 6 aa, Entamoeba invadens
STIPYG

SEQ ID NO: 2777652 - protein, 5 aa, Entamoeba invadens
STIQT

SEQ ID NO: 2777653 - protein, 5 aa, Entamoeba invadens
STIRN

SEQ ID NO: 2777654 - protein, 15 aa, Entamoeba invadens
STISDLSQQSTTTKP

SEQ ID NO: 2777655 - protein, 6 aa, Entamoeba invadens
STISNS

SEQ ID NO: 2777656 - protein, 4 aa, Entamoeba invadens
STIT

SEQ ID NO: 2777657 - protein, 5 aa, Entamoeba invadens
STITG

SEQ ID NO: 2777658 - protein, 6 aa, Entamoeba invadens
STITIQ

SEQ ID NO: 2777659 - protein, 10 aa, Entamoeba invadens
STITPQNTSE

SEQ ID NO: 2777660 - protein, 14 aa, Entamoeba invadens
STITSSTNKTCSKC

SEQ ID NO: 2777661 - protein, 12 aa, Entamoeba invadens
STITTETVTSNY

SEQ ID NO: 2777662 - protein, 5 aa, Entamoeba invadens
STKCD

SEQ ID NO: 2777663 - protein, 5 aa, Entamoeba invadens
STKEN

SEQ ID NO: 2777664 - protein, 9 aa, Entamoeba invadens
STKENNERL

SEQ ID NO: 2777665 - protein, 5 aa, Entamoeba invadens
STKEY

SEQ ID NO: 2777666 - protein, 9 aa, Entamoeba invadens
STKHQNGKN

SEQ ID NO: 2777667 - protein, 4 aa, Entamoeba invadens
STKI

SEQ ID NO: 2777668 - protein, 9 aa, Entamoeba invadens
STKIDPEEI

SEQ ID NO: 2777669 - protein, 5 aa, Entamoeba invadens
STKIP

SEQ ID NO: 2777670 - protein, 13 aa, Entamoeba invadens
STKISTKIDPDEL

SEQ ID NO: 2777671 - protein, 6 aa, Entamoeba invadens
STKKNI

SEQ ID NO: 2777672 - protein, 5 aa, Entamoeba invadens
STKKQ

SEQ ID NO: 2777673 - protein, 6 aa, Entamoeba invadens
STKLDH

SEQ ID NO: 2777674 - protein, 7 aa, Entamoeba invadens
STKLGQT

SEQ ID NO: 2777675 - protein, 14 aa, Entamoeba invadens
STKNATDKYEIRTN

SEQ ID NO: 2777676 - protein, 9 aa, Entamoeba invadens
STKNKTQDV

SEQ ID NO: 2777677 - protein, 12 aa, Entamoeba invadens
STKNNTEKYTIR

SEQ ID NO: 2777678 - protein, 8 aa, Entamoeba invadens
STKPEEIG

SEQ ID NO: 2777679 - protein, 33 aa, Entamoeba invadens
STKPENKYRFSGETSPFADIPEDRGDKAGKRSS

SEQ ID NO: 2777680 - protein, 6 aa, Entamoeba invadens
STKPVF

SEQ ID NO: 2777681 - protein, 9 aa, Entamoeba invadens
STKQCEGCD

SEQ ID NO: 2777682 - protein, 6 aa, Entamoeba invadens
STKQNY

SEQ ID NO: 2777683 - protein, 8 aa, Entamoeba invadens
STKQQYQA

SEQ ID NO: 2777684 - protein, 9 aa, Entamoeba invadens
STKSASMNI

SEQ ID NO: 2777685 - protein, 9 aa, Entamoeba invadens
STKSDDFRL

SEQ ID NO: 2777686 - protein, 6 aa, Entamoeba invadens
STKSDR

SEQ ID NO: 2777687 - protein, 6 aa, Entamoeba invadens
STKSRV

SEQ ID NO: 2777688 - protein, 12 aa, Entamoeba invadens
STKTDQCESCST

SEQ ID NO: 2777689 - protein, 15 aa, Entamoeba invadens
STKTNQSDKIEFTSN

SEQ ID NO: 2777690 - protein, 9 aa, Entamoeba invadens
STKTQGEKF

SEQ ID NO: 2777691 - protein, 14 aa, Entamoeba invadens
STKTSANKYTIRTE

SEQ ID NO: 2777692 - protein, 7 aa, Entamoeba invadens
STKTTGL

SEQ ID NO: 2777693 - protein, 6 aa, Entamoeba invadens
STKTYS

SEQ ID NO: 2777694 - protein, 8 aa, Entamoeba invadens
STKYFNPQ

SEQ ID NO: 2777695 - protein, 10 aa, Entamoeba invadens
STLCDKDKRK

SEQ ID NO: 2777696 - protein, 18 aa, Entamoeba invadens
STLDTSNTDCDKAKPITS

SEQ ID NO: 2777697 - protein, 6 aa, Entamoeba invadens
STLEAE

SEQ ID NO: 2777698 - protein, 15 aa, Entamoeba invadens
STLEGGCATGNVSGC

SEQ ID NO: 2777699 - protein, 6 aa, Entamoeba invadens
STLENT

SEQ ID NO: 2777700 - protein, 4 aa, Entamoeba invadens
STLH

SEQ ID NO: 2777701 - protein, 8 aa, Entamoeba invadens
STLKNTNK

SEQ ID NO: 2777702 - protein, 9 aa, Entamoeba invadens
STLKTNKID

SEQ ID NO: 2777703 - protein, 23 aa, Entamoeba invadens
STLKTTTQCPRGYTSSENGKCQA

SEQ ID NO: 2777704 - protein, 5 aa, Entamoeba invadens
STLMT

SEQ ID NO: 2777705 - protein, 4 aa, Entamoeba invadens
STLN

SEQ ID NO: 2777706 - protein, 6 aa, Entamoeba invadens
STLNKE

SEQ ID NO: 2777707 - protein, 15 aa, Entamoeba invadens
STLPGENEGTRRKQW

SEQ ID NO: 2777708 - protein, 9 aa, Entamoeba invadens
STLPSPYFG

SEQ ID NO: 2777709 - protein, 9 aa, Entamoeba invadens
STLQGEKKE

SEQ ID NO: 2777710 - protein, 11 aa, Entamoeba invadens
STLSADATKDG

SEQ ID NO: 2777711 - protein, 4 aa, Entamoeba invadens
STLT

SEQ ID NO: 2777712 - protein, 5 aa, Entamoeba invadens
STLTA

SEQ ID NO: 2777713 - protein, 6 aa, Entamoeba invadens
STLTMN

SEQ ID NO: 2777714 - protein, 19 aa, Entamoeba invadens
STLTSKGAEDLKISSDKYY

SEQ ID NO: 2777715 - protein, 5 aa, Entamoeba invadens
STLTT

SEQ ID NO: 2777716 - protein, 9 aa, Entamoeba invadens
STLTTTSTN

SEQ ID NO: 2777717 - protein, 7 aa, Entamoeba invadens
STLYTTG

SEQ ID NO: 2777718 - protein, 11 aa, Entamoeba invadens
STMDSTPPIYT

SEQ ID NO: 2777719 - protein, 6 aa, Entamoeba invadens
STMKSS

SEQ ID NO: 2777720 - protein, 10 aa, Entamoeba invadens
STMNGDSGAK

SEQ ID NO: 2777721 - protein, 12 aa, Entamoeba invadens
STMPDTDCRTAR

SEQ ID NO: 2777722 - protein, 10 aa, Entamoeba invadens
STNAAPTKES

SEQ ID NO: 2777723 - protein, 5 aa, Entamoeba invadens
STNCP

SEQ ID NO: 2777724 - protein, 19 aa, Entamoeba invadens
STNDLGDEVTEGGDNFSLG

SEQ ID NO: 2777725 - protein, 5 aa, Entamoeba invadens
STNDT

SEQ ID NO: 2777726 - protein, 6 aa, Entamoeba invadens
STNEKG

SEQ ID NO: 2777727 - protein, 8 aa, Entamoeba invadens
STNENGCV

SEQ ID NO: 2777728 - protein, 7 aa, Entamoeba invadens
STNERSK

SEQ ID NO: 2777729 - protein, 9 aa, Entamoeba invadens
STNESKEFT

SEQ ID NO: 2777730 - protein, 9 aa, Entamoeba invadens
STNESNHIE

SEQ ID NO: 2777731 - protein, 6 aa, Entamoeba invadens
STNETN

SEQ ID NO: 2777732 - protein, 4 aa, Entamoeba invadens
STNF

SEQ ID NO: 2777733 - protein, 6 aa, Entamoeba invadens
STNFGS

SEQ ID NO: 2777734 - protein, 12 aa, Entamoeba invadens
STNFKTSSGECL

SEQ ID NO: 2777735 - protein, 12 aa, Entamoeba invadens
STNFKTTSGNCL

SEQ ID NO: 2777736 - protein, 12 aa, Entamoeba invadens
STNFKTTSGSCL

SEQ ID NO: 2777737 - protein, 6 aa, Entamoeba invadens
STNFNN

SEQ ID NO: 2777738 - protein, 6 aa, Entamoeba invadens
STNGKC

SEQ ID NO: 2777739 - protein, 6 aa, Entamoeba invadens
STNGYC

SEQ ID NO: 2777740 - protein, 22 aa, Entamoeba invadens
STNKCKHCSSPCDTCTGPSNGT

SEQ ID NO: 2777741 - protein, 9 aa, Entamoeba invadens
STNKCTSCD

SEQ ID NO: 2777742 - protein, 11 aa, Entamoeba invadens
STNKEGVKDLG

SEQ ID NO: 2777743 - protein, 12 aa, Entamoeba invadens
STNKSSSCTPCN

SEQ ID NO: 2777744 - protein, 8 aa, Entamoeba invadens
STNLYSQA

SEQ ID NO: 2777745 - protein, 7 aa, Entamoeba invadens
STNMKES

SEQ ID NO: 2777746 - protein, 5 aa, Entamoeba invadens
STNMN

SEQ ID NO: 2777747 - protein, 5 aa, Entamoeba invadens
STNNM

SEQ ID NO: 2777748 - protein, 16 aa, Entamoeba invadens
STNNPDENPPQPAAKM

SEQ ID NO: 2777749 - protein, 5 aa, Entamoeba invadens
STNNQ

SEQ ID NO: 2777750 - protein, 11 aa, Entamoeba invadens
STNQTPEVPYG

SEQ ID NO: 2777751 - protein, 5 aa, Entamoeba invadens
STNRI

SEQ ID NO: 2777752 - protein, 8 aa, Entamoeba invadens
STNSCEKC

SEQ ID NO: 2777753 - protein, 15 aa, Entamoeba invadens
STNSECSQCDDGYYA

SEQ ID NO: 2777754 - protein, 5 aa, Entamoeba invadens
STNSF

SEQ ID NO: 2777755 - protein, 8 aa, Entamoeba invadens
STNSSEFY

SEQ ID NO: 2777756 - protein, 6 aa, Entamoeba invadens
STNTEA

SEQ ID NO: 2777757 - protein, 5 aa, Entamoeba invadens
STNTL

SEQ ID NO: 2777758 - protein, 10 aa, Entamoeba invadens
STNTSEESYS

SEQ ID NO: 2777759 - protein, 7 aa, Entamoeba invadens
STNTTTV

SEQ ID NO: 2777760 - protein, 16 aa, Entamoeba invadens
STNVSTKLTDFGSSRN

SEQ ID NO: 2777761 - protein, 10 aa, Entamoeba invadens
STNYKTNDGE

SEQ ID NO: 2777762 - protein, 12 aa, Entamoeba invadens
STNYKTSNGGCL

SEQ ID NO: 2777763 - protein, 16 aa, Entamoeba invadens
STNYKTWSGDCKPQNS

SEQ ID NO: 2777764 - protein, 12 aa, Entamoeba invadens
STNYRTKSGKCL

SEQ ID NO: 2777765 - protein, 15 aa, Entamoeba invadens
STNYRTKSGKCLPQS

SEQ ID NO: 2777766 - protein, 16 aa, Entamoeba invadens
STNYRTSNNECKPQSD

SEQ ID NO: 2777767 - protein, 14 aa, Entamoeba invadens
STNYTTKGGDCLPQ

SEQ ID NO: 2777768 - protein, 5 aa, Entamoeba invadens
STPAI

SEQ ID NO: 2777769 - protein, 10 aa, Entamoeba invadens
STPASGAVGA

SEQ ID NO: 2777770 - protein, 5 aa, Entamoeba invadens
STPAY

SEQ ID NO: 2777771 - protein, 6 aa, Entamoeba invadens
STPFDY

SEQ ID NO: 2777772 - protein, 6 aa, Entamoeba invadens
STPFHT

SEQ ID NO: 2777773 - protein, 11 aa, Entamoeba invadens
STPGSRGSDSL

SEQ ID NO: 2777774 - protein, 9 aa, Entamoeba invadens
STPKITSIG

SEQ ID NO: 2777775 - protein, 11 aa, Entamoeba invadens
STPKLQNIKEE

SEQ ID NO: 2777776 - protein, 14 aa, Entamoeba invadens
STPKTTVSCQNSRI

SEQ ID NO: 2777777 - protein, 6 aa, Entamoeba invadens
STPKTV

SEQ ID NO: 2777778 - protein, 5 aa, Entamoeba invadens
STPLN

SEQ ID NO: 2777779 - protein, 13 aa, Entamoeba invadens
STPNLTSKQNDEF

SEQ ID NO: 2777780 - protein, 5 aa, Entamoeba invadens
STPNT

SEQ ID NO: 2777781 - protein, 4 aa, Entamoeba invadens
STPS

SEQ ID NO: 2777782 - protein, 6 aa, Entamoeba invadens
STPSFP

SEQ ID NO: 2777783 - protein, 9 aa, Entamoeba invadens
STPSGCTAC

SEQ ID NO: 2777784 - protein, 7 aa, Entamoeba invadens
STPSPVT

SEQ ID NO: 2777785 - protein, 9 aa, Entamoeba invadens
STPSTHCEP

SEQ ID NO: 2777786 - protein, 7 aa, Entamoeba invadens
STPSVQP

SEQ ID NO: 2777787 - protein, 7 aa, Entamoeba invadens
STPTTDT

SEQ ID NO: 2777788 - protein, 6 aa, Entamoeba invadens
STPTVD

SEQ ID NO: 2777789 - protein, 7 aa, Entamoeba invadens
STPVSVK

SEQ ID NO: 2777790 - protein, 6 aa, Entamoeba invadens
STQEFT

SEQ ID NO: 2777791 - protein, 7 aa, Entamoeba invadens
STQESDI

SEQ ID NO: 2777792 - protein, 4 aa, Entamoeba invadens
STQF

SEQ ID NO: 2777793 - protein, 7 aa, Entamoeba invadens
STQHNEN

SEQ ID NO: 2777794 - protein, 4 aa, Entamoeba invadens
STQI

SEQ ID NO: 2777795 - protein, 9 aa, Entamoeba invadens
STQIERGVS

SEQ ID NO: 2777796 - protein, 5 aa, Entamoeba invadens
STQIG

SEQ ID NO: 2777797 - protein, 7 aa, Entamoeba invadens
STQKGNL

SEQ ID NO: 2777798 - protein, 5 aa, Entamoeba invadens
STQKI

SEQ ID NO: 2777799 - protein, 11 aa, Entamoeba invadens
STQKKEQRQSV

SEQ ID NO: 2777800 - protein, 17 aa, Entamoeba invadens
STQKTDKKTKSVKRGYK

SEQ ID NO: 2777801 - protein, 20 aa, Entamoeba invadens
STQLEESKSDTQNGKGMKNN

SEQ ID NO: 2777802 - protein, 9 aa, Entamoeba invadens
STQLEKTKS

SEQ ID NO: 2777803 - protein, 26 aa, Entamoeba invadens
STQLGECPQCEPGSISTTINATTCTP

SEQ ID NO: 2777804 - protein, 10 aa, Entamoeba invadens
STQNAVVSSN

SEQ ID NO: 2777805 - protein, 6 aa, Entamoeba invadens
STQNID

SEQ ID NO: 2777806 - protein, 12 aa, Entamoeba invadens
STQQKKVGNSAG

SEQ ID NO: 2777807 - protein, 7 aa, Entamoeba invadens
STQSPAA

SEQ ID NO: 2777808 - protein, 4 aa, Entamoeba invadens
STQW

SEQ ID NO: 2777809 - protein, 15 aa, Entamoeba invadens
STRAEEKKDEDDWGD

SEQ ID NO: 2777810 - protein, 5 aa, Entamoeba invadens
STRES

SEQ ID NO: 2777811 - protein, 10 aa, Entamoeba invadens
STRESVGSTK

SEQ ID NO: 2777812 - protein, 8 aa, Entamoeba invadens
STRGCTTC

SEQ ID NO: 2777813 - protein, 11 aa, Entamoeba invadens
STRGYNEDTIE

SEQ ID NO: 2777814 - protein, 7 aa, Entamoeba invadens
STRIDPN

SEQ ID NO: 2777815 - protein, 6 aa, Entamoeba invadens
STRIPP

SEQ ID NO: 2777816 - protein, 13 aa, Entamoeba invadens
STRITDMENTRNT

SEQ ID NO: 2777817 - protein, 5 aa, Entamoeba invadens
STRKC

SEQ ID NO: 2777818 - protein, 9 aa, Entamoeba invadens
STRKLSQDQ

SEQ ID NO: 2777819 - protein, 19 aa, Entamoeba invadens
STRLDPDELKTEKKLGEGS

SEQ ID NO: 2777820 - protein, 9 aa, Entamoeba invadens
STRLDPQEI

SEQ ID NO: 2777821 - protein, 7 aa, Entamoeba invadens
STRLNPN

SEQ ID NO: 2777822 - protein, 11 aa, Entamoeba invadens
STRPPGSVNES

SEQ ID NO: 2777823 - protein, 4 aa, Entamoeba invadens
STRS

SEQ ID NO: 2777824 - protein, 11 aa, Entamoeba invadens
STRSTTISSLS

SEQ ID NO: 2777825 - protein, 6 aa, Entamoeba invadens
STRTQN

SEQ ID NO: 2777826 - protein, 4 aa, Entamoeba invadens
STSA

SEQ ID NO: 2777827 - protein, 4 aa, Entamoeba invadens
STSD

SEQ ID NO: 2777828 - protein, 15 aa, Entamoeba invadens
STSDASKQKSVSQLQ

SEQ ID NO: 2777829 - protein, 5 aa, Entamoeba invadens
STSDG

SEQ ID NO: 2777830 - protein, 7 aa, Entamoeba invadens
STSDIES

SEQ ID NO: 2777831 - protein, 7 aa, Entamoeba invadens
STSDNRI

SEQ ID NO: 2777832 - protein, 8 aa, Entamoeba invadens
STSEAPFK

SEQ ID NO: 2777833 - protein, 5 aa, Entamoeba invadens
STSEH

SEQ ID NO: 2777834 - protein, 10 aa, Entamoeba invadens
STSESCTERA

SEQ ID NO: 2777835 - protein, 14 aa, Entamoeba invadens
STSETSTIDGDGSI

SEQ ID NO: 2777836 - protein, 4 aa, Entamoeba invadens
STSF

SEQ ID NO: 2777837 - protein, 8 aa, Entamoeba invadens
STSFKQQE

SEQ ID NO: 2777838 - protein, 7 aa, Entamoeba invadens
STSGKCV

SEQ ID NO: 2777839 - protein, 9 aa, Entamoeba invadens
STSGNLPFS

SEQ ID NO: 2777840 - protein, 25 aa, Entamoeba invadens
STSGSRSVAVSPPLTPKLKAGNQAN

SEQ ID NO: 2777841 - protein, 5 aa, Entamoeba invadens
STSHM

SEQ ID NO: 2777842 - protein, 6 aa, Entamoeba invadens
STSIGN

SEQ ID NO: 2777843 - protein, 6 aa, Entamoeba invadens
STSINP

SEQ ID NO: 2777844 - protein, 8 aa, Entamoeba invadens
STSLPTDT

SEQ ID NO: 2777845 - protein, 5 aa, Entamoeba invadens
STSNC

SEQ ID NO: 2777846 - protein, 7 aa, Entamoeba invadens
STSNDTC

SEQ ID NO: 2777847 - protein, 9 aa, Entamoeba invadens
STSNDTESA

SEQ ID NO: 2777848 - protein, 5 aa, Entamoeba invadens
STSPA

SEQ ID NO: 2777849 - protein, 9 aa, Entamoeba invadens
STSPNECEP

SEQ ID NO: 2777850 - protein, 12 aa, Entamoeba invadens
STSQSTKLTIPK

SEQ ID NO: 2777851 - protein, 5 aa, Entamoeba invadens
STSSD

SEQ ID NO: 2777852 - protein, 5 aa, Entamoeba invadens
STSSI

SEQ ID NO: 2777853 - protein, 7 aa, Entamoeba invadens
STSSPHR

SEQ ID NO: 2777854 - protein, 6 aa, Entamoeba invadens
STSTAT

SEQ ID NO: 2777855 - protein, 5 aa, Entamoeba invadens
STSTV

SEQ ID NO: 2777856 - protein, 4 aa, Entamoeba invadens
STSV

SEQ ID NO: 2777857 - protein, 9 aa, Entamoeba invadens
STSWTPDED

SEQ ID NO: 2777858 - protein, 16 aa, Entamoeba invadens
STSYYDKTTNRCVNRN

SEQ ID NO: 2777859 - protein, 19 aa, Entamoeba invadens
STTAGPEKTCTLNEEGGLD

SEQ ID NO: 2777860 - protein, 6 aa, Entamoeba invadens
STTCKK

SEQ ID NO: 2777861 - protein, 10 aa, Entamoeba invadens
STTCSSRNFD

SEQ ID NO: 2777862 - protein, 16 aa, Entamoeba invadens
STTCTDKCNTSTGACT

SEQ ID NO: 2777863 - protein, 4 aa, Entamoeba invadens
STTD

SEQ ID NO: 2777864 - protein, 10 aa, Entamoeba invadens
STTDDLASQQ

SEQ ID NO: 2777865 - protein, 5 aa, Entamoeba invadens
STTDI

SEQ ID NO: 2777866 - protein, 15 aa, Entamoeba invadens
STTDNTEKYTIRTEP

SEQ ID NO: 2777867 - protein, 14 aa, Entamoeba invadens
STTDSILSNDPNSR

SEQ ID NO: 2777868 - protein, 14 aa, Entamoeba invadens
STTDSVTKCKTCED

SEQ ID NO: 2777869 - protein, 5 aa, Entamoeba invadens
STTER

SEQ ID NO: 2777870 - protein, 17 aa, Entamoeba invadens
STTFQDQDTAPIGIAYA

SEQ ID NO: 2777871 - protein, 4 aa, Entamoeba invadens
STTG

SEQ ID NO: 2777872 - protein, 10 aa, Entamoeba invadens
STTGKCTSCS

SEQ ID NO: 2777873 - protein, 5 aa, Entamoeba invadens
STTGL

SEQ ID NO: 2777874 - protein, 7 aa, Entamoeba invadens
STTGTEF

SEQ ID NO: 2777875 - protein, 7 aa, Entamoeba invadens
STTGTTK

SEQ ID NO: 2777876 - protein, 6 aa, Entamoeba invadens
STTGVA

SEQ ID NO: 2777877 - protein, 4 aa, Entamoeba invadens
STTI

SEQ ID NO: 2777878 - protein, 5 aa, Entamoeba invadens
STTIQ

SEQ ID NO: 2777879 - protein, 10 aa, Entamoeba invadens
STTIQDKEKI

SEQ ID NO: 2777880 - protein, 5 aa, Entamoeba invadens
STTIS

SEQ ID NO: 2777881 - protein, 10 aa, Entamoeba invadens
STTITGTTTI

SEQ ID NO: 2777882 - protein, 4 aa, Entamoeba invadens
STTK

SEQ ID NO: 2777883 - protein, 7 aa, Entamoeba invadens
STTKPFY

SEQ ID NO: 2777884 - protein, 6 aa, Entamoeba invadens
STTKYR

SEQ ID NO: 2777885 - protein, 4 aa, Entamoeba invadens
STTL

SEQ ID NO: 2777886 - protein, 6 aa, Entamoeba invadens
STTLED

SEQ ID NO: 2777887 - protein, 5 aa, Entamoeba invadens
STTLS

SEQ ID NO: 2777888 - protein, 14 aa, Entamoeba invadens
STTNCRTSQYSNAN

SEQ ID NO: 2777889 - protein, 6 aa, Entamoeba invadens
STTNEV

SEQ ID NO: 2777890 - protein, 5 aa, Entamoeba invadens
STTNR

SEQ ID NO: 2777891 - protein, 6 aa, Entamoeba invadens
STTNSI

SEQ ID NO: 2777892 - protein, 10 aa, Entamoeba invadens
STTNTVTPAN

SEQ ID NO: 2777893 - protein, 6 aa, Entamoeba invadens
STTPDM

SEQ ID NO: 2777894 - protein, 10 aa, Entamoeba invadens
STTPEKYPEL

SEQ ID NO: 2777895 - protein, 6 aa, Entamoeba invadens
STTPKF

SEQ ID NO: 2777896 - protein, 9 aa, Entamoeba invadens
STTPSPNNT

SEQ ID NO: 2777897 - protein, 5 aa, Entamoeba invadens
STTSA

SEQ ID NO: 2777898 - protein, 10 aa, Entamoeba invadens
STTSAECTQC

SEQ ID NO: 2777899 - protein, 14 aa, Entamoeba invadens
STTSDCDQYSIRTN

SEQ ID NO: 2777900 - protein, 15 aa, Entamoeba invadens
STTSGACTSCREGEY

SEQ ID NO: 2777901 - protein, 5 aa, Entamoeba invadens
STTSH

SEQ ID NO: 2777902 - protein, 8 aa, Entamoeba invadens
STTSISNL

SEQ ID NO: 2777903 - protein, 6 aa, Entamoeba invadens
STTSPE

SEQ ID NO: 2777904 - protein, 6 aa, Entamoeba invadens
STTSSE

SEQ ID NO: 2777905 - protein, 8 aa, Entamoeba invadens
STTSTGTI

SEQ ID NO: 2777906 - protein, 16 aa, Entamoeba invadens
STTSTHCNSCKSNSHL

SEQ ID NO: 2777907 - protein, 6 aa, Entamoeba invadens
STTSVE

SEQ ID NO: 2777908 - protein, 4 aa, Entamoeba invadens
STTT

SEQ ID NO: 2777909 - protein, 6 aa, Entamoeba invadens
STTTDP

SEQ ID NO: 2777910 - protein, 8 aa, Entamoeba invadens
STTTDTTI

SEQ ID NO: 2777911 - protein, 8 aa, Entamoeba invadens
STTTENKN

SEQ ID NO: 2777912 - protein, 8 aa, Entamoeba invadens
STTTITSN

SEQ ID NO: 2777913 - protein, 8 aa, Entamoeba invadens
STTTLHEA

SEQ ID NO: 2777914 - protein, 7 aa, Entamoeba invadens
STTTNEC

SEQ ID NO: 2777915 - protein, 5 aa, Entamoeba invadens
STTTY

SEQ ID NO: 2777916 - protein, 4 aa, Entamoeba invadens
STTV

SEQ ID NO: 2777917 - protein, 5 aa, Entamoeba invadens
STTVP

SEQ ID NO: 2777918 - protein, 6 aa, Entamoeba invadens
STTVTN

SEQ ID NO: 2777919 - protein, 6 aa, Entamoeba invadens
STVCTK

SEQ ID NO: 2777920 - protein, 4 aa, Entamoeba invadens
STVE

SEQ ID NO: 2777921 - protein, 6 aa, Entamoeba invadens
STVESS

SEQ ID NO: 2777922 - protein, 44 aa, Entamoeba invadens
STVESSSRNLTKNATKNIPKNNTTNNSSMTTRDKTAAEKQMDKK

SEQ ID NO: 2777923 - protein, 11 aa, Entamoeba invadens
STVGSSSCQQC

SEQ ID NO: 2777924 - protein, 4 aa, Entamoeba invadens
STVN

SEQ ID NO: 2777925 - protein, 6 aa, Entamoeba invadens
STVPTG

SEQ ID NO: 2777926 - protein, 6 aa, Entamoeba invadens
STVQED

SEQ ID NO: 2777927 - protein, 4 aa, Entamoeba invadens
STVS

SEQ ID NO: 2777928 - protein, 8 aa, Entamoeba invadens
STVSNSEY

SEQ ID NO: 2777929 - protein, 9 aa, Entamoeba invadens
STVSSASSF

SEQ ID NO: 2777930 - protein, 6 aa, Entamoeba invadens
STVSVS

SEQ ID NO: 2777931 - protein, 14 aa, Entamoeba invadens
STVTSEQTSEKSLR

SEQ ID NO: 2777932 - protein, 6 aa, Entamoeba invadens
STVTSS

SEQ ID NO: 2777933 - protein, 4 aa, Entamoeba invadens
STYD

SEQ ID NO: 2777934 - protein, 5 aa, Entamoeba invadens
STYDK

SEQ ID NO: 2777935 - protein, 5 aa, Entamoeba invadens
STYDT

SEQ ID NO: 2777936 - protein, 5 aa, Entamoeba invadens
STYEE

SEQ ID NO: 2777937 - protein, 5 aa, Entamoeba invadens
STYKN

SEQ ID NO: 2777938 - protein, 4 aa, Entamoeba invadens
STYM

SEQ ID NO: 2777939 - protein, 6 aa, Entamoeba invadens
STYNGR

SEQ ID NO: 2777940 - protein, 6 aa, Entamoeba invadens
STYPPA

SEQ ID NO: 2777941 - protein, 8 aa, Entamoeba invadens
STYPPPFT

SEQ ID NO: 2777942 - protein, 9 aa, Entamoeba invadens
STYPTSDQM

SEQ ID NO: 2777943 - protein, 6 aa, Entamoeba invadens
STYPVA

SEQ ID NO: 2777944 - protein, 4 aa, Entamoeba invadens
STYQ

SEQ ID NO: 2777945 - protein, 5 aa, Entamoeba invadens
STYQE

SEQ ID NO: 2777946 - protein, 6 aa, Entamoeba invadens
STYQTF

SEQ ID NO: 2777947 - protein, 15 aa, Entamoeba invadens
STYRTPSYDKCSNQC

SEQ ID NO: 2777948 - protein, 10 aa, Entamoeba invadens
STYSDEDYRR

SEQ ID NO: 2777949 - protein, 6 aa, Entamoeba invadens
STYSFD

SEQ ID NO: 2777950 - protein, 11 aa, Entamoeba invadens
STYTTIGNNKI

SEQ ID NO: 2777951 - protein, 7 aa, Entamoeba invadens
SVANEQS

SEQ ID NO: 2777952 - protein, 5 aa, Entamoeba invadens
SVCER

SEQ ID NO: 2777953 - protein, 11 aa, Entamoeba invadens
SVCSSSDECTS

SEQ ID NO: 2777954 - protein, 9 aa, Entamoeba invadens
SVCSTESRY

SEQ ID NO: 2777955 - protein, 4 aa, Entamoeba invadens
SVDE

SEQ ID NO: 2777956 - protein, 8 aa, Entamoeba invadens
SVDKGESI

SEQ ID NO: 2777957 - protein, 6 aa, Entamoeba invadens
SVDNGK

SEQ ID NO: 2777958 - protein, 8 aa, Entamoeba invadens
SVDPSGCT

SEQ ID NO: 2777959 - protein, 6 aa, Entamoeba invadens
SVDQQY

SEQ ID NO: 2777960 - protein, 8 aa, Entamoeba invadens
SVDSAPDD

SEQ ID NO: 2777961 - protein, 11 aa, Entamoeba invadens
SVDSKENNVAN

SEQ ID NO: 2777962 - protein, 6 aa, Entamoeba invadens
SVDSVK

SEQ ID NO: 2777963 - protein, 6 aa, Entamoeba invadens
SVDTDS

SEQ ID NO: 2777964 - protein, 6 aa, Entamoeba invadens
SVDTNT

SEQ ID NO: 2777965 - protein, 9 aa, Entamoeba invadens
SVDYNTETC

SEQ ID NO: 2777966 - protein, 9 aa, Entamoeba invadens
SVEASEREI

SEQ ID NO: 2777967 - protein, 4 aa, Entamoeba invadens
SVED

SEQ ID NO: 2777968 - protein, 8 aa, Entamoeba invadens
SVEDNYPN

SEQ ID NO: 2777969 - protein, 4 aa, Entamoeba invadens
SVEE

SEQ ID NO: 2777970 - protein, 12 aa, Entamoeba invadens
SVEEQKKEIRAV

SEQ ID NO: 2777971 - protein, 12 aa, Entamoeba invadens
SVEESSKKRYAG

SEQ ID NO: 2777972 - protein, 15 aa, Entamoeba invadens
SVEGCQKEVTSDGCS

SEQ ID NO: 2777973 - protein, 12 aa, Entamoeba invadens
SVEGEDDETKMS

SEQ ID NO: 2777974 - protein, 5 aa, Entamoeba invadens
SVEIA

SEQ ID NO: 2777975 - protein, 15 aa, Entamoeba invadens
SVEKNHPKEAEKEVE

SEQ ID NO: 2777976 - protein, 9 aa, Entamoeba invadens
SVEKTPSQN

SEQ ID NO: 2777977 - protein, 8 aa, Entamoeba invadens
SVEKTSKK

SEQ ID NO: 2777978 - protein, 6 aa, Entamoeba invadens
SVENNL

SEQ ID NO: 2777979 - protein, 5 aa, Entamoeba invadens
SVENP

SEQ ID NO: 2777980 - protein, 6 aa, Entamoeba invadens
SVENTD

SEQ ID NO: 2777981 - protein, 5 aa, Entamoeba invadens
SVEQA

SEQ ID NO: 2777982 - protein, 9 aa, Entamoeba invadens
SVEQNGKKD

SEQ ID NO: 2777983 - protein, 17 aa, Entamoeba invadens
SVESGSVLSTTGSSQIN

SEQ ID NO: 2777984 - protein, 4 aa, Entamoeba invadens
SVET

SEQ ID NO: 2777985 - protein, 11 aa, Entamoeba invadens
SVETQNDKKSF

SEQ ID NO: 2777986 - protein, 15 aa, Entamoeba invadens
SVETSSSSTEEDAYF

SEQ ID NO: 2777987 - protein, 5 aa, Entamoeba invadens
SVETV

SEQ ID NO: 2777988 - protein, 10 aa, Entamoeba invadens
SVFSEDGGKE

SEQ ID NO: 2777989 - protein, 8 aa, Entamoeba invadens
SVGGSTKV

SEQ ID NO: 2777990 - protein, 6 aa, Entamoeba invadens
SVGKRP

SEQ ID NO: 2777991 - protein, 7 aa, Entamoeba invadens
SVGKRPN

SEQ ID NO: 2777992 - protein, 4 aa, Entamoeba invadens
SVGN

SEQ ID NO: 2777993 - protein, 17 aa, Entamoeba invadens
SVGSEDGEIERKPTKMH

SEQ ID NO: 2777994 - protein, 7 aa, Entamoeba invadens
SVGSQCN

SEQ ID NO: 2777995 - protein, 5 aa, Entamoeba invadens
SVGTQ

SEQ ID NO: 2777996 - protein, 10 aa, Entamoeba invadens
SVIDPKTNSL

SEQ ID NO: 2777997 - protein, 12 aa, Entamoeba invadens
SVIPSRSPTSGV

SEQ ID NO: 2777998 - protein, 8 aa, Entamoeba invadens
SVKCDEND

SEQ ID NO: 2777999 - protein, 8 aa, Entamoeba invadens
SVKENDID

SEQ ID NO: 2778000 - protein, 6 aa, Entamoeba invadens
SVKESD

SEQ ID NO: 2778001 - protein, 8 aa, Entamoeba invadens
SVKPKHPV

SEQ ID NO: 2778002 - protein, 17 aa, Entamoeba invadens
SVKRKAREAKEKEAKDD

SEQ ID NO: 2778003 - protein, 18 aa, Entamoeba invadens
SVKTENYDTNQVHPENSG

SEQ ID NO: 2778004 - protein, 10 aa, Entamoeba invadens
SVKTSGYRDI

SEQ ID NO: 2778005 - protein, 8 aa, Entamoeba invadens
SVNANKNN

SEQ ID NO: 2778006 - protein, 17 aa, Entamoeba invadens
SVNDDKNTKKEREEESR

SEQ ID NO: 2778007 - protein, 9 aa, Entamoeba invadens
SVNDKKNKY

SEQ ID NO: 2778008 - protein, 7 aa, Entamoeba invadens
SVNENGV

SEQ ID NO: 2778009 - protein, 7 aa, Entamoeba invadens
SVNGTSC

SEQ ID NO: 2778010 - protein, 8 aa, Entamoeba invadens
SVNKTEST

SEQ ID NO: 2778011 - protein, 11 aa, Entamoeba invadens
SVNKTPEQLKE

SEQ ID NO: 2778012 - protein, 8 aa, Entamoeba invadens
SVNLGTAK

SEQ ID NO: 2778013 - protein, 20 aa, Entamoeba invadens
SVNTTENKATLYSEPFITTD

SEQ ID NO: 2778014 - protein, 4 aa, Entamoeba invadens
SVPK

SEQ ID NO: 2778015 - protein, 10 aa, Entamoeba invadens
SVPKKKKKKF

SEQ ID NO: 2778016 - protein, 6 aa, Entamoeba invadens
SVPPYR

SEQ ID NO: 2778017 - protein, 7 aa, Entamoeba invadens
SVPRREV

SEQ ID NO: 2778018 - protein, 7 aa, Entamoeba invadens
SVPSLSS

SEQ ID NO: 2778019 - protein, 4 aa, Entamoeba invadens
SVPT

SEQ ID NO: 2778020 - protein, 8 aa, Entamoeba invadens
SVQEGKRL

SEQ ID NO: 2778021 - protein, 13 aa, Entamoeba invadens
SVQSGIPDFRSSN

SEQ ID NO: 2778022 - protein, 9 aa, Entamoeba invadens
SVQSKEIDF

SEQ ID NO: 2778023 - protein, 9 aa, Entamoeba invadens
SVQSKQIDF

SEQ ID NO: 2778024 - protein, 7 aa, Entamoeba invadens
SVQSNLP

SEQ ID NO: 2778025 - protein, 7 aa, Entamoeba invadens
SVQTEEL

SEQ ID NO: 2778026 - protein, 8 aa, Entamoeba invadens
SVQTGVGS

SEQ ID NO: 2778027 - protein, 4 aa, Entamoeba invadens
SVRD

SEQ ID NO: 2778028 - protein, 12 aa, Entamoeba invadens
SVREYTISGSTV

SEQ ID NO: 2778029 - protein, 6 aa, Entamoeba invadens
SVRGGK

SEQ ID NO: 2778030 - protein, 5 aa, Entamoeba invadens
SVRND

SEQ ID NO: 2778031 - protein, 7 aa, Entamoeba invadens
SVRTDVE

SEQ ID NO: 2778032 - protein, 5 aa, Entamoeba invadens
SVRTE

SEQ ID NO: 2778033 - protein, 18 aa, Entamoeba invadens
SVRVQNSTAKLQETDKQV

SEQ ID NO: 2778034 - protein, 5 aa, Entamoeba invadens
SVSAT

SEQ ID NO: 2778035 - protein, 5 aa, Entamoeba invadens
SVSCN

SEQ ID NO: 2778036 - protein, 11 aa, Entamoeba invadens
SVSGSTKTTKC

SEQ ID NO: 2778037 - protein, 8 aa, Entamoeba invadens
SVSGTSGK

SEQ ID NO: 2778038 - protein, 11 aa, Entamoeba invadens
SVSKEPSRENK

SEQ ID NO: 2778039 - protein, 9 aa, Entamoeba invadens
SVSKEQMSN

SEQ ID NO: 2778040 - protein, 9 aa, Entamoeba invadens
SVSPNKLSS

SEQ ID NO: 2778041 - protein, 8 aa, Entamoeba invadens
SVSQSGSI

SEQ ID NO: 2778042 - protein, 5 aa, Entamoeba invadens
SVSSQ

SEQ ID NO: 2778043 - protein, 5 aa, Entamoeba invadens
SVSTI

SEQ ID NO: 2778044 - protein, 10 aa, Entamoeba invadens
SVSTNKKTKV

SEQ ID NO: 2778045 - protein, 12 aa, Entamoeba invadens
SVSVDSLEDQSS

SEQ ID NO: 2778046 - protein, 10 aa, Entamoeba invadens
SVSVTRQDGK

SEQ ID NO: 2778047 - protein, 7 aa, Entamoeba invadens
SVTAATG

SEQ ID NO: 2778048 - protein, 25 aa, Entamoeba invadens
SVTDKTTHIKPSKYDYSGTEISGAG

SEQ ID NO: 2778049 - protein, 11 aa, Entamoeba invadens
SVTDNTGICSS

SEQ ID NO: 2778050 - protein, 12 aa, Entamoeba invadens
SVTEDNKSMEEF

SEQ ID NO: 2778051 - protein, 6 aa, Entamoeba invadens
SVTGSG

SEQ ID NO: 2778052 - protein, 11 aa, Entamoeba invadens
SVTIPSTVSSI

SEQ ID NO: 2778053 - protein, 7 aa, Entamoeba invadens
SVTKKND

SEQ ID NO: 2778054 - protein, 35 aa, Entamoeba invadens
SVTKNKETCKKKSIITKPQDVSATQTEEEKREIGG

SEQ ID NO: 2778055 - protein, 14 aa, Entamoeba invadens
SVTKSQQNEMTPQT

SEQ ID NO: 2778056 - protein, 5 aa, Entamoeba invadens
SVTLT

SEQ ID NO: 2778057 - protein, 9 aa, Entamoeba invadens
SVTNDNAIE

SEQ ID NO: 2778058 - protein, 15 aa, Entamoeba invadens
SVTNNENDGCECDNK

SEQ ID NO: 2778059 - protein, 13 aa, Entamoeba invadens
SVTNSKITMSSDN

SEQ ID NO: 2778060 - protein, 4 aa, Entamoeba invadens
SVTP

SEQ ID NO: 2778061 - protein, 5 aa, Entamoeba invadens
SVTSI

SEQ ID NO: 2778062 - protein, 8 aa, Entamoeba invadens
SVTSTEST

SEQ ID NO: 2778063 - protein, 5 aa, Entamoeba invadens
SVTTG

SEQ ID NO: 2778064 - protein, 6 aa, Entamoeba invadens
SVTTKD

SEQ ID NO: 2778065 - protein, 9 aa, Entamoeba invadens
SVTTPTSDK

SEQ ID NO: 2778066 - protein, 6 aa, Entamoeba invadens
SVTTTT

SEQ ID NO: 2778067 - protein, 23 aa, Entamoeba invadens
SVTVEGDGNIIQTTQSGVSENSL

SEQ ID NO: 2778068 - protein, 4 aa, Entamoeba invadens
SVTY

SEQ ID NO: 2778069 - protein, 7 aa, Entamoeba invadens
SVVDGTN

SEQ ID NO: 2778070 - protein, 11 aa, Entamoeba invadens
SVVEEEDGKNG

SEQ ID NO: 2778071 - protein, 7 aa, Entamoeba invadens
SVVESSE

SEQ ID NO: 2778072 - protein, 6 aa, Entamoeba invadens
SVVGSP

SEQ ID NO: 2778073 - protein, 9 aa, Entamoeba invadens
SVVPRPKTL

SEQ ID NO: 2778074 - protein, 12 aa, Entamoeba invadens
SVVSSNGETLRQ

SEQ ID NO: 2778075 - protein, 15 aa, Entamoeba invadens
SVYGSNSKLTLTETT

SEQ ID NO: 2778076 - protein, 8 aa, Entamoeba invadens
SVYNTSDI

SEQ ID NO: 2778077 - protein, 5 aa, Entamoeba invadens
SVYQN

SEQ ID NO: 2778078 - protein, 7 aa, Entamoeba invadens
SVYSDQY

SEQ ID NO: 2778079 - protein, 7 aa, Entamoeba invadens
SWGENNN

SEQ ID NO: 2778080 - protein, 9 aa, Entamoeba invadens
SWGNQGHSA

SEQ ID NO: 2778081 - protein, 6 aa, Entamoeba invadens
SWQTDN

SEQ ID NO: 2778082 - protein, 11 aa, Entamoeba invadens
SWRESNRDNTL

SEQ ID NO: 2778083 - protein, 11 aa, Entamoeba invadens
SWSQSQEDRPK

SEQ ID NO: 2778084 - protein, 4 aa, Entamoeba invadens
SYAN

SEQ ID NO: 2778085 - protein, 9 aa, Entamoeba invadens
SYANPNAPY

SEQ ID NO: 2778086 - protein, 4 aa, Entamoeba invadens
SYAS

SEQ ID NO: 2778087 - protein, 6 aa, Entamoeba invadens
SYASQT

SEQ ID NO: 2778088 - protein, 6 aa, Entamoeba invadens
SYAYDG

SEQ ID NO: 2778089 - protein, 6 aa, Entamoeba invadens
SYDAYD

SEQ ID NO: 2778090 - protein, 4 aa, Entamoeba invadens
SYDE

SEQ ID NO: 2778091 - protein, 4 aa, Entamoeba invadens
SYDG

SEQ ID NO: 2778092 - protein, 9 aa, Entamoeba invadens
SYDGGNQRR

SEQ ID NO: 2778093 - protein, 5 aa, Entamoeba invadens
SYDGK

SEQ ID NO: 2778094 - protein, 5 aa, Entamoeba invadens
SYDGN

SEQ ID NO: 2778095 - protein, 5 aa, Entamoeba invadens
SYDGV

SEQ ID NO: 2778096 - protein, 24 aa, Entamoeba invadens
SYDSKTQKCSECNGSNKVGPNGDE

SEQ ID NO: 2778097 - protein, 16 aa, Entamoeba invadens
SYDSNCSTCSTTQRGC

SEQ ID NO: 2778098 - protein, 10 aa, Entamoeba invadens
SYDSSSNCAY

SEQ ID NO: 2778099 - protein, 10 aa, Entamoeba invadens
SYDSTTGHCS

SEQ ID NO: 2778100 - protein, 9 aa, Entamoeba invadens
SYDSYHDPV

SEQ ID NO: 2778101 - protein, 7 aa, Entamoeba invadens
SYDTDSC

SEQ ID NO: 2778102 - protein, 9 aa, Entamoeba invadens
SYDTTYEKS

SEQ ID NO: 2778103 - protein, 4 aa, Entamoeba invadens
SYEE

SEQ ID NO: 2778104 - protein, 8 aa, Entamoeba invadens
SYEEHAKE

SEQ ID NO: 2778105 - protein, 7 aa, Entamoeba invadens
SYEKGEK

SEQ ID NO: 2778106 - protein, 5 aa, Entamoeba invadens
SYEKL

SEQ ID NO: 2778107 - protein, 28 aa, Entamoeba invadens
SYEKSSTCTSCDSKCNGCNSTNGNCTSC

SEQ ID NO: 2778108 - protein, 7 aa, Entamoeba invadens
SYELEEN

SEQ ID NO: 2778109 - protein, 7 aa, Entamoeba invadens
SYEPSQR

SEQ ID NO: 2778110 - protein, 6 aa, Entamoeba invadens
SYEQKQ

SEQ ID NO: 2778111 - protein, 20 aa, Entamoeba invadens
SYEYGDTRETACGTSKDEMT

SEQ ID NO: 2778112 - protein, 6 aa, Entamoeba invadens
SYFNNT

SEQ ID NO: 2778113 - protein, 17 aa, Entamoeba invadens
SYFPGAPTFKANGVKTN

SEQ ID NO: 2778114 - protein, 10 aa, Entamoeba invadens
SYGEVEKDRD

SEQ ID NO: 2778115 - protein, 4 aa, Entamoeba invadens
SYGF

SEQ ID NO: 2778116 - protein, 6 aa, Entamoeba invadens
SYGGDD

SEQ ID NO: 2778117 - protein, 5 aa, Entamoeba invadens
SYGKI

SEQ ID NO: 2778118 - protein, 22 aa, Entamoeba invadens
SYGKQTSQTATLTPLSSCTKGR

SEQ ID NO: 2778119 - protein, 11 aa, Entamoeba invadens
SYGSKSGTFVN

SEQ ID NO: 2778120 - protein, 6 aa, Entamoeba invadens
SYGTSA

SEQ ID NO: 2778121 - protein, 4 aa, Entamoeba invadens
SYGY

SEQ ID NO: 2778122 - protein, 9 aa, Entamoeba invadens
SYGYSEDST

SEQ ID NO: 2778123 - protein, 12 aa, Entamoeba invadens
SYHPSKDAQTKF

SEQ ID NO: 2778124 - protein, 9 aa, Entamoeba invadens
SYHYSKDDK

SEQ ID NO: 2778125 - protein, 5 aa, Entamoeba invadens
SYIRS

SEQ ID NO: 2778126 - protein, 7 aa, Entamoeba invadens
SYISTGD

SEQ ID NO: 2778127 - protein, 8 aa, Entamoeba invadens
SYISTGDS

SEQ ID NO: 2778128 - protein, 20 aa, Entamoeba invadens
SYITNENKCVSDTKCQHSDG

SEQ ID NO: 2778129 - protein, 6 aa, Entamoeba invadens
SYITSG

SEQ ID NO: 2778130 - protein, 6 aa, Entamoeba invadens
SYKDPA

SEQ ID NO: 2778131 - protein, 6 aa, Entamoeba invadens
SYKGGS

SEQ ID NO: 2778132 - protein, 10 aa, Entamoeba invadens
SYKKNLKRTE

SEQ ID NO: 2778133 - protein, 6 aa, Entamoeba invadens
SYKNNP

SEQ ID NO: 2778134 - protein, 5 aa, Entamoeba invadens
SYKSS

SEQ ID NO: 2778135 - protein, 18 aa, Entamoeba invadens
SYKSTRNLYSTNSPKEGK

SEQ ID NO: 2778136 - protein, 4 aa, Entamoeba invadens
SYKV

SEQ ID NO: 2778137 - protein, 9 aa, Entamoeba invadens
SYKVSNGKC

SEQ ID NO: 2778138 - protein, 6 aa, Entamoeba invadens
SYLEPQ

SEQ ID NO: 2778139 - protein, 5 aa, Entamoeba invadens
SYLSG

SEQ ID NO: 2778140 - protein, 15 aa, Entamoeba invadens
SYLSNNKSTEHEGGY

SEQ ID NO: 2778141 - protein, 8 aa, Entamoeba invadens
SYLTPTNQ

SEQ ID NO: 2778142 - protein, 5 aa, Entamoeba invadens
SYMSE

SEQ ID NO: 2778143 - protein, 9 aa, Entamoeba invadens
SYNDANSEC

SEQ ID NO: 2778144 - protein, 6 aa, Entamoeba invadens
SYNENG

SEQ ID NO: 2778145 - protein, 12 aa, Entamoeba invadens
SYNKENNTYNQV

SEQ ID NO: 2778146 - protein, 21 aa, Entamoeba invadens
SYNQQPSLYDNSNTVSSTENN

SEQ ID NO: 2778147 - protein, 27 aa, Entamoeba invadens
SYNSKCTACKGSYKVSDDGESCVSNTK

SEQ ID NO: 2778148 - protein, 9 aa, Entamoeba invadens
SYNTQSEEL

SEQ ID NO: 2778149 - protein, 8 aa, Entamoeba invadens
SYPETNKK

SEQ ID NO: 2778150 - protein, 5 aa, Entamoeba invadens
SYPKT

SEQ ID NO: 2778151 - protein, 7 aa, Entamoeba invadens
SYPNKEN

SEQ ID NO: 2778152 - protein, 7 aa, Entamoeba invadens
SYPPPLR

SEQ ID NO: 2778153 - protein, 7 aa, Entamoeba invadens
SYPSRKE

SEQ ID NO: 2778154 - protein, 10 aa, Entamoeba invadens
SYPTTASTAM

SEQ ID NO: 2778155 - protein, 7 aa, Entamoeba invadens
SYQHDKG

SEQ ID NO: 2778156 - protein, 10 aa, Entamoeba invadens
SYQKYEKVDT

SEQ ID NO: 2778157 - protein, 5 aa, Entamoeba invadens
SYQSD

SEQ ID NO: 2778158 - protein, 6 aa, Entamoeba invadens
SYQTST

SEQ ID NO: 2778159 - protein, 7 aa, Entamoeba invadens
SYQTSTY

SEQ ID NO: 2778160 - protein, 14 aa, Entamoeba invadens
SYRDSFNSTPSDLC

SEQ ID NO: 2778161 - protein, 16 aa, Entamoeba invadens
SYREGTTTAIAPNYND

SEQ ID NO: 2778162 - protein, 6 aa, Entamoeba invadens
SYRGNT

SEQ ID NO: 2778163 - protein, 9 aa, Entamoeba invadens
SYRGNTEDG

SEQ ID NO: 2778164 - protein, 6 aa, Entamoeba invadens
SYRKNI

SEQ ID NO: 2778165 - protein, 12 aa, Entamoeba invadens
SYRQEIEDSQKN

SEQ ID NO: 2778166 - protein, 8 aa, Entamoeba invadens
SYSDNEGA

SEQ ID NO: 2778167 - protein, 10 aa, Entamoeba invadens
SYSDNEGASS

SEQ ID NO: 2778168 - protein, 11 aa, Entamoeba invadens
SYSEDKDLSNP

SEQ ID NO: 2778169 - protein, 13 aa, Entamoeba invadens
SYSHDATTRDSVS

SEQ ID NO: 2778170 - protein, 7 aa, Entamoeba invadens
SYSKYST

SEQ ID NO: 2778171 - protein, 8 aa, Entamoeba invadens
SYSLDGAS

SEQ ID NO: 2778172 - protein, 5 aa, Entamoeba invadens
SYSND

SEQ ID NO: 2778173 - protein, 10 aa, Entamoeba invadens
SYSPGGSSRE

SEQ ID NO: 2778174 - protein, 11 aa, Entamoeba invadens
SYSPRYNQTNG

SEQ ID NO: 2778175 - protein, 7 aa, Entamoeba invadens
SYSPSLD

SEQ ID NO: 2778176 - protein, 7 aa, Entamoeba invadens
SYSQETK

SEQ ID NO: 2778177 - protein, 5 aa, Entamoeba invadens
SYSQG

SEQ ID NO: 2778178 - protein, 5 aa, Entamoeba invadens
SYSRN

SEQ ID NO: 2778179 - protein, 7 aa, Entamoeba invadens
SYSSENV

SEQ ID NO: 2778180 - protein, 11 aa, Entamoeba invadens
SYSSSSGSDSC

SEQ ID NO: 2778181 - protein, 36 aa, Entamoeba invadens
SYSSTCSSSYSSSLRAEDCRTSPADQFYRQKFIPIF

SEQ ID NO: 2778182 - protein, 9 aa, Entamoeba invadens
SYSTDETTL

SEQ ID NO: 2778183 - protein, 7 aa, Entamoeba invadens
SYSTEES

SEQ ID NO: 2778184 - protein, 10 aa, Entamoeba invadens
SYSTPGSSKC

SEQ ID NO: 2778185 - protein, 10 aa, Entamoeba invadens
SYSYADNKGV

SEQ ID NO: 2778186 - protein, 8 aa, Entamoeba invadens
SYSYTKNG

SEQ ID NO: 2778187 - protein, 9 aa, Entamoeba invadens
SYSYTKNGK

SEQ ID NO: 2778188 - protein, 6 aa, Entamoeba invadens
SYTCQN

SEQ ID NO: 2778189 - protein, 15 aa, Entamoeba invadens
SYTDNDRKIYSDTIP

SEQ ID NO: 2778190 - protein, 6 aa, Entamoeba invadens
SYTDQI

SEQ ID NO: 2778191 - protein, 9 aa, Entamoeba invadens
SYTDQTPSI

SEQ ID NO: 2778192 - protein, 11 aa, Entamoeba invadens
SYTFSDETTTV

SEQ ID NO: 2778193 - protein, 5 aa, Entamoeba invadens
SYTKD

SEQ ID NO: 2778194 - protein, 5 aa, Entamoeba invadens
SYTKF

SEQ ID NO: 2778195 - protein, 7 aa, Entamoeba invadens
SYTNKEL

SEQ ID NO: 2778196 - protein, 8 aa, Entamoeba invadens
SYTNVQTE

SEQ ID NO: 2778197 - protein, 9 aa, Entamoeba invadens
SYTPNDNYS

SEQ ID NO: 2778198 - protein, 9 aa, Entamoeba invadens
SYTSTEGKG

SEQ ID NO: 2778199 - protein, 4 aa, Entamoeba invadens
SYTT

SEQ ID NO: 2778200 - protein, 8 aa, Entamoeba invadens
SYTTNTGY

SEQ ID NO: 2778201 - protein, 12 aa, Entamoeba invadens
SYTTPCKEDDKE

SEQ ID NO: 2778202 - protein, 8 aa, Entamoeba invadens
SYTVEGRA

SEQ ID NO: 2778203 - protein, 12 aa, Entamoeba invadens
SYVDKSDVTTKC

SEQ ID NO: 2778204 - protein, 12 aa, Entamoeba invadens
SYVKNADNTCNK

SEQ ID NO: 2778205 - protein, 10 aa, Entamoeba invadens
SYVPTTSDQF

SEQ ID NO: 2778206 - protein, 10 aa, Entamoeba invadens
SYYDEPKVSA

SEQ ID NO: 2778207 - protein, 8 aa, Entamoeba invadens
SYYNNNTK

SEQ ID NO: 2778208 - protein, 6 aa, Entamoeba invadens
SYYPDP

SEQ ID NO: 2778209 - protein, 7 aa, Entamoeba invadens
SYYPNSN

SEQ ID NO: 2778210 - protein, 7 aa, Entamoeba invadens
SYYPSGV

SEQ ID NO: 2778211 - protein, 7 aa, Entamoeba invadens
SYYRKGD

SEQ ID NO: 2778212 - protein, 10 aa, Entamoeba invadens
SYYSSGGTSL

SEQ ID NO: 2778213 - protein, 12 aa, Entamoeba invadens
SYYTNPSTQRCQ

SEQ ID NO: 2778214 - protein, 10 aa, Entamoeba invadens
TAAGKSQPAN

SEQ ID NO: 2778215 - protein, 11 aa, Entamoeba invadens
TAALTDLEGEI

SEQ ID NO: 2778216 - protein, 5 aa, Entamoeba invadens
TAANA

SEQ ID NO: 2778217 - protein, 7 aa, Entamoeba invadens
TADCGRS

SEQ ID NO: 2778218 - protein, 7 aa, Entamoeba invadens
TADEKKR

SEQ ID NO: 2778219 - protein, 9 aa, Entamoeba invadens
TADGAESWF

SEQ ID NO: 2778220 - protein, 7 aa, Entamoeba invadens
TADGDGH

SEQ ID NO: 2778221 - protein, 7 aa, Entamoeba invadens
TADKKGK

SEQ ID NO: 2778222 - protein, 12 aa, Entamoeba invadens
TADKTADTFEGQ

SEQ ID NO: 2778223 - protein, 11 aa, Entamoeba invadens
TADTATKIKTS

SEQ ID NO: 2778224 - protein, 8 aa, Entamoeba invadens
TADTPTTV

SEQ ID NO: 2778225 - protein, 6 aa, Entamoeba invadens
TAEEEL

SEQ ID NO: 2778226 - protein, 18 aa, Entamoeba invadens
TAEEKKREMYDSVYVTET

SEQ ID NO: 2778227 - protein, 18 aa, Entamoeba invadens
TAEERTKYEVDERNGKNI

SEQ ID NO: 2778228 - protein, 9 aa, Entamoeba invadens
TAEKDLKTK

SEQ ID NO: 2778229 - protein, 5 aa, Entamoeba invadens
TAENI

SEQ ID NO: 2778230 - protein, 13 aa, Entamoeba invadens
TAENTLENREEKV

SEQ ID NO: 2778231 - protein, 4 aa, Entamoeba invadens
TAEP

SEQ ID NO: 2778232 - protein, 7 aa, Entamoeba invadens
TAEPTEV

SEQ ID NO: 2778233 - protein, 5 aa, Entamoeba invadens
TAESV

SEQ ID NO: 2778234 - protein, 6 aa, Entamoeba invadens
TAESVL

SEQ ID NO: 2778235 - protein, 8 aa, Entamoeba invadens
TAETGKTA

SEQ ID NO: 2778236 - protein, 5 aa, Entamoeba invadens
TAETI

SEQ ID NO: 2778237 - protein, 13 aa, Entamoeba invadens
TAFKKTANKTPMK

SEQ ID NO: 2778238 - protein, 7 aa, Entamoeba invadens
TAFNNGS

SEQ ID NO: 2778239 - protein, 11 aa, Entamoeba invadens
TAFPKKAEKVY

SEQ ID NO: 2778240 - protein, 11 aa, Entamoeba invadens
TAGGKVLSPNE

SEQ ID NO: 2778241 - protein, 12 aa, Entamoeba invadens
TAGKRPEKRKNI

SEQ ID NO: 2778242 - protein, 7 aa, Entamoeba invadens
TAGLGNK

SEQ ID NO: 2778243 - protein, 16 aa, Entamoeba invadens
TAGNSFSETDCNHDES

SEQ ID NO: 2778244 - protein, 11 aa, Entamoeba invadens
TAGPNGCETCN

SEQ ID NO: 2778245 - protein, 9 aa, Entamoeba invadens
TAGSEEYSA

SEQ ID NO: 2778246 - protein, 16 aa, Entamoeba invadens
TAGTDIELQKNSTTNY

SEQ ID NO: 2778247 - protein, 13 aa, Entamoeba invadens
TAGVDYETDQKIQ

SEQ ID NO: 2778248 - protein, 12 aa, Entamoeba invadens
TAGYTSDCQSCQ

SEQ ID NO: 2778249 - protein, 4 aa, Entamoeba invadens
TAHE

SEQ ID NO: 2778250 - protein, 6 aa, Entamoeba invadens
TAIENG

SEQ ID NO: 2778251 - protein, 7 aa, Entamoeba invadens
TAIETEP

SEQ ID NO: 2778252 - protein, 11 aa, Entamoeba invadens
TAITAEESLTT

SEQ ID NO: 2778253 - protein, 4 aa, Entamoeba invadens
TAKA

SEQ ID NO: 2778254 - protein, 14 aa, Entamoeba invadens
TAKATSEPQDHTQL

SEQ ID NO: 2778255 - protein, 9 aa, Entamoeba invadens
TAKDTTGKH

SEQ ID NO: 2778256 - protein, 10 aa, Entamoeba invadens
TAKEGETTAF

SEQ ID NO: 2778257 - protein, 12 aa, Entamoeba invadens
TAKIQNNEEQRV

SEQ ID NO: 2778258 - protein, 8 aa, Entamoeba invadens
TAKKNGSE

SEQ ID NO: 2778259 - protein, 9 aa, Entamoeba invadens
TAKNGEDEM

SEQ ID NO: 2778260 - protein, 9 aa, Entamoeba invadens
TAKNSFKNN

SEQ ID NO: 2778261 - protein, 9 aa, Entamoeba invadens
TAKQKPKPK

SEQ ID NO: 2778262 - protein, 8 aa, Entamoeba invadens
TAKTATSL

SEQ ID NO: 2778263 - protein, 6 aa, Entamoeba invadens
TAKYSG

SEQ ID NO: 2778264 - protein, 5 aa, Entamoeba invadens
TALDS

SEQ ID NO: 2778265 - protein, 5 aa, Entamoeba invadens
TALKQ

SEQ ID NO: 2778266 - protein, 8 aa, Entamoeba invadens
TALPNKAG

SEQ ID NO: 2778267 - protein, 9 aa, Entamoeba invadens
TALPTSQCT

SEQ ID NO: 2778268 - protein, 17 aa, Entamoeba invadens
TALPTSQCTECTTKTNG

SEQ ID NO: 2778269 - protein, 16 aa, Entamoeba invadens
TALQEQQKAQAETEMA

SEQ ID NO: 2778270 - protein, 6 aa, Entamoeba invadens
TALSTH

SEQ ID NO: 2778271 - protein, 9 aa, Entamoeba invadens
TAMDKTTKN

SEQ ID NO: 2778272 - protein, 7 aa, Entamoeba invadens
TAMDTEE

SEQ ID NO: 2778273 - protein, 5 aa, Entamoeba invadens
TAMKS

SEQ ID NO: 2778274 - protein, 4 aa, Entamoeba invadens
TAMP

SEQ ID NO: 2778275 - protein, 11 aa, Entamoeba invadens
TANDSQNGQEC

SEQ ID NO: 2778276 - protein, 8 aa, Entamoeba invadens
TANDYQDC

SEQ ID NO: 2778277 - protein, 8 aa, Entamoeba invadens
TANEDGDE

SEQ ID NO: 2778278 - protein, 13 aa, Entamoeba invadens
TANGAYNDGTKNN

SEQ ID NO: 2778279 - protein, 7 aa, Entamoeba invadens
TANGQQC

SEQ ID NO: 2778280 - protein, 10 aa, Entamoeba invadens
TANKNKESLA

SEQ ID NO: 2778281 - protein, 9 aa, Entamoeba invadens
TANSITSST

SEQ ID NO: 2778282 - protein, 10 aa, Entamoeba invadens
TANSQHQRQE

SEQ ID NO: 2778283 - protein, 8 aa, Entamoeba invadens
TANSTRST

SEQ ID NO: 2778284 - protein, 8 aa, Entamoeba invadens
TANSTTDL

SEQ ID NO: 2778285 - protein, 6 aa, Entamoeba invadens
TANTTV

SEQ ID NO: 2778286 - protein, 5 aa, Entamoeba invadens
TANVD

SEQ ID NO: 2778287 - protein, 4 aa, Entamoeba invadens
TAPA

SEQ ID NO: 2778288 - protein, 6 aa, Entamoeba invadens
TAPDDF

SEQ ID NO: 2778289 - protein, 5 aa, Entamoeba invadens
TAPEA

SEQ ID NO: 2778290 - protein, 6 aa, Entamoeba invadens
TAPEDK

SEQ ID NO: 2778291 - protein, 4 aa, Entamoeba invadens
TAPK

SEQ ID NO: 2778292 - protein, 7 aa, Entamoeba invadens
TAPLEDL

SEQ ID NO: 2778293 - protein, 14 aa, Entamoeba invadens
TAPPKTLPTEPPLK

SEQ ID NO: 2778294 - protein, 7 aa, Entamoeba invadens
TAPSDGD

SEQ ID NO: 2778295 - protein, 14 aa, Entamoeba invadens
TAPTDETKANTISI

SEQ ID NO: 2778296 - protein, 7 aa, Entamoeba invadens
TAPTKDF

SEQ ID NO: 2778297 - protein, 11 aa, Entamoeba invadens
TAPTSAARRAA

SEQ ID NO: 2778298 - protein, 12 aa, Entamoeba invadens
TAPTTEVKKSYR

SEQ ID NO: 2778299 - protein, 17 aa, Entamoeba invadens
TAPWNGKRSPLSLSTNN

SEQ ID NO: 2778300 - protein, 6 aa, Entamoeba invadens
TAQADV

SEQ ID NO: 2778301 - protein, 5 aa, Entamoeba invadens
TAQAG

SEQ ID NO: 2778302 - protein, 18 aa, Entamoeba invadens
TAQGKCEKVNNKMTSSSA

SEQ ID NO: 2778303 - protein, 6 aa, Entamoeba invadens
TAQKSS

SEQ ID NO: 2778304 - protein, 8 aa, Entamoeba invadens
TAQPPTWG

SEQ ID NO: 2778305 - protein, 5 aa, Entamoeba invadens
TAQTN

SEQ ID NO: 2778306 - protein, 8 aa, Entamoeba invadens
TARDPKYT

SEQ ID NO: 2778307 - protein, 12 aa, Entamoeba invadens
TAREKLENMLNN

SEQ ID NO: 2778308 - protein, 4 aa, Entamoeba invadens
TARG

SEQ ID NO: 2778309 - protein, 6 aa, Entamoeba invadens
TARRGR

SEQ ID NO: 2778310 - protein, 13 aa, Entamoeba invadens
TARRGRKIKTNEQ

SEQ ID NO: 2778311 - protein, 14 aa, Entamoeba invadens
TASAGIKEIGNESF

SEQ ID NO: 2778312 - protein, 10 aa, Entamoeba invadens
TASDEQLSQA

SEQ ID NO: 2778313 - protein, 4 aa, Entamoeba invadens
TASE

SEQ ID NO: 2778314 - protein, 10 aa, Entamoeba invadens
TASGDPSKSI

SEQ ID NO: 2778315 - protein, 16 aa, Entamoeba invadens
TASGERYYQASSPDEV

SEQ ID NO: 2778316 - protein, 10 aa, Entamoeba invadens
TASGTIDTVR

SEQ ID NO: 2778317 - protein, 5 aa, Entamoeba invadens
TASIA

SEQ ID NO: 2778318 - protein, 7 aa, Entamoeba invadens
TASPTPL

SEQ ID NO: 2778319 - protein, 17 aa, Entamoeba invadens
TASQHGCNGIETSNKGS

SEQ ID NO: 2778320 - protein, 7 aa, Entamoeba invadens
TASSDAM

SEQ ID NO: 2778321 - protein, 14 aa, Entamoeba invadens
TASSIDSSVNTNYD

SEQ ID NO: 2778322 - protein, 6 aa, Entamoeba invadens
TASSLN

SEQ ID NO: 2778323 - protein, 7 aa, Entamoeba invadens
TASYEGG

SEQ ID NO: 2778324 - protein, 5 aa, Entamoeba invadens
TATAR

SEQ ID NO: 2778325 - protein, 7 aa, Entamoeba invadens
TATCEEK

SEQ ID NO: 2778326 - protein, 14 aa, Entamoeba invadens
TATDSSPTEQNCHT

SEQ ID NO: 2778327 - protein, 6 aa, Entamoeba invadens
TATDTG

SEQ ID NO: 2778328 - protein, 4 aa, Entamoeba invadens
TATE

SEQ ID NO: 2778329 - protein, 6 aa, Entamoeba invadens
TATEKQ

SEQ ID NO: 2778330 - protein, 6 aa, Entamoeba invadens
TATESL

SEQ ID NO: 2778331 - protein, 18 aa, Entamoeba invadens
TATFDSSAKREFITKAKT

SEQ ID NO: 2778332 - protein, 19 aa, Entamoeba invadens
TATFTRQTTSQNLKECEAN

SEQ ID NO: 2778333 - protein, 6 aa, Entamoeba invadens
TATIQT

SEQ ID NO: 2778334 - protein, 18 aa, Entamoeba invadens
TATISSDDFTTPDFSGVQ

SEQ ID NO: 2778335 - protein, 14 aa, Entamoeba invadens
TATKDKKLSINTDD

SEQ ID NO: 2778336 - protein, 4 aa, Entamoeba invadens
TATN

SEQ ID NO: 2778337 - protein, 18 aa, Entamoeba invadens
TATNCDTCENNPKCQKCS

SEQ ID NO: 2778338 - protein, 18 aa, Entamoeba invadens
TATNCDTCENNSKCQKCS

SEQ ID NO: 2778339 - protein, 8 aa, Entamoeba invadens
TATNQSNT

SEQ ID NO: 2778340 - protein, 11 aa, Entamoeba invadens
TATPKEQSDLT

SEQ ID NO: 2778341 - protein, 7 aa, Entamoeba invadens
TATPNSV

SEQ ID NO: 2778342 - protein, 11 aa, Entamoeba invadens
TATPPKEYRVT

SEQ ID NO: 2778343 - protein, 4 aa, Entamoeba invadens
TATQ

SEQ ID NO: 2778344 - protein, 6 aa, Entamoeba invadens
TATQKS

SEQ ID NO: 2778345 - protein, 9 aa, Entamoeba invadens
TATQTVDVR

SEQ ID NO: 2778346 - protein, 8 aa, Entamoeba invadens
TATSGLPL

SEQ ID NO: 2778347 - protein, 25 aa, Entamoeba invadens
TATSKLTTRLDPDELEEDKKLGEGS

SEQ ID NO: 2778348 - protein, 25 aa, Entamoeba invadens
TATSKLTTRLDPDELKKDKKLGEGS

SEQ ID NO: 2778349 - protein, 19 aa, Entamoeba invadens
TATSKLTTRLDPDELQEDN

SEQ ID NO: 2778350 - protein, 9 aa, Entamoeba invadens
TATSLEGPQ

SEQ ID NO: 2778351 - protein, 5 aa, Entamoeba invadens
TATSM

SEQ ID NO: 2778352 - protein, 13 aa, Entamoeba invadens
TATSPDDKVTSKC

SEQ ID NO: 2778353 - protein, 6 aa, Entamoeba invadens
TATSTL

SEQ ID NO: 2778354 - protein, 17 aa, Entamoeba invadens
TATSTSWKKSVDAKYTK

SEQ ID NO: 2778355 - protein, 4 aa, Entamoeba invadens
TATT

SEQ ID NO: 2778356 - protein, 13 aa, Entamoeba invadens
TATYSPSKSPNNF

SEQ ID NO: 2778357 - protein, 12 aa, Entamoeba invadens
TAVDNDDSMDEF

SEQ ID NO: 2778358 - protein, 11 aa, Entamoeba invadens
TAYDSTDPRFN

SEQ ID NO: 2778359 - protein, 6 aa, Entamoeba invadens
TCAAGE

SEQ ID NO: 2778360 - protein, 7 aa, Entamoeba invadens
TCAAGER

SEQ ID NO: 2778361 - protein, 8 aa, Entamoeba invadens
TCAAGERQ

SEQ ID NO: 2778362 - protein, 4 aa, Entamoeba invadens
TCAS

SEQ ID NO: 2778363 - protein, 10 aa, Entamoeba invadens
TCASDTSRKC

SEQ ID NO: 2778364 - protein, 9 aa, Entamoeba invadens
TCASDYSKT

SEQ ID NO: 2778365 - protein, 9 aa, Entamoeba invadens
TCASNGERK

SEQ ID NO: 2778366 - protein, 5 aa, Entamoeba invadens
TCATD

SEQ ID NO: 2778367 - protein, 5 aa, Entamoeba invadens
TCATN

SEQ ID NO: 2778368 - protein, 9 aa, Entamoeba invadens
TCDDDQCKR

SEQ ID NO: 2778369 - protein, 10 aa, Entamoeba invadens
TCDGGDRDTI

SEQ ID NO: 2778370 - protein, 9 aa, Entamoeba invadens
TCDGPNADN

SEQ ID NO: 2778371 - protein, 20 aa, Entamoeba invadens
TCDKTCKIGKANKESNKCEK

SEQ ID NO: 2778372 - protein, 17 aa, Entamoeba invadens
TCDKTCKTGKVNKNSMT

SEQ ID NO: 2778373 - protein, 5 aa, Entamoeba invadens
TCDNN

SEQ ID NO: 2778374 - protein, 7 aa, Entamoeba invadens
TCDPGYQ

SEQ ID NO: 2778375 - protein, 7 aa, Entamoeba invadens
TCDPQTD

SEQ ID NO: 2778376 - protein, 9 aa, Entamoeba invadens
TCDQSGECT

SEQ ID NO: 2778377 - protein, 8 aa, Entamoeba invadens
TCDQTNGN

SEQ ID NO: 2778378 - protein, 8 aa, Entamoeba invadens
TCDSCSNG

SEQ ID NO: 2778379 - protein, 9 aa, Entamoeba invadens
TCDSKNGNC

SEQ ID NO: 2778380 - protein, 9 aa, Entamoeba invadens
TCDSNYEKK

SEQ ID NO: 2778381 - protein, 5 aa, Entamoeba invadens
TCDSS

SEQ ID NO: 2778382 - protein, 9 aa, Entamoeba invadens
TCDSSGKCT

SEQ ID NO: 2778383 - protein, 9 aa, Entamoeba invadens
TCDSSYEKK

SEQ ID NO: 2778384 - protein, 7 aa, Entamoeba invadens
TCDTNNA

SEQ ID NO: 2778385 - protein, 7 aa, Entamoeba invadens
TCDTTNP

SEQ ID NO: 2778386 - protein, 11 aa, Entamoeba invadens
TCEASTPSQCK

SEQ ID NO: 2778387 - protein, 9 aa, Entamoeba invadens
TCEATKDQV

SEQ ID NO: 2778388 - protein, 4 aa, Entamoeba invadens
TCED

SEQ ID NO: 2778389 - protein, 10 aa, Entamoeba invadens
TCEDCGNSIS

SEQ ID NO: 2778390 - protein, 11 aa, Entamoeba invadens
TCEDGNYKDVK

SEQ ID NO: 2778391 - protein, 12 aa, Entamoeba invadens
TCEGEYSRFSPI

SEQ ID NO: 2778392 - protein, 17 aa, Entamoeba invadens
TCEGGSPTYEESLNAGT

SEQ ID NO: 2778393 - protein, 10 aa, Entamoeba invadens
TCEGGYTNNA

SEQ ID NO: 2778394 - protein, 10 aa, Entamoeba invadens
TCEGSEIQTR

SEQ ID NO: 2778395 - protein, 10 aa, Entamoeba invadens
TCEISTKETC

SEQ ID NO: 2778396 - protein, 13 aa, Entamoeba invadens
TCEKQGDSCKNSS

SEQ ID NO: 2778397 - protein, 4 aa, Entamoeba invadens
TCEN

SEQ ID NO: 2778398 - protein, 12 aa, Entamoeba invadens
TCENNDSQKIEF

SEQ ID NO: 2778399 - protein, 6 aa, Entamoeba invadens
TCENNG

SEQ ID NO: 2778400 - protein, 10 aa, Entamoeba invadens
TCENNTRDCV

SEQ ID NO: 2778401 - protein, 6 aa, Entamoeba invadens
TCEPCD

SEQ ID NO: 2778402 - protein, 7 aa, Entamoeba invadens
TCEQRKE

SEQ ID NO: 2778403 - protein, 10 aa, Entamoeba invadens
TCEQTSHKCK

SEQ ID NO: 2778404 - protein, 5 aa, Entamoeba invadens
TCERC

SEQ ID NO: 2778405 - protein, 20 aa, Entamoeba invadens
TCERCSNPKCKRCDSDPSIC

SEQ ID NO: 2778406 - protein, 6 aa, Entamoeba invadens
TCERGR

SEQ ID NO: 2778407 - protein, 5 aa, Entamoeba invadens
TCESC

SEQ ID NO: 2778408 - protein, 5 aa, Entamoeba invadens
TCESQ

SEQ ID NO: 2778409 - protein, 7 aa, Entamoeba invadens
TCESSSD

SEQ ID NO: 2778410 - protein, 6 aa, Entamoeba invadens
TCESTT

SEQ ID NO: 2778411 - protein, 4 aa, Entamoeba invadens
TCET

SEQ ID NO: 2778412 - protein, 14 aa, Entamoeba invadens
TCETVENAEQCTKC

SEQ ID NO: 2778413 - protein, 9 aa, Entamoeba invadens
TCEYSNNDK

SEQ ID NO: 2778414 - protein, 4 aa, Entamoeba invadens
TCGD

SEQ ID NO: 2778415 - protein, 8 aa, Entamoeba invadens
TCGDETTN

SEQ ID NO: 2778416 - protein, 5 aa, Entamoeba invadens
TCGDN

SEQ ID NO: 2778417 - protein, 6 aa, Entamoeba invadens
TCGDSK

SEQ ID NO: 2778418 - protein, 6 aa, Entamoeba invadens
TCGEGN

SEQ ID NO: 2778419 - protein, 12 aa, Entamoeba invadens
TCGGACNPTTGY

SEQ ID NO: 2778420 - protein, 6 aa, Entamoeba invadens
TCGGAT

SEQ ID NO: 2778421 - protein, 9 aa, Entamoeba invadens
TCGGKCNTV

SEQ ID NO: 2778422 - protein, 11 aa, Entamoeba invadens
TCGGQCDTKNG

SEQ ID NO: 2778423 - protein, 12 aa, Entamoeba invadens
TCGGQCNPSNGY

SEQ ID NO: 2778424 - protein, 12 aa, Entamoeba invadens
TCGGQCNPTNGY

SEQ ID NO: 2778425 - protein, 11 aa, Entamoeba invadens
TCGGQCNSTNG

SEQ ID NO: 2778426 - protein, 9 aa, Entamoeba invadens
TCGKCDGTS

SEQ ID NO: 2778427 - protein, 8 aa, Entamoeba invadens
TCGNCSGL

SEQ ID NO: 2778428 - protein, 5 aa, Entamoeba invadens
TCGNG

SEQ ID NO: 2778429 - protein, 7 aa, Entamoeba invadens
TCGNGGY

SEQ ID NO: 2778430 - protein, 7 aa, Entamoeba invadens
TCGNGKI

SEQ ID NO: 2778431 - protein, 16 aa, Entamoeba invadens
TCGNKKWDKGEECDGG

SEQ ID NO: 2778432 - protein, 10 aa, Entamoeba invadens
TCGPCDGPTD

SEQ ID NO: 2778433 - protein, 25 aa, Entamoeba invadens
TCGTNCSSCDSSECYSCSTSDGVLS

SEQ ID NO: 2778434 - protein, 9 aa, Entamoeba invadens
TCGTNNPNH

SEQ ID NO: 2778435 - protein, 4 aa, Entamoeba invadens
TCGV

SEQ ID NO: 2778436 - protein, 5 aa, Entamoeba invadens
TCHTY

SEQ ID NO: 2778437 - protein, 13 aa, Entamoeba invadens
TCKANTCDSTSGY

SEQ ID NO: 2778438 - protein, 8 aa, Entamoeba invadens
TCKDKCNN

SEQ ID NO: 2778439 - protein, 8 aa, Entamoeba invadens
TCKEDGER

SEQ ID NO: 2778440 - protein, 5 aa, Entamoeba invadens
TCKKC

SEQ ID NO: 2778441 - protein, 10 aa, Entamoeba invadens
TCKNCTDTNV

SEQ ID NO: 2778442 - protein, 13 aa, Entamoeba invadens
TCKNDSYSLDNSG

SEQ ID NO: 2778443 - protein, 11 aa, Entamoeba invadens
TCKNSNTCETC

SEQ ID NO: 2778444 - protein, 7 aa, Entamoeba invadens
TCKPCQS

SEQ ID NO: 2778445 - protein, 6 aa, Entamoeba invadens
TCKPFD

SEQ ID NO: 2778446 - protein, 13 aa, Entamoeba invadens
TCKPNTCDSTSGF

SEQ ID NO: 2778447 - protein, 7 aa, Entamoeba invadens
TCKPQVS

SEQ ID NO: 2778448 - protein, 6 aa, Entamoeba invadens
TCKQSE

SEQ ID NO: 2778449 - protein, 5 aa, Entamoeba invadens
TCKSL

SEQ ID NO: 2778450 - protein, 29 aa, Entamoeba invadens
TCKTCANGYKKEGNNCVDDDTCSTRNDDA

SEQ ID NO: 2778451 - protein, 12 aa, Entamoeba invadens
TCKTRGDNGKCA

SEQ ID NO: 2778452 - protein, 13 aa, Entamoeba invadens
TCKTRGDNGKCSE

SEQ ID NO: 2778453 - protein, 6 aa, Entamoeba invadens
TCKTSD

SEQ ID NO: 2778454 - protein, 5 aa, Entamoeba invadens
TCLED

SEQ ID NO: 2778455 - protein, 11 aa, Entamoeba invadens
TCLSDENCETI

SEQ ID NO: 2778456 - protein, 4 aa, Entamoeba invadens
TCND

SEQ ID NO: 2778457 - protein, 7 aa, Entamoeba invadens
TCNDESK

SEQ ID NO: 2778458 - protein, 9 aa, Entamoeba invadens
TCNEKTGKV

SEQ ID NO: 2778459 - protein, 9 aa, Entamoeba invadens
TCNEKTGNV

SEQ ID NO: 2778460 - protein, 11 aa, Entamoeba invadens
TCNEKTGNVER

SEQ ID NO: 2778461 - protein, 16 aa, Entamoeba invadens
TCNEQNSYNFTTTKDS

SEQ ID NO: 2778462 - protein, 7 aa, Entamoeba invadens
TCNETDG

SEQ ID NO: 2778463 - protein, 13 aa, Entamoeba invadens
TCNGNCDQTTGKC

SEQ ID NO: 2778464 - protein, 11 aa, Entamoeba invadens
TCNGNCNQTSG

SEQ ID NO: 2778465 - protein, 14 aa, Entamoeba invadens
TCNGPESSNCTSCS

SEQ ID NO: 2778466 - protein, 9 aa, Entamoeba invadens
TCNGPTSSD

SEQ ID NO: 2778467 - protein, 9 aa, Entamoeba invadens
TCNGTSNGN

SEQ ID NO: 2778468 - protein, 13 aa, Entamoeba invadens
TCNKATGLTEYKD

SEQ ID NO: 2778469 - protein, 12 aa, Entamoeba invadens
TCNKTCKIGKTN

SEQ ID NO: 2778470 - protein, 12 aa, Entamoeba invadens
TCNNGNTCTSCA

SEQ ID NO: 2778471 - protein, 5 aa, Entamoeba invadens
TCNNR

SEQ ID NO: 2778472 - protein, 9 aa, Entamoeba invadens
TCNNTNNGS

SEQ ID NO: 2778473 - protein, 8 aa, Entamoeba invadens
TCNPTNGK

SEQ ID NO: 2778474 - protein, 6 aa, Entamoeba invadens
TCNQKS

SEQ ID NO: 2778475 - protein, 8 aa, Entamoeba invadens
TCNSEEYD

SEQ ID NO: 2778476 - protein, 9 aa, Entamoeba invadens
TCNSGTECA

SEQ ID NO: 2778477 - protein, 5 aa, Entamoeba invadens
TCNSK

SEQ ID NO: 2778478 - protein, 9 aa, Entamoeba invadens
TCNSKEDKL

SEQ ID NO: 2778479 - protein, 8 aa, Entamoeba invadens
TCNSQNGT

SEQ ID NO: 2778480 - protein, 6 aa, Entamoeba invadens
TCNSST

SEQ ID NO: 2778481 - protein, 7 aa, Entamoeba invadens
TCNSSTK

SEQ ID NO: 2778482 - protein, 4 aa, Entamoeba invadens
TCNT

SEQ ID NO: 2778483 - protein, 6 aa, Entamoeba invadens
TCNTKN

SEQ ID NO: 2778484 - protein, 8 aa, Entamoeba invadens
TCNTNYER

SEQ ID NO: 2778485 - protein, 14 aa, Entamoeba invadens
TCNTSNGNCEKCTE

SEQ ID NO: 2778486 - protein, 39 aa, Entamoeba invadens
TCNVDKSNFQSNPNSVHCTDDSVSSRTGLRQTVSGMETG

SEQ ID NO: 2778487 - protein, 12 aa, Entamoeba invadens
TCPAGTYQSGGS

SEQ ID NO: 2778488 - protein, 13 aa, Entamoeba invadens
TCPAGTYQSGGSC

SEQ ID NO: 2778489 - protein, 11 aa, Entamoeba invadens
TCPDDKVTSKC

SEQ ID NO: 2778490 - protein, 12 aa, Entamoeba invadens
TCPDNQFANGTS

SEQ ID NO: 2778491 - protein, 14 aa, Entamoeba invadens
TCPEGYEANKETKK

SEQ ID NO: 2778492 - protein, 19 aa, Entamoeba invadens
TCPITPPEPCRGKGCNPVH

SEQ ID NO: 2778493 - protein, 11 aa, Entamoeba invadens
TCPNCNSSNGN

SEQ ID NO: 2778494 - protein, 8 aa, Entamoeba invadens
TCPNTNQY

SEQ ID NO: 2778495 - protein, 15 aa, Entamoeba invadens
TCPPGTFSDGTDSKC

SEQ ID NO: 2778496 - protein, 11 aa, Entamoeba invadens
TCPQNCGSNGI

SEQ ID NO: 2778497 - protein, 33 aa, Entamoeba invadens
TCPSGTKSNSDTTKCDNCPAGYYSKEKSSSCTE

SEQ ID NO: 2778498 - protein, 19 aa, Entamoeba invadens
TCPSGTYSLDRSTDCKSCE

SEQ ID NO: 2778499 - protein, 9 aa, Entamoeba invadens
TCQKNKEQN

SEQ ID NO: 2778500 - protein, 4 aa, Entamoeba invadens
TCQN

SEQ ID NO: 2778501 - protein, 13 aa, Entamoeba invadens
TCQNGQYPDTSNG

SEQ ID NO: 2778502 - protein, 18 aa, Entamoeba invadens
TCQPEQYNGQGRDPTNQC

SEQ ID NO: 2778503 - protein, 12 aa, Entamoeba invadens
TCQPGYKETTNE

SEQ ID NO: 2778504 - protein, 13 aa, Entamoeba invadens
TCQQNECNTATGQ

SEQ ID NO: 2778505 - protein, 15 aa, Entamoeba invadens
TCQQNKCNTASGQCT

SEQ ID NO: 2778506 - protein, 13 aa, Entamoeba invadens
TCQRKTQSDDLDD

SEQ ID NO: 2778507 - protein, 7 aa, Entamoeba invadens
TCQSCTP

SEQ ID NO: 2778508 - protein, 6 aa, Entamoeba invadens
TCQSGK

SEQ ID NO: 2778509 - protein, 11 aa, Entamoeba invadens
TCQSGSDSDST

SEQ ID NO: 2778510 - protein, 5 aa, Entamoeba invadens
TCQTC

SEQ ID NO: 2778511 - protein, 12 aa, Entamoeba invadens
TCQTEKASEVIG

SEQ ID NO: 2778512 - protein, 12 aa, Entamoeba invadens
TCQTNTCNTNDG

SEQ ID NO: 2778513 - protein, 12 aa, Entamoeba invadens
TCQTNTCNTNNG

SEQ ID NO: 2778514 - protein, 15 aa, Entamoeba invadens
TCRDGTYSSTPGSTN

SEQ ID NO: 2778515 - protein, 11 aa, Entamoeba invadens
TCRGPCEEKEG

SEQ ID NO: 2778516 - protein, 7 aa, Entamoeba invadens
TCRPDGS

SEQ ID NO: 2778517 - protein, 5 aa, Entamoeba invadens
TCSAT

SEQ ID NO: 2778518 - protein, 12 aa, Entamoeba invadens
TCSDKTTCTKCS

SEQ ID NO: 2778519 - protein, 14 aa, Entamoeba invadens
TCSDNCNKCTSQTT

SEQ ID NO: 2778520 - protein, 9 aa, Entamoeba invadens
TCSGSNANN

SEQ ID NO: 2778521 - protein, 9 aa, Entamoeba invadens
TCSGSNENN

SEQ ID NO: 2778522 - protein, 12 aa, Entamoeba invadens
TCSKTSRKCNKC

SEQ ID NO: 2778523 - protein, 6 aa, Entamoeba invadens
TCSNED

SEQ ID NO: 2778524 - protein, 7 aa, Entamoeba invadens
TCSNENS

SEQ ID NO: 2778525 - protein, 8 aa, Entamoeba invadens
TCSPTHER

SEQ ID NO: 2778526 - protein, 7 aa, Entamoeba invadens
TCSPTYE

SEQ ID NO: 2778527 - protein, 8 aa, Entamoeba invadens
TCSQTERK

SEQ ID NO: 2778528 - protein, 6 aa, Entamoeba invadens
TCSQTS

SEQ ID NO: 2778529 - protein, 8 aa, Entamoeba invadens
TCSQTTKR

SEQ ID NO: 2778530 - protein, 9 aa, Entamoeba invadens
TCSRTSDKC

SEQ ID NO: 2778531 - protein, 13 aa, Entamoeba invadens
TCSSATGKCSACQ

SEQ ID NO: 2778532 - protein, 5 aa, Entamoeba invadens
TCSSC

SEQ ID NO: 2778533 - protein, 8 aa, Entamoeba invadens
TCSSCDNI

SEQ ID NO: 2778534 - protein, 11 aa, Entamoeba invadens
TCSSDKKRSCS

SEQ ID NO: 2778535 - protein, 16 aa, Entamoeba invadens
TCSSKSGSQQSDCTSC

SEQ ID NO: 2778536 - protein, 6 aa, Entamoeba invadens
TCSSLP

SEQ ID NO: 2778537 - protein, 14 aa, Entamoeba invadens
TCSSRTDEVDCTGN

SEQ ID NO: 2778538 - protein, 13 aa, Entamoeba invadens
TCSSSNCESCEES

SEQ ID NO: 2778539 - protein, 5 aa, Entamoeba invadens
TCSST

SEQ ID NO: 2778540 - protein, 9 aa, Entamoeba invadens
TCSSTTGKC

SEQ ID NO: 2778541 - protein, 11 aa, Entamoeba invadens
TCSSTTGKCSA

SEQ ID NO: 2778542 - protein, 13 aa, Entamoeba invadens
TCSSTTGKCSACQ

SEQ ID NO: 2778543 - protein, 13 aa, Entamoeba invadens
TCSTKSNSCVSCT

SEQ ID NO: 2778544 - protein, 10 aa, Entamoeba invadens
TCSTQNEKSV

SEQ ID NO: 2778545 - protein, 9 aa, Entamoeba invadens
TCSTQSGQI

SEQ ID NO: 2778546 - protein, 6 aa, Entamoeba invadens
TCSTSQ

SEQ ID NO: 2778547 - protein, 25 aa, Entamoeba invadens
TCSTSSSTCTACTDNTMSPSVTNTC

SEQ ID NO: 2778548 - protein, 5 aa, Entamoeba invadens
TCSTT

SEQ ID NO: 2778549 - protein, 7 aa, Entamoeba invadens
TCSTTEK

SEQ ID NO: 2778550 - protein, 6 aa, Entamoeba invadens
TCSTTK

SEQ ID NO: 2778551 - protein, 14 aa, Entamoeba invadens
TCSTTTSNCTECNS

SEQ ID NO: 2778552 - protein, 12 aa, Entamoeba invadens
TCSVGNKKLNGI

SEQ ID NO: 2778553 - protein, 5 aa, Entamoeba invadens
TCSVT

SEQ ID NO: 2778554 - protein, 10 aa, Entamoeba invadens
TCTAKTTGTL

SEQ ID NO: 2778555 - protein, 7 aa, Entamoeba invadens
TCTDETK

SEQ ID NO: 2778556 - protein, 30 aa, Entamoeba invadens
TCTEATKCTECTTGNLQPEDKTCKANCPDG

SEQ ID NO: 2778557 - protein, 31 aa, Entamoeba invadens
TCTEGTKCTECATGNLQPEDKTCKKDCPDGY

SEQ ID NO: 2778558 - protein, 11 aa, Entamoeba invadens
TCTGENANQCT

SEQ ID NO: 2778559 - protein, 21 aa, Entamoeba invadens
TCTGGANTFEEYKTNTEAKKC

SEQ ID NO: 2778560 - protein, 17 aa, Entamoeba invadens
TCTGGSDTYEGSAEAGA

SEQ ID NO: 2778561 - protein, 12 aa, Entamoeba invadens
TCTGGSSTYEGS

SEQ ID NO: 2778562 - protein, 11 aa, Entamoeba invadens
TCTHPKNAHPV

SEQ ID NO: 2778563 - protein, 10 aa, Entamoeba invadens
TCTKCDTNTN

SEQ ID NO: 2778564 - protein, 9 aa, Entamoeba invadens
TCTKEPITN

SEQ ID NO: 2778565 - protein, 7 aa, Entamoeba invadens
TCTKRAV

SEQ ID NO: 2778566 - protein, 4 aa, Entamoeba invadens
TCTN

SEQ ID NO: 2778567 - protein, 7 aa, Entamoeba invadens
TCTNNGN

SEQ ID NO: 2778568 - protein, 12 aa, Entamoeba invadens
TCTPQGCNVQTG

SEQ ID NO: 2778569 - protein, 6 aa, Entamoeba invadens
TCTQCD

SEQ ID NO: 2778570 - protein, 5 aa, Entamoeba invadens
TCTQH

SEQ ID NO: 2778571 - protein, 6 aa, Entamoeba invadens
TCTRCG

SEQ ID NO: 2778572 - protein, 5 aa, Entamoeba invadens
TCTSC

SEQ ID NO: 2778573 - protein, 5 aa, Entamoeba invadens
TCTSG

SEQ ID NO: 2778574 - protein, 8 aa, Entamoeba invadens
TCTSGKRI

SEQ ID NO: 2778575 - protein, 10 aa, Entamoeba invadens
TCTSKDNSVN

SEQ ID NO: 2778576 - protein, 5 aa, Entamoeba invadens
TCTSP

SEQ ID NO: 2778577 - protein, 42 aa, Entamoeba invadens
TCTSSEPNKCASCKGTNKLSVDKTKCSATCPSGQTASNNNTC

SEQ ID NO: 2778578 - protein, 12 aa, Entamoeba invadens
TCTTNDQTCNSC

SEQ ID NO: 2778579 - protein, 7 aa, Entamoeba invadens
TCTTTNE

SEQ ID NO: 2778580 - protein, 9 aa, Entamoeba invadens
TCVKKDENC

SEQ ID NO: 2778581 - protein, 7 aa, Entamoeba invadens
TCVNESK

SEQ ID NO: 2778582 - protein, 5 aa, Entamoeba invadens
TCVPQ

SEQ ID NO: 2778583 - protein, 11 aa, Entamoeba invadens
TCVSTQQTVND

SEQ ID NO: 2778584 - protein, 4 aa, Entamoeba invadens
TDAA

SEQ ID NO: 2778585 - protein, 8 aa, Entamoeba invadens
TDAASSTY

SEQ ID NO: 2778586 - protein, 9 aa, Entamoeba invadens
TDADCYSQR

SEQ ID NO: 2778587 - protein, 10 aa, Entamoeba invadens
TDADSEQEIA

SEQ ID NO: 2778588 - protein, 4 aa, Entamoeba invadens
TDAE

SEQ ID NO: 2778589 - protein, 20 aa, Entamoeba invadens
TDAEEKKKEPDEKKKQNEIQ

SEQ ID NO: 2778590 - protein, 21 aa, Entamoeba invadens
TDAEENSSTDVAESTPFIEIN

SEQ ID NO: 2778591 - protein, 5 aa, Entamoeba invadens
TDAGK

SEQ ID NO: 2778592 - protein, 9 aa, Entamoeba invadens
TDAISSTQL

SEQ ID NO: 2778593 - protein, 30 aa, Entamoeba invadens
TDAKEGSDNRSPTLQNVEQKKDDATQKKDM

SEQ ID NO: 2778594 - protein, 10 aa, Entamoeba invadens
TDAKFAGEIT

SEQ ID NO: 2778595 - protein, 4 aa, Entamoeba invadens
TDAN

SEQ ID NO: 2778596 - protein, 17 aa, Entamoeba invadens
TDANEDKFDEVQQAQRV

SEQ ID NO: 2778597 - protein, 5 aa, Entamoeba invadens
TDASI

SEQ ID NO: 2778598 - protein, 5 aa, Entamoeba invadens
TDASR

SEQ ID NO: 2778599 - protein, 9 aa, Entamoeba invadens
TDASSSTHI

SEQ ID NO: 2778600 - protein, 10 aa, Entamoeba invadens
TDASSSTQID

SEQ ID NO: 2778601 - protein, 9 aa, Entamoeba invadens
TDASTDLSA

SEQ ID NO: 2778602 - protein, 4 aa, Entamoeba invadens
TDAT

SEQ ID NO: 2778603 - protein, 9 aa, Entamoeba invadens
TDATGQQEI

SEQ ID NO: 2778604 - protein, 6 aa, Entamoeba invadens
TDCDDY

SEQ ID NO: 2778605 - protein, 4 aa, Entamoeba invadens
TDCG

SEQ ID NO: 2778606 - protein, 6 aa, Entamoeba invadens
TDCNSC

SEQ ID NO: 2778607 - protein, 6 aa, Entamoeba invadens
TDCSTR

SEQ ID NO: 2778608 - protein, 9 aa, Entamoeba invadens
TDCSVSDRT

SEQ ID NO: 2778609 - protein, 10 aa, Entamoeba invadens
TDCTKNPRTN

SEQ ID NO: 2778610 - protein, 12 aa, Entamoeba invadens
TDDAIPVDKESR

SEQ ID NO: 2778611 - protein, 9 aa, Entamoeba invadens
TDDDKLPDI

SEQ ID NO: 2778612 - protein, 7 aa, Entamoeba invadens
TDDEFTT

SEQ ID NO: 2778613 - protein, 8 aa, Entamoeba invadens
TDDEFTTE

SEQ ID NO: 2778614 - protein, 7 aa, Entamoeba invadens
TDDEGKY

SEQ ID NO: 2778615 - protein, 6 aa, Entamoeba invadens
TDDFGG

SEQ ID NO: 2778616 - protein, 15 aa, Entamoeba invadens
TDDGQFQANPASELY

SEQ ID NO: 2778617 - protein, 6 aa, Entamoeba invadens
TDDGTV

SEQ ID NO: 2778618 - protein, 5 aa, Entamoeba invadens
TDDKK

SEQ ID NO: 2778619 - protein, 9 aa, Entamoeba invadens
TDDKNKCQE

SEQ ID NO: 2778620 - protein, 7 aa, Entamoeba invadens
TDDLSKG

SEQ ID NO: 2778621 - protein, 8 aa, Entamoeba invadens
TDDNSFSE

SEQ ID NO: 2778622 - protein, 5 aa, Entamoeba invadens
TDDPR

SEQ ID NO: 2778623 - protein, 11 aa, Entamoeba invadens
TDDSPANTNCT

SEQ ID NO: 2778624 - protein, 10 aa, Entamoeba invadens
TDDTCGDKCP

SEQ ID NO: 2778625 - protein, 9 aa, Entamoeba invadens
TDDTPSRLT

SEQ ID NO: 2778626 - protein, 13 aa, Entamoeba invadens
TDDTRLKGKQTFY

SEQ ID NO: 2778627 - protein, 19 aa, Entamoeba invadens
TDDVKNELAQRQAAWANKG

SEQ ID NO: 2778628 - protein, 5 aa, Entamoeba invadens
TDDYK

SEQ ID NO: 2778629 - protein, 6 aa, Entamoeba invadens
TDEARR

SEQ ID NO: 2778630 - protein, 5 aa, Entamoeba invadens
TDECG

SEQ ID NO: 2778631 - protein, 11 aa, Entamoeba invadens
TDEDLEGGENL

SEQ ID NO: 2778632 - protein, 5 aa, Entamoeba invadens
TDEDV

SEQ ID NO: 2778633 - protein, 9 aa, Entamoeba invadens
TDEECKDLE

SEQ ID NO: 2778634 - protein, 6 aa, Entamoeba invadens
TDEEIE

SEQ ID NO: 2778635 - protein, 7 aa, Entamoeba invadens
TDEETID

SEQ ID NO: 2778636 - protein, 14 aa, Entamoeba invadens
TDEGENGAGTIAID

SEQ ID NO: 2778637 - protein, 20 aa, Entamoeba invadens
TDEGENGAGTITIDSSADIT

SEQ ID NO: 2778638 - protein, 9 aa, Entamoeba invadens
TDEGGPKEI

SEQ ID NO: 2778639 - protein, 8 aa, Entamoeba invadens
TDEGTGCK

SEQ ID NO: 2778640 - protein, 10 aa, Entamoeba invadens
TDEKCSTGGV

SEQ ID NO: 2778641 - protein, 20 aa, Entamoeba invadens
TDEKDKTAGEITIDSTADVS

SEQ ID NO: 2778642 - protein, 6 aa, Entamoeba invadens
TDEKLE

SEQ ID NO: 2778643 - protein, 8 aa, Entamoeba invadens
TDEKRTCK

SEQ ID NO: 2778644 - protein, 5 aa, Entamoeba invadens
TDEKT

SEQ ID NO: 2778645 - protein, 5 aa, Entamoeba invadens
TDEKV

SEQ ID NO: 2778646 - protein, 10 aa, Entamoeba invadens
TDELGENAKE

SEQ ID NO: 2778647 - protein, 6 aa, Entamoeba invadens
TDEMGS

SEQ ID NO: 2778648 - protein, 4 aa, Entamoeba invadens
TDEN

SEQ ID NO: 2778649 - protein, 10 aa, Entamoeba invadens
TDENAKNMCS

SEQ ID NO: 2778650 - protein, 6 aa, Entamoeba invadens
TDENGL

SEQ ID NO: 2778651 - protein, 15 aa, Entamoeba invadens
TDENGTEIPANEESR

SEQ ID NO: 2778652 - protein, 5 aa, Entamoeba invadens
TDEPI

SEQ ID NO: 2778653 - protein, 8 aa, Entamoeba invadens
TDEQTGTL

SEQ ID NO: 2778654 - protein, 13 aa, Entamoeba invadens
TDESFEEEHYHTL

SEQ ID NO: 2778655 - protein, 4 aa, Entamoeba invadens
TDET

SEQ ID NO: 2778656 - protein, 5 aa, Entamoeba invadens
TDETK

SEQ ID NO: 2778657 - protein, 6 aa, Entamoeba invadens
TDETQC

SEQ ID NO: 2778658 - protein, 9 aa, Entamoeba invadens
TDEVEGDVD

SEQ ID NO: 2778659 - protein, 8 aa, Entamoeba invadens
TDEYPRHC

SEQ ID NO: 2778660 - protein, 5 aa, Entamoeba invadens
TDFAD

SEQ ID NO: 2778661 - protein, 4 aa, Entamoeba invadens
TDFE

SEQ ID NO: 2778662 - protein, 5 aa, Entamoeba invadens
TDFEG

SEQ ID NO: 2778663 - protein, 6 aa, Entamoeba invadens
TDFEQK

SEQ ID NO: 2778664 - protein, 5 aa, Entamoeba invadens
TDFGA

SEQ ID NO: 2778665 - protein, 7 aa, Entamoeba invadens
TDFGASR

SEQ ID NO: 2778666 - protein, 7 aa, Entamoeba invadens
TDFGDNG

SEQ ID NO: 2778667 - protein, 9 aa, Entamoeba invadens
TDFGSARNT

SEQ ID NO: 2778668 - protein, 11 aa, Entamoeba invadens
TDFGSSRNTSS

SEQ ID NO: 2778669 - protein, 9 aa, Entamoeba invadens
TDFGSSRNV

SEQ ID NO: 2778670 - protein, 11 aa, Entamoeba invadens
TDFGSSRNVNS

SEQ ID NO: 2778671 - protein, 12 aa, Entamoeba invadens
TDFGSSRNVNSL

SEQ ID NO: 2778672 - protein, 8 aa, Entamoeba invadens
TDFGSSRS

SEQ ID NO: 2778673 - protein, 8 aa, Entamoeba invadens
TDFGTSRG

SEQ ID NO: 2778674 - protein, 7 aa, Entamoeba invadens
TDFKPKT

SEQ ID NO: 2778675 - protein, 5 aa, Entamoeba invadens
TDFPG

SEQ ID NO: 2778676 - protein, 9 aa, Entamoeba invadens
TDFQSSKKE

SEQ ID NO: 2778677 - protein, 13 aa, Entamoeba invadens
TDFSQPQHRKSPK

SEQ ID NO: 2778678 - protein, 12 aa, Entamoeba invadens
TDFSSKQKNGDL

SEQ ID NO: 2778679 - protein, 6 aa, Entamoeba invadens
TDGKCS

SEQ ID NO: 2778680 - protein, 7 aa, Entamoeba invadens
TDGKESS

SEQ ID NO: 2778681 - protein, 5 aa, Entamoeba invadens
TDGND

SEQ ID NO: 2778682 - protein, 4 aa, Entamoeba invadens
TDGS

SEQ ID NO: 2778683 - protein, 6 aa, Entamoeba invadens
TDGSFT

SEQ ID NO: 2778684 - protein, 9 aa, Entamoeba invadens
TDGSPEKRE

SEQ ID NO: 2778685 - protein, 10 aa, Entamoeba invadens
TDGSTCSECT

SEQ ID NO: 2778686 - protein, 6 aa, Entamoeba invadens
TDGTCK

SEQ ID NO: 2778687 - protein, 5 aa, Entamoeba invadens
TDGTF

SEQ ID NO: 2778688 - protein, 10 aa, Entamoeba invadens
TDGTNADPTT

SEQ ID NO: 2778689 - protein, 6 aa, Entamoeba invadens
TDGTSI

SEQ ID NO: 2778690 - protein, 6 aa, Entamoeba invadens
TDGTTL

SEQ ID NO: 2778691 - protein, 4 aa, Entamoeba invadens
TDHE

SEQ ID NO: 2778692 - protein, 4 aa, Entamoeba invadens
TDHI

SEQ ID NO: 2778693 - protein, 10 aa, Entamoeba invadens
TDHRNQKEKI

SEQ ID NO: 2778694 - protein, 7 aa, Entamoeba invadens
TDHSTDL

SEQ ID NO: 2778695 - protein, 11 aa, Entamoeba invadens
TDHTNCSECST

SEQ ID NO: 2778696 - protein, 7 aa, Entamoeba invadens
TDHTPIC

SEQ ID NO: 2778697 - protein, 7 aa, Entamoeba invadens
TDHTPVC

SEQ ID NO: 2778698 - protein, 6 aa, Entamoeba invadens
TDIEPI

SEQ ID NO: 2778699 - protein, 7 aa, Entamoeba invadens
TDIGTTR

SEQ ID NO: 2778700 - protein, 8 aa, Entamoeba invadens
TDIKEQQR

SEQ ID NO: 2778701 - protein, 11 aa, Entamoeba invadens
TDIPEQTAGQS

SEQ ID NO: 2778702 - protein, 9 aa, Entamoeba invadens
TDIPVDSET

SEQ ID NO: 2778703 - protein, 5 aa, Entamoeba invadens
TDISS

SEQ ID NO: 2778704 - protein, 5 aa, Entamoeba invadens
TDITL

SEQ ID NO: 2778705 - protein, 8 aa, Entamoeba invadens
TDITVDSS

SEQ ID NO: 2778706 - protein, 4 aa, Entamoeba invadens
TDKA

SEQ ID NO: 2778707 - protein, 8 aa, Entamoeba invadens
TDKERAAD

SEQ ID NO: 2778708 - protein, 8 aa, Entamoeba invadens
TDKHPNSV

SEQ ID NO: 2778709 - protein, 4 aa, Entamoeba invadens
TDKI

SEQ ID NO: 2778710 - protein, 16 aa, Entamoeba invadens
TDKLDIGTNAFKGATK

SEQ ID NO: 2778711 - protein, 28 aa, Entamoeba invadens
TDKLDIGTNAFKGATKLSSFTAKAGIKT

SEQ ID NO: 2778712 - protein, 7 aa, Entamoeba invadens
TDKLPQK

SEQ ID NO: 2778713 - protein, 8 aa, Entamoeba invadens
TDKNGNAA

SEQ ID NO: 2778714 - protein, 9 aa, Entamoeba invadens
TDKNRAVDT

SEQ ID NO: 2778715 - protein, 7 aa, Entamoeba invadens
TDKPSFD

SEQ ID NO: 2778716 - protein, 7 aa, Entamoeba invadens
TDKPTEY

SEQ ID NO: 2778717 - protein, 7 aa, Entamoeba invadens
TDKQDLP

SEQ ID NO: 2778718 - protein, 11 aa, Entamoeba invadens
TDKQHSSELEY

SEQ ID NO: 2778719 - protein, 7 aa, Entamoeba invadens
TDKQKEF

SEQ ID NO: 2778720 - protein, 6 aa, Entamoeba invadens
TDKQKI

SEQ ID NO: 2778721 - protein, 10 aa, Entamoeba invadens
TDKRPDIDNG

SEQ ID NO: 2778722 - protein, 9 aa, Entamoeba invadens
TDKSNHKGH

SEQ ID NO: 2778723 - protein, 31 aa, Entamoeba invadens
TDKSTDNDAQYINEPDRNPNFGNKTQKEVKT

SEQ ID NO: 2778724 - protein, 9 aa, Entamoeba invadens
TDKSTSKRY

SEQ ID NO: 2778725 - protein, 4 aa, Entamoeba invadens
TDKT

SEQ ID NO: 2778726 - protein, 8 aa, Entamoeba invadens
TDKTDSNI

SEQ ID NO: 2778727 - protein, 13 aa, Entamoeba invadens
TDKTEKYTIRTEP

SEQ ID NO: 2778728 - protein, 10 aa, Entamoeba invadens
TDKTGTLTEN

SEQ ID NO: 2778729 - protein, 13 aa, Entamoeba invadens
TDKTKKDVSRRGP

SEQ ID NO: 2778730 - protein, 10 aa, Entamoeba invadens
TDKTQRRQLE

SEQ ID NO: 2778731 - protein, 5 aa, Entamoeba invadens
TDKTT

SEQ ID NO: 2778732 - protein, 5 aa, Entamoeba invadens
TDKVL

SEQ ID NO: 2778733 - protein, 9 aa, Entamoeba invadens
TDLGKVDNV

SEQ ID NO: 2778734 - protein, 7 aa, Entamoeba invadens
TDLIDKS

SEQ ID NO: 2778735 - protein, 9 aa, Entamoeba invadens
TDLSENSNL

SEQ ID NO: 2778736 - protein, 7 aa, Entamoeba invadens
TDLSPED

SEQ ID NO: 2778737 - protein, 11 aa, Entamoeba invadens
TDLTNSQSSGI

SEQ ID NO: 2778738 - protein, 9 aa, Entamoeba invadens
TDMDNNDGS

SEQ ID NO: 2778739 - protein, 5 aa, Entamoeba invadens
TDNAE

SEQ ID NO: 2778740 - protein, 9 aa, Entamoeba invadens
TDNDCKDVS

SEQ ID NO: 2778741 - protein, 12 aa, Entamoeba invadens
TDNECSETLTGS

SEQ ID NO: 2778742 - protein, 6 aa, Entamoeba invadens
TDNEKT

SEQ ID NO: 2778743 - protein, 22 aa, Entamoeba invadens
TDNHKSDDEVLDEDQNNTGKKW

SEQ ID NO: 2778744 - protein, 7 aa, Entamoeba invadens
TDNHSRG

SEQ ID NO: 2778745 - protein, 7 aa, Entamoeba invadens
TDNLESQ

SEQ ID NO: 2778746 - protein, 5 aa, Entamoeba invadens
TDNLK

SEQ ID NO: 2778747 - protein, 7 aa, Entamoeba invadens
TDNNKYN

SEQ ID NO: 2778748 - protein, 15 aa, Entamoeba invadens
TDNNTAKVQVGNSNQ

SEQ ID NO: 2778749 - protein, 6 aa, Entamoeba invadens
TDNSFQ

SEQ ID NO: 2778750 - protein, 16 aa, Entamoeba invadens
TDNSPPVSVVQRSKTL

SEQ ID NO: 2778751 - protein, 15 aa, Entamoeba invadens
TDNTIQYEKADKYDD

SEQ ID NO: 2778752 - protein, 5 aa, Entamoeba invadens
TDNTL

SEQ ID NO: 2778753 - protein, 7 aa, Entamoeba invadens
TDNTNRV

SEQ ID NO: 2778754 - protein, 17 aa, Entamoeba invadens
TDNTQSSSELSESSEED

SEQ ID NO: 2778755 - protein, 6 aa, Entamoeba invadens
TDNYDD

SEQ ID NO: 2778756 - protein, 6 aa, Entamoeba invadens
TDNYKG

SEQ ID NO: 2778757 - protein, 15 aa, Entamoeba invadens
TDPAHDEDCGRCPGG

SEQ ID NO: 2778758 - protein, 14 aa, Entamoeba invadens
TDPARLKERKYNSV

SEQ ID NO: 2778759 - protein, 12 aa, Entamoeba invadens
TDPASSSFDPTA

SEQ ID NO: 2778760 - protein, 6 aa, Entamoeba invadens
TDPDCV

SEQ ID NO: 2778761 - protein, 13 aa, Entamoeba invadens
TDPESKNSCIPKG

SEQ ID NO: 2778762 - protein, 10 aa, Entamoeba invadens
TDPHSKDYSK

SEQ ID NO: 2778763 - protein, 9 aa, Entamoeba invadens
TDPKDPKSC

SEQ ID NO: 2778764 - protein, 10 aa, Entamoeba invadens
TDPKDTTKPI

SEQ ID NO: 2778765 - protein, 9 aa, Entamoeba invadens
TDPKSENDC

SEQ ID NO: 2778766 - protein, 8 aa, Entamoeba invadens
TDPKSKKC

SEQ ID NO: 2778767 - protein, 8 aa, Entamoeba invadens
TDPKTTSC

SEQ ID NO: 2778768 - protein, 8 aa, Entamoeba invadens
TDPNDETS

SEQ ID NO: 2778769 - protein, 23 aa, Entamoeba invadens
TDPNGNTAEAYLPSGDECVSSTN

SEQ ID NO: 2778770 - protein, 4 aa, Entamoeba invadens
TDPP

SEQ ID NO: 2778771 - protein, 10 aa, Entamoeba invadens
TDPQKAGPRY

SEQ ID NO: 2778772 - protein, 5 aa, Entamoeba invadens
TDPQY

SEQ ID NO: 2778773 - protein, 9 aa, Entamoeba invadens
TDPSKGLDC

SEQ ID NO: 2778774 - protein, 6 aa, Entamoeba invadens
TDPYPK

SEQ ID NO: 2778775 - protein, 13 aa, Entamoeba invadens
TDQDVEAQRASAR

SEQ ID NO: 2778776 - protein, 32 aa, Entamoeba invadens
TDQGESKQAKEVECDSASDIPLEPKKGHGKRT

SEQ ID NO: 2778777 - protein, 18 aa, Entamoeba invadens
TDQNGICKNKEQKGNCTY

SEQ ID NO: 2778778 - protein, 7 aa, Entamoeba invadens
TDQPKDT

SEQ ID NO: 2778779 - protein, 8 aa, Entamoeba invadens
TDQQNSKN

SEQ ID NO: 2778780 - protein, 13 aa, Entamoeba invadens
TDQSSSYPDGNNL

SEQ ID NO: 2778781 - protein, 7 aa, Entamoeba invadens
TDQTASV

SEQ ID NO: 2778782 - protein, 8 aa, Entamoeba invadens
TDQTFPDK

SEQ ID NO: 2778783 - protein, 6 aa, Entamoeba invadens
TDQYSC

SEQ ID NO: 2778784 - protein, 8 aa, Entamoeba invadens
TDRTQQLN

SEQ ID NO: 2778785 - protein, 9 aa, Entamoeba invadens
TDRTQQLNE

SEQ ID NO: 2778786 - protein, 6 aa, Entamoeba invadens
TDRTTE

SEQ ID NO: 2778787 - protein, 4 aa, Entamoeba invadens
TDSA

SEQ ID NO: 2778788 - protein, 9 aa, Entamoeba invadens
TDSASSTHI

SEQ ID NO: 2778789 - protein, 7 aa, Entamoeba invadens
TDSAVNA

SEQ ID NO: 2778790 - protein, 5 aa, Entamoeba invadens
TDSCK

SEQ ID NO: 2778791 - protein, 7 aa, Entamoeba invadens
TDSCSIG

SEQ ID NO: 2778792 - protein, 5 aa, Entamoeba invadens
TDSEL

SEQ ID NO: 2778793 - protein, 7 aa, Entamoeba invadens
TDSIDDM

SEQ ID NO: 2778794 - protein, 4 aa, Entamoeba invadens
TDSK

SEQ ID NO: 2778795 - protein, 18 aa, Entamoeba invadens
TDSKRTEITDNSKLNYTV

SEQ ID NO: 2778796 - protein, 17 aa, Entamoeba invadens
TDSNAELKKSESSNNYC

SEQ ID NO: 2778797 - protein, 9 aa, Entamoeba invadens
TDSNIPVDV

SEQ ID NO: 2778798 - protein, 5 aa, Entamoeba invadens
TDSPL

SEQ ID NO: 2778799 - protein, 15 aa, Entamoeba invadens
TDSPMHTHSTKEPLV

SEQ ID NO: 2778800 - protein, 7 aa, Entamoeba invadens
TDSPQIS

SEQ ID NO: 2778801 - protein, 28 aa, Entamoeba invadens
TDSQNASLSSSIENTPRDRGSFEYRNEN

SEQ ID NO: 2778802 - protein, 8 aa, Entamoeba invadens
TDSSESSE

SEQ ID NO: 2778803 - protein, 7 aa, Entamoeba invadens
TDSSNYS

SEQ ID NO: 2778804 - protein, 9 aa, Entamoeba invadens
TDSTRASPI

SEQ ID NO: 2778805 - protein, 9 aa, Entamoeba invadens
TDSTTCSGC

SEQ ID NO: 2778806 - protein, 10 aa, Entamoeba invadens
TDSYGTPHYG

SEQ ID NO: 2778807 - protein, 11 aa, Entamoeba invadens
TDSYGTPRYGE

SEQ ID NO: 2778808 - protein, 10 aa, Entamoeba invadens
TDTAQMTTKS

SEQ ID NO: 2778809 - protein, 11 aa, Entamoeba invadens
TDTDFRNTTTL

SEQ ID NO: 2778810 - protein, 7 aa, Entamoeba invadens
TDTDTSL

SEQ ID NO: 2778811 - protein, 7 aa, Entamoeba invadens
TDTEMDE

SEQ ID NO: 2778812 - protein, 12 aa, Entamoeba invadens
TDTKLSRNSLQP

SEQ ID NO: 2778813 - protein, 9 aa, Entamoeba invadens
TDTLNSESK

SEQ ID NO: 2778814 - protein, 13 aa, Entamoeba invadens
TDTNDVNSFGRSA

SEQ ID NO: 2778815 - protein, 5 aa, Entamoeba invadens
TDTNG

SEQ ID NO: 2778816 - protein, 6 aa, Entamoeba invadens
TDTNGT

SEQ ID NO: 2778817 - protein, 6 aa, Entamoeba invadens
TDTPAI

SEQ ID NO: 2778818 - protein, 7 aa, Entamoeba invadens
TDTQKDN

SEQ ID NO: 2778819 - protein, 12 aa, Entamoeba invadens
TDTRDPQKKEQQ

SEQ ID NO: 2778820 - protein, 13 aa, Entamoeba invadens
TDTSSIKTEATSD

SEQ ID NO: 2778821 - protein, 13 aa, Entamoeba invadens
TDTSSVKRQATSD

SEQ ID NO: 2778822 - protein, 17 aa, Entamoeba invadens
TDTYRVSSKADTNGSNK

SEQ ID NO: 2778823 - protein, 7 aa, Entamoeba invadens
TDVAGEY

SEQ ID NO: 2778824 - protein, 10 aa, Entamoeba invadens
TDVEDTPPYS

SEQ ID NO: 2778825 - protein, 13 aa, Entamoeba invadens
TDVEEKTYNSSTV

SEQ ID NO: 2778826 - protein, 9 aa, Entamoeba invadens
TDVNNSGYY

SEQ ID NO: 2778827 - protein, 6 aa, Entamoeba invadens
TDVSQY

SEQ ID NO: 2778828 - protein, 5 aa, Entamoeba invadens
TDVTE

SEQ ID NO: 2778829 - protein, 4 aa, Entamoeba invadens
TDYL

SEQ ID NO: 2778830 - protein, 16 aa, Entamoeba invadens
TDYLSDDKCNNCTSDI

SEQ ID NO: 2778831 - protein, 4 aa, Entamoeba invadens
TDYN

SEQ ID NO: 2778832 - protein, 6 aa, Entamoeba invadens
TDYNSS

SEQ ID NO: 2778833 - protein, 12 aa, Entamoeba invadens
TEADKSLETTQT

SEQ ID NO: 2778834 - protein, 5 aa, Entamoeba invadens
TEAGT

SEQ ID NO: 2778835 - protein, 10 aa, Entamoeba invadens
TEAGTCDQCE

SEQ ID NO: 2778836 - protein, 21 aa, Entamoeba invadens
TEAKEESPEINKATPPMNKTE

SEQ ID NO: 2778837 - protein, 8 aa, Entamoeba invadens
TEANGYGS

SEQ ID NO: 2778838 - protein, 10 aa, Entamoeba invadens
TEANRSTSID

SEQ ID NO: 2778839 - protein, 13 aa, Entamoeba invadens
TEAQETPSAPHSA

SEQ ID NO: 2778840 - protein, 9 aa, Entamoeba invadens
TEASRERVG

SEQ ID NO: 2778841 - protein, 8 aa, Entamoeba invadens
TEATQNKW

SEQ ID NO: 2778842 - protein, 10 aa, Entamoeba invadens
TEATSSTQID

SEQ ID NO: 2778843 - protein, 9 aa, Entamoeba invadens
TECATNMDT

SEQ ID NO: 2778844 - protein, 9 aa, Entamoeba invadens
TECDSTTGY

SEQ ID NO: 2778845 - protein, 12 aa, Entamoeba invadens
TECEEAFNSNDK

SEQ ID NO: 2778846 - protein, 6 aa, Entamoeba invadens
TECNNS

SEQ ID NO: 2778847 - protein, 5 aa, Entamoeba invadens
TECTK

SEQ ID NO: 2778848 - protein, 8 aa, Entamoeba invadens
TEDDEIDV

SEQ ID NO: 2778849 - protein, 9 aa, Entamoeba invadens
TEDDTSLPY

SEQ ID NO: 2778850 - protein, 4 aa, Entamoeba invadens
TEDE

SEQ ID NO: 2778851 - protein, 6 aa, Entamoeba invadens
TEDEHY

SEQ ID NO: 2778852 - protein, 9 aa, Entamoeba invadens
TEDEKANDQ

SEQ ID NO: 2778853 - protein, 7 aa, Entamoeba invadens
TEDETYS

SEQ ID NO: 2778854 - protein, 9 aa, Entamoeba invadens
TEDGSTITS

SEQ ID NO: 2778855 - protein, 5 aa, Entamoeba invadens
TEDIT

SEQ ID NO: 2778856 - protein, 10 aa, Entamoeba invadens
TEDKKLGQGS

SEQ ID NO: 2778857 - protein, 5 aa, Entamoeba invadens
TEDLS

SEQ ID NO: 2778858 - protein, 8 aa, Entamoeba invadens
TEDNGDIT

SEQ ID NO: 2778859 - protein, 7 aa, Entamoeba invadens
TEDNGNC

SEQ ID NO: 2778860 - protein, 19 aa, Entamoeba invadens
TEDPTTPGGSVKTQLKSGT

SEQ ID NO: 2778861 - protein, 8 aa, Entamoeba invadens
TEDQNQMD

SEQ ID NO: 2778862 - protein, 7 aa, Entamoeba invadens
TEDSNSH

SEQ ID NO: 2778863 - protein, 9 aa, Entamoeba invadens
TEDSQNEGQ

SEQ ID NO: 2778864 - protein, 19 aa, Entamoeba invadens
TEDSTTPGGSVKTQIKSGT

SEQ ID NO: 2778865 - protein, 16 aa, Entamoeba invadens
TEDTNGCEERNNKGCQ

SEQ ID NO: 2778866 - protein, 7 aa, Entamoeba invadens
TEDTPYP

SEQ ID NO: 2778867 - protein, 6 aa, Entamoeba invadens
TEDTQV

SEQ ID NO: 2778868 - protein, 7 aa, Entamoeba invadens
TEDTQYP

SEQ ID NO: 2778869 - protein, 7 aa, Entamoeba invadens
TEDTRHP

SEQ ID NO: 2778870 - protein, 5 aa, Entamoeba invadens
TEDTT

SEQ ID NO: 2778871 - protein, 5 aa, Entamoeba invadens
TEDTV

SEQ ID NO: 2778872 - protein, 9 aa, Entamoeba invadens
TEDTYTENV

SEQ ID NO: 2778873 - protein, 6 aa, Entamoeba invadens
TEEANY

SEQ ID NO: 2778874 - protein, 6 aa, Entamoeba invadens
TEEAPT

SEQ ID NO: 2778875 - protein, 23 aa, Entamoeba invadens
TEEATKPQIYSQDKTEHKEKAKS

SEQ ID NO: 2778876 - protein, 11 aa, Entamoeba invadens
TEECDNGTNCN

SEQ ID NO: 2778877 - protein, 13 aa, Entamoeba invadens
TEECDSGTNCDSQ

SEQ ID NO: 2778878 - protein, 4 aa, Entamoeba invadens
TEED

SEQ ID NO: 2778879 - protein, 8 aa, Entamoeba invadens
TEEDKESD

SEQ ID NO: 2778880 - protein, 14 aa, Entamoeba invadens
TEEEIGEVNTCDTN

SEQ ID NO: 2778881 - protein, 13 aa, Entamoeba invadens
TEEEKKEIAGEME

SEQ ID NO: 2778882 - protein, 5 aa, Entamoeba invadens
TEEEM

SEQ ID NO: 2778883 - protein, 7 aa, Entamoeba invadens
TEEEMDD

SEQ ID NO: 2778884 - protein, 7 aa, Entamoeba invadens
TEEESLN

SEQ ID NO: 2778885 - protein, 4 aa, Entamoeba invadens
TEEF

SEQ ID NO: 2778886 - protein, 7 aa, Entamoeba invadens
TEEGRRS

SEQ ID NO: 2778887 - protein, 4 aa, Entamoeba invadens
TEEK

SEQ ID NO: 2778888 - protein, 9 aa, Entamoeba invadens
TEEKMKPKF

SEQ ID NO: 2778889 - protein, 5 aa, Entamoeba invadens
TEEND

SEQ ID NO: 2778890 - protein, 8 aa, Entamoeba invadens
TEEPETNV

SEQ ID NO: 2778891 - protein, 8 aa, Entamoeba invadens
TEEPQRIQ

SEQ ID NO: 2778892 - protein, 6 aa, Entamoeba invadens
TEEQLK

SEQ ID NO: 2778893 - protein, 7 aa, Entamoeba invadens
TEERING

SEQ ID NO: 2778894 - protein, 5 aa, Entamoeba invadens
TEERV

SEQ ID NO: 2778895 - protein, 4 aa, Entamoeba invadens
TEES

SEQ ID NO: 2778896 - protein, 8 aa, Entamoeba invadens
TEESPDLI

SEQ ID NO: 2778897 - protein, 13 aa, Entamoeba invadens
TEETSRIPVATES

SEQ ID NO: 2778898 - protein, 4 aa, Entamoeba invadens
TEFE

SEQ ID NO: 2778899 - protein, 16 aa, Entamoeba invadens
TEFGSESVYGATSGNI

SEQ ID NO: 2778900 - protein, 7 aa, Entamoeba invadens
TEFPKQT

SEQ ID NO: 2778901 - protein, 4 aa, Entamoeba invadens
TEFT

SEQ ID NO: 2778902 - protein, 7 aa, Entamoeba invadens
TEGCDQS

SEQ ID NO: 2778903 - protein, 6 aa, Entamoeba invadens
TEGCQD

SEQ ID NO: 2778904 - protein, 6 aa, Entamoeba invadens
TEGDGM

SEQ ID NO: 2778905 - protein, 7 aa, Entamoeba invadens
TEGEIKQ

SEQ ID NO: 2778906 - protein, 12 aa, Entamoeba invadens
TEGEQDRVEEKR

SEQ ID NO: 2778907 - protein, 4 aa, Entamoeba invadens
TEGI

SEQ ID NO: 2778908 - protein, 5 aa, Entamoeba invadens
TEGIT

SEQ ID NO: 2778909 - protein, 6 aa, Entamoeba invadens
TEGKEI

SEQ ID NO: 2778910 - protein, 10 aa, Entamoeba invadens
TEGKQDKIEQ

SEQ ID NO: 2778911 - protein, 5 aa, Entamoeba invadens
TEGLK

SEQ ID NO: 2778912 - protein, 9 aa, Entamoeba invadens
TEGYDNDTS

SEQ ID NO: 2778913 - protein, 7 aa, Entamoeba invadens
TEGYTLK

SEQ ID NO: 2778914 - protein, 7 aa, Entamoeba invadens
TEHPSID

SEQ ID NO: 2778915 - protein, 4 aa, Entamoeba invadens
TEIE

SEQ ID NO: 2778916 - protein, 14 aa, Entamoeba invadens
TEIEPETLENKELT

SEQ ID NO: 2778917 - protein, 11 aa, Entamoeba invadens
TEIGKPGNNPH

SEQ ID NO: 2778918 - protein, 7 aa, Entamoeba invadens
TEINSGV

SEQ ID NO: 2778919 - protein, 8 aa, Entamoeba invadens
TEIPIEEE

SEQ ID NO: 2778920 - protein, 8 aa, Entamoeba invadens
TEIPTDVT

SEQ ID NO: 2778921 - protein, 9 aa, Entamoeba invadens
TEIPVEQES

SEQ ID NO: 2778922 - protein, 13 aa, Entamoeba invadens
TEIQGSTKEGVST

SEQ ID NO: 2778923 - protein, 5 aa, Entamoeba invadens
TEIRK

SEQ ID NO: 2778924 - protein, 13 aa, Entamoeba invadens
TEISSRLDPDELK

SEQ ID NO: 2778925 - protein, 13 aa, Entamoeba invadens
TEISTKLDPDELV

SEQ ID NO: 2778926 - protein, 22 aa, Entamoeba invadens
TEISTRLDPDELKEEKKLGEGS

SEQ ID NO: 2778927 - protein, 12 aa, Entamoeba invadens
TEITECTTNPHT

SEQ ID NO: 2778928 - protein, 6 aa, Entamoeba invadens
TEITGN

SEQ ID NO: 2778929 - protein, 8 aa, Entamoeba invadens
TEITNSRC

SEQ ID NO: 2778930 - protein, 12 aa, Entamoeba invadens
TEITTQLDPDEL

SEQ ID NO: 2778931 - protein, 9 aa, Entamoeba invadens
TEKADEFQK

SEQ ID NO: 2778932 - protein, 4 aa, Entamoeba invadens
TEKC

SEQ ID NO: 2778933 - protein, 11 aa, Entamoeba invadens
TEKCSDHTSTC

SEQ ID NO: 2778934 - protein, 4 aa, Entamoeba invadens
TEKD

SEQ ID NO: 2778935 - protein, 18 aa, Entamoeba invadens
TEKDETYQRSQGNSPTDF

SEQ ID NO: 2778936 - protein, 8 aa, Entamoeba invadens
TEKDGESV

SEQ ID NO: 2778937 - protein, 9 aa, Entamoeba invadens
TEKDMIDDN

SEQ ID NO: 2778938 - protein, 8 aa, Entamoeba invadens
TEKDRMLE

SEQ ID NO: 2778939 - protein, 6 aa, Entamoeba invadens
TEKDSI

SEQ ID NO: 2778940 - protein, 10 aa, Entamoeba invadens
TEKECKEHYK

SEQ ID NO: 2778941 - protein, 9 aa, Entamoeba invadens
TEKETTKQY

SEQ ID NO: 2778942 - protein, 4 aa, Entamoeba invadens
TEKF

SEQ ID NO: 2778943 - protein, 9 aa, Entamoeba invadens
TEKGAYTDE

SEQ ID NO: 2778944 - protein, 9 aa, Entamoeba invadens
TEKGCSTCQ

SEQ ID NO: 2778945 - protein, 7 aa, Entamoeba invadens
TEKGNYP

SEQ ID NO: 2778946 - protein, 13 aa, Entamoeba invadens
TEKGYTSDCQGCD

SEQ ID NO: 2778947 - protein, 5 aa, Entamoeba invadens
TEKHT

SEQ ID NO: 2778948 - protein, 8 aa, Entamoeba invadens
TEKIGEGS

SEQ ID NO: 2778949 - protein, 9 aa, Entamoeba invadens
TEKKSDVAQ

SEQ ID NO: 2778950 - protein, 7 aa, Entamoeba invadens
TEKKSEL

SEQ ID NO: 2778951 - protein, 12 aa, Entamoeba invadens
TEKNAYENDERF

SEQ ID NO: 2778952 - protein, 9 aa, Entamoeba invadens
TEKNGSKHN

SEQ ID NO: 2778953 - protein, 7 aa, Entamoeba invadens
TEKNTCG

SEQ ID NO: 2778954 - protein, 7 aa, Entamoeba invadens
TEKQAYI

SEQ ID NO: 2778955 - protein, 12 aa, Entamoeba invadens
TEKQGYENDERF

SEQ ID NO: 2778956 - protein, 4 aa, Entamoeba invadens
TEKR

SEQ ID NO: 2778957 - protein, 8 aa, Entamoeba invadens
TEKRESHQ

SEQ ID NO: 2778958 - protein, 9 aa, Entamoeba invadens
TEKSTRIDY

SEQ ID NO: 2778959 - protein, 9 aa, Entamoeba invadens
TEKTEITVE

SEQ ID NO: 2778960 - protein, 7 aa, Entamoeba invadens
TEKTSDI

SEQ ID NO: 2778961 - protein, 7 aa, Entamoeba invadens
TEKVEEV

SEQ ID NO: 2778962 - protein, 8 aa, Entamoeba invadens
TEKVNKED

SEQ ID NO: 2778963 - protein, 11 aa, Entamoeba invadens
TEKVNKEKSSH

SEQ ID NO: 2778964 - protein, 6 aa, Entamoeba invadens
TELAKS

SEQ ID NO: 2778965 - protein, 4 aa, Entamoeba invadens
TELD

SEQ ID NO: 2778966 - protein, 15 aa, Entamoeba invadens
TELNSKEECDNGTNC

SEQ ID NO: 2778967 - protein, 7 aa, Entamoeba invadens
TELSTKL

SEQ ID NO: 2778968 - protein, 12 aa, Entamoeba invadens
TEMKKSSERQQK

SEQ ID NO: 2778969 - protein, 4 aa, Entamoeba invadens
TEMN

SEQ ID NO: 2778970 - protein, 10 aa, Entamoeba invadens
TEMNAKTNAM

SEQ ID NO: 2778971 - protein, 8 aa, Entamoeba invadens
TEMPGDSF

SEQ ID NO: 2778972 - protein, 22 aa, Entamoeba invadens
TEMSTRLDPNEINEEKKLGEGS

SEQ ID NO: 2778973 - protein, 4 aa, Entamoeba invadens
TEMT

SEQ ID NO: 2778974 - protein, 12 aa, Entamoeba invadens
TEMTEADRAKPA

SEQ ID NO: 2778975 - protein, 8 aa, Entamoeba invadens
TEMTETQK

SEQ ID NO: 2778976 - protein, 5 aa, Entamoeba invadens
TEMTS

SEQ ID NO: 2778977 - protein, 12 aa, Entamoeba invadens
TEMTSRLDPTEI

SEQ ID NO: 2778978 - protein, 6 aa, Entamoeba invadens
TENAYD

SEQ ID NO: 2778979 - protein, 6 aa, Entamoeba invadens
TENDEY

SEQ ID NO: 2778980 - protein, 5 aa, Entamoeba invadens
TENDF

SEQ ID NO: 2778981 - protein, 6 aa, Entamoeba invadens
TENDID

SEQ ID NO: 2778982 - protein, 4 aa, Entamoeba invadens
TENE

SEQ ID NO: 2778983 - protein, 5 aa, Entamoeba invadens
TENEE

SEQ ID NO: 2778984 - protein, 8 aa, Entamoeba invadens
TENEYSSL

SEQ ID NO: 2778985 - protein, 4 aa, Entamoeba invadens
TENG

SEQ ID NO: 2778986 - protein, 6 aa, Entamoeba invadens
TENGCQ

SEQ ID NO: 2778987 - protein, 9 aa, Entamoeba invadens
TENGCSECD

SEQ ID NO: 2778988 - protein, 7 aa, Entamoeba invadens
TENHNDL

SEQ ID NO: 2778989 - protein, 5 aa, Entamoeba invadens
TENIE

SEQ ID NO: 2778990 - protein, 5 aa, Entamoeba invadens
TENKC

SEQ ID NO: 2778991 - protein, 11 aa, Entamoeba invadens
TENNEKTDIEI

SEQ ID NO: 2778992 - protein, 8 aa, Entamoeba invadens
TENNTYES

SEQ ID NO: 2778993 - protein, 5 aa, Entamoeba invadens
TENPI

SEQ ID NO: 2778994 - protein, 7 aa, Entamoeba invadens
TENPSGD

SEQ ID NO: 2778995 - protein, 8 aa, Entamoeba invadens
TENPSKGI

SEQ ID NO: 2778996 - protein, 5 aa, Entamoeba invadens
TENSQ

SEQ ID NO: 2778997 - protein, 8 aa, Entamoeba invadens
TENSTKLD

SEQ ID NO: 2778998 - protein, 8 aa, Entamoeba invadens
TENVESAK

SEQ ID NO: 2778999 - protein, 7 aa, Entamoeba invadens
TENVGNK

SEQ ID NO: 2779000 - protein, 8 aa, Entamoeba invadens
TEPDYNYT

SEQ ID NO: 2779001 - protein, 9 aa, Entamoeba invadens
TEPETVTQK

SEQ ID NO: 2779002 - protein, 14 aa, Entamoeba invadens
TEPIKSSNVTVGDR

SEQ ID NO: 2779003 - protein, 6 aa, Entamoeba invadens
TEPKKE

SEQ ID NO: 2779004 - protein, 8 aa, Entamoeba invadens
TEPKSKKC

SEQ ID NO: 2779005 - protein, 5 aa, Entamoeba invadens
TEPNE

SEQ ID NO: 2779006 - protein, 83 aa, Entamoeba invadens
TEPSEDTKETTKEETKDDSSLEESSSSMSSSSSSKSDSNSESESDSNSDIKSESKTSNKSDVQQKNNVSNKSTSKSDTSDDES

SEQ ID NO: 2779007 - protein, 12 aa, Entamoeba invadens
TEPTRFAPKKNT

SEQ ID NO: 2779008 - protein, 4 aa, Entamoeba invadens
TEPW

SEQ ID NO: 2779009 - protein, 5 aa, Entamoeba invadens
TEPYA

SEQ ID NO: 2779010 - protein, 11 aa, Entamoeba invadens
TEQDQNSNNFF

SEQ ID NO: 2779011 - protein, 9 aa, Entamoeba invadens
TEQEEDIDD

SEQ ID NO: 2779012 - protein, 5 aa, Entamoeba invadens
TEQEP

SEQ ID NO: 2779013 - protein, 5 aa, Entamoeba invadens
TEQGF

SEQ ID NO: 2779014 - protein, 11 aa, Entamoeba invadens
TEQKKQIPGTK

SEQ ID NO: 2779015 - protein, 12 aa, Entamoeba invadens
TEQNQPSGYDRV

SEQ ID NO: 2779016 - protein, 7 aa, Entamoeba invadens
TEQPGAC

SEQ ID NO: 2779017 - protein, 7 aa, Entamoeba invadens
TEQPSIE

SEQ ID NO: 2779018 - protein, 34 aa, Entamoeba invadens
TEQVEEKEGKEKEKKKPKERSRRLSSSGMGTGTL

SEQ ID NO: 2779019 - protein, 11 aa, Entamoeba invadens
TEQYQNNKNIS

SEQ ID NO: 2779020 - protein, 9 aa, Entamoeba invadens
TERENHESE

SEQ ID NO: 2779021 - protein, 22 aa, Entamoeba invadens
TERKKEENSDGISGGKEVVAAK

SEQ ID NO: 2779022 - protein, 10 aa, Entamoeba invadens
TERNDSREYQ

SEQ ID NO: 2779023 - protein, 7 aa, Entamoeba invadens
TERNEQD

SEQ ID NO: 2779024 - protein, 9 aa, Entamoeba invadens
TERPTPSFE

SEQ ID NO: 2779025 - protein, 6 aa, Entamoeba invadens
TERPTT

SEQ ID NO: 2779026 - protein, 4 aa, Entamoeba invadens
TERT

SEQ ID NO: 2779027 - protein, 9 aa, Entamoeba invadens
TESAQEESI

SEQ ID NO: 2779028 - protein, 7 aa, Entamoeba invadens
TESCGPV

SEQ ID NO: 2779029 - protein, 8 aa, Entamoeba invadens
TESEKCAT

SEQ ID NO: 2779030 - protein, 10 aa, Entamoeba invadens
TESEVGSDPL

SEQ ID NO: 2779031 - protein, 4 aa, Entamoeba invadens
TESG

SEQ ID NO: 2779032 - protein, 5 aa, Entamoeba invadens
TESGA

SEQ ID NO: 2779033 - protein, 11 aa, Entamoeba invadens
TESGCSECRES

SEQ ID NO: 2779034 - protein, 5 aa, Entamoeba invadens
TESGK

SEQ ID NO: 2779035 - protein, 5 aa, Entamoeba invadens
TESKM

SEQ ID NO: 2779036 - protein, 4 aa, Entamoeba invadens
TESN

SEQ ID NO: 2779037 - protein, 12 aa, Entamoeba invadens
TESPAPSLQSER

SEQ ID NO: 2779038 - protein, 5 aa, Entamoeba invadens
TESPL

SEQ ID NO: 2779039 - protein, 10 aa, Entamoeba invadens
TESPSAEAAE

SEQ ID NO: 2779040 - protein, 11 aa, Entamoeba invadens
TESQRGQRKNC

SEQ ID NO: 2779041 - protein, 5 aa, Entamoeba invadens
TESRM

SEQ ID NO: 2779042 - protein, 11 aa, Entamoeba invadens
TESTGNDKTSI

SEQ ID NO: 2779043 - protein, 9 aa, Entamoeba invadens
TESTQLTNN

SEQ ID NO: 2779044 - protein, 10 aa, Entamoeba invadens
TESVKTVQSL

SEQ ID NO: 2779045 - protein, 7 aa, Entamoeba invadens
TESYKGN

SEQ ID NO: 2779046 - protein, 17 aa, Entamoeba invadens
TESYSKEKSKSSDICEK

SEQ ID NO: 2779047 - protein, 6 aa, Entamoeba invadens
TETAFS

SEQ ID NO: 2779048 - protein, 8 aa, Entamoeba invadens
TETALSTK

SEQ ID NO: 2779049 - protein, 7 aa, Entamoeba invadens
TETANGR

SEQ ID NO: 2779050 - protein, 4 aa, Entamoeba invadens
TETD

SEQ ID NO: 2779051 - protein, 12 aa, Entamoeba invadens
TETDEERGDLSE

SEQ ID NO: 2779052 - protein, 4 aa, Entamoeba invadens
TETE

SEQ ID NO: 2779053 - protein, 15 aa, Entamoeba invadens
TETETEELKNDITEE

SEQ ID NO: 2779054 - protein, 4 aa, Entamoeba invadens
TETF

SEQ ID NO: 2779055 - protein, 8 aa, Entamoeba invadens
TETGCTKC

SEQ ID NO: 2779056 - protein, 5 aa, Entamoeba invadens
TETGY

SEQ ID NO: 2779057 - protein, 4 aa, Entamoeba invadens
TETI

SEQ ID NO: 2779058 - protein, 7 aa, Entamoeba invadens
TETIPAD

SEQ ID NO: 2779059 - protein, 8 aa, Entamoeba invadens
TETITKPK

SEQ ID NO: 2779060 - protein, 9 aa, Entamoeba invadens
TETKEAPQY

SEQ ID NO: 2779061 - protein, 14 aa, Entamoeba invadens
TETKEIIRTSEKKR

SEQ ID NO: 2779062 - protein, 12 aa, Entamoeba invadens
TETKKCKECEAG

SEQ ID NO: 2779063 - protein, 13 aa, Entamoeba invadens
TETNENALTGLGP

SEQ ID NO: 2779064 - protein, 11 aa, Entamoeba invadens
TETNSGNFQNT

SEQ ID NO: 2779065 - protein, 6 aa, Entamoeba invadens
TETPQP

SEQ ID NO: 2779066 - protein, 4 aa, Entamoeba invadens
TETQ

SEQ ID NO: 2779067 - protein, 8 aa, Entamoeba invadens
TETQPGVY

SEQ ID NO: 2779068 - protein, 11 aa, Entamoeba invadens
TETSDQTANIP

SEQ ID NO: 2779069 - protein, 10 aa, Entamoeba invadens
TETSFDQTKF

SEQ ID NO: 2779070 - protein, 14 aa, Entamoeba invadens
TETTESGATEKTGL

SEQ ID NO: 2779071 - protein, 7 aa, Entamoeba invadens
TETTKAL

SEQ ID NO: 2779072 - protein, 6 aa, Entamoeba invadens
TETTLK

SEQ ID NO: 2779073 - protein, 6 aa, Entamoeba invadens
TETTPR

SEQ ID NO: 2779074 - protein, 9 aa, Entamoeba invadens
TETTQKRLE

SEQ ID NO: 2779075 - protein, 9 aa, Entamoeba invadens
TETTTLPEN

SEQ ID NO: 2779076 - protein, 5 aa, Entamoeba invadens
TETVG

SEQ ID NO: 2779077 - protein, 4 aa, Entamoeba invadens
TEVD

SEQ ID NO: 2779078 - protein, 17 aa, Entamoeba invadens
TEVDNLKAQAETNAQTN

SEQ ID NO: 2779079 - protein, 8 aa, Entamoeba invadens
TEVDTGDV

SEQ ID NO: 2779080 - protein, 6 aa, Entamoeba invadens
TEVEDN

SEQ ID NO: 2779081 - protein, 9 aa, Entamoeba invadens
TEVKERPTY

SEQ ID NO: 2779082 - protein, 17 aa, Entamoeba invadens
TEVKTGYCKENSNTGCA

SEQ ID NO: 2779083 - protein, 9 aa, Entamoeba invadens
TEVSNSKCS

SEQ ID NO: 2779084 - protein, 5 aa, Entamoeba invadens
TEVTL

SEQ ID NO: 2779085 - protein, 4 aa, Entamoeba invadens
TEWR

SEQ ID NO: 2779086 - protein, 5 aa, Entamoeba invadens
TEWST

SEQ ID NO: 2779087 - protein, 9 aa, Entamoeba invadens
TEYDEDDNE

SEQ ID NO: 2779088 - protein, 9 aa, Entamoeba invadens
TEYDPSVDK

SEQ ID NO: 2779089 - protein, 7 aa, Entamoeba invadens
TEYKVSD

SEQ ID NO: 2779090 - protein, 14 aa, Entamoeba invadens
TEYTKENPLRAKGD

SEQ ID NO: 2779091 - protein, 12 aa, Entamoeba invadens
TFADEQGSSECK

SEQ ID NO: 2779092 - protein, 9 aa, Entamoeba invadens
TFANAETNT

SEQ ID NO: 2779093 - protein, 14 aa, Entamoeba invadens
TFANTTSATDKALG

SEQ ID NO: 2779094 - protein, 7 aa, Entamoeba invadens
TFAPKGL

SEQ ID NO: 2779095 - protein, 12 aa, Entamoeba invadens
TFASDSKDSSTF

SEQ ID NO: 2779096 - protein, 18 aa, Entamoeba invadens
TFDEDNKFKTDTKTATET

SEQ ID NO: 2779097 - protein, 10 aa, Entamoeba invadens
TFDNTSPSTW

SEQ ID NO: 2779098 - protein, 21 aa, Entamoeba invadens
TFDPEDSETEVQNKNEKSDDI

SEQ ID NO: 2779099 - protein, 12 aa, Entamoeba invadens
TFDSGSESSLTK

SEQ ID NO: 2779100 - protein, 13 aa, Entamoeba invadens
TFDSGSGTKTKKC

SEQ ID NO: 2779101 - protein, 37 aa, Entamoeba invadens
TFEDENEVSDASEEEMNGEEQKSDNEENERESVTNEE

SEQ ID NO: 2779102 - protein, 4 aa, Entamoeba invadens
TFEE

SEQ ID NO: 2779103 - protein, 7 aa, Entamoeba invadens
TFEEQKE

SEQ ID NO: 2779104 - protein, 12 aa, Entamoeba invadens
TFEETKDSITKS

SEQ ID NO: 2779105 - protein, 5 aa, Entamoeba invadens
TFEKK

SEQ ID NO: 2779106 - protein, 5 aa, Entamoeba invadens
TFEKS

SEQ ID NO: 2779107 - protein, 6 aa, Entamoeba invadens
TFENTK

SEQ ID NO: 2779108 - protein, 4 aa, Entamoeba invadens
TFEP

SEQ ID NO: 2779109 - protein, 5 aa, Entamoeba invadens
TFEVT

SEQ ID NO: 2779110 - protein, 4 aa, Entamoeba invadens
TFGD

SEQ ID NO: 2779111 - protein, 6 aa, Entamoeba invadens
TFGGSS

SEQ ID NO: 2779112 - protein, 12 aa, Entamoeba invadens
TFGGSYKISGES

SEQ ID NO: 2779113 - protein, 6 aa, Entamoeba invadens
TFGGTQ

SEQ ID NO: 2779114 - protein, 8 aa, Entamoeba invadens
TFGKKDKV

SEQ ID NO: 2779115 - protein, 8 aa, Entamoeba invadens
TFGPTRTK

SEQ ID NO: 2779116 - protein, 5 aa, Entamoeba invadens
TFGSE

SEQ ID NO: 2779117 - protein, 6 aa, Entamoeba invadens
TFGSED

SEQ ID NO: 2779118 - protein, 7 aa, Entamoeba invadens
TFGTATV

SEQ ID NO: 2779119 - protein, 6 aa, Entamoeba invadens
TFKEEN

SEQ ID NO: 2779120 - protein, 13 aa, Entamoeba invadens
TFKPKDEDKTTVI

SEQ ID NO: 2779121 - protein, 27 aa, Entamoeba invadens
TFKSNTSKKTIQTNTSIKRNRLKGGRN

SEQ ID NO: 2779122 - protein, 63 aa, Entamoeba invadens
TFKSSEKRKREEEARRGSEKRKREEEARRGSEKRKREEEARRGSEKRKREEEARRGSEKRKRK

SEQ ID NO: 2779123 - protein, 8 aa, Entamoeba invadens
TFKTTQRI

SEQ ID NO: 2779124 - protein, 7 aa, Entamoeba invadens
TFNENKS

SEQ ID NO: 2779125 - protein, 12 aa, Entamoeba invadens
TFNENKSQLNEF

SEQ ID NO: 2779126 - protein, 5 aa, Entamoeba invadens
TFNES

SEQ ID NO: 2779127 - protein, 16 aa, Entamoeba invadens
TFNGNSIQLGDNSQVT

SEQ ID NO: 2779128 - protein, 11 aa, Entamoeba invadens
TFNRSEESKDA

SEQ ID NO: 2779129 - protein, 12 aa, Entamoeba invadens
TFNTSGSLYTTS

SEQ ID NO: 2779130 - protein, 4 aa, Entamoeba invadens
TFPD

SEQ ID NO: 2779131 - protein, 5 aa, Entamoeba invadens
TFPEN

SEQ ID NO: 2779132 - protein, 6 aa, Entamoeba invadens
TFPEPD

SEQ ID NO: 2779133 - protein, 5 aa, Entamoeba invadens
TFPSG

SEQ ID NO: 2779134 - protein, 6 aa, Entamoeba invadens
TFQGKP

SEQ ID NO: 2779135 - protein, 5 aa, Entamoeba invadens
TFQKY

SEQ ID NO: 2779136 - protein, 5 aa, Entamoeba invadens
TFQPA

SEQ ID NO: 2779137 - protein, 25 aa, Entamoeba invadens
TFQSGDSCYPCGGDNSFSLSNSSKC

SEQ ID NO: 2779138 - protein, 4 aa, Entamoeba invadens
TFRG

SEQ ID NO: 2779139 - protein, 5 aa, Entamoeba invadens
TFRGK

SEQ ID NO: 2779140 - protein, 5 aa, Entamoeba invadens
TFRGN

SEQ ID NO: 2779141 - protein, 7 aa, Entamoeba invadens
TFRSSKS

SEQ ID NO: 2779142 - protein, 4 aa, Entamoeba invadens
TFSG

SEQ ID NO: 2779143 - protein, 6 aa, Entamoeba invadens
TFSGCS

SEQ ID NO: 2779144 - protein, 4 aa, Entamoeba invadens
TFSI

SEQ ID NO: 2779145 - protein, 12 aa, Entamoeba invadens
TFSNSDDTTKEL

SEQ ID NO: 2779146 - protein, 10 aa, Entamoeba invadens
TFSPAGASKC

SEQ ID NO: 2779147 - protein, 20 aa, Entamoeba invadens
TFSPDVSGYYRTSSKRCDGE

SEQ ID NO: 2779148 - protein, 25 aa, Entamoeba invadens
TFSSGSTQCNKCDPGYYSSAGASKC

SEQ ID NO: 2779149 - protein, 7 aa, Entamoeba invadens
TFSSSGS

SEQ ID NO: 2779150 - protein, 12 aa, Entamoeba invadens
TFSSSPKSLSCD

SEQ ID NO: 2779151 - protein, 9 aa, Entamoeba invadens
TFSSSRTSH

SEQ ID NO: 2779152 - protein, 7 aa, Entamoeba invadens
TFSSSTV

SEQ ID NO: 2779153 - protein, 15 aa, Entamoeba invadens
TFSTKQSMTDKRTKQ

SEQ ID NO: 2779154 - protein, 26 aa, Entamoeba invadens
TFSYQQSSKCSSCDSKCNGCNPSTGD

SEQ ID NO: 2779155 - protein, 14 aa, Entamoeba invadens
TFTDRIENKTKNAT

SEQ ID NO: 2779156 - protein, 5 aa, Entamoeba invadens
TFTEQ

SEQ ID NO: 2779157 - protein, 5 aa, Entamoeba invadens
TFTIP

SEQ ID NO: 2779158 - protein, 20 aa, Entamoeba invadens
TFTNKLKSASNHTKSTFKSE

SEQ ID NO: 2779159 - protein, 5 aa, Entamoeba invadens
TFTNQ

SEQ ID NO: 2779160 - protein, 10 aa, Entamoeba invadens
TFTPNDAKKF

SEQ ID NO: 2779161 - protein, 9 aa, Entamoeba invadens
TFTQPNKQI

SEQ ID NO: 2779162 - protein, 6 aa, Entamoeba invadens
TFTSTS

SEQ ID NO: 2779163 - protein, 4 aa, Entamoeba invadens
TFTT

SEQ ID NO: 2779164 - protein, 4 aa, Entamoeba invadens
TFTV

SEQ ID NO: 2779165 - protein, 11 aa, Entamoeba invadens
TFVSSTNGFTV

SEQ ID NO: 2779166 - protein, 14 aa, Entamoeba invadens
TFYTTDETTITNSQ

SEQ ID NO: 2779167 - protein, 8 aa, Entamoeba invadens
TGAPTTVK

SEQ ID NO: 2779168 - protein, 11 aa, Entamoeba invadens
TGAQKSNEEMS

SEQ ID NO: 2779169 - protein, 7 aa, Entamoeba invadens
TGATREN

SEQ ID NO: 2779170 - protein, 5 aa, Entamoeba invadens
TGAYT

SEQ ID NO: 2779171 - protein, 5 aa, Entamoeba invadens
TGCAK

SEQ ID NO: 2779172 - protein, 9 aa, Entamoeba invadens
TGCGKTTQI

SEQ ID NO: 2779173 - protein, 12 aa, Entamoeba invadens
TGCSTGSCSANS

SEQ ID NO: 2779174 - protein, 4 aa, Entamoeba invadens
TGCT

SEQ ID NO: 2779175 - protein, 5 aa, Entamoeba invadens
TGCTE

SEQ ID NO: 2779176 - protein, 6 aa, Entamoeba invadens
TGCTGG

SEQ ID NO: 2779177 - protein, 8 aa, Entamoeba invadens
TGCTSNDN

SEQ ID NO: 2779178 - protein, 6 aa, Entamoeba invadens
TGDGKA

SEQ ID NO: 2779179 - protein, 8 aa, Entamoeba invadens
TGDGSQKD

SEQ ID NO: 2779180 - protein, 4 aa, Entamoeba invadens
TGDH

SEQ ID NO: 2779181 - protein, 12 aa, Entamoeba invadens
TGDLERNIDGAT

SEQ ID NO: 2779182 - protein, 9 aa, Entamoeba invadens
TGECEARSD

SEQ ID NO: 2779183 - protein, 5 aa, Entamoeba invadens
TGEDV

SEQ ID NO: 2779184 - protein, 6 aa, Entamoeba invadens
TGEEGI

SEQ ID NO: 2779185 - protein, 5 aa, Entamoeba invadens
TGEEI

SEQ ID NO: 2779186 - protein, 12 aa, Entamoeba invadens
TGEHKSSSIYTY

SEQ ID NO: 2779187 - protein, 12 aa, Entamoeba invadens
TGEKKEKGKENC

SEQ ID NO: 2779188 - protein, 5 aa, Entamoeba invadens
TGELA

SEQ ID NO: 2779189 - protein, 13 aa, Entamoeba invadens
TGELDSSANNGEC

SEQ ID NO: 2779190 - protein, 17 aa, Entamoeba invadens
TGENVGGVTIDTKEGLS

SEQ ID NO: 2779191 - protein, 5 aa, Entamoeba invadens
TGEPN

SEQ ID NO: 2779192 - protein, 8 aa, Entamoeba invadens
TGESTPHM

SEQ ID NO: 2779193 - protein, 15 aa, Entamoeba invadens
TGETPVCKNSNCKED

SEQ ID NO: 2779194 - protein, 9 aa, Entamoeba invadens
TGETQTSCD

SEQ ID NO: 2779195 - protein, 6 aa, Entamoeba invadens
TGEYDD

SEQ ID NO: 2779196 - protein, 13 aa, Entamoeba invadens
TGFCGDDKNEDFI

SEQ ID NO: 2779197 - protein, 9 aa, Entamoeba invadens
TGFEPNKGT

SEQ ID NO: 2779198 - protein, 10 aa, Entamoeba invadens
TGFGQPGGGS

SEQ ID NO: 2779199 - protein, 25 aa, Entamoeba invadens
TGFQNYGSVEATTLDMNGTSKFNNY

SEQ ID NO: 2779200 - protein, 5 aa, Entamoeba invadens
TGFTS

SEQ ID NO: 2779201 - protein, 5 aa, Entamoeba invadens
TGGAF

SEQ ID NO: 2779202 - protein, 7 aa, Entamoeba invadens
TGGALGD

SEQ ID NO: 2779203 - protein, 12 aa, Entamoeba invadens
TGGENKDSNTYS

SEQ ID NO: 2779204 - protein, 5 aa, Entamoeba invadens
TGGIL

SEQ ID NO: 2779205 - protein, 7 aa, Entamoeba invadens
TGGKRLK

SEQ ID NO: 2779206 - protein, 6 aa, Entamoeba invadens
TGGKTV

SEQ ID NO: 2779207 - protein, 7 aa, Entamoeba invadens
TGGNDKL

SEQ ID NO: 2779208 - protein, 12 aa, Entamoeba invadens
TGGNRLKRKQIS

SEQ ID NO: 2779209 - protein, 8 aa, Entamoeba invadens
TGGNSKAC

SEQ ID NO: 2779210 - protein, 10 aa, Entamoeba invadens
TGGQEDYPPM

SEQ ID NO: 2779211 - protein, 14 aa, Entamoeba invadens
TGGQRRPKPANLSD

SEQ ID NO: 2779212 - protein, 4 aa, Entamoeba invadens
TGGS

SEQ ID NO: 2779213 - protein, 8 aa, Entamoeba invadens
TGGTWDPS

SEQ ID NO: 2779214 - protein, 5 aa, Entamoeba invadens
TGHAF

SEQ ID NO: 2779215 - protein, 5 aa, Entamoeba invadens
TGHPY

SEQ ID NO: 2779216 - protein, 12 aa, Entamoeba invadens
TGHVSPGQTPEQ

SEQ ID NO: 2779217 - protein, 11 aa, Entamoeba invadens
TGIDEAKEKTC

SEQ ID NO: 2779218 - protein, 8 aa, Entamoeba invadens
TGIDNSTK

SEQ ID NO: 2779219 - protein, 7 aa, Entamoeba invadens
TGIGDSN

SEQ ID NO: 2779220 - protein, 13 aa, Entamoeba invadens
TGIGSGWDKGSTQ

SEQ ID NO: 2779221 - protein, 10 aa, Entamoeba invadens
TGIKEESTKP

SEQ ID NO: 2779222 - protein, 8 aa, Entamoeba invadens
TGIPPNYH

SEQ ID NO: 2779223 - protein, 18 aa, Entamoeba invadens
TGISDTINSANCSTNHNR

SEQ ID NO: 2779224 - protein, 5 aa, Entamoeba invadens
TGISN

SEQ ID NO: 2779225 - protein, 5 aa, Entamoeba invadens
TGITC

SEQ ID NO: 2779226 - protein, 7 aa, Entamoeba invadens
TGIVSNK

SEQ ID NO: 2779227 - protein, 10 aa, Entamoeba invadens
TGKCTSCPAG

SEQ ID NO: 2779228 - protein, 13 aa, Entamoeba invadens
TGKCTTGSTCPAE

SEQ ID NO: 2779229 - protein, 9 aa, Entamoeba invadens
TGKEEVTKD

SEQ ID NO: 2779230 - protein, 8 aa, Entamoeba invadens
TGKEKTVQ

SEQ ID NO: 2779231 - protein, 8 aa, Entamoeba invadens
TGKETPSI

SEQ ID NO: 2779232 - protein, 8 aa, Entamoeba invadens
TGKFEEEQ

SEQ ID NO: 2779233 - protein, 8 aa, Entamoeba invadens
TGKGGNCS

SEQ ID NO: 2779234 - protein, 5 aa, Entamoeba invadens
TGKGI

SEQ ID NO: 2779235 - protein, 5 aa, Entamoeba invadens
TGKGL

SEQ ID NO: 2779236 - protein, 17 aa, Entamoeba invadens
TGKIKTDGTCDTPEYAC

SEQ ID NO: 2779237 - protein, 20 aa, Entamoeba invadens
TGKIKTDGTCDTTENVCGNG

SEQ ID NO: 2779238 - protein, 8 aa, Entamoeba invadens
TGKIRPNE

SEQ ID NO: 2779239 - protein, 20 aa, Entamoeba invadens
TGKITTDKKCDSSANACGNG

SEQ ID NO: 2779240 - protein, 10 aa, Entamoeba invadens
TGKKDATPYY

SEQ ID NO: 2779241 - protein, 11 aa, Entamoeba invadens
TGKKLKGHGRR

SEQ ID NO: 2779242 - protein, 7 aa, Entamoeba invadens
TGKNTNI

SEQ ID NO: 2779243 - protein, 7 aa, Entamoeba invadens
TGKNTTM

SEQ ID NO: 2779244 - protein, 5 aa, Entamoeba invadens
TGKPS

SEQ ID NO: 2779245 - protein, 15 aa, Entamoeba invadens
TGKRLEKTNSMSNEQ

SEQ ID NO: 2779246 - protein, 9 aa, Entamoeba invadens
TGKRLERPD

SEQ ID NO: 2779247 - protein, 8 aa, Entamoeba invadens
TGKSDEAR

SEQ ID NO: 2779248 - protein, 9 aa, Entamoeba invadens
TGKSGAAEC

SEQ ID NO: 2779249 - protein, 7 aa, Entamoeba invadens
TGKSYNQ

SEQ ID NO: 2779250 - protein, 7 aa, Entamoeba invadens
TGKTDGD

SEQ ID NO: 2779251 - protein, 7 aa, Entamoeba invadens
TGKTEVT

SEQ ID NO: 2779252 - protein, 7 aa, Entamoeba invadens
TGKTLSE

SEQ ID NO: 2779253 - protein, 9 aa, Entamoeba invadens
TGKTNNNVT

SEQ ID NO: 2779254 - protein, 11 aa, Entamoeba invadens
TGKVKTNEKTC

SEQ ID NO: 2779255 - protein, 19 aa, Entamoeba invadens
TGKVNEQTQWERSQCPCDG

SEQ ID NO: 2779256 - protein, 8 aa, Entamoeba invadens
TGKYPDEI

SEQ ID NO: 2779257 - protein, 12 aa, Entamoeba invadens
TGKYPNDSSKVC

SEQ ID NO: 2779258 - protein, 11 aa, Entamoeba invadens
TGKYPNPSSPF

SEQ ID NO: 2779259 - protein, 7 aa, Entamoeba invadens
TGLDTGR

SEQ ID NO: 2779260 - protein, 9 aa, Entamoeba invadens
TGLGDETAL

SEQ ID NO: 2779261 - protein, 27 aa, Entamoeba invadens
TGLPAHEVQSRRENYGTNELPKPPKKN

SEQ ID NO: 2779262 - protein, 6 aa, Entamoeba invadens
TGLSST

SEQ ID NO: 2779263 - protein, 13 aa, Entamoeba invadens
TGMPTGQKAPSLN

SEQ ID NO: 2779264 - protein, 6 aa, Entamoeba invadens
TGMSST

SEQ ID NO: 2779265 - protein, 8 aa, Entamoeba invadens
TGMTNTSI

SEQ ID NO: 2779266 - protein, 5 aa, Entamoeba invadens
TGNCQ

SEQ ID NO: 2779267 - protein, 9 aa, Entamoeba invadens
TGNDTKLKV

SEQ ID NO: 2779268 - protein, 7 aa, Entamoeba invadens
TGNEDTK

SEQ ID NO: 2779269 - protein, 6 aa, Entamoeba invadens
TGNFET

SEQ ID NO: 2779270 - protein, 4 aa, Entamoeba invadens
TGNI

SEQ ID NO: 2779271 - protein, 5 aa, Entamoeba invadens
TGNIQ

SEQ ID NO: 2779272 - protein, 5 aa, Entamoeba invadens
TGNNT

SEQ ID NO: 2779273 - protein, 10 aa, Entamoeba invadens
TGNNTGCTRC

SEQ ID NO: 2779274 - protein, 4 aa, Entamoeba invadens
TGNQ

SEQ ID NO: 2779275 - protein, 7 aa, Entamoeba invadens
TGNSLTT

SEQ ID NO: 2779276 - protein, 8 aa, Entamoeba invadens
TGNTEIRG

SEQ ID NO: 2779277 - protein, 7 aa, Entamoeba invadens
TGNTNRF

SEQ ID NO: 2779278 - protein, 8 aa, Entamoeba invadens
TGNTNVDL

SEQ ID NO: 2779279 - protein, 6 aa, Entamoeba invadens
TGNTTT

SEQ ID NO: 2779280 - protein, 5 aa, Entamoeba invadens
TGNWS

SEQ ID NO: 2779281 - protein, 13 aa, Entamoeba invadens
TGNYQHESVGDSC

SEQ ID NO: 2779282 - protein, 6 aa, Entamoeba invadens
TGPART

SEQ ID NO: 2779283 - protein, 7 aa, Entamoeba invadens
TGPLDAE

SEQ ID NO: 2779284 - protein, 4 aa, Entamoeba invadens
TGPQ

SEQ ID NO: 2779285 - protein, 4 aa, Entamoeba invadens
TGPS

SEQ ID NO: 2779286 - protein, 9 aa, Entamoeba invadens
TGPSLKTAS

SEQ ID NO: 2779287 - protein, 6 aa, Entamoeba invadens
TGPSMK

SEQ ID NO: 2779288 - protein, 6 aa, Entamoeba invadens
TGPSNG

SEQ ID NO: 2779289 - protein, 7 aa, Entamoeba invadens
TGPSQKS

SEQ ID NO: 2779290 - protein, 8 aa, Entamoeba invadens
TGPSQSSV

SEQ ID NO: 2779291 - protein, 4 aa, Entamoeba invadens
TGQE

SEQ ID NO: 2779292 - protein, 8 aa, Entamoeba invadens
TGQNKNKG

SEQ ID NO: 2779293 - protein, 19 aa, Entamoeba invadens
TGQPEKKTKKNKNEGGNTT

SEQ ID NO: 2779294 - protein, 20 aa, Entamoeba invadens
TGQPTDSQEDPEKPVKERKE

SEQ ID NO: 2779295 - protein, 8 aa, Entamoeba invadens
TGQTIPSN

SEQ ID NO: 2779296 - protein, 9 aa, Entamoeba invadens
TGQVEENGI

SEQ ID NO: 2779297 - protein, 7 aa, Entamoeba invadens
TGQYVSS

SEQ ID NO: 2779298 - protein, 4 aa, Entamoeba invadens
TGRC

SEQ ID NO: 2779299 - protein, 6 aa, Entamoeba invadens
TGRCAK

SEQ ID NO: 2779300 - protein, 13 aa, Entamoeba invadens
TGRCTTGSTCPAE

SEQ ID NO: 2779301 - protein, 6 aa, Entamoeba invadens
TGREDK

SEQ ID NO: 2779302 - protein, 6 aa, Entamoeba invadens
TGRIEN

SEQ ID NO: 2779303 - protein, 6 aa, Entamoeba invadens
TGRPTT

SEQ ID NO: 2779304 - protein, 5 aa, Entamoeba invadens
TGRSE

SEQ ID NO: 2779305 - protein, 7 aa, Entamoeba invadens
TGRTAAG

SEQ ID NO: 2779306 - protein, 9 aa, Entamoeba invadens
TGSCTTKDV

SEQ ID NO: 2779307 - protein, 9 aa, Entamoeba invadens
TGSDKVKKS

SEQ ID NO: 2779308 - protein, 6 aa, Entamoeba invadens
TGSESK

SEQ ID NO: 2779309 - protein, 4 aa, Entamoeba invadens
TGSG

SEQ ID NO: 2779310 - protein, 7 aa, Entamoeba invadens
TGSGGVD

SEQ ID NO: 2779311 - protein, 8 aa, Entamoeba invadens
TGSGTTFP

SEQ ID NO: 2779312 - protein, 18 aa, Entamoeba invadens
TGSINKNECYSPATYRPH

SEQ ID NO: 2779313 - protein, 6 aa, Entamoeba invadens
TGSLAA

SEQ ID NO: 2779314 - protein, 5 aa, Entamoeba invadens
TGSLS

SEQ ID NO: 2779315 - protein, 6 aa, Entamoeba invadens
TGSNDS

SEQ ID NO: 2779316 - protein, 7 aa, Entamoeba invadens
TGSNKTP

SEQ ID NO: 2779317 - protein, 5 aa, Entamoeba invadens
TGSNT

SEQ ID NO: 2779318 - protein, 27 aa, Entamoeba invadens
TGSPNKILSPRRQFTEEKKKEENGMCS

SEQ ID NO: 2779319 - protein, 10 aa, Entamoeba invadens
TGSPTVPETL

SEQ ID NO: 2779320 - protein, 4 aa, Entamoeba invadens
TGSQ

SEQ ID NO: 2779321 - protein, 14 aa, Entamoeba invadens
TGSSEFKDSRTWNT

SEQ ID NO: 2779322 - protein, 10 aa, Entamoeba invadens
TGSSNSKCSG

SEQ ID NO: 2779323 - protein, 4 aa, Entamoeba invadens
TGST

SEQ ID NO: 2779324 - protein, 12 aa, Entamoeba invadens
TGSTDPDKKYQK

SEQ ID NO: 2779325 - protein, 7 aa, Entamoeba invadens
TGSTNQQ

SEQ ID NO: 2779326 - protein, 7 aa, Entamoeba invadens
TGSTQNP

SEQ ID NO: 2779327 - protein, 15 aa, Entamoeba invadens
TGSTTDPAKITTQAT

SEQ ID NO: 2779328 - protein, 5 aa, Entamoeba invadens
TGSVG

SEQ ID NO: 2779329 - protein, 10 aa, Entamoeba invadens
TGSYSEIGDL

SEQ ID NO: 2779330 - protein, 9 aa, Entamoeba invadens
TGSYSESGT

SEQ ID NO: 2779331 - protein, 8 aa, Entamoeba invadens
TGTANKVT

SEQ ID NO: 2779332 - protein, 10 aa, Entamoeba invadens
TGTDVSSALK

SEQ ID NO: 2779333 - protein, 7 aa, Entamoeba invadens
TGTEAIT

SEQ ID NO: 2779334 - protein, 13 aa, Entamoeba invadens
TGTFSSSTNTSSC

SEQ ID NO: 2779335 - protein, 21 aa, Entamoeba invadens
TGTGAQKGDITRNGKRTVQGR

SEQ ID NO: 2779336 - protein, 4 aa, Entamoeba invadens
TGTL

SEQ ID NO: 2779337 - protein, 8 aa, Entamoeba invadens
TGTLTENR

SEQ ID NO: 2779338 - protein, 4 aa, Entamoeba invadens
TGTN

SEQ ID NO: 2779339 - protein, 5 aa, Entamoeba invadens
TGTNC

SEQ ID NO: 2779340 - protein, 13 aa, Entamoeba invadens
TGTNGGFGNGQPN

SEQ ID NO: 2779341 - protein, 6 aa, Entamoeba invadens
TGTPIT

SEQ ID NO: 2779342 - protein, 4 aa, Entamoeba invadens
TGTS

SEQ ID NO: 2779343 - protein, 7 aa, Entamoeba invadens
TGTTGSV

SEQ ID NO: 2779344 - protein, 5 aa, Entamoeba invadens
TGTVS

SEQ ID NO: 2779345 - protein, 6 aa, Entamoeba invadens
TGTVYT

SEQ ID NO: 2779346 - protein, 6 aa, Entamoeba invadens
TGTYGN

SEQ ID NO: 2779347 - protein, 21 aa, Entamoeba invadens
TGTYSSSSGSDSCTNCSEGYY

SEQ ID NO: 2779348 - protein, 5 aa, Entamoeba invadens
TGVDT

SEQ ID NO: 2779349 - protein, 8 aa, Entamoeba invadens
TGVGTPTY

SEQ ID NO: 2779350 - protein, 4 aa, Entamoeba invadens
TGVQ

SEQ ID NO: 2779351 - protein, 8 aa, Entamoeba invadens
TGVQENEK

SEQ ID NO: 2779352 - protein, 15 aa, Entamoeba invadens
TGVRDKEKKADEERQ

SEQ ID NO: 2779353 - protein, 4 aa, Entamoeba invadens
TGVS

SEQ ID NO: 2779354 - protein, 9 aa, Entamoeba invadens
TGVTNNNTA

SEQ ID NO: 2779355 - protein, 4 aa, Entamoeba invadens
TGVV

SEQ ID NO: 2779356 - protein, 14 aa, Entamoeba invadens
TGWGDRDDSFRSLS

SEQ ID NO: 2779357 - protein, 5 aa, Entamoeba invadens
TGWVP

SEQ ID NO: 2779358 - protein, 6 aa, Entamoeba invadens
TGYALQ

SEQ ID NO: 2779359 - protein, 13 aa, Entamoeba invadens
TGYAYKSDDGSCV

SEQ ID NO: 2779360 - protein, 4 aa, Entamoeba invadens
TGYE

SEQ ID NO: 2779361 - protein, 8 aa, Entamoeba invadens
TGYETQAK

SEQ ID NO: 2779362 - protein, 8 aa, Entamoeba invadens
TGYGPGAS

SEQ ID NO: 2779363 - protein, 16 aa, Entamoeba invadens
TGYNESKCKTCQPGFD

SEQ ID NO: 2779364 - protein, 6 aa, Entamoeba invadens
TGYNTW

SEQ ID NO: 2779365 - protein, 5 aa, Entamoeba invadens
TGYSL

SEQ ID NO: 2779366 - protein, 8 aa, Entamoeba invadens
TGYSTQNG

SEQ ID NO: 2779367 - protein, 11 aa, Entamoeba invadens
TGYTADGKGGC

SEQ ID NO: 2779368 - protein, 11 aa, Entamoeba invadens
TGYTKNTTDSI

SEQ ID NO: 2779369 - protein, 9 aa, Entamoeba invadens
TGYVPTEPT

SEQ ID NO: 2779370 - protein, 7 aa, Entamoeba invadens
TGYVTEA

SEQ ID NO: 2779371 - protein, 9 aa, Entamoeba invadens
TGYYPNADG

SEQ ID NO: 2779372 - protein, 9 aa, Entamoeba invadens
TGYYPNAEG

SEQ ID NO: 2779373 - protein, 10 aa, Entamoeba invadens
TGYYPSPPTH

SEQ ID NO: 2779374 - protein, 9 aa, Entamoeba invadens
TGYYPSSNG

SEQ ID NO: 2779375 - protein, 8 aa, Entamoeba invadens
TGYYRNDS

SEQ ID NO: 2779376 - protein, 8 aa, Entamoeba invadens
TGYYSNEN

SEQ ID NO: 2779377 - protein, 15 aa, Entamoeba invadens
THATECQKCTSEYGV

SEQ ID NO: 2779378 - protein, 6 aa, Entamoeba invadens
THCEGK

SEQ ID NO: 2779379 - protein, 5 aa, Entamoeba invadens
THCRG

SEQ ID NO: 2779380 - protein, 12 aa, Entamoeba invadens
THCTTEKNGECY

SEQ ID NO: 2779381 - protein, 6 aa, Entamoeba invadens
THDCRP

SEQ ID NO: 2779382 - protein, 13 aa, Entamoeba invadens
THDKDKRVNPEST

SEQ ID NO: 2779383 - protein, 10 aa, Entamoeba invadens
THDSEDIQEL

SEQ ID NO: 2779384 - protein, 6 aa, Entamoeba invadens
THDSTT

SEQ ID NO: 2779385 - protein, 8 aa, Entamoeba invadens
THECETGN

SEQ ID NO: 2779386 - protein, 7 aa, Entamoeba invadens
THEPNGK

SEQ ID NO: 2779387 - protein, 5 aa, Entamoeba invadens
THFDY

SEQ ID NO: 2779388 - protein, 25 aa, Entamoeba invadens
THGSDIDTDKNQIRGNSGDAWTESD

SEQ ID NO: 2779389 - protein, 5 aa, Entamoeba invadens
THHTS

SEQ ID NO: 2779390 - protein, 5 aa, Entamoeba invadens
THIQG

SEQ ID NO: 2779391 - protein, 6 aa, Entamoeba invadens
THITNA

SEQ ID NO: 2779392 - protein, 7 aa, Entamoeba invadens
THKIEKT

SEQ ID NO: 2779393 - protein, 26 aa, Entamoeba invadens
THKTETAASPVTKNEKDTGNKEVNPI

SEQ ID NO: 2779394 - protein, 6 aa, Entamoeba invadens
THKTVP

SEQ ID NO: 2779395 - protein, 8 aa, Entamoeba invadens
THLATTPV

SEQ ID NO: 2779396 - protein, 4 aa, Entamoeba invadens
THLD

SEQ ID NO: 2779397 - protein, 39 aa, Entamoeba invadens
THLQPPTSKLSLPTTGPNQIAPLPPTPQTQQQTQQPSLQ

SEQ ID NO: 2779398 - protein, 6 aa, Entamoeba invadens
THLTTE

SEQ ID NO: 2779399 - protein, 10 aa, Entamoeba invadens
THNLETEGVK

SEQ ID NO: 2779400 - protein, 6 aa, Entamoeba invadens
THPLTS

SEQ ID NO: 2779401 - protein, 8 aa, Entamoeba invadens
THPMRQNP

SEQ ID NO: 2779402 - protein, 7 aa, Entamoeba invadens
THQPTKY

SEQ ID NO: 2779403 - protein, 4 aa, Entamoeba invadens
THSL

SEQ ID NO: 2779404 - protein, 6 aa, Entamoeba invadens
THSNEI

SEQ ID NO: 2779405 - protein, 11 aa, Entamoeba invadens
THSNTGNTNSC

SEQ ID NO: 2779406 - protein, 8 aa, Entamoeba invadens
THSQRDMK

SEQ ID NO: 2779407 - protein, 5 aa, Entamoeba invadens
THSTN

SEQ ID NO: 2779408 - protein, 5 aa, Entamoeba invadens
THSVD

SEQ ID NO: 2779409 - protein, 7 aa, Entamoeba invadens
THTNNEE

SEQ ID NO: 2779410 - protein, 4 aa, Entamoeba invadens
THVS

SEQ ID NO: 2779411 - protein, 5 aa, Entamoeba invadens
TIAGT

SEQ ID NO: 2779412 - protein, 5 aa, Entamoeba invadens
TIDDD

SEQ ID NO: 2779413 - protein, 5 aa, Entamoeba invadens
TIDDN

SEQ ID NO: 2779414 - protein, 5 aa, Entamoeba invadens
TIDDS

SEQ ID NO: 2779415 - protein, 4 aa, Entamoeba invadens
TIDG

SEQ ID NO: 2779416 - protein, 6 aa, Entamoeba invadens
TIDSSE

SEQ ID NO: 2779417 - protein, 8 aa, Entamoeba invadens
TIDTPENI

SEQ ID NO: 2779418 - protein, 8 aa, Entamoeba invadens
TIDTSDDH

SEQ ID NO: 2779419 - protein, 9 aa, Entamoeba invadens
TIEATTNPM

SEQ ID NO: 2779420 - protein, 6 aa, Entamoeba invadens
TIEDTK

SEQ ID NO: 2779421 - protein, 5 aa, Entamoeba invadens
TIEEF

SEQ ID NO: 2779422 - protein, 13 aa, Entamoeba invadens
TIEEKKKYEERTA

SEQ ID NO: 2779423 - protein, 6 aa, Entamoeba invadens
TIEKDP

SEQ ID NO: 2779424 - protein, 10 aa, Entamoeba invadens
TIEKSDEDVE

SEQ ID NO: 2779425 - protein, 11 aa, Entamoeba invadens
TIENGEEGMKE

SEQ ID NO: 2779426 - protein, 6 aa, Entamoeba invadens
TIEPYK

SEQ ID NO: 2779427 - protein, 8 aa, Entamoeba invadens
TIESETKE

SEQ ID NO: 2779428 - protein, 7 aa, Entamoeba invadens
TIESSSD

SEQ ID NO: 2779429 - protein, 7 aa, Entamoeba invadens
TIESSSN

SEQ ID NO: 2779430 - protein, 8 aa, Entamoeba invadens
TIETKEEE

SEQ ID NO: 2779431 - protein, 13 aa, Entamoeba invadens
TIEYDGKTFTDED

SEQ ID NO: 2779432 - protein, 4 aa, Entamoeba invadens
TIGD

SEQ ID NO: 2779433 - protein, 5 aa, Entamoeba invadens
TIGDA

SEQ ID NO: 2779434 - protein, 6 aa, Entamoeba invadens
TIGDGA

SEQ ID NO: 2779435 - protein, 10 aa, Entamoeba invadens
TIGEEADYDV

SEQ ID NO: 2779436 - protein, 4 aa, Entamoeba invadens
TIGG

SEQ ID NO: 2779437 - protein, 9 aa, Entamoeba invadens
TIGGDSEGI

SEQ ID NO: 2779438 - protein, 10 aa, Entamoeba invadens
TIGGTSATSF

SEQ ID NO: 2779439 - protein, 7 aa, Entamoeba invadens
TIGNSTC

SEQ ID NO: 2779440 - protein, 6 aa, Entamoeba invadens
TIGNTG

SEQ ID NO: 2779441 - protein, 4 aa, Entamoeba invadens
TIGS

SEQ ID NO: 2779442 - protein, 5 aa, Entamoeba invadens
TIGSN

SEQ ID NO: 2779443 - protein, 8 aa, Entamoeba invadens
TIGTQKSN

SEQ ID NO: 2779444 - protein, 10 aa, Entamoeba invadens
TIKAEDNKPL

SEQ ID NO: 2779445 - protein, 4 aa, Entamoeba invadens
TIKD

SEQ ID NO: 2779446 - protein, 5 aa, Entamoeba invadens
TIKDL

SEQ ID NO: 2779447 - protein, 11 aa, Entamoeba invadens
TIKEEGNGYET

SEQ ID NO: 2779448 - protein, 5 aa, Entamoeba invadens
TIKEN

SEQ ID NO: 2779449 - protein, 7 aa, Entamoeba invadens
TIKGDSR

SEQ ID NO: 2779450 - protein, 5 aa, Entamoeba invadens
TIKNA

SEQ ID NO: 2779451 - protein, 9 aa, Entamoeba invadens
TIKNETHTY

SEQ ID NO: 2779452 - protein, 6 aa, Entamoeba invadens
TIKNTT

SEQ ID NO: 2779453 - protein, 10 aa, Entamoeba invadens
TIKSNKASRD

SEQ ID NO: 2779454 - protein, 6 aa, Entamoeba invadens
TIKSQS

SEQ ID NO: 2779455 - protein, 20 aa, Entamoeba invadens
TINDSGNCIQNDGNIKQTNC

SEQ ID NO: 2779456 - protein, 11 aa, Entamoeba invadens
TINDSNGMCTN

SEQ ID NO: 2779457 - protein, 7 aa, Entamoeba invadens
TINDTQQ

SEQ ID NO: 2779458 - protein, 5 aa, Entamoeba invadens
TINEE

SEQ ID NO: 2779459 - protein, 10 aa, Entamoeba invadens
TINENELEKL

SEQ ID NO: 2779460 - protein, 10 aa, Entamoeba invadens
TINESNADSL

SEQ ID NO: 2779461 - protein, 9 aa, Entamoeba invadens
TINETSGEV

SEQ ID NO: 2779462 - protein, 12 aa, Entamoeba invadens
TINETTPVDQRS

SEQ ID NO: 2779463 - protein, 4 aa, Entamoeba invadens
TING

SEQ ID NO: 2779464 - protein, 7 aa, Entamoeba invadens
TINGTTV

SEQ ID NO: 2779465 - protein, 7 aa, Entamoeba invadens
TINKHQD

SEQ ID NO: 2779466 - protein, 8 aa, Entamoeba invadens
TINNETNV

SEQ ID NO: 2779467 - protein, 11 aa, Entamoeba invadens
TINPSNPKQCQ

SEQ ID NO: 2779468 - protein, 13 aa, Entamoeba invadens
TINPSNPKQCQTC

SEQ ID NO: 2779469 - protein, 11 aa, Entamoeba invadens
TINTPNPDNQE

SEQ ID NO: 2779470 - protein, 8 aa, Entamoeba invadens
TIPADAAG

SEQ ID NO: 2779471 - protein, 9 aa, Entamoeba invadens
TIPADSDLT

SEQ ID NO: 2779472 - protein, 13 aa, Entamoeba invadens
TIPDSTTSTCKPV

SEQ ID NO: 2779473 - protein, 6 aa, Entamoeba invadens
TIPEKT

SEQ ID NO: 2779474 - protein, 6 aa, Entamoeba invadens
TIPKEK

SEQ ID NO: 2779475 - protein, 7 aa, Entamoeba invadens
TIPKGKA

SEQ ID NO: 2779476 - protein, 8 aa, Entamoeba invadens
TIPKTPNI

SEQ ID NO: 2779477 - protein, 5 aa, Entamoeba invadens
TIPLN

SEQ ID NO: 2779478 - protein, 4 aa, Entamoeba invadens
TIPP

SEQ ID NO: 2779479 - protein, 7 aa, Entamoeba invadens
TIPPQQT

SEQ ID NO: 2779480 - protein, 8 aa, Entamoeba invadens
TIPPSVTS

SEQ ID NO: 2779481 - protein, 4 aa, Entamoeba invadens
TIPR

SEQ ID NO: 2779482 - protein, 6 aa, Entamoeba invadens
TIPSET

SEQ ID NO: 2779483 - protein, 6 aa, Entamoeba invadens
TIPSGT

SEQ ID NO: 2779484 - protein, 9 aa, Entamoeba invadens
TIPSSSLTP

SEQ ID NO: 2779485 - protein, 6 aa, Entamoeba invadens
TIPSSV

SEQ ID NO: 2779486 - protein, 5 aa, Entamoeba invadens
TIPST

SEQ ID NO: 2779487 - protein, 9 aa, Entamoeba invadens
TIPTDSTNI

SEQ ID NO: 2779488 - protein, 13 aa, Entamoeba invadens
TIPTDTTTVSDTS

SEQ ID NO: 2779489 - protein, 6 aa, Entamoeba invadens
TIPTGG

SEQ ID NO: 2779490 - protein, 7 aa, Entamoeba invadens
TIPTNTP

SEQ ID NO: 2779491 - protein, 5 aa, Entamoeba invadens
TIQNA

SEQ ID NO: 2779492 - protein, 6 aa, Entamoeba invadens
TIQNNE

SEQ ID NO: 2779493 - protein, 5 aa, Entamoeba invadens
TIQNS

SEQ ID NO: 2779494 - protein, 6 aa, Entamoeba invadens
TIQNTT

SEQ ID NO: 2779495 - protein, 19 aa, Entamoeba invadens
TIQSPKKELKREAKQTKLT

SEQ ID NO: 2779496 - protein, 6 aa, Entamoeba invadens
TIQTAT

SEQ ID NO: 2779497 - protein, 8 aa, Entamoeba invadens
TIQTEKKY

SEQ ID NO: 2779498 - protein, 13 aa, Entamoeba invadens
TIRTSQDDKMNEI

SEQ ID NO: 2779499 - protein, 5 aa, Entamoeba invadens
TIRTT

SEQ ID NO: 2779500 - protein, 7 aa, Entamoeba invadens
TISDEEQ

SEQ ID NO: 2779501 - protein, 12 aa, Entamoeba invadens
TISDISKDSSNV

SEQ ID NO: 2779502 - protein, 16 aa, Entamoeba invadens
TISGSVDDPAKPSKFT

SEQ ID NO: 2779503 - protein, 17 aa, Entamoeba invadens
TISKSEKETNCQVRTQK

SEQ ID NO: 2779504 - protein, 8 aa, Entamoeba invadens
TISNANPK

SEQ ID NO: 2779505 - protein, 9 aa, Entamoeba invadens
TISNNTGRY

SEQ ID NO: 2779506 - protein, 6 aa, Entamoeba invadens
TISNTK

SEQ ID NO: 2779507 - protein, 10 aa, Entamoeba invadens
TISPEGEEQV

SEQ ID NO: 2779508 - protein, 15 aa, Entamoeba invadens
TISSTKIGEKLGKSY

SEQ ID NO: 2779509 - protein, 8 aa, Entamoeba invadens
TISSTTSE

SEQ ID NO: 2779510 - protein, 5 aa, Entamoeba invadens
TISSY

SEQ ID NO: 2779511 - protein, 8 aa, Entamoeba invadens
TISTAGPM

SEQ ID NO: 2779512 - protein, 11 aa, Entamoeba invadens
TISTEQCNTEV

SEQ ID NO: 2779513 - protein, 12 aa, Entamoeba invadens
TISTGDQSLEDG

SEQ ID NO: 2779514 - protein, 10 aa, Entamoeba invadens
TISTTPQNTF

SEQ ID NO: 2779515 - protein, 10 aa, Entamoeba invadens
TITDDDDCTV

SEQ ID NO: 2779516 - protein, 7 aa, Entamoeba invadens
TITDKTR

SEQ ID NO: 2779517 - protein, 10 aa, Entamoeba invadens
TITENSTKLN

SEQ ID NO: 2779518 - protein, 11 aa, Entamoeba invadens
TITGGVPTDTL

SEQ ID NO: 2779519 - protein, 28 aa, Entamoeba invadens
TITNCSTEISSQNGCSQCDDGYYNKNRQ

SEQ ID NO: 2779520 - protein, 13 aa, Entamoeba invadens
TITPESGCTSCQD

SEQ ID NO: 2779521 - protein, 8 aa, Entamoeba invadens
TITPTTNC

SEQ ID NO: 2779522 - protein, 5 aa, Entamoeba invadens
TITPV

SEQ ID NO: 2779523 - protein, 6 aa, Entamoeba invadens
TITSGA

SEQ ID NO: 2779524 - protein, 9 aa, Entamoeba invadens
TITSSAKTF

SEQ ID NO: 2779525 - protein, 12 aa, Entamoeba invadens
TITSTDLTQCSK

SEQ ID NO: 2779526 - protein, 8 aa, Entamoeba invadens
TITSTPGV

SEQ ID NO: 2779527 - protein, 9 aa, Entamoeba invadens
TITSTSDTF

SEQ ID NO: 2779528 - protein, 8 aa, Entamoeba invadens
TITSTTAA

SEQ ID NO: 2779529 - protein, 8 aa, Entamoeba invadens
TITSVTPL

SEQ ID NO: 2779530 - protein, 10 aa, Entamoeba invadens
TITTGKKTPI

SEQ ID NO: 2779531 - protein, 12 aa, Entamoeba invadens
TITTNGGCKKCE

SEQ ID NO: 2779532 - protein, 6 aa, Entamoeba invadens
TIVAPK

SEQ ID NO: 2779533 - protein, 11 aa, Entamoeba invadens
TIYDENKTAIG

SEQ ID NO: 2779534 - protein, 6 aa, Entamoeba invadens
TIYGSE

SEQ ID NO: 2779535 - protein, 4 aa, Entamoeba invadens
TIYN

SEQ ID NO: 2779536 - protein, 11 aa, Entamoeba invadens
TIYPDDSNIHQ

SEQ ID NO: 2779537 - protein, 6 aa, Entamoeba invadens
TIYPRE

SEQ ID NO: 2779538 - protein, 9 aa, Entamoeba invadens
TKAANSRCS

SEQ ID NO: 2779539 - protein, 16 aa, Entamoeba invadens
TKACDAPQSDCGDGKF

SEQ ID NO: 2779540 - protein, 5 aa, Entamoeba invadens
TKACG

SEQ ID NO: 2779541 - protein, 7 aa, Entamoeba invadens
TKADDTI

SEQ ID NO: 2779542 - protein, 8 aa, Entamoeba invadens
TKAGELPT

SEQ ID NO: 2779543 - protein, 8 aa, Entamoeba invadens
TKAKDDNL

SEQ ID NO: 2779544 - protein, 6 aa, Entamoeba invadens
TKAPSH

SEQ ID NO: 2779545 - protein, 8 aa, Entamoeba invadens
TKATEQDY

SEQ ID NO: 2779546 - protein, 14 aa, Entamoeba invadens
TKATSKGQNATGIA

SEQ ID NO: 2779547 - protein, 12 aa, Entamoeba invadens
TKAVVDESYTET

SEQ ID NO: 2779548 - protein, 7 aa, Entamoeba invadens
TKAYEDV

SEQ ID NO: 2779549 - protein, 5 aa, Entamoeba invadens
TKAYF

SEQ ID NO: 2779550 - protein, 7 aa, Entamoeba invadens
TKAYGTS

SEQ ID NO: 2779551 - protein, 9 aa, Entamoeba invadens
TKCAPGYRS

SEQ ID NO: 2779552 - protein, 11 aa, Entamoeba invadens
TKCDGCDATNG

SEQ ID NO: 2779553 - protein, 10 aa, Entamoeba invadens
TKCDSSSKMN

SEQ ID NO: 2779554 - protein, 9 aa, Entamoeba invadens
TKCDTTTKY

SEQ ID NO: 2779555 - protein, 4 aa, Entamoeba invadens
TKCE

SEQ ID NO: 2779556 - protein, 10 aa, Entamoeba invadens
TKCEDGYQLE

SEQ ID NO: 2779557 - protein, 5 aa, Entamoeba invadens
TKCES

SEQ ID NO: 2779558 - protein, 4 aa, Entamoeba invadens
TKCG

SEQ ID NO: 2779559 - protein, 14 aa, Entamoeba invadens
TKCGNNKKVSTDGT

SEQ ID NO: 2779560 - protein, 5 aa, Entamoeba invadens
TKCGS

SEQ ID NO: 2779561 - protein, 17 aa, Entamoeba invadens
TKCGTKCPDGEYSGTTN

SEQ ID NO: 2779562 - protein, 10 aa, Entamoeba invadens
TKCGTTAQYL

SEQ ID NO: 2779563 - protein, 9 aa, Entamoeba invadens
TKCNKDPSI

SEQ ID NO: 2779564 - protein, 5 aa, Entamoeba invadens
TKCNS

SEQ ID NO: 2779565 - protein, 9 aa, Entamoeba invadens
TKCNTANGV

SEQ ID NO: 2779566 - protein, 6 aa, Entamoeba invadens
TKCNTT

SEQ ID NO: 2779567 - protein, 6 aa, Entamoeba invadens
TKCPDG

SEQ ID NO: 2779568 - protein, 4 aa, Entamoeba invadens
TKCS

SEQ ID NO: 2779569 - protein, 6 aa, Entamoeba invadens
TKCSAM

SEQ ID NO: 2779570 - protein, 4 aa, Entamoeba invadens
TKCT

SEQ ID NO: 2779571 - protein, 8 aa, Entamoeba invadens
TKCTAANA

SEQ ID NO: 2779572 - protein, 6 aa, Entamoeba invadens
TKCTDG

SEQ ID NO: 2779573 - protein, 19 aa, Entamoeba invadens
TKCTGYDVEGTSKNATAEI

SEQ ID NO: 2779574 - protein, 9 aa, Entamoeba invadens
TKCTKEGCS

SEQ ID NO: 2779575 - protein, 6 aa, Entamoeba invadens
TKCTSN

SEQ ID NO: 2779576 - protein, 6 aa, Entamoeba invadens
TKCVTS

SEQ ID NO: 2779577 - protein, 19 aa, Entamoeba invadens
TKDADGCVKYDGTKCETTI

SEQ ID NO: 2779578 - protein, 6 aa, Entamoeba invadens
TKDDEV

SEQ ID NO: 2779579 - protein, 9 aa, Entamoeba invadens
TKDDTGNLS

SEQ ID NO: 2779580 - protein, 5 aa, Entamoeba invadens
TKDEC

SEQ ID NO: 2779581 - protein, 6 aa, Entamoeba invadens
TKDETI

SEQ ID NO: 2779582 - protein, 9 aa, Entamoeba invadens
TKDEWKGEE

SEQ ID NO: 2779583 - protein, 5 aa, Entamoeba invadens
TKDFG

SEQ ID NO: 2779584 - protein, 6 aa, Entamoeba invadens
TKDGCR

SEQ ID NO: 2779585 - protein, 9 aa, Entamoeba invadens
TKDGQDATR

SEQ ID NO: 2779586 - protein, 8 aa, Entamoeba invadens
TKDKCDTC

SEQ ID NO: 2779587 - protein, 7 aa, Entamoeba invadens
TKDKTSP

SEQ ID NO: 2779588 - protein, 20 aa, Entamoeba invadens
TKDNTKTTRRFKSQRGIPPL

SEQ ID NO: 2779589 - protein, 9 aa, Entamoeba invadens
TKDQPEGLE

SEQ ID NO: 2779590 - protein, 12 aa, Entamoeba invadens
TKDQTKSDDGNC

SEQ ID NO: 2779591 - protein, 12 aa, Entamoeba invadens
TKDSKASKIPMK

SEQ ID NO: 2779592 - protein, 9 aa, Entamoeba invadens
TKDSKCSKC

SEQ ID NO: 2779593 - protein, 6 aa, Entamoeba invadens
TKDSNF

SEQ ID NO: 2779594 - protein, 11 aa, Entamoeba invadens
TKDSSTGSIEN

SEQ ID NO: 2779595 - protein, 7 aa, Entamoeba invadens
TKDTHYS

SEQ ID NO: 2779596 - protein, 9 aa, Entamoeba invadens
TKDYISNSK

SEQ ID NO: 2779597 - protein, 9 aa, Entamoeba invadens
TKEAVAEAK

SEQ ID NO: 2779598 - protein, 6 aa, Entamoeba invadens
TKEAVK

SEQ ID NO: 2779599 - protein, 5 aa, Entamoeba invadens
TKECD

SEQ ID NO: 2779600 - protein, 16 aa, Entamoeba invadens
TKECDAPQSDCGDGKF

SEQ ID NO: 2779601 - protein, 22 aa, Entamoeba invadens
TKEDREKYGDTIPYKTKALGAN

SEQ ID NO: 2779602 - protein, 6 aa, Entamoeba invadens
TKEDSA

SEQ ID NO: 2779603 - protein, 4 aa, Entamoeba invadens
TKEE

SEQ ID NO: 2779604 - protein, 16 aa, Entamoeba invadens
TKEEQQMKEQHKLERI

SEQ ID NO: 2779605 - protein, 5 aa, Entamoeba invadens
TKEER

SEQ ID NO: 2779606 - protein, 6 aa, Entamoeba invadens
TKEFNG

SEQ ID NO: 2779607 - protein, 23 aa, Entamoeba invadens
TKEHLDDSNTSSLLPNDADDLAP

SEQ ID NO: 2779608 - protein, 9 aa, Entamoeba invadens
TKEKEEKTS

SEQ ID NO: 2779609 - protein, 8 aa, Entamoeba invadens
TKEKLEKI

SEQ ID NO: 2779610 - protein, 9 aa, Entamoeba invadens
TKEKNQKVS

SEQ ID NO: 2779611 - protein, 12 aa, Entamoeba invadens
TKELDPSEKDDL

SEQ ID NO: 2779612 - protein, 22 aa, Entamoeba invadens
TKENKCKQCDSKCENCTSATDC

SEQ ID NO: 2779613 - protein, 8 aa, Entamoeba invadens
TKENPTFT

SEQ ID NO: 2779614 - protein, 8 aa, Entamoeba invadens
TKENSQKK

SEQ ID NO: 2779615 - protein, 7 aa, Entamoeba invadens
TKENTVD

SEQ ID NO: 2779616 - protein, 6 aa, Entamoeba invadens
TKEPEI

SEQ ID NO: 2779617 - protein, 10 aa, Entamoeba invadens
TKEPVSKTDM

SEQ ID NO: 2779618 - protein, 12 aa, Entamoeba invadens
TKEQYDDNNKID

SEQ ID NO: 2779619 - protein, 4 aa, Entamoeba invadens
TKER

SEQ ID NO: 2779620 - protein, 6 aa, Entamoeba invadens
TKERTL

SEQ ID NO: 2779621 - protein, 6 aa, Entamoeba invadens
TKESAA

SEQ ID NO: 2779622 - protein, 8 aa, Entamoeba invadens
TKESEVNV

SEQ ID NO: 2779623 - protein, 9 aa, Entamoeba invadens
TKESLPSSK

SEQ ID NO: 2779624 - protein, 38 aa, Entamoeba invadens
TKETAATKCDSCKNSLKLSSDKTACGTTCPNGEIDNNG

SEQ ID NO: 2779625 - protein, 17 aa, Entamoeba invadens
TKETGSLVAGGKEEDTF

SEQ ID NO: 2779626 - protein, 6 aa, Entamoeba invadens
TKETGY

SEQ ID NO: 2779627 - protein, 12 aa, Entamoeba invadens
TKFDRKECTDPI

SEQ ID NO: 2779628 - protein, 8 aa, Entamoeba invadens
TKFEDGLK

SEQ ID NO: 2779629 - protein, 7 aa, Entamoeba invadens
TKFGESC

SEQ ID NO: 2779630 - protein, 8 aa, Entamoeba invadens
TKFGNSAF

SEQ ID NO: 2779631 - protein, 5 aa, Entamoeba invadens
TKFRN

SEQ ID NO: 2779632 - protein, 8 aa, Entamoeba invadens
TKFSPQEM

SEQ ID NO: 2779633 - protein, 6 aa, Entamoeba invadens
TKFTKT

SEQ ID NO: 2779634 - protein, 12 aa, Entamoeba invadens
TKGAEKCPTKTS

SEQ ID NO: 2779635 - protein, 17 aa, Entamoeba invadens
TKGAISPWTEDKTLSPR

SEQ ID NO: 2779636 - protein, 12 aa, Entamoeba invadens
TKGCNTCSATGG

SEQ ID NO: 2779637 - protein, 11 aa, Entamoeba invadens
TKGKEKIYGQN

SEQ ID NO: 2779638 - protein, 29 aa, Entamoeba invadens
TKGKGTVAGGHKQSKSTAPGEKAEEKSYD

SEQ ID NO: 2779639 - protein, 5 aa, Entamoeba invadens
TKGNF

SEQ ID NO: 2779640 - protein, 13 aa, Entamoeba invadens
TKGNKEKLKNGNI

SEQ ID NO: 2779641 - protein, 9 aa, Entamoeba invadens
TKGNLKKIE

SEQ ID NO: 2779642 - protein, 4 aa, Entamoeba invadens
TKGQ

SEQ ID NO: 2779643 - protein, 8 aa, Entamoeba invadens
TKGQTLLT

SEQ ID NO: 2779644 - protein, 8 aa, Entamoeba invadens
TKGSIKPN

SEQ ID NO: 2779645 - protein, 13 aa, Entamoeba invadens
TKGTNCSSLQRTN

SEQ ID NO: 2779646 - protein, 6 aa, Entamoeba invadens
TKGTTL

SEQ ID NO: 2779647 - protein, 8 aa, Entamoeba invadens
TKGVGTPK

SEQ ID NO: 2779648 - protein, 9 aa, Entamoeba invadens
TKGVTSNAI

SEQ ID NO: 2779649 - protein, 7 aa, Entamoeba invadens
TKGYEGV

SEQ ID NO: 2779650 - protein, 11 aa, Entamoeba invadens
TKIDKGDCDPY

SEQ ID NO: 2779651 - protein, 5 aa, Entamoeba invadens
TKIDS

SEQ ID NO: 2779652 - protein, 8 aa, Entamoeba invadens
TKIEEDTK

SEQ ID NO: 2779653 - protein, 9 aa, Entamoeba invadens
TKIEKETIE

SEQ ID NO: 2779654 - protein, 7 aa, Entamoeba invadens
TKIGEGS

SEQ ID NO: 2779655 - protein, 9 aa, Entamoeba invadens
TKIGGDKKA

SEQ ID NO: 2779656 - protein, 25 aa, Entamoeba invadens
TKIGGEDKGLGTPIYASPESYQDEY

SEQ ID NO: 2779657 - protein, 6 aa, Entamoeba invadens
TKIKPN

SEQ ID NO: 2779658 - protein, 6 aa, Entamoeba invadens
TKIKYT

SEQ ID NO: 2779659 - protein, 18 aa, Entamoeba invadens
TKIPDENPPQPAAKTEKA

SEQ ID NO: 2779660 - protein, 7 aa, Entamoeba invadens
TKIPEET

SEQ ID NO: 2779661 - protein, 13 aa, Entamoeba invadens
TKIQEESREVGGL

SEQ ID NO: 2779662 - protein, 4 aa, Entamoeba invadens
TKIS

SEQ ID NO: 2779663 - protein, 12 aa, Entamoeba invadens
TKISEDNKEPNS

SEQ ID NO: 2779664 - protein, 10 aa, Entamoeba invadens
TKISNSKSKT

SEQ ID NO: 2779665 - protein, 7 aa, Entamoeba invadens
TKISPKD

SEQ ID NO: 2779666 - protein, 9 aa, Entamoeba invadens
TKITDGNGQ

SEQ ID NO: 2779667 - protein, 10 aa, Entamoeba invadens
TKITTSGCNS

SEQ ID NO: 2779668 - protein, 6 aa, Entamoeba invadens
TKKDGN

SEQ ID NO: 2779669 - protein, 6 aa, Entamoeba invadens
TKKEEA

SEQ ID NO: 2779670 - protein, 6 aa, Entamoeba invadens
TKKEKD

SEQ ID NO: 2779671 - protein, 9 aa, Entamoeba invadens
TKKESESVS

SEQ ID NO: 2779672 - protein, 5 aa, Entamoeba invadens
TKKGE

SEQ ID NO: 2779673 - protein, 24 aa, Entamoeba invadens
TKKHDTKDKKTKRTKKIDDKRTHV

SEQ ID NO: 2779674 - protein, 8 aa, Entamoeba invadens
TKKIPPHT

SEQ ID NO: 2779675 - protein, 13 aa, Entamoeba invadens
TKKKTEKALPESE

SEQ ID NO: 2779676 - protein, 5 aa, Entamoeba invadens
TKKNE

SEQ ID NO: 2779677 - protein, 16 aa, Entamoeba invadens
TKKPKLKWNEEQLKNK

SEQ ID NO: 2779678 - protein, 6 aa, Entamoeba invadens
TKKRPP

SEQ ID NO: 2779679 - protein, 5 aa, Entamoeba invadens
TKKSI

SEQ ID NO: 2779680 - protein, 9 aa, Entamoeba invadens
TKKTDCTQC

SEQ ID NO: 2779681 - protein, 9 aa, Entamoeba invadens
TKKTDSSKC

SEQ ID NO: 2779682 - protein, 14 aa, Entamoeba invadens
TKKTSAANATQSAL

SEQ ID NO: 2779683 - protein, 10 aa, Entamoeba invadens
TKLDKDSLHE

SEQ ID NO: 2779684 - protein, 18 aa, Entamoeba invadens
TKLDNEELNEDKKLGEGG

SEQ ID NO: 2779685 - protein, 18 aa, Entamoeba invadens
TKLGNGAFKSVKSTAMTF

SEQ ID NO: 2779686 - protein, 8 aa, Entamoeba invadens
TKLNESAC

SEQ ID NO: 2779687 - protein, 4 aa, Entamoeba invadens
TKLS

SEQ ID NO: 2779688 - protein, 14 aa, Entamoeba invadens
TKLSETSSRKVDVT

SEQ ID NO: 2779689 - protein, 16 aa, Entamoeba invadens
TKLSSSMQGRDNSSDI

SEQ ID NO: 2779690 - protein, 5 aa, Entamoeba invadens
TKLST

SEQ ID NO: 2779691 - protein, 5 aa, Entamoeba invadens
TKLTE

SEQ ID NO: 2779692 - protein, 8 aa, Entamoeba invadens
TKLTSKLD

SEQ ID NO: 2779693 - protein, 5 aa, Entamoeba invadens
TKMES

SEQ ID NO: 2779694 - protein, 10 aa, Entamoeba invadens
TKMGNGAFKE

SEQ ID NO: 2779695 - protein, 8 aa, Entamoeba invadens
TKMNEQKY

SEQ ID NO: 2779696 - protein, 6 aa, Entamoeba invadens
TKNAEG

SEQ ID NO: 2779697 - protein, 9 aa, Entamoeba invadens
TKNCESCDR

SEQ ID NO: 2779698 - protein, 17 aa, Entamoeba invadens
TKNCESCPSNCKTCNTS

SEQ ID NO: 2779699 - protein, 4 aa, Entamoeba invadens
TKND

SEQ ID NO: 2779700 - protein, 14 aa, Entamoeba invadens
TKNDCGNWEETNEF

SEQ ID NO: 2779701 - protein, 7 aa, Entamoeba invadens
TKNEQLL

SEQ ID NO: 2779702 - protein, 7 aa, Entamoeba invadens
TKNETGS

SEQ ID NO: 2779703 - protein, 12 aa, Entamoeba invadens
TKNEVSSYQPEY

SEQ ID NO: 2779704 - protein, 8 aa, Entamoeba invadens
TKNFPNKS

SEQ ID NO: 2779705 - protein, 7 aa, Entamoeba invadens
TKNGCSK

SEQ ID NO: 2779706 - protein, 8 aa, Entamoeba invadens
TKNGSMKG

SEQ ID NO: 2779707 - protein, 5 aa, Entamoeba invadens
TKNKC

SEQ ID NO: 2779708 - protein, 9 aa, Entamoeba invadens
TKNKVPPMN

SEQ ID NO: 2779709 - protein, 4 aa, Entamoeba invadens
TKNM

SEQ ID NO: 2779710 - protein, 4 aa, Entamoeba invadens
TKNP

SEQ ID NO: 2779711 - protein, 6 aa, Entamoeba invadens
TKNPFD

SEQ ID NO: 2779712 - protein, 7 aa, Entamoeba invadens
TKNPNKV

SEQ ID NO: 2779713 - protein, 7 aa, Entamoeba invadens
TKNPRIP

SEQ ID NO: 2779714 - protein, 9 aa, Entamoeba invadens
TKNPRKPTE

SEQ ID NO: 2779715 - protein, 7 aa, Entamoeba invadens
TKNPRTN

SEQ ID NO: 2779716 - protein, 4 aa, Entamoeba invadens
TKNQ

SEQ ID NO: 2779717 - protein, 4 aa, Entamoeba invadens
TKNR

SEQ ID NO: 2779718 - protein, 13 aa, Entamoeba invadens
TKNRQTVFEDSSQ

SEQ ID NO: 2779719 - protein, 5 aa, Entamoeba invadens
TKNRR

SEQ ID NO: 2779720 - protein, 4 aa, Entamoeba invadens
TKNS

SEQ ID NO: 2779721 - protein, 7 aa, Entamoeba invadens
TKNSFGC

SEQ ID NO: 2779722 - protein, 24 aa, Entamoeba invadens
TKNSSNETENIKTAQNKCKKFGES

SEQ ID NO: 2779723 - protein, 5 aa, Entamoeba invadens
TKNSV

SEQ ID NO: 2779724 - protein, 7 aa, Entamoeba invadens
TKNTFNK

SEQ ID NO: 2779725 - protein, 5 aa, Entamoeba invadens
TKNTG

SEQ ID NO: 2779726 - protein, 7 aa, Entamoeba invadens
TKNTGNV

SEQ ID NO: 2779727 - protein, 11 aa, Entamoeba invadens
TKNTLNKDGNC

SEQ ID NO: 2779728 - protein, 8 aa, Entamoeba invadens
TKNTLSAS

SEQ ID NO: 2779729 - protein, 7 aa, Entamoeba invadens
TKNTQER

SEQ ID NO: 2779730 - protein, 11 aa, Entamoeba invadens
TKNTRPCKKTT

SEQ ID NO: 2779731 - protein, 7 aa, Entamoeba invadens
TKNVPEK

SEQ ID NO: 2779732 - protein, 14 aa, Entamoeba invadens
TKNVPTLSETKSSN

SEQ ID NO: 2779733 - protein, 7 aa, Entamoeba invadens
TKNYGKA

SEQ ID NO: 2779734 - protein, 10 aa, Entamoeba invadens
TKPDDQYSKR

SEQ ID NO: 2779735 - protein, 8 aa, Entamoeba invadens
TKPEDGSA

SEQ ID NO: 2779736 - protein, 12 aa, Entamoeba invadens
TKPENDRKCGRC

SEQ ID NO: 2779737 - protein, 7 aa, Entamoeba invadens
TKPERAH

SEQ ID NO: 2779738 - protein, 10 aa, Entamoeba invadens
TKPGRCDGCA

SEQ ID NO: 2779739 - protein, 12 aa, Entamoeba invadens
TKPHPDETASRI

SEQ ID NO: 2779740 - protein, 6 aa, Entamoeba invadens
TKPKAV

SEQ ID NO: 2779741 - protein, 5 aa, Entamoeba invadens
TKPKF

SEQ ID NO: 2779742 - protein, 10 aa, Entamoeba invadens
TKPKGLTSDG

SEQ ID NO: 2779743 - protein, 6 aa, Entamoeba invadens
TKPNKI

SEQ ID NO: 2779744 - protein, 6 aa, Entamoeba invadens
TKPPIR

SEQ ID NO: 2779745 - protein, 8 aa, Entamoeba invadens
TKPQIEKE

SEQ ID NO: 2779746 - protein, 13 aa, Entamoeba invadens
TKPQKVGDENQVD

SEQ ID NO: 2779747 - protein, 4 aa, Entamoeba invadens
TKPR

SEQ ID NO: 2779748 - protein, 10 aa, Entamoeba invadens
TKPREKTTDP

SEQ ID NO: 2779749 - protein, 10 aa, Entamoeba invadens
TKPSKPYEKR

SEQ ID NO: 2779750 - protein, 10 aa, Entamoeba invadens
TKPSNDAFQP

SEQ ID NO: 2779751 - protein, 13 aa, Entamoeba invadens
TKPSRGSARLTTR

SEQ ID NO: 2779752 - protein, 21 aa, Entamoeba invadens
TKPSTATLKKIDGKSTYTDTN

SEQ ID NO: 2779753 - protein, 4 aa, Entamoeba invadens
TKPT

SEQ ID NO: 2779754 - protein, 6 aa, Entamoeba invadens
TKPTKK

SEQ ID NO: 2779755 - protein, 5 aa, Entamoeba invadens
TKPVD

SEQ ID NO: 2779756 - protein, 5 aa, Entamoeba invadens
TKPVE

SEQ ID NO: 2779757 - protein, 4 aa, Entamoeba invadens
TKQE

SEQ ID NO: 2779758 - protein, 8 aa, Entamoeba invadens
TKQGASNL

SEQ ID NO: 2779759 - protein, 7 aa, Entamoeba invadens
TKQGGKQ

SEQ ID NO: 2779760 - protein, 9 aa, Entamoeba invadens
TKQHTKTNF

SEQ ID NO: 2779761 - protein, 11 aa, Entamoeba invadens
TKQHYSNSVEV

SEQ ID NO: 2779762 - protein, 14 aa, Entamoeba invadens
TKQKSHNKNIGCLL

SEQ ID NO: 2779763 - protein, 7 aa, Entamoeba invadens
TKQKTSK

SEQ ID NO: 2779764 - protein, 9 aa, Entamoeba invadens
TKQLGTGSL

SEQ ID NO: 2779765 - protein, 10 aa, Entamoeba invadens
TKQNLDEKVQ

SEQ ID NO: 2779766 - protein, 22 aa, Entamoeba invadens
TKQPPQVEVESPYNQQIDQDAP

SEQ ID NO: 2779767 - protein, 7 aa, Entamoeba invadens
TKQPTKL

SEQ ID NO: 2779768 - protein, 6 aa, Entamoeba invadens
TKQSQT

SEQ ID NO: 2779769 - protein, 4 aa, Entamoeba invadens
TKQT

SEQ ID NO: 2779770 - protein, 7 aa, Entamoeba invadens
TKQTVDS

SEQ ID NO: 2779771 - protein, 25 aa, Entamoeba invadens
TKRDRDKDHSSSNASPRLHSKDEKV

SEQ ID NO: 2779772 - protein, 6 aa, Entamoeba invadens
TKREIR

SEQ ID NO: 2779773 - protein, 10 aa, Entamoeba invadens
TKRKESEQLK

SEQ ID NO: 2779774 - protein, 5 aa, Entamoeba invadens
TKRKP

SEQ ID NO: 2779775 - protein, 19 aa, Entamoeba invadens
TKRKQQENLKTESEAGPVA

SEQ ID NO: 2779776 - protein, 6 aa, Entamoeba invadens
TKRPNK

SEQ ID NO: 2779777 - protein, 4 aa, Entamoeba invadens
TKRR

SEQ ID NO: 2779778 - protein, 14 aa, Entamoeba invadens
TKRSKEAKNCNGFI

SEQ ID NO: 2779779 - protein, 6 aa, Entamoeba invadens
TKRSNK

SEQ ID NO: 2779780 - protein, 7 aa, Entamoeba invadens
TKRSNKV

SEQ ID NO: 2779781 - protein, 8 aa, Entamoeba invadens
TKRTYRDN

SEQ ID NO: 2779782 - protein, 14 aa, Entamoeba invadens
TKRVPPKTDIEVSL

SEQ ID NO: 2779783 - protein, 7 aa, Entamoeba invadens
TKSAKKI

SEQ ID NO: 2779784 - protein, 8 aa, Entamoeba invadens
TKSAKKIV

SEQ ID NO: 2779785 - protein, 7 aa, Entamoeba invadens
TKSATIK

SEQ ID NO: 2779786 - protein, 7 aa, Entamoeba invadens
TKSATVE

SEQ ID NO: 2779787 - protein, 29 aa, Entamoeba invadens
TKSCENVTNSVHDSNGRCSNKENCALTNN

SEQ ID NO: 2779788 - protein, 6 aa, Entamoeba invadens
TKSDAV

SEQ ID NO: 2779789 - protein, 10 aa, Entamoeba invadens
TKSECGGVSR

SEQ ID NO: 2779790 - protein, 8 aa, Entamoeba invadens
TKSETNVS

SEQ ID NO: 2779791 - protein, 9 aa, Entamoeba invadens
TKSETWTSG

SEQ ID NO: 2779792 - protein, 5 aa, Entamoeba invadens
TKSEY

SEQ ID NO: 2779793 - protein, 8 aa, Entamoeba invadens
TKSGCASC

SEQ ID NO: 2779794 - protein, 9 aa, Entamoeba invadens
TKSGDKATE

SEQ ID NO: 2779795 - protein, 9 aa, Entamoeba invadens
TKSGEEKEK

SEQ ID NO: 2779796 - protein, 7 aa, Entamoeba invadens
TKSGESM

SEQ ID NO: 2779797 - protein, 8 aa, Entamoeba invadens
TKSGFDKT

SEQ ID NO: 2779798 - protein, 9 aa, Entamoeba invadens
TKSGNNNKK

SEQ ID NO: 2779799 - protein, 12 aa, Entamoeba invadens
TKSKRDAKSGNC

SEQ ID NO: 2779800 - protein, 4 aa, Entamoeba invadens
TKSL

SEQ ID NO: 2779801 - protein, 6 aa, Entamoeba invadens
TKSMKK

SEQ ID NO: 2779802 - protein, 4 aa, Entamoeba invadens
TKSN

SEQ ID NO: 2779803 - protein, 7 aa, Entamoeba invadens
TKSNKSM

SEQ ID NO: 2779804 - protein, 6 aa, Entamoeba invadens
TKSNMK

SEQ ID NO: 2779805 - protein, 36 aa, Entamoeba invadens
TKSQKSDSKRQPSDKLTNNSFSSHSTRTSFSSENTD

SEQ ID NO: 2779806 - protein, 8 aa, Entamoeba invadens
TKSSDTLL

SEQ ID NO: 2779807 - protein, 6 aa, Entamoeba invadens
TKSSLT

SEQ ID NO: 2779808 - protein, 7 aa, Entamoeba invadens
TKSSSGC

SEQ ID NO: 2779809 - protein, 8 aa, Entamoeba invadens
TKSSVQDT

SEQ ID NO: 2779810 - protein, 7 aa, Entamoeba invadens
TKSTCKY

SEQ ID NO: 2779811 - protein, 7 aa, Entamoeba invadens
TKSTGGF

SEQ ID NO: 2779812 - protein, 10 aa, Entamoeba invadens
TKSTSCNKCS

SEQ ID NO: 2779813 - protein, 9 aa, Entamoeba invadens
TKSVEKTTT

SEQ ID NO: 2779814 - protein, 7 aa, Entamoeba invadens
TKSVTGS

SEQ ID NO: 2779815 - protein, 15 aa, Entamoeba invadens
TKSYQSGGKGDNSYS

SEQ ID NO: 2779816 - protein, 4 aa, Entamoeba invadens
TKTA

SEQ ID NO: 2779817 - protein, 9 aa, Entamoeba invadens
TKTCEQCNS

SEQ ID NO: 2779818 - protein, 5 aa, Entamoeba invadens
TKTCV

SEQ ID NO: 2779819 - protein, 8 aa, Entamoeba invadens
TKTDNATL

SEQ ID NO: 2779820 - protein, 5 aa, Entamoeba invadens
TKTER

SEQ ID NO: 2779821 - protein, 7 aa, Entamoeba invadens
TKTESIV

SEQ ID NO: 2779822 - protein, 12 aa, Entamoeba invadens
TKTESSLKRSSY

SEQ ID NO: 2779823 - protein, 6 aa, Entamoeba invadens
TKTGGH

SEQ ID NO: 2779824 - protein, 5 aa, Entamoeba invadens
TKTKE

SEQ ID NO: 2779825 - protein, 9 aa, Entamoeba invadens
TKTKESNSF

SEQ ID NO: 2779826 - protein, 6 aa, Entamoeba invadens
TKTKLN

SEQ ID NO: 2779827 - protein, 8 aa, Entamoeba invadens
TKTKQSNY

SEQ ID NO: 2779828 - protein, 7 aa, Entamoeba invadens
TKTLETL

SEQ ID NO: 2779829 - protein, 9 aa, Entamoeba invadens
TKTNCSSSQ

SEQ ID NO: 2779830 - protein, 6 aa, Entamoeba invadens
TKTNDR

SEQ ID NO: 2779831 - protein, 6 aa, Entamoeba invadens
TKTNEK

SEQ ID NO: 2779832 - protein, 5 aa, Entamoeba invadens
TKTNI

SEQ ID NO: 2779833 - protein, 8 aa, Entamoeba invadens
TKTNKNVN

SEQ ID NO: 2779834 - protein, 8 aa, Entamoeba invadens
TKTNSNEL

SEQ ID NO: 2779835 - protein, 7 aa, Entamoeba invadens
TKTPEGC

SEQ ID NO: 2779836 - protein, 6 aa, Entamoeba invadens
TKTPKV

SEQ ID NO: 2779837 - protein, 5 aa, Entamoeba invadens
TKTPS

SEQ ID NO: 2779838 - protein, 21 aa, Entamoeba invadens
TKTQNEKVSKNEENVESETLP

SEQ ID NO: 2779839 - protein, 7 aa, Entamoeba invadens
TKTQQTV

SEQ ID NO: 2779840 - protein, 9 aa, Entamoeba invadens
TKTQSGTEN

SEQ ID NO: 2779841 - protein, 7 aa, Entamoeba invadens
TKTQTSE

SEQ ID NO: 2779842 - protein, 5 aa, Entamoeba invadens
TKTQV

SEQ ID NO: 2779843 - protein, 13 aa, Entamoeba invadens
TKTTAKYSGSNLY

SEQ ID NO: 2779844 - protein, 9 aa, Entamoeba invadens
TKTTESSCL

SEQ ID NO: 2779845 - protein, 11 aa, Entamoeba invadens
TKTTLNPSCEK

SEQ ID NO: 2779846 - protein, 7 aa, Entamoeba invadens
TKTTNTA

SEQ ID NO: 2779847 - protein, 9 aa, Entamoeba invadens
TKTTQNMKT

SEQ ID NO: 2779848 - protein, 10 aa, Entamoeba invadens
TKTTQNVKTA

SEQ ID NO: 2779849 - protein, 7 aa, Entamoeba invadens
TKTTTNY

SEQ ID NO: 2779850 - protein, 4 aa, Entamoeba invadens
TKTV

SEQ ID NO: 2779851 - protein, 8 aa, Entamoeba invadens
TKTVTNMN

SEQ ID NO: 2779852 - protein, 4 aa, Entamoeba invadens
TKVD

SEQ ID NO: 2779853 - protein, 6 aa, Entamoeba invadens
TKVGDE

SEQ ID NO: 2779854 - protein, 22 aa, Entamoeba invadens
TKVGKQKKKTIEATYAKESVRG

SEQ ID NO: 2779855 - protein, 12 aa, Entamoeba invadens
TKVGSNSVTDSS

SEQ ID NO: 2779856 - protein, 14 aa, Entamoeba invadens
TKVGTDKYSIRTDP

SEQ ID NO: 2779857 - protein, 9 aa, Entamoeba invadens
TKVKTNTQT

SEQ ID NO: 2779858 - protein, 4 aa, Entamoeba invadens
TKVN

SEQ ID NO: 2779859 - protein, 13 aa, Entamoeba invadens
TKVNGKLTDFGSA

SEQ ID NO: 2779860 - protein, 14 aa, Entamoeba invadens
TKVPKEQQARYVAF

SEQ ID NO: 2779861 - protein, 4 aa, Entamoeba invadens
TKVT

SEQ ID NO: 2779862 - protein, 9 aa, Entamoeba invadens
TKVTDGNGE

SEQ ID NO: 2779863 - protein, 13 aa, Entamoeba invadens
TKVTPSSDLNAKE

SEQ ID NO: 2779864 - protein, 9 aa, Entamoeba invadens
TKVYKGTET

SEQ ID NO: 2779865 - protein, 5 aa, Entamoeba invadens
TKYDA

SEQ ID NO: 2779866 - protein, 11 aa, Entamoeba invadens
TKYDPTEITPT

SEQ ID NO: 2779867 - protein, 6 aa, Entamoeba invadens
TKYDST

SEQ ID NO: 2779868 - protein, 19 aa, Entamoeba invadens
TKYDTGPCRSKDNNTHDSY

SEQ ID NO: 2779869 - protein, 11 aa, Entamoeba invadens
TKYECEECESG

SEQ ID NO: 2779870 - protein, 8 aa, Entamoeba invadens
TKYGCKEC

SEQ ID NO: 2779871 - protein, 6 aa, Entamoeba invadens
TKYGEH

SEQ ID NO: 2779872 - protein, 6 aa, Entamoeba invadens
TKYGEN

SEQ ID NO: 2779873 - protein, 6 aa, Entamoeba invadens
TKYPEI

SEQ ID NO: 2779874 - protein, 10 aa, Entamoeba invadens
TKYRPDNNGT

SEQ ID NO: 2779875 - protein, 9 aa, Entamoeba invadens
TKYYPNTST

SEQ ID NO: 2779876 - protein, 9 aa, Entamoeba invadens
TKYYPSNNY

SEQ ID NO: 2779877 - protein, 26 aa, Entamoeba invadens
TKYYTQPDTPHTCERDCPDAYYKGDG

SEQ ID NO: 2779878 - protein, 19 aa, Entamoeba invadens
TLAGQTGYSITRTKSTETN

SEQ ID NO: 2779879 - protein, 11 aa, Entamoeba invadens
TLCEQSSSNGC

SEQ ID NO: 2779880 - protein, 7 aa, Entamoeba invadens
TLDAENN

SEQ ID NO: 2779881 - protein, 15 aa, Entamoeba invadens
TLDDTTIDASLRNDT

SEQ ID NO: 2779882 - protein, 7 aa, Entamoeba invadens
TLDEDSA

SEQ ID NO: 2779883 - protein, 6 aa, Entamoeba invadens
TLDKNI

SEQ ID NO: 2779884 - protein, 8 aa, Entamoeba invadens
TLDKTTNK

SEQ ID NO: 2779885 - protein, 5 aa, Entamoeba invadens
TLDTT

SEQ ID NO: 2779886 - protein, 8 aa, Entamoeba invadens
TLEDEKGF

SEQ ID NO: 2779887 - protein, 9 aa, Entamoeba invadens
TLEDGDEDK

SEQ ID NO: 2779888 - protein, 18 aa, Entamoeba invadens
TLEEKVNKASEKWANGKM

SEQ ID NO: 2779889 - protein, 14 aa, Entamoeba invadens
TLEKGENEVSESEV

SEQ ID NO: 2779890 - protein, 5 aa, Entamoeba invadens
TLENA

SEQ ID NO: 2779891 - protein, 5 aa, Entamoeba invadens
TLENE

SEQ ID NO: 2779892 - protein, 9 aa, Entamoeba invadens
TLEPPQKSL

SEQ ID NO: 2779893 - protein, 9 aa, Entamoeba invadens
TLEQPKGRE

SEQ ID NO: 2779894 - protein, 15 aa, Entamoeba invadens
TLETPRESGEITRDS

SEQ ID NO: 2779895 - protein, 4 aa, Entamoeba invadens
TLGD

SEQ ID NO: 2779896 - protein, 7 aa, Entamoeba invadens
TLGNNSA

SEQ ID NO: 2779897 - protein, 11 aa, Entamoeba invadens
TLKAPAKDGEY

SEQ ID NO: 2779898 - protein, 10 aa, Entamoeba invadens
TLKDKTFETW

SEQ ID NO: 2779899 - protein, 5 aa, Entamoeba invadens
TLKGA

SEQ ID NO: 2779900 - protein, 12 aa, Entamoeba invadens
TLKGKDACSTQE

SEQ ID NO: 2779901 - protein, 8 aa, Entamoeba invadens
TLKIESED

SEQ ID NO: 2779902 - protein, 8 aa, Entamoeba invadens
TLKNNEQV

SEQ ID NO: 2779903 - protein, 5 aa, Entamoeba invadens
TLKTD

SEQ ID NO: 2779904 - protein, 20 aa, Entamoeba invadens
TLKTTKSNTTLKSATPDTLQ

SEQ ID NO: 2779905 - protein, 7 aa, Entamoeba invadens
TLNAKSV

SEQ ID NO: 2779906 - protein, 16 aa, Entamoeba invadens
TLNASSEDKEAEIGTV

SEQ ID NO: 2779907 - protein, 6 aa, Entamoeba invadens
TLNDAQ

SEQ ID NO: 2779908 - protein, 4 aa, Entamoeba invadens
TLNG

SEQ ID NO: 2779909 - protein, 4 aa, Entamoeba invadens
TLNN

SEQ ID NO: 2779910 - protein, 17 aa, Entamoeba invadens
TLNNEGNTNKDNYCTDN

SEQ ID NO: 2779911 - protein, 9 aa, Entamoeba invadens
TLNPTKQDI

SEQ ID NO: 2779912 - protein, 20 aa, Entamoeba invadens
TLNQKAKDIVDDDRPMSPSL

SEQ ID NO: 2779913 - protein, 10 aa, Entamoeba invadens
TLNSKDKNNI

SEQ ID NO: 2779914 - protein, 13 aa, Entamoeba invadens
TLNSKKVQSTDTQ

SEQ ID NO: 2779915 - protein, 10 aa, Entamoeba invadens
TLNSQNNPAL

SEQ ID NO: 2779916 - protein, 10 aa, Entamoeba invadens
TLNTDSNQDF

SEQ ID NO: 2779917 - protein, 13 aa, Entamoeba invadens
TLNTNSTKCVTQE

SEQ ID NO: 2779918 - protein, 6 aa, Entamoeba invadens
TLNTSS

SEQ ID NO: 2779919 - protein, 5 aa, Entamoeba invadens
TLPDQ

SEQ ID NO: 2779920 - protein, 4 aa, Entamoeba invadens
TLPE

SEQ ID NO: 2779921 - protein, 12 aa, Entamoeba invadens
TLPESMKERGDI

SEQ ID NO: 2779922 - protein, 4 aa, Entamoeba invadens
TLPH

SEQ ID NO: 2779923 - protein, 4 aa, Entamoeba invadens
TLPK

SEQ ID NO: 2779924 - protein, 11 aa, Entamoeba invadens
TLPKDKKPSMA

SEQ ID NO: 2779925 - protein, 10 aa, Entamoeba invadens
TLPKKNVEVA

SEQ ID NO: 2779926 - protein, 4 aa, Entamoeba invadens
TLPN

SEQ ID NO: 2779927 - protein, 29 aa, Entamoeba invadens
TLPNETTKEKTKNEDTQTNSHCEASTTKG

SEQ ID NO: 2779928 - protein, 28 aa, Entamoeba invadens
TLPNETTKQTTKNEDTQTDSHCEVSTTK

SEQ ID NO: 2779929 - protein, 28 aa, Entamoeba invadens
TLPNETTKQTTKYEDTQTDSHCEVSTTK

SEQ ID NO: 2779930 - protein, 27 aa, Entamoeba invadens
TLPNETTRQTTIKEDTQTDSHCEVRTT

SEQ ID NO: 2779931 - protein, 7 aa, Entamoeba invadens
TLPPEEH

SEQ ID NO: 2779932 - protein, 5 aa, Entamoeba invadens
TLPRG

SEQ ID NO: 2779933 - protein, 6 aa, Entamoeba invadens
TLPSGR

SEQ ID NO: 2779934 - protein, 9 aa, Entamoeba invadens
TLPSQDKEI

SEQ ID NO: 2779935 - protein, 6 aa, Entamoeba invadens
TLPTQQ

SEQ ID NO: 2779936 - protein, 10 aa, Entamoeba invadens
TLPTSEVSGV

SEQ ID NO: 2779937 - protein, 9 aa, Entamoeba invadens
TLPVGSESR

SEQ ID NO: 2779938 - protein, 34 aa, Entamoeba invadens
TLQERVDESSCESTSYDRDKSESYSSSNDDLETT

SEQ ID NO: 2779939 - protein, 6 aa, Entamoeba invadens
TLQETF

SEQ ID NO: 2779940 - protein, 4 aa, Entamoeba invadens
TLQH

SEQ ID NO: 2779941 - protein, 10 aa, Entamoeba invadens
TLQKREAKER

SEQ ID NO: 2779942 - protein, 4 aa, Entamoeba invadens
TLQN

SEQ ID NO: 2779943 - protein, 6 aa, Entamoeba invadens
TLQNNN

SEQ ID NO: 2779944 - protein, 8 aa, Entamoeba invadens
TLQNTAKT

SEQ ID NO: 2779945 - protein, 10 aa, Entamoeba invadens
TLQRSQSTTP

SEQ ID NO: 2779946 - protein, 5 aa, Entamoeba invadens
TLQSG

SEQ ID NO: 2779947 - protein, 4 aa, Entamoeba invadens
TLQT

SEQ ID NO: 2779948 - protein, 8 aa, Entamoeba invadens
TLRERGKK

SEQ ID NO: 2779949 - protein, 11 aa, Entamoeba invadens
TLRESGVTEET

SEQ ID NO: 2779950 - protein, 4 aa, Entamoeba invadens
TLRN

SEQ ID NO: 2779951 - protein, 8 aa, Entamoeba invadens
TLSADKCE

SEQ ID NO: 2779952 - protein, 13 aa, Entamoeba invadens
TLSDQTSCSLSSS

SEQ ID NO: 2779953 - protein, 12 aa, Entamoeba invadens
TLSEEQNAKYEN

SEQ ID NO: 2779954 - protein, 9 aa, Entamoeba invadens
TLSESESQL

SEQ ID NO: 2779955 - protein, 10 aa, Entamoeba invadens
TLSGKQPSFL

SEQ ID NO: 2779956 - protein, 8 aa, Entamoeba invadens
TLSGTETI

SEQ ID NO: 2779957 - protein, 15 aa, Entamoeba invadens
TLSNDDPSKSSRRDM

SEQ ID NO: 2779958 - protein, 28 aa, Entamoeba invadens
TLSNETTKQATKNEDTQTDSHCEVSTTK

SEQ ID NO: 2779959 - protein, 5 aa, Entamoeba invadens
TLSNI

SEQ ID NO: 2779960 - protein, 5 aa, Entamoeba invadens
TLSNN

SEQ ID NO: 2779961 - protein, 4 aa, Entamoeba invadens
TLSP

SEQ ID NO: 2779962 - protein, 10 aa, Entamoeba invadens
TLSQETGQRL

SEQ ID NO: 2779963 - protein, 7 aa, Entamoeba invadens
TLSRTKR

SEQ ID NO: 2779964 - protein, 7 aa, Entamoeba invadens
TLSSKQK

SEQ ID NO: 2779965 - protein, 6 aa, Entamoeba invadens
TLSSNG

SEQ ID NO: 2779966 - protein, 10 aa, Entamoeba invadens
TLSSNGKSCD

SEQ ID NO: 2779967 - protein, 8 aa, Entamoeba invadens
TLSSPTTC

SEQ ID NO: 2779968 - protein, 8 aa, Entamoeba invadens
TLSSSTVP

SEQ ID NO: 2779969 - protein, 13 aa, Entamoeba invadens
TLSSTSTSKSAEF

SEQ ID NO: 2779970 - protein, 4 aa, Entamoeba invadens
TLTA

SEQ ID NO: 2779971 - protein, 6 aa, Entamoeba invadens
TLTEHD

SEQ ID NO: 2779972 - protein, 22 aa, Entamoeba invadens
TLTESYQSNPIQYQQPTQTTPI

SEQ ID NO: 2779973 - protein, 20 aa, Entamoeba invadens
TLTEYETADCTGEGTENSYD

SEQ ID NO: 2779974 - protein, 11 aa, Entamoeba invadens
TLTGSDLNTDI

SEQ ID NO: 2779975 - protein, 4 aa, Entamoeba invadens
TLTI

SEQ ID NO: 2779976 - protein, 17 aa, Entamoeba invadens
TLTISTNSSFNSSGGLE

SEQ ID NO: 2779977 - protein, 4 aa, Entamoeba invadens
TLTL

SEQ ID NO: 2779978 - protein, 10 aa, Entamoeba invadens
TLTLETSTGN

SEQ ID NO: 2779979 - protein, 8 aa, Entamoeba invadens
TLTNPPDV

SEQ ID NO: 2779980 - protein, 5 aa, Entamoeba invadens
TLTNY

SEQ ID NO: 2779981 - protein, 7 aa, Entamoeba invadens
TLTPDDG

SEQ ID NO: 2779982 - protein, 12 aa, Entamoeba invadens
TLTPEELFELEF

SEQ ID NO: 2779983 - protein, 10 aa, Entamoeba invadens
TLTQTSTSAY

SEQ ID NO: 2779984 - protein, 11 aa, Entamoeba invadens
TLTRSGNRDEL

SEQ ID NO: 2779985 - protein, 7 aa, Entamoeba invadens
TLTTNRN

SEQ ID NO: 2779986 - protein, 7 aa, Entamoeba invadens
TLTTRQN

SEQ ID NO: 2779987 - protein, 13 aa, Entamoeba invadens
TLTTTGPTIIPDR

SEQ ID NO: 2779988 - protein, 4 aa, Entamoeba invadens
TLTV

SEQ ID NO: 2779989 - protein, 5 aa, Entamoeba invadens
TLTVP

SEQ ID NO: 2779990 - protein, 9 aa, Entamoeba invadens
TLTVPGRQH

SEQ ID NO: 2779991 - protein, 5 aa, Entamoeba invadens
TLTYE

SEQ ID NO: 2779992 - protein, 8 aa, Entamoeba invadens
TLTYGDYP

SEQ ID NO: 2779993 - protein, 17 aa, Entamoeba invadens
TLVGEKGASLSGGQKQR

SEQ ID NO: 2779994 - protein, 14 aa, Entamoeba invadens
TLVSSTNDVQCTSG

SEQ ID NO: 2779995 - protein, 4 aa, Entamoeba invadens
TLYS

SEQ ID NO: 2779996 - protein, 12 aa, Entamoeba invadens
TMAGSGNKLTEL

SEQ ID NO: 2779997 - protein, 4 aa, Entamoeba invadens
TMDS

SEQ ID NO: 2779998 - protein, 8 aa, Entamoeba invadens
TMHPNENY

SEQ ID NO: 2779999 - protein, 10 aa, Entamoeba invadens
TMISNEGGLA

SEQ ID NO: 2780000 - protein, 13 aa, Entamoeba invadens
TMKENSKLDVGEN

SEQ ID NO: 2780001 - protein, 15 aa, Entamoeba invadens
TMKKNEDKGLGTPVY

SEQ ID NO: 2780002 - protein, 14 aa, Entamoeba invadens
TMKNNEDKGLGTPV

SEQ ID NO: 2780003 - protein, 10 aa, Entamoeba invadens
TMKPERYSEW

SEQ ID NO: 2780004 - protein, 8 aa, Entamoeba invadens
TMKSNTRW

SEQ ID NO: 2780005 - protein, 20 aa, Entamoeba invadens
TMNEDNNVDLSKNPNLDTIS

SEQ ID NO: 2780006 - protein, 6 aa, Entamoeba invadens
TMPDNQ

SEQ ID NO: 2780007 - protein, 5 aa, Entamoeba invadens
TMPPA

SEQ ID NO: 2780008 - protein, 5 aa, Entamoeba invadens
TMPSE

SEQ ID NO: 2780009 - protein, 6 aa, Entamoeba invadens
TMQSTE

SEQ ID NO: 2780010 - protein, 7 aa, Entamoeba invadens
TMSEDEL

SEQ ID NO: 2780011 - protein, 9 aa, Entamoeba invadens
TMSENMTQM

SEQ ID NO: 2780012 - protein, 6 aa, Entamoeba invadens
TMSEQK

SEQ ID NO: 2780013 - protein, 16 aa, Entamoeba invadens
TMSQTWDTKALNSRLT

SEQ ID NO: 2780014 - protein, 8 aa, Entamoeba invadens
TMTNNGRI

SEQ ID NO: 2780015 - protein, 7 aa, Entamoeba invadens
TMTPAQE

SEQ ID NO: 2780016 - protein, 4 aa, Entamoeba invadens
TMTT

SEQ ID NO: 2780017 - protein, 16 aa, Entamoeba invadens
TNACGDGQYGTAGNCQ

SEQ ID NO: 2780018 - protein, 9 aa, Entamoeba invadens
TNAENSKCS

SEQ ID NO: 2780019 - protein, 5 aa, Entamoeba invadens
TNAEV

SEQ ID NO: 2780020 - protein, 10 aa, Entamoeba invadens
TNAGKAPENV

SEQ ID NO: 2780021 - protein, 5 aa, Entamoeba invadens
TNAKY

SEQ ID NO: 2780022 - protein, 4 aa, Entamoeba invadens
TNAL

SEQ ID NO: 2780023 - protein, 10 aa, Entamoeba invadens
TNAPTETGIS

SEQ ID NO: 2780024 - protein, 7 aa, Entamoeba invadens
TNAPYTV

SEQ ID NO: 2780025 - protein, 7 aa, Entamoeba invadens
TNASDTP

SEQ ID NO: 2780026 - protein, 7 aa, Entamoeba invadens
TNASGEY

SEQ ID NO: 2780027 - protein, 9 aa, Entamoeba invadens
TNATQKENF

SEQ ID NO: 2780028 - protein, 6 aa, Entamoeba invadens
TNAYLN

SEQ ID NO: 2780029 - protein, 9 aa, Entamoeba invadens
TNCATQDSN

SEQ ID NO: 2780030 - protein, 4 aa, Entamoeba invadens
TNCD

SEQ ID NO: 2780031 - protein, 10 aa, Entamoeba invadens
TNCDGSNGNC

SEQ ID NO: 2780032 - protein, 7 aa, Entamoeba invadens
TNCDKKT

SEQ ID NO: 2780033 - protein, 20 aa, Entamoeba invadens
TNCDSSCGNQCDGKDGHCTG

SEQ ID NO: 2780034 - protein, 5 aa, Entamoeba invadens
TNCET

SEQ ID NO: 2780035 - protein, 8 aa, Entamoeba invadens
TNCETCPT

SEQ ID NO: 2780036 - protein, 8 aa, Entamoeba invadens
TNCKPCSS

SEQ ID NO: 2780037 - protein, 11 aa, Entamoeba invadens
TNCKQENCDVN

SEQ ID NO: 2780038 - protein, 9 aa, Entamoeba invadens
TNCKTCNSK

SEQ ID NO: 2780039 - protein, 4 aa, Entamoeba invadens
TNCN

SEQ ID NO: 2780040 - protein, 15 aa, Entamoeba invadens
TNCSEKSEQSGCTKC

SEQ ID NO: 2780041 - protein, 18 aa, Entamoeba invadens
TNCSTEESLLSTTGNAQL

SEQ ID NO: 2780042 - protein, 4 aa, Entamoeba invadens
TNCT

SEQ ID NO: 2780043 - protein, 12 aa, Entamoeba invadens
TNCTNNKGTYCT

SEQ ID NO: 2780044 - protein, 5 aa, Entamoeba invadens
TNCTS

SEQ ID NO: 2780045 - protein, 7 aa, Entamoeba invadens
TNCTSCD

SEQ ID NO: 2780046 - protein, 10 aa, Entamoeba invadens
TNDADDCVKY

SEQ ID NO: 2780047 - protein, 6 aa, Entamoeba invadens
TNDAPI

SEQ ID NO: 2780048 - protein, 6 aa, Entamoeba invadens
TNDCSS

SEQ ID NO: 2780049 - protein, 5 aa, Entamoeba invadens
TNDFP

SEQ ID NO: 2780050 - protein, 15 aa, Entamoeba invadens
TNDGFSDSNTKKCVP

SEQ ID NO: 2780051 - protein, 8 aa, Entamoeba invadens
TNDNGTLC

SEQ ID NO: 2780052 - protein, 8 aa, Entamoeba invadens
TNDNTRSC

SEQ ID NO: 2780053 - protein, 8 aa, Entamoeba invadens
TNDPLNKI

SEQ ID NO: 2780054 - protein, 11 aa, Entamoeba invadens
TNDPPESSKCN

SEQ ID NO: 2780055 - protein, 9 aa, Entamoeba invadens
TNDQKDAFE

SEQ ID NO: 2780056 - protein, 16 aa, Entamoeba invadens
TNDQVDVKSDGSNAVT

SEQ ID NO: 2780057 - protein, 21 aa, Entamoeba invadens
TNDSTNSDTQKVSEIKGVSES

SEQ ID NO: 2780058 - protein, 6 aa, Entamoeba invadens
TNDTSM

SEQ ID NO: 2780059 - protein, 7 aa, Entamoeba invadens
TNECDKC

SEQ ID NO: 2780060 - protein, 13 aa, Entamoeba invadens
TNECKSKNGTYGC

SEQ ID NO: 2780061 - protein, 13 aa, Entamoeba invadens
TNECQKCDDNCNT

SEQ ID NO: 2780062 - protein, 14 aa, Entamoeba invadens
TNECQKCDDNCNTC

SEQ ID NO: 2780063 - protein, 4 aa, Entamoeba invadens
TNED

SEQ ID NO: 2780064 - protein, 7 aa, Entamoeba invadens
TNEDESI

SEQ ID NO: 2780065 - protein, 11 aa, Entamoeba invadens
TNEDQVVESDN

SEQ ID NO: 2780066 - protein, 4 aa, Entamoeba invadens
TNEE

SEQ ID NO: 2780067 - protein, 8 aa, Entamoeba invadens
TNEEEGQA

SEQ ID NO: 2780068 - protein, 6 aa, Entamoeba invadens
TNEEER

SEQ ID NO: 2780069 - protein, 9 aa, Entamoeba invadens
TNEELDKSK

SEQ ID NO: 2780070 - protein, 5 aa, Entamoeba invadens
TNEEQ

SEQ ID NO: 2780071 - protein, 10 aa, Entamoeba invadens
TNEETEELKQ

SEQ ID NO: 2780072 - protein, 19 aa, Entamoeba invadens
TNEKCEGALYTTSNALKTN

SEQ ID NO: 2780073 - protein, 9 aa, Entamoeba invadens
TNEKGEDVD

SEQ ID NO: 2780074 - protein, 7 aa, Entamoeba invadens
TNEKQRV

SEQ ID NO: 2780075 - protein, 7 aa, Entamoeba invadens
TNEKRSA

SEQ ID NO: 2780076 - protein, 28 aa, Entamoeba invadens
TNEKTDKSTDLETSFSGGNESYEESQGF

SEQ ID NO: 2780077 - protein, 7 aa, Entamoeba invadens
TNEKVNA

SEQ ID NO: 2780078 - protein, 8 aa, Entamoeba invadens
TNEKVNAK

SEQ ID NO: 2780079 - protein, 15 aa, Entamoeba invadens
TNEKVNAKLTDFGSA

SEQ ID NO: 2780080 - protein, 4 aa, Entamoeba invadens
TNEM

SEQ ID NO: 2780081 - protein, 6 aa, Entamoeba invadens
TNEMED

SEQ ID NO: 2780082 - protein, 5 aa, Entamoeba invadens
TNENC

SEQ ID NO: 2780083 - protein, 6 aa, Entamoeba invadens
TNENTP

SEQ ID NO: 2780084 - protein, 15 aa, Entamoeba invadens
TNEPCTFNDDKSKAL

SEQ ID NO: 2780085 - protein, 5 aa, Entamoeba invadens
TNEQQ

SEQ ID NO: 2780086 - protein, 7 aa, Entamoeba invadens
TNEQSIP

SEQ ID NO: 2780087 - protein, 5 aa, Entamoeba invadens
TNERI

SEQ ID NO: 2780088 - protein, 4 aa, Entamoeba invadens
TNES

SEQ ID NO: 2780089 - protein, 11 aa, Entamoeba invadens
TNESANVGPSP

SEQ ID NO: 2780090 - protein, 8 aa, Entamoeba invadens
TNESAPRH

SEQ ID NO: 2780091 - protein, 14 aa, Entamoeba invadens
TNESGEITNCGASK

SEQ ID NO: 2780092 - protein, 5 aa, Entamoeba invadens
TNESS

SEQ ID NO: 2780093 - protein, 7 aa, Entamoeba invadens
TNESTKY

SEQ ID NO: 2780094 - protein, 4 aa, Entamoeba invadens
TNEY

SEQ ID NO: 2780095 - protein, 7 aa, Entamoeba invadens
TNEYQRC

SEQ ID NO: 2780096 - protein, 5 aa, Entamoeba invadens
TNFRT

SEQ ID NO: 2780097 - protein, 6 aa, Entamoeba invadens
TNFSRN

SEQ ID NO: 2780098 - protein, 4 aa, Entamoeba invadens
TNGA

SEQ ID NO: 2780099 - protein, 16 aa, Entamoeba invadens
TNGCASCDKTTGQCTN

SEQ ID NO: 2780100 - protein, 5 aa, Entamoeba invadens
TNGCL

SEQ ID NO: 2780101 - protein, 10 aa, Entamoeba invadens
TNGCTQCEDG

SEQ ID NO: 2780102 - protein, 4 aa, Entamoeba invadens
TNGD

SEQ ID NO: 2780103 - protein, 9 aa, Entamoeba invadens
TNGDTWSSE

SEQ ID NO: 2780104 - protein, 5 aa, Entamoeba invadens
TNGEC

SEQ ID NO: 2780105 - protein, 11 aa, Entamoeba invadens
TNGEPVETNNV

SEQ ID NO: 2780106 - protein, 9 aa, Entamoeba invadens
TNGESITTF

SEQ ID NO: 2780107 - protein, 10 aa, Entamoeba invadens
TNGESITTFD

SEQ ID NO: 2780108 - protein, 4 aa, Entamoeba invadens
TNGG

SEQ ID NO: 2780109 - protein, 5 aa, Entamoeba invadens
TNGGF

SEQ ID NO: 2780110 - protein, 6 aa, Entamoeba invadens
TNGGYY

SEQ ID NO: 2780111 - protein, 6 aa, Entamoeba invadens
TNGKCK

SEQ ID NO: 2780112 - protein, 7 aa, Entamoeba invadens
TNGKGVN

SEQ ID NO: 2780113 - protein, 11 aa, Entamoeba invadens
TNGKRKEIKKD

SEQ ID NO: 2780114 - protein, 10 aa, Entamoeba invadens
TNGKSELPMN

SEQ ID NO: 2780115 - protein, 9 aa, Entamoeba invadens
TNGKSTPDI

SEQ ID NO: 2780116 - protein, 8 aa, Entamoeba invadens
TNGLEEDH

SEQ ID NO: 2780117 - protein, 19 aa, Entamoeba invadens
TNGNCKTCKPGYAYYPSTG

SEQ ID NO: 2780118 - protein, 8 aa, Entamoeba invadens
TNGNCSIE

SEQ ID NO: 2780119 - protein, 6 aa, Entamoeba invadens
TNGNCT

SEQ ID NO: 2780120 - protein, 9 aa, Entamoeba invadens
TNGNEKQEC

SEQ ID NO: 2780121 - protein, 8 aa, Entamoeba invadens
TNGNGTLC

SEQ ID NO: 2780122 - protein, 11 aa, Entamoeba invadens
TNGNRLKKPLD

SEQ ID NO: 2780123 - protein, 6 aa, Entamoeba invadens
TNGNSQ

SEQ ID NO: 2780124 - protein, 9 aa, Entamoeba invadens
TNGPKAKKY

SEQ ID NO: 2780125 - protein, 10 aa, Entamoeba invadens
TNGRCSSCGE

SEQ ID NO: 2780126 - protein, 9 aa, Entamoeba invadens
TNGSLQGLS

SEQ ID NO: 2780127 - protein, 6 aa, Entamoeba invadens
TNGSNV

SEQ ID NO: 2780128 - protein, 5 aa, Entamoeba invadens
TNGSY

SEQ ID NO: 2780129 - protein, 10 aa, Entamoeba invadens
TNGTNEKKIG

SEQ ID NO: 2780130 - protein, 4 aa, Entamoeba invadens
TNGV

SEQ ID NO: 2780131 - protein, 7 aa, Entamoeba invadens
TNGVDTC

SEQ ID NO: 2780132 - protein, 19 aa, Entamoeba invadens
TNGVNRTATYQLNGGGEVT

SEQ ID NO: 2780133 - protein, 6 aa, Entamoeba invadens
TNHNKF

SEQ ID NO: 2780134 - protein, 13 aa, Entamoeba invadens
TNIANAGDETQTI

SEQ ID NO: 2780135 - protein, 5 aa, Entamoeba invadens
TNIDE

SEQ ID NO: 2780136 - protein, 32 aa, Entamoeba invadens
TNINDKSCKNCTEQNKGCLDANPDCGTCTTCG

SEQ ID NO: 2780137 - protein, 7 aa, Entamoeba invadens
TNIPTNT

SEQ ID NO: 2780138 - protein, 5 aa, Entamoeba invadens
TNISN

SEQ ID NO: 2780139 - protein, 4 aa, Entamoeba invadens
TNIY

SEQ ID NO: 2780140 - protein, 10 aa, Entamoeba invadens
TNKCATCSSQ

SEQ ID NO: 2780141 - protein, 9 aa, Entamoeba invadens
TNKCDTVQG

SEQ ID NO: 2780142 - protein, 12 aa, Entamoeba invadens
TNKDDAKYKAFG

SEQ ID NO: 2780143 - protein, 7 aa, Entamoeba invadens
TNKDEDF

SEQ ID NO: 2780144 - protein, 4 aa, Entamoeba invadens
TNKK

SEQ ID NO: 2780145 - protein, 8 aa, Entamoeba invadens
TNKKRKDL

SEQ ID NO: 2780146 - protein, 14 aa, Entamoeba invadens
TNKLSEDKKTCYAT

SEQ ID NO: 2780147 - protein, 6 aa, Entamoeba invadens
TNKNSK

SEQ ID NO: 2780148 - protein, 8 aa, Entamoeba invadens
TNKPTKCV

SEQ ID NO: 2780149 - protein, 7 aa, Entamoeba invadens
TNKQSAW

SEQ ID NO: 2780150 - protein, 19 aa, Entamoeba invadens
TNKQSPRSQFSNNKFSEGI

SEQ ID NO: 2780151 - protein, 6 aa, Entamoeba invadens
TNKRQV

SEQ ID NO: 2780152 - protein, 9 aa, Entamoeba invadens
TNKSSMKMT

SEQ ID NO: 2780153 - protein, 8 aa, Entamoeba invadens
TNKTEDWD

SEQ ID NO: 2780154 - protein, 9 aa, Entamoeba invadens
TNKTQRNDF

SEQ ID NO: 2780155 - protein, 6 aa, Entamoeba invadens
TNKTRA

SEQ ID NO: 2780156 - protein, 12 aa, Entamoeba invadens
TNLDGKKKVPYA

SEQ ID NO: 2780157 - protein, 8 aa, Entamoeba invadens
TNLNESQY

SEQ ID NO: 2780158 - protein, 11 aa, Entamoeba invadens
TNLNKENYKNN

SEQ ID NO: 2780159 - protein, 5 aa, Entamoeba invadens
TNLNL

SEQ ID NO: 2780160 - protein, 5 aa, Entamoeba invadens
TNLPR

SEQ ID NO: 2780161 - protein, 45 aa, Entamoeba invadens
TNLSGRRPSLSPRGNTQRRPSFNNKTKTDRNETKNYSKNEQGEDT

SEQ ID NO: 2780162 - protein, 7 aa, Entamoeba invadens
TNLSNTE

SEQ ID NO: 2780163 - protein, 4 aa, Entamoeba invadens
TNLT

SEQ ID NO: 2780164 - protein, 5 aa, Entamoeba invadens
TNLTE

SEQ ID NO: 2780165 - protein, 8 aa, Entamoeba invadens
TNMNNDNN

SEQ ID NO: 2780166 - protein, 6 aa, Entamoeba invadens
TNMPDG

SEQ ID NO: 2780167 - protein, 5 aa, Entamoeba invadens
TNMPN

SEQ ID NO: 2780168 - protein, 6 aa, Entamoeba invadens
TNMPNG

SEQ ID NO: 2780169 - protein, 11 aa, Entamoeba invadens
TNMYPSPDTGK

SEQ ID NO: 2780170 - protein, 4 aa, Entamoeba invadens
TNNA

SEQ ID NO: 2780171 - protein, 9 aa, Entamoeba invadens
TNNASNNLK

SEQ ID NO: 2780172 - protein, 8 aa, Entamoeba invadens
TNNCGDDG

SEQ ID NO: 2780173 - protein, 11 aa, Entamoeba invadens
TNNCNAPSTIS

SEQ ID NO: 2780174 - protein, 12 aa, Entamoeba invadens
TNNCNAPSTVSK

SEQ ID NO: 2780175 - protein, 16 aa, Entamoeba invadens
TNNDSKDVQQQTTSSD

SEQ ID NO: 2780176 - protein, 6 aa, Entamoeba invadens
TNNEAK

SEQ ID NO: 2780177 - protein, 7 aa, Entamoeba invadens
TNNENST

SEQ ID NO: 2780178 - protein, 8 aa, Entamoeba invadens
TNNENSTI

SEQ ID NO: 2780179 - protein, 7 aa, Entamoeba invadens
TNNEPKL

SEQ ID NO: 2780180 - protein, 8 aa, Entamoeba invadens
TNNGDCLP

SEQ ID NO: 2780181 - protein, 9 aa, Entamoeba invadens
TNNGDDFKA

SEQ ID NO: 2780182 - protein, 26 aa, Entamoeba invadens
TNNGYVNNNGTCVKSDINSEVTTNNN

SEQ ID NO: 2780183 - protein, 7 aa, Entamoeba invadens
TNNIRGG

SEQ ID NO: 2780184 - protein, 17 aa, Entamoeba invadens
TNNKDPVKTEMSGEAAA

SEQ ID NO: 2780185 - protein, 17 aa, Entamoeba invadens
TNNKKAMSKETRKSMDL

SEQ ID NO: 2780186 - protein, 5 aa, Entamoeba invadens
TNNKM

SEQ ID NO: 2780187 - protein, 6 aa, Entamoeba invadens
TNNKRV

SEQ ID NO: 2780188 - protein, 4 aa, Entamoeba invadens
TNNL

SEQ ID NO: 2780189 - protein, 17 aa, Entamoeba invadens
TNNMKSRSKCNGETNDG

SEQ ID NO: 2780190 - protein, 4 aa, Entamoeba invadens
TNNN

SEQ ID NO: 2780191 - protein, 6 aa, Entamoeba invadens
TNNNFD

SEQ ID NO: 2780192 - protein, 9 aa, Entamoeba invadens
TNNNPNDPD

SEQ ID NO: 2780193 - protein, 8 aa, Entamoeba invadens
TNNNTCST

SEQ ID NO: 2780194 - protein, 9 aa, Entamoeba invadens
TNNNTTTGC

SEQ ID NO: 2780195 - protein, 8 aa, Entamoeba invadens
TNNPKQPF

SEQ ID NO: 2780196 - protein, 4 aa, Entamoeba invadens
TNNQ

SEQ ID NO: 2780197 - protein, 5 aa, Entamoeba invadens
TNNQN

SEQ ID NO: 2780198 - protein, 6 aa, Entamoeba invadens
TNNRRE

SEQ ID NO: 2780199 - protein, 8 aa, Entamoeba invadens
TNNSCSSC

SEQ ID NO: 2780200 - protein, 8 aa, Entamoeba invadens
TNNSMTTK

SEQ ID NO: 2780201 - protein, 4 aa, Entamoeba invadens
TNNT

SEQ ID NO: 2780202 - protein, 6 aa, Entamoeba invadens
TNNTIE

SEQ ID NO: 2780203 - protein, 5 aa, Entamoeba invadens
TNNTK

SEQ ID NO: 2780204 - protein, 8 aa, Entamoeba invadens
TNNTTSMN

SEQ ID NO: 2780205 - protein, 6 aa, Entamoeba invadens
TNNTYY

SEQ ID NO: 2780206 - protein, 4 aa, Entamoeba invadens
TNNY

SEQ ID NO: 2780207 - protein, 11 aa, Entamoeba invadens
TNNYTNGSPYG

SEQ ID NO: 2780208 - protein, 9 aa, Entamoeba invadens
TNPADKTSC

SEQ ID NO: 2780209 - protein, 6 aa, Entamoeba invadens
TNPAFR

SEQ ID NO: 2780210 - protein, 7 aa, Entamoeba invadens
TNPANNC

SEQ ID NO: 2780211 - protein, 5 aa, Entamoeba invadens
TNPAP

SEQ ID NO: 2780212 - protein, 6 aa, Entamoeba invadens
TNPDFT

SEQ ID NO: 2780213 - protein, 8 aa, Entamoeba invadens
TNPDGKTT

SEQ ID NO: 2780214 - protein, 10 aa, Entamoeba invadens
TNPDNNTSCK

SEQ ID NO: 2780215 - protein, 7 aa, Entamoeba invadens
TNPELNK

SEQ ID NO: 2780216 - protein, 5 aa, Entamoeba invadens
TNPER

SEQ ID NO: 2780217 - protein, 5 aa, Entamoeba invadens
TNPIN

SEQ ID NO: 2780218 - protein, 4 aa, Entamoeba invadens
TNPK

SEQ ID NO: 2780219 - protein, 8 aa, Entamoeba invadens
TNPKDKLS

SEQ ID NO: 2780220 - protein, 7 aa, Entamoeba invadens
TNPKSRL

SEQ ID NO: 2780221 - protein, 4 aa, Entamoeba invadens
TNPL

SEQ ID NO: 2780222 - protein, 8 aa, Entamoeba invadens
TNPNDRTS

SEQ ID NO: 2780223 - protein, 7 aa, Entamoeba invadens
TNPNELP

SEQ ID NO: 2780224 - protein, 6 aa, Entamoeba invadens
TNPPLT

SEQ ID NO: 2780225 - protein, 7 aa, Entamoeba invadens
TNPPSKT

SEQ ID NO: 2780226 - protein, 7 aa, Entamoeba invadens
TNPPSNT

SEQ ID NO: 2780227 - protein, 12 aa, Entamoeba invadens
TNPSFTSKGSPI

SEQ ID NO: 2780228 - protein, 15 aa, Entamoeba invadens
TNPSPSGHLKGEGLR

SEQ ID NO: 2780229 - protein, 4 aa, Entamoeba invadens
TNPT

SEQ ID NO: 2780230 - protein, 8 aa, Entamoeba invadens
TNPTGNSN

SEQ ID NO: 2780231 - protein, 5 aa, Entamoeba invadens
TNPTM

SEQ ID NO: 2780232 - protein, 9 aa, Entamoeba invadens
TNPTTPQEL

SEQ ID NO: 2780233 - protein, 11 aa, Entamoeba invadens
TNPTYAPLKDK

SEQ ID NO: 2780234 - protein, 8 aa, Entamoeba invadens
TNPVRYEP

SEQ ID NO: 2780235 - protein, 8 aa, Entamoeba invadens
TNQATSKI

SEQ ID NO: 2780236 - protein, 10 aa, Entamoeba invadens
TNQCETKETY

SEQ ID NO: 2780237 - protein, 19 aa, Entamoeba invadens
TNQCETKETYNCQQSKSNK

SEQ ID NO: 2780238 - protein, 6 aa, Entamoeba invadens
TNQCVT

SEQ ID NO: 2780239 - protein, 14 aa, Entamoeba invadens
TNQCVTDDNCQTTK

SEQ ID NO: 2780240 - protein, 5 aa, Entamoeba invadens
TNQIS

SEQ ID NO: 2780241 - protein, 10 aa, Entamoeba invadens
TNQNEKVKPQ

SEQ ID NO: 2780242 - protein, 17 aa, Entamoeba invadens
TNQNNNETIKSVKSKSL

SEQ ID NO: 2780243 - protein, 9 aa, Entamoeba invadens
TNQRETTTL

SEQ ID NO: 2780244 - protein, 6 aa, Entamoeba invadens
TNQSNV

SEQ ID NO: 2780245 - protein, 18 aa, Entamoeba invadens
TNQSQKYRKQFEEHTQPK

SEQ ID NO: 2780246 - protein, 6 aa, Entamoeba invadens
TNQTLK

SEQ ID NO: 2780247 - protein, 12 aa, Entamoeba invadens
TNQYTLNNDSSI

SEQ ID NO: 2780248 - protein, 4 aa, Entamoeba invadens
TNRE

SEQ ID NO: 2780249 - protein, 5 aa, Entamoeba invadens
TNREA

SEQ ID NO: 2780250 - protein, 4 aa, Entamoeba invadens
TNRI

SEQ ID NO: 2780251 - protein, 19 aa, Entamoeba invadens
TNRTSIEVSSKQLQNLFDS

SEQ ID NO: 2780252 - protein, 5 aa, Entamoeba invadens
TNSAN

SEQ ID NO: 2780253 - protein, 11 aa, Entamoeba invadens
TNSAREQNSDC

SEQ ID NO: 2780254 - protein, 22 aa, Entamoeba invadens
TNSDESEPFLEGTTSSNFPTST

SEQ ID NO: 2780255 - protein, 4 aa, Entamoeba invadens
TNSE

SEQ ID NO: 2780256 - protein, 5 aa, Entamoeba invadens
TNSES

SEQ ID NO: 2780257 - protein, 16 aa, Entamoeba invadens
TNSESCKAKDQNTVTV

SEQ ID NO: 2780258 - protein, 5 aa, Entamoeba invadens
TNSEY

SEQ ID NO: 2780259 - protein, 12 aa, Entamoeba invadens
TNSFEKSQKLKT

SEQ ID NO: 2780260 - protein, 5 aa, Entamoeba invadens
TNSHL

SEQ ID NO: 2780261 - protein, 9 aa, Entamoeba invadens
TNSIDTKAD

SEQ ID NO: 2780262 - protein, 13 aa, Entamoeba invadens
TNSIENCKQNTQM

SEQ ID NO: 2780263 - protein, 10 aa, Entamoeba invadens
TNSKKDEYTN

SEQ ID NO: 2780264 - protein, 6 aa, Entamoeba invadens
TNSKQV

SEQ ID NO: 2780265 - protein, 12 aa, Entamoeba invadens
TNSKRDAKSGNC

SEQ ID NO: 2780266 - protein, 6 aa, Entamoeba invadens
TNSKSG

SEQ ID NO: 2780267 - protein, 8 aa, Entamoeba invadens
TNSKSSKC

SEQ ID NO: 2780268 - protein, 8 aa, Entamoeba invadens
TNSNETKF

SEQ ID NO: 2780269 - protein, 6 aa, Entamoeba invadens
TNSNTG

SEQ ID NO: 2780270 - protein, 4 aa, Entamoeba invadens
TNSP

SEQ ID NO: 2780271 - protein, 7 aa, Entamoeba invadens
TNSPIKE

SEQ ID NO: 2780272 - protein, 5 aa, Entamoeba invadens
TNSPK

SEQ ID NO: 2780273 - protein, 6 aa, Entamoeba invadens
TNSPKY

SEQ ID NO: 2780274 - protein, 9 aa, Entamoeba invadens
TNSPNEHAS

SEQ ID NO: 2780275 - protein, 6 aa, Entamoeba invadens
TNSQPD

SEQ ID NO: 2780276 - protein, 10 aa, Entamoeba invadens
TNSQRSDVTA

SEQ ID NO: 2780277 - protein, 7 aa, Entamoeba invadens
TNSRLNR

SEQ ID NO: 2780278 - protein, 5 aa, Entamoeba invadens
TNSTA

SEQ ID NO: 2780279 - protein, 9 aa, Entamoeba invadens
TNSTCQSNE

SEQ ID NO: 2780280 - protein, 6 aa, Entamoeba invadens
TNSTIN

SEQ ID NO: 2780281 - protein, 26 aa, Entamoeba invadens
TNSTNNKNSLLNEKNTIQNTIQRSDN

SEQ ID NO: 2780282 - protein, 7 aa, Entamoeba invadens
TNSTPKL

SEQ ID NO: 2780283 - protein, 7 aa, Entamoeba invadens
TNSTRTC

SEQ ID NO: 2780284 - protein, 6 aa, Entamoeba invadens
TNSTSL

SEQ ID NO: 2780285 - protein, 8 aa, Entamoeba invadens
TNSTYNAP

SEQ ID NO: 2780286 - protein, 4 aa, Entamoeba invadens
TNSV

SEQ ID NO: 2780287 - protein, 6 aa, Entamoeba invadens
TNSVNS

SEQ ID NO: 2780288 - protein, 10 aa, Entamoeba invadens
TNSVPEYSVP

SEQ ID NO: 2780289 - protein, 5 aa, Entamoeba invadens
TNTAN

SEQ ID NO: 2780290 - protein, 6 aa, Entamoeba invadens
TNTANT

SEQ ID NO: 2780291 - protein, 6 aa, Entamoeba invadens
TNTARA

SEQ ID NO: 2780292 - protein, 37 aa, Entamoeba invadens
TNTCDNCPAGTFSKPSSMECTSCEENSYSQEKSETCT

SEQ ID NO: 2780293 - protein, 13 aa, Entamoeba invadens
TNTCEKSEDLTKK

SEQ ID NO: 2780294 - protein, 20 aa, Entamoeba invadens
TNTCEKSEDLTKKSTTKMTT

SEQ ID NO: 2780295 - protein, 4 aa, Entamoeba invadens
TNTD

SEQ ID NO: 2780296 - protein, 5 aa, Entamoeba invadens
TNTDL

SEQ ID NO: 2780297 - protein, 5 aa, Entamoeba invadens
TNTDM

SEQ ID NO: 2780298 - protein, 27 aa, Entamoeba invadens
TNTDMGNNTNSGKAQTEQEKPLFDLSF

SEQ ID NO: 2780299 - protein, 8 aa, Entamoeba invadens
TNTDNTSC

SEQ ID NO: 2780300 - protein, 9 aa, Entamoeba invadens
TNTDPTTSD

SEQ ID NO: 2780301 - protein, 6 aa, Entamoeba invadens
TNTDSP

SEQ ID NO: 2780302 - protein, 7 aa, Entamoeba invadens
TNTEENK

SEQ ID NO: 2780303 - protein, 6 aa, Entamoeba invadens
TNTENV

SEQ ID NO: 2780304 - protein, 5 aa, Entamoeba invadens
TNTEP

SEQ ID NO: 2780305 - protein, 6 aa, Entamoeba invadens
TNTGVH

SEQ ID NO: 2780306 - protein, 7 aa, Entamoeba invadens
TNTKGVV

SEQ ID NO: 2780307 - protein, 5 aa, Entamoeba invadens
TNTKL

SEQ ID NO: 2780308 - protein, 6 aa, Entamoeba invadens
TNTKSQ

SEQ ID NO: 2780309 - protein, 5 aa, Entamoeba invadens
TNTMG

SEQ ID NO: 2780310 - protein, 9 aa, Entamoeba invadens
TNTNEETIE

SEQ ID NO: 2780311 - protein, 5 aa, Entamoeba invadens
TNTNL

SEQ ID NO: 2780312 - protein, 5 aa, Entamoeba invadens
TNTNN

SEQ ID NO: 2780313 - protein, 9 aa, Entamoeba invadens
TNTNSKTLT

SEQ ID NO: 2780314 - protein, 4 aa, Entamoeba invadens
TNTP

SEQ ID NO: 2780315 - protein, 8 aa, Entamoeba invadens
TNTPITEA

SEQ ID NO: 2780316 - protein, 18 aa, Entamoeba invadens
TNTPKYTPSAGCKEPSDV

SEQ ID NO: 2780317 - protein, 18 aa, Entamoeba invadens
TNTPNSQQQNNTQLQTQV

SEQ ID NO: 2780318 - protein, 5 aa, Entamoeba invadens
TNTQE

SEQ ID NO: 2780319 - protein, 4 aa, Entamoeba invadens
TNTS

SEQ ID NO: 2780320 - protein, 5 aa, Entamoeba invadens
TNTSI

SEQ ID NO: 2780321 - protein, 8 aa, Entamoeba invadens
TNTSMSQQ

SEQ ID NO: 2780322 - protein, 8 aa, Entamoeba invadens
TNTSPEPI

SEQ ID NO: 2780323 - protein, 10 aa, Entamoeba invadens
TNTSTSLVAE

SEQ ID NO: 2780324 - protein, 4 aa, Entamoeba invadens
TNTT

SEQ ID NO: 2780325 - protein, 6 aa, Entamoeba invadens
TNTTEK

SEQ ID NO: 2780326 - protein, 14 aa, Entamoeba invadens
TNTTGGAVNVADGN

SEQ ID NO: 2780327 - protein, 11 aa, Entamoeba invadens
TNTTKNTDSTK

SEQ ID NO: 2780328 - protein, 10 aa, Entamoeba invadens
TNTTTSGCTQ

SEQ ID NO: 2780329 - protein, 4 aa, Entamoeba invadens
TNTY

SEQ ID NO: 2780330 - protein, 5 aa, Entamoeba invadens
TNTYI

SEQ ID NO: 2780331 - protein, 8 aa, Entamoeba invadens
TNTYSSNG

SEQ ID NO: 2780332 - protein, 5 aa, Entamoeba invadens
TNVEE

SEQ ID NO: 2780333 - protein, 7 aa, Entamoeba invadens
TNVEPSK

SEQ ID NO: 2780334 - protein, 6 aa, Entamoeba invadens
TNVNLK

SEQ ID NO: 2780335 - protein, 21 aa, Entamoeba invadens
TNVPCNSPDNSGSSKSSLRTS

SEQ ID NO: 2780336 - protein, 8 aa, Entamoeba invadens
TNVQSANY

SEQ ID NO: 2780337 - protein, 7 aa, Entamoeba invadens
TNVSQNK

SEQ ID NO: 2780338 - protein, 13 aa, Entamoeba invadens
TNVSTSETFATDK

SEQ ID NO: 2780339 - protein, 5 aa, Entamoeba invadens
TNVVK

SEQ ID NO: 2780340 - protein, 4 aa, Entamoeba invadens
TNVY

SEQ ID NO: 2780341 - protein, 31 aa, Entamoeba invadens
TNYEITESGSCESTTCKNNEETEQNGRCSVT

SEQ ID NO: 2780342 - protein, 32 aa, Entamoeba invadens
TNYEITESGSCESTTCKNNEETEQNGRCSVTQ

SEQ ID NO: 2780343 - protein, 9 aa, Entamoeba invadens
TNYETKTPI

SEQ ID NO: 2780344 - protein, 7 aa, Entamoeba invadens
TNYHNEY

SEQ ID NO: 2780345 - protein, 15 aa, Entamoeba invadens
TNYKTANNECKPQSD

SEQ ID NO: 2780346 - protein, 18 aa, Entamoeba invadens
TNYKTNSGECKPQSSIDG

SEQ ID NO: 2780347 - protein, 7 aa, Entamoeba invadens
TNYKTSF

SEQ ID NO: 2780348 - protein, 12 aa, Entamoeba invadens
TNYKTSNGDCFP

SEQ ID NO: 2780349 - protein, 15 aa, Entamoeba invadens
TNYKTSNGDCLPRSS

SEQ ID NO: 2780350 - protein, 13 aa, Entamoeba invadens
TNYKTSSGDCLPQ

SEQ ID NO: 2780351 - protein, 12 aa, Entamoeba invadens
TNYKTTSGQCLP

SEQ ID NO: 2780352 - protein, 5 aa, Entamoeba invadens
TNYMK

SEQ ID NO: 2780353 - protein, 6 aa, Entamoeba invadens
TNYNVA

SEQ ID NO: 2780354 - protein, 11 aa, Entamoeba invadens
TNYPSEKTLND

SEQ ID NO: 2780355 - protein, 13 aa, Entamoeba invadens
TNYRTISGDCAPR

SEQ ID NO: 2780356 - protein, 8 aa, Entamoeba invadens
TNYRTVTQ

SEQ ID NO: 2780357 - protein, 5 aa, Entamoeba invadens
TNYSK

SEQ ID NO: 2780358 - protein, 10 aa, Entamoeba invadens
TNYSSGNTTK

SEQ ID NO: 2780359 - protein, 6 aa, Entamoeba invadens
TNYTIE

SEQ ID NO: 2780360 - protein, 8 aa, Entamoeba invadens
TNYTNQEI

SEQ ID NO: 2780361 - protein, 17 aa, Entamoeba invadens
TNYYNQPDTPYTCEEDC

SEQ ID NO: 2780362 - protein, 5 aa, Entamoeba invadens
TNYYP

SEQ ID NO: 2780363 - protein, 11 aa, Entamoeba invadens
TNYYPDTSTDF

SEQ ID NO: 2780364 - protein, 26 aa, Entamoeba invadens
TNYYTQPDTPHTCERDCPDAYYKGDG

SEQ ID NO: 2780365 - protein, 8 aa, Entamoeba invadens
TPAEGQES

SEQ ID NO: 2780366 - protein, 5 aa, Entamoeba invadens
TPAIP

SEQ ID NO: 2780367 - protein, 4 aa, Entamoeba invadens
TPAP

SEQ ID NO: 2780368 - protein, 8 aa, Entamoeba invadens
TPAPQTTD

SEQ ID NO: 2780369 - protein, 15 aa, Entamoeba invadens
TPARDPYGTYSATSQ

SEQ ID NO: 2780370 - protein, 8 aa, Entamoeba invadens
TPASGDAY

SEQ ID NO: 2780371 - protein, 22 aa, Entamoeba invadens
TPATPEVPPSSGKMAESPKCKD

SEQ ID NO: 2780372 - protein, 6 aa, Entamoeba invadens
TPAYQS

SEQ ID NO: 2780373 - protein, 5 aa, Entamoeba invadens
TPCGD

SEQ ID NO: 2780374 - protein, 5 aa, Entamoeba invadens
TPCPS

SEQ ID NO: 2780375 - protein, 4 aa, Entamoeba invadens
TPCS

SEQ ID NO: 2780376 - protein, 4 aa, Entamoeba invadens
TPCT

SEQ ID NO: 2780377 - protein, 9 aa, Entamoeba invadens
TPDETIDDD

SEQ ID NO: 2780378 - protein, 13 aa, Entamoeba invadens
TPDGSQTTNEYTI

SEQ ID NO: 2780379 - protein, 5 aa, Entamoeba invadens
TPDNC

SEQ ID NO: 2780380 - protein, 7 aa, Entamoeba invadens
TPDPDEL

SEQ ID NO: 2780381 - protein, 21 aa, Entamoeba invadens
TPDPDLLSRKNQKPEEKGSVS

SEQ ID NO: 2780382 - protein, 6 aa, Entamoeba invadens
TPDPNN

SEQ ID NO: 2780383 - protein, 21 aa, Entamoeba invadens
TPDPTEVTQCSTTDEYKGSLS

SEQ ID NO: 2780384 - protein, 8 aa, Entamoeba invadens
TPDQFEEG

SEQ ID NO: 2780385 - protein, 6 aa, Entamoeba invadens
TPDSCS

SEQ ID NO: 2780386 - protein, 8 aa, Entamoeba invadens
TPDSREKA

SEQ ID NO: 2780387 - protein, 5 aa, Entamoeba invadens
TPDTT

SEQ ID NO: 2780388 - protein, 17 aa, Entamoeba invadens
TPDVAPAAKMAGEVTPK

SEQ ID NO: 2780389 - protein, 5 aa, Entamoeba invadens
TPDYS

SEQ ID NO: 2780390 - protein, 7 aa, Entamoeba invadens
TPEDRKR

SEQ ID NO: 2780391 - protein, 6 aa, Entamoeba invadens
TPEKTC

SEQ ID NO: 2780392 - protein, 7 aa, Entamoeba invadens
TPENAPR

SEQ ID NO: 2780393 - protein, 10 aa, Entamoeba invadens
TPENKNEEVC

SEQ ID NO: 2780394 - protein, 4 aa, Entamoeba invadens
TPER

SEQ ID NO: 2780395 - protein, 4 aa, Entamoeba invadens
TPES

SEQ ID NO: 2780396 - protein, 7 aa, Entamoeba invadens
TPESIQK

SEQ ID NO: 2780397 - protein, 5 aa, Entamoeba invadens
TPETL

SEQ ID NO: 2780398 - protein, 6 aa, Entamoeba invadens
TPFETQ

SEQ ID NO: 2780399 - protein, 7 aa, Entamoeba invadens
TPFGPNS

SEQ ID NO: 2780400 - protein, 11 aa, Entamoeba invadens
TPFSPSNNQYG

SEQ ID NO: 2780401 - protein, 8 aa, Entamoeba invadens
TPGEIDGF

SEQ ID NO: 2780402 - protein, 14 aa, Entamoeba invadens
TPGISIPKSTKALR

SEQ ID NO: 2780403 - protein, 8 aa, Entamoeba invadens
TPGSRTVL

SEQ ID NO: 2780404 - protein, 11 aa, Entamoeba invadens
TPGYSTKDMPH

SEQ ID NO: 2780405 - protein, 8 aa, Entamoeba invadens
TPGYSTPT

SEQ ID NO: 2780406 - protein, 7 aa, Entamoeba invadens
TPHISDD

SEQ ID NO: 2780407 - protein, 7 aa, Entamoeba invadens
TPIDPEK

SEQ ID NO: 2780408 - protein, 5 aa, Entamoeba invadens
TPIES

SEQ ID NO: 2780409 - protein, 9 aa, Entamoeba invadens
TPIGKNSQC

SEQ ID NO: 2780410 - protein, 10 aa, Entamoeba invadens
TPINTETQLK

SEQ ID NO: 2780411 - protein, 4 aa, Entamoeba invadens
TPIQ

SEQ ID NO: 2780412 - protein, 7 aa, Entamoeba invadens
TPIQENE

SEQ ID NO: 2780413 - protein, 5 aa, Entamoeba invadens
TPIQR

SEQ ID NO: 2780414 - protein, 12 aa, Entamoeba invadens
TPIRTYDGNYHR

SEQ ID NO: 2780415 - protein, 13 aa, Entamoeba invadens
TPISDNNENITSD

SEQ ID NO: 2780416 - protein, 8 aa, Entamoeba invadens
TPIVGASQ

SEQ ID NO: 2780417 - protein, 7 aa, Entamoeba invadens
TPKADDV

SEQ ID NO: 2780418 - protein, 46 aa, Entamoeba invadens
TPKAQPTEAEENGKVKKSESPKAGKKEEKPVEQKTEAPKEGEKPKQ

SEQ ID NO: 2780419 - protein, 9 aa, Entamoeba invadens
TPKCPQTTV

SEQ ID NO: 2780420 - protein, 8 aa, Entamoeba invadens
TPKEDGGY

SEQ ID NO: 2780421 - protein, 8 aa, Entamoeba invadens
TPKEEGVM

SEQ ID NO: 2780422 - protein, 9 aa, Entamoeba invadens
TPKEKAEIT

SEQ ID NO: 2780423 - protein, 17 aa, Entamoeba invadens
TPKEKTKFQKYNDDAEK

SEQ ID NO: 2780424 - protein, 24 aa, Entamoeba invadens
TPKETSSAQEQKQQTPPPPTEHHD

SEQ ID NO: 2780425 - protein, 5 aa, Entamoeba invadens
TPKFQ

SEQ ID NO: 2780426 - protein, 8 aa, Entamoeba invadens
TPKPTYCG

SEQ ID NO: 2780427 - protein, 6 aa, Entamoeba invadens
TPKSYP

SEQ ID NO: 2780428 - protein, 5 aa, Entamoeba invadens
TPKTI

SEQ ID NO: 2780429 - protein, 4 aa, Entamoeba invadens
TPKV

SEQ ID NO: 2780430 - protein, 25 aa, Entamoeba invadens
TPKVATKSLTQTDDPDKTHKTGEHP

SEQ ID NO: 2780431 - protein, 4 aa, Entamoeba invadens
TPKY

SEQ ID NO: 2780432 - protein, 8 aa, Entamoeba invadens
TPKYAATG

SEQ ID NO: 2780433 - protein, 5 aa, Entamoeba invadens
TPKYR

SEQ ID NO: 2780434 - protein, 10 aa, Entamoeba invadens
TPLATNQIPN

SEQ ID NO: 2780435 - protein, 18 aa, Entamoeba invadens
TPLGNTNNTNFKGFGGFA

SEQ ID NO: 2780436 - protein, 7 aa, Entamoeba invadens
TPLNQPN

SEQ ID NO: 2780437 - protein, 25 aa, Entamoeba invadens
TPLSNAEKSEQLRDMEAQKSDQIDR

SEQ ID NO: 2780438 - protein, 14 aa, Entamoeba invadens
TPLTPESQPQKQQI

SEQ ID NO: 2780439 - protein, 8 aa, Entamoeba invadens
TPMDEEDV

SEQ ID NO: 2780440 - protein, 8 aa, Entamoeba invadens
TPNAEAPT

SEQ ID NO: 2780441 - protein, 5 aa, Entamoeba invadens
TPNEI

SEQ ID NO: 2780442 - protein, 5 aa, Entamoeba invadens
TPNNE

SEQ ID NO: 2780443 - protein, 9 aa, Entamoeba invadens
TPNPKKPTI

SEQ ID NO: 2780444 - protein, 5 aa, Entamoeba invadens
TPNPY

SEQ ID NO: 2780445 - protein, 21 aa, Entamoeba invadens
TPNQNPPKATTTQQQTTTQVD

SEQ ID NO: 2780446 - protein, 7 aa, Entamoeba invadens
TPNQPIE

SEQ ID NO: 2780447 - protein, 11 aa, Entamoeba invadens
TPNRRNPEGIY

SEQ ID NO: 2780448 - protein, 6 aa, Entamoeba invadens
TPNRTV

SEQ ID NO: 2780449 - protein, 12 aa, Entamoeba invadens
TPNSLKSKSYDT

SEQ ID NO: 2780450 - protein, 7 aa, Entamoeba invadens
TPNSPTM

SEQ ID NO: 2780451 - protein, 8 aa, Entamoeba invadens
TPNTERRC

SEQ ID NO: 2780452 - protein, 5 aa, Entamoeba invadens
TPNTT

SEQ ID NO: 2780453 - protein, 13 aa, Entamoeba invadens
TPNTVKDDGTEQC

SEQ ID NO: 2780454 - protein, 17 aa, Entamoeba invadens
TPNVSPAAKMAGEVTPK

SEQ ID NO: 2780455 - protein, 5 aa, Entamoeba invadens
TPNYM

SEQ ID NO: 2780456 - protein, 16 aa, Entamoeba invadens
TPPADLPDNLKNEIEQ

SEQ ID NO: 2780457 - protein, 18 aa, Entamoeba invadens
TPPDVTNGFETRRKNSAV

SEQ ID NO: 2780458 - protein, 6 aa, Entamoeba invadens
TPPDYY

SEQ ID NO: 2780459 - protein, 7 aa, Entamoeba invadens
TPPFTTT

SEQ ID NO: 2780460 - protein, 4 aa, Entamoeba invadens
TPPI

SEQ ID NO: 2780461 - protein, 14 aa, Entamoeba invadens
TPPINSHQKTNELE

SEQ ID NO: 2780462 - protein, 13 aa, Entamoeba invadens
TPPINSQHKTNEL

SEQ ID NO: 2780463 - protein, 7 aa, Entamoeba invadens
TPPNHND

SEQ ID NO: 2780464 - protein, 10 aa, Entamoeba invadens
TPPQYQQAPV

SEQ ID NO: 2780465 - protein, 6 aa, Entamoeba invadens
TPPTFY

SEQ ID NO: 2780466 - protein, 8 aa, Entamoeba invadens
TPPTSQAE

SEQ ID NO: 2780467 - protein, 4 aa, Entamoeba invadens
TPPY

SEQ ID NO: 2780468 - protein, 14 aa, Entamoeba invadens
TPQANDTDGGSKRI

SEQ ID NO: 2780469 - protein, 6 aa, Entamoeba invadens
TPQDRI

SEQ ID NO: 2780470 - protein, 4 aa, Entamoeba invadens
TPQE

SEQ ID NO: 2780471 - protein, 8 aa, Entamoeba invadens
TPQETEWP

SEQ ID NO: 2780472 - protein, 7 aa, Entamoeba invadens
TPQFSQG

SEQ ID NO: 2780473 - protein, 5 aa, Entamoeba invadens
TPQKH

SEQ ID NO: 2780474 - protein, 15 aa, Entamoeba invadens
TPQPKENESTEIPMT

SEQ ID NO: 2780475 - protein, 4 aa, Entamoeba invadens
TPQQ

SEQ ID NO: 2780476 - protein, 7 aa, Entamoeba invadens
TPQQPQQ

SEQ ID NO: 2780477 - protein, 5 aa, Entamoeba invadens
TPQTF

SEQ ID NO: 2780478 - protein, 7 aa, Entamoeba invadens
TPQYCDT

SEQ ID NO: 2780479 - protein, 4 aa, Entamoeba invadens
TPRA

SEQ ID NO: 2780480 - protein, 9 aa, Entamoeba invadens
TPRDRPPFD

SEQ ID NO: 2780481 - protein, 4 aa, Entamoeba invadens
TPRE

SEQ ID NO: 2780482 - protein, 6 aa, Entamoeba invadens
TPRNDY

SEQ ID NO: 2780483 - protein, 24 aa, Entamoeba invadens
TPRPTQREIPKSPQQEEVSSRNEM

SEQ ID NO: 2780484 - protein, 5 aa, Entamoeba invadens
TPRTE

SEQ ID NO: 2780485 - protein, 11 aa, Entamoeba invadens
TPSAGQSAGLN

SEQ ID NO: 2780486 - protein, 16 aa, Entamoeba invadens
TPSEFGCEENESQISL

SEQ ID NO: 2780487 - protein, 9 aa, Entamoeba invadens
TPSEMKNSR

SEQ ID NO: 2780488 - protein, 6 aa, Entamoeba invadens
TPSGAS

SEQ ID NO: 2780489 - protein, 7 aa, Entamoeba invadens
TPSGFPY

SEQ ID NO: 2780490 - protein, 10 aa, Entamoeba invadens
TPSGGEEEAK

SEQ ID NO: 2780491 - protein, 12 aa, Entamoeba invadens
TPSGSLDSNYSS

SEQ ID NO: 2780492 - protein, 6 aa, Entamoeba invadens
TPSIGS

SEQ ID NO: 2780493 - protein, 5 aa, Entamoeba invadens
TPSIK

SEQ ID NO: 2780494 - protein, 6 aa, Entamoeba invadens
TPSKKL

SEQ ID NO: 2780495 - protein, 8 aa, Entamoeba invadens
TPSKQEAL

SEQ ID NO: 2780496 - protein, 8 aa, Entamoeba invadens
TPSNGGIC

SEQ ID NO: 2780497 - protein, 4 aa, Entamoeba invadens
TPSQ

SEQ ID NO: 2780498 - protein, 7 aa, Entamoeba invadens
TPSQDVG

SEQ ID NO: 2780499 - protein, 9 aa, Entamoeba invadens
TPSQNGTSC

SEQ ID NO: 2780500 - protein, 7 aa, Entamoeba invadens
TPSQTSA

SEQ ID NO: 2780501 - protein, 7 aa, Entamoeba invadens
TPSTIGK

SEQ ID NO: 2780502 - protein, 4 aa, Entamoeba invadens
TPSY

SEQ ID NO: 2780503 - protein, 63 aa, Entamoeba invadens
TPTADTDETKLPLTTKESSEEKVTSETSQNSENNKSEHLENDLKEHKDKKEEKDEEEEEPEPL

SEQ ID NO: 2780504 - protein, 11 aa, Entamoeba invadens
TPTAGPISGGT

SEQ ID NO: 2780505 - protein, 66 aa, Entamoeba invadens
TPTAKRPLDSSSTSTPSNSFQTSKSAPTNQEELGKKSDITDFDDGSDWNSFDTQQPTSVKGAPKVK

SEQ ID NO: 2780506 - protein, 7 aa, Entamoeba invadens
TPTASRE

SEQ ID NO: 2780507 - protein, 6 aa, Entamoeba invadens
TPTGKL

SEQ ID NO: 2780508 - protein, 4 aa, Entamoeba invadens
TPTH

SEQ ID NO: 2780509 - protein, 12 aa, Entamoeba invadens
TPTNAPSGSFSS

SEQ ID NO: 2780510 - protein, 12 aa, Entamoeba invadens
TPTNDPNNKVEE

SEQ ID NO: 2780511 - protein, 18 aa, Entamoeba invadens
TPTNETTANCTQIPNGVY

SEQ ID NO: 2780512 - protein, 11 aa, Entamoeba invadens
TPTNTTGVQNT

SEQ ID NO: 2780513 - protein, 7 aa, Entamoeba invadens
TPTPKIS

SEQ ID NO: 2780514 - protein, 4 aa, Entamoeba invadens
TPTQ

SEQ ID NO: 2780515 - protein, 13 aa, Entamoeba invadens
TPTQSYTQSGCDG

SEQ ID NO: 2780516 - protein, 6 aa, Entamoeba invadens
TPTQTN

SEQ ID NO: 2780517 - protein, 7 aa, Entamoeba invadens
TPTQYSS

SEQ ID NO: 2780518 - protein, 17 aa, Entamoeba invadens
TPTRGINTEELDDVKVD

SEQ ID NO: 2780519 - protein, 4 aa, Entamoeba invadens
TPTT

SEQ ID NO: 2780520 - protein, 15 aa, Entamoeba invadens
TPTTPVVPPVSGKMA

SEQ ID NO: 2780521 - protein, 8 aa, Entamoeba invadens
TPTTTSDS

SEQ ID NO: 2780522 - protein, 5 aa, Entamoeba invadens
TPTVS

SEQ ID NO: 2780523 - protein, 10 aa, Entamoeba invadens
TPVDDNNKYH

SEQ ID NO: 2780524 - protein, 22 aa, Entamoeba invadens
TPVEDTKEKKAKYTIPPDNWPV

SEQ ID NO: 2780525 - protein, 6 aa, Entamoeba invadens
TPVNEK

SEQ ID NO: 2780526 - protein, 5 aa, Entamoeba invadens
TPVNN

SEQ ID NO: 2780527 - protein, 6 aa, Entamoeba invadens
TPVNVG

SEQ ID NO: 2780528 - protein, 11 aa, Entamoeba invadens
TPVQFKNDTKN

SEQ ID NO: 2780529 - protein, 6 aa, Entamoeba invadens
TPVTPA

SEQ ID NO: 2780530 - protein, 9 aa, Entamoeba invadens
TPVVSASQT

SEQ ID NO: 2780531 - protein, 9 aa, Entamoeba invadens
TPWNETKTV

SEQ ID NO: 2780532 - protein, 4 aa, Entamoeba invadens
TPWS

SEQ ID NO: 2780533 - protein, 12 aa, Entamoeba invadens
TPYADEKMEEGM

SEQ ID NO: 2780534 - protein, 11 aa, Entamoeba invadens
TPYDCTPENPH

SEQ ID NO: 2780535 - protein, 26 aa, Entamoeba invadens
TPYKSTSKSENIEDNTNCDVKTTKGC

SEQ ID NO: 2780536 - protein, 10 aa, Entamoeba invadens
TPYPTTPSLL

SEQ ID NO: 2780537 - protein, 4 aa, Entamoeba invadens
TPYS

SEQ ID NO: 2780538 - protein, 7 aa, Entamoeba invadens
TPYSGRK

SEQ ID NO: 2780539 - protein, 5 aa, Entamoeba invadens
TPYTK

SEQ ID NO: 2780540 - protein, 5 aa, Entamoeba invadens
TQADY

SEQ ID NO: 2780541 - protein, 7 aa, Entamoeba invadens
TQAENSQ

SEQ ID NO: 2780542 - protein, 5 aa, Entamoeba invadens
TQCAR

SEQ ID NO: 2780543 - protein, 8 aa, Entamoeba invadens
TQCNPKNK

SEQ ID NO: 2780544 - protein, 7 aa, Entamoeba invadens
TQCNPNN

SEQ ID NO: 2780545 - protein, 8 aa, Entamoeba invadens
TQCNSHNK

SEQ ID NO: 2780546 - protein, 13 aa, Entamoeba invadens
TQCNSPKAQYNRA

SEQ ID NO: 2780547 - protein, 5 aa, Entamoeba invadens
TQCPT

SEQ ID NO: 2780548 - protein, 11 aa, Entamoeba invadens
TQCSYSSSSDC

SEQ ID NO: 2780549 - protein, 10 aa, Entamoeba invadens
TQCVPKDGNC

SEQ ID NO: 2780550 - protein, 4 aa, Entamoeba invadens
TQDA

SEQ ID NO: 2780551 - protein, 5 aa, Entamoeba invadens
TQDDI

SEQ ID NO: 2780552 - protein, 9 aa, Entamoeba invadens
TQDDWDTPK

SEQ ID NO: 2780553 - protein, 9 aa, Entamoeba invadens
TQDEEDVSK

SEQ ID NO: 2780554 - protein, 7 aa, Entamoeba invadens
TQDPNNC

SEQ ID NO: 2780555 - protein, 14 aa, Entamoeba invadens
TQDSPPKCQPCSPN

SEQ ID NO: 2780556 - protein, 14 aa, Entamoeba invadens
TQEEADITTPQGKT

SEQ ID NO: 2780557 - protein, 6 aa, Entamoeba invadens
TQEEDL

SEQ ID NO: 2780558 - protein, 6 aa, Entamoeba invadens
TQEGDR

SEQ ID NO: 2780559 - protein, 7 aa, Entamoeba invadens
TQEHEEE

SEQ ID NO: 2780560 - protein, 11 aa, Entamoeba invadens
TQEKVGDGSTF

SEQ ID NO: 2780561 - protein, 7 aa, Entamoeba invadens
TQEKVNA

SEQ ID NO: 2780562 - protein, 5 aa, Entamoeba invadens
TQENR

SEQ ID NO: 2780563 - protein, 7 aa, Entamoeba invadens
TQEPNTD

SEQ ID NO: 2780564 - protein, 10 aa, Entamoeba invadens
TQEQKKKVES

SEQ ID NO: 2780565 - protein, 8 aa, Entamoeba invadens
TQESPESQ

SEQ ID NO: 2780566 - protein, 8 aa, Entamoeba invadens
TQESPPKC

SEQ ID NO: 2780567 - protein, 7 aa, Entamoeba invadens
TQETTKK

SEQ ID NO: 2780568 - protein, 14 aa, Entamoeba invadens
TQFDGSPNRLEGRN

SEQ ID NO: 2780569 - protein, 13 aa, Entamoeba invadens
TQFNKKKITSNIK

SEQ ID NO: 2780570 - protein, 23 aa, Entamoeba invadens
TQFPQNGNYPTQGYPIQPQNGIQ

SEQ ID NO: 2780571 - protein, 5 aa, Entamoeba invadens
TQGDL

SEQ ID NO: 2780572 - protein, 9 aa, Entamoeba invadens
TQGKGLNLQ

SEQ ID NO: 2780573 - protein, 7 aa, Entamoeba invadens
TQGKSVQ

SEQ ID NO: 2780574 - protein, 7 aa, Entamoeba invadens
TQGRKSQ

SEQ ID NO: 2780575 - protein, 6 aa, Entamoeba invadens
TQGTVE

SEQ ID NO: 2780576 - protein, 8 aa, Entamoeba invadens
TQGVGASG

SEQ ID NO: 2780577 - protein, 9 aa, Entamoeba invadens
TQHGNECEK

SEQ ID NO: 2780578 - protein, 8 aa, Entamoeba invadens
TQHNSTDQ

SEQ ID NO: 2780579 - protein, 6 aa, Entamoeba invadens
TQHNTD

SEQ ID NO: 2780580 - protein, 4 aa, Entamoeba invadens
TQHR

SEQ ID NO: 2780581 - protein, 9 aa, Entamoeba invadens
TQIAPPDKN

SEQ ID NO: 2780582 - protein, 5 aa, Entamoeba invadens
TQIGE

SEQ ID NO: 2780583 - protein, 5 aa, Entamoeba invadens
TQIKD

SEQ ID NO: 2780584 - protein, 15 aa, Entamoeba invadens
TQIKNGSSKTGIKSA

SEQ ID NO: 2780585 - protein, 7 aa, Entamoeba invadens
TQIPNDK

SEQ ID NO: 2780586 - protein, 5 aa, Entamoeba invadens
TQIPS

SEQ ID NO: 2780587 - protein, 15 aa, Entamoeba invadens
TQIQGVDGTVNTGKT

SEQ ID NO: 2780588 - protein, 19 aa, Entamoeba invadens
TQIQPPVPCGTAPPQCNRP

SEQ ID NO: 2780589 - protein, 21 aa, Entamoeba invadens
TQIQPTQPPMQPTPPTQIPYQ

SEQ ID NO: 2780590 - protein, 4 aa, Entamoeba invadens
TQIS

SEQ ID NO: 2780591 - protein, 5 aa, Entamoeba invadens
TQISK

SEQ ID NO: 2780592 - protein, 5 aa, Entamoeba invadens
TQIST

SEQ ID NO: 2780593 - protein, 7 aa, Entamoeba invadens
TQKCPEN

SEQ ID NO: 2780594 - protein, 8 aa, Entamoeba invadens
TQKEANAQ

SEQ ID NO: 2780595 - protein, 15 aa, Entamoeba invadens
TQKEKNQFQKYNDEC

SEQ ID NO: 2780596 - protein, 5 aa, Entamoeba invadens
TQKFA

SEQ ID NO: 2780597 - protein, 9 aa, Entamoeba invadens
TQKGCSKCE

SEQ ID NO: 2780598 - protein, 7 aa, Entamoeba invadens
TQKNFSD

SEQ ID NO: 2780599 - protein, 10 aa, Entamoeba invadens
TQKNNQNGDN

SEQ ID NO: 2780600 - protein, 11 aa, Entamoeba invadens
TQKQQTGSTQT

SEQ ID NO: 2780601 - protein, 4 aa, Entamoeba invadens
TQKR

SEQ ID NO: 2780602 - protein, 9 aa, Entamoeba invadens
TQKSKRVPA

SEQ ID NO: 2780603 - protein, 5 aa, Entamoeba invadens
TQKSQ

SEQ ID NO: 2780604 - protein, 5 aa, Entamoeba invadens
TQKSY

SEQ ID NO: 2780605 - protein, 9 aa, Entamoeba invadens
TQKTSTSEN

SEQ ID NO: 2780606 - protein, 15 aa, Entamoeba invadens
TQKVSGKLTDFGSSR

SEQ ID NO: 2780607 - protein, 5 aa, Entamoeba invadens
TQLDT

SEQ ID NO: 2780608 - protein, 5 aa, Entamoeba invadens
TQLEA

SEQ ID NO: 2780609 - protein, 12 aa, Entamoeba invadens
TQLETKTCTVNS

SEQ ID NO: 2780610 - protein, 4 aa, Entamoeba invadens
TQLP

SEQ ID NO: 2780611 - protein, 13 aa, Entamoeba invadens
TQLPGAAKEPNSF

SEQ ID NO: 2780612 - protein, 10 aa, Entamoeba invadens
TQLSSRLDPE

SEQ ID NO: 2780613 - protein, 18 aa, Entamoeba invadens
TQMETSTFNSQTVEGPPL

SEQ ID NO: 2780614 - protein, 7 aa, Entamoeba invadens
TQNANIQ

SEQ ID NO: 2780615 - protein, 8 aa, Entamoeba invadens
TQNAPNAH

SEQ ID NO: 2780616 - protein, 17 aa, Entamoeba invadens
TQNDDIENSATKASKIS

SEQ ID NO: 2780617 - protein, 8 aa, Entamoeba invadens
TQNDREKF

SEQ ID NO: 2780618 - protein, 4 aa, Entamoeba invadens
TQNE

SEQ ID NO: 2780619 - protein, 10 aa, Entamoeba invadens
TQNEATKCEP

SEQ ID NO: 2780620 - protein, 5 aa, Entamoeba invadens
TQNEY

SEQ ID NO: 2780621 - protein, 5 aa, Entamoeba invadens
TQNFT

SEQ ID NO: 2780622 - protein, 4 aa, Entamoeba invadens
TQNG

SEQ ID NO: 2780623 - protein, 6 aa, Entamoeba invadens
TQNGCS

SEQ ID NO: 2780624 - protein, 9 aa, Entamoeba invadens
TQNGCSKCE

SEQ ID NO: 2780625 - protein, 23 aa, Entamoeba invadens
TQNGCSKCQDGYYTSNTNECQKC

SEQ ID NO: 2780626 - protein, 10 aa, Entamoeba invadens
TQNGCSKCQG

SEQ ID NO: 2780627 - protein, 11 aa, Entamoeba invadens
TQNGCSKCSDS

SEQ ID NO: 2780628 - protein, 38 aa, Entamoeba invadens
TQNGFNPHKSISSSRGDPAGSNTTNSPRSVAEKTYISD

SEQ ID NO: 2780629 - protein, 9 aa, Entamoeba invadens
TQNPKERPT

SEQ ID NO: 2780630 - protein, 6 aa, Entamoeba invadens
TQNPKY

SEQ ID NO: 2780631 - protein, 10 aa, Entamoeba invadens
TQNPPQPDFD

SEQ ID NO: 2780632 - protein, 8 aa, Entamoeba invadens
TQNPTNSH

SEQ ID NO: 2780633 - protein, 13 aa, Entamoeba invadens
TQNRLGKVKGDSV

SEQ ID NO: 2780634 - protein, 5 aa, Entamoeba invadens
TQNSY

SEQ ID NO: 2780635 - protein, 7 aa, Entamoeba invadens
TQNTTKL

SEQ ID NO: 2780636 - protein, 7 aa, Entamoeba invadens
TQNTTTR

SEQ ID NO: 2780637 - protein, 13 aa, Entamoeba invadens
TQNTVKDDGTEQC

SEQ ID NO: 2780638 - protein, 14 aa, Entamoeba invadens
TQNTVKDDGTEQCV

SEQ ID NO: 2780639 - protein, 13 aa, Entamoeba invadens
TQNTVKDVGTEQC

SEQ ID NO: 2780640 - protein, 9 aa, Entamoeba invadens
TQNYASGDA

SEQ ID NO: 2780641 - protein, 6 aa, Entamoeba invadens
TQNYEE

SEQ ID NO: 2780642 - protein, 6 aa, Entamoeba invadens
TQNYSR

SEQ ID NO: 2780643 - protein, 8 aa, Entamoeba invadens
TQPANTNV

SEQ ID NO: 2780644 - protein, 9 aa, Entamoeba invadens
TQPASVSTS

SEQ ID NO: 2780645 - protein, 7 aa, Entamoeba invadens
TQPDTRT

SEQ ID NO: 2780646 - protein, 6 aa, Entamoeba invadens
TQPEKC

SEQ ID NO: 2780647 - protein, 9 aa, Entamoeba invadens
TQPHQLSKK

SEQ ID NO: 2780648 - protein, 15 aa, Entamoeba invadens
TQPIPPDQTPSSASK

SEQ ID NO: 2780649 - protein, 7 aa, Entamoeba invadens
TQPKNVE

SEQ ID NO: 2780650 - protein, 8 aa, Entamoeba invadens
TQPNYSYA

SEQ ID NO: 2780651 - protein, 4 aa, Entamoeba invadens
TQPP

SEQ ID NO: 2780652 - protein, 5 aa, Entamoeba invadens
TQPPG

SEQ ID NO: 2780653 - protein, 14 aa, Entamoeba invadens
TQPPSVPGSPYSSL

SEQ ID NO: 2780654 - protein, 6 aa, Entamoeba invadens
TQPQMQ

SEQ ID NO: 2780655 - protein, 9 aa, Entamoeba invadens
TQPQNNHQQ

SEQ ID NO: 2780656 - protein, 12 aa, Entamoeba invadens
TQQDTSCESCTT

SEQ ID NO: 2780657 - protein, 9 aa, Entamoeba invadens
TQQFQSTGE

SEQ ID NO: 2780658 - protein, 4 aa, Entamoeba invadens
TQQG

SEQ ID NO: 2780659 - protein, 7 aa, Entamoeba invadens
TQQGATN

SEQ ID NO: 2780660 - protein, 6 aa, Entamoeba invadens
TQQITH

SEQ ID NO: 2780661 - protein, 9 aa, Entamoeba invadens
TQQKKSIGS

SEQ ID NO: 2780662 - protein, 12 aa, Entamoeba invadens
TQQLTRSNTSGV

SEQ ID NO: 2780663 - protein, 10 aa, Entamoeba invadens
TQQNTKVESI

SEQ ID NO: 2780664 - protein, 16 aa, Entamoeba invadens
TQQSTRIDYDELTEMK

SEQ ID NO: 2780665 - protein, 4 aa, Entamoeba invadens
TQQT

SEQ ID NO: 2780666 - protein, 44 aa, Entamoeba invadens
TQQTESQLTEEHLGNKKETKDDDFVRNEKSPNDSNGSDDEITKM

SEQ ID NO: 2780667 - protein, 5 aa, Entamoeba invadens
TQQTL

SEQ ID NO: 2780668 - protein, 7 aa, Entamoeba invadens
TQQTTRI

SEQ ID NO: 2780669 - protein, 8 aa, Entamoeba invadens
TQQTTRID

SEQ ID NO: 2780670 - protein, 5 aa, Entamoeba invadens
TQQVI

SEQ ID NO: 2780671 - protein, 5 aa, Entamoeba invadens
TQREY

SEQ ID NO: 2780672 - protein, 4 aa, Entamoeba invadens
TQRG

SEQ ID NO: 2780673 - protein, 8 aa, Entamoeba invadens
TQRGDGEF

SEQ ID NO: 2780674 - protein, 5 aa, Entamoeba invadens
TQRGE

SEQ ID NO: 2780675 - protein, 7 aa, Entamoeba invadens
TQRITTP

SEQ ID NO: 2780676 - protein, 15 aa, Entamoeba invadens
TQRKHSTSKSDDLPI

SEQ ID NO: 2780677 - protein, 10 aa, Entamoeba invadens
TQRKSSNDAL

SEQ ID NO: 2780678 - protein, 8 aa, Entamoeba invadens
TQRKTVQT

SEQ ID NO: 2780679 - protein, 11 aa, Entamoeba invadens
TQRPSNVPQTI

SEQ ID NO: 2780680 - protein, 8 aa, Entamoeba invadens
TQRSEFGK

SEQ ID NO: 2780681 - protein, 5 aa, Entamoeba invadens
TQRSV

SEQ ID NO: 2780682 - protein, 4 aa, Entamoeba invadens
TQRY

SEQ ID NO: 2780683 - protein, 11 aa, Entamoeba invadens
TQSEKREEIGN

SEQ ID NO: 2780684 - protein, 11 aa, Entamoeba invadens
TQSEVNNTTNV

SEQ ID NO: 2780685 - protein, 5 aa, Entamoeba invadens
TQSEY

SEQ ID NO: 2780686 - protein, 5 aa, Entamoeba invadens
TQSGC

SEQ ID NO: 2780687 - protein, 14 aa, Entamoeba invadens
TQSGCSKCKDGYYT

SEQ ID NO: 2780688 - protein, 11 aa, Entamoeba invadens
TQSGCSKCQNG

SEQ ID NO: 2780689 - protein, 9 aa, Entamoeba invadens
TQSGCSRCQ

SEQ ID NO: 2780690 - protein, 5 aa, Entamoeba invadens
TQSKC

SEQ ID NO: 2780691 - protein, 5 aa, Entamoeba invadens
TQSKI

SEQ ID NO: 2780692 - protein, 4 aa, Entamoeba invadens
TQSL

SEQ ID NO: 2780693 - protein, 9 aa, Entamoeba invadens
TQSNHHEYS

SEQ ID NO: 2780694 - protein, 8 aa, Entamoeba invadens
TQSPSQLV

SEQ ID NO: 2780695 - protein, 13 aa, Entamoeba invadens
TQSSSEKYTIRTE

SEQ ID NO: 2780696 - protein, 8 aa, Entamoeba invadens
TQSSSPTL

SEQ ID NO: 2780697 - protein, 4 aa, Entamoeba invadens
TQST

SEQ ID NO: 2780698 - protein, 5 aa, Entamoeba invadens
TQSTA

SEQ ID NO: 2780699 - protein, 4 aa, Entamoeba invadens
TQSV

SEQ ID NO: 2780700 - protein, 5 aa, Entamoeba invadens
TQSVT

SEQ ID NO: 2780701 - protein, 13 aa, Entamoeba invadens
TQSYDTNKQNTWQ

SEQ ID NO: 2780702 - protein, 12 aa, Entamoeba invadens
TQTANDEKCGRC

SEQ ID NO: 2780703 - protein, 7 aa, Entamoeba invadens
TQTAPDD

SEQ ID NO: 2780704 - protein, 27 aa, Entamoeba invadens
TQTCGNGKLDHPEEQCDSGDSCNSTNC

SEQ ID NO: 2780705 - protein, 26 aa, Entamoeba invadens
TQTCGNGKLDHPEEQCDSGNSCNSTN

SEQ ID NO: 2780706 - protein, 4 aa, Entamoeba invadens
TQTD

SEQ ID NO: 2780707 - protein, 5 aa, Entamoeba invadens
TQTDK

SEQ ID NO: 2780708 - protein, 20 aa, Entamoeba invadens
TQTEQLKAGNEDESNGDNLK

SEQ ID NO: 2780709 - protein, 8 aa, Entamoeba invadens
TQTEQPHY

SEQ ID NO: 2780710 - protein, 7 aa, Entamoeba invadens
TQTETSR

SEQ ID NO: 2780711 - protein, 5 aa, Entamoeba invadens
TQTGC

SEQ ID NO: 2780712 - protein, 6 aa, Entamoeba invadens
TQTGTV

SEQ ID NO: 2780713 - protein, 10 aa, Entamoeba invadens
TQTKDVPCED

SEQ ID NO: 2780714 - protein, 17 aa, Entamoeba invadens
TQTKENSNYECAKNNRD

SEQ ID NO: 2780715 - protein, 6 aa, Entamoeba invadens
TQTKYD

SEQ ID NO: 2780716 - protein, 19 aa, Entamoeba invadens
TQTLSPEPKESDPQTFGEI

SEQ ID NO: 2780717 - protein, 14 aa, Entamoeba invadens
TQTLTNQKYQIESN

SEQ ID NO: 2780718 - protein, 4 aa, Entamoeba invadens
TQTN

SEQ ID NO: 2780719 - protein, 6 aa, Entamoeba invadens
TQTNPP

SEQ ID NO: 2780720 - protein, 6 aa, Entamoeba invadens
TQTNTS

SEQ ID NO: 2780721 - protein, 5 aa, Entamoeba invadens
TQTSI

SEQ ID NO: 2780722 - protein, 13 aa, Entamoeba invadens
TQTSSSSSSDDTF

SEQ ID NO: 2780723 - protein, 4 aa, Entamoeba invadens
TQTT

SEQ ID NO: 2780724 - protein, 9 aa, Entamoeba invadens
TQTTGNTDL

SEQ ID NO: 2780725 - protein, 6 aa, Entamoeba invadens
TQTTQT

SEQ ID NO: 2780726 - protein, 6 aa, Entamoeba invadens
TQVGNT

SEQ ID NO: 2780727 - protein, 9 aa, Entamoeba invadens
TQVKPNEVT

SEQ ID NO: 2780728 - protein, 16 aa, Entamoeba invadens
TQVPKDLYGAFGDAVP

SEQ ID NO: 2780729 - protein, 9 aa, Entamoeba invadens
TQVPQEPEI

SEQ ID NO: 2780730 - protein, 9 aa, Entamoeba invadens
TQVPREPEI

SEQ ID NO: 2780731 - protein, 14 aa, Entamoeba invadens
TQVSERKRDKDCNN

SEQ ID NO: 2780732 - protein, 7 aa, Entamoeba invadens
TQYETSM

SEQ ID NO: 2780733 - protein, 4 aa, Entamoeba invadens
TQYG

SEQ ID NO: 2780734 - protein, 12 aa, Entamoeba invadens
TQYIEESNNTLD

SEQ ID NO: 2780735 - protein, 6 aa, Entamoeba invadens
TQYNTD

SEQ ID NO: 2780736 - protein, 7 aa, Entamoeba invadens
TQYPELT

SEQ ID NO: 2780737 - protein, 6 aa, Entamoeba invadens
TQYSDG

SEQ ID NO: 2780738 - protein, 4 aa, Entamoeba invadens
TQYT

SEQ ID NO: 2780739 - protein, 5 aa, Entamoeba invadens
TQYTD

SEQ ID NO: 2780740 - protein, 11 aa, Entamoeba invadens
TQYVKNGGCAP

SEQ ID NO: 2780741 - protein, 11 aa, Entamoeba invadens
TRALSGKQSRY

SEQ ID NO: 2780742 - protein, 15 aa, Entamoeba invadens
TRAPEDTSIGDLDQR

SEQ ID NO: 2780743 - protein, 5 aa, Entamoeba invadens
TRAPH

SEQ ID NO: 2780744 - protein, 13 aa, Entamoeba invadens
TRAQGPDGKYKTD

SEQ ID NO: 2780745 - protein, 7 aa, Entamoeba invadens
TRAQNRD

SEQ ID NO: 2780746 - protein, 4 aa, Entamoeba invadens
TRCN

SEQ ID NO: 2780747 - protein, 7 aa, Entamoeba invadens
TRCNSAT

SEQ ID NO: 2780748 - protein, 4 aa, Entamoeba invadens
TRDD

SEQ ID NO: 2780749 - protein, 12 aa, Entamoeba invadens
TRDNKNATGSPI

SEQ ID NO: 2780750 - protein, 5 aa, Entamoeba invadens
TRDSL

SEQ ID NO: 2780751 - protein, 11 aa, Entamoeba invadens
TRDSTWTTTIQ

SEQ ID NO: 2780752 - protein, 6 aa, Entamoeba invadens
TREELM

SEQ ID NO: 2780753 - protein, 8 aa, Entamoeba invadens
TREIRGDA

SEQ ID NO: 2780754 - protein, 5 aa, Entamoeba invadens
TREMK

SEQ ID NO: 2780755 - protein, 4 aa, Entamoeba invadens
TRER

SEQ ID NO: 2780756 - protein, 9 aa, Entamoeba invadens
TRESERIEA

SEQ ID NO: 2780757 - protein, 11 aa, Entamoeba invadens
TREVDQQKPYT

SEQ ID NO: 2780758 - protein, 18 aa, Entamoeba invadens
TREVNETTFNETSNCGDG

SEQ ID NO: 2780759 - protein, 9 aa, Entamoeba invadens
TREYEQENV

SEQ ID NO: 2780760 - protein, 5 aa, Entamoeba invadens
TRFPE

SEQ ID NO: 2780761 - protein, 5 aa, Entamoeba invadens
TRGCT

SEQ ID NO: 2780762 - protein, 10 aa, Entamoeba invadens
TRGIGTPNYM

SEQ ID NO: 2780763 - protein, 14 aa, Entamoeba invadens
TRGLGNTLKTGVGQ

SEQ ID NO: 2780764 - protein, 6 aa, Entamoeba invadens
TRGNAE

SEQ ID NO: 2780765 - protein, 20 aa, Entamoeba invadens
TRGNHDSDGMLTGEETKNMA

SEQ ID NO: 2780766 - protein, 20 aa, Entamoeba invadens
TRGNSDPQKSGSSLSDSSNV

SEQ ID NO: 2780767 - protein, 11 aa, Entamoeba invadens
TRGSSEKDIRA

SEQ ID NO: 2780768 - protein, 7 aa, Entamoeba invadens
TRGSSSD

SEQ ID NO: 2780769 - protein, 6 aa, Entamoeba invadens
TRHPGM

SEQ ID NO: 2780770 - protein, 12 aa, Entamoeba invadens
TRHTKKMEKDTT

SEQ ID NO: 2780771 - protein, 6 aa, Entamoeba invadens
TRIGSS

SEQ ID NO: 2780772 - protein, 7 aa, Entamoeba invadens
TRIPGTL

SEQ ID NO: 2780773 - protein, 5 aa, Entamoeba invadens
TRKDV

SEQ ID NO: 2780774 - protein, 4 aa, Entamoeba invadens
TRKL

SEQ ID NO: 2780775 - protein, 5 aa, Entamoeba invadens
TRKNE

SEQ ID NO: 2780776 - protein, 13 aa, Entamoeba invadens
TRKPAPPKDEEEA

SEQ ID NO: 2780777 - protein, 13 aa, Entamoeba invadens
TRKPKKVVMHPKK

SEQ ID NO: 2780778 - protein, 6 aa, Entamoeba invadens
TRKRQE

SEQ ID NO: 2780779 - protein, 10 aa, Entamoeba invadens
TRKSTNRLSK

SEQ ID NO: 2780780 - protein, 9 aa, Entamoeba invadens
TRKTADVVQ

SEQ ID NO: 2780781 - protein, 5 aa, Entamoeba invadens
TRKTI

SEQ ID NO: 2780782 - protein, 6 aa, Entamoeba invadens
TRKTKL

SEQ ID NO: 2780783 - protein, 7 aa, Entamoeba invadens
TRKVPRE

SEQ ID NO: 2780784 - protein, 13 aa, Entamoeba invadens
TRLASDPTTLKGI

SEQ ID NO: 2780785 - protein, 5 aa, Entamoeba invadens
TRLDP

SEQ ID NO: 2780786 - protein, 18 aa, Entamoeba invadens
TRLDPDELKEDKKLGEGS

SEQ ID NO: 2780787 - protein, 18 aa, Entamoeba invadens
TRLDPDELYEDKKLGEGS

SEQ ID NO: 2780788 - protein, 8 aa, Entamoeba invadens
TRLDPESL

SEQ ID NO: 2780789 - protein, 6 aa, Entamoeba invadens
TRLDPK

SEQ ID NO: 2780790 - protein, 27 aa, Entamoeba invadens
TRLGGDSVTTPVTSTKSSEEPTRQTSL

SEQ ID NO: 2780791 - protein, 10 aa, Entamoeba invadens
TRLGPNGENK

SEQ ID NO: 2780792 - protein, 8 aa, Entamoeba invadens
TRLNPDDI

SEQ ID NO: 2780793 - protein, 6 aa, Entamoeba invadens
TRLPQQ

SEQ ID NO: 2780794 - protein, 9 aa, Entamoeba invadens
TRLSNNSKC

SEQ ID NO: 2780795 - protein, 18 aa, Entamoeba invadens
TRLSSDPTSLGGISAERV

SEQ ID NO: 2780796 - protein, 6 aa, Entamoeba invadens
TRLSSY

SEQ ID NO: 2780797 - protein, 12 aa, Entamoeba invadens
TRMDESKLGEGS

SEQ ID NO: 2780798 - protein, 5 aa, Entamoeba invadens
TRMST

SEQ ID NO: 2780799 - protein, 6 aa, Entamoeba invadens
TRNESG

SEQ ID NO: 2780800 - protein, 4 aa, Entamoeba invadens
TRNG

SEQ ID NO: 2780801 - protein, 9 aa, Entamoeba invadens
TRNGCSKCE

SEQ ID NO: 2780802 - protein, 6 aa, Entamoeba invadens
TRNGTI

SEQ ID NO: 2780803 - protein, 9 aa, Entamoeba invadens
TRNQNEGIK

SEQ ID NO: 2780804 - protein, 15 aa, Entamoeba invadens
TRNSKEFNKLSSQID

SEQ ID NO: 2780805 - protein, 7 aa, Entamoeba invadens
TRNTETN

SEQ ID NO: 2780806 - protein, 7 aa, Entamoeba invadens
TRPFPPC

SEQ ID NO: 2780807 - protein, 5 aa, Entamoeba invadens
TRPGI

SEQ ID NO: 2780808 - protein, 8 aa, Entamoeba invadens
TRPKRPDW

SEQ ID NO: 2780809 - protein, 4 aa, Entamoeba invadens
TRPN

SEQ ID NO: 2780810 - protein, 5 aa, Entamoeba invadens
TRPNF

SEQ ID NO: 2780811 - protein, 9 aa, Entamoeba invadens
TRPSKNFSL

SEQ ID NO: 2780812 - protein, 4 aa, Entamoeba invadens
TRPT

SEQ ID NO: 2780813 - protein, 4 aa, Entamoeba invadens
TRPV

SEQ ID NO: 2780814 - protein, 13 aa, Entamoeba invadens
TRPYSDQHNDPDE

SEQ ID NO: 2780815 - protein, 5 aa, Entamoeba invadens
TRQAG

SEQ ID NO: 2780816 - protein, 7 aa, Entamoeba invadens
TRQPTSV

SEQ ID NO: 2780817 - protein, 10 aa, Entamoeba invadens
TRSDANDNQY

SEQ ID NO: 2780818 - protein, 16 aa, Entamoeba invadens
TRSDERAKEKIQSINN

SEQ ID NO: 2780819 - protein, 5 aa, Entamoeba invadens
TRSDN

SEQ ID NO: 2780820 - protein, 7 aa, Entamoeba invadens
TRSEGTA

SEQ ID NO: 2780821 - protein, 5 aa, Entamoeba invadens
TRSGC

SEQ ID NO: 2780822 - protein, 7 aa, Entamoeba invadens
TRSGNIS

SEQ ID NO: 2780823 - protein, 13 aa, Entamoeba invadens
TRSHPNTEVKMLR

SEQ ID NO: 2780824 - protein, 7 aa, Entamoeba invadens
TRSPETN

SEQ ID NO: 2780825 - protein, 10 aa, Entamoeba invadens
TRSPTKVNTI

SEQ ID NO: 2780826 - protein, 16 aa, Entamoeba invadens
TRSRINTQKHKVSGYS

SEQ ID NO: 2780827 - protein, 5 aa, Entamoeba invadens
TRSRV

SEQ ID NO: 2780828 - protein, 18 aa, Entamoeba invadens
TRSTNNDEQPFALSGDLC

SEQ ID NO: 2780829 - protein, 5 aa, Entamoeba invadens
TRSTQ

SEQ ID NO: 2780830 - protein, 11 aa, Entamoeba invadens
TRSVDRRKPYT

SEQ ID NO: 2780831 - protein, 6 aa, Entamoeba invadens
TRTARF

SEQ ID NO: 2780832 - protein, 25 aa, Entamoeba invadens
TRTATTAEDQSKLYSPPKEDKYAPD

SEQ ID NO: 2780833 - protein, 8 aa, Entamoeba invadens
TRTDPEGA

SEQ ID NO: 2780834 - protein, 8 aa, Entamoeba invadens
TRTDPRFK

SEQ ID NO: 2780835 - protein, 8 aa, Entamoeba invadens
TRTFAQSV

SEQ ID NO: 2780836 - protein, 9 aa, Entamoeba invadens
TRTFGQGVG

SEQ ID NO: 2780837 - protein, 13 aa, Entamoeba invadens
TRTHGESKLTGGV

SEQ ID NO: 2780838 - protein, 6 aa, Entamoeba invadens
TRTIKD

SEQ ID NO: 2780839 - protein, 19 aa, Entamoeba invadens
TRTKDNEEDKNSKEENVTE

SEQ ID NO: 2780840 - protein, 5 aa, Entamoeba invadens
TRTLP

SEQ ID NO: 2780841 - protein, 12 aa, Entamoeba invadens
TRTNKGCERCNS

SEQ ID NO: 2780842 - protein, 12 aa, Entamoeba invadens
TRTTTENGNTIN

SEQ ID NO: 2780843 - protein, 12 aa, Entamoeba invadens
TRVAGNRVERYK

SEQ ID NO: 2780844 - protein, 11 aa, Entamoeba invadens
TRVEQCEEQKK

SEQ ID NO: 2780845 - protein, 10 aa, Entamoeba invadens
TRVGPNQNSL

SEQ ID NO: 2780846 - protein, 4 aa, Entamoeba invadens
TRYN

SEQ ID NO: 2780847 - protein, 5 aa, Entamoeba invadens
TRYQE

SEQ ID NO: 2780848 - protein, 8 aa, Entamoeba invadens
TRYSGYTT

SEQ ID NO: 2780849 - protein, 6 aa, Entamoeba invadens
TSAAPL

SEQ ID NO: 2780850 - protein, 11 aa, Entamoeba invadens
TSADNTTTDSI

SEQ ID NO: 2780851 - protein, 11 aa, Entamoeba invadens
TSADTAKTIDI

SEQ ID NO: 2780852 - protein, 17 aa, Entamoeba invadens
TSAEEDVKTIENSDARL

SEQ ID NO: 2780853 - protein, 7 aa, Entamoeba invadens
TSAEGDE

SEQ ID NO: 2780854 - protein, 9 aa, Entamoeba invadens
TSAESLSLD

SEQ ID NO: 2780855 - protein, 28 aa, Entamoeba invadens
TSAKDSKCTSCENNNKPTNTGESCEGYK

SEQ ID NO: 2780856 - protein, 6 aa, Entamoeba invadens
TSAKNK

SEQ ID NO: 2780857 - protein, 5 aa, Entamoeba invadens
TSALD

SEQ ID NO: 2780858 - protein, 12 aa, Entamoeba invadens
TSALDAESESVV

SEQ ID NO: 2780859 - protein, 11 aa, Entamoeba invadens
TSALDSESEKI

SEQ ID NO: 2780860 - protein, 10 aa, Entamoeba invadens
TSALDSVSEK

SEQ ID NO: 2780861 - protein, 6 aa, Entamoeba invadens
TSALTT

SEQ ID NO: 2780862 - protein, 5 aa, Entamoeba invadens
TSAND

SEQ ID NO: 2780863 - protein, 8 aa, Entamoeba invadens
TSANFSGN

SEQ ID NO: 2780864 - protein, 9 aa, Entamoeba invadens
TSANGNNCD

SEQ ID NO: 2780865 - protein, 6 aa, Entamoeba invadens
TSAPKI

SEQ ID NO: 2780866 - protein, 5 aa, Entamoeba invadens
TSAPY

SEQ ID NO: 2780867 - protein, 10 aa, Entamoeba invadens
TSATFGPSLN

SEQ ID NO: 2780868 - protein, 19 aa, Entamoeba invadens
TSATNNSKYITKSQDNQIT

SEQ ID NO: 2780869 - protein, 8 aa, Entamoeba invadens
TSATTWYP

SEQ ID NO: 2780870 - protein, 12 aa, Entamoeba invadens
TSAVAEEKNEYY

SEQ ID NO: 2780871 - protein, 4 aa, Entamoeba invadens
TSCD

SEQ ID NO: 2780872 - protein, 9 aa, Entamoeba invadens
TSCDSRSGI

SEQ ID NO: 2780873 - protein, 28 aa, Entamoeba invadens
TSCDSSCKSCDKTNGNCTSCDNGSVIDN

SEQ ID NO: 2780874 - protein, 15 aa, Entamoeba invadens
TSCDTLKDADENVMS

SEQ ID NO: 2780875 - protein, 8 aa, Entamoeba invadens
TSCDYDQT

SEQ ID NO: 2780876 - protein, 4 aa, Entamoeba invadens
TSCE

SEQ ID NO: 2780877 - protein, 6 aa, Entamoeba invadens
TSCEES

SEQ ID NO: 2780878 - protein, 13 aa, Entamoeba invadens
TSCEESYDNDNTC

SEQ ID NO: 2780879 - protein, 7 aa, Entamoeba invadens
TSCEKES

SEQ ID NO: 2780880 - protein, 9 aa, Entamoeba invadens
TSCEKESGF

SEQ ID NO: 2780881 - protein, 13 aa, Entamoeba invadens
TSCEPGNKKVGES

SEQ ID NO: 2780882 - protein, 6 aa, Entamoeba invadens
TSCEQC

SEQ ID NO: 2780883 - protein, 9 aa, Entamoeba invadens
TSCGDEGCV

SEQ ID NO: 2780884 - protein, 18 aa, Entamoeba invadens
TSCGDNTVQCDSRDGVSM

SEQ ID NO: 2780885 - protein, 13 aa, Entamoeba invadens
TSCGPNYDNDNTC

SEQ ID NO: 2780886 - protein, 6 aa, Entamoeba invadens
TSCKDG

SEQ ID NO: 2780887 - protein, 6 aa, Entamoeba invadens
TSCKNY

SEQ ID NO: 2780888 - protein, 9 aa, Entamoeba invadens
TSCKPGYSY

SEQ ID NO: 2780889 - protein, 9 aa, Entamoeba invadens
TSCKSGSYL

SEQ ID NO: 2780890 - protein, 7 aa, Entamoeba invadens
TSCNGES

SEQ ID NO: 2780891 - protein, 7 aa, Entamoeba invadens
TSCNSGY

SEQ ID NO: 2780892 - protein, 6 aa, Entamoeba invadens
TSCNTE

SEQ ID NO: 2780893 - protein, 4 aa, Entamoeba invadens
TSCP

SEQ ID NO: 2780894 - protein, 5 aa, Entamoeba invadens
TSCPE

SEQ ID NO: 2780895 - protein, 5 aa, Entamoeba invadens
TSCPH

SEQ ID NO: 2780896 - protein, 22 aa, Entamoeba invadens
TSCPSGSYSGSGASSCTKCSPG

SEQ ID NO: 2780897 - protein, 7 aa, Entamoeba invadens
TSCPTES

SEQ ID NO: 2780898 - protein, 13 aa, Entamoeba invadens
TSCQGKCSTTTGI

SEQ ID NO: 2780899 - protein, 32 aa, Entamoeba invadens
TSCQPGKGFYATSSKCSSCQPGYYSQGGTGGY

SEQ ID NO: 2780900 - protein, 26 aa, Entamoeba invadens
TSCQPGYKEITNNGNKNCVSCSSNGN

SEQ ID NO: 2780901 - protein, 7 aa, Entamoeba invadens
TSCRESS

SEQ ID NO: 2780902 - protein, 5 aa, Entamoeba invadens
TSCRI

SEQ ID NO: 2780903 - protein, 4 aa, Entamoeba invadens
TSCS

SEQ ID NO: 2780904 - protein, 14 aa, Entamoeba invadens
TSCSGPGNDQCSAC

SEQ ID NO: 2780905 - protein, 7 aa, Entamoeba invadens
TSCSPGY

SEQ ID NO: 2780906 - protein, 6 aa, Entamoeba invadens
TSCSQI

SEQ ID NO: 2780907 - protein, 6 aa, Entamoeba invadens
TSCSQT

SEQ ID NO: 2780908 - protein, 8 aa, Entamoeba invadens
TSCSQTTK

SEQ ID NO: 2780909 - protein, 6 aa, Entamoeba invadens
TSCSSG

SEQ ID NO: 2780910 - protein, 49 aa, Entamoeba invadens
TSCSSGQYFSGSSCSNCRAGTYSLGGTTTSCTSCPAGTYSSTGASSCTK

SEQ ID NO: 2780911 - protein, 8 aa, Entamoeba invadens
TSCSTSSM

SEQ ID NO: 2780912 - protein, 10 aa, Entamoeba invadens
TSCSTSSTES

SEQ ID NO: 2780913 - protein, 10 aa, Entamoeba invadens
TSCSTTQNTY

SEQ ID NO: 2780914 - protein, 4 aa, Entamoeba invadens
TSCT

SEQ ID NO: 2780915 - protein, 7 aa, Entamoeba invadens
TSCTNCN

SEQ ID NO: 2780916 - protein, 7 aa, Entamoeba invadens
TSCTPSE

SEQ ID NO: 2780917 - protein, 9 aa, Entamoeba invadens
TSCVSTSSQ

SEQ ID NO: 2780918 - protein, 7 aa, Entamoeba invadens
TSDADLN

SEQ ID NO: 2780919 - protein, 23 aa, Entamoeba invadens
TSDDTRKKAMNNDKERGKYSKME

SEQ ID NO: 2780920 - protein, 4 aa, Entamoeba invadens
TSDE

SEQ ID NO: 2780921 - protein, 6 aa, Entamoeba invadens
TSDENN

SEQ ID NO: 2780922 - protein, 6 aa, Entamoeba invadens
TSDGDD

SEQ ID NO: 2780923 - protein, 5 aa, Entamoeba invadens
TSDKK

SEQ ID NO: 2780924 - protein, 8 aa, Entamoeba invadens
TSDKNNCQ

SEQ ID NO: 2780925 - protein, 8 aa, Entamoeba invadens
TSDKNNTY

SEQ ID NO: 2780926 - protein, 5 aa, Entamoeba invadens
TSDKP

SEQ ID NO: 2780927 - protein, 5 aa, Entamoeba invadens
TSDND

SEQ ID NO: 2780928 - protein, 5 aa, Entamoeba invadens
TSDNE

SEQ ID NO: 2780929 - protein, 10 aa, Entamoeba invadens
TSDNNCTKCD

SEQ ID NO: 2780930 - protein, 8 aa, Entamoeba invadens
TSDNSEKK

SEQ ID NO: 2780931 - protein, 7 aa, Entamoeba invadens
TSDPEVL

SEQ ID NO: 2780932 - protein, 6 aa, Entamoeba invadens
TSDQEE

SEQ ID NO: 2780933 - protein, 7 aa, Entamoeba invadens
TSDQGEF

SEQ ID NO: 2780934 - protein, 4 aa, Entamoeba invadens
TSDS

SEQ ID NO: 2780935 - protein, 9 aa, Entamoeba invadens
TSDSEDTGY

SEQ ID NO: 2780936 - protein, 9 aa, Entamoeba invadens
TSDSKKVAI

SEQ ID NO: 2780937 - protein, 9 aa, Entamoeba invadens
TSDSQIDIN

SEQ ID NO: 2780938 - protein, 7 aa, Entamoeba invadens
TSDTAEM

SEQ ID NO: 2780939 - protein, 12 aa, Entamoeba invadens
TSDVDEKESESY

SEQ ID NO: 2780940 - protein, 4 aa, Entamoeba invadens
TSEC

SEQ ID NO: 2780941 - protein, 5 aa, Entamoeba invadens
TSECL

SEQ ID NO: 2780942 - protein, 12 aa, Entamoeba invadens
TSEDTTTQEAQY

SEQ ID NO: 2780943 - protein, 5 aa, Entamoeba invadens
TSEED

SEQ ID NO: 2780944 - protein, 9 aa, Entamoeba invadens
TSEEKIPYT

SEQ ID NO: 2780945 - protein, 8 aa, Entamoeba invadens
TSEENCHS

SEQ ID NO: 2780946 - protein, 32 aa, Entamoeba invadens
TSEGFQSLKDSYSSRTCKGSSSLKKEVTKGQH

SEQ ID NO: 2780947 - protein, 7 aa, Entamoeba invadens
TSEGVES

SEQ ID NO: 2780948 - protein, 4 aa, Entamoeba invadens
TSEK

SEQ ID NO: 2780949 - protein, 10 aa, Entamoeba invadens
TSEKKESRFS

SEQ ID NO: 2780950 - protein, 8 aa, Entamoeba invadens
TSEKLGAT

SEQ ID NO: 2780951 - protein, 10 aa, Entamoeba invadens
TSEKTSPQSP

SEQ ID NO: 2780952 - protein, 7 aa, Entamoeba invadens
TSEKYIK

SEQ ID NO: 2780953 - protein, 7 aa, Entamoeba invadens
TSELRRT

SEQ ID NO: 2780954 - protein, 8 aa, Entamoeba invadens
TSENDESL

SEQ ID NO: 2780955 - protein, 6 aa, Entamoeba invadens
TSENGM

SEQ ID NO: 2780956 - protein, 7 aa, Entamoeba invadens
TSENLTK

SEQ ID NO: 2780957 - protein, 5 aa, Entamoeba invadens
TSEPD

SEQ ID NO: 2780958 - protein, 7 aa, Entamoeba invadens
TSEPQSF

SEQ ID NO: 2780959 - protein, 6 aa, Entamoeba invadens
TSEPTN

SEQ ID NO: 2780960 - protein, 26 aa, Entamoeba invadens
TSEQEPKDKDGKKKEEITEDKLTPEM

SEQ ID NO: 2780961 - protein, 10 aa, Entamoeba invadens
TSEQGREEVF

SEQ ID NO: 2780962 - protein, 6 aa, Entamoeba invadens
TSEQNR

SEQ ID NO: 2780963 - protein, 11 aa, Entamoeba invadens
TSERNNSGAQL

SEQ ID NO: 2780964 - protein, 9 aa, Entamoeba invadens
TSESGVQKE

SEQ ID NO: 2780965 - protein, 44 aa, Entamoeba invadens
TSESRSGDSYSKSSAGFSNSENASNLQSVSSLSSAGKKKRVLKV

SEQ ID NO: 2780966 - protein, 5 aa, Entamoeba invadens
TSESS

SEQ ID NO: 2780967 - protein, 6 aa, Entamoeba invadens
TSETAL

SEQ ID NO: 2780968 - protein, 9 aa, Entamoeba invadens
TSETPYDRG

SEQ ID NO: 2780969 - protein, 6 aa, Entamoeba invadens
TSETTK

SEQ ID NO: 2780970 - protein, 5 aa, Entamoeba invadens
TSEYN

SEQ ID NO: 2780971 - protein, 5 aa, Entamoeba invadens
TSEYS

SEQ ID NO: 2780972 - protein, 12 aa, Entamoeba invadens
TSFEAKNQTLNF

SEQ ID NO: 2780973 - protein, 4 aa, Entamoeba invadens
TSFG

SEQ ID NO: 2780974 - protein, 6 aa, Entamoeba invadens
TSFNSN

SEQ ID NO: 2780975 - protein, 4 aa, Entamoeba invadens
TSFP

SEQ ID NO: 2780976 - protein, 11 aa, Entamoeba invadens
TSFTTSSKSEF

SEQ ID NO: 2780977 - protein, 10 aa, Entamoeba invadens
TSGADNAANY

SEQ ID NO: 2780978 - protein, 7 aa, Entamoeba invadens
TSGEDKC

SEQ ID NO: 2780979 - protein, 11 aa, Entamoeba invadens
TSGERLPRTET

SEQ ID NO: 2780980 - protein, 13 aa, Entamoeba invadens
TSGERMKKTDTME

SEQ ID NO: 2780981 - protein, 6 aa, Entamoeba invadens
TSGESQ

SEQ ID NO: 2780982 - protein, 4 aa, Entamoeba invadens
TSGG

SEQ ID NO: 2780983 - protein, 5 aa, Entamoeba invadens
TSGIN

SEQ ID NO: 2780984 - protein, 5 aa, Entamoeba invadens
TSGIS

SEQ ID NO: 2780985 - protein, 5 aa, Entamoeba invadens
TSGIY

SEQ ID NO: 2780986 - protein, 8 aa, Entamoeba invadens
TSGKNGYC

SEQ ID NO: 2780987 - protein, 16 aa, Entamoeba invadens
TSGKRLEKKENMSDDQ

SEQ ID NO: 2780988 - protein, 14 aa, Entamoeba invadens
TSGKRLPQPDNVSD

SEQ ID NO: 2780989 - protein, 21 aa, Entamoeba invadens
TSGKRRECQENMNVEAYNIVD

SEQ ID NO: 2780990 - protein, 8 aa, Entamoeba invadens
TSGKRRPC

SEQ ID NO: 2780991 - protein, 9 aa, Entamoeba invadens
TSGNEASTE

SEQ ID NO: 2780992 - protein, 7 aa, Entamoeba invadens
TSGNRLE

SEQ ID NO: 2780993 - protein, 14 aa, Entamoeba invadens
TSGNRRQRTENMNE

SEQ ID NO: 2780994 - protein, 8 aa, Entamoeba invadens
TSGQRPEI

SEQ ID NO: 2780995 - protein, 9 aa, Entamoeba invadens
TSGQRPERL

SEQ ID NO: 2780996 - protein, 7 aa, Entamoeba invadens
TSGRTYT

SEQ ID NO: 2780997 - protein, 6 aa, Entamoeba invadens
TSGSTF

SEQ ID NO: 2780998 - protein, 12 aa, Entamoeba invadens
TSGSYKNTKTSC

SEQ ID NO: 2780999 - protein, 8 aa, Entamoeba invadens
TSGTCEKC

SEQ ID NO: 2781000 - protein, 5 aa, Entamoeba invadens
TSGTT

SEQ ID NO: 2781001 - protein, 7 aa, Entamoeba invadens
TSGTTRG

SEQ ID NO: 2781002 - protein, 4 aa, Entamoeba invadens
TSGV

SEQ ID NO: 2781003 - protein, 6 aa, Entamoeba invadens
TSGVDN

SEQ ID NO: 2781004 - protein, 10 aa, Entamoeba invadens
TSGVDNTKNY

SEQ ID NO: 2781005 - protein, 4 aa, Entamoeba invadens
TSHE

SEQ ID NO: 2781006 - protein, 6 aa, Entamoeba invadens
TSHKNV

SEQ ID NO: 2781007 - protein, 22 aa, Entamoeba invadens
TSHLTPGDFPRPLKEGTASLLS

SEQ ID NO: 2781008 - protein, 8 aa, Entamoeba invadens
TSHPSTTF

SEQ ID NO: 2781009 - protein, 5 aa, Entamoeba invadens
TSHSH

SEQ ID NO: 2781010 - protein, 7 aa, Entamoeba invadens
TSHSTRI

SEQ ID NO: 2781011 - protein, 5 aa, Entamoeba invadens
TSHYD

SEQ ID NO: 2781012 - protein, 13 aa, Entamoeba invadens
TSIEGNPNANKAT

SEQ ID NO: 2781013 - protein, 7 aa, Entamoeba invadens
TSIGSNQ

SEQ ID NO: 2781014 - protein, 6 aa, Entamoeba invadens
TSIGSS

SEQ ID NO: 2781015 - protein, 13 aa, Entamoeba invadens
TSIPDDKYKVTND

SEQ ID NO: 2781016 - protein, 7 aa, Entamoeba invadens
TSIPPDE

SEQ ID NO: 2781017 - protein, 4 aa, Entamoeba invadens
TSIQ

SEQ ID NO: 2781018 - protein, 6 aa, Entamoeba invadens
TSIQDA

SEQ ID NO: 2781019 - protein, 7 aa, Entamoeba invadens
TSIQNGP

SEQ ID NO: 2781020 - protein, 8 aa, Entamoeba invadens
TSIQPNTN

SEQ ID NO: 2781021 - protein, 16 aa, Entamoeba invadens
TSISETDDCGYPSGEN

SEQ ID NO: 2781022 - protein, 8 aa, Entamoeba invadens
TSISSEPS

SEQ ID NO: 2781023 - protein, 5 aa, Entamoeba invadens
TSITG

SEQ ID NO: 2781024 - protein, 4 aa, Entamoeba invadens
TSKC

SEQ ID NO: 2781025 - protein, 9 aa, Entamoeba invadens
TSKCTTPVK

SEQ ID NO: 2781026 - protein, 7 aa, Entamoeba invadens
TSKDSEN

SEQ ID NO: 2781027 - protein, 7 aa, Entamoeba invadens
TSKENNQ

SEQ ID NO: 2781028 - protein, 12 aa, Entamoeba invadens
TSKFNDKEQHDA

SEQ ID NO: 2781029 - protein, 9 aa, Entamoeba invadens
TSKGITKTQ

SEQ ID NO: 2781030 - protein, 20 aa, Entamoeba invadens
TSKGSGATGKAGAIAEETIG

SEQ ID NO: 2781031 - protein, 9 aa, Entamoeba invadens
TSKGSQISI

SEQ ID NO: 2781032 - protein, 5 aa, Entamoeba invadens
TSKHD

SEQ ID NO: 2781033 - protein, 5 aa, Entamoeba invadens
TSKHE

SEQ ID NO: 2781034 - protein, 6 aa, Entamoeba invadens
TSKHNI

SEQ ID NO: 2781035 - protein, 14 aa, Entamoeba invadens
TSKHNMKVQFIIIV

SEQ ID NO: 2781036 - protein, 17 aa, Entamoeba invadens
TSKHPNVNAQAEYTQTR

SEQ ID NO: 2781037 - protein, 5 aa, Entamoeba invadens
TSKHT

SEQ ID NO: 2781038 - protein, 4 aa, Entamoeba invadens
TSKI

SEQ ID NO: 2781039 - protein, 5 aa, Entamoeba invadens
TSKIY

SEQ ID NO: 2781040 - protein, 11 aa, Entamoeba invadens
TSKKLTKKGRF

SEQ ID NO: 2781041 - protein, 9 aa, Entamoeba invadens
TSKKYGDGL

SEQ ID NO: 2781042 - protein, 7 aa, Entamoeba invadens
TSKNENL

SEQ ID NO: 2781043 - protein, 6 aa, Entamoeba invadens
TSKNET

SEQ ID NO: 2781044 - protein, 5 aa, Entamoeba invadens
TSKNF

SEQ ID NO: 2781045 - protein, 17 aa, Entamoeba invadens
TSKNNTSNLKSGGVNCE

SEQ ID NO: 2781046 - protein, 7 aa, Entamoeba invadens
TSKQPME

SEQ ID NO: 2781047 - protein, 10 aa, Entamoeba invadens
TSKSNSEKYE

SEQ ID NO: 2781048 - protein, 7 aa, Entamoeba invadens
TSKSQSG

SEQ ID NO: 2781049 - protein, 12 aa, Entamoeba invadens
TSKSVEMKTASV

SEQ ID NO: 2781050 - protein, 9 aa, Entamoeba invadens
TSKTCQSCN

SEQ ID NO: 2781051 - protein, 15 aa, Entamoeba invadens
TSKTDISSSLNNAID

SEQ ID NO: 2781052 - protein, 8 aa, Entamoeba invadens
TSKTGQMK

SEQ ID NO: 2781053 - protein, 10 aa, Entamoeba invadens
TSKTKGVREK

SEQ ID NO: 2781054 - protein, 5 aa, Entamoeba invadens
TSKTL

SEQ ID NO: 2781055 - protein, 7 aa, Entamoeba invadens
TSKTNEK

SEQ ID NO: 2781056 - protein, 7 aa, Entamoeba invadens
TSKTQKL

SEQ ID NO: 2781057 - protein, 8 aa, Entamoeba invadens
TSKTSGSC

SEQ ID NO: 2781058 - protein, 11 aa, Entamoeba invadens
TSKTSSVDEKR

SEQ ID NO: 2781059 - protein, 15 aa, Entamoeba invadens
TSKTSTGQKTKNILE

SEQ ID NO: 2781060 - protein, 5 aa, Entamoeba invadens
TSKVE

SEQ ID NO: 2781061 - protein, 7 aa, Entamoeba invadens
TSKVSTE

SEQ ID NO: 2781062 - protein, 5 aa, Entamoeba invadens
TSKYI

SEQ ID NO: 2781063 - protein, 11 aa, Entamoeba invadens
TSKYPDETTGM

SEQ ID NO: 2781064 - protein, 6 aa, Entamoeba invadens
TSKYTV

SEQ ID NO: 2781065 - protein, 9 aa, Entamoeba invadens
TSLDQSEIS

SEQ ID NO: 2781066 - protein, 16 aa, Entamoeba invadens
TSLDYSEVKEESYLGA

SEQ ID NO: 2781067 - protein, 4 aa, Entamoeba invadens
TSLE

SEQ ID NO: 2781068 - protein, 5 aa, Entamoeba invadens
TSLEE

SEQ ID NO: 2781069 - protein, 6 aa, Entamoeba invadens
TSLGAT

SEQ ID NO: 2781070 - protein, 7 aa, Entamoeba invadens
TSLKQND

SEQ ID NO: 2781071 - protein, 12 aa, Entamoeba invadens
TSLKSAYDTNEE

SEQ ID NO: 2781072 - protein, 14 aa, Entamoeba invadens
TSLNSSPSTTLEEV

SEQ ID NO: 2781073 - protein, 6 aa, Entamoeba invadens
TSLPED

SEQ ID NO: 2781074 - protein, 5 aa, Entamoeba invadens
TSLPQ

SEQ ID NO: 2781075 - protein, 6 aa, Entamoeba invadens
TSLSVG

SEQ ID NO: 2781076 - protein, 5 aa, Entamoeba invadens
TSMGY

SEQ ID NO: 2781077 - protein, 14 aa, Entamoeba invadens
TSNCTSCNNTEKSC

SEQ ID NO: 2781078 - protein, 9 aa, Entamoeba invadens
TSNCTSDYT

SEQ ID NO: 2781079 - protein, 4 aa, Entamoeba invadens
TSND

SEQ ID NO: 2781080 - protein, 5 aa, Entamoeba invadens
TSNDD

SEQ ID NO: 2781081 - protein, 9 aa, Entamoeba invadens
TSNDENKKC

SEQ ID NO: 2781082 - protein, 70 aa, Entamoeba invadens
TSNDPAINPVHNQSETPSEASSQSHEQSQTSRNESSNSMEEYSSSISEGSLSHQSNDESHNNHTSNDTVF

SEQ ID NO: 2781083 - protein, 8 aa, Entamoeba invadens
TSNENTKC

SEQ ID NO: 2781084 - protein, 7 aa, Entamoeba invadens
TSNEQER

SEQ ID NO: 2781085 - protein, 5 aa, Entamoeba invadens
TSNGC

SEQ ID NO: 2781086 - protein, 5 aa, Entamoeba invadens
TSNGL

SEQ ID NO: 2781087 - protein, 7 aa, Entamoeba invadens
TSNGNCN

SEQ ID NO: 2781088 - protein, 9 aa, Entamoeba invadens
TSNGPDVQE

SEQ ID NO: 2781089 - protein, 15 aa, Entamoeba invadens
TSNGQIKSTPLDQPN

SEQ ID NO: 2781090 - protein, 6 aa, Entamoeba invadens
TSNGTC

SEQ ID NO: 2781091 - protein, 12 aa, Entamoeba invadens
TSNHPPKESVPH

SEQ ID NO: 2781092 - protein, 5 aa, Entamoeba invadens
TSNIP

SEQ ID NO: 2781093 - protein, 7 aa, Entamoeba invadens
TSNKTGF

SEQ ID NO: 2781094 - protein, 5 aa, Entamoeba invadens
TSNKY

SEQ ID NO: 2781095 - protein, 9 aa, Entamoeba invadens
TSNNSFSEN

SEQ ID NO: 2781096 - protein, 6 aa, Entamoeba invadens
TSNNTY

SEQ ID NO: 2781097 - protein, 9 aa, Entamoeba invadens
TSNPGSLIT

SEQ ID NO: 2781098 - protein, 10 aa, Entamoeba invadens
TSNPLASAGI

SEQ ID NO: 2781099 - protein, 5 aa, Entamoeba invadens
TSNPT

SEQ ID NO: 2781100 - protein, 4 aa, Entamoeba invadens
TSNQ

SEQ ID NO: 2781101 - protein, 5 aa, Entamoeba invadens
TSNQE

SEQ ID NO: 2781102 - protein, 8 aa, Entamoeba invadens
TSNRGTSW

SEQ ID NO: 2781103 - protein, 27 aa, Entamoeba invadens
TSNSCQTCSSTTGDCTGCNPGFSYDAT

SEQ ID NO: 2781104 - protein, 5 aa, Entamoeba invadens
TSNSS

SEQ ID NO: 2781105 - protein, 8 aa, Entamoeba invadens
TSNTEDSI

SEQ ID NO: 2781106 - protein, 8 aa, Entamoeba invadens
TSNTINAT

SEQ ID NO: 2781107 - protein, 5 aa, Entamoeba invadens
TSNTP

SEQ ID NO: 2781108 - protein, 7 aa, Entamoeba invadens
TSNTQQF

SEQ ID NO: 2781109 - protein, 5 aa, Entamoeba invadens
TSNYE

SEQ ID NO: 2781110 - protein, 9 aa, Entamoeba invadens
TSPDTREDG

SEQ ID NO: 2781111 - protein, 21 aa, Entamoeba invadens
TSPENSCDSTCGGQCSGSTGV

SEQ ID NO: 2781112 - protein, 6 aa, Entamoeba invadens
TSPFGT

SEQ ID NO: 2781113 - protein, 6 aa, Entamoeba invadens
TSPFNS

SEQ ID NO: 2781114 - protein, 7 aa, Entamoeba invadens
TSPFYGP

SEQ ID NO: 2781115 - protein, 4 aa, Entamoeba invadens
TSPI

SEQ ID NO: 2781116 - protein, 5 aa, Entamoeba invadens
TSPIC

SEQ ID NO: 2781117 - protein, 5 aa, Entamoeba invadens
TSPIS

SEQ ID NO: 2781118 - protein, 4 aa, Entamoeba invadens
TSPK

SEQ ID NO: 2781119 - protein, 7 aa, Entamoeba invadens
TSPLPNC

SEQ ID NO: 2781120 - protein, 18 aa, Entamoeba invadens
TSPLSTNATITSSCSQSN

SEQ ID NO: 2781121 - protein, 13 aa, Entamoeba invadens
TSPMSSNSEKYTK

SEQ ID NO: 2781122 - protein, 5 aa, Entamoeba invadens
TSPPL

SEQ ID NO: 2781123 - protein, 6 aa, Entamoeba invadens
TSPPLK

SEQ ID NO: 2781124 - protein, 10 aa, Entamoeba invadens
TSPPNGPDDY

SEQ ID NO: 2781125 - protein, 8 aa, Entamoeba invadens
TSPPSYKC

SEQ ID NO: 2781126 - protein, 7 aa, Entamoeba invadens
TSPPTFP

SEQ ID NO: 2781127 - protein, 16 aa, Entamoeba invadens
TSPQPVSVSPSTPQIV

SEQ ID NO: 2781128 - protein, 7 aa, Entamoeba invadens
TSPQSTR

SEQ ID NO: 2781129 - protein, 13 aa, Entamoeba invadens
TSPRKFADKRFLR

SEQ ID NO: 2781130 - protein, 17 aa, Entamoeba invadens
TSPRSEFKKKKKATKSL

SEQ ID NO: 2781131 - protein, 4 aa, Entamoeba invadens
TSPS

SEQ ID NO: 2781132 - protein, 12 aa, Entamoeba invadens
TSPSDSTSPTPE

SEQ ID NO: 2781133 - protein, 7 aa, Entamoeba invadens
TSPTATE

SEQ ID NO: 2781134 - protein, 7 aa, Entamoeba invadens
TSPTCTT

SEQ ID NO: 2781135 - protein, 7 aa, Entamoeba invadens
TSPTECT

SEQ ID NO: 2781136 - protein, 7 aa, Entamoeba invadens
TSPTSKM

SEQ ID NO: 2781137 - protein, 14 aa, Entamoeba invadens
TSPTSKTCQKCSDF

SEQ ID NO: 2781138 - protein, 24 aa, Entamoeba invadens
TSPTSKTCQKCSDLDSKCKTCATD

SEQ ID NO: 2781139 - protein, 9 aa, Entamoeba invadens
TSQCDDDSQ

SEQ ID NO: 2781140 - protein, 5 aa, Entamoeba invadens
TSQCE

SEQ ID NO: 2781141 - protein, 5 aa, Entamoeba invadens
TSQDG

SEQ ID NO: 2781142 - protein, 5 aa, Entamoeba invadens
TSQEI

SEQ ID NO: 2781143 - protein, 10 aa, Entamoeba invadens
TSQGEGKYEG

SEQ ID NO: 2781144 - protein, 5 aa, Entamoeba invadens
TSQGG

SEQ ID NO: 2781145 - protein, 9 aa, Entamoeba invadens
TSQGSDPYS

SEQ ID NO: 2781146 - protein, 5 aa, Entamoeba invadens
TSQIA

SEQ ID NO: 2781147 - protein, 4 aa, Entamoeba invadens
TSQK

SEQ ID NO: 2781148 - protein, 7 aa, Entamoeba invadens
TSQNCGK

SEQ ID NO: 2781149 - protein, 11 aa, Entamoeba invadens
TSQNSAGRQLS

SEQ ID NO: 2781150 - protein, 4 aa, Entamoeba invadens
TSQP

SEQ ID NO: 2781151 - protein, 7 aa, Entamoeba invadens
TSQQSRP

SEQ ID NO: 2781152 - protein, 5 aa, Entamoeba invadens
TSQRK

SEQ ID NO: 2781153 - protein, 9 aa, Entamoeba invadens
TSQSENSDV

SEQ ID NO: 2781154 - protein, 22 aa, Entamoeba invadens
TSQSSRIDYDELNEESKLGEGS

SEQ ID NO: 2781155 - protein, 7 aa, Entamoeba invadens
TSQSTRI

SEQ ID NO: 2781156 - protein, 8 aa, Entamoeba invadens
TSQSTRID

SEQ ID NO: 2781157 - protein, 8 aa, Entamoeba invadens
TSQTEDFT

SEQ ID NO: 2781158 - protein, 9 aa, Entamoeba invadens
TSQTPNEIT

SEQ ID NO: 2781159 - protein, 5 aa, Entamoeba invadens
TSQTY

SEQ ID NO: 2781160 - protein, 8 aa, Entamoeba invadens
TSQYTPQN

SEQ ID NO: 2781161 - protein, 6 aa, Entamoeba invadens
TSRDKF

SEQ ID NO: 2781162 - protein, 6 aa, Entamoeba invadens
TSRENF

SEQ ID NO: 2781163 - protein, 27 aa, Entamoeba invadens
TSRFTQRGKGISEKGLGTPIYASPESF

SEQ ID NO: 2781164 - protein, 5 aa, Entamoeba invadens
TSRGF

SEQ ID NO: 2781165 - protein, 8 aa, Entamoeba invadens
TSRITKTV

SEQ ID NO: 2781166 - protein, 8 aa, Entamoeba invadens
TSRKCQKC

SEQ ID NO: 2781167 - protein, 6 aa, Entamoeba invadens
TSRLDQ

SEQ ID NO: 2781168 - protein, 6 aa, Entamoeba invadens
TSRNDF

SEQ ID NO: 2781169 - protein, 5 aa, Entamoeba invadens
TSRNF

SEQ ID NO: 2781170 - protein, 7 aa, Entamoeba invadens
TSRNTPR

SEQ ID NO: 2781171 - protein, 8 aa, Entamoeba invadens
TSRPTSKL

SEQ ID NO: 2781172 - protein, 5 aa, Entamoeba invadens
TSRRS

SEQ ID NO: 2781173 - protein, 10 aa, Entamoeba invadens
TSRSAKTNID

SEQ ID NO: 2781174 - protein, 5 aa, Entamoeba invadens
TSRYC

SEQ ID NO: 2781175 - protein, 20 aa, Entamoeba invadens
TSSADDIDCPNRDTLDRNYY

SEQ ID NO: 2781176 - protein, 5 aa, Entamoeba invadens
TSSAG

SEQ ID NO: 2781177 - protein, 11 aa, Entamoeba invadens
TSSATKTDPII

SEQ ID NO: 2781178 - protein, 10 aa, Entamoeba invadens
TSSCGSEGCV

SEQ ID NO: 2781179 - protein, 8 aa, Entamoeba invadens
TSSDDGTI

SEQ ID NO: 2781180 - protein, 11 aa, Entamoeba invadens
TSSDDKEKATT

SEQ ID NO: 2781181 - protein, 6 aa, Entamoeba invadens
TSSDDN

SEQ ID NO: 2781182 - protein, 6 aa, Entamoeba invadens
TSSDEN

SEQ ID NO: 2781183 - protein, 4 aa, Entamoeba invadens
TSSE

SEQ ID NO: 2781184 - protein, 7 aa, Entamoeba invadens
TSSEENL

SEQ ID NO: 2781185 - protein, 8 aa, Entamoeba invadens
TSSEKSID

SEQ ID NO: 2781186 - protein, 7 aa, Entamoeba invadens
TSSENGS

SEQ ID NO: 2781187 - protein, 4 aa, Entamoeba invadens
TSSF

SEQ ID NO: 2781188 - protein, 16 aa, Entamoeba invadens
TSSFDNTTVTLNGTSQ

SEQ ID NO: 2781189 - protein, 7 aa, Entamoeba invadens
TSSFSKN

SEQ ID NO: 2781190 - protein, 4 aa, Entamoeba invadens
TSSG

SEQ ID NO: 2781191 - protein, 9 aa, Entamoeba invadens
TSSGSAGLA

SEQ ID NO: 2781192 - protein, 5 aa, Entamoeba invadens
TSSIA

SEQ ID NO: 2781193 - protein, 8 aa, Entamoeba invadens
TSSIKKDI

SEQ ID NO: 2781194 - protein, 20 aa, Entamoeba invadens
TSSISPTSTNIVTPQNMNTD

SEQ ID NO: 2781195 - protein, 8 aa, Entamoeba invadens
TSSKGDLK

SEQ ID NO: 2781196 - protein, 9 aa, Entamoeba invadens
TSSKSELNK

SEQ ID NO: 2781197 - protein, 10 aa, Entamoeba invadens
TSSKTNDTVT

SEQ ID NO: 2781198 - protein, 6 aa, Entamoeba invadens
TSSKYG

SEQ ID NO: 2781199 - protein, 9 aa, Entamoeba invadens
TSSNKTIRE

SEQ ID NO: 2781200 - protein, 5 aa, Entamoeba invadens
TSSNR

SEQ ID NO: 2781201 - protein, 8 aa, Entamoeba invadens
TSSPMSSR

SEQ ID NO: 2781202 - protein, 8 aa, Entamoeba invadens
TSSPNGNC

SEQ ID NO: 2781203 - protein, 8 aa, Entamoeba invadens
TSSPVSSR

SEQ ID NO: 2781204 - protein, 4 aa, Entamoeba invadens
TSSR

SEQ ID NO: 2781205 - protein, 10 aa, Entamoeba invadens
TSSSGCDGTI

SEQ ID NO: 2781206 - protein, 11 aa, Entamoeba invadens
TSSSKNKCDSC

SEQ ID NO: 2781207 - protein, 9 aa, Entamoeba invadens
TSSSNTVNV

SEQ ID NO: 2781208 - protein, 10 aa, Entamoeba invadens
TSSSSSPTYS

SEQ ID NO: 2781209 - protein, 14 aa, Entamoeba invadens
TSSTCDSCSSTTGK

SEQ ID NO: 2781210 - protein, 16 aa, Entamoeba invadens
TSSTDTYTETTTVADT

SEQ ID NO: 2781211 - protein, 5 aa, Entamoeba invadens
TSSTI

SEQ ID NO: 2781212 - protein, 7 aa, Entamoeba invadens
TSSTNAE

SEQ ID NO: 2781213 - protein, 6 aa, Entamoeba invadens
TSSTTC

SEQ ID NO: 2781214 - protein, 6 aa, Entamoeba invadens
TSSTTL

SEQ ID NO: 2781215 - protein, 9 aa, Entamoeba invadens
TSSVRQKTE

SEQ ID NO: 2781216 - protein, 11 aa, Entamoeba invadens
TSSVSGDTNAI

SEQ ID NO: 2781217 - protein, 5 aa, Entamoeba invadens
TSSVT

SEQ ID NO: 2781218 - protein, 5 aa, Entamoeba invadens
TSTAP

SEQ ID NO: 2781219 - protein, 6 aa, Entamoeba invadens
TSTESS

SEQ ID NO: 2781220 - protein, 8 aa, Entamoeba invadens
TSTETPLP

SEQ ID NO: 2781221 - protein, 8 aa, Entamoeba invadens
TSTEYSDN

SEQ ID NO: 2781222 - protein, 4 aa, Entamoeba invadens
TSTF

SEQ ID NO: 2781223 - protein, 5 aa, Entamoeba invadens
TSTFD

SEQ ID NO: 2781224 - protein, 5 aa, Entamoeba invadens
TSTGL

SEQ ID NO: 2781225 - protein, 8 aa, Entamoeba invadens
TSTGNFTT

SEQ ID NO: 2781226 - protein, 14 aa, Entamoeba invadens
TSTHCTSPSGCTQC

SEQ ID NO: 2781227 - protein, 79 aa, Entamoeba invadens
TSTKEERAAAEEAKKKEEGGEGEKSENTPKAVEMSDKSEKSNENAENKTDLTKAPETEVKEDGPKEEEKQEFKEVEEES

SEQ ID NO: 2781228 - protein, 7 aa, Entamoeba invadens
TSTKIQR

SEQ ID NO: 2781229 - protein, 10 aa, Entamoeba invadens
TSTKSTYSQI

SEQ ID NO: 2781230 - protein, 4 aa, Entamoeba invadens
TSTL

SEQ ID NO: 2781231 - protein, 5 aa, Entamoeba invadens
TSTLI

SEQ ID NO: 2781232 - protein, 5 aa, Entamoeba invadens
TSTLN

SEQ ID NO: 2781233 - protein, 8 aa, Entamoeba invadens
TSTNCTTC

SEQ ID NO: 2781234 - protein, 5 aa, Entamoeba invadens
TSTNE

SEQ ID NO: 2781235 - protein, 7 aa, Entamoeba invadens
TSTNKNL

SEQ ID NO: 2781236 - protein, 6 aa, Entamoeba invadens
TSTNMN

SEQ ID NO: 2781237 - protein, 6 aa, Entamoeba invadens
TSTNNS

SEQ ID NO: 2781238 - protein, 9 aa, Entamoeba invadens
TSTNQAGRY

SEQ ID NO: 2781239 - protein, 8 aa, Entamoeba invadens
TSTPLSTN

SEQ ID NO: 2781240 - protein, 5 aa, Entamoeba invadens
TSTQS

SEQ ID NO: 2781241 - protein, 7 aa, Entamoeba invadens
TSTQTSQ

SEQ ID NO: 2781242 - protein, 9 aa, Entamoeba invadens
TSTRVERDG

SEQ ID NO: 2781243 - protein, 8 aa, Entamoeba invadens
TSTSFKQK

SEQ ID NO: 2781244 - protein, 5 aa, Entamoeba invadens
TSTSL

SEQ ID NO: 2781245 - protein, 6 aa, Entamoeba invadens
TSTSQI

SEQ ID NO: 2781246 - protein, 6 aa, Entamoeba invadens
TSTSSV

SEQ ID NO: 2781247 - protein, 5 aa, Entamoeba invadens
TSTST

SEQ ID NO: 2781248 - protein, 5 aa, Entamoeba invadens
TSTTC

SEQ ID NO: 2781249 - protein, 5 aa, Entamoeba invadens
TSTTF

SEQ ID NO: 2781250 - protein, 5 aa, Entamoeba invadens
TSTTI

SEQ ID NO: 2781251 - protein, 5 aa, Entamoeba invadens
TSTTL

SEQ ID NO: 2781252 - protein, 7 aa, Entamoeba invadens
TSTTRNE

SEQ ID NO: 2781253 - protein, 7 aa, Entamoeba invadens
TSTTSNI

SEQ ID NO: 2781254 - protein, 5 aa, Entamoeba invadens
TSTTT

SEQ ID NO: 2781255 - protein, 11 aa, Entamoeba invadens
TSTTTENGNTI

SEQ ID NO: 2781256 - protein, 11 aa, Entamoeba invadens
TSTVANGKYDT

SEQ ID NO: 2781257 - protein, 5 aa, Entamoeba invadens
TSTVE

SEQ ID NO: 2781258 - protein, 8 aa, Entamoeba invadens
TSTVTTPM

SEQ ID NO: 2781259 - protein, 6 aa, Entamoeba invadens
TSTYSI

SEQ ID NO: 2781260 - protein, 7 aa, Entamoeba invadens
TSVDDSV

SEQ ID NO: 2781261 - protein, 14 aa, Entamoeba invadens
TSVGNSKCSSIPTI

SEQ ID NO: 2781262 - protein, 9 aa, Entamoeba invadens
TSVKIKPDP

SEQ ID NO: 2781263 - protein, 5 aa, Entamoeba invadens
TSVQY

SEQ ID NO: 2781264 - protein, 4 aa, Entamoeba invadens
TSVR

SEQ ID NO: 2781265 - protein, 7 aa, Entamoeba invadens
TSVSNPK

SEQ ID NO: 2781266 - protein, 22 aa, Entamoeba invadens
TSVTANDAVTTYEESSFKNSGL

SEQ ID NO: 2781267 - protein, 5 aa, Entamoeba invadens
TSVTF

SEQ ID NO: 2781268 - protein, 13 aa, Entamoeba invadens
TSVTKKAAFSQDK

SEQ ID NO: 2781269 - protein, 19 aa, Entamoeba invadens
TSVTQDSDWSSWLRLLLFF

SEQ ID NO: 2781270 - protein, 9 aa, Entamoeba invadens
TSVTTGKQN

SEQ ID NO: 2781271 - protein, 5 aa, Entamoeba invadens
TSVTY

SEQ ID NO: 2781272 - protein, 5 aa, Entamoeba invadens
TSYET

SEQ ID NO: 2781273 - protein, 4 aa, Entamoeba invadens
TSYG

SEQ ID NO: 2781274 - protein, 5 aa, Entamoeba invadens
TSYGS

SEQ ID NO: 2781275 - protein, 4 aa, Entamoeba invadens
TSYP

SEQ ID NO: 2781276 - protein, 14 aa, Entamoeba invadens
TSYQLQAEGSGGNV

SEQ ID NO: 2781277 - protein, 4 aa, Entamoeba invadens
TSYT

SEQ ID NO: 2781278 - protein, 9 aa, Entamoeba invadens
TSYTTSSNN

SEQ ID NO: 2781279 - protein, 5 aa, Entamoeba invadens
TTAAN

SEQ ID NO: 2781280 - protein, 6 aa, Entamoeba invadens
TTADTT

SEQ ID NO: 2781281 - protein, 4 aa, Entamoeba invadens
TTAE

SEQ ID NO: 2781282 - protein, 13 aa, Entamoeba invadens
TTAGNVNDYSTKI

SEQ ID NO: 2781283 - protein, 24 aa, Entamoeba invadens
TTAKESKCTTCEGRNIPSDDGERC

SEQ ID NO: 2781284 - protein, 9 aa, Entamoeba invadens
TTANSTEKL

SEQ ID NO: 2781285 - protein, 19 aa, Entamoeba invadens
TTAQQGSSTQNNVKDSDTF

SEQ ID NO: 2781286 - protein, 18 aa, Entamoeba invadens
TTARSEGKTEVKENKGEN

SEQ ID NO: 2781287 - protein, 5 aa, Entamoeba invadens
TTART

SEQ ID NO: 2781288 - protein, 15 aa, Entamoeba invadens
TTASGSIDTNKGDVS

SEQ ID NO: 2781289 - protein, 15 aa, Entamoeba invadens
TTASNPVDTNGGSVS

SEQ ID NO: 2781290 - protein, 8 aa, Entamoeba invadens
TTASSKSL

SEQ ID NO: 2781291 - protein, 8 aa, Entamoeba invadens
TTATASTH

SEQ ID NO: 2781292 - protein, 5 aa, Entamoeba invadens
TTATP

SEQ ID NO: 2781293 - protein, 8 aa, Entamoeba invadens
TTATQNTI

SEQ ID NO: 2781294 - protein, 24 aa, Entamoeba invadens
TTCAEDQYYDGATEKSECNKCTNG

SEQ ID NO: 2781295 - protein, 6 aa, Entamoeba invadens
TTCDSS

SEQ ID NO: 2781296 - protein, 4 aa, Entamoeba invadens
TTCE

SEQ ID NO: 2781297 - protein, 13 aa, Entamoeba invadens
TTCETQTGQCTSC

SEQ ID NO: 2781298 - protein, 12 aa, Entamoeba invadens
TTCGDDCNATTG

SEQ ID NO: 2781299 - protein, 10 aa, Entamoeba invadens
TTCGGKCNTV

SEQ ID NO: 2781300 - protein, 6 aa, Entamoeba invadens
TTCGGS

SEQ ID NO: 2781301 - protein, 7 aa, Entamoeba invadens
TTCGGSC

SEQ ID NO: 2781302 - protein, 9 aa, Entamoeba invadens
TTCGNGEID

SEQ ID NO: 2781303 - protein, 5 aa, Entamoeba invadens
TTCKA

SEQ ID NO: 2781304 - protein, 6 aa, Entamoeba invadens
TTCKKE

SEQ ID NO: 2781305 - protein, 6 aa, Entamoeba invadens
TTCKNY

SEQ ID NO: 2781306 - protein, 11 aa, Entamoeba invadens
TTCKTDSNAIT

SEQ ID NO: 2781307 - protein, 4 aa, Entamoeba invadens
TTCN

SEQ ID NO: 2781308 - protein, 6 aa, Entamoeba invadens
TTCNTN

SEQ ID NO: 2781309 - protein, 10 aa, Entamoeba invadens
TTCPNNQVRD

SEQ ID NO: 2781310 - protein, 13 aa, Entamoeba invadens
TTCQTNTCNTNNG

SEQ ID NO: 2781311 - protein, 5 aa, Entamoeba invadens
TTCRP

SEQ ID NO: 2781312 - protein, 4 aa, Entamoeba invadens
TTCS

SEQ ID NO: 2781313 - protein, 10 aa, Entamoeba invadens
TTCSGGQYLS

SEQ ID NO: 2781314 - protein, 8 aa, Entamoeba invadens
TTCSQSEG

SEQ ID NO: 2781315 - protein, 17 aa, Entamoeba invadens
TTCSSKSGSQQSDCTSC

SEQ ID NO: 2781316 - protein, 8 aa, Entamoeba invadens
TTCSTTTR

SEQ ID NO: 2781317 - protein, 12 aa, Entamoeba invadens
TTCTKCDPTCSQ

SEQ ID NO: 2781318 - protein, 9 aa, Entamoeba invadens
TTCTRCNSN

SEQ ID NO: 2781319 - protein, 6 aa, Entamoeba invadens
TTCTTP

SEQ ID NO: 2781320 - protein, 9 aa, Entamoeba invadens
TTDDPLKCE

SEQ ID NO: 2781321 - protein, 12 aa, Entamoeba invadens
TTDGAATCSGLD

SEQ ID NO: 2781322 - protein, 15 aa, Entamoeba invadens
TTDGASSMIGKEGGF

SEQ ID NO: 2781323 - protein, 19 aa, Entamoeba invadens
TTDGQNTQNAANRSRCQSE

SEQ ID NO: 2781324 - protein, 11 aa, Entamoeba invadens
TTDKCETCDSI

SEQ ID NO: 2781325 - protein, 6 aa, Entamoeba invadens
TTDKTT

SEQ ID NO: 2781326 - protein, 10 aa, Entamoeba invadens
TTDNPSKCER

SEQ ID NO: 2781327 - protein, 22 aa, Entamoeba invadens
TTDNTSLKTAKRRTQVTKRRET

SEQ ID NO: 2781328 - protein, 9 aa, Entamoeba invadens
TTDNYPQNG

SEQ ID NO: 2781329 - protein, 5 aa, Entamoeba invadens
TTDPL

SEQ ID NO: 2781330 - protein, 14 aa, Entamoeba invadens
TTDPTTKCDSCNTG

SEQ ID NO: 2781331 - protein, 10 aa, Entamoeba invadens
TTDPYGQRGT

SEQ ID NO: 2781332 - protein, 9 aa, Entamoeba invadens
TTDQSSILD

SEQ ID NO: 2781333 - protein, 5 aa, Entamoeba invadens
TTDSN

SEQ ID NO: 2781334 - protein, 13 aa, Entamoeba invadens
TTDTNCEANDGGA

SEQ ID NO: 2781335 - protein, 4 aa, Entamoeba invadens
TTDV

SEQ ID NO: 2781336 - protein, 12 aa, Entamoeba invadens
TTDVENKRYAPL

SEQ ID NO: 2781337 - protein, 7 aa, Entamoeba invadens
TTDVPSQ

SEQ ID NO: 2781338 - protein, 6 aa, Entamoeba invadens
TTDVTS

SEQ ID NO: 2781339 - protein, 4 aa, Entamoeba invadens
TTED

SEQ ID NO: 2781340 - protein, 7 aa, Entamoeba invadens
TTEDKDI

SEQ ID NO: 2781341 - protein, 9 aa, Entamoeba invadens
TTEDNISNE

SEQ ID NO: 2781342 - protein, 12 aa, Entamoeba invadens
TTEDSKSSRKPY

SEQ ID NO: 2781343 - protein, 14 aa, Entamoeba invadens
TTEGNCQSNNSNNC

SEQ ID NO: 2781344 - protein, 17 aa, Entamoeba invadens
TTEIGEECDSVSSNCNA

SEQ ID NO: 2781345 - protein, 8 aa, Entamoeba invadens
TTEIGEKG

SEQ ID NO: 2781346 - protein, 5 aa, Entamoeba invadens
TTEKC

SEQ ID NO: 2781347 - protein, 7 aa, Entamoeba invadens
TTEKCDA

SEQ ID NO: 2781348 - protein, 7 aa, Entamoeba invadens
TTEKCDK

SEQ ID NO: 2781349 - protein, 9 aa, Entamoeba invadens
TTEKDEVPT

SEQ ID NO: 2781350 - protein, 6 aa, Entamoeba invadens
TTEKNR

SEQ ID NO: 2781351 - protein, 28 aa, Entamoeba invadens
TTEMNSNKRCENKNCSIPNDQNGRCSSP

SEQ ID NO: 2781352 - protein, 4 aa, Entamoeba invadens
TTEN

SEQ ID NO: 2781353 - protein, 5 aa, Entamoeba invadens
TTENG

SEQ ID NO: 2781354 - protein, 9 aa, Entamoeba invadens
TTENSTRLD

SEQ ID NO: 2781355 - protein, 5 aa, Entamoeba invadens
TTEPP

SEQ ID NO: 2781356 - protein, 6 aa, Entamoeba invadens
TTEQGL

SEQ ID NO: 2781357 - protein, 8 aa, Entamoeba invadens
TTEQIERE

SEQ ID NO: 2781358 - protein, 9 aa, Entamoeba invadens
TTEQRDNYT

SEQ ID NO: 2781359 - protein, 8 aa, Entamoeba invadens
TTEQSTRI

SEQ ID NO: 2781360 - protein, 9 aa, Entamoeba invadens
TTEQSTRID

SEQ ID NO: 2781361 - protein, 8 aa, Entamoeba invadens
TTEQSYVS

SEQ ID NO: 2781362 - protein, 9 aa, Entamoeba invadens
TTERYGEEC

SEQ ID NO: 2781363 - protein, 8 aa, Entamoeba invadens
TTESCEQC

SEQ ID NO: 2781364 - protein, 4 aa, Entamoeba invadens
TTET

SEQ ID NO: 2781365 - protein, 11 aa, Entamoeba invadens
TTETASTTKNS

SEQ ID NO: 2781366 - protein, 13 aa, Entamoeba invadens
TTETDNRKSDSAI

SEQ ID NO: 2781367 - protein, 13 aa, Entamoeba invadens
TTETNELGDKAKD

SEQ ID NO: 2781368 - protein, 8 aa, Entamoeba invadens
TTETNTKD

SEQ ID NO: 2781369 - protein, 14 aa, Entamoeba invadens
TTETTQQETPEAEN

SEQ ID NO: 2781370 - protein, 4 aa, Entamoeba invadens
TTEV

SEQ ID NO: 2781371 - protein, 21 aa, Entamoeba invadens
TTEYYTKPAPCTPRGDQNEKV

SEQ ID NO: 2781372 - protein, 7 aa, Entamoeba invadens
TTFDQSS

SEQ ID NO: 2781373 - protein, 8 aa, Entamoeba invadens
TTFGRKSE

SEQ ID NO: 2781374 - protein, 5 aa, Entamoeba invadens
TTFKN

SEQ ID NO: 2781375 - protein, 4 aa, Entamoeba invadens
TTFS

SEQ ID NO: 2781376 - protein, 9 aa, Entamoeba invadens
TTFTNAGKT

SEQ ID NO: 2781377 - protein, 12 aa, Entamoeba invadens
TTFTSNKKSVVQ

SEQ ID NO: 2781378 - protein, 4 aa, Entamoeba invadens
TTGC

SEQ ID NO: 2781379 - protein, 5 aa, Entamoeba invadens
TTGCS

SEQ ID NO: 2781380 - protein, 7 aa, Entamoeba invadens
TTGECTS

SEQ ID NO: 2781381 - protein, 6 aa, Entamoeba invadens
TTGEDT

SEQ ID NO: 2781382 - protein, 5 aa, Entamoeba invadens
TTGEV

SEQ ID NO: 2781383 - protein, 8 aa, Entamoeba invadens
TTGGNHCS

SEQ ID NO: 2781384 - protein, 14 aa, Entamoeba invadens
TTGGRLAQTAKTPN

SEQ ID NO: 2781385 - protein, 6 aa, Entamoeba invadens
TTGTIE

SEQ ID NO: 2781386 - protein, 5 aa, Entamoeba invadens
TTGTL

SEQ ID NO: 2781387 - protein, 5 aa, Entamoeba invadens
TTGVA

SEQ ID NO: 2781388 - protein, 11 aa, Entamoeba invadens
TTGVTINSSGC

SEQ ID NO: 2781389 - protein, 9 aa, Entamoeba invadens
TTGYDPNTI

SEQ ID NO: 2781390 - protein, 15 aa, Entamoeba invadens
TTGYYSLGGSSGCRT

SEQ ID NO: 2781391 - protein, 19 aa, Entamoeba invadens
TTHENCSSCSVDGNCTECK

SEQ ID NO: 2781392 - protein, 4 aa, Entamoeba invadens
TTHH

SEQ ID NO: 2781393 - protein, 8 aa, Entamoeba invadens
TTHKNGSE

SEQ ID NO: 2781394 - protein, 6 aa, Entamoeba invadens
TTHKPA

SEQ ID NO: 2781395 - protein, 6 aa, Entamoeba invadens
TTHPIG

SEQ ID NO: 2781396 - protein, 5 aa, Entamoeba invadens
TTHPL

SEQ ID NO: 2781397 - protein, 6 aa, Entamoeba invadens
TTHPNP

SEQ ID NO: 2781398 - protein, 4 aa, Entamoeba invadens
TTHT

SEQ ID NO: 2781399 - protein, 9 aa, Entamoeba invadens
TTHTSPGLD

SEQ ID NO: 2781400 - protein, 12 aa, Entamoeba invadens
TTHTTAKTTESH

SEQ ID NO: 2781401 - protein, 13 aa, Entamoeba invadens
TTHYNNTLQTKEM

SEQ ID NO: 2781402 - protein, 11 aa, Entamoeba invadens
TTIDIDEGKTF

SEQ ID NO: 2781403 - protein, 6 aa, Entamoeba invadens
TTIDPK

SEQ ID NO: 2781404 - protein, 4 aa, Entamoeba invadens
TTIE

SEQ ID NO: 2781405 - protein, 5 aa, Entamoeba invadens
TTIGA

SEQ ID NO: 2781406 - protein, 7 aa, Entamoeba invadens
TTIGANS

SEQ ID NO: 2781407 - protein, 7 aa, Entamoeba invadens
TTIGDKT

SEQ ID NO: 2781408 - protein, 7 aa, Entamoeba invadens
TTIGSNQ

SEQ ID NO: 2781409 - protein, 19 aa, Entamoeba invadens
TTIKEDSTDHCQESTSKGC

SEQ ID NO: 2781410 - protein, 10 aa, Entamoeba invadens
TTIKSDKFDR

SEQ ID NO: 2781411 - protein, 4 aa, Entamoeba invadens
TTIN

SEQ ID NO: 2781412 - protein, 6 aa, Entamoeba invadens
TTINGS

SEQ ID NO: 2781413 - protein, 13 aa, Entamoeba invadens
TTINSVNSTQEGE

SEQ ID NO: 2781414 - protein, 4 aa, Entamoeba invadens
TTIP

SEQ ID NO: 2781415 - protein, 7 aa, Entamoeba invadens
TTIPSDL

SEQ ID NO: 2781416 - protein, 11 aa, Entamoeba invadens
TTIQTRNETTL

SEQ ID NO: 2781417 - protein, 4 aa, Entamoeba invadens
TTIT

SEQ ID NO: 2781418 - protein, 8 aa, Entamoeba invadens
TTITANTN

SEQ ID NO: 2781419 - protein, 16 aa, Entamoeba invadens
TTITDNSDVTTYEESS

SEQ ID NO: 2781420 - protein, 9 aa, Entamoeba invadens
TTITPSDGI

SEQ ID NO: 2781421 - protein, 13 aa, Entamoeba invadens
TTITSDGKCYPTD

SEQ ID NO: 2781422 - protein, 14 aa, Entamoeba invadens
TTITSDGKCYSTDN

SEQ ID NO: 2781423 - protein, 5 aa, Entamoeba invadens
TTITT

SEQ ID NO: 2781424 - protein, 10 aa, Entamoeba invadens
TTITTPAGSG

SEQ ID NO: 2781425 - protein, 7 aa, Entamoeba invadens
TTKAGET

SEQ ID NO: 2781426 - protein, 8 aa, Entamoeba invadens
TTKAGYDY

SEQ ID NO: 2781427 - protein, 7 aa, Entamoeba invadens
TTKAHQV

SEQ ID NO: 2781428 - protein, 9 aa, Entamoeba invadens
TTKCEKCGD

SEQ ID NO: 2781429 - protein, 10 aa, Entamoeba invadens
TTKCQSGRGE

SEQ ID NO: 2781430 - protein, 24 aa, Entamoeba invadens
TTKDKCDKYKIRTEPKIVTLKSGF

SEQ ID NO: 2781431 - protein, 16 aa, Entamoeba invadens
TTKDKCNKYKIRTEPQ

SEQ ID NO: 2781432 - protein, 7 aa, Entamoeba invadens
TTKDKID

SEQ ID NO: 2781433 - protein, 15 aa, Entamoeba invadens
TTKDNCDKYTIRTEP

SEQ ID NO: 2781434 - protein, 15 aa, Entamoeba invadens
TTKEEQTAESNQVIE

SEQ ID NO: 2781435 - protein, 6 aa, Entamoeba invadens
TTKEGC

SEQ ID NO: 2781436 - protein, 15 aa, Entamoeba invadens
TTKEGCDKYSIRTEP

SEQ ID NO: 2781437 - protein, 15 aa, Entamoeba invadens
TTKENCEKYSIRTEP

SEQ ID NO: 2781438 - protein, 24 aa, Entamoeba invadens
TTKFGNGEDGNPTPKVPPTLPPKN

SEQ ID NO: 2781439 - protein, 13 aa, Entamoeba invadens
TTKGYAADCQGCT

SEQ ID NO: 2781440 - protein, 7 aa, Entamoeba invadens
TTKKFGK

SEQ ID NO: 2781441 - protein, 8 aa, Entamoeba invadens
TTKKYTPQ

SEQ ID NO: 2781442 - protein, 10 aa, Entamoeba invadens
TTKLDPDELV

SEQ ID NO: 2781443 - protein, 7 aa, Entamoeba invadens
TTKLDPN

SEQ ID NO: 2781444 - protein, 4 aa, Entamoeba invadens
TTKM

SEQ ID NO: 2781445 - protein, 4 aa, Entamoeba invadens
TTKN

SEQ ID NO: 2781446 - protein, 7 aa, Entamoeba invadens
TTKNDIE

SEQ ID NO: 2781447 - protein, 5 aa, Entamoeba invadens
TTKNL

SEQ ID NO: 2781448 - protein, 9 aa, Entamoeba invadens
TTKNSDRAT

SEQ ID NO: 2781449 - protein, 16 aa, Entamoeba invadens
TTKNSIKSSTVDNENL

SEQ ID NO: 2781450 - protein, 25 aa, Entamoeba invadens
TTKPPKSSMLKNSQSDSSVKHTQST

SEQ ID NO: 2781451 - protein, 18 aa, Entamoeba invadens
TTKPTGYTRIDPDRYQRQ

SEQ ID NO: 2781452 - protein, 9 aa, Entamoeba invadens
TTKPTTIGA

SEQ ID NO: 2781453 - protein, 6 aa, Entamoeba invadens
TTKPTV

SEQ ID NO: 2781454 - protein, 5 aa, Entamoeba invadens
TTKQN

SEQ ID NO: 2781455 - protein, 14 aa, Entamoeba invadens
TTKQNQPGYATEVT

SEQ ID NO: 2781456 - protein, 9 aa, Entamoeba invadens
TTKQQKVSG

SEQ ID NO: 2781457 - protein, 8 aa, Entamoeba invadens
TTKQSTKL

SEQ ID NO: 2781458 - protein, 9 aa, Entamoeba invadens
TTKQSTRID

SEQ ID NO: 2781459 - protein, 7 aa, Entamoeba invadens
TTKRTIT

SEQ ID NO: 2781460 - protein, 18 aa, Entamoeba invadens
TTKSAQWKTISSSEDYTI

SEQ ID NO: 2781461 - protein, 7 aa, Entamoeba invadens
TTKSATV

SEQ ID NO: 2781462 - protein, 8 aa, Entamoeba invadens
TTKSDRIQ

SEQ ID NO: 2781463 - protein, 7 aa, Entamoeba invadens
TTKSEKI

SEQ ID NO: 2781464 - protein, 9 aa, Entamoeba invadens
TTKSENEKI

SEQ ID NO: 2781465 - protein, 9 aa, Entamoeba invadens
TTKSETVEK

SEQ ID NO: 2781466 - protein, 5 aa, Entamoeba invadens
TTKSF

SEQ ID NO: 2781467 - protein, 9 aa, Entamoeba invadens
TTKSNCEKY

SEQ ID NO: 2781468 - protein, 5 aa, Entamoeba invadens
TTKSV

SEQ ID NO: 2781469 - protein, 11 aa, Entamoeba invadens
TTKTCHQGGDV

SEQ ID NO: 2781470 - protein, 7 aa, Entamoeba invadens
TTKTFGK

SEQ ID NO: 2781471 - protein, 8 aa, Entamoeba invadens
TTKTNCDK

SEQ ID NO: 2781472 - protein, 7 aa, Entamoeba invadens
TTKTQDE

SEQ ID NO: 2781473 - protein, 12 aa, Entamoeba invadens
TTKTSEWRTGEI

SEQ ID NO: 2781474 - protein, 8 aa, Entamoeba invadens
TTKTTLTS

SEQ ID NO: 2781475 - protein, 6 aa, Entamoeba invadens
TTKVEG

SEQ ID NO: 2781476 - protein, 10 aa, Entamoeba invadens
TTKVEQPGSL

SEQ ID NO: 2781477 - protein, 10 aa, Entamoeba invadens
TTKYPDDRTK

SEQ ID NO: 2781478 - protein, 11 aa, Entamoeba invadens
TTKYPDETTGM

SEQ ID NO: 2781479 - protein, 10 aa, Entamoeba invadens
TTKYPDETTK

SEQ ID NO: 2781480 - protein, 13 aa, Entamoeba invadens
TTKYTTKRTDFGE

SEQ ID NO: 2781481 - protein, 15 aa, Entamoeba invadens
TTLAKEINTSKNLTS

SEQ ID NO: 2781482 - protein, 5 aa, Entamoeba invadens
TTLDD

SEQ ID NO: 2781483 - protein, 6 aa, Entamoeba invadens
TTLGNC

SEQ ID NO: 2781484 - protein, 4 aa, Entamoeba invadens
TTLN

SEQ ID NO: 2781485 - protein, 9 aa, Entamoeba invadens
TTLNNTSMT

SEQ ID NO: 2781486 - protein, 4 aa, Entamoeba invadens
TTLP

SEQ ID NO: 2781487 - protein, 8 aa, Entamoeba invadens
TTLPPRVK

SEQ ID NO: 2781488 - protein, 4 aa, Entamoeba invadens
TTLS

SEQ ID NO: 2781489 - protein, 10 aa, Entamoeba invadens
TTLSAQPGKR

SEQ ID NO: 2781490 - protein, 11 aa, Entamoeba invadens
TTLSQTTTGVI

SEQ ID NO: 2781491 - protein, 4 aa, Entamoeba invadens
TTLT

SEQ ID NO: 2781492 - protein, 8 aa, Entamoeba invadens
TTLTGNAT

SEQ ID NO: 2781493 - protein, 15 aa, Entamoeba invadens
TTLTGNLPSPNLEES

SEQ ID NO: 2781494 - protein, 8 aa, Entamoeba invadens
TTLTVGDT

SEQ ID NO: 2781495 - protein, 4 aa, Entamoeba invadens
TTME

SEQ ID NO: 2781496 - protein, 4 aa, Entamoeba invadens
TTMS

SEQ ID NO: 2781497 - protein, 6 aa, Entamoeba invadens
TTMSGS

SEQ ID NO: 2781498 - protein, 5 aa, Entamoeba invadens
TTMTA

SEQ ID NO: 2781499 - protein, 8 aa, Entamoeba invadens
TTNANCPV

SEQ ID NO: 2781500 - protein, 5 aa, Entamoeba invadens
TTNCN

SEQ ID NO: 2781501 - protein, 8 aa, Entamoeba invadens
TTNDEPSI

SEQ ID NO: 2781502 - protein, 8 aa, Entamoeba invadens
TTNDETTL

SEQ ID NO: 2781503 - protein, 5 aa, Entamoeba invadens
TTNDY

SEQ ID NO: 2781504 - protein, 9 aa, Entamoeba invadens
TTNEAQKKI

SEQ ID NO: 2781505 - protein, 9 aa, Entamoeba invadens
TTNENGKFD

SEQ ID NO: 2781506 - protein, 5 aa, Entamoeba invadens
TTNGC

SEQ ID NO: 2781507 - protein, 10 aa, Entamoeba invadens
TTNGDCSITS

SEQ ID NO: 2781508 - protein, 8 aa, Entamoeba invadens
TTNGLTSI

SEQ ID NO: 2781509 - protein, 5 aa, Entamoeba invadens
TTNGN

SEQ ID NO: 2781510 - protein, 21 aa, Entamoeba invadens
TTNGSVAKLEDTTTNKTKPNL

SEQ ID NO: 2781511 - protein, 11 aa, Entamoeba invadens
TTNGYEGTGRS

SEQ ID NO: 2781512 - protein, 5 aa, Entamoeba invadens
TTNIN

SEQ ID NO: 2781513 - protein, 16 aa, Entamoeba invadens
TTNKRSTQLNSNHNER

SEQ ID NO: 2781514 - protein, 25 aa, Entamoeba invadens
TTNKSTPKSENIEDNTNCDVKTTKG

SEQ ID NO: 2781515 - protein, 6 aa, Entamoeba invadens
TTNKTD

SEQ ID NO: 2781516 - protein, 4 aa, Entamoeba invadens
TTNL

SEQ ID NO: 2781517 - protein, 5 aa, Entamoeba invadens
TTNNA

SEQ ID NO: 2781518 - protein, 20 aa, Entamoeba invadens
TTNNELKIDANSDFTIQGDN

SEQ ID NO: 2781519 - protein, 8 aa, Entamoeba invadens
TTNNEVPG

SEQ ID NO: 2781520 - protein, 9 aa, Entamoeba invadens
TTNNNQKSF

SEQ ID NO: 2781521 - protein, 7 aa, Entamoeba invadens
TTNNTRT

SEQ ID NO: 2781522 - protein, 11 aa, Entamoeba invadens
TTNNVIQREKK

SEQ ID NO: 2781523 - protein, 5 aa, Entamoeba invadens
TTNPH

SEQ ID NO: 2781524 - protein, 8 aa, Entamoeba invadens
TTNPQQPY

SEQ ID NO: 2781525 - protein, 10 aa, Entamoeba invadens
TTNQKMTDTT

SEQ ID NO: 2781526 - protein, 6 aa, Entamoeba invadens
TTNQYM

SEQ ID NO: 2781527 - protein, 19 aa, Entamoeba invadens
TTNRSKEVKAIQNVHFKIQ

SEQ ID NO: 2781528 - protein, 6 aa, Entamoeba invadens
TTNSAE

SEQ ID NO: 2781529 - protein, 6 aa, Entamoeba invadens
TTNSAV

SEQ ID NO: 2781530 - protein, 12 aa, Entamoeba invadens
TTNSGTTETLKS

SEQ ID NO: 2781531 - protein, 11 aa, Entamoeba invadens
TTNSGTTTADC

SEQ ID NO: 2781532 - protein, 6 aa, Entamoeba invadens
TTNSIE

SEQ ID NO: 2781533 - protein, 11 aa, Entamoeba invadens
TTNSKCSKCEA

SEQ ID NO: 2781534 - protein, 9 aa, Entamoeba invadens
TTNSKYSIG

SEQ ID NO: 2781535 - protein, 6 aa, Entamoeba invadens
TTNSLQ

SEQ ID NO: 2781536 - protein, 10 aa, Entamoeba invadens
TTNSNKDNVR

SEQ ID NO: 2781537 - protein, 8 aa, Entamoeba invadens
TTNSNSQI

SEQ ID NO: 2781538 - protein, 15 aa, Entamoeba invadens
TTNSTQLSCSPGCSS

SEQ ID NO: 2781539 - protein, 5 aa, Entamoeba invadens
TTNSV

SEQ ID NO: 2781540 - protein, 10 aa, Entamoeba invadens
TTNTHLNSTD

SEQ ID NO: 2781541 - protein, 8 aa, Entamoeba invadens
TTNTNMTT

SEQ ID NO: 2781542 - protein, 5 aa, Entamoeba invadens
TTNTQ

SEQ ID NO: 2781543 - protein, 9 aa, Entamoeba invadens
TTNTQNKPI

SEQ ID NO: 2781544 - protein, 4 aa, Entamoeba invadens
TTNY

SEQ ID NO: 2781545 - protein, 14 aa, Entamoeba invadens
TTNYKTNDGDCLPQ

SEQ ID NO: 2781546 - protein, 14 aa, Entamoeba invadens
TTNYRTKSGDCLPQ

SEQ ID NO: 2781547 - protein, 4 aa, Entamoeba invadens
TTPA

SEQ ID NO: 2781548 - protein, 10 aa, Entamoeba invadens
TTPASGSAKC

SEQ ID NO: 2781549 - protein, 7 aa, Entamoeba invadens
TTPDNKV

SEQ ID NO: 2781550 - protein, 8 aa, Entamoeba invadens
TTPFEEND

SEQ ID NO: 2781551 - protein, 11 aa, Entamoeba invadens
TTPFTTQLDDK

SEQ ID NO: 2781552 - protein, 18 aa, Entamoeba invadens
TTPGYVTKRNQSVYESRY

SEQ ID NO: 2781553 - protein, 4 aa, Entamoeba invadens
TTPI

SEQ ID NO: 2781554 - protein, 8 aa, Entamoeba invadens
TTPKGPNC

SEQ ID NO: 2781555 - protein, 4 aa, Entamoeba invadens
TTPL

SEQ ID NO: 2781556 - protein, 12 aa, Entamoeba invadens
TTPLESSKCATS

SEQ ID NO: 2781557 - protein, 11 aa, Entamoeba invadens
TTPLSDGQQHY

SEQ ID NO: 2781558 - protein, 6 aa, Entamoeba invadens
TTPMKQ

SEQ ID NO: 2781559 - protein, 5 aa, Entamoeba invadens
TTPNY

SEQ ID NO: 2781560 - protein, 7 aa, Entamoeba invadens
TTPPDTF

SEQ ID NO: 2781561 - protein, 5 aa, Entamoeba invadens
TTPPL

SEQ ID NO: 2781562 - protein, 7 aa, Entamoeba invadens
TTPPPEQ

SEQ ID NO: 2781563 - protein, 6 aa, Entamoeba invadens
TTPQGM

SEQ ID NO: 2781564 - protein, 11 aa, Entamoeba invadens
TTPQQKNGATK

SEQ ID NO: 2781565 - protein, 5 aa, Entamoeba invadens
TTPQR

SEQ ID NO: 2781566 - protein, 5 aa, Entamoeba invadens
TTPSG

SEQ ID NO: 2781567 - protein, 5 aa, Entamoeba invadens
TTPSK

SEQ ID NO: 2781568 - protein, 8 aa, Entamoeba invadens
TTPSKKNI

SEQ ID NO: 2781569 - protein, 5 aa, Entamoeba invadens
TTPSY

SEQ ID NO: 2781570 - protein, 4 aa, Entamoeba invadens
TTPT

SEQ ID NO: 2781571 - protein, 7 aa, Entamoeba invadens
TTPTERK

SEQ ID NO: 2781572 - protein, 4 aa, Entamoeba invadens
TTPW

SEQ ID NO: 2781573 - protein, 4 aa, Entamoeba invadens
TTQG

SEQ ID NO: 2781574 - protein, 6 aa, Entamoeba invadens
TTQGGP

SEQ ID NO: 2781575 - protein, 4 aa, Entamoeba invadens
TTQH

SEQ ID NO: 2781576 - protein, 5 aa, Entamoeba invadens
TTQHN

SEQ ID NO: 2781577 - protein, 13 aa, Entamoeba invadens
TTQITTNRDPSEV

SEQ ID NO: 2781578 - protein, 4 aa, Entamoeba invadens
TTQN

SEQ ID NO: 2781579 - protein, 9 aa, Entamoeba invadens
TTQNDEDKF

SEQ ID NO: 2781580 - protein, 14 aa, Entamoeba invadens
TTQNDEDKYESECS

SEQ ID NO: 2781581 - protein, 10 aa, Entamoeba invadens
TTQNDKEKFE

SEQ ID NO: 2781582 - protein, 6 aa, Entamoeba invadens
TTQNDL

SEQ ID NO: 2781583 - protein, 15 aa, Entamoeba invadens
TTQNFQSGVNKTDGY

SEQ ID NO: 2781584 - protein, 6 aa, Entamoeba invadens
TTQNLS

SEQ ID NO: 2781585 - protein, 4 aa, Entamoeba invadens
TTQP

SEQ ID NO: 2781586 - protein, 6 aa, Entamoeba invadens
TTQPNM

SEQ ID NO: 2781587 - protein, 9 aa, Entamoeba invadens
TTQPPQSLK

SEQ ID NO: 2781588 - protein, 8 aa, Entamoeba invadens
TTQQTKGL

SEQ ID NO: 2781589 - protein, 6 aa, Entamoeba invadens
TTQSCT

SEQ ID NO: 2781590 - protein, 15 aa, Entamoeba invadens
TTQSSSEKYTIRTEP

SEQ ID NO: 2781591 - protein, 6 aa, Entamoeba invadens
TTQTFS

SEQ ID NO: 2781592 - protein, 6 aa, Entamoeba invadens
TTQTKN

SEQ ID NO: 2781593 - protein, 8 aa, Entamoeba invadens
TTQTNVTT

SEQ ID NO: 2781594 - protein, 4 aa, Entamoeba invadens
TTQV

SEQ ID NO: 2781595 - protein, 13 aa, Entamoeba invadens
TTQVKDGVTVSYP

SEQ ID NO: 2781596 - protein, 11 aa, Entamoeba invadens
TTREFNAKYGD

SEQ ID NO: 2781597 - protein, 11 aa, Entamoeba invadens
TTREISNTEVT

SEQ ID NO: 2781598 - protein, 7 aa, Entamoeba invadens
TTRGDCD

SEQ ID NO: 2781599 - protein, 5 aa, Entamoeba invadens
TTRGK

SEQ ID NO: 2781600 - protein, 10 aa, Entamoeba invadens
TTRHESTNFA

SEQ ID NO: 2781601 - protein, 10 aa, Entamoeba invadens
TTRKEPSQFS

SEQ ID NO: 2781602 - protein, 6 aa, Entamoeba invadens
TTRKSV

SEQ ID NO: 2781603 - protein, 5 aa, Entamoeba invadens
TTRLD

SEQ ID NO: 2781604 - protein, 19 aa, Entamoeba invadens
TTRLDPDELKEDKKLGEGS

SEQ ID NO: 2781605 - protein, 4 aa, Entamoeba invadens
TTRN

SEQ ID NO: 2781606 - protein, 8 aa, Entamoeba invadens
TTRSIENR

SEQ ID NO: 2781607 - protein, 17 aa, Entamoeba invadens
TTRTQRNVTRSLDNSEL

SEQ ID NO: 2781608 - protein, 5 aa, Entamoeba invadens
TTRVG

SEQ ID NO: 2781609 - protein, 11 aa, Entamoeba invadens
TTRVNTNYDGL

SEQ ID NO: 2781610 - protein, 6 aa, Entamoeba invadens
TTRVVG

SEQ ID NO: 2781611 - protein, 13 aa, Entamoeba invadens
TTSAETITTNNNS

SEQ ID NO: 2781612 - protein, 9 aa, Entamoeba invadens
TTSAKESYE

SEQ ID NO: 2781613 - protein, 6 aa, Entamoeba invadens
TTSAYH

SEQ ID NO: 2781614 - protein, 19 aa, Entamoeba invadens
TTSDNCDTCQGGFTPNGTE

SEQ ID NO: 2781615 - protein, 7 aa, Entamoeba invadens
TTSEEDE

SEQ ID NO: 2781616 - protein, 26 aa, Entamoeba invadens
TTSEEMTEASGTCTDCSTRGCTTCNS

SEQ ID NO: 2781617 - protein, 9 aa, Entamoeba invadens
TTSEEMTES

SEQ ID NO: 2781618 - protein, 9 aa, Entamoeba invadens
TTSELPRVR

SEQ ID NO: 2781619 - protein, 5 aa, Entamoeba invadens
TTSFE

SEQ ID NO: 2781620 - protein, 4 aa, Entamoeba invadens
TTSG

SEQ ID NO: 2781621 - protein, 13 aa, Entamoeba invadens
TTSGSCASSCDVQ

SEQ ID NO: 2781622 - protein, 9 aa, Entamoeba invadens
TTSGSTAIS

SEQ ID NO: 2781623 - protein, 6 aa, Entamoeba invadens
TTSGTC

SEQ ID NO: 2781624 - protein, 22 aa, Entamoeba invadens
TTSGTCTPWPPVNPKQKVKCPS

SEQ ID NO: 2781625 - protein, 4 aa, Entamoeba invadens
TTSH

SEQ ID NO: 2781626 - protein, 23 aa, Entamoeba invadens
TTSHYNSSTANKIENNEGCTNQV

SEQ ID NO: 2781627 - protein, 9 aa, Entamoeba invadens
TTSKKNGYV

SEQ ID NO: 2781628 - protein, 10 aa, Entamoeba invadens
TTSMEEIEKD

SEQ ID NO: 2781629 - protein, 10 aa, Entamoeba invadens
TTSMEEIEKT

SEQ ID NO: 2781630 - protein, 5 aa, Entamoeba invadens
TTSMK

SEQ ID NO: 2781631 - protein, 8 aa, Entamoeba invadens
TTSNASIS

SEQ ID NO: 2781632 - protein, 5 aa, Entamoeba invadens
TTSNG

SEQ ID NO: 2781633 - protein, 5 aa, Entamoeba invadens
TTSNP

SEQ ID NO: 2781634 - protein, 6 aa, Entamoeba invadens
TTSNRP

SEQ ID NO: 2781635 - protein, 10 aa, Entamoeba invadens
TTSNTCKTCD

SEQ ID NO: 2781636 - protein, 12 aa, Entamoeba invadens
TTSNTCKTCDSP

SEQ ID NO: 2781637 - protein, 7 aa, Entamoeba invadens
TTSNTKC

SEQ ID NO: 2781638 - protein, 5 aa, Entamoeba invadens
TTSNV

SEQ ID NO: 2781639 - protein, 10 aa, Entamoeba invadens
TTSPATYSTT

SEQ ID NO: 2781640 - protein, 8 aa, Entamoeba invadens
TTSPCNSQ

SEQ ID NO: 2781641 - protein, 6 aa, Entamoeba invadens
TTSPKI

SEQ ID NO: 2781642 - protein, 13 aa, Entamoeba invadens
TTSPLPNCTESRN

SEQ ID NO: 2781643 - protein, 24 aa, Entamoeba invadens
TTSQQWQNKKGVQVTSASEKSQFE

SEQ ID NO: 2781644 - protein, 6 aa, Entamoeba invadens
TTSQRK

SEQ ID NO: 2781645 - protein, 19 aa, Entamoeba invadens
TTSQVTIGEAGFKNSPSLH

SEQ ID NO: 2781646 - protein, 7 aa, Entamoeba invadens
TTSQYNT

SEQ ID NO: 2781647 - protein, 6 aa, Entamoeba invadens
TTSREC

SEQ ID NO: 2781648 - protein, 8 aa, Entamoeba invadens
TTSSGELR

SEQ ID NO: 2781649 - protein, 7 aa, Entamoeba invadens
TTSSLSG

SEQ ID NO: 2781650 - protein, 8 aa, Entamoeba invadens
TTSSPPSN

SEQ ID NO: 2781651 - protein, 5 aa, Entamoeba invadens
TTSSQ

SEQ ID NO: 2781652 - protein, 5 aa, Entamoeba invadens
TTSSR

SEQ ID NO: 2781653 - protein, 7 aa, Entamoeba invadens
TTSSRYR

SEQ ID NO: 2781654 - protein, 7 aa, Entamoeba invadens
TTSSTRL

SEQ ID NO: 2781655 - protein, 11 aa, Entamoeba invadens
TTSSVQIDGTN

SEQ ID NO: 2781656 - protein, 4 aa, Entamoeba invadens
TTST

SEQ ID NO: 2781657 - protein, 5 aa, Entamoeba invadens
TTSTA

SEQ ID NO: 2781658 - protein, 11 aa, Entamoeba invadens
TTSTEITSSCT

SEQ ID NO: 2781659 - protein, 5 aa, Entamoeba invadens
TTSTP

SEQ ID NO: 2781660 - protein, 9 aa, Entamoeba invadens
TTSTPITVN

SEQ ID NO: 2781661 - protein, 13 aa, Entamoeba invadens
TTSVSNDKNGHFT

SEQ ID NO: 2781662 - protein, 7 aa, Entamoeba invadens
TTSWKDG

SEQ ID NO: 2781663 - protein, 6 aa, Entamoeba invadens
TTTAAT

SEQ ID NO: 2781664 - protein, 17 aa, Entamoeba invadens
TTTASCTPWPPANPKQK

SEQ ID NO: 2781665 - protein, 6 aa, Entamoeba invadens
TTTCES

SEQ ID NO: 2781666 - protein, 6 aa, Entamoeba invadens
TTTDPV

SEQ ID NO: 2781667 - protein, 6 aa, Entamoeba invadens
TTTEIT

SEQ ID NO: 2781668 - protein, 7 aa, Entamoeba invadens
TTTENGY

SEQ ID NO: 2781669 - protein, 6 aa, Entamoeba invadens
TTTENR

SEQ ID NO: 2781670 - protein, 7 aa, Entamoeba invadens
TTTEQGQ

SEQ ID NO: 2781671 - protein, 7 aa, Entamoeba invadens
TTTERGG

SEQ ID NO: 2781672 - protein, 4 aa, Entamoeba invadens
TTTF

SEQ ID NO: 2781673 - protein, 4 aa, Entamoeba invadens
TTTG

SEQ ID NO: 2781674 - protein, 8 aa, Entamoeba invadens
TTTGLPGS

SEQ ID NO: 2781675 - protein, 14 aa, Entamoeba invadens
TTTGRCTSCNPGYS

SEQ ID NO: 2781676 - protein, 7 aa, Entamoeba invadens
TTTIDQN

SEQ ID NO: 2781677 - protein, 6 aa, Entamoeba invadens
TTTIDR

SEQ ID NO: 2781678 - protein, 7 aa, Entamoeba invadens
TTTKDPF

SEQ ID NO: 2781679 - protein, 6 aa, Entamoeba invadens
TTTKET

SEQ ID NO: 2781680 - protein, 6 aa, Entamoeba invadens
TTTKGE

SEQ ID NO: 2781681 - protein, 11 aa, Entamoeba invadens
TTTKMGEKYGG

SEQ ID NO: 2781682 - protein, 12 aa, Entamoeba invadens
TTTKTCTQDPIE

SEQ ID NO: 2781683 - protein, 6 aa, Entamoeba invadens
TTTKTY

SEQ ID NO: 2781684 - protein, 6 aa, Entamoeba invadens
TTTKYL

SEQ ID NO: 2781685 - protein, 4 aa, Entamoeba invadens
TTTL

SEQ ID NO: 2781686 - protein, 10 aa, Entamoeba invadens
TTTLDGEVQS

SEQ ID NO: 2781687 - protein, 6 aa, Entamoeba invadens
TTTLPP

SEQ ID NO: 2781688 - protein, 12 aa, Entamoeba invadens
TTTNELNETSTA

SEQ ID NO: 2781689 - protein, 5 aa, Entamoeba invadens
TTTNG

SEQ ID NO: 2781690 - protein, 5 aa, Entamoeba invadens
TTTNT

SEQ ID NO: 2781691 - protein, 8 aa, Entamoeba invadens
TTTPEDGK

SEQ ID NO: 2781692 - protein, 9 aa, Entamoeba invadens
TTTPFTQST

SEQ ID NO: 2781693 - protein, 8 aa, Entamoeba invadens
TTTPSPAK

SEQ ID NO: 2781694 - protein, 15 aa, Entamoeba invadens
TTTPTAITSYTTQID

SEQ ID NO: 2781695 - protein, 5 aa, Entamoeba invadens
TTTQK

SEQ ID NO: 2781696 - protein, 10 aa, Entamoeba invadens
TTTQRQVKEA

SEQ ID NO: 2781697 - protein, 6 aa, Entamoeba invadens
TTTQTC

SEQ ID NO: 2781698 - protein, 9 aa, Entamoeba invadens
TTTQTCQSC

SEQ ID NO: 2781699 - protein, 4 aa, Entamoeba invadens
TTTR

SEQ ID NO: 2781700 - protein, 6 aa, Entamoeba invadens
TTTREG

SEQ ID NO: 2781701 - protein, 5 aa, Entamoeba invadens
TTTRQ

SEQ ID NO: 2781702 - protein, 6 aa, Entamoeba invadens
TTTSCI

SEQ ID NO: 2781703 - protein, 9 aa, Entamoeba invadens
TTTSGDDVK

SEQ ID NO: 2781704 - protein, 10 aa, Entamoeba invadens
TTTSGKRPNI

SEQ ID NO: 2781705 - protein, 5 aa, Entamoeba invadens
TTTSI

SEQ ID NO: 2781706 - protein, 8 aa, Entamoeba invadens
TTTSIGTE

SEQ ID NO: 2781707 - protein, 9 aa, Entamoeba invadens
TTTSTTKTA

SEQ ID NO: 2781708 - protein, 5 aa, Entamoeba invadens
TTTTC

SEQ ID NO: 2781709 - protein, 6 aa, Entamoeba invadens
TTTTEF

SEQ ID NO: 2781710 - protein, 11 aa, Entamoeba invadens
TTTTKCQKCAS

SEQ ID NO: 2781711 - protein, 12 aa, Entamoeba invadens
TTTTTSSCTDCK

SEQ ID NO: 2781712 - protein, 6 aa, Entamoeba invadens
TTTTYY

SEQ ID NO: 2781713 - protein, 15 aa, Entamoeba invadens
TTTTYYDTDDHQLRT

SEQ ID NO: 2781714 - protein, 10 aa, Entamoeba invadens
TTTTYYNTDD

SEQ ID NO: 2781715 - protein, 6 aa, Entamoeba invadens
TTTVDN

SEQ ID NO: 2781716 - protein, 6 aa, Entamoeba invadens
TTTYTI

SEQ ID NO: 2781717 - protein, 11 aa, Entamoeba invadens
TTTYYDTNDHK

SEQ ID NO: 2781718 - protein, 9 aa, Entamoeba invadens
TTTYYNTDD

SEQ ID NO: 2781719 - protein, 14 aa, Entamoeba invadens
TTTYYNTNDNQLHT

SEQ ID NO: 2781720 - protein, 4 aa, Entamoeba invadens
TTVC

SEQ ID NO: 2781721 - protein, 6 aa, Entamoeba invadens
TTVDSS

SEQ ID NO: 2781722 - protein, 4 aa, Entamoeba invadens
TTVE

SEQ ID NO: 2781723 - protein, 12 aa, Entamoeba invadens
TTVKKDGKTIID

SEQ ID NO: 2781724 - protein, 5 aa, Entamoeba invadens
TTVKR

SEQ ID NO: 2781725 - protein, 4 aa, Entamoeba invadens
TTVN

SEQ ID NO: 2781726 - protein, 6 aa, Entamoeba invadens
TTVQQR

SEQ ID NO: 2781727 - protein, 6 aa, Entamoeba invadens
TTVQTT

SEQ ID NO: 2781728 - protein, 8 aa, Entamoeba invadens
TTVSDTCT

SEQ ID NO: 2781729 - protein, 8 aa, Entamoeba invadens
TTVSGVTN

SEQ ID NO: 2781730 - protein, 8 aa, Entamoeba invadens
TTVSSTLS

SEQ ID NO: 2781731 - protein, 12 aa, Entamoeba invadens
TTVSVSKQTTIN

SEQ ID NO: 2781732 - protein, 18 aa, Entamoeba invadens
TTVTAKPPKFVPQKGDKR

SEQ ID NO: 2781733 - protein, 15 aa, Entamoeba invadens
TTYEENSYFDDTNTA

SEQ ID NO: 2781734 - protein, 6 aa, Entamoeba invadens
TTYQNS

SEQ ID NO: 2781735 - protein, 6 aa, Entamoeba invadens
TTYSNT

SEQ ID NO: 2781736 - protein, 5 aa, Entamoeba invadens
TTYTT

SEQ ID NO: 2781737 - protein, 15 aa, Entamoeba invadens
TVAEEFEQSEESLSQ

SEQ ID NO: 2781738 - protein, 9 aa, Entamoeba invadens
TVDDTEHSP

SEQ ID NO: 2781739 - protein, 4 aa, Entamoeba invadens
TVDE

SEQ ID NO: 2781740 - protein, 4 aa, Entamoeba invadens
TVDN

SEQ ID NO: 2781741 - protein, 9 aa, Entamoeba invadens
TVDPSNEIK

SEQ ID NO: 2781742 - protein, 19 aa, Entamoeba invadens
TVDRDDSSGTFPSGHVGET

SEQ ID NO: 2781743 - protein, 5 aa, Entamoeba invadens
TVDRE

SEQ ID NO: 2781744 - protein, 6 aa, Entamoeba invadens
TVDSER

SEQ ID NO: 2781745 - protein, 9 aa, Entamoeba invadens
TVDSSTRVL

SEQ ID NO: 2781746 - protein, 4 aa, Entamoeba invadens
TVEC

SEQ ID NO: 2781747 - protein, 7 aa, Entamoeba invadens
TVEDDYK

SEQ ID NO: 2781748 - protein, 6 aa, Entamoeba invadens
TVEDNT

SEQ ID NO: 2781749 - protein, 10 aa, Entamoeba invadens
TVEEEQYKYP

SEQ ID NO: 2781750 - protein, 20 aa, Entamoeba invadens
TVENPDLNNPDSYLDNTDRN

SEQ ID NO: 2781751 - protein, 7 aa, Entamoeba invadens
TVENSIS

SEQ ID NO: 2781752 - protein, 6 aa, Entamoeba invadens
TVEPFK

SEQ ID NO: 2781753 - protein, 7 aa, Entamoeba invadens
TVESPVN

SEQ ID NO: 2781754 - protein, 9 aa, Entamoeba invadens
TVESSTSIP

SEQ ID NO: 2781755 - protein, 5 aa, Entamoeba invadens
TVGEC

SEQ ID NO: 2781756 - protein, 11 aa, Entamoeba invadens
TVGEITQKIDT

SEQ ID NO: 2781757 - protein, 12 aa, Entamoeba invadens
TVGENSKTTYEV

SEQ ID NO: 2781758 - protein, 5 aa, Entamoeba invadens
TVGGR

SEQ ID NO: 2781759 - protein, 13 aa, Entamoeba invadens
TVGKEAPIGKENM

SEQ ID NO: 2781760 - protein, 10 aa, Entamoeba invadens
TVGKPVETPV

SEQ ID NO: 2781761 - protein, 8 aa, Entamoeba invadens
TVGKSDTW

SEQ ID NO: 2781762 - protein, 11 aa, Entamoeba invadens
TVGRNQSEQEL

SEQ ID NO: 2781763 - protein, 8 aa, Entamoeba invadens
TVGSRTKK

SEQ ID NO: 2781764 - protein, 8 aa, Entamoeba invadens
TVIPEGTF

SEQ ID NO: 2781765 - protein, 7 aa, Entamoeba invadens
TVKAQGG

SEQ ID NO: 2781766 - protein, 13 aa, Entamoeba invadens
TVKGGKDKKMNSL

SEQ ID NO: 2781767 - protein, 4 aa, Entamoeba invadens
TVKN

SEQ ID NO: 2781768 - protein, 6 aa, Entamoeba invadens
TVKPTL

SEQ ID NO: 2781769 - protein, 12 aa, Entamoeba invadens
TVKQPGDVSNDK

SEQ ID NO: 2781770 - protein, 14 aa, Entamoeba invadens
TVKTPDEKVVTEAD

SEQ ID NO: 2781771 - protein, 4 aa, Entamoeba invadens
TVLS

SEQ ID NO: 2781772 - protein, 16 aa, Entamoeba invadens
TVNDGKYKSPSPDEEA

SEQ ID NO: 2781773 - protein, 9 aa, Entamoeba invadens
TVNEEKSEI

SEQ ID NO: 2781774 - protein, 4 aa, Entamoeba invadens
TVNG

SEQ ID NO: 2781775 - protein, 6 aa, Entamoeba invadens
TVNKST

SEQ ID NO: 2781776 - protein, 5 aa, Entamoeba invadens
TVNNN

SEQ ID NO: 2781777 - protein, 16 aa, Entamoeba invadens
TVNNSTLNDPTCGGIP

SEQ ID NO: 2781778 - protein, 6 aa, Entamoeba invadens
TVNPSI

SEQ ID NO: 2781779 - protein, 7 aa, Entamoeba invadens
TVNPSKH

SEQ ID NO: 2781780 - protein, 40 aa, Entamoeba invadens
TVNQRKRKPYKTGKRSNDTDDECESTSPPKVDSLTPDNLQ

SEQ ID NO: 2781781 - protein, 9 aa, Entamoeba invadens
TVNSTTIID

SEQ ID NO: 2781782 - protein, 4 aa, Entamoeba invadens
TVNT

SEQ ID NO: 2781783 - protein, 6 aa, Entamoeba invadens
TVPCEN

SEQ ID NO: 2781784 - protein, 5 aa, Entamoeba invadens
TVPEE

SEQ ID NO: 2781785 - protein, 8 aa, Entamoeba invadens
TVPGNTVD

SEQ ID NO: 2781786 - protein, 12 aa, Entamoeba invadens
TVPKLPTKTNPK

SEQ ID NO: 2781787 - protein, 10 aa, Entamoeba invadens
TVPKPTSNTF

SEQ ID NO: 2781788 - protein, 6 aa, Entamoeba invadens
TVPNSV

SEQ ID NO: 2781789 - protein, 4 aa, Entamoeba invadens
TVPP

SEQ ID NO: 2781790 - protein, 5 aa, Entamoeba invadens
TVPSD

SEQ ID NO: 2781791 - protein, 7 aa, Entamoeba invadens
TVPSSVT

SEQ ID NO: 2781792 - protein, 6 aa, Entamoeba invadens
TVPTSD

SEQ ID NO: 2781793 - protein, 4 aa, Entamoeba invadens
TVQG

SEQ ID NO: 2781794 - protein, 7 aa, Entamoeba invadens
TVQRGGP

SEQ ID NO: 2781795 - protein, 8 aa, Entamoeba invadens
TVQSAQNV

SEQ ID NO: 2781796 - protein, 12 aa, Entamoeba invadens
TVQTTTKNSTKL

SEQ ID NO: 2781797 - protein, 5 aa, Entamoeba invadens
TVQTY

SEQ ID NO: 2781798 - protein, 7 aa, Entamoeba invadens
TVRGTST

SEQ ID NO: 2781799 - protein, 5 aa, Entamoeba invadens
TVRNA

SEQ ID NO: 2781800 - protein, 7 aa, Entamoeba invadens
TVRNDSL

SEQ ID NO: 2781801 - protein, 11 aa, Entamoeba invadens
TVRTENTTCEN

SEQ ID NO: 2781802 - protein, 7 aa, Entamoeba invadens
TVSASTC

SEQ ID NO: 2781803 - protein, 16 aa, Entamoeba invadens
TVSCGDGYYPDSDNNF

SEQ ID NO: 2781804 - protein, 5 aa, Entamoeba invadens
TVSCT

SEQ ID NO: 2781805 - protein, 4 aa, Entamoeba invadens
TVSE

SEQ ID NO: 2781806 - protein, 5 aa, Entamoeba invadens
TVSEA

SEQ ID NO: 2781807 - protein, 8 aa, Entamoeba invadens
TVSENGTF

SEQ ID NO: 2781808 - protein, 4 aa, Entamoeba invadens
TVSG

SEQ ID NO: 2781809 - protein, 5 aa, Entamoeba invadens
TVSGI

SEQ ID NO: 2781810 - protein, 20 aa, Entamoeba invadens
TVSKKKESAKKEETETVPQD

SEQ ID NO: 2781811 - protein, 9 aa, Entamoeba invadens
TVSNPAQRL

SEQ ID NO: 2781812 - protein, 6 aa, Entamoeba invadens
TVSPIT

SEQ ID NO: 2781813 - protein, 4 aa, Entamoeba invadens
TVSS

SEQ ID NO: 2781814 - protein, 5 aa, Entamoeba invadens
TVSTE

SEQ ID NO: 2781815 - protein, 4 aa, Entamoeba invadens
TVSV

SEQ ID NO: 2781816 - protein, 5 aa, Entamoeba invadens
TVSVG

SEQ ID NO: 2781817 - protein, 7 aa, Entamoeba invadens
TVTADQA

SEQ ID NO: 2781818 - protein, 21 aa, Entamoeba invadens
TVTANDAVTTYEESSFKNSGL

SEQ ID NO: 2781819 - protein, 11 aa, Entamoeba invadens
TVTAPKGTLGY

SEQ ID NO: 2781820 - protein, 5 aa, Entamoeba invadens
TVTAS

SEQ ID NO: 2781821 - protein, 4 aa, Entamoeba invadens
TVTM

SEQ ID NO: 2781822 - protein, 5 aa, Entamoeba invadens
TVTME

SEQ ID NO: 2781823 - protein, 5 aa, Entamoeba invadens
TVTNS

SEQ ID NO: 2781824 - protein, 10 aa, Entamoeba invadens
TVTPSIPQDQ

SEQ ID NO: 2781825 - protein, 5 aa, Entamoeba invadens
TVTQK

SEQ ID NO: 2781826 - protein, 10 aa, Entamoeba invadens
TVTRDEFNEK

SEQ ID NO: 2781827 - protein, 4 aa, Entamoeba invadens
TVTS

SEQ ID NO: 2781828 - protein, 25 aa, Entamoeba invadens
TVTSGDYEQCSKCEDGYSLNEGGKC

SEQ ID NO: 2781829 - protein, 5 aa, Entamoeba invadens
TVTSS

SEQ ID NO: 2781830 - protein, 10 aa, Entamoeba invadens
TVTTPVGTPT

SEQ ID NO: 2781831 - protein, 11 aa, Entamoeba invadens
TVVQSKNKVTV

SEQ ID NO: 2781832 - protein, 4 aa, Entamoeba invadens
TVYA

SEQ ID NO: 2781833 - protein, 6 aa, Entamoeba invadens
TVYNNT

SEQ ID NO: 2781834 - protein, 5 aa, Entamoeba invadens
TVYPE

SEQ ID NO: 2781835 - protein, 9 aa, Entamoeba invadens
TVYSDNRDK

SEQ ID NO: 2781836 - protein, 5 aa, Entamoeba invadens
TWADS

SEQ ID NO: 2781837 - protein, 5 aa, Entamoeba invadens
TWANE

SEQ ID NO: 2781838 - protein, 6 aa, Entamoeba invadens
TWGTST

SEQ ID NO: 2781839 - protein, 13 aa, Entamoeba invadens
TWKSDDLKKKLQL

SEQ ID NO: 2781840 - protein, 9 aa, Entamoeba invadens
TWNESSTRC

SEQ ID NO: 2781841 - protein, 11 aa, Entamoeba invadens
TWNGSDGNAHS

SEQ ID NO: 2781842 - protein, 4 aa, Entamoeba invadens
TWNN

SEQ ID NO: 2781843 - protein, 11 aa, Entamoeba invadens
TWNSLSSSEYI

SEQ ID NO: 2781844 - protein, 4 aa, Entamoeba invadens
TWQN

SEQ ID NO: 2781845 - protein, 5 aa, Entamoeba invadens
TWRGD

SEQ ID NO: 2781846 - protein, 9 aa, Entamoeba invadens
TWSDSQENE

SEQ ID NO: 2781847 - protein, 5 aa, Entamoeba invadens
TWSEQ

SEQ ID NO: 2781848 - protein, 6 aa, Entamoeba invadens
TWTRTA

SEQ ID NO: 2781849 - protein, 8 aa, Entamoeba invadens
TWTTPDNS

SEQ ID NO: 2781850 - protein, 4 aa, Entamoeba invadens
TWVG

SEQ ID NO: 2781851 - protein, 21 aa, Entamoeba invadens
TYAATAGSPTCTNCSTGSISV

SEQ ID NO: 2781852 - protein, 4 aa, Entamoeba invadens
TYAD

SEQ ID NO: 2781853 - protein, 11 aa, Entamoeba invadens
TYADDIESSEC

SEQ ID NO: 2781854 - protein, 10 aa, Entamoeba invadens
TYADQSKEDV

SEQ ID NO: 2781855 - protein, 6 aa, Entamoeba invadens
TYALEK

SEQ ID NO: 2781856 - protein, 10 aa, Entamoeba invadens
TYAPRDSKDI

SEQ ID NO: 2781857 - protein, 10 aa, Entamoeba invadens
TYAPSKSPSC

SEQ ID NO: 2781858 - protein, 6 aa, Entamoeba invadens
TYASQN

SEQ ID NO: 2781859 - protein, 13 aa, Entamoeba invadens
TYCDTTKSGYLSS

SEQ ID NO: 2781860 - protein, 10 aa, Entamoeba invadens
TYDAQKAKYT

SEQ ID NO: 2781861 - protein, 4 aa, Entamoeba invadens
TYDE

SEQ ID NO: 2781862 - protein, 11 aa, Entamoeba invadens
TYDKESGNITY

SEQ ID NO: 2781863 - protein, 12 aa, Entamoeba invadens
TYDNSEPSARNL

SEQ ID NO: 2781864 - protein, 18 aa, Entamoeba invadens
TYDREKQTCTQCSSGYSY

SEQ ID NO: 2781865 - protein, 6 aa, Entamoeba invadens
TYEDQG

SEQ ID NO: 2781866 - protein, 7 aa, Entamoeba invadens
TYFSPSS

SEQ ID NO: 2781867 - protein, 5 aa, Entamoeba invadens
TYGGK

SEQ ID NO: 2781868 - protein, 8 aa, Entamoeba invadens
TYGPIPSD

SEQ ID NO: 2781869 - protein, 4 aa, Entamoeba invadens
TYGS

SEQ ID NO: 2781870 - protein, 7 aa, Entamoeba invadens
TYGTTTE

SEQ ID NO: 2781871 - protein, 11 aa, Entamoeba invadens
TYHGAPASLRS

SEQ ID NO: 2781872 - protein, 7 aa, Entamoeba invadens
TYHNSNT

SEQ ID NO: 2781873 - protein, 15 aa, Entamoeba invadens
TYHSTQRSTCGNSSH

SEQ ID NO: 2781874 - protein, 5 aa, Entamoeba invadens
TYKGH

SEQ ID NO: 2781875 - protein, 9 aa, Entamoeba invadens
TYKGKEEKK

SEQ ID NO: 2781876 - protein, 7 aa, Entamoeba invadens
TYKGNEV

SEQ ID NO: 2781877 - protein, 6 aa, Entamoeba invadens
TYKGQD

SEQ ID NO: 2781878 - protein, 10 aa, Entamoeba invadens
TYKGRGVETS

SEQ ID NO: 2781879 - protein, 9 aa, Entamoeba invadens
TYKKTETTC

SEQ ID NO: 2781880 - protein, 9 aa, Entamoeba invadens
TYKSEDDSY

SEQ ID NO: 2781881 - protein, 6 aa, Entamoeba invadens
TYKSNK

SEQ ID NO: 2781882 - protein, 11 aa, Entamoeba invadens
TYKTEGDVNNY

SEQ ID NO: 2781883 - protein, 6 aa, Entamoeba invadens
TYLKDD

SEQ ID NO: 2781884 - protein, 5 aa, Entamoeba invadens
TYLND

SEQ ID NO: 2781885 - protein, 13 aa, Entamoeba invadens
TYLTKQNTCDSCG

SEQ ID NO: 2781886 - protein, 23 aa, Entamoeba invadens
TYLTNQNTCDSCGGSNAVCSTQN

SEQ ID NO: 2781887 - protein, 17 aa, Entamoeba invadens
TYLTTQNTCDSCGGSNA

SEQ ID NO: 2781888 - protein, 20 aa, Entamoeba invadens
TYNGKSCSISNEDGNPRETL

SEQ ID NO: 2781889 - protein, 6 aa, Entamoeba invadens
TYNGRE

SEQ ID NO: 2781890 - protein, 5 aa, Entamoeba invadens
TYPDG

SEQ ID NO: 2781891 - protein, 9 aa, Entamoeba invadens
TYPDNYYKK

SEQ ID NO: 2781892 - protein, 12 aa, Entamoeba invadens
TYPQNNARTTTL

SEQ ID NO: 2781893 - protein, 9 aa, Entamoeba invadens
TYPSASSKI

SEQ ID NO: 2781894 - protein, 5 aa, Entamoeba invadens
TYPSQ

SEQ ID NO: 2781895 - protein, 19 aa, Entamoeba invadens
TYPSTKDCTTTNEDSNPIE

SEQ ID NO: 2781896 - protein, 6 aa, Entamoeba invadens
TYPTPQ

SEQ ID NO: 2781897 - protein, 5 aa, Entamoeba invadens
TYPTQ

SEQ ID NO: 2781898 - protein, 4 aa, Entamoeba invadens
TYQE

SEQ ID NO: 2781899 - protein, 20 aa, Entamoeba invadens
TYQPTASKVSQGDMNDSSTS

SEQ ID NO: 2781900 - protein, 15 aa, Entamoeba invadens
TYQQTNGWSCGPSSS

SEQ ID NO: 2781901 - protein, 10 aa, Entamoeba invadens
TYQSKEGQTF

SEQ ID NO: 2781902 - protein, 10 aa, Entamoeba invadens
TYQSKQGQTF

SEQ ID NO: 2781903 - protein, 4 aa, Entamoeba invadens
TYQT

SEQ ID NO: 2781904 - protein, 14 aa, Entamoeba invadens
TYRESRNAQRPDNA

SEQ ID NO: 2781905 - protein, 5 aa, Entamoeba invadens
TYRGN

SEQ ID NO: 2781906 - protein, 6 aa, Entamoeba invadens
TYRGND

SEQ ID NO: 2781907 - protein, 6 aa, Entamoeba invadens
TYRGNE

SEQ ID NO: 2781908 - protein, 6 aa, Entamoeba invadens
TYRGNT

SEQ ID NO: 2781909 - protein, 4 aa, Entamoeba invadens
TYRN

SEQ ID NO: 2781910 - protein, 6 aa, Entamoeba invadens
TYRNNT

SEQ ID NO: 2781911 - protein, 8 aa, Entamoeba invadens
TYRSAPID

SEQ ID NO: 2781912 - protein, 12 aa, Entamoeba invadens
TYRTQFGRHTSQ

SEQ ID NO: 2781913 - protein, 10 aa, Entamoeba invadens
TYSDDTCTTE

SEQ ID NO: 2781914 - protein, 20 aa, Entamoeba invadens
TYSDETCTTQTEQKTQTIEA

SEQ ID NO: 2781915 - protein, 11 aa, Entamoeba invadens
TYSDETQNSVQ

SEQ ID NO: 2781916 - protein, 8 aa, Entamoeba invadens
TYSEFGQP

SEQ ID NO: 2781917 - protein, 5 aa, Entamoeba invadens
TYSEG

SEQ ID NO: 2781918 - protein, 6 aa, Entamoeba invadens
TYSGGG

SEQ ID NO: 2781919 - protein, 5 aa, Entamoeba invadens
TYSIE

SEQ ID NO: 2781920 - protein, 12 aa, Entamoeba invadens
TYSKGGDPTCTK

SEQ ID NO: 2781921 - protein, 28 aa, Entamoeba invadens
TYSLSGSSKCTNCNAGTFSSSNGASTCS

SEQ ID NO: 2781922 - protein, 11 aa, Entamoeba invadens
TYSNAGASSCK

SEQ ID NO: 2781923 - protein, 26 aa, Entamoeba invadens
TYSNKGSSTCTKCDAGTYSSLSGAST

SEQ ID NO: 2781924 - protein, 8 aa, Entamoeba invadens
TYSNQKKG

SEQ ID NO: 2781925 - protein, 22 aa, Entamoeba invadens
TYSQCGGTVTESKCRCNAETNN

SEQ ID NO: 2781926 - protein, 6 aa, Entamoeba invadens
TYSQMG

SEQ ID NO: 2781927 - protein, 8 aa, Entamoeba invadens
TYSSHNGA

SEQ ID NO: 2781928 - protein, 6 aa, Entamoeba invadens
TYSSLG

SEQ ID NO: 2781929 - protein, 9 aa, Entamoeba invadens
TYSSPEEEI

SEQ ID NO: 2781930 - protein, 42 aa, Entamoeba invadens
TYSSSGSTSCTQCTAGTYSSSTGAASCKPCNAGYYSDNGAVT

SEQ ID NO: 2781931 - protein, 8 aa, Entamoeba invadens
TYSSSGSV

SEQ ID NO: 2781932 - protein, 11 aa, Entamoeba invadens
TYSSSPKSLQC

SEQ ID NO: 2781933 - protein, 7 aa, Entamoeba invadens
TYSSTMA

SEQ ID NO: 2781934 - protein, 13 aa, Entamoeba invadens
TYSSTQKSTQCSN

SEQ ID NO: 2781935 - protein, 9 aa, Entamoeba invadens
TYSTAGSLS

SEQ ID NO: 2781936 - protein, 13 aa, Entamoeba invadens
TYSTAGSSSCQQC

SEQ ID NO: 2781937 - protein, 25 aa, Entamoeba invadens
TYSTAGSSSCQQCDSRCDGCDATNG

SEQ ID NO: 2781938 - protein, 29 aa, Entamoeba invadens
TYSTGGDSYCSQCSSTCKSSCSNTNGNCN

SEQ ID NO: 2781939 - protein, 12 aa, Entamoeba invadens
TYSTLVTSQKEE

SEQ ID NO: 2781940 - protein, 7 aa, Entamoeba invadens
TYSTPSS

SEQ ID NO: 2781941 - protein, 7 aa, Entamoeba invadens
TYSTRSK

SEQ ID NO: 2781942 - protein, 7 aa, Entamoeba invadens
TYSTTNN

SEQ ID NO: 2781943 - protein, 5 aa, Entamoeba invadens
TYTCE

SEQ ID NO: 2781944 - protein, 10 aa, Entamoeba invadens
TYTCEQGATP

SEQ ID NO: 2781945 - protein, 4 aa, Entamoeba invadens
TYTD

SEQ ID NO: 2781946 - protein, 9 aa, Entamoeba invadens
TYTEQDKTT

SEQ ID NO: 2781947 - protein, 13 aa, Entamoeba invadens
TYTFSSKESYNSI

SEQ ID NO: 2781948 - protein, 11 aa, Entamoeba invadens
TYTGCSPNDGI

SEQ ID NO: 2781949 - protein, 5 aa, Entamoeba invadens
TYTGI

SEQ ID NO: 2781950 - protein, 4 aa, Entamoeba invadens
TYTK

SEQ ID NO: 2781951 - protein, 11 aa, Entamoeba invadens
TYTKNNSFTQT

SEQ ID NO: 2781952 - protein, 4 aa, Entamoeba invadens
TYTN

SEQ ID NO: 2781953 - protein, 7 aa, Entamoeba invadens
TYTNPNL

SEQ ID NO: 2781954 - protein, 16 aa, Entamoeba invadens
TYTNQDRKRYSDTLPP

SEQ ID NO: 2781955 - protein, 4 aa, Entamoeba invadens
TYTP

SEQ ID NO: 2781956 - protein, 5 aa, Entamoeba invadens
TYTPQ

SEQ ID NO: 2781957 - protein, 10 aa, Entamoeba invadens
TYTPRNESDK

SEQ ID NO: 2781958 - protein, 6 aa, Entamoeba invadens
TYTPYE

SEQ ID NO: 2781959 - protein, 7 aa, Entamoeba invadens
TYTPYES

SEQ ID NO: 2781960 - protein, 8 aa, Entamoeba invadens
TYTQKSDM

SEQ ID NO: 2781961 - protein, 9 aa, Entamoeba invadens
TYTQNDSEI

SEQ ID NO: 2781962 - protein, 10 aa, Entamoeba invadens
TYTRDDREKF

SEQ ID NO: 2781963 - protein, 13 aa, Entamoeba invadens
TYTSKPDESAAPK

SEQ ID NO: 2781964 - protein, 6 aa, Entamoeba invadens
TYTTGD

SEQ ID NO: 2781965 - protein, 8 aa, Entamoeba invadens
TYTVEGNT

SEQ ID NO: 2781966 - protein, 10 aa, Entamoeba invadens
TYVEGDANGL

SEQ ID NO: 2781967 - protein, 6 aa, Entamoeba invadens
TYVKDG

SEQ ID NO: 2781968 - protein, 4 aa, Entamoeba invadens
TYYD

SEQ ID NO: 2781969 - protein, 4 aa, Entamoeba invadens
TYYN

SEQ ID NO: 2781970 - protein, 22 aa, Entamoeba invadens
VAAGKYCGDAKFESSYTIPSDT

SEQ ID NO: 2781971 - protein, 13 aa, Entamoeba invadens
VAAKNSEVKDNEV

SEQ ID NO: 2781972 - protein, 4 aa, Entamoeba invadens
VAAN

SEQ ID NO: 2781973 - protein, 7 aa, Entamoeba invadens
VAASGRL

SEQ ID NO: 2781974 - protein, 39 aa, Entamoeba invadens
VAEATEVNVEAEDDSSGPHMNDTDTSDEEDAKKKLQGSL

SEQ ID NO: 2781975 - protein, 8 aa, Entamoeba invadens
VAEEGTHE

SEQ ID NO: 2781976 - protein, 6 aa, Entamoeba invadens
VAEESR

SEQ ID NO: 2781977 - protein, 6 aa, Entamoeba invadens
VAEKDR

SEQ ID NO: 2781978 - protein, 7 aa, Entamoeba invadens
VAELGSD

SEQ ID NO: 2781979 - protein, 6 aa, Entamoeba invadens
VAEPPN

SEQ ID NO: 2781980 - protein, 6 aa, Entamoeba invadens
VAEPSN

SEQ ID NO: 2781981 - protein, 5 aa, Entamoeba invadens
VAEQT

SEQ ID NO: 2781982 - protein, 8 aa, Entamoeba invadens
VAERGTHE

SEQ ID NO: 2781983 - protein, 16 aa, Entamoeba invadens
VAERNRKAALKVNKAD

SEQ ID NO: 2781984 - protein, 4 aa, Entamoeba invadens
VAET

SEQ ID NO: 2781985 - protein, 6 aa, Entamoeba invadens
VAEYNN

SEQ ID NO: 2781986 - protein, 12 aa, Entamoeba invadens
VAGAEKQNMEIP

SEQ ID NO: 2781987 - protein, 10 aa, Entamoeba invadens
VAGGERKCST

SEQ ID NO: 2781988 - protein, 5 aa, Entamoeba invadens
VAGGL

SEQ ID NO: 2781989 - protein, 6 aa, Entamoeba invadens
VAGGNT

SEQ ID NO: 2781990 - protein, 4 aa, Entamoeba invadens
VAGK

SEQ ID NO: 2781991 - protein, 5 aa, Entamoeba invadens
VAGNN

SEQ ID NO: 2781992 - protein, 10 aa, Entamoeba invadens
VAGNRENGIN

SEQ ID NO: 2781993 - protein, 7 aa, Entamoeba invadens
VAGSYDN

SEQ ID NO: 2781994 - protein, 7 aa, Entamoeba invadens
VAHTDAP

SEQ ID NO: 2781995 - protein, 4 aa, Entamoeba invadens
VAKD

SEQ ID NO: 2781996 - protein, 9 aa, Entamoeba invadens
VAKKTTTSV

SEQ ID NO: 2781997 - protein, 4 aa, Entamoeba invadens
VAKS

SEQ ID NO: 2781998 - protein, 9 aa, Entamoeba invadens
VAKSTNPIG

SEQ ID NO: 2781999 - protein, 8 aa, Entamoeba invadens
VAKTEDLN

SEQ ID NO: 2782000 - protein, 6 aa, Entamoeba invadens
VAKTGP

SEQ ID NO: 2782001 - protein, 8 aa, Entamoeba invadens
VAKTPRDR

SEQ ID NO: 2782002 - protein, 6 aa, Entamoeba invadens
VAKTTK

SEQ ID NO: 2782003 - protein, 4 aa, Entamoeba invadens
VANG

SEQ ID NO: 2782004 - protein, 5 aa, Entamoeba invadens
VANGT

SEQ ID NO: 2782005 - protein, 8 aa, Entamoeba invadens
VANPPGAY

SEQ ID NO: 2782006 - protein, 7 aa, Entamoeba invadens
VANTTTK

SEQ ID NO: 2782007 - protein, 8 aa, Entamoeba invadens
VAPDTVSA

SEQ ID NO: 2782008 - protein, 7 aa, Entamoeba invadens
VAPSESM

SEQ ID NO: 2782009 - protein, 9 aa, Entamoeba invadens
VAPSSLSSS

SEQ ID NO: 2782010 - protein, 4 aa, Entamoeba invadens
VAPT

SEQ ID NO: 2782011 - protein, 7 aa, Entamoeba invadens
VAPTDGI

SEQ ID NO: 2782012 - protein, 19 aa, Entamoeba invadens
VAQESYTDSFSTDTSEDKV

SEQ ID NO: 2782013 - protein, 5 aa, Entamoeba invadens
VARAS

SEQ ID NO: 2782014 - protein, 4 aa, Entamoeba invadens
VARS

SEQ ID NO: 2782015 - protein, 6 aa, Entamoeba invadens
VARYEK

SEQ ID NO: 2782016 - protein, 4 aa, Entamoeba invadens
VASN

SEQ ID NO: 2782017 - protein, 6 aa, Entamoeba invadens
VASNAR

SEQ ID NO: 2782018 - protein, 5 aa, Entamoeba invadens
VASNK

SEQ ID NO: 2782019 - protein, 12 aa, Entamoeba invadens
VASQAQSSQMGS

SEQ ID NO: 2782020 - protein, 9 aa, Entamoeba invadens
VASTQEDVQ

SEQ ID NO: 2782021 - protein, 5 aa, Entamoeba invadens
VATAT

SEQ ID NO: 2782022 - protein, 6 aa, Entamoeba invadens
VATDAS

SEQ ID NO: 2782023 - protein, 6 aa, Entamoeba invadens
VATPEK

SEQ ID NO: 2782024 - protein, 5 aa, Entamoeba invadens
VATPT

SEQ ID NO: 2782025 - protein, 33 aa, Entamoeba invadens
VATPTEMNTETKDYAFSPASPADTLKQSSSDVD

SEQ ID NO: 2782026 - protein, 4 aa, Entamoeba invadens
VATS

SEQ ID NO: 2782027 - protein, 5 aa, Entamoeba invadens
VCASS

SEQ ID NO: 2782028 - protein, 10 aa, Entamoeba invadens
VCDQEKNGVS

SEQ ID NO: 2782029 - protein, 11 aa, Entamoeba invadens
VCESDEAFNEV

SEQ ID NO: 2782030 - protein, 9 aa, Entamoeba invadens
VCESSSSEF

SEQ ID NO: 2782031 - protein, 6 aa, Entamoeba invadens
VCGPDD

SEQ ID NO: 2782032 - protein, 8 aa, Entamoeba invadens
VCKHKQDR

SEQ ID NO: 2782033 - protein, 7 aa, Entamoeba invadens
VCKPKSD

SEQ ID NO: 2782034 - protein, 10 aa, Entamoeba invadens
VCPSGTYSLN

SEQ ID NO: 2782035 - protein, 7 aa, Entamoeba invadens
VCQTRGD

SEQ ID NO: 2782036 - protein, 7 aa, Entamoeba invadens
VCSDSNI

SEQ ID NO: 2782037 - protein, 10 aa, Entamoeba invadens
VCSPKSGIEG

SEQ ID NO: 2782038 - protein, 8 aa, Entamoeba invadens
VCSTSKGQ

SEQ ID NO: 2782039 - protein, 6 aa, Entamoeba invadens
VCTNAK

SEQ ID NO: 2782040 - protein, 7 aa, Entamoeba invadens
VDAADKV

SEQ ID NO: 2782041 - protein, 17 aa, Entamoeba invadens
VDAKNEDTEKSGPKEVK

SEQ ID NO: 2782042 - protein, 18 aa, Entamoeba invadens
VDAPKQNSIVKSAENEEN

SEQ ID NO: 2782043 - protein, 17 aa, Entamoeba invadens
VDAPKQSLNVKSTENEE

SEQ ID NO: 2782044 - protein, 9 aa, Entamoeba invadens
VDCGSSSNK

SEQ ID NO: 2782045 - protein, 10 aa, Entamoeba invadens
VDDANRTDPF

SEQ ID NO: 2782046 - protein, 7 aa, Entamoeba invadens
VDDERYE

SEQ ID NO: 2782047 - protein, 10 aa, Entamoeba invadens
VDDGEKRTQI

SEQ ID NO: 2782048 - protein, 5 aa, Entamoeba invadens
VDDGN

SEQ ID NO: 2782049 - protein, 7 aa, Entamoeba invadens
VDDKSTA

SEQ ID NO: 2782050 - protein, 36 aa, Entamoeba invadens
VDDKVEKNENEEMNEEENNKFGEDVDTDNLEDGYTF

SEQ ID NO: 2782051 - protein, 4 aa, Entamoeba invadens
VDDP

SEQ ID NO: 2782052 - protein, 7 aa, Entamoeba invadens
VDDTKTK

SEQ ID NO: 2782053 - protein, 17 aa, Entamoeba invadens
VDDVNGKLTDFGSSRNV

SEQ ID NO: 2782054 - protein, 8 aa, Entamoeba invadens
VDEEDSQQ

SEQ ID NO: 2782055 - protein, 5 aa, Entamoeba invadens
VDEEK

SEQ ID NO: 2782056 - protein, 10 aa, Entamoeba invadens
VDEENGLSTT

SEQ ID NO: 2782057 - protein, 7 aa, Entamoeba invadens
VDEENVK

SEQ ID NO: 2782058 - protein, 5 aa, Entamoeba invadens
VDEET

SEQ ID NO: 2782059 - protein, 6 aa, Entamoeba invadens
VDEETR

SEQ ID NO: 2782060 - protein, 13 aa, Entamoeba invadens
VDEGEQCDNTTNC

SEQ ID NO: 2782061 - protein, 9 aa, Entamoeba invadens
VDEGKETEQ

SEQ ID NO: 2782062 - protein, 10 aa, Entamoeba invadens
VDEKCTQPET

SEQ ID NO: 2782063 - protein, 11 aa, Entamoeba invadens
VDEKGEKVPSN

SEQ ID NO: 2782064 - protein, 11 aa, Entamoeba invadens
VDEKGTVAAAS

SEQ ID NO: 2782065 - protein, 15 aa, Entamoeba invadens
VDEKSSIKTGGFNAD

SEQ ID NO: 2782066 - protein, 9 aa, Entamoeba invadens
VDENASYAS

SEQ ID NO: 2782067 - protein, 16 aa, Entamoeba invadens
VDENGQCEVPRGNCGG

SEQ ID NO: 2782068 - protein, 8 aa, Entamoeba invadens
VDENGQSV

SEQ ID NO: 2782069 - protein, 6 aa, Entamoeba invadens
VDEQKK

SEQ ID NO: 2782070 - protein, 10 aa, Entamoeba invadens
VDEQNKETAA

SEQ ID NO: 2782071 - protein, 10 aa, Entamoeba invadens
VDESKSEKLP

SEQ ID NO: 2782072 - protein, 7 aa, Entamoeba invadens
VDESLKS

SEQ ID NO: 2782073 - protein, 22 aa, Entamoeba invadens
VDESSSSFSASIQSSSTVKDTF

SEQ ID NO: 2782074 - protein, 7 aa, Entamoeba invadens
VDETTPC

SEQ ID NO: 2782075 - protein, 5 aa, Entamoeba invadens
VDEVE

SEQ ID NO: 2782076 - protein, 4 aa, Entamoeba invadens
VDFT

SEQ ID NO: 2782077 - protein, 11 aa, Entamoeba invadens
VDGCKDKTGAL

SEQ ID NO: 2782078 - protein, 11 aa, Entamoeba invadens
VDGCKDKTGVL

SEQ ID NO: 2782079 - protein, 9 aa, Entamoeba invadens
VDGCKEKTG

SEQ ID NO: 2782080 - protein, 11 aa, Entamoeba invadens
VDGCKEKTGVL

SEQ ID NO: 2782081 - protein, 7 aa, Entamoeba invadens
VDGCSYS

SEQ ID NO: 2782082 - protein, 8 aa, Entamoeba invadens
VDGHEGIA

SEQ ID NO: 2782083 - protein, 4 aa, Entamoeba invadens
VDGM

SEQ ID NO: 2782084 - protein, 6 aa, Entamoeba invadens
VDGQKK

SEQ ID NO: 2782085 - protein, 4 aa, Entamoeba invadens
VDGT

SEQ ID NO: 2782086 - protein, 8 aa, Entamoeba invadens
VDGTNSQY

SEQ ID NO: 2782087 - protein, 6 aa, Entamoeba invadens
VDGTYC

SEQ ID NO: 2782088 - protein, 15 aa, Entamoeba invadens
VDIDGRYQQFVVGYK

SEQ ID NO: 2782089 - protein, 12 aa, Entamoeba invadens
VDISSGKGIEYK

SEQ ID NO: 2782090 - protein, 6 aa, Entamoeba invadens
VDKDTR

SEQ ID NO: 2782091 - protein, 6 aa, Entamoeba invadens
VDKETK

SEQ ID NO: 2782092 - protein, 8 aa, Entamoeba invadens
VDKETKKD

SEQ ID NO: 2782093 - protein, 6 aa, Entamoeba invadens
VDKETR

SEQ ID NO: 2782094 - protein, 8 aa, Entamoeba invadens
VDKIGSSA

SEQ ID NO: 2782095 - protein, 9 aa, Entamoeba invadens
VDKKESIPD

SEQ ID NO: 2782096 - protein, 8 aa, Entamoeba invadens
VDKNGQCQ

SEQ ID NO: 2782097 - protein, 8 aa, Entamoeba invadens
VDKNSKNL

SEQ ID NO: 2782098 - protein, 8 aa, Entamoeba invadens
VDKNSPLA

SEQ ID NO: 2782099 - protein, 12 aa, Entamoeba invadens
VDKRVGSYEAHA

SEQ ID NO: 2782100 - protein, 14 aa, Entamoeba invadens
VDKSIEEKDYLGES

SEQ ID NO: 2782101 - protein, 8 aa, Entamoeba invadens
VDKSKTGV

SEQ ID NO: 2782102 - protein, 7 aa, Entamoeba invadens
VDKTGGL

SEQ ID NO: 2782103 - protein, 9 aa, Entamoeba invadens
VDKVEKSDL

SEQ ID NO: 2782104 - protein, 8 aa, Entamoeba invadens
VDNDTNTL

SEQ ID NO: 2782105 - protein, 20 aa, Entamoeba invadens
VDNESPPVDNNDEEKLADEK

SEQ ID NO: 2782106 - protein, 25 aa, Entamoeba invadens
VDNKEVKINAEEVTVQKEEHQNTEV

SEQ ID NO: 2782107 - protein, 10 aa, Entamoeba invadens
VDNKSSPKNI

SEQ ID NO: 2782108 - protein, 4 aa, Entamoeba invadens
VDNN

SEQ ID NO: 2782109 - protein, 18 aa, Entamoeba invadens
VDNNQRASVTKELPTEFT

SEQ ID NO: 2782110 - protein, 8 aa, Entamoeba invadens
VDNPPALE

SEQ ID NO: 2782111 - protein, 8 aa, Entamoeba invadens
VDNQDDGF

SEQ ID NO: 2782112 - protein, 5 aa, Entamoeba invadens
VDNSF

SEQ ID NO: 2782113 - protein, 4 aa, Entamoeba invadens
VDNT

SEQ ID NO: 2782114 - protein, 7 aa, Entamoeba invadens
VDNTINS

SEQ ID NO: 2782115 - protein, 9 aa, Entamoeba invadens
VDNTQLQPA

SEQ ID NO: 2782116 - protein, 5 aa, Entamoeba invadens
VDNYT

SEQ ID NO: 2782117 - protein, 12 aa, Entamoeba invadens
VDPFPSGPEQAF

SEQ ID NO: 2782118 - protein, 12 aa, Entamoeba invadens
VDPHATKKAVIA

SEQ ID NO: 2782119 - protein, 4 aa, Entamoeba invadens
VDPK

SEQ ID NO: 2782120 - protein, 12 aa, Entamoeba invadens
VDPLKERKKIKE

SEQ ID NO: 2782121 - protein, 12 aa, Entamoeba invadens
VDPNAPGNCRSK

SEQ ID NO: 2782122 - protein, 5 aa, Entamoeba invadens
VDPNF

SEQ ID NO: 2782123 - protein, 6 aa, Entamoeba invadens
VDPNHP

SEQ ID NO: 2782124 - protein, 7 aa, Entamoeba invadens
VDPPKTK

SEQ ID NO: 2782125 - protein, 6 aa, Entamoeba invadens
VDPQGI

SEQ ID NO: 2782126 - protein, 9 aa, Entamoeba invadens
VDPQNKEAC

SEQ ID NO: 2782127 - protein, 9 aa, Entamoeba invadens
VDPTNNSTQ

SEQ ID NO: 2782128 - protein, 6 aa, Entamoeba invadens
VDPTQC

SEQ ID NO: 2782129 - protein, 6 aa, Entamoeba invadens
VDPTSE

SEQ ID NO: 2782130 - protein, 4 aa, Entamoeba invadens
VDQH

SEQ ID NO: 2782131 - protein, 6 aa, Entamoeba invadens
VDQTEC

SEQ ID NO: 2782132 - protein, 28 aa, Entamoeba invadens
VDRDQSTYVKTKEEGINRQDDGNQYYNP

SEQ ID NO: 2782133 - protein, 10 aa, Entamoeba invadens
VDRNKSPNIE

SEQ ID NO: 2782134 - protein, 8 aa, Entamoeba invadens
VDRYTSPW

SEQ ID NO: 2782135 - protein, 7 aa, Entamoeba invadens
VDSANGK

SEQ ID NO: 2782136 - protein, 11 aa, Entamoeba invadens
VDSCTEEAEKH

SEQ ID NO: 2782137 - protein, 8 aa, Entamoeba invadens
VDSDARRE

SEQ ID NO: 2782138 - protein, 9 aa, Entamoeba invadens
VDSEDNYKD

SEQ ID NO: 2782139 - protein, 15 aa, Entamoeba invadens
VDSEGVEKDEGMRTN

SEQ ID NO: 2782140 - protein, 17 aa, Entamoeba invadens
VDSEKITKSETNKQQRL

SEQ ID NO: 2782141 - protein, 4 aa, Entamoeba invadens
VDSG

SEQ ID NO: 2782142 - protein, 20 aa, Entamoeba invadens
VDSIPSKMNDTKPNKVEPTI

SEQ ID NO: 2782143 - protein, 17 aa, Entamoeba invadens
VDSPQKDPKKRISSQES

SEQ ID NO: 2782144 - protein, 24 aa, Entamoeba invadens
VDSPTEENGDKIEQVETKEHGGGE

SEQ ID NO: 2782145 - protein, 20 aa, Entamoeba invadens
VDSPTNNTEKSPEKSSSSES

SEQ ID NO: 2782146 - protein, 4 aa, Entamoeba invadens
VDSS

SEQ ID NO: 2782147 - protein, 16 aa, Entamoeba invadens
VDSSDGEELSYNDYTK

SEQ ID NO: 2782148 - protein, 5 aa, Entamoeba invadens
VDSSH

SEQ ID NO: 2782149 - protein, 13 aa, Entamoeba invadens
VDSSKEADATSIE

SEQ ID NO: 2782150 - protein, 6 aa, Entamoeba invadens
VDSTLE

SEQ ID NO: 2782151 - protein, 14 aa, Entamoeba invadens
VDSTTISQFNPSNA

SEQ ID NO: 2782152 - protein, 7 aa, Entamoeba invadens
VDSTTKK

SEQ ID NO: 2782153 - protein, 11 aa, Entamoeba invadens
VDSYSRNNAKF

SEQ ID NO: 2782154 - protein, 12 aa, Entamoeba invadens
VDTCSNKNYPRN

SEQ ID NO: 2782155 - protein, 9 aa, Entamoeba invadens
VDTEQSTKL

SEQ ID NO: 2782156 - protein, 24 aa, Entamoeba invadens
VDTEQSTKLNSRELEETKQIGEGS

SEQ ID NO: 2782157 - protein, 11 aa, Entamoeba invadens
VDTIRAPKSLK

SEQ ID NO: 2782158 - protein, 15 aa, Entamoeba invadens
VDTKITGTVTSQKCS

SEQ ID NO: 2782159 - protein, 18 aa, Entamoeba invadens
VDTPKQNSIVKSAENEEN

SEQ ID NO: 2782160 - protein, 24 aa, Entamoeba invadens
VDTSNNKCKQCDSTCGGKCDGVSG

SEQ ID NO: 2782161 - protein, 7 aa, Entamoeba invadens
VDTSTKK

SEQ ID NO: 2782162 - protein, 6 aa, Entamoeba invadens
VDTSTR

SEQ ID NO: 2782163 - protein, 9 aa, Entamoeba invadens
VDTTNTENK

SEQ ID NO: 2782164 - protein, 5 aa, Entamoeba invadens
VDTTR

SEQ ID NO: 2782165 - protein, 11 aa, Entamoeba invadens
VDTTSEKITTL

SEQ ID NO: 2782166 - protein, 5 aa, Entamoeba invadens
VDTTT

SEQ ID NO: 2782167 - protein, 14 aa, Entamoeba invadens
VDYGNGALHNRTQP

SEQ ID NO: 2782168 - protein, 12 aa, Entamoeba invadens
VEAEGDAEKKVE

SEQ ID NO: 2782169 - protein, 8 aa, Entamoeba invadens
VEAGPYGT

SEQ ID NO: 2782170 - protein, 14 aa, Entamoeba invadens
VEANARPNTLASPM

SEQ ID NO: 2782171 - protein, 8 aa, Entamoeba invadens
VEASDSVT

SEQ ID NO: 2782172 - protein, 8 aa, Entamoeba invadens
VEATNSKC

SEQ ID NO: 2782173 - protein, 6 aa, Entamoeba invadens
VEATSV

SEQ ID NO: 2782174 - protein, 4 aa, Entamoeba invadens
VECP

SEQ ID NO: 2782175 - protein, 6 aa, Entamoeba invadens
VECPSE

SEQ ID NO: 2782176 - protein, 19 aa, Entamoeba invadens
VECSASATGCSKCKADTTT

SEQ ID NO: 2782177 - protein, 6 aa, Entamoeba invadens
VECTDC

SEQ ID NO: 2782178 - protein, 8 aa, Entamoeba invadens
VECTPGCS

SEQ ID NO: 2782179 - protein, 8 aa, Entamoeba invadens
VEDAEENM

SEQ ID NO: 2782180 - protein, 16 aa, Entamoeba invadens
VEDDDTKKTQIKKDFD

SEQ ID NO: 2782181 - protein, 10 aa, Entamoeba invadens
VEDDESLNEF

SEQ ID NO: 2782182 - protein, 4 aa, Entamoeba invadens
VEDE

SEQ ID NO: 2782183 - protein, 62 aa, Entamoeba invadens
VEDENNEKVKELEESDKEKRSEQVQEKEATEGKSTSTDKEMSIEKPESDQNESKSSMSSEDL

SEQ ID NO: 2782184 - protein, 6 aa, Entamoeba invadens
VEDGDY

SEQ ID NO: 2782185 - protein, 8 aa, Entamoeba invadens
VEDGTEEP

SEQ ID NO: 2782186 - protein, 4 aa, Entamoeba invadens
VEDK

SEQ ID NO: 2782187 - protein, 7 aa, Entamoeba invadens
VEDKLQE

SEQ ID NO: 2782188 - protein, 10 aa, Entamoeba invadens
VEDKLQEGVP

SEQ ID NO: 2782189 - protein, 7 aa, Entamoeba invadens
VEDKNEW

SEQ ID NO: 2782190 - protein, 5 aa, Entamoeba invadens
VEDNE

SEQ ID NO: 2782191 - protein, 6 aa, Entamoeba invadens
VEDNST

SEQ ID NO: 2782192 - protein, 10 aa, Entamoeba invadens
VEDNTNSCKF

SEQ ID NO: 2782193 - protein, 21 aa, Entamoeba invadens
VEDPKDANGKCKTCDTNTNYK

SEQ ID NO: 2782194 - protein, 17 aa, Entamoeba invadens
VEDPKDANGKCTKCDTT

SEQ ID NO: 2782195 - protein, 17 aa, Entamoeba invadens
VEDPKDVNGKCKTCDST

SEQ ID NO: 2782196 - protein, 18 aa, Entamoeba invadens
VEDPNDANGKCKTCDTKT

SEQ ID NO: 2782197 - protein, 7 aa, Entamoeba invadens
VEDSKRN

SEQ ID NO: 2782198 - protein, 9 aa, Entamoeba invadens
VEDTQLDQG

SEQ ID NO: 2782199 - protein, 12 aa, Entamoeba invadens
VEDVDDEDEYVP

SEQ ID NO: 2782200 - protein, 6 aa, Entamoeba invadens
VEEDED

SEQ ID NO: 2782201 - protein, 9 aa, Entamoeba invadens
VEEEITEKD

SEQ ID NO: 2782202 - protein, 21 aa, Entamoeba invadens
VEEESEDNEEDVDYGQSDDEY

SEQ ID NO: 2782203 - protein, 10 aa, Entamoeba invadens
VEEGADIAGK

SEQ ID NO: 2782204 - protein, 5 aa, Entamoeba invadens
VEEGN

SEQ ID NO: 2782205 - protein, 9 aa, Entamoeba invadens
VEENETELS

SEQ ID NO: 2782206 - protein, 11 aa, Entamoeba invadens
VEEPGLTSHEK

SEQ ID NO: 2782207 - protein, 4 aa, Entamoeba invadens
VEES

SEQ ID NO: 2782208 - protein, 5 aa, Entamoeba invadens
VEEYT

SEQ ID NO: 2782209 - protein, 55 aa, Entamoeba invadens
VEGEKKVLPGEQPGVTANTPSAPSMPSTSSSIPQEPNVEPQADKKDNSESSDSDT

SEQ ID NO: 2782210 - protein, 4 aa, Entamoeba invadens
VEGG

SEQ ID NO: 2782211 - protein, 7 aa, Entamoeba invadens
VEGKPTE

SEQ ID NO: 2782212 - protein, 9 aa, Entamoeba invadens
VEGKRPDII

SEQ ID NO: 2782213 - protein, 10 aa, Entamoeba invadens
VEGNKMEDTN

SEQ ID NO: 2782214 - protein, 5 aa, Entamoeba invadens
VEGQC

SEQ ID NO: 2782215 - protein, 11 aa, Entamoeba invadens
VEGSAKKDPNC

SEQ ID NO: 2782216 - protein, 12 aa, Entamoeba invadens
VEGSKEKVGDQL

SEQ ID NO: 2782217 - protein, 9 aa, Entamoeba invadens
VEGSTSKEV

SEQ ID NO: 2782218 - protein, 8 aa, Entamoeba invadens
VEGSYKYS

SEQ ID NO: 2782219 - protein, 9 aa, Entamoeba invadens
VEHTHSQES

SEQ ID NO: 2782220 - protein, 6 aa, Entamoeba invadens
VEIKDT

SEQ ID NO: 2782221 - protein, 11 aa, Entamoeba invadens
VEKAVDEIREK

SEQ ID NO: 2782222 - protein, 4 aa, Entamoeba invadens
VEKC

SEQ ID NO: 2782223 - protein, 6 aa, Entamoeba invadens
VEKDEG

SEQ ID NO: 2782224 - protein, 9 aa, Entamoeba invadens
VEKDGEVVT

SEQ ID NO: 2782225 - protein, 16 aa, Entamoeba invadens
VEKERKKSFRPTKVSS

SEQ ID NO: 2782226 - protein, 5 aa, Entamoeba invadens
VEKES

SEQ ID NO: 2782227 - protein, 5 aa, Entamoeba invadens
VEKET

SEQ ID NO: 2782228 - protein, 6 aa, Entamoeba invadens
VEKETT

SEQ ID NO: 2782229 - protein, 4 aa, Entamoeba invadens
VEKG

SEQ ID NO: 2782230 - protein, 5 aa, Entamoeba invadens
VEKGK

SEQ ID NO: 2782231 - protein, 10 aa, Entamoeba invadens
VEKGKRLPIK

SEQ ID NO: 2782232 - protein, 7 aa, Entamoeba invadens
VEKGKTV

SEQ ID NO: 2782233 - protein, 9 aa, Entamoeba invadens
VEKGSHDEL

SEQ ID NO: 2782234 - protein, 10 aa, Entamoeba invadens
VEKGSHDELM

SEQ ID NO: 2782235 - protein, 8 aa, Entamoeba invadens
VEKGTHQE

SEQ ID NO: 2782236 - protein, 9 aa, Entamoeba invadens
VEKHEEPLN

SEQ ID NO: 2782237 - protein, 6 aa, Entamoeba invadens
VEKKQE

SEQ ID NO: 2782238 - protein, 6 aa, Entamoeba invadens
VEKKYK

SEQ ID NO: 2782239 - protein, 9 aa, Entamoeba invadens
VEKNKTAAA

SEQ ID NO: 2782240 - protein, 12 aa, Entamoeba invadens
VEKQSTKKGQDV

SEQ ID NO: 2782241 - protein, 17 aa, Entamoeba invadens
VEKRATAQELVTELTKL

SEQ ID NO: 2782242 - protein, 6 aa, Entamoeba invadens
VEKSEE

SEQ ID NO: 2782243 - protein, 6 aa, Entamoeba invadens
VEKTVQ

SEQ ID NO: 2782244 - protein, 11 aa, Entamoeba invadens
VEKVNSSSFTS

SEQ ID NO: 2782245 - protein, 6 aa, Entamoeba invadens
VELRDT

SEQ ID NO: 2782246 - protein, 6 aa, Entamoeba invadens
VELSSN

SEQ ID NO: 2782247 - protein, 18 aa, Entamoeba invadens
VEMGDKTDDKLQDQYKED

SEQ ID NO: 2782248 - protein, 14 aa, Entamoeba invadens
VEMRTSKDSNLASV

SEQ ID NO: 2782249 - protein, 13 aa, Entamoeba invadens
VENDINKNTTKTF

SEQ ID NO: 2782250 - protein, 14 aa, Entamoeba invadens
VENDNCSATRYING

SEQ ID NO: 2782251 - protein, 9 aa, Entamoeba invadens
VENDTNITK

SEQ ID NO: 2782252 - protein, 4 aa, Entamoeba invadens
VENE

SEQ ID NO: 2782253 - protein, 18 aa, Entamoeba invadens
VENEANNVETESVQEVNP

SEQ ID NO: 2782254 - protein, 11 aa, Entamoeba invadens
VENGKRLEIGS

SEQ ID NO: 2782255 - protein, 4 aa, Entamoeba invadens
VENK

SEQ ID NO: 2782256 - protein, 6 aa, Entamoeba invadens
VENKDT

SEQ ID NO: 2782257 - protein, 5 aa, Entamoeba invadens
VENLP

SEQ ID NO: 2782258 - protein, 12 aa, Entamoeba invadens
VENNALKTQLDE

SEQ ID NO: 2782259 - protein, 7 aa, Entamoeba invadens
VENPQFP

SEQ ID NO: 2782260 - protein, 7 aa, Entamoeba invadens
VENSPTA

SEQ ID NO: 2782261 - protein, 4 aa, Entamoeba invadens
VEPD

SEQ ID NO: 2782262 - protein, 5 aa, Entamoeba invadens
VEPKE

SEQ ID NO: 2782263 - protein, 7 aa, Entamoeba invadens
VEPNKLS

SEQ ID NO: 2782264 - protein, 5 aa, Entamoeba invadens
VEPNV

SEQ ID NO: 2782265 - protein, 39 aa, Entamoeba invadens
VEPSSSNEQSSEMPSPSSTTPVESSTTSISSSEEKDKTT

SEQ ID NO: 2782266 - protein, 8 aa, Entamoeba invadens
VEPTEGSA

SEQ ID NO: 2782267 - protein, 13 aa, Entamoeba invadens
VEPTSSESSESGF

SEQ ID NO: 2782268 - protein, 4 aa, Entamoeba invadens
VEQA

SEQ ID NO: 2782269 - protein, 6 aa, Entamoeba invadens
VEQGSK

SEQ ID NO: 2782270 - protein, 7 aa, Entamoeba invadens
VEQQKEY

SEQ ID NO: 2782271 - protein, 13 aa, Entamoeba invadens
VEQQTNREKSDEI

SEQ ID NO: 2782272 - protein, 8 aa, Entamoeba invadens
VEQYDDDG

SEQ ID NO: 2782273 - protein, 35 aa, Entamoeba invadens
VERADEPKKEKAKTVTATSSPPKVKKEKPTLPKKS

SEQ ID NO: 2782274 - protein, 8 aa, Entamoeba invadens
VEREEEKR

SEQ ID NO: 2782275 - protein, 5 aa, Entamoeba invadens
VERER

SEQ ID NO: 2782276 - protein, 6 aa, Entamoeba invadens
VERESK

SEQ ID NO: 2782277 - protein, 12 aa, Entamoeba invadens
VERHKDAQNTYL

SEQ ID NO: 2782278 - protein, 9 aa, Entamoeba invadens
VERNNETLT

SEQ ID NO: 2782279 - protein, 26 aa, Entamoeba invadens
VERNQSEQKLIPSPSLDKSTDSTSPT

SEQ ID NO: 2782280 - protein, 4 aa, Entamoeba invadens
VERP

SEQ ID NO: 2782281 - protein, 10 aa, Entamoeba invadens
VESAKEIKAT

SEQ ID NO: 2782282 - protein, 11 aa, Entamoeba invadens
VESDNDTCIEG

SEQ ID NO: 2782283 - protein, 4 aa, Entamoeba invadens
VESE

SEQ ID NO: 2782284 - protein, 6 aa, Entamoeba invadens
VESEKT

SEQ ID NO: 2782285 - protein, 4 aa, Entamoeba invadens
VESG

SEQ ID NO: 2782286 - protein, 7 aa, Entamoeba invadens
VESGETQ

SEQ ID NO: 2782287 - protein, 10 aa, Entamoeba invadens
VESGKRLPLK

SEQ ID NO: 2782288 - protein, 9 aa, Entamoeba invadens
VESGSQFSK

SEQ ID NO: 2782289 - protein, 5 aa, Entamoeba invadens
VESIG

SEQ ID NO: 2782290 - protein, 22 aa, Entamoeba invadens
VESKTESLHDDDSVLKYDDEIE

SEQ ID NO: 2782291 - protein, 13 aa, Entamoeba invadens
VESNALGKGQEEF

SEQ ID NO: 2782292 - protein, 11 aa, Entamoeba invadens
VESNDELTNNI

SEQ ID NO: 2782293 - protein, 15 aa, Entamoeba invadens
VESNNGSCQKCSEFD

SEQ ID NO: 2782294 - protein, 7 aa, Entamoeba invadens
VESNPGQ

SEQ ID NO: 2782295 - protein, 7 aa, Entamoeba invadens
VESPRGE

SEQ ID NO: 2782296 - protein, 7 aa, Entamoeba invadens
VESRNSV

SEQ ID NO: 2782297 - protein, 94 aa, Entamoeba invadens
VESSDDTSSAQKSSQPDESSSSEGKESNAMSSDNTQSSEESSNNSGESSGKPSGESSESKESSDKPGVISSDNTPSGGESGNNEESKVPGQDGS

SEQ ID NO: 2782298 - protein, 5 aa, Entamoeba invadens
VESTQ

SEQ ID NO: 2782299 - protein, 10 aa, Entamoeba invadens
VESTSTSGEC

SEQ ID NO: 2782300 - protein, 6 aa, Entamoeba invadens
VETDTK

SEQ ID NO: 2782301 - protein, 11 aa, Entamoeba invadens
VETGDEVVPNE

SEQ ID NO: 2782302 - protein, 10 aa, Entamoeba invadens
VETHPGELES

SEQ ID NO: 2782303 - protein, 4 aa, Entamoeba invadens
VETK

SEQ ID NO: 2782304 - protein, 14 aa, Entamoeba invadens
VETKSQEEVTEVEN

SEQ ID NO: 2782305 - protein, 12 aa, Entamoeba invadens
VETKTKNTTKLN

SEQ ID NO: 2782306 - protein, 12 aa, Entamoeba invadens
VETNDSVSGQTN

SEQ ID NO: 2782307 - protein, 7 aa, Entamoeba invadens
VETNGSL

SEQ ID NO: 2782308 - protein, 8 aa, Entamoeba invadens
VETNPSDA

SEQ ID NO: 2782309 - protein, 7 aa, Entamoeba invadens
VETNPSS

SEQ ID NO: 2782310 - protein, 7 aa, Entamoeba invadens
VETPQPA

SEQ ID NO: 2782311 - protein, 11 aa, Entamoeba invadens
VETQNDTYANN

SEQ ID NO: 2782312 - protein, 16 aa, Entamoeba invadens
VETQPKNPVLKPKEGC

SEQ ID NO: 2782313 - protein, 9 aa, Entamoeba invadens
VETQTTTKL

SEQ ID NO: 2782314 - protein, 6 aa, Entamoeba invadens
VETREK

SEQ ID NO: 2782315 - protein, 5 aa, Entamoeba invadens
VETRY

SEQ ID NO: 2782316 - protein, 6 aa, Entamoeba invadens
VETSND

SEQ ID NO: 2782317 - protein, 4 aa, Entamoeba invadens
VETT

SEQ ID NO: 2782318 - protein, 6 aa, Entamoeba invadens
VETTHQ

SEQ ID NO: 2782319 - protein, 9 aa, Entamoeba invadens
VETTNTSKC

SEQ ID NO: 2782320 - protein, 17 aa, Entamoeba invadens
VETTPEGETEAVTSYET

SEQ ID NO: 2782321 - protein, 11 aa, Entamoeba invadens
VETVSTTNSFD

SEQ ID NO: 2782322 - protein, 11 aa, Entamoeba invadens
VEVEEIDGQTP

SEQ ID NO: 2782323 - protein, 4 aa, Entamoeba invadens
VEVP

SEQ ID NO: 2782324 - protein, 7 aa, Entamoeba invadens
VEVSKKE

SEQ ID NO: 2782325 - protein, 16 aa, Entamoeba invadens
VEVTESGCSKCKDGYY

SEQ ID NO: 2782326 - protein, 10 aa, Entamoeba invadens
VEYPDGENGY

SEQ ID NO: 2782327 - protein, 15 aa, Entamoeba invadens
VEYTERPKRKFNPTW

SEQ ID NO: 2782328 - protein, 10 aa, Entamoeba invadens
VFDDPKGKTC

SEQ ID NO: 2782329 - protein, 6 aa, Entamoeba invadens
VFDNNT

SEQ ID NO: 2782330 - protein, 7 aa, Entamoeba invadens
VFEDPPS

SEQ ID NO: 2782331 - protein, 94 aa, Entamoeba invadens
VFEESSLSSDENESKVSDKNKSESDSLSETSGSGSESSVKSQEKDVPKQSEISQVSNKSETMSKPVDESDESLSKTGDASESESESEKSSNTND

SEQ ID NO: 2782332 - protein, 9 aa, Entamoeba invadens
VFEETDKRF

SEQ ID NO: 2782333 - protein, 10 aa, Entamoeba invadens
VFENNDQKEF

SEQ ID NO: 2782334 - protein, 8 aa, Entamoeba invadens
VFGSKNPA

SEQ ID NO: 2782335 - protein, 7 aa, Entamoeba invadens
VFNDPKG

SEQ ID NO: 2782336 - protein, 5 aa, Entamoeba invadens
VFPDG

SEQ ID NO: 2782337 - protein, 8 aa, Entamoeba invadens
VFPDPNCG

SEQ ID NO: 2782338 - protein, 7 aa, Entamoeba invadens
VFSTTNN

SEQ ID NO: 2782339 - protein, 7 aa, Entamoeba invadens
VFTDPPD

SEQ ID NO: 2782340 - protein, 10 aa, Entamoeba invadens
VFTSPKGKTC

SEQ ID NO: 2782341 - protein, 9 aa, Entamoeba invadens
VFTSPQSEV

SEQ ID NO: 2782342 - protein, 4 aa, Entamoeba invadens
VGAE

SEQ ID NO: 2782343 - protein, 4 aa, Entamoeba invadens
VGAG

SEQ ID NO: 2782344 - protein, 15 aa, Entamoeba invadens
VGANDGDPNGVCDGH

SEQ ID NO: 2782345 - protein, 8 aa, Entamoeba invadens
VGAQNTIE

SEQ ID NO: 2782346 - protein, 10 aa, Entamoeba invadens
VGATNKNKKL

SEQ ID NO: 2782347 - protein, 17 aa, Entamoeba invadens
VGCGDSKRRYVRSTSDI

SEQ ID NO: 2782348 - protein, 8 aa, Entamoeba invadens
VGCSNGKY

SEQ ID NO: 2782349 - protein, 4 aa, Entamoeba invadens
VGDC

SEQ ID NO: 2782350 - protein, 10 aa, Entamoeba invadens
VGDDQQTLQR

SEQ ID NO: 2782351 - protein, 9 aa, Entamoeba invadens
VGDEKPRSI

SEQ ID NO: 2782352 - protein, 8 aa, Entamoeba invadens
VGDESCEA

SEQ ID NO: 2782353 - protein, 11 aa, Entamoeba invadens
VGDESSSSVPH

SEQ ID NO: 2782354 - protein, 14 aa, Entamoeba invadens
VGDGQKVDVTGSMG

SEQ ID NO: 2782355 - protein, 6 aa, Entamoeba invadens
VGDGSE

SEQ ID NO: 2782356 - protein, 4 aa, Entamoeba invadens
VGEE

SEQ ID NO: 2782357 - protein, 7 aa, Entamoeba invadens
VGEEKGA

SEQ ID NO: 2782358 - protein, 7 aa, Entamoeba invadens
VGEESPL

SEQ ID NO: 2782359 - protein, 6 aa, Entamoeba invadens
VGEETR

SEQ ID NO: 2782360 - protein, 13 aa, Entamoeba invadens
VGEGYKKRPQIEK

SEQ ID NO: 2782361 - protein, 5 aa, Entamoeba invadens
VGELK

SEQ ID NO: 2782362 - protein, 6 aa, Entamoeba invadens
VGEPTT

SEQ ID NO: 2782363 - protein, 4 aa, Entamoeba invadens
VGEQ

SEQ ID NO: 2782364 - protein, 5 aa, Entamoeba invadens
VGEQL

SEQ ID NO: 2782365 - protein, 15 aa, Entamoeba invadens
VGERGSQLSGGQKQR

SEQ ID NO: 2782366 - protein, 8 aa, Entamoeba invadens
VGESGCQK

SEQ ID NO: 2782367 - protein, 7 aa, Entamoeba invadens
VGEYSKR

SEQ ID NO: 2782368 - protein, 6 aa, Entamoeba invadens
VGGASS

SEQ ID NO: 2782369 - protein, 5 aa, Entamoeba invadens
VGGDT

SEQ ID NO: 2782370 - protein, 26 aa, Entamoeba invadens
VGGECTSCASNGNCNSCDSNENESSR

SEQ ID NO: 2782371 - protein, 4 aa, Entamoeba invadens
VGGF

SEQ ID NO: 2782372 - protein, 17 aa, Entamoeba invadens
VGGFGDYTKKYNKTREG

SEQ ID NO: 2782373 - protein, 5 aa, Entamoeba invadens
VGGGQ

SEQ ID NO: 2782374 - protein, 16 aa, Entamoeba invadens
VGGGSSACEKCSSFDS

SEQ ID NO: 2782375 - protein, 5 aa, Entamoeba invadens
VGHSK

SEQ ID NO: 2782376 - protein, 5 aa, Entamoeba invadens
VGIEG

SEQ ID NO: 2782377 - protein, 9 aa, Entamoeba invadens
VGKEESSVS

SEQ ID NO: 2782378 - protein, 9 aa, Entamoeba invadens
VGKEKRNRL

SEQ ID NO: 2782379 - protein, 5 aa, Entamoeba invadens
VGKGE

SEQ ID NO: 2782380 - protein, 5 aa, Entamoeba invadens
VGKGQ

SEQ ID NO: 2782381 - protein, 8 aa, Entamoeba invadens
VGKGSYGY

SEQ ID NO: 2782382 - protein, 9 aa, Entamoeba invadens
VGKKDGENL

SEQ ID NO: 2782383 - protein, 9 aa, Entamoeba invadens
VGKNETRGC

SEQ ID NO: 2782384 - protein, 6 aa, Entamoeba invadens
VGKNSI

SEQ ID NO: 2782385 - protein, 7 aa, Entamoeba invadens
VGKQKAL

SEQ ID NO: 2782386 - protein, 10 aa, Entamoeba invadens
VGKRPKTVDR

SEQ ID NO: 2782387 - protein, 8 aa, Entamoeba invadens
VGKSINSN

SEQ ID NO: 2782388 - protein, 19 aa, Entamoeba invadens
VGKSSRGTFAGETCDETQS

SEQ ID NO: 2782389 - protein, 4 aa, Entamoeba invadens
VGKT

SEQ ID NO: 2782390 - protein, 4 aa, Entamoeba invadens
VGKY

SEQ ID NO: 2782391 - protein, 11 aa, Entamoeba invadens
VGLRDTQTISR

SEQ ID NO: 2782392 - protein, 5 aa, Entamoeba invadens
VGMND

SEQ ID NO: 2782393 - protein, 7 aa, Entamoeba invadens
VGMQNGV

SEQ ID NO: 2782394 - protein, 14 aa, Entamoeba invadens
VGNESYAGGESKNI

SEQ ID NO: 2782395 - protein, 9 aa, Entamoeba invadens
VGNKNGKTH

SEQ ID NO: 2782396 - protein, 9 aa, Entamoeba invadens
VGNKSKNTI

SEQ ID NO: 2782397 - protein, 4 aa, Entamoeba invadens
VGNP

SEQ ID NO: 2782398 - protein, 6 aa, Entamoeba invadens
VGNSKC

SEQ ID NO: 2782399 - protein, 7 aa, Entamoeba invadens
VGNSPQK

SEQ ID NO: 2782400 - protein, 9 aa, Entamoeba invadens
VGNTSSSSV

SEQ ID NO: 2782401 - protein, 6 aa, Entamoeba invadens
VGNYPT

SEQ ID NO: 2782402 - protein, 4 aa, Entamoeba invadens
VGPP

SEQ ID NO: 2782403 - protein, 87 aa, Entamoeba invadens
VGQPTYSQPMQPQMNQSNYTPGGIQNVEQSGQYVPPPMQYTPGGQGEVQSTQDYIQQNEQHPYTPAQHQQEYVPGGQQVQMQTTETE

SEQ ID NO: 2782404 - protein, 6 aa, Entamoeba invadens
VGQSHV

SEQ ID NO: 2782405 - protein, 8 aa, Entamoeba invadens
VGQSPTAI

SEQ ID NO: 2782406 - protein, 7 aa, Entamoeba invadens
VGRENVP

SEQ ID NO: 2782407 - protein, 4 aa, Entamoeba invadens
VGRQ

SEQ ID NO: 2782408 - protein, 9 aa, Entamoeba invadens
VGRSTGFDY

SEQ ID NO: 2782409 - protein, 11 aa, Entamoeba invadens
VGRTGSGKSTM

SEQ ID NO: 2782410 - protein, 4 aa, Entamoeba invadens
VGRV

SEQ ID NO: 2782411 - protein, 7 aa, Entamoeba invadens
VGRVKSK

SEQ ID NO: 2782412 - protein, 18 aa, Entamoeba invadens
VGSESNTATSSSSLQEST

SEQ ID NO: 2782413 - protein, 4 aa, Entamoeba invadens
VGSG

SEQ ID NO: 2782414 - protein, 5 aa, Entamoeba invadens
VGSGK

SEQ ID NO: 2782415 - protein, 8 aa, Entamoeba invadens
VGSGKSTL

SEQ ID NO: 2782416 - protein, 7 aa, Entamoeba invadens
VGSGKTS

SEQ ID NO: 2782417 - protein, 4 aa, Entamoeba invadens
VGSH

SEQ ID NO: 2782418 - protein, 8 aa, Entamoeba invadens
VGSKARTA

SEQ ID NO: 2782419 - protein, 5 aa, Entamoeba invadens
VGSPN

SEQ ID NO: 2782420 - protein, 8 aa, Entamoeba invadens
VGSTKKEL

SEQ ID NO: 2782421 - protein, 6 aa, Entamoeba invadens
VGSTND

SEQ ID NO: 2782422 - protein, 7 aa, Entamoeba invadens
VGTNNEM

SEQ ID NO: 2782423 - protein, 6 aa, Entamoeba invadens
VGTPKY

SEQ ID NO: 2782424 - protein, 5 aa, Entamoeba invadens
VGTSE

SEQ ID NO: 2782425 - protein, 7 aa, Entamoeba invadens
VGTSEID

SEQ ID NO: 2782426 - protein, 11 aa, Entamoeba invadens
VGTSSLTIKGN

SEQ ID NO: 2782427 - protein, 7 aa, Entamoeba invadens
VGTSTNC

SEQ ID NO: 2782428 - protein, 6 aa, Entamoeba invadens
VGTTEN

SEQ ID NO: 2782429 - protein, 10 aa, Entamoeba invadens
VGTYKKTDMT

SEQ ID NO: 2782430 - protein, 48 aa, Entamoeba invadens
VGTYSSTSGSSSCTSCPAGKYSSNYGSTSCSTCSTGTYSSSTGSTTCS

SEQ ID NO: 2782431 - protein, 17 aa, Entamoeba invadens
VGVAGSGAALADAQNSS

SEQ ID NO: 2782432 - protein, 6 aa, Entamoeba invadens
VGVDNQ

SEQ ID NO: 2782433 - protein, 9 aa, Entamoeba invadens
VGVGGDGAY

SEQ ID NO: 2782434 - protein, 6 aa, Entamoeba invadens
VGVSNR

SEQ ID NO: 2782435 - protein, 7 aa, Entamoeba invadens
VGYDQES

SEQ ID NO: 2782436 - protein, 12 aa, Entamoeba invadens
VGYEGDPEGDVS

SEQ ID NO: 2782437 - protein, 4 aa, Entamoeba invadens
VGYN

SEQ ID NO: 2782438 - protein, 8 aa, Entamoeba invadens
VGYSDSGC

SEQ ID NO: 2782439 - protein, 6 aa, Entamoeba invadens
VGYTGG

SEQ ID NO: 2782440 - protein, 11 aa, Entamoeba invadens
VGYTSDCQSCQ

SEQ ID NO: 2782441 - protein, 4 aa, Entamoeba invadens
VHDL

SEQ ID NO: 2782442 - protein, 8 aa, Entamoeba invadens
VHEDSDGY

SEQ ID NO: 2782443 - protein, 9 aa, Entamoeba invadens
VHEESTRQK

SEQ ID NO: 2782444 - protein, 6 aa, Entamoeba invadens
VHEPDE

SEQ ID NO: 2782445 - protein, 6 aa, Entamoeba invadens
VHESGN

SEQ ID NO: 2782446 - protein, 4 aa, Entamoeba invadens
VHGD

SEQ ID NO: 2782447 - protein, 12 aa, Entamoeba invadens
VHNEGKKTCDKC

SEQ ID NO: 2782448 - protein, 6 aa, Entamoeba invadens
VHPSNT

SEQ ID NO: 2782449 - protein, 6 aa, Entamoeba invadens
VHSDKA

SEQ ID NO: 2782450 - protein, 12 aa, Entamoeba invadens
VIAPQQNNPSFP

SEQ ID NO: 2782451 - protein, 27 aa, Entamoeba invadens
VIDDENADSLSVPPSLPVNEHAAILKE

SEQ ID NO: 2782452 - protein, 4 aa, Entamoeba invadens
VIDK

SEQ ID NO: 2782453 - protein, 5 aa, Entamoeba invadens
VIDTT

SEQ ID NO: 2782454 - protein, 5 aa, Entamoeba invadens
VIEQN

SEQ ID NO: 2782455 - protein, 7 aa, Entamoeba invadens
VIERDGY

SEQ ID NO: 2782456 - protein, 5 aa, Entamoeba invadens
VIEST

SEQ ID NO: 2782457 - protein, 5 aa, Entamoeba invadens
VIGEG

SEQ ID NO: 2782458 - protein, 9 aa, Entamoeba invadens
VIGNSPDEC

SEQ ID NO: 2782459 - protein, 12 aa, Entamoeba invadens
VIGSNDTKTTVK

SEQ ID NO: 2782460 - protein, 5 aa, Entamoeba invadens
VIGTY

SEQ ID NO: 2782461 - protein, 15 aa, Entamoeba invadens
VIKNNSKTSDEPNFS

SEQ ID NO: 2782462 - protein, 19 aa, Entamoeba invadens
VINDTGKCEEEKNGKSYGI

SEQ ID NO: 2782463 - protein, 11 aa, Entamoeba invadens
VINNEKKSIKY

SEQ ID NO: 2782464 - protein, 13 aa, Entamoeba invadens
VINQEKKMKEHET

SEQ ID NO: 2782465 - protein, 7 aa, Entamoeba invadens
VINRSPT

SEQ ID NO: 2782466 - protein, 13 aa, Entamoeba invadens
VINSTGKCTDITT

SEQ ID NO: 2782467 - protein, 11 aa, Entamoeba invadens
VIPNEGYEGTY

SEQ ID NO: 2782468 - protein, 14 aa, Entamoeba invadens
VIPPDSSNSPTQEI

SEQ ID NO: 2782469 - protein, 9 aa, Entamoeba invadens
VIPQSTESM

SEQ ID NO: 2782470 - protein, 12 aa, Entamoeba invadens
VIPSNKGGKSFD

SEQ ID NO: 2782471 - protein, 5 aa, Entamoeba invadens
VISGG

SEQ ID NO: 2782472 - protein, 11 aa, Entamoeba invadens
VISSDKDTLDK

SEQ ID NO: 2782473 - protein, 11 aa, Entamoeba invadens
VISSTSNNVNI

SEQ ID NO: 2782474 - protein, 6 aa, Entamoeba invadens
VISTTG

SEQ ID NO: 2782475 - protein, 9 aa, Entamoeba invadens
VITTNGDCS

SEQ ID NO: 2782476 - protein, 15 aa, Entamoeba invadens
VKAEKVKKVGDKKED

SEQ ID NO: 2782477 - protein, 6 aa, Entamoeba invadens
VKAENA

SEQ ID NO: 2782478 - protein, 7 aa, Entamoeba invadens
VKAETAA

SEQ ID NO: 2782479 - protein, 9 aa, Entamoeba invadens
VKATGGCES

SEQ ID NO: 2782480 - protein, 7 aa, Entamoeba invadens
VKCTKAN

SEQ ID NO: 2782481 - protein, 12 aa, Entamoeba invadens
VKDAEDQFKWIN

SEQ ID NO: 2782482 - protein, 5 aa, Entamoeba invadens
VKDGL

SEQ ID NO: 2782483 - protein, 9 aa, Entamoeba invadens
VKDGTTPCS

SEQ ID NO: 2782484 - protein, 11 aa, Entamoeba invadens
VKDQIGKDIPR

SEQ ID NO: 2782485 - protein, 8 aa, Entamoeba invadens
VKDTDGIS

SEQ ID NO: 2782486 - protein, 7 aa, Entamoeba invadens
VKDTEKA

SEQ ID NO: 2782487 - protein, 7 aa, Entamoeba invadens
VKEAKNI

SEQ ID NO: 2782488 - protein, 23 aa, Entamoeba invadens
VKEEKESEEKEDELVQQEAKITD

SEQ ID NO: 2782489 - protein, 9 aa, Entamoeba invadens
VKEGKNPRV

SEQ ID NO: 2782490 - protein, 5 aa, Entamoeba invadens
VKEGS

SEQ ID NO: 2782491 - protein, 9 aa, Entamoeba invadens
VKEKRPTES

SEQ ID NO: 2782492 - protein, 4 aa, Entamoeba invadens
VKEL

SEQ ID NO: 2782493 - protein, 20 aa, Entamoeba invadens
VKENENTKIVENKEDNPMAH

SEQ ID NO: 2782494 - protein, 8 aa, Entamoeba invadens
VKENNTRI

SEQ ID NO: 2782495 - protein, 9 aa, Entamoeba invadens
VKEPAQKVS

SEQ ID NO: 2782496 - protein, 15 aa, Entamoeba invadens
VKEPEPENKDEDIEK

SEQ ID NO: 2782497 - protein, 15 aa, Entamoeba invadens
VKEPQTDVPSETEGV

SEQ ID NO: 2782498 - protein, 7 aa, Entamoeba invadens
VKESSSF

SEQ ID NO: 2782499 - protein, 7 aa, Entamoeba invadens
VKESTSK

SEQ ID NO: 2782500 - protein, 6 aa, Entamoeba invadens
VKETPM

SEQ ID NO: 2782501 - protein, 7 aa, Entamoeba invadens
VKETQDV

SEQ ID NO: 2782502 - protein, 10 aa, Entamoeba invadens
VKETSECDNK

SEQ ID NO: 2782503 - protein, 10 aa, Entamoeba invadens
VKETSECDSK

SEQ ID NO: 2782504 - protein, 8 aa, Entamoeba invadens
VKEYPNPC

SEQ ID NO: 2782505 - protein, 8 aa, Entamoeba invadens
VKEYQGDV

SEQ ID NO: 2782506 - protein, 8 aa, Entamoeba invadens
VKGAEKEM

SEQ ID NO: 2782507 - protein, 5 aa, Entamoeba invadens
VKGAQ

SEQ ID NO: 2782508 - protein, 18 aa, Entamoeba invadens
VKGDEGEKLVKNDEKNIE

SEQ ID NO: 2782509 - protein, 7 aa, Entamoeba invadens
VKGDESL

SEQ ID NO: 2782510 - protein, 6 aa, Entamoeba invadens
VKGDFD

SEQ ID NO: 2782511 - protein, 14 aa, Entamoeba invadens
VKGDGQDASDKKWE

SEQ ID NO: 2782512 - protein, 6 aa, Entamoeba invadens
VKGDTL

SEQ ID NO: 2782513 - protein, 4 aa, Entamoeba invadens
VKGS

SEQ ID NO: 2782514 - protein, 9 aa, Entamoeba invadens
VKGSSNTQI

SEQ ID NO: 2782515 - protein, 5 aa, Entamoeba invadens
VKGST

SEQ ID NO: 2782516 - protein, 7 aa, Entamoeba invadens
VKGSTAN

SEQ ID NO: 2782517 - protein, 7 aa, Entamoeba invadens
VKGSTPI

SEQ ID NO: 2782518 - protein, 7 aa, Entamoeba invadens
VKHDESV

SEQ ID NO: 2782519 - protein, 8 aa, Entamoeba invadens
VKIKGSQY

SEQ ID NO: 2782520 - protein, 12 aa, Entamoeba invadens
VKINTKDTFTPS

SEQ ID NO: 2782521 - protein, 16 aa, Entamoeba invadens
VKKDNKSDSESESESF

SEQ ID NO: 2782522 - protein, 14 aa, Entamoeba invadens
VKKDNKSDSESESF

SEQ ID NO: 2782523 - protein, 9 aa, Entamoeba invadens
VKKEKQERS

SEQ ID NO: 2782524 - protein, 19 aa, Entamoeba invadens
VKKENDKTQTLEATISPRP

SEQ ID NO: 2782525 - protein, 4 aa, Entamoeba invadens
VKKG

SEQ ID NO: 2782526 - protein, 4 aa, Entamoeba invadens
VKKK

SEQ ID NO: 2782527 - protein, 8 aa, Entamoeba invadens
VKKKNLEK

SEQ ID NO: 2782528 - protein, 10 aa, Entamoeba invadens
VKKKPEKDFV

SEQ ID NO: 2782529 - protein, 14 aa, Entamoeba invadens
VKKKPKKDYIPERR

SEQ ID NO: 2782530 - protein, 19 aa, Entamoeba invadens
VKKNDTEKSVEENKEDPIE

SEQ ID NO: 2782531 - protein, 9 aa, Entamoeba invadens
VKKNNSQKM

SEQ ID NO: 2782532 - protein, 5 aa, Entamoeba invadens
VKKPT

SEQ ID NO: 2782533 - protein, 4 aa, Entamoeba invadens
VKKR

SEQ ID NO: 2782534 - protein, 8 aa, Entamoeba invadens
VKKRTDKD

SEQ ID NO: 2782535 - protein, 19 aa, Entamoeba invadens
VKKSDDKTLQQENETEKEV

SEQ ID NO: 2782536 - protein, 5 aa, Entamoeba invadens
VKKSK

SEQ ID NO: 2782537 - protein, 7 aa, Entamoeba invadens
VKKSKEI

SEQ ID NO: 2782538 - protein, 9 aa, Entamoeba invadens
VKKSVKEDA

SEQ ID NO: 2782539 - protein, 4 aa, Entamoeba invadens
VKLD

SEQ ID NO: 2782540 - protein, 7 aa, Entamoeba invadens
VKLGEGS

SEQ ID NO: 2782541 - protein, 4 aa, Entamoeba invadens
VKNA

SEQ ID NO: 2782542 - protein, 8 aa, Entamoeba invadens
VKNEDDTF

SEQ ID NO: 2782543 - protein, 5 aa, Entamoeba invadens
VKNEE

SEQ ID NO: 2782544 - protein, 14 aa, Entamoeba invadens
VKNESKGVYERSDN

SEQ ID NO: 2782545 - protein, 7 aa, Entamoeba invadens
VKNHSRN

SEQ ID NO: 2782546 - protein, 4 aa, Entamoeba invadens
VKNK

SEQ ID NO: 2782547 - protein, 5 aa, Entamoeba invadens
VKNPL

SEQ ID NO: 2782548 - protein, 8 aa, Entamoeba invadens
VKNRSRNK

SEQ ID NO: 2782549 - protein, 7 aa, Entamoeba invadens
VKNSDIQ

SEQ ID NO: 2782550 - protein, 7 aa, Entamoeba invadens
VKNTASY

SEQ ID NO: 2782551 - protein, 18 aa, Entamoeba invadens
VKNTQSDGFESSKNIDCA

SEQ ID NO: 2782552 - protein, 8 aa, Entamoeba invadens
VKNTSEQD

SEQ ID NO: 2782553 - protein, 8 aa, Entamoeba invadens
VKPDSQCE

SEQ ID NO: 2782554 - protein, 8 aa, Entamoeba invadens
VKPEEDNK

SEQ ID NO: 2782555 - protein, 21 aa, Entamoeba invadens
VKPEEIPEGRFSTGNYMPTEG

SEQ ID NO: 2782556 - protein, 4 aa, Entamoeba invadens
VKPG

SEQ ID NO: 2782557 - protein, 12 aa, Entamoeba invadens
VKPGSKIEELEE

SEQ ID NO: 2782558 - protein, 10 aa, Entamoeba invadens
VKPINPDYYD

SEQ ID NO: 2782559 - protein, 4 aa, Entamoeba invadens
VKPK

SEQ ID NO: 2782560 - protein, 25 aa, Entamoeba invadens
VKPKNKNVNKNNESSSSNVNIQKAN

SEQ ID NO: 2782561 - protein, 6 aa, Entamoeba invadens
VKPNCD

SEQ ID NO: 2782562 - protein, 7 aa, Entamoeba invadens
VKPSDMN

SEQ ID NO: 2782563 - protein, 5 aa, Entamoeba invadens
VKPTN

SEQ ID NO: 2782564 - protein, 10 aa, Entamoeba invadens
VKPTSEDVSK

SEQ ID NO: 2782565 - protein, 4 aa, Entamoeba invadens
VKQE

SEQ ID NO: 2782566 - protein, 15 aa, Entamoeba invadens
VKQESDEDAKEKMDN

SEQ ID NO: 2782567 - protein, 8 aa, Entamoeba invadens
VKQLPTHN

SEQ ID NO: 2782568 - protein, 6 aa, Entamoeba invadens
VKRATK

SEQ ID NO: 2782569 - protein, 8 aa, Entamoeba invadens
VKRKGNYQ

SEQ ID NO: 2782570 - protein, 6 aa, Entamoeba invadens
VKRKPS

SEQ ID NO: 2782571 - protein, 27 aa, Entamoeba invadens
VKRKRSRMSSTDFQSVTASEEATKSMT

SEQ ID NO: 2782572 - protein, 26 aa, Entamoeba invadens
VKRTTNSKRKGSQSSGNSGKKSPEEL

SEQ ID NO: 2782573 - protein, 14 aa, Entamoeba invadens
VKSDINGEVTTNNN

SEQ ID NO: 2782574 - protein, 13 aa, Entamoeba invadens
VKSEKAEDQTEEI

SEQ ID NO: 2782575 - protein, 9 aa, Entamoeba invadens
VKSGEETLN

SEQ ID NO: 2782576 - protein, 7 aa, Entamoeba invadens
VKSIETR

SEQ ID NO: 2782577 - protein, 20 aa, Entamoeba invadens
VKSPFEQQQPTPQPSPGQQI

SEQ ID NO: 2782578 - protein, 5 aa, Entamoeba invadens
VKSSH

SEQ ID NO: 2782579 - protein, 16 aa, Entamoeba invadens
VKSSKAITVNTTTPLA

SEQ ID NO: 2782580 - protein, 5 aa, Entamoeba invadens
VKSTI

SEQ ID NO: 2782581 - protein, 8 aa, Entamoeba invadens
VKSTKAPP

SEQ ID NO: 2782582 - protein, 12 aa, Entamoeba invadens
VKTCSSSTTTNS

SEQ ID NO: 2782583 - protein, 46 aa, Entamoeba invadens
VKTEKRRMTEENIRNQTKGDQQDLDSQNDNTKTLENSNQTTPIQTQ

SEQ ID NO: 2782584 - protein, 8 aa, Entamoeba invadens
VKTGNDSS

SEQ ID NO: 2782585 - protein, 22 aa, Entamoeba invadens
VKTGNSCNTLKASNMKTAGSSD

SEQ ID NO: 2782586 - protein, 6 aa, Entamoeba invadens
VKTGYR

SEQ ID NO: 2782587 - protein, 11 aa, Entamoeba invadens
VKTKEPEKTQV

SEQ ID NO: 2782588 - protein, 11 aa, Entamoeba invadens
VKTLSTSEQGC

SEQ ID NO: 2782589 - protein, 9 aa, Entamoeba invadens
VKTNGYSVT

SEQ ID NO: 2782590 - protein, 14 aa, Entamoeba invadens
VKTPDIKIESGSEN

SEQ ID NO: 2782591 - protein, 7 aa, Entamoeba invadens
VKTPTRT

SEQ ID NO: 2782592 - protein, 5 aa, Entamoeba invadens
VKTPV

SEQ ID NO: 2782593 - protein, 8 aa, Entamoeba invadens
VKTQDSEQ

SEQ ID NO: 2782594 - protein, 6 aa, Entamoeba invadens
VKTSKY

SEQ ID NO: 2782595 - protein, 13 aa, Entamoeba invadens
VKTSNGNCERLTT

SEQ ID NO: 2782596 - protein, 11 aa, Entamoeba invadens
VKTTPKGEQIK

SEQ ID NO: 2782597 - protein, 4 aa, Entamoeba invadens
VKVN

SEQ ID NO: 2782598 - protein, 12 aa, Entamoeba invadens
VKVSNGDDKQLN

SEQ ID NO: 2782599 - protein, 7 aa, Entamoeba invadens
VKVTSNG

SEQ ID NO: 2782600 - protein, 7 aa, Entamoeba invadens
VKYATKS

SEQ ID NO: 2782601 - protein, 5 aa, Entamoeba invadens
VKYDD

SEQ ID NO: 2782602 - protein, 13 aa, Entamoeba invadens
VKYNDDGKGDKNV

SEQ ID NO: 2782603 - protein, 12 aa, Entamoeba invadens
VKYNPEEYKDDP

SEQ ID NO: 2782604 - protein, 6 aa, Entamoeba invadens
VKYQGQ

SEQ ID NO: 2782605 - protein, 7 aa, Entamoeba invadens
VKYSEPY

SEQ ID NO: 2782606 - protein, 9 aa, Entamoeba invadens
VKYSSTSNN

SEQ ID NO: 2782607 - protein, 11 aa, Entamoeba invadens
VKYTRGVNNSQ

SEQ ID NO: 2782608 - protein, 9 aa, Entamoeba invadens
VLDSNEDCD

SEQ ID NO: 2782609 - protein, 6 aa, Entamoeba invadens
VLDSNG

SEQ ID NO: 2782610 - protein, 12 aa, Entamoeba invadens
VLEGKRPKIDDR

SEQ ID NO: 2782611 - protein, 12 aa, Entamoeba invadens
VLNDNKSMDEFE

SEQ ID NO: 2782612 - protein, 17 aa, Entamoeba invadens
VLNSGEYKFGSYNSTDF

SEQ ID NO: 2782613 - protein, 23 aa, Entamoeba invadens
VLPESTDSLQKEGVSEPTETQGI

SEQ ID NO: 2782614 - protein, 7 aa, Entamoeba invadens
VLPTNDP

SEQ ID NO: 2782615 - protein, 6 aa, Entamoeba invadens
VLPTTS

SEQ ID NO: 2782616 - protein, 11 aa, Entamoeba invadens
VLSDNGSIEEF

SEQ ID NO: 2782617 - protein, 10 aa, Entamoeba invadens
VLSGNSSREF

SEQ ID NO: 2782618 - protein, 9 aa, Entamoeba invadens
VLSGTGQIE

SEQ ID NO: 2782619 - protein, 6 aa, Entamoeba invadens
VLSSGS

SEQ ID NO: 2782620 - protein, 6 aa, Entamoeba invadens
VLTKNT

SEQ ID NO: 2782621 - protein, 11 aa, Entamoeba invadens
VLTNDTYQQKR

SEQ ID NO: 2782622 - protein, 7 aa, Entamoeba invadens
VLTPTGG

SEQ ID NO: 2782623 - protein, 8 aa, Entamoeba invadens
VLTSKPAI

SEQ ID NO: 2782624 - protein, 4 aa, Entamoeba invadens
VLTT

SEQ ID NO: 2782625 - protein, 24 aa, Entamoeba invadens
VLTTKSETKEGSSKLEGCEYGSDI

SEQ ID NO: 2782626 - protein, 5 aa, Entamoeba invadens
VMAQN

SEQ ID NO: 2782627 - protein, 9 aa, Entamoeba invadens
VNAHPNAKK

SEQ ID NO: 2782628 - protein, 9 aa, Entamoeba invadens
VNANESERT

SEQ ID NO: 2782629 - protein, 5 aa, Entamoeba invadens
VNAQQ

SEQ ID NO: 2782630 - protein, 7 aa, Entamoeba invadens
VNASNEW

SEQ ID NO: 2782631 - protein, 13 aa, Entamoeba invadens
VNASRQSKRNGTI

SEQ ID NO: 2782632 - protein, 14 aa, Entamoeba invadens
VNASSNETTTSPHF

SEQ ID NO: 2782633 - protein, 5 aa, Entamoeba invadens
VNATD

SEQ ID NO: 2782634 - protein, 10 aa, Entamoeba invadens
VNCADGDTID

SEQ ID NO: 2782635 - protein, 16 aa, Entamoeba invadens
VNCEPNKESKFEVDPE

SEQ ID NO: 2782636 - protein, 15 aa, Entamoeba invadens
VNCEPNKESKFEVEP

SEQ ID NO: 2782637 - protein, 13 aa, Entamoeba invadens
VNCERTSQSGCAQ

SEQ ID NO: 2782638 - protein, 13 aa, Entamoeba invadens
VNCKRTNQSGCAQ

SEQ ID NO: 2782639 - protein, 4 aa, Entamoeba invadens
VNDE

SEQ ID NO: 2782640 - protein, 10 aa, Entamoeba invadens
VNDESTSNGC

SEQ ID NO: 2782641 - protein, 10 aa, Entamoeba invadens
VNDGQCKPCS

SEQ ID NO: 2782642 - protein, 7 aa, Entamoeba invadens
VNDMPNQ

SEQ ID NO: 2782643 - protein, 6 aa, Entamoeba invadens
VNDPRA

SEQ ID NO: 2782644 - protein, 4 aa, Entamoeba invadens
VNDR

SEQ ID NO: 2782645 - protein, 9 aa, Entamoeba invadens
VNEETGSGN

SEQ ID NO: 2782646 - protein, 6 aa, Entamoeba invadens
VNEETK

SEQ ID NO: 2782647 - protein, 6 aa, Entamoeba invadens
VNEETR

SEQ ID NO: 2782648 - protein, 6 aa, Entamoeba invadens
VNEHKN

SEQ ID NO: 2782649 - protein, 8 aa, Entamoeba invadens
VNEKNNCG

SEQ ID NO: 2782650 - protein, 6 aa, Entamoeba invadens
VNEKSS

SEQ ID NO: 2782651 - protein, 10 aa, Entamoeba invadens
VNEKTNIVGE

SEQ ID NO: 2782652 - protein, 4 aa, Entamoeba invadens
VNEN

SEQ ID NO: 2782653 - protein, 7 aa, Entamoeba invadens
VNENGEE

SEQ ID NO: 2782654 - protein, 7 aa, Entamoeba invadens
VNEPEED

SEQ ID NO: 2782655 - protein, 7 aa, Entamoeba invadens
VNEQEPR

SEQ ID NO: 2782656 - protein, 8 aa, Entamoeba invadens
VNERPDAY

SEQ ID NO: 2782657 - protein, 5 aa, Entamoeba invadens
VNESD

SEQ ID NO: 2782658 - protein, 9 aa, Entamoeba invadens
VNESDCDKL

SEQ ID NO: 2782659 - protein, 4 aa, Entamoeba invadens
VNET

SEQ ID NO: 2782660 - protein, 8 aa, Entamoeba invadens
VNETDDKQ

SEQ ID NO: 2782661 - protein, 6 aa, Entamoeba invadens
VNETEF

SEQ ID NO: 2782662 - protein, 27 aa, Entamoeba invadens
VNETKGQYSYQTQNPSPQKKTQSTYGG

SEQ ID NO: 2782663 - protein, 14 aa, Entamoeba invadens
VNETNEENGQCTLP

SEQ ID NO: 2782664 - protein, 13 aa, Entamoeba invadens
VNETPSKNAKYDM

SEQ ID NO: 2782665 - protein, 9 aa, Entamoeba invadens
VNETPSKNI

SEQ ID NO: 2782666 - protein, 8 aa, Entamoeba invadens
VNFETTST

SEQ ID NO: 2782667 - protein, 13 aa, Entamoeba invadens
VNFETTSTITIDN

SEQ ID NO: 2782668 - protein, 6 aa, Entamoeba invadens
VNGCEK

SEQ ID NO: 2782669 - protein, 7 aa, Entamoeba invadens
VNGCETC

SEQ ID NO: 2782670 - protein, 5 aa, Entamoeba invadens
VNGCT

SEQ ID NO: 2782671 - protein, 6 aa, Entamoeba invadens
VNGCTA

SEQ ID NO: 2782672 - protein, 8 aa, Entamoeba invadens
VNGDGLDG

SEQ ID NO: 2782673 - protein, 8 aa, Entamoeba invadens
VNGEPNKC

SEQ ID NO: 2782674 - protein, 7 aa, Entamoeba invadens
VNGESGS

SEQ ID NO: 2782675 - protein, 15 aa, Entamoeba invadens
VNGGKDGSKSLTSPI

SEQ ID NO: 2782676 - protein, 10 aa, Entamoeba invadens
VNGKDTKKSE

SEQ ID NO: 2782677 - protein, 5 aa, Entamoeba invadens
VNGKG

SEQ ID NO: 2782678 - protein, 11 aa, Entamoeba invadens
VNGKLTDFGSA

SEQ ID NO: 2782679 - protein, 12 aa, Entamoeba invadens
VNGKLTDFGSSR

SEQ ID NO: 2782680 - protein, 7 aa, Entamoeba invadens
VNGKPTK

SEQ ID NO: 2782681 - protein, 9 aa, Entamoeba invadens
VNGNNTRYG

SEQ ID NO: 2782682 - protein, 8 aa, Entamoeba invadens
VNGQELQK

SEQ ID NO: 2782683 - protein, 8 aa, Entamoeba invadens
VNGTGEIT

SEQ ID NO: 2782684 - protein, 6 aa, Entamoeba invadens
VNGTGL

SEQ ID NO: 2782685 - protein, 11 aa, Entamoeba invadens
VNGTKGNGGDY

SEQ ID NO: 2782686 - protein, 15 aa, Entamoeba invadens
VNGTSDKCSEEFTDP

SEQ ID NO: 2782687 - protein, 5 aa, Entamoeba invadens
VNHSS

SEQ ID NO: 2782688 - protein, 5 aa, Entamoeba invadens
VNIEG

SEQ ID NO: 2782689 - protein, 6 aa, Entamoeba invadens
VNIQGQ

SEQ ID NO: 2782690 - protein, 4 aa, Entamoeba invadens
VNKC

SEQ ID NO: 2782691 - protein, 7 aa, Entamoeba invadens
VNKDERC

SEQ ID NO: 2782692 - protein, 13 aa, Entamoeba invadens
VNKDKQRPTPLQE

SEQ ID NO: 2782693 - protein, 10 aa, Entamoeba invadens
VNKDQTLSLG

SEQ ID NO: 2782694 - protein, 8 aa, Entamoeba invadens
VNKETQTS

SEQ ID NO: 2782695 - protein, 12 aa, Entamoeba invadens
VNKKTEIKKETC

SEQ ID NO: 2782696 - protein, 5 aa, Entamoeba invadens
VNKTK

SEQ ID NO: 2782697 - protein, 7 aa, Entamoeba invadens
VNKTSTF

SEQ ID NO: 2782698 - protein, 7 aa, Entamoeba invadens
VNKTTQD

SEQ ID NO: 2782699 - protein, 9 aa, Entamoeba invadens
VNLNETSEE

SEQ ID NO: 2782700 - protein, 14 aa, Entamoeba invadens
VNLTSSDLNLTNNS

SEQ ID NO: 2782701 - protein, 10 aa, Entamoeba invadens
VNNGKKYDYC

SEQ ID NO: 2782702 - protein, 6 aa, Entamoeba invadens
VNNGTQ

SEQ ID NO: 2782703 - protein, 16 aa, Entamoeba invadens
VNNGTYSAQSPDEEAL

SEQ ID NO: 2782704 - protein, 8 aa, Entamoeba invadens
VNNNENIG

SEQ ID NO: 2782705 - protein, 7 aa, Entamoeba invadens
VNNPPTT

SEQ ID NO: 2782706 - protein, 9 aa, Entamoeba invadens
VNNPTEYKN

SEQ ID NO: 2782707 - protein, 4 aa, Entamoeba invadens
VNNT

SEQ ID NO: 2782708 - protein, 15 aa, Entamoeba invadens
VNNTENCEIQNGQNE

SEQ ID NO: 2782709 - protein, 15 aa, Entamoeba invadens
VNNTKNCEIQNGQNE

SEQ ID NO: 2782710 - protein, 7 aa, Entamoeba invadens
VNPETDM

SEQ ID NO: 2782711 - protein, 4 aa, Entamoeba invadens
VNPI

SEQ ID NO: 2782712 - protein, 7 aa, Entamoeba invadens
VNPKKIQ

SEQ ID NO: 2782713 - protein, 6 aa, Entamoeba invadens
VNPPTL

SEQ ID NO: 2782714 - protein, 10 aa, Entamoeba invadens
VNPQEPISAA

SEQ ID NO: 2782715 - protein, 8 aa, Entamoeba invadens
VNPTFNPD

SEQ ID NO: 2782716 - protein, 6 aa, Entamoeba invadens
VNPYYN

SEQ ID NO: 2782717 - protein, 27 aa, Entamoeba invadens
VNQKNTLKANQKNTLKANQKKSHQLKR

SEQ ID NO: 2782718 - protein, 20 aa, Entamoeba invadens
VNQKNTLKANQKNTLKANQR

SEQ ID NO: 2782719 - protein, 35 aa, Entamoeba invadens
VNQKNTLKANQKNTLKANQRNTLKANQKKSHQLKR

SEQ ID NO: 2782720 - protein, 14 aa, Entamoeba invadens
VNQNKSDPTPLQES

SEQ ID NO: 2782721 - protein, 21 aa, Entamoeba invadens
VNQNNECKSCAESAAKSQQCN

SEQ ID NO: 2782722 - protein, 9 aa, Entamoeba invadens
VNRANPTID

SEQ ID NO: 2782723 - protein, 8 aa, Entamoeba invadens
VNRRRNPN

SEQ ID NO: 2782724 - protein, 5 aa, Entamoeba invadens
VNRRS

SEQ ID NO: 2782725 - protein, 5 aa, Entamoeba invadens
VNSDN

SEQ ID NO: 2782726 - protein, 33 aa, Entamoeba invadens
VNSGGSCESIGSSECTESNNTYCSGCSDKSDFI

SEQ ID NO: 2782727 - protein, 10 aa, Entamoeba invadens
VNSKGDSCND

SEQ ID NO: 2782728 - protein, 8 aa, Entamoeba invadens
VNSKGTCG

SEQ ID NO: 2782729 - protein, 14 aa, Entamoeba invadens
VNSKITVNSNSIVS

SEQ ID NO: 2782730 - protein, 7 aa, Entamoeba invadens
VNSKYSY

SEQ ID NO: 2782731 - protein, 4 aa, Entamoeba invadens
VNSN

SEQ ID NO: 2782732 - protein, 6 aa, Entamoeba invadens
VNSNDK

SEQ ID NO: 2782733 - protein, 11 aa, Entamoeba invadens
VNSPDTPMNSE

SEQ ID NO: 2782734 - protein, 7 aa, Entamoeba invadens
VNSPNVH

SEQ ID NO: 2782735 - protein, 10 aa, Entamoeba invadens
VNSQDSFGNT

SEQ ID NO: 2782736 - protein, 6 aa, Entamoeba invadens
VNSQID

SEQ ID NO: 2782737 - protein, 7 aa, Entamoeba invadens
VNSQYAK

SEQ ID NO: 2782738 - protein, 5 aa, Entamoeba invadens
VNSRG

SEQ ID NO: 2782739 - protein, 6 aa, Entamoeba invadens
VNSSDI

SEQ ID NO: 2782740 - protein, 9 aa, Entamoeba invadens
VNSTNKGVD

SEQ ID NO: 2782741 - protein, 6 aa, Entamoeba invadens
VNSTNR

SEQ ID NO: 2782742 - protein, 7 aa, Entamoeba invadens
VNSTPDQ

SEQ ID NO: 2782743 - protein, 12 aa, Entamoeba invadens
VNSTQENLKRNS

SEQ ID NO: 2782744 - protein, 8 aa, Entamoeba invadens
VNSTTIID

SEQ ID NO: 2782745 - protein, 14 aa, Entamoeba invadens
VNTEGTQCNKKTNY

SEQ ID NO: 2782746 - protein, 10 aa, Entamoeba invadens
VNTEQSTKLN

SEQ ID NO: 2782747 - protein, 6 aa, Entamoeba invadens
VNTEQT

SEQ ID NO: 2782748 - protein, 7 aa, Entamoeba invadens
VNTGKTY

SEQ ID NO: 2782749 - protein, 9 aa, Entamoeba invadens
VNTGNKVPG

SEQ ID NO: 2782750 - protein, 8 aa, Entamoeba invadens
VNTKQGTA

SEQ ID NO: 2782751 - protein, 6 aa, Entamoeba invadens
VNTNDR

SEQ ID NO: 2782752 - protein, 6 aa, Entamoeba invadens
VNTNGN

SEQ ID NO: 2782753 - protein, 9 aa, Entamoeba invadens
VNTPEGEKG

SEQ ID NO: 2782754 - protein, 8 aa, Entamoeba invadens
VNTRPSFK

SEQ ID NO: 2782755 - protein, 4 aa, Entamoeba invadens
VNTS

SEQ ID NO: 2782756 - protein, 5 aa, Entamoeba invadens
VNTSE

SEQ ID NO: 2782757 - protein, 5 aa, Entamoeba invadens
VNTSK

SEQ ID NO: 2782758 - protein, 22 aa, Entamoeba invadens
VNTTSEIKCESRTNKGCQRCSD

SEQ ID NO: 2782759 - protein, 4 aa, Entamoeba invadens
VNTV

SEQ ID NO: 2782760 - protein, 9 aa, Entamoeba invadens
VNTVTNADS

SEQ ID NO: 2782761 - protein, 7 aa, Entamoeba invadens
VNVTSSP

SEQ ID NO: 2782762 - protein, 9 aa, Entamoeba invadens
VNYKSSNPA

SEQ ID NO: 2782763 - protein, 4 aa, Entamoeba invadens
VPAK

SEQ ID NO: 2782764 - protein, 5 aa, Entamoeba invadens
VPAVS

SEQ ID NO: 2782765 - protein, 7 aa, Entamoeba invadens
VPDDAGP

SEQ ID NO: 2782766 - protein, 6 aa, Entamoeba invadens
VPDESN

SEQ ID NO: 2782767 - protein, 4 aa, Entamoeba invadens
VPDG

SEQ ID NO: 2782768 - protein, 16 aa, Entamoeba invadens
VPDGAKLQSSTTSPIE

SEQ ID NO: 2782769 - protein, 9 aa, Entamoeba invadens
VPDKRPSFT

SEQ ID NO: 2782770 - protein, 8 aa, Entamoeba invadens
VPDKVSEI

SEQ ID NO: 2782771 - protein, 10 aa, Entamoeba invadens
VPDNSENDKM

SEQ ID NO: 2782772 - protein, 14 aa, Entamoeba invadens
VPDPDNKGSCKGSN

SEQ ID NO: 2782773 - protein, 10 aa, Entamoeba invadens
VPDRKQGEKR

SEQ ID NO: 2782774 - protein, 6 aa, Entamoeba invadens
VPDTNG

SEQ ID NO: 2782775 - protein, 9 aa, Entamoeba invadens
VPDTSTSKF

SEQ ID NO: 2782776 - protein, 6 aa, Entamoeba invadens
VPDYET

SEQ ID NO: 2782777 - protein, 4 aa, Entamoeba invadens
VPED

SEQ ID NO: 2782778 - protein, 6 aa, Entamoeba invadens
VPEDVD

SEQ ID NO: 2782779 - protein, 4 aa, Entamoeba invadens
VPEL

SEQ ID NO: 2782780 - protein, 10 aa, Entamoeba invadens
VPENGKTTCR

SEQ ID NO: 2782781 - protein, 5 aa, Entamoeba invadens
VPEQI

SEQ ID NO: 2782782 - protein, 8 aa, Entamoeba invadens
VPESESKT

SEQ ID NO: 2782783 - protein, 4 aa, Entamoeba invadens
VPEV

SEQ ID NO: 2782784 - protein, 8 aa, Entamoeba invadens
VPGCTSVS

SEQ ID NO: 2782785 - protein, 7 aa, Entamoeba invadens
VPGEGSI

SEQ ID NO: 2782786 - protein, 10 aa, Entamoeba invadens
VPGNNQSSYT

SEQ ID NO: 2782787 - protein, 8 aa, Entamoeba invadens
VPGQNDPS

SEQ ID NO: 2782788 - protein, 6 aa, Entamoeba invadens
VPGTAG

SEQ ID NO: 2782789 - protein, 11 aa, Entamoeba invadens
VPGYEDSQCTA

SEQ ID NO: 2782790 - protein, 8 aa, Entamoeba invadens
VPIDTADT

SEQ ID NO: 2782791 - protein, 8 aa, Entamoeba invadens
VPITDEQQ

SEQ ID NO: 2782792 - protein, 5 aa, Entamoeba invadens
VPKDQ

SEQ ID NO: 2782793 - protein, 16 aa, Entamoeba invadens
VPKERPSAERLQNKFS

SEQ ID NO: 2782794 - protein, 7 aa, Entamoeba invadens
VPKGQKN

SEQ ID NO: 2782795 - protein, 14 aa, Entamoeba invadens
VPKKRQKKLTPLAD

SEQ ID NO: 2782796 - protein, 6 aa, Entamoeba invadens
VPKNDN

SEQ ID NO: 2782797 - protein, 7 aa, Entamoeba invadens
VPKNEKV

SEQ ID NO: 2782798 - protein, 7 aa, Entamoeba invadens
VPKNGEF

SEQ ID NO: 2782799 - protein, 5 aa, Entamoeba invadens
VPKNT

SEQ ID NO: 2782800 - protein, 4 aa, Entamoeba invadens
VPKS

SEQ ID NO: 2782801 - protein, 9 aa, Entamoeba invadens
VPKTCGNNK

SEQ ID NO: 2782802 - protein, 7 aa, Entamoeba invadens
VPKTTMD

SEQ ID NO: 2782803 - protein, 18 aa, Entamoeba invadens
VPKTTRGERNKEFDAEDK

SEQ ID NO: 2782804 - protein, 4 aa, Entamoeba invadens
VPLE

SEQ ID NO: 2782805 - protein, 5 aa, Entamoeba invadens
VPLSE

SEQ ID NO: 2782806 - protein, 5 aa, Entamoeba invadens
VPLTP

SEQ ID NO: 2782807 - protein, 12 aa, Entamoeba invadens
VPMSPSEEARYN

SEQ ID NO: 2782808 - protein, 18 aa, Entamoeba invadens
VPNDVSLNNTTDEETIET

SEQ ID NO: 2782809 - protein, 4 aa, Entamoeba invadens
VPNG

SEQ ID NO: 2782810 - protein, 27 aa, Entamoeba invadens
VPNLNTSNLPPVAPERPKTPKAKAEMK

SEQ ID NO: 2782811 - protein, 4 aa, Entamoeba invadens
VPNS

SEQ ID NO: 2782812 - protein, 8 aa, Entamoeba invadens
VPNVSKVT

SEQ ID NO: 2782813 - protein, 8 aa, Entamoeba invadens
VPPATDTD

SEQ ID NO: 2782814 - protein, 9 aa, Entamoeba invadens
VPPETEPEL

SEQ ID NO: 2782815 - protein, 12 aa, Entamoeba invadens
VPPETPTRYEVP

SEQ ID NO: 2782816 - protein, 4 aa, Entamoeba invadens
VPPI

SEQ ID NO: 2782817 - protein, 18 aa, Entamoeba invadens
VPPPFTPNEKDSIPRNRA

SEQ ID NO: 2782818 - protein, 23 aa, Entamoeba invadens
VPPPPQVGNESEMQNAPAADGLD

SEQ ID NO: 2782819 - protein, 6 aa, Entamoeba invadens
VPPPTL

SEQ ID NO: 2782820 - protein, 6 aa, Entamoeba invadens
VPPSPL

SEQ ID NO: 2782821 - protein, 22 aa, Entamoeba invadens
VPQIQGSVTNIKEQQIKGFSPF

SEQ ID NO: 2782822 - protein, 14 aa, Entamoeba invadens
VPQPQLPKPPKGIK

SEQ ID NO: 2782823 - protein, 4 aa, Entamoeba invadens
VPQQ

SEQ ID NO: 2782824 - protein, 11 aa, Entamoeba invadens
VPQQSVGKECR

SEQ ID NO: 2782825 - protein, 36 aa, Entamoeba invadens
VPQYEEKSHSTEKKKGNKETKFDPNAPKLKASNGKP

SEQ ID NO: 2782826 - protein, 6 aa, Entamoeba invadens
VPRPKE

SEQ ID NO: 2782827 - protein, 11 aa, Entamoeba invadens
VPRTQTQRKKN

SEQ ID NO: 2782828 - protein, 4 aa, Entamoeba invadens
VPSA

SEQ ID NO: 2782829 - protein, 4 aa, Entamoeba invadens
VPSD

SEQ ID NO: 2782830 - protein, 6 aa, Entamoeba invadens
VPSDEI

SEQ ID NO: 2782831 - protein, 6 aa, Entamoeba invadens
VPSDVT

SEQ ID NO: 2782832 - protein, 4 aa, Entamoeba invadens
VPSG

SEQ ID NO: 2782833 - protein, 4 aa, Entamoeba invadens
VPSK

SEQ ID NO: 2782834 - protein, 8 aa, Entamoeba invadens
VPSKSTIG

SEQ ID NO: 2782835 - protein, 4 aa, Entamoeba invadens
VPSP

SEQ ID NO: 2782836 - protein, 7 aa, Entamoeba invadens
VPSPDTV

SEQ ID NO: 2782837 - protein, 6 aa, Entamoeba invadens
VPSPLG

SEQ ID NO: 2782838 - protein, 61 aa, Entamoeba invadens
VPSQSSSAETSEASSEVSSDNSSKDSSETSSTTSEQSKGSESASKSEDSKSASSSESGMTT

SEQ ID NO: 2782839 - protein, 6 aa, Entamoeba invadens
VPSSTN

SEQ ID NO: 2782840 - protein, 6 aa, Entamoeba invadens
VPSTNT

SEQ ID NO: 2782841 - protein, 18 aa, Entamoeba invadens
VPTCDNKQMDAYEQCDGG

SEQ ID NO: 2782842 - protein, 7 aa, Entamoeba invadens
VPTCGDN

SEQ ID NO: 2782843 - protein, 9 aa, Entamoeba invadens
VPTDDTRLT

SEQ ID NO: 2782844 - protein, 8 aa, Entamoeba invadens
VPTDSTRL

SEQ ID NO: 2782845 - protein, 9 aa, Entamoeba invadens
VPTGTNGGV

SEQ ID NO: 2782846 - protein, 12 aa, Entamoeba invadens
VPTNLSEKFPNK

SEQ ID NO: 2782847 - protein, 17 aa, Entamoeba invadens
VPTPEGELQQKKSVTHT

SEQ ID NO: 2782848 - protein, 19 aa, Entamoeba invadens
VPTPFTKSQKPGDSSLYDN

SEQ ID NO: 2782849 - protein, 11 aa, Entamoeba invadens
VPTPITTNGRY

SEQ ID NO: 2782850 - protein, 5 aa, Entamoeba invadens
VPTPQ

SEQ ID NO: 2782851 - protein, 8 aa, Entamoeba invadens
VPTQSDGA

SEQ ID NO: 2782852 - protein, 4 aa, Entamoeba invadens
VPTS

SEQ ID NO: 2782853 - protein, 7 aa, Entamoeba invadens
VPTSEDA

SEQ ID NO: 2782854 - protein, 11 aa, Entamoeba invadens
VPTTGTLEQPN

SEQ ID NO: 2782855 - protein, 5 aa, Entamoeba invadens
VPTTI

SEQ ID NO: 2782856 - protein, 7 aa, Entamoeba invadens
VPTTNHP

SEQ ID NO: 2782857 - protein, 7 aa, Entamoeba invadens
VPTTSTT

SEQ ID NO: 2782858 - protein, 7 aa, Entamoeba invadens
VPTTTTK

SEQ ID NO: 2782859 - protein, 12 aa, Entamoeba invadens
VPTTVTTNSAES

SEQ ID NO: 2782860 - protein, 5 aa, Entamoeba invadens
VPTVQ

SEQ ID NO: 2782861 - protein, 4 aa, Entamoeba invadens
VPWS

SEQ ID NO: 2782862 - protein, 6 aa, Entamoeba invadens
VPYENP

SEQ ID NO: 2782863 - protein, 9 aa, Entamoeba invadens
VQADGTVKY

SEQ ID NO: 2782864 - protein, 9 aa, Entamoeba invadens
VQASNAQQI

SEQ ID NO: 2782865 - protein, 12 aa, Entamoeba invadens
VQCDSDGKPVEK

SEQ ID NO: 2782866 - protein, 9 aa, Entamoeba invadens
VQDADEARR

SEQ ID NO: 2782867 - protein, 13 aa, Entamoeba invadens
VQDLTDAAKLGGF

SEQ ID NO: 2782868 - protein, 8 aa, Entamoeba invadens
VQDTESTL

SEQ ID NO: 2782869 - protein, 21 aa, Entamoeba invadens
VQDTKKKTTTTKEALQGETNE

SEQ ID NO: 2782870 - protein, 4 aa, Entamoeba invadens
VQED

SEQ ID NO: 2782871 - protein, 12 aa, Entamoeba invadens
VQFTPKGGSICS

SEQ ID NO: 2782872 - protein, 4 aa, Entamoeba invadens
VQGD

SEQ ID NO: 2782873 - protein, 4 aa, Entamoeba invadens
VQIQ

SEQ ID NO: 2782874 - protein, 13 aa, Entamoeba invadens
VQISGDSATNPVS

SEQ ID NO: 2782875 - protein, 4 aa, Entamoeba invadens
VQKA

SEQ ID NO: 2782876 - protein, 5 aa, Entamoeba invadens
VQKDG

SEQ ID NO: 2782877 - protein, 8 aa, Entamoeba invadens
VQKDSESK

SEQ ID NO: 2782878 - protein, 6 aa, Entamoeba invadens
VQKESL

SEQ ID NO: 2782879 - protein, 8 aa, Entamoeba invadens
VQKNQQKY

SEQ ID NO: 2782880 - protein, 17 aa, Entamoeba invadens
VQKPAQEQANEAAPFFG

SEQ ID NO: 2782881 - protein, 11 aa, Entamoeba invadens
VQKQKEKQKKH

SEQ ID NO: 2782882 - protein, 8 aa, Entamoeba invadens
VQKSPSPV

SEQ ID NO: 2782883 - protein, 31 aa, Entamoeba invadens
VQNEEKRRVDEKEGENENNDEKEKEKKRIEE

SEQ ID NO: 2782884 - protein, 9 aa, Entamoeba invadens
VQNGRSVSS

SEQ ID NO: 2782885 - protein, 8 aa, Entamoeba invadens
VQNNTGEV

SEQ ID NO: 2782886 - protein, 7 aa, Entamoeba invadens
VQNSNEG

SEQ ID NO: 2782887 - protein, 12 aa, Entamoeba invadens
VQNTGQSDMSTT

SEQ ID NO: 2782888 - protein, 20 aa, Entamoeba invadens
VQPKAPEYTYTPSISNEQNT

SEQ ID NO: 2782889 - protein, 10 aa, Entamoeba invadens
VQPPECKTTE

SEQ ID NO: 2782890 - protein, 9 aa, Entamoeba invadens
VQPTEGSAA

SEQ ID NO: 2782891 - protein, 5 aa, Entamoeba invadens
VQPTL

SEQ ID NO: 2782892 - protein, 21 aa, Entamoeba invadens
VQQEKAELNKTVEEKQATAIK

SEQ ID NO: 2782893 - protein, 4 aa, Entamoeba invadens
VQQK

SEQ ID NO: 2782894 - protein, 10 aa, Entamoeba invadens
VQQPTDKSLE

SEQ ID NO: 2782895 - protein, 6 aa, Entamoeba invadens
VQQQMQ

SEQ ID NO: 2782896 - protein, 5 aa, Entamoeba invadens
VQQTV

SEQ ID NO: 2782897 - protein, 7 aa, Entamoeba invadens
VQREQED

SEQ ID NO: 2782898 - protein, 10 aa, Entamoeba invadens
VQRNKNSKCN

SEQ ID NO: 2782899 - protein, 6 aa, Entamoeba invadens
VQRPSI

SEQ ID NO: 2782900 - protein, 7 aa, Entamoeba invadens
VQRSGDL

SEQ ID NO: 2782901 - protein, 4 aa, Entamoeba invadens
VQSA

SEQ ID NO: 2782902 - protein, 4 aa, Entamoeba invadens
VQSD

SEQ ID NO: 2782903 - protein, 8 aa, Entamoeba invadens
VQSKEIDF

SEQ ID NO: 2782904 - protein, 7 aa, Entamoeba invadens
VQSKPTS

SEQ ID NO: 2782905 - protein, 9 aa, Entamoeba invadens
VQSKRDMKN

SEQ ID NO: 2782906 - protein, 4 aa, Entamoeba invadens
VQSL

SEQ ID NO: 2782907 - protein, 5 aa, Entamoeba invadens
VQSNA

SEQ ID NO: 2782908 - protein, 6 aa, Entamoeba invadens
VQSNTF

SEQ ID NO: 2782909 - protein, 8 aa, Entamoeba invadens
VQSQTEEQ

SEQ ID NO: 2782910 - protein, 4 aa, Entamoeba invadens
VQSR

SEQ ID NO: 2782911 - protein, 6 aa, Entamoeba invadens
VQSRRM

SEQ ID NO: 2782912 - protein, 9 aa, Entamoeba invadens
VQSSSDPLS

SEQ ID NO: 2782913 - protein, 6 aa, Entamoeba invadens
VQTGET

SEQ ID NO: 2782914 - protein, 18 aa, Entamoeba invadens
VQTQSQSTLHTSPPAAVQ

SEQ ID NO: 2782915 - protein, 7 aa, Entamoeba invadens
VQTSSHN

SEQ ID NO: 2782916 - protein, 7 aa, Entamoeba invadens
VQTTKQS

SEQ ID NO: 2782917 - protein, 9 aa, Entamoeba invadens
VQYSRPPTR

SEQ ID NO: 2782918 - protein, 19 aa, Entamoeba invadens
VRAPPVTKDKPDEEEGERT

SEQ ID NO: 2782919 - protein, 8 aa, Entamoeba invadens
VRAPTQQE

SEQ ID NO: 2782920 - protein, 10 aa, Entamoeba invadens
VRDDPNPTNV

SEQ ID NO: 2782921 - protein, 6 aa, Entamoeba invadens
VRDNST

SEQ ID NO: 2782922 - protein, 9 aa, Entamoeba invadens
VRDSSTNEH

SEQ ID NO: 2782923 - protein, 9 aa, Entamoeba invadens
VREDGDEKT

SEQ ID NO: 2782924 - protein, 14 aa, Entamoeba invadens
VREDKKAKGYTSAT

SEQ ID NO: 2782925 - protein, 19 aa, Entamoeba invadens
VREDKKAKGYTSTTGCGDW

SEQ ID NO: 2782926 - protein, 11 aa, Entamoeba invadens
VREKEQGKTVE

SEQ ID NO: 2782927 - protein, 13 aa, Entamoeba invadens
VREKGGAQESVTM

SEQ ID NO: 2782928 - protein, 4 aa, Entamoeba invadens
VREM

SEQ ID NO: 2782929 - protein, 4 aa, Entamoeba invadens
VREN

SEQ ID NO: 2782930 - protein, 9 aa, Entamoeba invadens
VRENGENVT

SEQ ID NO: 2782931 - protein, 11 aa, Entamoeba invadens
VRGAPSKQTKY

SEQ ID NO: 2782932 - protein, 11 aa, Entamoeba invadens
VRGDKNEQKYS

SEQ ID NO: 2782933 - protein, 8 aa, Entamoeba invadens
VRGNWSDD

SEQ ID NO: 2782934 - protein, 5 aa, Entamoeba invadens
VRGPD

SEQ ID NO: 2782935 - protein, 6 aa, Entamoeba invadens
VRKDGK

SEQ ID NO: 2782936 - protein, 7 aa, Entamoeba invadens
VRKRQTA

SEQ ID NO: 2782937 - protein, 16 aa, Entamoeba invadens
VRNEEKKVYERSDSGK

SEQ ID NO: 2782938 - protein, 7 aa, Entamoeba invadens
VRNTSHK

SEQ ID NO: 2782939 - protein, 6 aa, Entamoeba invadens
VRPEPT

SEQ ID NO: 2782940 - protein, 5 aa, Entamoeba invadens
VRPGK

SEQ ID NO: 2782941 - protein, 6 aa, Entamoeba invadens
VRPSLG

SEQ ID NO: 2782942 - protein, 7 aa, Entamoeba invadens
VRPTPGA

SEQ ID NO: 2782943 - protein, 11 aa, Entamoeba invadens
VRQPQSVLTPT

SEQ ID NO: 2782944 - protein, 13 aa, Entamoeba invadens
VRQQNGKGQGQDF

SEQ ID NO: 2782945 - protein, 8 aa, Entamoeba invadens
VRQTSGPG

SEQ ID NO: 2782946 - protein, 11 aa, Entamoeba invadens
VRSAGAQDTFK

SEQ ID NO: 2782947 - protein, 4 aa, Entamoeba invadens
VRSE

SEQ ID NO: 2782948 - protein, 4 aa, Entamoeba invadens
VRSK

SEQ ID NO: 2782949 - protein, 11 aa, Entamoeba invadens
VRSPRVKQNEM

SEQ ID NO: 2782950 - protein, 7 aa, Entamoeba invadens
VRSRKKR

SEQ ID NO: 2782951 - protein, 21 aa, Entamoeba invadens
VRSSDSQQAESCKSDEKCTTY

SEQ ID NO: 2782952 - protein, 8 aa, Entamoeba invadens
VRSVTEMS

SEQ ID NO: 2782953 - protein, 8 aa, Entamoeba invadens
VRTAEEND

SEQ ID NO: 2782954 - protein, 11 aa, Entamoeba invadens
VRTESGSEESF

SEQ ID NO: 2782955 - protein, 5 aa, Entamoeba invadens
VRTID

SEQ ID NO: 2782956 - protein, 9 aa, Entamoeba invadens
VRTITPDIR

SEQ ID NO: 2782957 - protein, 6 aa, Entamoeba invadens
VRTSIE

SEQ ID NO: 2782958 - protein, 8 aa, Entamoeba invadens
VRTSNGQD

SEQ ID NO: 2782959 - protein, 5 aa, Entamoeba invadens
VRYEN

SEQ ID NO: 2782960 - protein, 9 aa, Entamoeba invadens
VSADDSKCS

SEQ ID NO: 2782961 - protein, 7 aa, Entamoeba invadens
VSAQNSK

SEQ ID NO: 2782962 - protein, 5 aa, Entamoeba invadens
VSARG

SEQ ID NO: 2782963 - protein, 11 aa, Entamoeba invadens
VSASNNKCTQC

SEQ ID NO: 2782964 - protein, 6 aa, Entamoeba invadens
VSCSNK

SEQ ID NO: 2782965 - protein, 5 aa, Entamoeba invadens
VSDAQ

SEQ ID NO: 2782966 - protein, 12 aa, Entamoeba invadens
VSDASRKKFGGD

SEQ ID NO: 2782967 - protein, 4 aa, Entamoeba invadens
VSDI

SEQ ID NO: 2782968 - protein, 8 aa, Entamoeba invadens
VSDKASKV

SEQ ID NO: 2782969 - protein, 5 aa, Entamoeba invadens
VSDKR

SEQ ID NO: 2782970 - protein, 4 aa, Entamoeba invadens
VSDN

SEQ ID NO: 2782971 - protein, 11 aa, Entamoeba invadens
VSDNKEQTKMT

SEQ ID NO: 2782972 - protein, 8 aa, Entamoeba invadens
VSDSKGVL

SEQ ID NO: 2782973 - protein, 5 aa, Entamoeba invadens
VSDTS

SEQ ID NO: 2782974 - protein, 6 aa, Entamoeba invadens
VSEAND

SEQ ID NO: 2782975 - protein, 14 aa, Entamoeba invadens
VSEDEMIQNWIVRE

SEQ ID NO: 2782976 - protein, 5 aa, Entamoeba invadens
VSEDP

SEQ ID NO: 2782977 - protein, 14 aa, Entamoeba invadens
VSEDTTNCSNNIKD

SEQ ID NO: 2782978 - protein, 9 aa, Entamoeba invadens
VSEENTKEI

SEQ ID NO: 2782979 - protein, 7 aa, Entamoeba invadens
VSEETER

SEQ ID NO: 2782980 - protein, 13 aa, Entamoeba invadens
VSEGEPGASHDTR

SEQ ID NO: 2782981 - protein, 18 aa, Entamoeba invadens
VSEGIRPDTTNLKREENE

SEQ ID NO: 2782982 - protein, 9 aa, Entamoeba invadens
VSEKDPQFG

SEQ ID NO: 2782983 - protein, 6 aa, Entamoeba invadens
VSEKRK

SEQ ID NO: 2782984 - protein, 12 aa, Entamoeba invadens
VSENGSARCKGC

SEQ ID NO: 2782985 - protein, 6 aa, Entamoeba invadens
VSENPY

SEQ ID NO: 2782986 - protein, 34 aa, Entamoeba invadens
VSERALSTKPLSTGIGTPTYMSPESLQGTSDYSY

SEQ ID NO: 2782987 - protein, 21 aa, Entamoeba invadens
VSERNLASKALSQGIGTPTYM

SEQ ID NO: 2782988 - protein, 11 aa, Entamoeba invadens
VSERYQGNGYP

SEQ ID NO: 2782989 - protein, 7 aa, Entamoeba invadens
VSESKCS

SEQ ID NO: 2782990 - protein, 9 aa, Entamoeba invadens
VSESPKARS

SEQ ID NO: 2782991 - protein, 6 aa, Entamoeba invadens
VSESSL

SEQ ID NO: 2782992 - protein, 5 aa, Entamoeba invadens
VSETT

SEQ ID NO: 2782993 - protein, 11 aa, Entamoeba invadens
VSFETSQINGE

SEQ ID NO: 2782994 - protein, 5 aa, Entamoeba invadens
VSFGE

SEQ ID NO: 2782995 - protein, 5 aa, Entamoeba invadens
VSFPE

SEQ ID NO: 2782996 - protein, 10 aa, Entamoeba invadens
VSGCDDGVTK

SEQ ID NO: 2782997 - protein, 8 aa, Entamoeba invadens
VSGDYTAP

SEQ ID NO: 2782998 - protein, 7 aa, Entamoeba invadens
VSGEATL

SEQ ID NO: 2782999 - protein, 6 aa, Entamoeba invadens
VSGEKN

SEQ ID NO: 2783000 - protein, 8 aa, Entamoeba invadens
VSGEMTSE

SEQ ID NO: 2783001 - protein, 6 aa, Entamoeba invadens
VSGETI

SEQ ID NO: 2783002 - protein, 16 aa, Entamoeba invadens
VSGGGQPHRLHEEQNK

SEQ ID NO: 2783003 - protein, 7 aa, Entamoeba invadens
VSGGQDR

SEQ ID NO: 2783004 - protein, 13 aa, Entamoeba invadens
VSGKRPSVNEMTP

SEQ ID NO: 2783005 - protein, 10 aa, Entamoeba invadens
VSGKYNKDEV

SEQ ID NO: 2783006 - protein, 7 aa, Entamoeba invadens
VSGNEKD

SEQ ID NO: 2783007 - protein, 5 aa, Entamoeba invadens
VSGNR

SEQ ID NO: 2783008 - protein, 6 aa, Entamoeba invadens
VSGNSM

SEQ ID NO: 2783009 - protein, 10 aa, Entamoeba invadens
VSGQGNCNRQ

SEQ ID NO: 2783010 - protein, 11 aa, Entamoeba invadens
VSGRSNESKKI

SEQ ID NO: 2783011 - protein, 4 aa, Entamoeba invadens
VSGS

SEQ ID NO: 2783012 - protein, 8 aa, Entamoeba invadens
VSGSQDVT

SEQ ID NO: 2783013 - protein, 7 aa, Entamoeba invadens
VSGTDLR

SEQ ID NO: 2783014 - protein, 10 aa, Entamoeba invadens
VSGTNQLEGS

SEQ ID NO: 2783015 - protein, 6 aa, Entamoeba invadens
VSGTQL

SEQ ID NO: 2783016 - protein, 9 aa, Entamoeba invadens
VSISPSSIY

SEQ ID NO: 2783017 - protein, 7 aa, Entamoeba invadens
VSITGNS

SEQ ID NO: 2783018 - protein, 8 aa, Entamoeba invadens
VSITSKPE

SEQ ID NO: 2783019 - protein, 8 aa, Entamoeba invadens
VSKCEQCK

SEQ ID NO: 2783020 - protein, 7 aa, Entamoeba invadens
VSKDTEL

SEQ ID NO: 2783021 - protein, 8 aa, Entamoeba invadens
VSKEQYSN

SEQ ID NO: 2783022 - protein, 14 aa, Entamoeba invadens
VSKGAELRKQTGMS

SEQ ID NO: 2783023 - protein, 9 aa, Entamoeba invadens
VSKKQTAMR

SEQ ID NO: 2783024 - protein, 13 aa, Entamoeba invadens
VSKPFSDGSTTTA

SEQ ID NO: 2783025 - protein, 13 aa, Entamoeba invadens
VSKQKKQTSVTTP

SEQ ID NO: 2783026 - protein, 26 aa, Entamoeba invadens
VSKSPFAEQHEQRSESPLIEKKESSS

SEQ ID NO: 2783027 - protein, 8 aa, Entamoeba invadens
VSKSTLSK

SEQ ID NO: 2783028 - protein, 5 aa, Entamoeba invadens
VSKTN

SEQ ID NO: 2783029 - protein, 9 aa, Entamoeba invadens
VSKTSPMKP

SEQ ID NO: 2783030 - protein, 13 aa, Entamoeba invadens
VSKTSTQCGADKN

SEQ ID NO: 2783031 - protein, 8 aa, Entamoeba invadens
VSKTTIDL

SEQ ID NO: 2783032 - protein, 13 aa, Entamoeba invadens
VSKTTQQTKYEFE

SEQ ID NO: 2783033 - protein, 7 aa, Entamoeba invadens
VSKVGDA

SEQ ID NO: 2783034 - protein, 7 aa, Entamoeba invadens
VSKYSKG

SEQ ID NO: 2783035 - protein, 6 aa, Entamoeba invadens
VSLNGN

SEQ ID NO: 2783036 - protein, 11 aa, Entamoeba invadens
VSLTTAKRTTH

SEQ ID NO: 2783037 - protein, 4 aa, Entamoeba invadens
VSMS

SEQ ID NO: 2783038 - protein, 6 aa, Entamoeba invadens
VSNDEA

SEQ ID NO: 2783039 - protein, 8 aa, Entamoeba invadens
VSNKGTEC

SEQ ID NO: 2783040 - protein, 5 aa, Entamoeba invadens
VSNKT

SEQ ID NO: 2783041 - protein, 4 aa, Entamoeba invadens
VSNN

SEQ ID NO: 2783042 - protein, 10 aa, Entamoeba invadens
VSNNGSSCLP

SEQ ID NO: 2783043 - protein, 29 aa, Entamoeba invadens
VSNNKEELDADRSYSGEEKDGEKESYGSS

SEQ ID NO: 2783044 - protein, 30 aa, Entamoeba invadens
VSNNSTSNDSESEMETPSKKKVKYTCDSPR

SEQ ID NO: 2783045 - protein, 9 aa, Entamoeba invadens
VSNPDGSTA

SEQ ID NO: 2783046 - protein, 6 aa, Entamoeba invadens
VSNRTS

SEQ ID NO: 2783047 - protein, 8 aa, Entamoeba invadens
VSNSEETV

SEQ ID NO: 2783048 - protein, 7 aa, Entamoeba invadens
VSNSGNT

SEQ ID NO: 2783049 - protein, 5 aa, Entamoeba invadens
VSNST

SEQ ID NO: 2783050 - protein, 8 aa, Entamoeba invadens
VSNTDNPI

SEQ ID NO: 2783051 - protein, 7 aa, Entamoeba invadens
VSNTEIT

SEQ ID NO: 2783052 - protein, 8 aa, Entamoeba invadens
VSNTTKKS

SEQ ID NO: 2783053 - protein, 6 aa, Entamoeba invadens
VSPEDK

SEQ ID NO: 2783054 - protein, 6 aa, Entamoeba invadens
VSPKSF

SEQ ID NO: 2783055 - protein, 23 aa, Entamoeba invadens
VSPNDENGKCKPEIDGCSKYANT

SEQ ID NO: 2783056 - protein, 15 aa, Entamoeba invadens
VSPNDENGKCTPEID

SEQ ID NO: 2783057 - protein, 8 aa, Entamoeba invadens
VSPNSESN

SEQ ID NO: 2783058 - protein, 6 aa, Entamoeba invadens
VSPPYA

SEQ ID NO: 2783059 - protein, 24 aa, Entamoeba invadens
VSPQEKQKAADEEMKKELNEASRK

SEQ ID NO: 2783060 - protein, 4 aa, Entamoeba invadens
VSPR

SEQ ID NO: 2783061 - protein, 5 aa, Entamoeba invadens
VSPRS

SEQ ID NO: 2783062 - protein, 4 aa, Entamoeba invadens
VSPS

SEQ ID NO: 2783063 - protein, 8 aa, Entamoeba invadens
VSPSESQS

SEQ ID NO: 2783064 - protein, 28 aa, Entamoeba invadens
VSPSFEEKRRTKYMSGPVRSVSSSVSFD

SEQ ID NO: 2783065 - protein, 7 aa, Entamoeba invadens
VSPSNPS

SEQ ID NO: 2783066 - protein, 7 aa, Entamoeba invadens
VSPSSTY

SEQ ID NO: 2783067 - protein, 6 aa, Entamoeba invadens
VSPSTQ

SEQ ID NO: 2783068 - protein, 6 aa, Entamoeba invadens
VSPTKT

SEQ ID NO: 2783069 - protein, 14 aa, Entamoeba invadens
VSPVPTSGKSAKVY

SEQ ID NO: 2783070 - protein, 7 aa, Entamoeba invadens
VSPWSDK

SEQ ID NO: 2783071 - protein, 4 aa, Entamoeba invadens
VSPY

SEQ ID NO: 2783072 - protein, 6 aa, Entamoeba invadens
VSPYSS

SEQ ID NO: 2783073 - protein, 7 aa, Entamoeba invadens
VSQCTDN

SEQ ID NO: 2783074 - protein, 5 aa, Entamoeba invadens
VSQDV

SEQ ID NO: 2783075 - protein, 4 aa, Entamoeba invadens
VSQG

SEQ ID NO: 2783076 - protein, 4 aa, Entamoeba invadens
VSQK

SEQ ID NO: 2783077 - protein, 10 aa, Entamoeba invadens
VSQQKTKSKI

SEQ ID NO: 2783078 - protein, 4 aa, Entamoeba invadens
VSQS

SEQ ID NO: 2783079 - protein, 7 aa, Entamoeba invadens
VSQTANG

SEQ ID NO: 2783080 - protein, 6 aa, Entamoeba invadens
VSQTTH

SEQ ID NO: 2783081 - protein, 8 aa, Entamoeba invadens
VSQTTNGV

SEQ ID NO: 2783082 - protein, 6 aa, Entamoeba invadens
VSREVT

SEQ ID NO: 2783083 - protein, 11 aa, Entamoeba invadens
VSRQRNNTTTY

SEQ ID NO: 2783084 - protein, 15 aa, Entamoeba invadens
VSRTQKVATVGKDAF

SEQ ID NO: 2783085 - protein, 17 aa, Entamoeba invadens
VSRTQKVATVGKDAFKD

SEQ ID NO: 2783086 - protein, 17 aa, Entamoeba invadens
VSRTQKVATVGKDAFKE

SEQ ID NO: 2783087 - protein, 10 aa, Entamoeba invadens
VSSAIDKSSV

SEQ ID NO: 2783088 - protein, 5 aa, Entamoeba invadens
VSSAL

SEQ ID NO: 2783089 - protein, 8 aa, Entamoeba invadens
VSSASGKY

SEQ ID NO: 2783090 - protein, 5 aa, Entamoeba invadens
VSSAV

SEQ ID NO: 2783091 - protein, 8 aa, Entamoeba invadens
VSSDELSK

SEQ ID NO: 2783092 - protein, 8 aa, Entamoeba invadens
VSSDESTC

SEQ ID NO: 2783093 - protein, 16 aa, Entamoeba invadens
VSSDGKKCLSKQSDMT

SEQ ID NO: 2783094 - protein, 8 aa, Entamoeba invadens
VSSDNAVH

SEQ ID NO: 2783095 - protein, 8 aa, Entamoeba invadens
VSSDSSLD

SEQ ID NO: 2783096 - protein, 6 aa, Entamoeba invadens
VSSDTK

SEQ ID NO: 2783097 - protein, 5 aa, Entamoeba invadens
VSSDY

SEQ ID NO: 2783098 - protein, 4 aa, Entamoeba invadens
VSSE

SEQ ID NO: 2783099 - protein, 5 aa, Entamoeba invadens
VSSEC

SEQ ID NO: 2783100 - protein, 10 aa, Entamoeba invadens
VSSEETQVTQ

SEQ ID NO: 2783101 - protein, 6 aa, Entamoeba invadens
VSSEGT

SEQ ID NO: 2783102 - protein, 5 aa, Entamoeba invadens
VSSFG

SEQ ID NO: 2783103 - protein, 17 aa, Entamoeba invadens
VSSGKRRAYQEGMNKEA

SEQ ID NO: 2783104 - protein, 10 aa, Entamoeba invadens
VSSKASNTQK

SEQ ID NO: 2783105 - protein, 7 aa, Entamoeba invadens
VSSKEKN

SEQ ID NO: 2783106 - protein, 7 aa, Entamoeba invadens
VSSKNEV

SEQ ID NO: 2783107 - protein, 5 aa, Entamoeba invadens
VSSKV

SEQ ID NO: 2783108 - protein, 7 aa, Entamoeba invadens
VSSLSHP

SEQ ID NO: 2783109 - protein, 27 aa, Entamoeba invadens
VSSMEKTRDSMDSSRALSSMDGTDNYR

SEQ ID NO: 2783110 - protein, 4 aa, Entamoeba invadens
VSSN

SEQ ID NO: 2783111 - protein, 7 aa, Entamoeba invadens
VSSNRSS

SEQ ID NO: 2783112 - protein, 5 aa, Entamoeba invadens
VSSPN

SEQ ID NO: 2783113 - protein, 12 aa, Entamoeba invadens
VSSQAKKPKRDV

SEQ ID NO: 2783114 - protein, 8 aa, Entamoeba invadens
VSSRDGSN

SEQ ID NO: 2783115 - protein, 8 aa, Entamoeba invadens
VSSRLDSD

SEQ ID NO: 2783116 - protein, 4 aa, Entamoeba invadens
VSSS

SEQ ID NO: 2783117 - protein, 6 aa, Entamoeba invadens
VSSSDD

SEQ ID NO: 2783118 - protein, 9 aa, Entamoeba invadens
VSSSDGSNL

SEQ ID NO: 2783119 - protein, 12 aa, Entamoeba invadens
VSSSGNSCEYSS

SEQ ID NO: 2783120 - protein, 5 aa, Entamoeba invadens
VSSSI

SEQ ID NO: 2783121 - protein, 6 aa, Entamoeba invadens
VSSSNA

SEQ ID NO: 2783122 - protein, 9 aa, Entamoeba invadens
VSSSQERSA

SEQ ID NO: 2783123 - protein, 7 aa, Entamoeba invadens
VSSSTDN

SEQ ID NO: 2783124 - protein, 9 aa, Entamoeba invadens
VSSSTKDYY

SEQ ID NO: 2783125 - protein, 13 aa, Entamoeba invadens
VSSTAMSKPTFGK

SEQ ID NO: 2783126 - protein, 9 aa, Entamoeba invadens
VSSTNKTVN

SEQ ID NO: 2783127 - protein, 11 aa, Entamoeba invadens
VSSTPKSGETA

SEQ ID NO: 2783128 - protein, 6 aa, Entamoeba invadens
VSSTPS

SEQ ID NO: 2783129 - protein, 8 aa, Entamoeba invadens
VSSTSSAY

SEQ ID NO: 2783130 - protein, 6 aa, Entamoeba invadens
VSSTST

SEQ ID NO: 2783131 - protein, 4 aa, Entamoeba invadens
VSTD

SEQ ID NO: 2783132 - protein, 7 aa, Entamoeba invadens
VSTDRTI

SEQ ID NO: 2783133 - protein, 5 aa, Entamoeba invadens
VSTDS

SEQ ID NO: 2783134 - protein, 6 aa, Entamoeba invadens
VSTETQ

SEQ ID NO: 2783135 - protein, 23 aa, Entamoeba invadens
VSTGCQGASGATCIGSNSEGKLC

SEQ ID NO: 2783136 - protein, 7 aa, Entamoeba invadens
VSTGDNI

SEQ ID NO: 2783137 - protein, 5 aa, Entamoeba invadens
VSTGQ

SEQ ID NO: 2783138 - protein, 9 aa, Entamoeba invadens
VSTGTVSTT

SEQ ID NO: 2783139 - protein, 8 aa, Entamoeba invadens
VSTKEKID

SEQ ID NO: 2783140 - protein, 6 aa, Entamoeba invadens
VSTKLD

SEQ ID NO: 2783141 - protein, 17 aa, Entamoeba invadens
VSTKPENRVAGDASTLT

SEQ ID NO: 2783142 - protein, 10 aa, Entamoeba invadens
VSTLGEGAKD

SEQ ID NO: 2783143 - protein, 25 aa, Entamoeba invadens
VSTNGSCVNTKNNCSISKEGDNSTC

SEQ ID NO: 2783144 - protein, 5 aa, Entamoeba invadens
VSTPS

SEQ ID NO: 2783145 - protein, 11 aa, Entamoeba invadens
VSTPSSLERYT

SEQ ID NO: 2783146 - protein, 6 aa, Entamoeba invadens
VSTQGA

SEQ ID NO: 2783147 - protein, 6 aa, Entamoeba invadens
VSTSCG

SEQ ID NO: 2783148 - protein, 12 aa, Entamoeba invadens
VSTSEGKDYATK

SEQ ID NO: 2783149 - protein, 6 aa, Entamoeba invadens
VSTSNS

SEQ ID NO: 2783150 - protein, 6 aa, Entamoeba invadens
VSTSPT

SEQ ID NO: 2783151 - protein, 8 aa, Entamoeba invadens
VSTSTPVR

SEQ ID NO: 2783152 - protein, 5 aa, Entamoeba invadens
VSTTR

SEQ ID NO: 2783153 - protein, 11 aa, Entamoeba invadens
VSTTSAAPAQT

SEQ ID NO: 2783154 - protein, 16 aa, Entamoeba invadens
VSTTTKCTKCTKTTDY

SEQ ID NO: 2783155 - protein, 10 aa, Entamoeba invadens
VSVDTNTNYE

SEQ ID NO: 2783156 - protein, 5 aa, Entamoeba invadens
VSVGK

SEQ ID NO: 2783157 - protein, 5 aa, Entamoeba invadens
VSVSS

SEQ ID NO: 2783158 - protein, 7 aa, Entamoeba invadens
VSVSTDK

SEQ ID NO: 2783159 - protein, 10 aa, Entamoeba invadens
VSVYQKEASD

SEQ ID NO: 2783160 - protein, 4 aa, Entamoeba invadens
VSYN

SEQ ID NO: 2783161 - protein, 8 aa, Entamoeba invadens
VTASDTKN

SEQ ID NO: 2783162 - protein, 6 aa, Entamoeba invadens
VTATST

SEQ ID NO: 2783163 - protein, 5 aa, Entamoeba invadens
VTCET

SEQ ID NO: 2783164 - protein, 5 aa, Entamoeba invadens
VTCGD

SEQ ID NO: 2783165 - protein, 8 aa, Entamoeba invadens
VTDDTDDG

SEQ ID NO: 2783166 - protein, 8 aa, Entamoeba invadens
VTDFGSSR

SEQ ID NO: 2783167 - protein, 5 aa, Entamoeba invadens
VTDGP

SEQ ID NO: 2783168 - protein, 6 aa, Entamoeba invadens
VTDGSE

SEQ ID NO: 2783169 - protein, 6 aa, Entamoeba invadens
VTDGTG

SEQ ID NO: 2783170 - protein, 20 aa, Entamoeba invadens
VTDGTSCNKCGASEVKIDTQ

SEQ ID NO: 2783171 - protein, 9 aa, Entamoeba invadens
VTDPNTSID

SEQ ID NO: 2783172 - protein, 7 aa, Entamoeba invadens
VTDQQPE

SEQ ID NO: 2783173 - protein, 4 aa, Entamoeba invadens
VTDS

SEQ ID NO: 2783174 - protein, 9 aa, Entamoeba invadens
VTDTNEDGI

SEQ ID NO: 2783175 - protein, 9 aa, Entamoeba invadens
VTDVSPTAF

SEQ ID NO: 2783176 - protein, 49 aa, Entamoeba invadens
VTEDPVVDEKDEKKLPERFEEKKDGLNTLEQDEETIQVNTETAESNVRS

SEQ ID NO: 2783177 - protein, 8 aa, Entamoeba invadens
VTEEDKDV

SEQ ID NO: 2783178 - protein, 13 aa, Entamoeba invadens
VTEGGDNYSQGQK

SEQ ID NO: 2783179 - protein, 7 aa, Entamoeba invadens
VTEGKRP

SEQ ID NO: 2783180 - protein, 4 aa, Entamoeba invadens
VTEK

SEQ ID NO: 2783181 - protein, 4 aa, Entamoeba invadens
VTEN

SEQ ID NO: 2783182 - protein, 8 aa, Entamoeba invadens
VTENTEGN

SEQ ID NO: 2783183 - protein, 7 aa, Entamoeba invadens
VTEPFSE

SEQ ID NO: 2783184 - protein, 6 aa, Entamoeba invadens
VTEPGK

SEQ ID NO: 2783185 - protein, 10 aa, Entamoeba invadens
VTEPSQASRR

SEQ ID NO: 2783186 - protein, 12 aa, Entamoeba invadens
VTEQAKKPKRDV

SEQ ID NO: 2783187 - protein, 9 aa, Entamoeba invadens
VTERDNQGL

SEQ ID NO: 2783188 - protein, 24 aa, Entamoeba invadens
VTESGSGQFRKAAKDFDEASEIKC

SEQ ID NO: 2783189 - protein, 7 aa, Entamoeba invadens
VTETGTG

SEQ ID NO: 2783190 - protein, 5 aa, Entamoeba invadens
VTEYT

SEQ ID NO: 2783191 - protein, 9 aa, Entamoeba invadens
VTFDGGKSS

SEQ ID NO: 2783192 - protein, 10 aa, Entamoeba invadens
VTFEDESNAI

SEQ ID NO: 2783193 - protein, 4 aa, Entamoeba invadens
VTFP

SEQ ID NO: 2783194 - protein, 12 aa, Entamoeba invadens
VTGDGTNDVPAF

SEQ ID NO: 2783195 - protein, 14 aa, Entamoeba invadens
VTGDGTNDVPALKE

SEQ ID NO: 2783196 - protein, 4 aa, Entamoeba invadens
VTGE

SEQ ID NO: 2783197 - protein, 20 aa, Entamoeba invadens
VTGERKCTKCSTPNMYPDDT

SEQ ID NO: 2783198 - protein, 14 aa, Entamoeba invadens
VTGNEAVTTYEESS

SEQ ID NO: 2783199 - protein, 6 aa, Entamoeba invadens
VTGNTE

SEQ ID NO: 2783200 - protein, 8 aa, Entamoeba invadens
VTGPTAAS

SEQ ID NO: 2783201 - protein, 7 aa, Entamoeba invadens
VTGRSDC

SEQ ID NO: 2783202 - protein, 10 aa, Entamoeba invadens
VTGSDQPLGE

SEQ ID NO: 2783203 - protein, 7 aa, Entamoeba invadens
VTGSETI

SEQ ID NO: 2783204 - protein, 27 aa, Entamoeba invadens
VTGSKCQIRDNKGCQRCNDGYYDENNE

SEQ ID NO: 2783205 - protein, 8 aa, Entamoeba invadens
VTGSSTLC

SEQ ID NO: 2783206 - protein, 6 aa, Entamoeba invadens
VTGSTT

SEQ ID NO: 2783207 - protein, 8 aa, Entamoeba invadens
VTGTGCNN

SEQ ID NO: 2783208 - protein, 15 aa, Entamoeba invadens
VTGTGYRHGSSTKTC

SEQ ID NO: 2783209 - protein, 15 aa, Entamoeba invadens
VTGWGDRDDSFRNME

SEQ ID NO: 2783210 - protein, 7 aa, Entamoeba invadens
VTHKGNN

SEQ ID NO: 2783211 - protein, 8 aa, Entamoeba invadens
VTHRDLKP

SEQ ID NO: 2783212 - protein, 10 aa, Entamoeba invadens
VTIPSNVTSI

SEQ ID NO: 2783213 - protein, 10 aa, Entamoeba invadens
VTIPTSVTSL

SEQ ID NO: 2783214 - protein, 4 aa, Entamoeba invadens
VTKD

SEQ ID NO: 2783215 - protein, 19 aa, Entamoeba invadens
VTKKKENKKKEDTETVPQD

SEQ ID NO: 2783216 - protein, 6 aa, Entamoeba invadens
VTKPNV

SEQ ID NO: 2783217 - protein, 11 aa, Entamoeba invadens
VTKSGYTKSGY

SEQ ID NO: 2783218 - protein, 10 aa, Entamoeba invadens
VTKSKSGCVE

SEQ ID NO: 2783219 - protein, 5 aa, Entamoeba invadens
VTLDG

SEQ ID NO: 2783220 - protein, 6 aa, Entamoeba invadens
VTLETT

SEQ ID NO: 2783221 - protein, 4 aa, Entamoeba invadens
VTLK

SEQ ID NO: 2783222 - protein, 8 aa, Entamoeba invadens
VTLPTGGG

SEQ ID NO: 2783223 - protein, 4 aa, Entamoeba invadens
VTLR

SEQ ID NO: 2783224 - protein, 13 aa, Entamoeba invadens
VTNDYDKTKTRGV

SEQ ID NO: 2783225 - protein, 5 aa, Entamoeba invadens
VTNED

SEQ ID NO: 2783226 - protein, 12 aa, Entamoeba invadens
VTNEQKAEIERT

SEQ ID NO: 2783227 - protein, 10 aa, Entamoeba invadens
VTNGDETTKK

SEQ ID NO: 2783228 - protein, 5 aa, Entamoeba invadens
VTNGE

SEQ ID NO: 2783229 - protein, 5 aa, Entamoeba invadens
VTNGK

SEQ ID NO: 2783230 - protein, 20 aa, Entamoeba invadens
VTNGTSCNKCGASEVKIDTQ

SEQ ID NO: 2783231 - protein, 5 aa, Entamoeba invadens
VTNIG

SEQ ID NO: 2783232 - protein, 4 aa, Entamoeba invadens
VTNK

SEQ ID NO: 2783233 - protein, 36 aa, Entamoeba invadens
VTNKKDTKKKEGEKEETVPQDVGASEMEDELREKGR

SEQ ID NO: 2783234 - protein, 7 aa, Entamoeba invadens
VTNNQTQ

SEQ ID NO: 2783235 - protein, 12 aa, Entamoeba invadens
VTNPCSSRGTHV

SEQ ID NO: 2783236 - protein, 9 aa, Entamoeba invadens
VTNPGPDNI

SEQ ID NO: 2783237 - protein, 9 aa, Entamoeba invadens
VTNPQTEIP

SEQ ID NO: 2783238 - protein, 5 aa, Entamoeba invadens
VTNPT

SEQ ID NO: 2783239 - protein, 7 aa, Entamoeba invadens
VTNSEID

SEQ ID NO: 2783240 - protein, 11 aa, Entamoeba invadens
VTNSPNTSEQT

SEQ ID NO: 2783241 - protein, 9 aa, Entamoeba invadens
VTNSQTTVV

SEQ ID NO: 2783242 - protein, 6 aa, Entamoeba invadens
VTNSTD

SEQ ID NO: 2783243 - protein, 10 aa, Entamoeba invadens
VTNSTNCQKC

SEQ ID NO: 2783244 - protein, 6 aa, Entamoeba invadens
VTNTEP

SEQ ID NO: 2783245 - protein, 18 aa, Entamoeba invadens
VTNTESVTTIGDNAFEGT

SEQ ID NO: 2783246 - protein, 11 aa, Entamoeba invadens
VTNTKTKPWKE

SEQ ID NO: 2783247 - protein, 5 aa, Entamoeba invadens
VTNTQ

SEQ ID NO: 2783248 - protein, 7 aa, Entamoeba invadens
VTNTSKD

SEQ ID NO: 2783249 - protein, 15 aa, Entamoeba invadens
VTPDQTKEESSYYDE

SEQ ID NO: 2783250 - protein, 12 aa, Entamoeba invadens
VTPEDATQGDFT

SEQ ID NO: 2783251 - protein, 4 aa, Entamoeba invadens
VTPK

SEQ ID NO: 2783252 - protein, 8 aa, Entamoeba invadens
VTPKGEKQ

SEQ ID NO: 2783253 - protein, 12 aa, Entamoeba invadens
VTPKNEKKDIVP

SEQ ID NO: 2783254 - protein, 9 aa, Entamoeba invadens
VTPKPYGKY

SEQ ID NO: 2783255 - protein, 6 aa, Entamoeba invadens
VTPKQK

SEQ ID NO: 2783256 - protein, 5 aa, Entamoeba invadens
VTPKT

SEQ ID NO: 2783257 - protein, 24 aa, Entamoeba invadens
VTPLPKDPPPLKSLTPKTAKPEIF

SEQ ID NO: 2783258 - protein, 4 aa, Entamoeba invadens
VTPN

SEQ ID NO: 2783259 - protein, 8 aa, Entamoeba invadens
VTPNQKEE

SEQ ID NO: 2783260 - protein, 10 aa, Entamoeba invadens
VTPPNCSPCD

SEQ ID NO: 2783261 - protein, 7 aa, Entamoeba invadens
VTPPNRM

SEQ ID NO: 2783262 - protein, 4 aa, Entamoeba invadens
VTPQ

SEQ ID NO: 2783263 - protein, 7 aa, Entamoeba invadens
VTPQRDD

SEQ ID NO: 2783264 - protein, 11 aa, Entamoeba invadens
VTPSKSESASI

SEQ ID NO: 2783265 - protein, 9 aa, Entamoeba invadens
VTPSTRSIS

SEQ ID NO: 2783266 - protein, 5 aa, Entamoeba invadens
VTPVN

SEQ ID NO: 2783267 - protein, 8 aa, Entamoeba invadens
VTPVPRNP

SEQ ID NO: 2783268 - protein, 4 aa, Entamoeba invadens
VTQA

SEQ ID NO: 2783269 - protein, 6 aa, Entamoeba invadens
VTQETD

SEQ ID NO: 2783270 - protein, 13 aa, Entamoeba invadens
VTQISTSALSGCT

SEQ ID NO: 2783271 - protein, 6 aa, Entamoeba invadens
VTQNGC

SEQ ID NO: 2783272 - protein, 9 aa, Entamoeba invadens
VTQNGCSKC

SEQ ID NO: 2783273 - protein, 10 aa, Entamoeba invadens
VTQNGCSKCQ

SEQ ID NO: 2783274 - protein, 11 aa, Entamoeba invadens
VTQNGCSKCQT

SEQ ID NO: 2783275 - protein, 11 aa, Entamoeba invadens
VTQNGNRCTSC

SEQ ID NO: 2783276 - protein, 8 aa, Entamoeba invadens
VTQPEYSR

SEQ ID NO: 2783277 - protein, 5 aa, Entamoeba invadens
VTQPG

SEQ ID NO: 2783278 - protein, 9 aa, Entamoeba invadens
VTQPIENSY

SEQ ID NO: 2783279 - protein, 6 aa, Entamoeba invadens
VTQSDV

SEQ ID NO: 2783280 - protein, 25 aa, Entamoeba invadens
VTQSEENDTTNVNSSLKTASEYNDN

SEQ ID NO: 2783281 - protein, 5 aa, Entamoeba invadens
VTQSG

SEQ ID NO: 2783282 - protein, 9 aa, Entamoeba invadens
VTQSTSAPI

SEQ ID NO: 2783283 - protein, 6 aa, Entamoeba invadens
VTQTIS

SEQ ID NO: 2783284 - protein, 10 aa, Entamoeba invadens
VTRENETFAG

SEQ ID NO: 2783285 - protein, 4 aa, Entamoeba invadens
VTRK

SEQ ID NO: 2783286 - protein, 6 aa, Entamoeba invadens
VTRNDE

SEQ ID NO: 2783287 - protein, 10 aa, Entamoeba invadens
VTRNGQQTEI

SEQ ID NO: 2783288 - protein, 4 aa, Entamoeba invadens
VTRS

SEQ ID NO: 2783289 - protein, 8 aa, Entamoeba invadens
VTSCEDDS

SEQ ID NO: 2783290 - protein, 11 aa, Entamoeba invadens
VTSDGVKYTSF

SEQ ID NO: 2783291 - protein, 6 aa, Entamoeba invadens
VTSDSY

SEQ ID NO: 2783292 - protein, 7 aa, Entamoeba invadens
VTSDTKY

SEQ ID NO: 2783293 - protein, 4 aa, Entamoeba invadens
VTSG

SEQ ID NO: 2783294 - protein, 7 aa, Entamoeba invadens
VTSGGCS

SEQ ID NO: 2783295 - protein, 16 aa, Entamoeba invadens
VTSGKRINRTDNVPEN

SEQ ID NO: 2783296 - protein, 12 aa, Entamoeba invadens
VTSGKRKERPEK

SEQ ID NO: 2783297 - protein, 9 aa, Entamoeba invadens
VTSGNTCNG

SEQ ID NO: 2783298 - protein, 6 aa, Entamoeba invadens
VTSGSD

SEQ ID NO: 2783299 - protein, 4 aa, Entamoeba invadens
VTSI

SEQ ID NO: 2783300 - protein, 5 aa, Entamoeba invadens
VTSKQ

SEQ ID NO: 2783301 - protein, 5 aa, Entamoeba invadens
VTSQD

SEQ ID NO: 2783302 - protein, 5 aa, Entamoeba invadens
VTSSD

SEQ ID NO: 2783303 - protein, 11 aa, Entamoeba invadens
VTSSDNKVSGY

SEQ ID NO: 2783304 - protein, 13 aa, Entamoeba invadens
VTSSDSKSCNLGY

SEQ ID NO: 2783305 - protein, 9 aa, Entamoeba invadens
VTSSIPKTK

SEQ ID NO: 2783306 - protein, 4 aa, Entamoeba invadens
VTST

SEQ ID NO: 2783307 - protein, 13 aa, Entamoeba invadens
VTSTENTLEITTD

SEQ ID NO: 2783308 - protein, 12 aa, Entamoeba invadens
VTSTQTHSPLST

SEQ ID NO: 2783309 - protein, 5 aa, Entamoeba invadens
VTSYT

SEQ ID NO: 2783310 - protein, 10 aa, Entamoeba invadens
VTTAGEKQQY

SEQ ID NO: 2783311 - protein, 46 aa, Entamoeba invadens
VTTDDHVETTPPSKKEMNTSSNLVENSTSQNLEIKTETTAVSSTPK

SEQ ID NO: 2783312 - protein, 8 aa, Entamoeba invadens
VTTDPGRC

SEQ ID NO: 2783313 - protein, 4 aa, Entamoeba invadens
VTTE

SEQ ID NO: 2783314 - protein, 10 aa, Entamoeba invadens
VTTEESTKLN

SEQ ID NO: 2783315 - protein, 15 aa, Entamoeba invadens
VTTEKSSIEFGDTEN

SEQ ID NO: 2783316 - protein, 4 aa, Entamoeba invadens
VTTG

SEQ ID NO: 2783317 - protein, 7 aa, Entamoeba invadens
VTTGSTT

SEQ ID NO: 2783318 - protein, 7 aa, Entamoeba invadens
VTTKKTE

SEQ ID NO: 2783319 - protein, 5 aa, Entamoeba invadens
VTTKS

SEQ ID NO: 2783320 - protein, 10 aa, Entamoeba invadens
VTTKSKIQNN

SEQ ID NO: 2783321 - protein, 15 aa, Entamoeba invadens
VTTNTLKESNGQCVS

SEQ ID NO: 2783322 - protein, 23 aa, Entamoeba invadens
VTTPCKSANFDDPNHPGQKVRYD

SEQ ID NO: 2783323 - protein, 28 aa, Entamoeba invadens
VTTPPGDGSDPNPSCSEDEKEKAKERSI

SEQ ID NO: 2783324 - protein, 4 aa, Entamoeba invadens
VTTQ

SEQ ID NO: 2783325 - protein, 22 aa, Entamoeba invadens
VTTQSSLYEAEDNEAQNPMFQD

SEQ ID NO: 2783326 - protein, 5 aa, Entamoeba invadens
VTTRN

SEQ ID NO: 2783327 - protein, 5 aa, Entamoeba invadens
VTTSD

SEQ ID NO: 2783328 - protein, 12 aa, Entamoeba invadens
VTTSSIKTNKMA

SEQ ID NO: 2783329 - protein, 4 aa, Entamoeba invadens
VTTT

SEQ ID NO: 2783330 - protein, 5 aa, Entamoeba invadens
VTTTR

SEQ ID NO: 2783331 - protein, 9 aa, Entamoeba invadens
VTTTSSEHT

SEQ ID NO: 2783332 - protein, 7 aa, Entamoeba invadens
VTVADSK

SEQ ID NO: 2783333 - protein, 13 aa, Entamoeba invadens
VTVDENNDTINSN

SEQ ID NO: 2783334 - protein, 13 aa, Entamoeba invadens
VTVDENSDTINSN

SEQ ID NO: 2783335 - protein, 13 aa, Entamoeba invadens
VTVGGTTTIPQNT

SEQ ID NO: 2783336 - protein, 7 aa, Entamoeba invadens
VTVNENN

SEQ ID NO: 2783337 - protein, 6 aa, Entamoeba invadens
VTVPPK

SEQ ID NO: 2783338 - protein, 21 aa, Entamoeba invadens
VTVTENSAEVVKQNNKETDKD

SEQ ID NO: 2783339 - protein, 13 aa, Entamoeba invadens
VTYANDDSEKNCK

SEQ ID NO: 2783340 - protein, 7 aa, Entamoeba invadens
VTYNKGT

SEQ ID NO: 2783341 - protein, 6 aa, Entamoeba invadens
VTYNPS

SEQ ID NO: 2783342 - protein, 4 aa, Entamoeba invadens
VTYQ

SEQ ID NO: 2783343 - protein, 11 aa, Entamoeba invadens
VVDNDGSMDEF

SEQ ID NO: 2783344 - protein, 13 aa, Entamoeba invadens
VVESDSKTNFGEC

SEQ ID NO: 2783345 - protein, 11 aa, Entamoeba invadens
VVGNDKSPNSI

SEQ ID NO: 2783346 - protein, 11 aa, Entamoeba invadens
VVGPEKQTQHT

SEQ ID NO: 2783347 - protein, 8 aa, Entamoeba invadens
VVGRENDS

SEQ ID NO: 2783348 - protein, 12 aa, Entamoeba invadens
VVGRTGSGKSTL

SEQ ID NO: 2783349 - protein, 5 aa, Entamoeba invadens
VVHGT

SEQ ID NO: 2783350 - protein, 4 aa, Entamoeba invadens
VVNS

SEQ ID NO: 2783351 - protein, 7 aa, Entamoeba invadens
VVNTKSK

SEQ ID NO: 2783352 - protein, 10 aa, Entamoeba invadens
VVPPVSGKMA

SEQ ID NO: 2783353 - protein, 9 aa, Entamoeba invadens
VVPSEGKVT

SEQ ID NO: 2783354 - protein, 10 aa, Entamoeba invadens
VVPTPQAQTR

SEQ ID NO: 2783355 - protein, 8 aa, Entamoeba invadens
VVSGETKE

SEQ ID NO: 2783356 - protein, 10 aa, Entamoeba invadens
VVSNNSQNFS

SEQ ID NO: 2783357 - protein, 5 aa, Entamoeba invadens
VVSSE

SEQ ID NO: 2783358 - protein, 8 aa, Entamoeba invadens
VVSTKSEI

SEQ ID NO: 2783359 - protein, 4 aa, Entamoeba invadens
VVTK

SEQ ID NO: 2783360 - protein, 14 aa, Entamoeba invadens
VVTPQQANPPVFTF

SEQ ID NO: 2783361 - protein, 52 aa, Entamoeba invadens
VVTPQSDPLHQDVQGEQPPMPLPPQAPTYNPNTYQQNYTPTSYAGQQAPPYY

SEQ ID NO: 2783362 - protein, 10 aa, Entamoeba invadens
VVTPTKPKTY

SEQ ID NO: 2783363 - protein, 12 aa, Entamoeba invadens
VVTSNGKTLNED

SEQ ID NO: 2783364 - protein, 12 aa, Entamoeba invadens
VVTSPTSQTCQK

SEQ ID NO: 2783365 - protein, 7 aa, Entamoeba invadens
VWDGSSD

SEQ ID NO: 2783366 - protein, 12 aa, Entamoeba invadens
VWDPSDTSLNKG

SEQ ID NO: 2783367 - protein, 5 aa, Entamoeba invadens
VWQPK

SEQ ID NO: 2783368 - protein, 7 aa, Entamoeba invadens
VYDDTKP

SEQ ID NO: 2783369 - protein, 12 aa, Entamoeba invadens
VYDPKNCKVDDP

SEQ ID NO: 2783370 - protein, 6 aa, Entamoeba invadens
VYESPK

SEQ ID NO: 2783371 - protein, 7 aa, Entamoeba invadens
VYGDETV

SEQ ID NO: 2783372 - protein, 9 aa, Entamoeba invadens
VYKGETNKK

SEQ ID NO: 2783373 - protein, 6 aa, Entamoeba invadens
VYNKTQ

SEQ ID NO: 2783374 - protein, 10 aa, Entamoeba invadens
VYNPSNTKTC

SEQ ID NO: 2783375 - protein, 11 aa, Entamoeba invadens
VYNPSNTKTCR

SEQ ID NO: 2783376 - protein, 6 aa, Entamoeba invadens
VYNRTS

SEQ ID NO: 2783377 - protein, 11 aa, Entamoeba invadens
VYNTENGQRDF

SEQ ID NO: 2783378 - protein, 8 aa, Entamoeba invadens
VYPARTDP

SEQ ID NO: 2783379 - protein, 12 aa, Entamoeba invadens
VYPEDGSDNPKF

SEQ ID NO: 2783380 - protein, 11 aa, Entamoeba invadens
VYPNDSGKCVS

SEQ ID NO: 2783381 - protein, 12 aa, Entamoeba invadens
VYPNTSPELSEK

SEQ ID NO: 2783382 - protein, 9 aa, Entamoeba invadens
VYQPNKSNM

SEQ ID NO: 2783383 - protein, 4 aa, Entamoeba invadens
VYSE

SEQ ID NO: 2783384 - protein, 4 aa, Entamoeba invadens
VYSK

SEQ ID NO: 2783385 - protein, 10 aa, Entamoeba invadens
VYSKTTNETQ

SEQ ID NO: 2783386 - protein, 7 aa, Entamoeba invadens
VYSQSSD

SEQ ID NO: 2783387 - protein, 9 aa, Entamoeba invadens
VYSSTGSRW

SEQ ID NO: 2783388 - protein, 14 aa, Entamoeba invadens
WAADGKEKEEEVQN

SEQ ID NO: 2783389 - protein, 4 aa, Entamoeba invadens
WADS

SEQ ID NO: 2783390 - protein, 12 aa, Entamoeba invadens
WADSKTRNEALP

SEQ ID NO: 2783391 - protein, 7 aa, Entamoeba invadens
WAQEEHN

SEQ ID NO: 2783392 - protein, 11 aa, Entamoeba invadens
WASKPEDRPTI

SEQ ID NO: 2783393 - protein, 9 aa, Entamoeba invadens
WASNPKERT

SEQ ID NO: 2783394 - protein, 8 aa, Entamoeba invadens
WATTQEDF

SEQ ID NO: 2783395 - protein, 9 aa, Entamoeba invadens
WDASPQKRI

SEQ ID NO: 2783396 - protein, 11 aa, Entamoeba invadens
WDDDKGLGTPI

SEQ ID NO: 2783397 - protein, 15 aa, Entamoeba invadens
WDEQRKEDYEKIKST

SEQ ID NO: 2783398 - protein, 16 aa, Entamoeba invadens
WDNIEQPKDAFPSYPS

SEQ ID NO: 2783399 - protein, 11 aa, Entamoeba invadens
WDQNPSQRPHI

SEQ ID NO: 2783400 - protein, 4 aa, Entamoeba invadens
WDRN

SEQ ID NO: 2783401 - protein, 6 aa, Entamoeba invadens
WEDDEK

SEQ ID NO: 2783402 - protein, 8 aa, Entamoeba invadens
WEDSMKTR

SEQ ID NO: 2783403 - protein, 10 aa, Entamoeba invadens
WEEGQKNVSS

SEQ ID NO: 2783404 - protein, 12 aa, Entamoeba invadens
WEETGRDEEDHG

SEQ ID NO: 2783405 - protein, 14 aa, Entamoeba invadens
WEKETQKIGKIPKN

SEQ ID NO: 2783406 - protein, 11 aa, Entamoeba invadens
WEKGDNSQVRT

SEQ ID NO: 2783407 - protein, 9 aa, Entamoeba invadens
WEKQKKEEW

SEQ ID NO: 2783408 - protein, 12 aa, Entamoeba invadens
WENTEKSSNDND

SEQ ID NO: 2783409 - protein, 6 aa, Entamoeba invadens
WEQEPV

SEQ ID NO: 2783410 - protein, 9 aa, Entamoeba invadens
WEQNPKDRI

SEQ ID NO: 2783411 - protein, 8 aa, Entamoeba invadens
WEQNTKER

SEQ ID NO: 2783412 - protein, 5 aa, Entamoeba invadens
WETYT

SEQ ID NO: 2783413 - protein, 13 aa, Entamoeba invadens
WGDDWGDQGTARI

SEQ ID NO: 2783414 - protein, 7 aa, Entamoeba invadens
WGEGDNR

SEQ ID NO: 2783415 - protein, 11 aa, Entamoeba invadens
WGESWGENGGF

SEQ ID NO: 2783416 - protein, 5 aa, Entamoeba invadens
WGKEK

SEQ ID NO: 2783417 - protein, 8 aa, Entamoeba invadens
WGKSNSYV

SEQ ID NO: 2783418 - protein, 7 aa, Entamoeba invadens
WGQSGSY

SEQ ID NO: 2783419 - protein, 4 aa, Entamoeba invadens
WGRN

SEQ ID NO: 2783420 - protein, 7 aa, Entamoeba invadens
WGTPNKL

SEQ ID NO: 2783421 - protein, 11 aa, Entamoeba invadens
WGTREQKGEAI

SEQ ID NO: 2783422 - protein, 10 aa, Entamoeba invadens
WKERSDRNKW

SEQ ID NO: 2783423 - protein, 10 aa, Entamoeba invadens
WKGSDEELRT

SEQ ID NO: 2783424 - protein, 12 aa, Entamoeba invadens
WKNKPNERPSFK

SEQ ID NO: 2783425 - protein, 11 aa, Entamoeba invadens
WKNKPTERPTF

SEQ ID NO: 2783426 - protein, 9 aa, Entamoeba invadens
WKNTGSSKM

SEQ ID NO: 2783427 - protein, 8 aa, Entamoeba invadens
WKPNPHDR

SEQ ID NO: 2783428 - protein, 11 aa, Entamoeba invadens
WKQDPKERTDI

SEQ ID NO: 2783429 - protein, 8 aa, Entamoeba invadens
WKQDPKQR

SEQ ID NO: 2783430 - protein, 10 aa, Entamoeba invadens
WKQDTKDRIP

SEQ ID NO: 2783431 - protein, 5 aa, Entamoeba invadens
WKQGD

SEQ ID NO: 2783432 - protein, 9 aa, Entamoeba invadens
WKQNPKERI

SEQ ID NO: 2783433 - protein, 7 aa, Entamoeba invadens
WKQNPVD

SEQ ID NO: 2783434 - protein, 5 aa, Entamoeba invadens
WKSSC

SEQ ID NO: 2783435 - protein, 14 aa, Entamoeba invadens
WKSTKAEPCEDENC

SEQ ID NO: 2783436 - protein, 21 aa, Entamoeba invadens
WKSTKAEPCEDENCAQCADDG

SEQ ID NO: 2783437 - protein, 11 aa, Entamoeba invadens
WKTESEKSKPS

SEQ ID NO: 2783438 - protein, 6 aa, Entamoeba invadens
WLPEED

SEQ ID NO: 2783439 - protein, 7 aa, Entamoeba invadens
WLPEEDN

SEQ ID NO: 2783440 - protein, 7 aa, Entamoeba invadens
WLPESDN

SEQ ID NO: 2783441 - protein, 7 aa, Entamoeba invadens
WLPPSNK

SEQ ID NO: 2783442 - protein, 21 aa, Entamoeba invadens
WNDTAYGDRPMGSARGIRGSH

SEQ ID NO: 2783443 - protein, 10 aa, Entamoeba invadens
WNDVQDSNEL

SEQ ID NO: 2783444 - protein, 7 aa, Entamoeba invadens
WNEDPTG

SEQ ID NO: 2783445 - protein, 8 aa, Entamoeba invadens
WNEDSTNK

SEQ ID NO: 2783446 - protein, 17 aa, Entamoeba invadens
WNEEDNEIIPAASDSMV

SEQ ID NO: 2783447 - protein, 17 aa, Entamoeba invadens
WNENDNELIPPSSDSMV

SEQ ID NO: 2783448 - protein, 10 aa, Entamoeba invadens
WNGNKNEYRN

SEQ ID NO: 2783449 - protein, 6 aa, Entamoeba invadens
WNGNKY

SEQ ID NO: 2783450 - protein, 8 aa, Entamoeba invadens
WNKRPTSS

SEQ ID NO: 2783451 - protein, 11 aa, Entamoeba invadens
WNPERITPFTK

SEQ ID NO: 2783452 - protein, 10 aa, Entamoeba invadens
WNQNSSERIS

SEQ ID NO: 2783453 - protein, 50 aa, Entamoeba invadens
WNRKSSANLKEEKQKEKEEKQREKEKEKEEKQSAKEVKEAKGKDEGSSLI

SEQ ID NO: 2783454 - protein, 4 aa, Entamoeba invadens
WPTT

SEQ ID NO: 2783455 - protein, 18 aa, Entamoeba invadens
WQPSDNNGNDQCYYGTGN

SEQ ID NO: 2783456 - protein, 8 aa, Entamoeba invadens
WQQDAKNR

SEQ ID NO: 2783457 - protein, 6 aa, Entamoeba invadens
WQTDNT

SEQ ID NO: 2783458 - protein, 17 aa, Entamoeba invadens
WRNENREIGVDDNTAGT

SEQ ID NO: 2783459 - protein, 10 aa, Entamoeba invadens
WRPTDSSKVL

SEQ ID NO: 2783460 - protein, 11 aa, Entamoeba invadens
WSANNGNDGVS

SEQ ID NO: 2783461 - protein, 9 aa, Entamoeba invadens
WSASGSTYN

SEQ ID NO: 2783462 - protein, 12 aa, Entamoeba invadens
WSDPANYSEYPY

SEQ ID NO: 2783463 - protein, 7 aa, Entamoeba invadens
WSKKGKK

SEQ ID NO: 2783464 - protein, 17 aa, Entamoeba invadens
WSKKSTKSTQTEYTREE

SEQ ID NO: 2783465 - protein, 36 aa, Entamoeba invadens
WSKNANGNISEPKQSITSSKTITKQNKAKDDKQNSV

SEQ ID NO: 2783466 - protein, 4 aa, Entamoeba invadens
WSKR

SEQ ID NO: 2783467 - protein, 9 aa, Entamoeba invadens
WSNGDTSPF

SEQ ID NO: 2783468 - protein, 7 aa, Entamoeba invadens
WSQEAKT

SEQ ID NO: 2783469 - protein, 12 aa, Entamoeba invadens
WSSGTGFAGVAG

SEQ ID NO: 2783470 - protein, 9 aa, Entamoeba invadens
WSSPSALNP

SEQ ID NO: 2783471 - protein, 10 aa, Entamoeba invadens
WSSPSALNPE

SEQ ID NO: 2783472 - protein, 7 aa, Entamoeba invadens
WSSSGNS

SEQ ID NO: 2783473 - protein, 7 aa, Entamoeba invadens
WSSSGTS

SEQ ID NO: 2783474 - protein, 26 aa, Entamoeba invadens
WSTEGSATCTPCSTNCSSCSKSNGHC

SEQ ID NO: 2783475 - protein, 10 aa, Entamoeba invadens
WSTENAKSAF

SEQ ID NO: 2783476 - protein, 10 aa, Entamoeba invadens
WTDGSTGEGK

SEQ ID NO: 2783477 - protein, 11 aa, Entamoeba invadens
WTGCEGGLSDD

SEQ ID NO: 2783478 - protein, 5 aa, Entamoeba invadens
WTKDA

SEQ ID NO: 2783479 - protein, 11 aa, Entamoeba invadens
WTKKNKEELTP

SEQ ID NO: 2783480 - protein, 6 aa, Entamoeba invadens
WTNPTP

SEQ ID NO: 2783481 - protein, 4 aa, Entamoeba invadens
WTPE

SEQ ID NO: 2783482 - protein, 8 aa, Entamoeba invadens
WTQDPLER

SEQ ID NO: 2783483 - protein, 8 aa, Entamoeba invadens
WTQDQKTR

SEQ ID NO: 2783484 - protein, 6 aa, Entamoeba invadens
WTQNSM

SEQ ID NO: 2783485 - protein, 8 aa, Entamoeba invadens
WTSCEDAN

SEQ ID NO: 2783486 - protein, 7 aa, Entamoeba invadens
WTSDDGV

SEQ ID NO: 2783487 - protein, 6 aa, Entamoeba invadens
WTSEAK

SEQ ID NO: 2783488 - protein, 8 aa, Entamoeba invadens
WTSNDDSV

SEQ ID NO: 2783489 - protein, 10 aa, Entamoeba invadens
WTSSKVKERY

SEQ ID NO: 2783490 - protein, 12 aa, Entamoeba invadens
WVPSQDGKYCAE

SEQ ID NO: 2783491 - protein, 8 aa, Entamoeba invadens
WYPTQQND

SEQ ID NO: 2783492 - protein, 16 aa, Entamoeba invadens
YAAGGTLKSALGSSNS

SEQ ID NO: 2783493 - protein, 14 aa, Entamoeba invadens
YAAISETKDGKEMP

SEQ ID NO: 2783494 - protein, 13 aa, Entamoeba invadens
YAAKEGSSSCEPC

SEQ ID NO: 2783495 - protein, 5 aa, Entamoeba invadens
YAASK

SEQ ID NO: 2783496 - protein, 6 aa, Entamoeba invadens
YAATTF

SEQ ID NO: 2783497 - protein, 9 aa, Entamoeba invadens
YADEIGSST

SEQ ID NO: 2783498 - protein, 9 aa, Entamoeba invadens
YADTTGSDL

SEQ ID NO: 2783499 - protein, 4 aa, Entamoeba invadens
YAED

SEQ ID NO: 2783500 - protein, 5 aa, Entamoeba invadens
YAEET

SEQ ID NO: 2783501 - protein, 6 aa, Entamoeba invadens
YAEKMT

SEQ ID NO: 2783502 - protein, 10 aa, Entamoeba invadens
YAERNPTTTA

SEQ ID NO: 2783503 - protein, 5 aa, Entamoeba invadens
YAFKE

SEQ ID NO: 2783504 - protein, 6 aa, Entamoeba invadens
YAFKEN

SEQ ID NO: 2783505 - protein, 10 aa, Entamoeba invadens
YAGKPRPYYN

SEQ ID NO: 2783506 - protein, 8 aa, Entamoeba invadens
YAGRPRPN

SEQ ID NO: 2783507 - protein, 4 aa, Entamoeba invadens
YAGT

SEQ ID NO: 2783508 - protein, 9 aa, Entamoeba invadens
YAKGSSSTF

SEQ ID NO: 2783509 - protein, 11 aa, Entamoeba invadens
YAKPSIKTPTI

SEQ ID NO: 2783510 - protein, 8 aa, Entamoeba invadens
YAKSDKDV

SEQ ID NO: 2783511 - protein, 6 aa, Entamoeba invadens
YAKYGS

SEQ ID NO: 2783512 - protein, 8 aa, Entamoeba invadens
YAKYGYPN

SEQ ID NO: 2783513 - protein, 4 aa, Entamoeba invadens
YAND

SEQ ID NO: 2783514 - protein, 7 aa, Entamoeba invadens
YANGSSC

SEQ ID NO: 2783515 - protein, 5 aa, Entamoeba invadens
YANNQ

SEQ ID NO: 2783516 - protein, 8 aa, Entamoeba invadens
YANQTGSS

SEQ ID NO: 2783517 - protein, 26 aa, Entamoeba invadens
YANSANKKCQQCDNKTYQSNEGQTYC

SEQ ID NO: 2783518 - protein, 24 aa, Entamoeba invadens
YANSANNKCQQCGDKTYQPNEGQT

SEQ ID NO: 2783519 - protein, 12 aa, Entamoeba invadens
YAPAGATSCKDC

SEQ ID NO: 2783520 - protein, 15 aa, Entamoeba invadens
YAPEITYSSTEEGFT

SEQ ID NO: 2783521 - protein, 13 aa, Entamoeba invadens
YAPSKDGSYCNNQ

SEQ ID NO: 2783522 - protein, 7 aa, Entamoeba invadens
YAPSPYP

SEQ ID NO: 2783523 - protein, 10 aa, Entamoeba invadens
YAQEDSTMTI

SEQ ID NO: 2783524 - protein, 5 aa, Entamoeba invadens
YAQET

SEQ ID NO: 2783525 - protein, 8 aa, Entamoeba invadens
YAQPEDSE

SEQ ID NO: 2783526 - protein, 9 aa, Entamoeba invadens
YAQTNPTNA

SEQ ID NO: 2783527 - protein, 6 aa, Entamoeba invadens
YAQTQN

SEQ ID NO: 2783528 - protein, 6 aa, Entamoeba invadens
YARPRE

SEQ ID NO: 2783529 - protein, 4 aa, Entamoeba invadens
YARS

SEQ ID NO: 2783530 - protein, 8 aa, Entamoeba invadens
YASGDQVE

SEQ ID NO: 2783531 - protein, 10 aa, Entamoeba invadens
YASKNSDVTL

SEQ ID NO: 2783532 - protein, 5 aa, Entamoeba invadens
YASKS

SEQ ID NO: 2783533 - protein, 7 aa, Entamoeba invadens
YASPRRG

SEQ ID NO: 2783534 - protein, 8 aa, Entamoeba invadens
YASVTTNP

SEQ ID NO: 2783535 - protein, 12 aa, Entamoeba invadens
YASYDTTTGKVV

SEQ ID NO: 2783536 - protein, 6 aa, Entamoeba invadens
YATGLE

SEQ ID NO: 2783537 - protein, 19 aa, Entamoeba invadens
YATHGTAASVSSITRTASN

SEQ ID NO: 2783538 - protein, 9 aa, Entamoeba invadens
YATSAGSVS

SEQ ID NO: 2783539 - protein, 6 aa, Entamoeba invadens
YATTQN

SEQ ID NO: 2783540 - protein, 24 aa, Entamoeba invadens
YAYDTETKKCEDGTCLKSPNEAYK

SEQ ID NO: 2783541 - protein, 4 aa, Entamoeba invadens
YCEK

SEQ ID NO: 2783542 - protein, 6 aa, Entamoeba invadens
YCETSA

SEQ ID NO: 2783543 - protein, 11 aa, Entamoeba invadens
YCGNSKKEDTV

SEQ ID NO: 2783544 - protein, 6 aa, Entamoeba invadens
YCNGTA

SEQ ID NO: 2783545 - protein, 6 aa, Entamoeba invadens
YCPPSS

SEQ ID NO: 2783546 - protein, 13 aa, Entamoeba invadens
YCPTPKTQIHESD

SEQ ID NO: 2783547 - protein, 5 aa, Entamoeba invadens
YCQNT

SEQ ID NO: 2783548 - protein, 11 aa, Entamoeba invadens
YCSGPNSNQCT

SEQ ID NO: 2783549 - protein, 4 aa, Entamoeba invadens
YCSN

SEQ ID NO: 2783550 - protein, 6 aa, Entamoeba invadens
YCSNGG

SEQ ID NO: 2783551 - protein, 11 aa, Entamoeba invadens
YCSPQNNDGTI

SEQ ID NO: 2783552 - protein, 13 aa, Entamoeba invadens
YCSQKDNKYIPTR

SEQ ID NO: 2783553 - protein, 6 aa, Entamoeba invadens
YCTNGY

SEQ ID NO: 2783554 - protein, 4 aa, Entamoeba invadens
YCTS

SEQ ID NO: 2783555 - protein, 6 aa, Entamoeba invadens
YCTSST

SEQ ID NO: 2783556 - protein, 18 aa, Entamoeba invadens
YDAEVQSDQTYDSYKTTR

SEQ ID NO: 2783557 - protein, 8 aa, Entamoeba invadens
YDAKKSYE

SEQ ID NO: 2783558 - protein, 8 aa, Entamoeba invadens
YDANGQCS

SEQ ID NO: 2783559 - protein, 6 aa, Entamoeba invadens
YDAQTK

SEQ ID NO: 2783560 - protein, 18 aa, Entamoeba invadens
YDATSNPCSASNPTNTGC

SEQ ID NO: 2783561 - protein, 6 aa, Entamoeba invadens
YDCDSD

SEQ ID NO: 2783562 - protein, 11 aa, Entamoeba invadens
YDCNDKDRVDT

SEQ ID NO: 2783563 - protein, 16 aa, Entamoeba invadens
YDDANKDNEQNKTVRG

SEQ ID NO: 2783564 - protein, 19 aa, Entamoeba invadens
YDDDGSGSILYDVKTPLVP

SEQ ID NO: 2783565 - protein, 13 aa, Entamoeba invadens
YDDDTSKTCEKCD

SEQ ID NO: 2783566 - protein, 4 aa, Entamoeba invadens
YDDQ

SEQ ID NO: 2783567 - protein, 5 aa, Entamoeba invadens
YDDTF

SEQ ID NO: 2783568 - protein, 5 aa, Entamoeba invadens
YDDTS

SEQ ID NO: 2783569 - protein, 9 aa, Entamoeba invadens
YDEDEKKKS

SEQ ID NO: 2783570 - protein, 19 aa, Entamoeba invadens
YDEEDDEKKEREKEQRENL

SEQ ID NO: 2783571 - protein, 7 aa, Entamoeba invadens
YDEEKYN

SEQ ID NO: 2783572 - protein, 4 aa, Entamoeba invadens
YDEF

SEQ ID NO: 2783573 - protein, 6 aa, Entamoeba invadens
YDEKAR

SEQ ID NO: 2783574 - protein, 6 aa, Entamoeba invadens
YDEKEV

SEQ ID NO: 2783575 - protein, 7 aa, Entamoeba invadens
YDENGDF

SEQ ID NO: 2783576 - protein, 9 aa, Entamoeba invadens
YDENGEFSK

SEQ ID NO: 2783577 - protein, 5 aa, Entamoeba invadens
YDENL

SEQ ID NO: 2783578 - protein, 10 aa, Entamoeba invadens
YDEQPGFDDN

SEQ ID NO: 2783579 - protein, 5 aa, Entamoeba invadens
YDETS

SEQ ID NO: 2783580 - protein, 5 aa, Entamoeba invadens
YDEYY

SEQ ID NO: 2783581 - protein, 13 aa, Entamoeba invadens
YDFNPSNPVNPPA

SEQ ID NO: 2783582 - protein, 4 aa, Entamoeba invadens
YDGD

SEQ ID NO: 2783583 - protein, 5 aa, Entamoeba invadens
YDGDG

SEQ ID NO: 2783584 - protein, 4 aa, Entamoeba invadens
YDGE

SEQ ID NO: 2783585 - protein, 7 aa, Entamoeba invadens
YDGKEKG

SEQ ID NO: 2783586 - protein, 9 aa, Entamoeba invadens
YDGKPIKDK

SEQ ID NO: 2783587 - protein, 8 aa, Entamoeba invadens
YDGSNCES

SEQ ID NO: 2783588 - protein, 10 aa, Entamoeba invadens
YDHKPLDANN

SEQ ID NO: 2783589 - protein, 7 aa, Entamoeba invadens
YDIQSDG

SEQ ID NO: 2783590 - protein, 12 aa, Entamoeba invadens
YDKDGTCSRMNN

SEQ ID NO: 2783591 - protein, 13 aa, Entamoeba invadens
YDKENKYKLKEAS

SEQ ID NO: 2783592 - protein, 19 aa, Entamoeba invadens
YDKKGCENTVDKAKPTEQL

SEQ ID NO: 2783593 - protein, 8 aa, Entamoeba invadens
YDKNPTIS

SEQ ID NO: 2783594 - protein, 12 aa, Entamoeba invadens
YDKQDSETSKNI

SEQ ID NO: 2783595 - protein, 8 aa, Entamoeba invadens
YDKQTSTC

SEQ ID NO: 2783596 - protein, 9 aa, Entamoeba invadens
YDLSSDKTE

SEQ ID NO: 2783597 - protein, 11 aa, Entamoeba invadens
YDNDIQTPLTN

SEQ ID NO: 2783598 - protein, 6 aa, Entamoeba invadens
YDNDQE

SEQ ID NO: 2783599 - protein, 25 aa, Entamoeba invadens
YDNEAMNCENKEHPTTFEKDNEQTH

SEQ ID NO: 2783600 - protein, 9 aa, Entamoeba invadens
YDNENSKIR

SEQ ID NO: 2783601 - protein, 8 aa, Entamoeba invadens
YDNGDPNG

SEQ ID NO: 2783602 - protein, 14 aa, Entamoeba invadens
YDNNCRTCSPDSSQ

SEQ ID NO: 2783603 - protein, 5 aa, Entamoeba invadens
YDNNR

SEQ ID NO: 2783604 - protein, 12 aa, Entamoeba invadens
YDNQPDCNSTSF

SEQ ID NO: 2783605 - protein, 16 aa, Entamoeba invadens
YDNRKHKCANRNTTLP

SEQ ID NO: 2783606 - protein, 11 aa, Entamoeba invadens
YDNSCHGGHPK

SEQ ID NO: 2783607 - protein, 11 aa, Entamoeba invadens
YDNYDNVGRSM

SEQ ID NO: 2783608 - protein, 9 aa, Entamoeba invadens
YDNYGSKAK

SEQ ID NO: 2783609 - protein, 11 aa, Entamoeba invadens
YDPAQSPNYND

SEQ ID NO: 2783610 - protein, 15 aa, Entamoeba invadens
YDPDCSTCSQTTRKC

SEQ ID NO: 2783611 - protein, 6 aa, Entamoeba invadens
YDPEKI

SEQ ID NO: 2783612 - protein, 10 aa, Entamoeba invadens
YDPNCEQCSG

SEQ ID NO: 2783613 - protein, 16 aa, Entamoeba invadens
YDPNCQSCSKTARKCE

SEQ ID NO: 2783614 - protein, 16 aa, Entamoeba invadens
YDPNTGNKIPNNSQKQ

SEQ ID NO: 2783615 - protein, 7 aa, Entamoeba invadens
YDPSTPL

SEQ ID NO: 2783616 - protein, 12 aa, Entamoeba invadens
YDQTKKDEEFEN

SEQ ID NO: 2783617 - protein, 13 aa, Entamoeba invadens
YDQTTNTCTNCQD

SEQ ID NO: 2783618 - protein, 5 aa, Entamoeba invadens
YDRET

SEQ ID NO: 2783619 - protein, 23 aa, Entamoeba invadens
YDRKQREKNESNKTPKIESDEDN

SEQ ID NO: 2783620 - protein, 9 aa, Entamoeba invadens
YDRNETLDA

SEQ ID NO: 2783621 - protein, 5 aa, Entamoeba invadens
YDSDD

SEQ ID NO: 2783622 - protein, 6 aa, Entamoeba invadens
YDSING

SEQ ID NO: 2783623 - protein, 5 aa, Entamoeba invadens
YDSNC

SEQ ID NO: 2783624 - protein, 6 aa, Entamoeba invadens
YDSNGK

SEQ ID NO: 2783625 - protein, 8 aa, Entamoeba invadens
YDSNPEHL

SEQ ID NO: 2783626 - protein, 9 aa, Entamoeba invadens
YDSPDHPYQ

SEQ ID NO: 2783627 - protein, 8 aa, Entamoeba invadens
YDSPETDL

SEQ ID NO: 2783628 - protein, 27 aa, Entamoeba invadens
YDSPRARPSDVPTQNPINTDTEYYTKY

SEQ ID NO: 2783629 - protein, 15 aa, Entamoeba invadens
YDSTNGTYYTEQEEY

SEQ ID NO: 2783630 - protein, 7 aa, Entamoeba invadens
YDSTTHT

SEQ ID NO: 2783631 - protein, 9 aa, Entamoeba invadens
YDTAKNPTR

SEQ ID NO: 2783632 - protein, 6 aa, Entamoeba invadens
YDTAQK

SEQ ID NO: 2783633 - protein, 6 aa, Entamoeba invadens
YDTCGT

SEQ ID NO: 2783634 - protein, 4 aa, Entamoeba invadens
YDTD

SEQ ID NO: 2783635 - protein, 12 aa, Entamoeba invadens
YDTEDRKEIDSY

SEQ ID NO: 2783636 - protein, 9 aa, Entamoeba invadens
YDTENNKEL

SEQ ID NO: 2783637 - protein, 8 aa, Entamoeba invadens
YDTPQTEM

SEQ ID NO: 2783638 - protein, 14 aa, Entamoeba invadens
YDTQSLDQYPLSGG

SEQ ID NO: 2783639 - protein, 6 aa, Entamoeba invadens
YDTSEN

SEQ ID NO: 2783640 - protein, 8 aa, Entamoeba invadens
YDTSENPV

SEQ ID NO: 2783641 - protein, 10 aa, Entamoeba invadens
YDTSKSDVND

SEQ ID NO: 2783642 - protein, 4 aa, Entamoeba invadens
YDTT

SEQ ID NO: 2783643 - protein, 12 aa, Entamoeba invadens
YDTTFGKSRTDS

SEQ ID NO: 2783644 - protein, 9 aa, Entamoeba invadens
YDTTTGKCS

SEQ ID NO: 2783645 - protein, 14 aa, Entamoeba invadens
YDVNDAKKRKKQIE

SEQ ID NO: 2783646 - protein, 6 aa, Entamoeba invadens
YDVNTQ

SEQ ID NO: 2783647 - protein, 9 aa, Entamoeba invadens
YDVYTSQQQ

SEQ ID NO: 2783648 - protein, 15 aa, Entamoeba invadens
YDYQENYKKYTKNAP

SEQ ID NO: 2783649 - protein, 4 aa, Entamoeba invadens
YEAF

SEQ ID NO: 2783650 - protein, 4 aa, Entamoeba invadens
YEAK

SEQ ID NO: 2783651 - protein, 4 aa, Entamoeba invadens
YEAL

SEQ ID NO: 2783652 - protein, 4 aa, Entamoeba invadens
YEAN

SEQ ID NO: 2783653 - protein, 5 aa, Entamoeba invadens
YECET

SEQ ID NO: 2783654 - protein, 7 aa, Entamoeba invadens
YEDDETV

SEQ ID NO: 2783655 - protein, 5 aa, Entamoeba invadens
YEDDI

SEQ ID NO: 2783656 - protein, 9 aa, Entamoeba invadens
YEDDNEQMA

SEQ ID NO: 2783657 - protein, 8 aa, Entamoeba invadens
YEDDRPEG

SEQ ID NO: 2783658 - protein, 9 aa, Entamoeba invadens
YEDNKEDDL

SEQ ID NO: 2783659 - protein, 6 aa, Entamoeba invadens
YEDPTS

SEQ ID NO: 2783660 - protein, 11 aa, Entamoeba invadens
YEDSLSSSVKY

SEQ ID NO: 2783661 - protein, 16 aa, Entamoeba invadens
YEDSRRRLADRKFNQS

SEQ ID NO: 2783662 - protein, 6 aa, Entamoeba invadens
YEDTTN

SEQ ID NO: 2783663 - protein, 13 aa, Entamoeba invadens
YEECRDSNNTIDF

SEQ ID NO: 2783664 - protein, 12 aa, Entamoeba invadens
YEEFNKERITEQ

SEQ ID NO: 2783665 - protein, 12 aa, Entamoeba invadens
YEELDQTKNFDH

SEQ ID NO: 2783666 - protein, 4 aa, Entamoeba invadens
YEEN

SEQ ID NO: 2783667 - protein, 7 aa, Entamoeba invadens
YEENQTI

SEQ ID NO: 2783668 - protein, 5 aa, Entamoeba invadens
YEGGY

SEQ ID NO: 2783669 - protein, 9 aa, Entamoeba invadens
YEGKKNHDV

SEQ ID NO: 2783670 - protein, 10 aa, Entamoeba invadens
YEGLNTTTTD

SEQ ID NO: 2783671 - protein, 12 aa, Entamoeba invadens
YEGSKGNEDLEG

SEQ ID NO: 2783672 - protein, 5 aa, Entamoeba invadens
YEGTC

SEQ ID NO: 2783673 - protein, 13 aa, Entamoeba invadens
YEGYTGDEFNPQD

SEQ ID NO: 2783674 - protein, 10 aa, Entamoeba invadens
YEIPSNSITT

SEQ ID NO: 2783675 - protein, 6 aa, Entamoeba invadens
YEIQSG

SEQ ID NO: 2783676 - protein, 6 aa, Entamoeba invadens
YEKCGP

SEQ ID NO: 2783677 - protein, 10 aa, Entamoeba invadens
YEKCNSDNVD

SEQ ID NO: 2783678 - protein, 8 aa, Entamoeba invadens
YEKENKSV

SEQ ID NO: 2783679 - protein, 10 aa, Entamoeba invadens
YEKGCSKRKK

SEQ ID NO: 2783680 - protein, 9 aa, Entamoeba invadens
YEKKTEPID

SEQ ID NO: 2783681 - protein, 6 aa, Entamoeba invadens
YEKNDR

SEQ ID NO: 2783682 - protein, 5 aa, Entamoeba invadens
YEKQD

SEQ ID NO: 2783683 - protein, 5 aa, Entamoeba invadens
YEKRE

SEQ ID NO: 2783684 - protein, 5 aa, Entamoeba invadens
YEKSE

SEQ ID NO: 2783685 - protein, 8 aa, Entamoeba invadens
YEKSEVNS

SEQ ID NO: 2783686 - protein, 8 aa, Entamoeba invadens
YEKSRDSI

SEQ ID NO: 2783687 - protein, 17 aa, Entamoeba invadens
YELSSDNTCVKSQCGTV

SEQ ID NO: 2783688 - protein, 8 aa, Entamoeba invadens
YENGDTVE

SEQ ID NO: 2783689 - protein, 10 aa, Entamoeba invadens
YENGEIPVNE

SEQ ID NO: 2783690 - protein, 16 aa, Entamoeba invadens
YENGLGTCSPSEGKCR

SEQ ID NO: 2783691 - protein, 7 aa, Entamoeba invadens
YENGNHT

SEQ ID NO: 2783692 - protein, 4 aa, Entamoeba invadens
YENH

SEQ ID NO: 2783693 - protein, 5 aa, Entamoeba invadens
YENKE

SEQ ID NO: 2783694 - protein, 6 aa, Entamoeba invadens
YENLET

SEQ ID NO: 2783695 - protein, 5 aa, Entamoeba invadens
YENSG

SEQ ID NO: 2783696 - protein, 4 aa, Entamoeba invadens
YENT

SEQ ID NO: 2783697 - protein, 16 aa, Entamoeba invadens
YEPNCSEEEKKKAIER

SEQ ID NO: 2783698 - protein, 44 aa, Entamoeba invadens
YEPPKLPKSDEHDEKPLAQVQSEKLPIKKNSSDEYVAPNRSIST

SEQ ID NO: 2783699 - protein, 6 aa, Entamoeba invadens
YEPTRR

SEQ ID NO: 2783700 - protein, 5 aa, Entamoeba invadens
YEPTS

SEQ ID NO: 2783701 - protein, 6 aa, Entamoeba invadens
YEPTVG

SEQ ID NO: 2783702 - protein, 6 aa, Entamoeba invadens
YEQDTS

SEQ ID NO: 2783703 - protein, 8 aa, Entamoeba invadens
YEQPKDNN

SEQ ID NO: 2783704 - protein, 8 aa, Entamoeba invadens
YEQTSTEM

SEQ ID NO: 2783705 - protein, 12 aa, Entamoeba invadens
YERPRKRSSQTH

SEQ ID NO: 2783706 - protein, 19 aa, Entamoeba invadens
YERQLSKQWSKEEHSKHPS

SEQ ID NO: 2783707 - protein, 14 aa, Entamoeba invadens
YESANGVTFTSTTS

SEQ ID NO: 2783708 - protein, 17 aa, Entamoeba invadens
YESNGKYIRTEECDGGV

SEQ ID NO: 2783709 - protein, 13 aa, Entamoeba invadens
YESSNPGNIDTSD

SEQ ID NO: 2783710 - protein, 8 aa, Entamoeba invadens
YESTGEFK

SEQ ID NO: 2783711 - protein, 6 aa, Entamoeba invadens
YESVDR

SEQ ID NO: 2783712 - protein, 9 aa, Entamoeba invadens
YETNENEIA

SEQ ID NO: 2783713 - protein, 15 aa, Entamoeba invadens
YETNPDDKLSCRQKG

SEQ ID NO: 2783714 - protein, 8 aa, Entamoeba invadens
YETQSQPG

SEQ ID NO: 2783715 - protein, 6 aa, Entamoeba invadens
YETYQK

SEQ ID NO: 2783716 - protein, 6 aa, Entamoeba invadens
YETYTK

SEQ ID NO: 2783717 - protein, 4 aa, Entamoeba invadens
YEVK

SEQ ID NO: 2783718 - protein, 5 aa, Entamoeba invadens
YEVQN

SEQ ID NO: 2783719 - protein, 11 aa, Entamoeba invadens
YEVSSSGTECI

SEQ ID NO: 2783720 - protein, 11 aa, Entamoeba invadens
YEVSSSGTECV

SEQ ID NO: 2783721 - protein, 8 aa, Entamoeba invadens
YEVTRENK

SEQ ID NO: 2783722 - protein, 11 aa, Entamoeba invadens
YEYNEKQLTDH

SEQ ID NO: 2783723 - protein, 6 aa, Entamoeba invadens
YEYSNS

SEQ ID NO: 2783724 - protein, 5 aa, Entamoeba invadens
YFDEN

SEQ ID NO: 2783725 - protein, 5 aa, Entamoeba invadens
YFERG

SEQ ID NO: 2783726 - protein, 5 aa, Entamoeba invadens
YFGTP

SEQ ID NO: 2783727 - protein, 6 aa, Entamoeba invadens
YFKDGQ

SEQ ID NO: 2783728 - protein, 6 aa, Entamoeba invadens
YFKEGQ

SEQ ID NO: 2783729 - protein, 6 aa, Entamoeba invadens
YFNGDR

SEQ ID NO: 2783730 - protein, 5 aa, Entamoeba invadens
YFNPT

SEQ ID NO: 2783731 - protein, 6 aa, Entamoeba invadens
YFPKDK

SEQ ID NO: 2783732 - protein, 8 aa, Entamoeba invadens
YFPQSDGR

SEQ ID NO: 2783733 - protein, 9 aa, Entamoeba invadens
YFPQSDGRC

SEQ ID NO: 2783734 - protein, 11 aa, Entamoeba invadens
YFPSAKANDTV

SEQ ID NO: 2783735 - protein, 4 aa, Entamoeba invadens
YFPT

SEQ ID NO: 2783736 - protein, 4 aa, Entamoeba invadens
YFSD

SEQ ID NO: 2783737 - protein, 8 aa, Entamoeba invadens
YFSEGGTI

SEQ ID NO: 2783738 - protein, 9 aa, Entamoeba invadens
YFSGSGSSL

SEQ ID NO: 2783739 - protein, 25 aa, Entamoeba invadens
YFSKSGDATCSACSAGNYSAEGASS

SEQ ID NO: 2783740 - protein, 24 aa, Entamoeba invadens
YFSNSGDATCTACPAGSYSGKGFS

SEQ ID NO: 2783741 - protein, 12 aa, Entamoeba invadens
YFSNSGDATCTK

SEQ ID NO: 2783742 - protein, 43 aa, Entamoeba invadens
YFSSSSGQSSCSRCTAGTYSNGNSKTTCTKCPGGTYSKTGASI

SEQ ID NO: 2783743 - protein, 6 aa, Entamoeba invadens
YGAEPL

SEQ ID NO: 2783744 - protein, 9 aa, Entamoeba invadens
YGCGNSGRL

SEQ ID NO: 2783745 - protein, 8 aa, Entamoeba invadens
YGDDRDQF

SEQ ID NO: 2783746 - protein, 37 aa, Entamoeba invadens
YGDFEEERRVEGAHGKEKVETKKAKHQKRKSKIDEEI

SEQ ID NO: 2783747 - protein, 4 aa, Entamoeba invadens
YGDM

SEQ ID NO: 2783748 - protein, 8 aa, Entamoeba invadens
YGDMTPQT

SEQ ID NO: 2783749 - protein, 7 aa, Entamoeba invadens
YGECGDN

SEQ ID NO: 2783750 - protein, 4 aa, Entamoeba invadens
YGEG

SEQ ID NO: 2783751 - protein, 5 aa, Entamoeba invadens
YGENQ

SEQ ID NO: 2783752 - protein, 6 aa, Entamoeba invadens
YGEPSE

SEQ ID NO: 2783753 - protein, 6 aa, Entamoeba invadens
YGERDG

SEQ ID NO: 2783754 - protein, 6 aa, Entamoeba invadens
YGESNC

SEQ ID NO: 2783755 - protein, 14 aa, Entamoeba invadens
YGESSHQWNGPSKL

SEQ ID NO: 2783756 - protein, 6 aa, Entamoeba invadens
YGESTI

SEQ ID NO: 2783757 - protein, 11 aa, Entamoeba invadens
YGEYLGDTNTC

SEQ ID NO: 2783758 - protein, 10 aa, Entamoeba invadens
YGEYSGTSNV

SEQ ID NO: 2783759 - protein, 10 aa, Entamoeba invadens
YGFENGTKGV

SEQ ID NO: 2783760 - protein, 24 aa, Entamoeba invadens
YGFNDGKCTKCSDKTFSKGGNDVC

SEQ ID NO: 2783761 - protein, 5 aa, Entamoeba invadens
YGGDD

SEQ ID NO: 2783762 - protein, 8 aa, Entamoeba invadens
YGGGNNYS

SEQ ID NO: 2783763 - protein, 10 aa, Entamoeba invadens
YGGGTRYSDA

SEQ ID NO: 2783764 - protein, 8 aa, Entamoeba invadens
YGGNINEE

SEQ ID NO: 2783765 - protein, 13 aa, Entamoeba invadens
YGGNTEVKITEST

SEQ ID NO: 2783766 - protein, 9 aa, Entamoeba invadens
YGGQKGEVY

SEQ ID NO: 2783767 - protein, 6 aa, Entamoeba invadens
YGGTPT

SEQ ID NO: 2783768 - protein, 8 aa, Entamoeba invadens
YGIDPTYS

SEQ ID NO: 2783769 - protein, 5 aa, Entamoeba invadens
YGIKN

SEQ ID NO: 2783770 - protein, 8 aa, Entamoeba invadens
YGKDSEYK

SEQ ID NO: 2783771 - protein, 11 aa, Entamoeba invadens
YGKERRSIGEK

SEQ ID NO: 2783772 - protein, 13 aa, Entamoeba invadens
YGKETEATAIEDT

SEQ ID NO: 2783773 - protein, 4 aa, Entamoeba invadens
YGKG

SEQ ID NO: 2783774 - protein, 10 aa, Entamoeba invadens
YGKGDSPTKI

SEQ ID NO: 2783775 - protein, 17 aa, Entamoeba invadens
YGKGNGDNKCEYSSTGY

SEQ ID NO: 2783776 - protein, 13 aa, Entamoeba invadens
YGKNKKVNKEVSQ

SEQ ID NO: 2783777 - protein, 8 aa, Entamoeba invadens
YGKNNSEC

SEQ ID NO: 2783778 - protein, 13 aa, Entamoeba invadens
YGKTGGDNTCTYT

SEQ ID NO: 2783779 - protein, 6 aa, Entamoeba invadens
YGLDTS

SEQ ID NO: 2783780 - protein, 12 aa, Entamoeba invadens
YGLKGTNNITTQ

SEQ ID NO: 2783781 - protein, 8 aa, Entamoeba invadens
YGLNPQGQ

SEQ ID NO: 2783782 - protein, 5 aa, Entamoeba invadens
YGLSS

SEQ ID NO: 2783783 - protein, 15 aa, Entamoeba invadens
YGLTNTDDKIDLSQN

SEQ ID NO: 2783784 - protein, 7 aa, Entamoeba invadens
YGNAEST

SEQ ID NO: 2783785 - protein, 9 aa, Entamoeba invadens
YGNDNQATN

SEQ ID NO: 2783786 - protein, 10 aa, Entamoeba invadens
YGNDSQATNI

SEQ ID NO: 2783787 - protein, 12 aa, Entamoeba invadens
YGNEDATNKAQR

SEQ ID NO: 2783788 - protein, 9 aa, Entamoeba invadens
YGNENVPTN

SEQ ID NO: 2783789 - protein, 9 aa, Entamoeba invadens
YGNINTSTK

SEQ ID NO: 2783790 - protein, 9 aa, Entamoeba invadens
YGNTNQATE

SEQ ID NO: 2783791 - protein, 7 aa, Entamoeba invadens
YGNTTVS

SEQ ID NO: 2783792 - protein, 6 aa, Entamoeba invadens
YGNYGT

SEQ ID NO: 2783793 - protein, 8 aa, Entamoeba invadens
YGPIESTG

SEQ ID NO: 2783794 - protein, 8 aa, Entamoeba invadens
YGPNAFGT

SEQ ID NO: 2783795 - protein, 9 aa, Entamoeba invadens
YGPNRCKRC

SEQ ID NO: 2783796 - protein, 10 aa, Entamoeba invadens
YGPSSFPPHG

SEQ ID NO: 2783797 - protein, 9 aa, Entamoeba invadens
YGQGNATFD

SEQ ID NO: 2783798 - protein, 6 aa, Entamoeba invadens
YGQPSE

SEQ ID NO: 2783799 - protein, 7 aa, Entamoeba invadens
YGQTDNS

SEQ ID NO: 2783800 - protein, 14 aa, Entamoeba invadens
YGRNNGECTSCTSG

SEQ ID NO: 2783801 - protein, 4 aa, Entamoeba invadens
YGSD

SEQ ID NO: 2783802 - protein, 10 aa, Entamoeba invadens
YGSENTNCNT

SEQ ID NO: 2783803 - protein, 5 aa, Entamoeba invadens
YGSIQ

SEQ ID NO: 2783804 - protein, 7 aa, Entamoeba invadens
YGSKNYS

SEQ ID NO: 2783805 - protein, 9 aa, Entamoeba invadens
YGSKPNCSK

SEQ ID NO: 2783806 - protein, 5 aa, Entamoeba invadens
YGSLS

SEQ ID NO: 2783807 - protein, 19 aa, Entamoeba invadens
YGSNNKSSNGDGTNNVPTF

SEQ ID NO: 2783808 - protein, 4 aa, Entamoeba invadens
YGSS

SEQ ID NO: 2783809 - protein, 10 aa, Entamoeba invadens
YGSSPTLTSP

SEQ ID NO: 2783810 - protein, 14 aa, Entamoeba invadens
YGSYDKAQPDTGAS

SEQ ID NO: 2783811 - protein, 9 aa, Entamoeba invadens
YGSYPSPID

SEQ ID NO: 2783812 - protein, 7 aa, Entamoeba invadens
YGTASTG

SEQ ID NO: 2783813 - protein, 11 aa, Entamoeba invadens
YGTDGETGNTF

SEQ ID NO: 2783814 - protein, 8 aa, Entamoeba invadens
YGTDNNGS

SEQ ID NO: 2783815 - protein, 7 aa, Entamoeba invadens
YGTGEQK

SEQ ID NO: 2783816 - protein, 4 aa, Entamoeba invadens
YGTK

SEQ ID NO: 2783817 - protein, 22 aa, Entamoeba invadens
YGTKKCDTCKAGYYKENDGCTS

SEQ ID NO: 2783818 - protein, 8 aa, Entamoeba invadens
YGTNSEYK

SEQ ID NO: 2783819 - protein, 4 aa, Entamoeba invadens
YGTP

SEQ ID NO: 2783820 - protein, 6 aa, Entamoeba invadens
YGTPSD

SEQ ID NO: 2783821 - protein, 7 aa, Entamoeba invadens
YGTSTED

SEQ ID NO: 2783822 - protein, 6 aa, Entamoeba invadens
YGTYPE

SEQ ID NO: 2783823 - protein, 22 aa, Entamoeba invadens
YGTYSKDSATSCTTCPAGTYSG

SEQ ID NO: 2783824 - protein, 11 aa, Entamoeba invadens
YGVAKKMGNTY

SEQ ID NO: 2783825 - protein, 4 aa, Entamoeba invadens
YGVK

SEQ ID NO: 2783826 - protein, 11 aa, Entamoeba invadens
YGVQSKAGVGM

SEQ ID NO: 2783827 - protein, 12 aa, Entamoeba invadens
YGYDKDDTTGVN

SEQ ID NO: 2783828 - protein, 23 aa, Entamoeba invadens
YGYKKDGNNCIDDDSCQTRNDDA

SEQ ID NO: 2783829 - protein, 11 aa, Entamoeba invadens
YGYPSGDAPLH

SEQ ID NO: 2783830 - protein, 5 aa, Entamoeba invadens
YGYPV

SEQ ID NO: 2783831 - protein, 12 aa, Entamoeba invadens
YHANPKKNTFYK

SEQ ID NO: 2783832 - protein, 7 aa, Entamoeba invadens
YHDGHTG

SEQ ID NO: 2783833 - protein, 9 aa, Entamoeba invadens
YHKPSDAGD

SEQ ID NO: 2783834 - protein, 12 aa, Entamoeba invadens
YHPDKNKLESAK

SEQ ID NO: 2783835 - protein, 13 aa, Entamoeba invadens
YHPDKNKSPEAEE

SEQ ID NO: 2783836 - protein, 11 aa, Entamoeba invadens
YHQNDTKNSEN

SEQ ID NO: 2783837 - protein, 11 aa, Entamoeba invadens
YHSTDNKIQNC

SEQ ID NO: 2783838 - protein, 7 aa, Entamoeba invadens
YHTSSNT

SEQ ID NO: 2783839 - protein, 7 aa, Entamoeba invadens
YHTSSST

SEQ ID NO: 2783840 - protein, 7 aa, Entamoeba invadens
YHTTNDN

SEQ ID NO: 2783841 - protein, 12 aa, Entamoeba invadens
YHTTNDNTIKQC

SEQ ID NO: 2783842 - protein, 12 aa, Entamoeba invadens
YHTTNDNTVEQC

SEQ ID NO: 2783843 - protein, 12 aa, Entamoeba invadens
YHTTNDNTVERC

SEQ ID NO: 2783844 - protein, 13 aa, Entamoeba invadens
YHTTNDNTVKQCE

SEQ ID NO: 2783845 - protein, 8 aa, Entamoeba invadens
YHTTNNNT

SEQ ID NO: 2783846 - protein, 12 aa, Entamoeba invadens
YHTTNNNTVEQC

SEQ ID NO: 2783847 - protein, 12 aa, Entamoeba invadens
YHTTNNNTVERC

SEQ ID NO: 2783848 - protein, 12 aa, Entamoeba invadens
YHTTNYNTVEQC

SEQ ID NO: 2783849 - protein, 5 aa, Entamoeba invadens
YHYSS

SEQ ID NO: 2783850 - protein, 8 aa, Entamoeba invadens
YIATTNSR

SEQ ID NO: 2783851 - protein, 8 aa, Entamoeba invadens
YIEEPERK

SEQ ID NO: 2783852 - protein, 5 aa, Entamoeba invadens
YIHSD

SEQ ID NO: 2783853 - protein, 10 aa, Entamoeba invadens
YIKDDNTSFN

SEQ ID NO: 2783854 - protein, 9 aa, Entamoeba invadens
YIKDNQENC

SEQ ID NO: 2783855 - protein, 11 aa, Entamoeba invadens
YIKENGKCRQI

SEQ ID NO: 2783856 - protein, 10 aa, Entamoeba invadens
YIKGEENGRT

SEQ ID NO: 2783857 - protein, 5 aa, Entamoeba invadens
YIKND

SEQ ID NO: 2783858 - protein, 4 aa, Entamoeba invadens
YINN

SEQ ID NO: 2783859 - protein, 9 aa, Entamoeba invadens
YIPEGATGQ

SEQ ID NO: 2783860 - protein, 5 aa, Entamoeba invadens
YIPPE

SEQ ID NO: 2783861 - protein, 22 aa, Entamoeba invadens
YIPSSEGCTECQNGTIKDEKNT

SEQ ID NO: 2783862 - protein, 5 aa, Entamoeba invadens
YIPTN

SEQ ID NO: 2783863 - protein, 5 aa, Entamoeba invadens
YIRDS

SEQ ID NO: 2783864 - protein, 5 aa, Entamoeba invadens
YIRED

SEQ ID NO: 2783865 - protein, 10 aa, Entamoeba invadens
YIRSSDGKQC

SEQ ID NO: 2783866 - protein, 4 aa, Entamoeba invadens
YIRT

SEQ ID NO: 2783867 - protein, 24 aa, Entamoeba invadens
YISDGEECSQCEEGEEPNESRNDC

SEQ ID NO: 2783868 - protein, 10 aa, Entamoeba invadens
YISGKGKCTA

SEQ ID NO: 2783869 - protein, 5 aa, Entamoeba invadens
YISTE

SEQ ID NO: 2783870 - protein, 8 aa, Entamoeba invadens
YISTETNA

SEQ ID NO: 2783871 - protein, 11 aa, Entamoeba invadens
YITEEGDPLSC

SEQ ID NO: 2783872 - protein, 4 aa, Entamoeba invadens
YITN

SEQ ID NO: 2783873 - protein, 9 aa, Entamoeba invadens
YITTKDDKV

SEQ ID NO: 2783874 - protein, 12 aa, Entamoeba invadens
YKADKKRQQSVT

SEQ ID NO: 2783875 - protein, 7 aa, Entamoeba invadens
YKAERAL

SEQ ID NO: 2783876 - protein, 17 aa, Entamoeba invadens
YKAERREEDKLPLLEGT

SEQ ID NO: 2783877 - protein, 6 aa, Entamoeba invadens
YKAPER

SEQ ID NO: 2783878 - protein, 5 aa, Entamoeba invadens
YKAQD

SEQ ID NO: 2783879 - protein, 7 aa, Entamoeba invadens
YKATEEY

SEQ ID NO: 2783880 - protein, 9 aa, Entamoeba invadens
YKATGTTSF

SEQ ID NO: 2783881 - protein, 7 aa, Entamoeba invadens
YKDDEVA

SEQ ID NO: 2783882 - protein, 13 aa, Entamoeba invadens
YKDGQSCKKCSAT

SEQ ID NO: 2783883 - protein, 15 aa, Entamoeba invadens
YKDTSSNSCKRCSTT

SEQ ID NO: 2783884 - protein, 9 aa, Entamoeba invadens
YKDVSDPTV

SEQ ID NO: 2783885 - protein, 5 aa, Entamoeba invadens
YKDYE

SEQ ID NO: 2783886 - protein, 7 aa, Entamoeba invadens
YKEDIPK

SEQ ID NO: 2783887 - protein, 6 aa, Entamoeba invadens
YKEEKC

SEQ ID NO: 2783888 - protein, 12 aa, Entamoeba invadens
YKEETKTKVTSK

SEQ ID NO: 2783889 - protein, 8 aa, Entamoeba invadens
YKEGESKQ

SEQ ID NO: 2783890 - protein, 6 aa, Entamoeba invadens
YKEKGK

SEQ ID NO: 2783891 - protein, 14 aa, Entamoeba invadens
YKEKKSVKKPKALE

SEQ ID NO: 2783892 - protein, 6 aa, Entamoeba invadens
YKEKSA

SEQ ID NO: 2783893 - protein, 26 aa, Entamoeba invadens
YKENESGDYSVQNGSLTEDKKSNKAG

SEQ ID NO: 2783894 - protein, 6 aa, Entamoeba invadens
YKENKS

SEQ ID NO: 2783895 - protein, 8 aa, Entamoeba invadens
YKESDEDA

SEQ ID NO: 2783896 - protein, 5 aa, Entamoeba invadens
YKESG

SEQ ID NO: 2783897 - protein, 7 aa, Entamoeba invadens
YKETKDN

SEQ ID NO: 2783898 - protein, 18 aa, Entamoeba invadens
YKETMEKNQTTQAAREKE

SEQ ID NO: 2783899 - protein, 10 aa, Entamoeba invadens
YKETTDGKTV

SEQ ID NO: 2783900 - protein, 21 aa, Entamoeba invadens
YKFKADQNTCVEGEDGCGFQS

SEQ ID NO: 2783901 - protein, 19 aa, Entamoeba invadens
YKGDAQNEFDVTQTSTEYA

SEQ ID NO: 2783902 - protein, 13 aa, Entamoeba invadens
YKGDDVGKLPLED

SEQ ID NO: 2783903 - protein, 11 aa, Entamoeba invadens
YKGEIDGLNKE

SEQ ID NO: 2783904 - protein, 8 aa, Entamoeba invadens
YKGETNEK

SEQ ID NO: 2783905 - protein, 6 aa, Entamoeba invadens
YKGGDG

SEQ ID NO: 2783906 - protein, 7 aa, Entamoeba invadens
YKGNDSG

SEQ ID NO: 2783907 - protein, 12 aa, Entamoeba invadens
YKGQGTDKNSGD

SEQ ID NO: 2783908 - protein, 6 aa, Entamoeba invadens
YKGSGE

SEQ ID NO: 2783909 - protein, 6 aa, Entamoeba invadens
YKGSPY

SEQ ID NO: 2783910 - protein, 31 aa, Entamoeba invadens
YKITESGSCESTTCKDNEEMEQNGRCSATQD

SEQ ID NO: 2783911 - protein, 31 aa, Entamoeba invadens
YKITESGSCESTTCKNNEEMEQNGRCSATQD

SEQ ID NO: 2783912 - protein, 8 aa, Entamoeba invadens
YKITPKGG

SEQ ID NO: 2783913 - protein, 8 aa, Entamoeba invadens
YKITTSQK

SEQ ID NO: 2783914 - protein, 8 aa, Entamoeba invadens
YKKADNQT

SEQ ID NO: 2783915 - protein, 11 aa, Entamoeba invadens
YKKASKLKSTL

SEQ ID NO: 2783916 - protein, 14 aa, Entamoeba invadens
YKKASKLKSTSEKC

SEQ ID NO: 2783917 - protein, 15 aa, Entamoeba invadens
YKKASTLKSTSENRL

SEQ ID NO: 2783918 - protein, 4 aa, Entamoeba invadens
YKKE

SEQ ID NO: 2783919 - protein, 14 aa, Entamoeba invadens
YKKEYPECATEESL

SEQ ID NO: 2783920 - protein, 5 aa, Entamoeba invadens
YKKGT

SEQ ID NO: 2783921 - protein, 10 aa, Entamoeba invadens
YKKNADDNQY

SEQ ID NO: 2783922 - protein, 7 aa, Entamoeba invadens
YKKPSDI

SEQ ID NO: 2783923 - protein, 7 aa, Entamoeba invadens
YKKTDMT

SEQ ID NO: 2783924 - protein, 9 aa, Entamoeba invadens
YKKTISEKT

SEQ ID NO: 2783925 - protein, 8 aa, Entamoeba invadens
YKLDNNKT

SEQ ID NO: 2783926 - protein, 4 aa, Entamoeba invadens
YKLS

SEQ ID NO: 2783927 - protein, 5 aa, Entamoeba invadens
YKLSA

SEQ ID NO: 2783928 - protein, 9 aa, Entamoeba invadens
YKLSASTKK

SEQ ID NO: 2783929 - protein, 13 aa, Entamoeba invadens
YKMDPGSKSCSKT

SEQ ID NO: 2783930 - protein, 10 aa, Entamoeba invadens
YKNANSKPEN

SEQ ID NO: 2783931 - protein, 18 aa, Entamoeba invadens
YKNDRKKKKASKKELKKK

SEQ ID NO: 2783932 - protein, 6 aa, Entamoeba invadens
YKNKDN

SEQ ID NO: 2783933 - protein, 10 aa, Entamoeba invadens
YKNKKLSGRE

SEQ ID NO: 2783934 - protein, 6 aa, Entamoeba invadens
YKNKTN

SEQ ID NO: 2783935 - protein, 10 aa, Entamoeba invadens
YKNNPTDKKY

SEQ ID NO: 2783936 - protein, 8 aa, Entamoeba invadens
YKNSDAPS

SEQ ID NO: 2783937 - protein, 11 aa, Entamoeba invadens
YKNTEKDGDSF

SEQ ID NO: 2783938 - protein, 7 aa, Entamoeba invadens
YKNTPND

SEQ ID NO: 2783939 - protein, 22 aa, Entamoeba invadens
YKNVNGNCETLENTESVTSSSV

SEQ ID NO: 2783940 - protein, 11 aa, Entamoeba invadens
YKNVPPQSLPN

SEQ ID NO: 2783941 - protein, 9 aa, Entamoeba invadens
YKNVTKKDV

SEQ ID NO: 2783942 - protein, 8 aa, Entamoeba invadens
YKPAQKVK

SEQ ID NO: 2783943 - protein, 13 aa, Entamoeba invadens
YKPDEQPKASDYS

SEQ ID NO: 2783944 - protein, 10 aa, Entamoeba invadens
YKPECESMSR

SEQ ID NO: 2783945 - protein, 5 aa, Entamoeba invadens
YKPEQ

SEQ ID NO: 2783946 - protein, 8 aa, Entamoeba invadens
YKPNEEYN

SEQ ID NO: 2783947 - protein, 8 aa, Entamoeba invadens
YKPNNKKD

SEQ ID NO: 2783948 - protein, 7 aa, Entamoeba invadens
YKPNNRR

SEQ ID NO: 2783949 - protein, 10 aa, Entamoeba invadens
YKPSDDGESC

SEQ ID NO: 2783950 - protein, 13 aa, Entamoeba invadens
YKPSQKLTFSSES

SEQ ID NO: 2783951 - protein, 7 aa, Entamoeba invadens
YKPTDFS

SEQ ID NO: 2783952 - protein, 11 aa, Entamoeba invadens
YKQEKDCTTCD

SEQ ID NO: 2783953 - protein, 5 aa, Entamoeba invadens
YKQKT

SEQ ID NO: 2783954 - protein, 6 aa, Entamoeba invadens
YKQMGS

SEQ ID NO: 2783955 - protein, 7 aa, Entamoeba invadens
YKQPADV

SEQ ID NO: 2783956 - protein, 10 aa, Entamoeba invadens
YKRKSGDGIP

SEQ ID NO: 2783957 - protein, 6 aa, Entamoeba invadens
YKRPAD

SEQ ID NO: 2783958 - protein, 14 aa, Entamoeba invadens
YKRSEYECQSCSSK

SEQ ID NO: 2783959 - protein, 8 aa, Entamoeba invadens
YKSAPGDI

SEQ ID NO: 2783960 - protein, 7 aa, Entamoeba invadens
YKSQEAQ

SEQ ID NO: 2783961 - protein, 8 aa, Entamoeba invadens
YKSQSDLP

SEQ ID NO: 2783962 - protein, 4 aa, Entamoeba invadens
YKSS

SEQ ID NO: 2783963 - protein, 10 aa, Entamoeba invadens
YKSSASKRLT

SEQ ID NO: 2783964 - protein, 10 aa, Entamoeba invadens
YKSSTLQRTT

SEQ ID NO: 2783965 - protein, 14 aa, Entamoeba invadens
YKSTENEDGSQNNE

SEQ ID NO: 2783966 - protein, 11 aa, Entamoeba invadens
YKSYQKNEVED

SEQ ID NO: 2783967 - protein, 8 aa, Entamoeba invadens
YKTDATKM

SEQ ID NO: 2783968 - protein, 13 aa, Entamoeba invadens
YKTEAEAKAACPQ

SEQ ID NO: 2783969 - protein, 8 aa, Entamoeba invadens
YKTEDKIE

SEQ ID NO: 2783970 - protein, 4 aa, Entamoeba invadens
YKTG

SEQ ID NO: 2783971 - protein, 4 aa, Entamoeba invadens
YKTK

SEQ ID NO: 2783972 - protein, 9 aa, Entamoeba invadens
YKTKPCKFS

SEQ ID NO: 2783973 - protein, 12 aa, Entamoeba invadens
YKTKYENNTNAP

SEQ ID NO: 2783974 - protein, 8 aa, Entamoeba invadens
YKTNAPKD

SEQ ID NO: 2783975 - protein, 16 aa, Entamoeba invadens
YKTNNGECKPQSSING

SEQ ID NO: 2783976 - protein, 10 aa, Entamoeba invadens
YKTNQGDCLP

SEQ ID NO: 2783977 - protein, 6 aa, Entamoeba invadens
YKTPAD

SEQ ID NO: 2783978 - protein, 6 aa, Entamoeba invadens
YKTPKT

SEQ ID NO: 2783979 - protein, 4 aa, Entamoeba invadens
YKTQ

SEQ ID NO: 2783980 - protein, 7 aa, Entamoeba invadens
YKTSGLN

SEQ ID NO: 2783981 - protein, 19 aa, Entamoeba invadens
YKTSGTNTLTIDDNNSGLF

SEQ ID NO: 2783982 - protein, 10 aa, Entamoeba invadens
YKTSNTTADL

SEQ ID NO: 2783983 - protein, 6 aa, Entamoeba invadens
YKTTES

SEQ ID NO: 2783984 - protein, 8 aa, Entamoeba invadens
YKTTSEKY

SEQ ID NO: 2783985 - protein, 9 aa, Entamoeba invadens
YKTTSEKYT

SEQ ID NO: 2783986 - protein, 7 aa, Entamoeba invadens
YKTTTKS

SEQ ID NO: 2783987 - protein, 17 aa, Entamoeba invadens
YKVNTEGTQCNKKTNYG

SEQ ID NO: 2783988 - protein, 17 aa, Entamoeba invadens
YKVNTKGTQCDKKTNYG

SEQ ID NO: 2783989 - protein, 7 aa, Entamoeba invadens
YKVPQSD

SEQ ID NO: 2783990 - protein, 12 aa, Entamoeba invadens
YKVTENGENFSL

SEQ ID NO: 2783991 - protein, 10 aa, Entamoeba invadens
YKYIGKDDQK

SEQ ID NO: 2783992 - protein, 7 aa, Entamoeba invadens
YKYIGSN

SEQ ID NO: 2783993 - protein, 9 aa, Entamoeba invadens
YKYKNSPQM

SEQ ID NO: 2783994 - protein, 7 aa, Entamoeba invadens
YLDSTGS

SEQ ID NO: 2783995 - protein, 13 aa, Entamoeba invadens
YLEEDNKKGNENL

SEQ ID NO: 2783996 - protein, 7 aa, Entamoeba invadens
YLESGTK

SEQ ID NO: 2783997 - protein, 5 aa, Entamoeba invadens
YLGAD

SEQ ID NO: 2783998 - protein, 13 aa, Entamoeba invadens
YLGGQSHVETSDN

SEQ ID NO: 2783999 - protein, 23 aa, Entamoeba invadens
YLKTSKGSCVSECPTSSNQGYMN

SEQ ID NO: 2784000 - protein, 10 aa, Entamoeba invadens
YLPNGERGEY

SEQ ID NO: 2784001 - protein, 10 aa, Entamoeba invadens
YLRSSDGKQC

SEQ ID NO: 2784002 - protein, 12 aa, Entamoeba invadens
YLSDGKCNNCTS

SEQ ID NO: 2784003 - protein, 7 aa, Entamoeba invadens
YLSNGPK

SEQ ID NO: 2784004 - protein, 10 aa, Entamoeba invadens
YLTKDKQDYL

SEQ ID NO: 2784005 - protein, 5 aa, Entamoeba invadens
YLTNT

SEQ ID NO: 2784006 - protein, 7 aa, Entamoeba invadens
YLTPDKS

SEQ ID NO: 2784007 - protein, 5 aa, Entamoeba invadens
YLTTS

SEQ ID NO: 2784008 - protein, 13 aa, Entamoeba invadens
YMEGTTKKCDTNT

SEQ ID NO: 2784009 - protein, 5 aa, Entamoeba invadens
YMKKD

SEQ ID NO: 2784010 - protein, 13 aa, Entamoeba invadens
YMKKDGSISDLTD

SEQ ID NO: 2784011 - protein, 10 aa, Entamoeba invadens
YMRSPDGKTC

SEQ ID NO: 2784012 - protein, 11 aa, Entamoeba invadens
YMRSPDGKTCE

SEQ ID NO: 2784013 - protein, 7 aa, Entamoeba invadens
YMRSSDG

SEQ ID NO: 2784014 - protein, 12 aa, Entamoeba invadens
YMRSSDGKKCEK

SEQ ID NO: 2784015 - protein, 12 aa, Entamoeba invadens
YMRSSDGKQCDK

SEQ ID NO: 2784016 - protein, 11 aa, Entamoeba invadens
YMRSSDGKTCE

SEQ ID NO: 2784017 - protein, 12 aa, Entamoeba invadens
YMRSSDGKTCEP

SEQ ID NO: 2784018 - protein, 11 aa, Entamoeba invadens
YMRSSDSKQCV

SEQ ID NO: 2784019 - protein, 9 aa, Entamoeba invadens
YNAGGQGGI

SEQ ID NO: 2784020 - protein, 9 aa, Entamoeba invadens
YNANTGSAN

SEQ ID NO: 2784021 - protein, 6 aa, Entamoeba invadens
YNAQTK

SEQ ID NO: 2784022 - protein, 24 aa, Entamoeba invadens
YNATTKKCENNGGGCLTSSNQEQC

SEQ ID NO: 2784023 - protein, 4 aa, Entamoeba invadens
YNAY

SEQ ID NO: 2784024 - protein, 12 aa, Entamoeba invadens
YNCGEGTEPVGE

SEQ ID NO: 2784025 - protein, 4 aa, Entamoeba invadens
YNCT

SEQ ID NO: 2784026 - protein, 14 aa, Entamoeba invadens
YNDEGCGKSSTGAA

SEQ ID NO: 2784027 - protein, 10 aa, Entamoeba invadens
YNDETASYTF

SEQ ID NO: 2784028 - protein, 36 aa, Entamoeba invadens
YNDETASYTFQNETKEARKQNEDIRKAEESASTTHT

SEQ ID NO: 2784029 - protein, 15 aa, Entamoeba invadens
YNDKVDNVDTPTFNT

SEQ ID NO: 2784030 - protein, 4 aa, Entamoeba invadens
YNDN

SEQ ID NO: 2784031 - protein, 8 aa, Entamoeba invadens
YNDNPKAC

SEQ ID NO: 2784032 - protein, 7 aa, Entamoeba invadens
YNDPTKF

SEQ ID NO: 2784033 - protein, 7 aa, Entamoeba invadens
YNDSNGY

SEQ ID NO: 2784034 - protein, 10 aa, Entamoeba invadens
YNDSQLPTTY

SEQ ID NO: 2784035 - protein, 10 aa, Entamoeba invadens
YNDTEATLTT

SEQ ID NO: 2784036 - protein, 7 aa, Entamoeba invadens
YNDYPNT

SEQ ID NO: 2784037 - protein, 10 aa, Entamoeba invadens
YNEASRCGND

SEQ ID NO: 2784038 - protein, 10 aa, Entamoeba invadens
YNEDTANSME

SEQ ID NO: 2784039 - protein, 16 aa, Entamoeba invadens
YNEEDLTSLGGPLLQF

SEQ ID NO: 2784040 - protein, 9 aa, Entamoeba invadens
YNEETGKCS

SEQ ID NO: 2784041 - protein, 8 aa, Entamoeba invadens
YNEGVDKE

SEQ ID NO: 2784042 - protein, 11 aa, Entamoeba invadens
YNEKNTSDTVC

SEQ ID NO: 2784043 - protein, 5 aa, Entamoeba invadens
YNEKR

SEQ ID NO: 2784044 - protein, 13 aa, Entamoeba invadens
YNENCNSNFPSGH

SEQ ID NO: 2784045 - protein, 6 aa, Entamoeba invadens
YNENET

SEQ ID NO: 2784046 - protein, 7 aa, Entamoeba invadens
YNENGTF

SEQ ID NO: 2784047 - protein, 6 aa, Entamoeba invadens
YNENKT

SEQ ID NO: 2784048 - protein, 10 aa, Entamoeba invadens
YNENSASKHG

SEQ ID NO: 2784049 - protein, 6 aa, Entamoeba invadens
YNERHS

SEQ ID NO: 2784050 - protein, 4 aa, Entamoeba invadens
YNES

SEQ ID NO: 2784051 - protein, 9 aa, Entamoeba invadens
YNESGDKLE

SEQ ID NO: 2784052 - protein, 5 aa, Entamoeba invadens
YNESY

SEQ ID NO: 2784053 - protein, 10 aa, Entamoeba invadens
YNETDKTVPL

SEQ ID NO: 2784054 - protein, 5 aa, Entamoeba invadens
YNETG

SEQ ID NO: 2784055 - protein, 12 aa, Entamoeba invadens
YNETTNPESKCN

SEQ ID NO: 2784056 - protein, 12 aa, Entamoeba invadens
YNFADGGNQLEE

SEQ ID NO: 2784057 - protein, 12 aa, Entamoeba invadens
YNFADGGNRLKE

SEQ ID NO: 2784058 - protein, 5 aa, Entamoeba invadens
YNFDP

SEQ ID NO: 2784059 - protein, 4 aa, Entamoeba invadens
YNGC

SEQ ID NO: 2784060 - protein, 4 aa, Entamoeba invadens
YNGD

SEQ ID NO: 2784061 - protein, 19 aa, Entamoeba invadens
YNGDMRGPNSYSTKTGDSW

SEQ ID NO: 2784062 - protein, 9 aa, Entamoeba invadens
YNGGTTFNT

SEQ ID NO: 2784063 - protein, 9 aa, Entamoeba invadens
YNGHEGGWG

SEQ ID NO: 2784064 - protein, 13 aa, Entamoeba invadens
YNGQGRDPTKQCE

SEQ ID NO: 2784065 - protein, 7 aa, Entamoeba invadens
YNGTGLP

SEQ ID NO: 2784066 - protein, 4 aa, Entamoeba invadens
YNIP

SEQ ID NO: 2784067 - protein, 11 aa, Entamoeba invadens
YNKCPTTKGKC

SEQ ID NO: 2784068 - protein, 9 aa, Entamoeba invadens
YNKDNTCEK

SEQ ID NO: 2784069 - protein, 26 aa, Entamoeba invadens
YNKDTGLSFDGEKKEGVSCDSKSAKA

SEQ ID NO: 2784070 - protein, 4 aa, Entamoeba invadens
YNKE

SEQ ID NO: 2784071 - protein, 11 aa, Entamoeba invadens
YNKNQKQNERN

SEQ ID NO: 2784072 - protein, 14 aa, Entamoeba invadens
YNKPGSEFYGENKE

SEQ ID NO: 2784073 - protein, 12 aa, Entamoeba invadens
YNKTSQQCEDPT

SEQ ID NO: 2784074 - protein, 12 aa, Entamoeba invadens
YNKTSQRCEDPT

SEQ ID NO: 2784075 - protein, 12 aa, Entamoeba invadens
YNKTTQKCDSSA

SEQ ID NO: 2784076 - protein, 6 aa, Entamoeba invadens
YNKVGK

SEQ ID NO: 2784077 - protein, 16 aa, Entamoeba invadens
YNLEDGKCNKKAVQKE

SEQ ID NO: 2784078 - protein, 16 aa, Entamoeba invadens
YNLEDGKCNKKAVQNE

SEQ ID NO: 2784079 - protein, 5 aa, Entamoeba invadens
YNLNN

SEQ ID NO: 2784080 - protein, 9 aa, Entamoeba invadens
YNNATGRCS

SEQ ID NO: 2784081 - protein, 10 aa, Entamoeba invadens
YNNDPKRNTE

SEQ ID NO: 2784082 - protein, 10 aa, Entamoeba invadens
YNNEKGSCTS

SEQ ID NO: 2784083 - protein, 8 aa, Entamoeba invadens
YNNHRDKD

SEQ ID NO: 2784084 - protein, 17 aa, Entamoeba invadens
YNNKTGISSSVKTDASW

SEQ ID NO: 2784085 - protein, 11 aa, Entamoeba invadens
YNNPPSQRCES

SEQ ID NO: 2784086 - protein, 19 aa, Entamoeba invadens
YNNQDNSITLSEQNSCYND

SEQ ID NO: 2784087 - protein, 12 aa, Entamoeba invadens
YNNRISESDPLR

SEQ ID NO: 2784088 - protein, 5 aa, Entamoeba invadens
YNNSD

SEQ ID NO: 2784089 - protein, 10 aa, Entamoeba invadens
YNNTSCKSGY

SEQ ID NO: 2784090 - protein, 10 aa, Entamoeba invadens
YNNVTTSSKI

SEQ ID NO: 2784091 - protein, 8 aa, Entamoeba invadens
YNPDVNTS

SEQ ID NO: 2784092 - protein, 6 aa, Entamoeba invadens
YNPLRK

SEQ ID NO: 2784093 - protein, 10 aa, Entamoeba invadens
YNPNSDGTRC

SEQ ID NO: 2784094 - protein, 9 aa, Entamoeba invadens
YNPNYDKSP

SEQ ID NO: 2784095 - protein, 11 aa, Entamoeba invadens
YNPPQQPMQQQ

SEQ ID NO: 2784096 - protein, 4 aa, Entamoeba invadens
YNPT

SEQ ID NO: 2784097 - protein, 9 aa, Entamoeba invadens
YNPTETQKW

SEQ ID NO: 2784098 - protein, 9 aa, Entamoeba invadens
YNPTNTSKC

SEQ ID NO: 2784099 - protein, 12 aa, Entamoeba invadens
YNPVAPDTMEGS

SEQ ID NO: 2784100 - protein, 5 aa, Entamoeba invadens
YNQNT

SEQ ID NO: 2784101 - protein, 6 aa, Entamoeba invadens
YNQPPF

SEQ ID NO: 2784102 - protein, 15 aa, Entamoeba invadens
YNQSSQNTDEADTTS

SEQ ID NO: 2784103 - protein, 15 aa, Entamoeba invadens
YNRENTCQNCSNKYG

SEQ ID NO: 2784104 - protein, 18 aa, Entamoeba invadens
YNRTRCQSQSDEDADWDN

SEQ ID NO: 2784105 - protein, 7 aa, Entamoeba invadens
YNSAGYK

SEQ ID NO: 2784106 - protein, 6 aa, Entamoeba invadens
YNSDCE

SEQ ID NO: 2784107 - protein, 17 aa, Entamoeba invadens
YNSEAKQYHGHSPSSYV

SEQ ID NO: 2784108 - protein, 5 aa, Entamoeba invadens
YNSGK

SEQ ID NO: 2784109 - protein, 23 aa, Entamoeba invadens
YNSGSALSGIAQADSTKKSSLTI

SEQ ID NO: 2784110 - protein, 5 aa, Entamoeba invadens
YNSIS

SEQ ID NO: 2784111 - protein, 5 aa, Entamoeba invadens
YNSKK

SEQ ID NO: 2784112 - protein, 12 aa, Entamoeba invadens
YNSKSPTKMEGD

SEQ ID NO: 2784113 - protein, 6 aa, Entamoeba invadens
YNSKST

SEQ ID NO: 2784114 - protein, 9 aa, Entamoeba invadens
YNSNCRTSS

SEQ ID NO: 2784115 - protein, 26 aa, Entamoeba invadens
YNSQCTSCEGSHKVSDDGENCVSKTN

SEQ ID NO: 2784116 - protein, 7 aa, Entamoeba invadens
YNSSDEV

SEQ ID NO: 2784117 - protein, 9 aa, Entamoeba invadens
YNSSTEQCD

SEQ ID NO: 2784118 - protein, 6 aa, Entamoeba invadens
YNSSTI

SEQ ID NO: 2784119 - protein, 10 aa, Entamoeba invadens
YNSTDGSCAR

SEQ ID NO: 2784120 - protein, 14 aa, Entamoeba invadens
YNSTDTDNSDKDLG

SEQ ID NO: 2784121 - protein, 8 aa, Entamoeba invadens
YNSTNEKM

SEQ ID NO: 2784122 - protein, 7 aa, Entamoeba invadens
YNSTNNE

SEQ ID NO: 2784123 - protein, 5 aa, Entamoeba invadens
YNSTT

SEQ ID NO: 2784124 - protein, 4 aa, Entamoeba invadens
YNTD

SEQ ID NO: 2784125 - protein, 15 aa, Entamoeba invadens
YNTEKTCQVDDTDVG

SEQ ID NO: 2784126 - protein, 7 aa, Entamoeba invadens
YNTENQQ

SEQ ID NO: 2784127 - protein, 16 aa, Entamoeba invadens
YNTHSKTNHKTGDVFT

SEQ ID NO: 2784128 - protein, 5 aa, Entamoeba invadens
YNTKY

SEQ ID NO: 2784129 - protein, 6 aa, Entamoeba invadens
YNTNEA

SEQ ID NO: 2784130 - protein, 5 aa, Entamoeba invadens
YNTNG

SEQ ID NO: 2784131 - protein, 10 aa, Entamoeba invadens
YNTNGNCKTC

SEQ ID NO: 2784132 - protein, 17 aa, Entamoeba invadens
YNTQKENCGECEVGDEY

SEQ ID NO: 2784133 - protein, 15 aa, Entamoeba invadens
YNTSTTCAGTPTNVV

SEQ ID NO: 2784134 - protein, 8 aa, Entamoeba invadens
YNTTENGE

SEQ ID NO: 2784135 - protein, 5 aa, Entamoeba invadens
YNTTS

SEQ ID NO: 2784136 - protein, 11 aa, Entamoeba invadens
YNTTTKKCEPC

SEQ ID NO: 2784137 - protein, 7 aa, Entamoeba invadens
YNTTTSC

SEQ ID NO: 2784138 - protein, 7 aa, Entamoeba invadens
YNTVNDQ

SEQ ID NO: 2784139 - protein, 7 aa, Entamoeba invadens
YNVTPRR

SEQ ID NO: 2784140 - protein, 4 aa, Entamoeba invadens
YNYD

SEQ ID NO: 2784141 - protein, 13 aa, Entamoeba invadens
YPCPPGTYSEFEG

SEQ ID NO: 2784142 - protein, 5 aa, Entamoeba invadens
YPCTS

SEQ ID NO: 2784143 - protein, 10 aa, Entamoeba invadens
YPDANGQCKP

SEQ ID NO: 2784144 - protein, 5 aa, Entamoeba invadens
YPDAT

SEQ ID NO: 2784145 - protein, 6 aa, Entamoeba invadens
YPDKTS

SEQ ID NO: 2784146 - protein, 13 aa, Entamoeba invadens
YPDNEGKCQKGTI

SEQ ID NO: 2784147 - protein, 8 aa, Entamoeba invadens
YPDQEQPP

SEQ ID NO: 2784148 - protein, 5 aa, Entamoeba invadens
YPDSD

SEQ ID NO: 2784149 - protein, 9 aa, Entamoeba invadens
YPDSTNGYK

SEQ ID NO: 2784150 - protein, 6 aa, Entamoeba invadens
YPDTNG

SEQ ID NO: 2784151 - protein, 7 aa, Entamoeba invadens
YPDTNGV

SEQ ID NO: 2784152 - protein, 6 aa, Entamoeba invadens
YPDTNK

SEQ ID NO: 2784153 - protein, 4 aa, Entamoeba invadens
YPED

SEQ ID NO: 2784154 - protein, 7 aa, Entamoeba invadens
YPEDETA

SEQ ID NO: 2784155 - protein, 9 aa, Entamoeba invadens
YPEDSTSVC

SEQ ID NO: 2784156 - protein, 12 aa, Entamoeba invadens
YPEESNGLGGQV

SEQ ID NO: 2784157 - protein, 4 aa, Entamoeba invadens
YPEG

SEQ ID NO: 2784158 - protein, 8 aa, Entamoeba invadens
YPEGTKIK

SEQ ID NO: 2784159 - protein, 9 aa, Entamoeba invadens
YPEKQTATG

SEQ ID NO: 2784160 - protein, 9 aa, Entamoeba invadens
YPETSSGKC

SEQ ID NO: 2784161 - protein, 6 aa, Entamoeba invadens
YPFTNS

SEQ ID NO: 2784162 - protein, 5 aa, Entamoeba invadens
YPGAN

SEQ ID NO: 2784163 - protein, 5 aa, Entamoeba invadens
YPGGY

SEQ ID NO: 2784164 - protein, 4 aa, Entamoeba invadens
YPGK

SEQ ID NO: 2784165 - protein, 7 aa, Entamoeba invadens
YPGTTGQ

SEQ ID NO: 2784166 - protein, 11 aa, Entamoeba invadens
YPGYSSEDPFE

SEQ ID NO: 2784167 - protein, 14 aa, Entamoeba invadens
YPHFGNTETFTDQE

SEQ ID NO: 2784168 - protein, 7 aa, Entamoeba invadens
YPHSGDA

SEQ ID NO: 2784169 - protein, 11 aa, Entamoeba invadens
YPIPRSDEKGA

SEQ ID NO: 2784170 - protein, 4 aa, Entamoeba invadens
YPIR

SEQ ID NO: 2784171 - protein, 7 aa, Entamoeba invadens
YPITTTS

SEQ ID NO: 2784172 - protein, 4 aa, Entamoeba invadens
YPKA

SEQ ID NO: 2784173 - protein, 5 aa, Entamoeba invadens
YPKAE

SEQ ID NO: 2784174 - protein, 5 aa, Entamoeba invadens
YPKAT

SEQ ID NO: 2784175 - protein, 7 aa, Entamoeba invadens
YPKDGSC

SEQ ID NO: 2784176 - protein, 5 aa, Entamoeba invadens
YPKED

SEQ ID NO: 2784177 - protein, 8 aa, Entamoeba invadens
YPKEENQF

SEQ ID NO: 2784178 - protein, 5 aa, Entamoeba invadens
YPKGS

SEQ ID NO: 2784179 - protein, 13 aa, Entamoeba invadens
YPKGTTLVAQKGR

SEQ ID NO: 2784180 - protein, 5 aa, Entamoeba invadens
YPKKE

SEQ ID NO: 2784181 - protein, 6 aa, Entamoeba invadens
YPKLDG

SEQ ID NO: 2784182 - protein, 8 aa, Entamoeba invadens
YPKNSKRD

SEQ ID NO: 2784183 - protein, 5 aa, Entamoeba invadens
YPKQY

SEQ ID NO: 2784184 - protein, 5 aa, Entamoeba invadens
YPKST

SEQ ID NO: 2784185 - protein, 4 aa, Entamoeba invadens
YPNA

SEQ ID NO: 2784186 - protein, 4 aa, Entamoeba invadens
YPND

SEQ ID NO: 2784187 - protein, 5 aa, Entamoeba invadens
YPNGE

SEQ ID NO: 2784188 - protein, 4 aa, Entamoeba invadens
YPNM

SEQ ID NO: 2784189 - protein, 7 aa, Entamoeba invadens
YPNNDKQ

SEQ ID NO: 2784190 - protein, 5 aa, Entamoeba invadens
YPNNG

SEQ ID NO: 2784191 - protein, 6 aa, Entamoeba invadens
YPNNNK

SEQ ID NO: 2784192 - protein, 8 aa, Entamoeba invadens
YPNNSGKC

SEQ ID NO: 2784193 - protein, 8 aa, Entamoeba invadens
YPNSEGKC

SEQ ID NO: 2784194 - protein, 5 aa, Entamoeba invadens
YPNSG

SEQ ID NO: 2784195 - protein, 5 aa, Entamoeba invadens
YPNST

SEQ ID NO: 2784196 - protein, 12 aa, Entamoeba invadens
YPNSTTINNDPI

SEQ ID NO: 2784197 - protein, 17 aa, Entamoeba invadens
YPNSYGKCSSSIENCTH

SEQ ID NO: 2784198 - protein, 5 aa, Entamoeba invadens
YPNTN

SEQ ID NO: 2784199 - protein, 8 aa, Entamoeba invadens
YPNTNGTC

SEQ ID NO: 2784200 - protein, 8 aa, Entamoeba invadens
YPNTSSPF

SEQ ID NO: 2784201 - protein, 13 aa, Entamoeba invadens
YPPCQSSIGSQAN

SEQ ID NO: 2784202 - protein, 11 aa, Entamoeba invadens
YPPCSTPTNSN

SEQ ID NO: 2784203 - protein, 10 aa, Entamoeba invadens
YPPDKFPDSE

SEQ ID NO: 2784204 - protein, 7 aa, Entamoeba invadens
YPPNNNH

SEQ ID NO: 2784205 - protein, 32 aa, Entamoeba invadens
YPPPEPEKEEGKDDEVPKGDEESPEYDEKEPL

SEQ ID NO: 2784206 - protein, 7 aa, Entamoeba invadens
YPPPPAN

SEQ ID NO: 2784207 - protein, 4 aa, Entamoeba invadens
YPPQ

SEQ ID NO: 2784208 - protein, 8 aa, Entamoeba invadens
YPPQQEAT

SEQ ID NO: 2784209 - protein, 22 aa, Entamoeba invadens
YPPVESSNSSYQNGVPQYGTTP

SEQ ID NO: 2784210 - protein, 6 aa, Entamoeba invadens
YPQDKY

SEQ ID NO: 2784211 - protein, 4 aa, Entamoeba invadens
YPQP

SEQ ID NO: 2784212 - protein, 14 aa, Entamoeba invadens
YPQQPVYNQPPPQV

SEQ ID NO: 2784213 - protein, 8 aa, Entamoeba invadens
YPQQQEAT

SEQ ID NO: 2784214 - protein, 4 aa, Entamoeba invadens
YPQS

SEQ ID NO: 2784215 - protein, 9 aa, Entamoeba invadens
YPQSHRETL

SEQ ID NO: 2784216 - protein, 7 aa, Entamoeba invadens
YPQTAGD

SEQ ID NO: 2784217 - protein, 12 aa, Entamoeba invadens
YPQTAGKDPNDF

SEQ ID NO: 2784218 - protein, 13 aa, Entamoeba invadens
YPRENTGELSGRF

SEQ ID NO: 2784219 - protein, 9 aa, Entamoeba invadens
YPRGQDGEV

SEQ ID NO: 2784220 - protein, 7 aa, Entamoeba invadens
YPRPYQS

SEQ ID NO: 2784221 - protein, 6 aa, Entamoeba invadens
YPSDGN

SEQ ID NO: 2784222 - protein, 10 aa, Entamoeba invadens
YPSDKFPDSE

SEQ ID NO: 2784223 - protein, 6 aa, Entamoeba invadens
YPSGNC

SEQ ID NO: 2784224 - protein, 7 aa, Entamoeba invadens
YPSKPTA

SEQ ID NO: 2784225 - protein, 12 aa, Entamoeba invadens
YPSNKNDETQGK

SEQ ID NO: 2784226 - protein, 5 aa, Entamoeba invadens
YPSNY

SEQ ID NO: 2784227 - protein, 8 aa, Entamoeba invadens
YPSPNTGA

SEQ ID NO: 2784228 - protein, 8 aa, Entamoeba invadens
YPSRPEQK

SEQ ID NO: 2784229 - protein, 11 aa, Entamoeba invadens
YPSSDSSSNYY

SEQ ID NO: 2784230 - protein, 5 aa, Entamoeba invadens
YPSSG

SEQ ID NO: 2784231 - protein, 7 aa, Entamoeba invadens
YPSSSTN

SEQ ID NO: 2784232 - protein, 4 aa, Entamoeba invadens
YPST

SEQ ID NO: 2784233 - protein, 10 aa, Entamoeba invadens
YPSTWSSANM

SEQ ID NO: 2784234 - protein, 5 aa, Entamoeba invadens
YPSYC

SEQ ID NO: 2784235 - protein, 4 aa, Entamoeba invadens
YPTA

SEQ ID NO: 2784236 - protein, 5 aa, Entamoeba invadens
YPTAL

SEQ ID NO: 2784237 - protein, 14 aa, Entamoeba invadens
YPTATKKQLKDMEK

SEQ ID NO: 2784238 - protein, 11 aa, Entamoeba invadens
YPTDSINNEGK

SEQ ID NO: 2784239 - protein, 7 aa, Entamoeba invadens
YPTDSTT

SEQ ID NO: 2784240 - protein, 4 aa, Entamoeba invadens
YPTE

SEQ ID NO: 2784241 - protein, 8 aa, Entamoeba invadens
YPTHTTRS

SEQ ID NO: 2784242 - protein, 9 aa, Entamoeba invadens
YPTRETKSV

SEQ ID NO: 2784243 - protein, 6 aa, Entamoeba invadens
YPTRPE

SEQ ID NO: 2784244 - protein, 9 aa, Entamoeba invadens
YPTRREKPI

SEQ ID NO: 2784245 - protein, 5 aa, Entamoeba invadens
YPTSQ

SEQ ID NO: 2784246 - protein, 5 aa, Entamoeba invadens
YPTTI

SEQ ID NO: 2784247 - protein, 15 aa, Entamoeba invadens
YPTTNGKCTSCDQSC

SEQ ID NO: 2784248 - protein, 7 aa, Entamoeba invadens
YPTTPEA

SEQ ID NO: 2784249 - protein, 5 aa, Entamoeba invadens
YPTTV

SEQ ID NO: 2784250 - protein, 9 aa, Entamoeba invadens
YPVPQRNGE

SEQ ID NO: 2784251 - protein, 4 aa, Entamoeba invadens
YPYK

SEQ ID NO: 2784252 - protein, 23 aa, Entamoeba invadens
YPYTDYETKSENYNATNNPPECV

SEQ ID NO: 2784253 - protein, 24 aa, Entamoeba invadens
YPYYSGTSPSTNKGCQKGKKTPMK

SEQ ID NO: 2784254 - protein, 12 aa, Entamoeba invadens
YQAPASDDKTLS

SEQ ID NO: 2784255 - protein, 11 aa, Entamoeba invadens
YQDESGKNQQI

SEQ ID NO: 2784256 - protein, 8 aa, Entamoeba invadens
YQDSNTEE

SEQ ID NO: 2784257 - protein, 4 aa, Entamoeba invadens
YQDT

SEQ ID NO: 2784258 - protein, 13 aa, Entamoeba invadens
YQDTSAAYTPTQG

SEQ ID NO: 2784259 - protein, 7 aa, Entamoeba invadens
YQENSGC

SEQ ID NO: 2784260 - protein, 11 aa, Entamoeba invadens
YQENSSTAFPC

SEQ ID NO: 2784261 - protein, 6 aa, Entamoeba invadens
YQGGAS

SEQ ID NO: 2784262 - protein, 12 aa, Entamoeba invadens
YQGNDETEKQRF

SEQ ID NO: 2784263 - protein, 4 aa, Entamoeba invadens
YQIN

SEQ ID NO: 2784264 - protein, 25 aa, Entamoeba invadens
YQKETLGTRMGDTDVKRKKTPTKTL

SEQ ID NO: 2784265 - protein, 10 aa, Entamoeba invadens
YQKNDADSNC

SEQ ID NO: 2784266 - protein, 10 aa, Entamoeba invadens
YQKSFKQSTS

SEQ ID NO: 2784267 - protein, 9 aa, Entamoeba invadens
YQKTNENKK

SEQ ID NO: 2784268 - protein, 10 aa, Entamoeba invadens
YQKTQSSACN

SEQ ID NO: 2784269 - protein, 9 aa, Entamoeba invadens
YQLNTEKNG

SEQ ID NO: 2784270 - protein, 7 aa, Entamoeba invadens
YQNDTNG

SEQ ID NO: 2784271 - protein, 4 aa, Entamoeba invadens
YQNE

SEQ ID NO: 2784272 - protein, 7 aa, Entamoeba invadens
YQNEEGQ

SEQ ID NO: 2784273 - protein, 4 aa, Entamoeba invadens
YQNG

SEQ ID NO: 2784274 - protein, 27 aa, Entamoeba invadens
YQNKDGQNACKQCNSSCTSCNKNNGEC

SEQ ID NO: 2784275 - protein, 15 aa, Entamoeba invadens
YQNKPYSFSGGLSNI

SEQ ID NO: 2784276 - protein, 4 aa, Entamoeba invadens
YQNN

SEQ ID NO: 2784277 - protein, 38 aa, Entamoeba invadens
YQNNEKSNLNQLSTNETPKNNLKMDSNNKNEKSKEIDE

SEQ ID NO: 2784278 - protein, 19 aa, Entamoeba invadens
YQNSQDQTNSTAEQTNSME

SEQ ID NO: 2784279 - protein, 7 aa, Entamoeba invadens
YQNSQNT

SEQ ID NO: 2784280 - protein, 4 aa, Entamoeba invadens
YQNT

SEQ ID NO: 2784281 - protein, 11 aa, Entamoeba invadens
YQNTEGQTTCT

SEQ ID NO: 2784282 - protein, 20 aa, Entamoeba invadens
YQNTKDCPCSNKEAGGIYSS

SEQ ID NO: 2784283 - protein, 4 aa, Entamoeba invadens
YQNV

SEQ ID NO: 2784284 - protein, 27 aa, Entamoeba invadens
YQPKEGSSSCDPCPSGTYTSNVESTTC

SEQ ID NO: 2784285 - protein, 13 aa, Entamoeba invadens
YQPPTDTQKYYKG

SEQ ID NO: 2784286 - protein, 17 aa, Entamoeba invadens
YQPQQKVNTNNQNDSMT

SEQ ID NO: 2784287 - protein, 4 aa, Entamoeba invadens
YQPT

SEQ ID NO: 2784288 - protein, 16 aa, Entamoeba invadens
YQQIDEENTEYTEQNL

SEQ ID NO: 2784289 - protein, 7 aa, Entamoeba invadens
YQQNNKR

SEQ ID NO: 2784290 - protein, 9 aa, Entamoeba invadens
YQQNNSNYN

SEQ ID NO: 2784291 - protein, 25 aa, Entamoeba invadens
YQQPPQQTLPQSVPQQQYPQGNTLP

SEQ ID NO: 2784292 - protein, 10 aa, Entamoeba invadens
YQQSFKQSTS

SEQ ID NO: 2784293 - protein, 9 aa, Entamoeba invadens
YQRESQVEG

SEQ ID NO: 2784294 - protein, 10 aa, Entamoeba invadens
YQSCSTRGTY

SEQ ID NO: 2784295 - protein, 8 aa, Entamoeba invadens
YQSEKGQS

SEQ ID NO: 2784296 - protein, 15 aa, Entamoeba invadens
YQSEQKVNVTNQNDS

SEQ ID NO: 2784297 - protein, 11 aa, Entamoeba invadens
YQSGDAIPTQY

SEQ ID NO: 2784298 - protein, 8 aa, Entamoeba invadens
YQSKEGQS

SEQ ID NO: 2784299 - protein, 7 aa, Entamoeba invadens
YQSNSKI

SEQ ID NO: 2784300 - protein, 6 aa, Entamoeba invadens
YQTEKK

SEQ ID NO: 2784301 - protein, 5 aa, Entamoeba invadens
YQTET

SEQ ID NO: 2784302 - protein, 19 aa, Entamoeba invadens
YQTNTTSKCKKSFTANNVK

SEQ ID NO: 2784303 - protein, 17 aa, Entamoeba invadens
YQTNTTSKCKKSFTPNN

SEQ ID NO: 2784304 - protein, 11 aa, Entamoeba invadens
YQTNYNGNKNY

SEQ ID NO: 2784305 - protein, 6 aa, Entamoeba invadens
YQTPKE

SEQ ID NO: 2784306 - protein, 8 aa, Entamoeba invadens
YQVANDDS

SEQ ID NO: 2784307 - protein, 10 aa, Entamoeba invadens
YQVANSNDNS

SEQ ID NO: 2784308 - protein, 25 aa, Entamoeba invadens
YQVPPQPVYTQQQQQQPLTTEDEST

SEQ ID NO: 2784309 - protein, 10 aa, Entamoeba invadens
YQVSSCDGGS

SEQ ID NO: 2784310 - protein, 11 aa, Entamoeba invadens
YQVSTCSDDTF

SEQ ID NO: 2784311 - protein, 7 aa, Entamoeba invadens
YQYPAKS

SEQ ID NO: 2784312 - protein, 4 aa, Entamoeba invadens
YRAS

SEQ ID NO: 2784313 - protein, 4 aa, Entamoeba invadens
YREG

SEQ ID NO: 2784314 - protein, 16 aa, Entamoeba invadens
YREGDDDSDDHDDECE

SEQ ID NO: 2784315 - protein, 4 aa, Entamoeba invadens
YREK

SEQ ID NO: 2784316 - protein, 4 aa, Entamoeba invadens
YREN

SEQ ID NO: 2784317 - protein, 9 aa, Entamoeba invadens
YRERKFSTT

SEQ ID NO: 2784318 - protein, 4 aa, Entamoeba invadens
YRGD

SEQ ID NO: 2784319 - protein, 4 aa, Entamoeba invadens
YRGE

SEQ ID NO: 2784320 - protein, 6 aa, Entamoeba invadens
YRGEDV

SEQ ID NO: 2784321 - protein, 6 aa, Entamoeba invadens
YRGETA

SEQ ID NO: 2784322 - protein, 4 aa, Entamoeba invadens
YRGQ

SEQ ID NO: 2784323 - protein, 11 aa, Entamoeba invadens
YRGSEGNLCSP

SEQ ID NO: 2784324 - protein, 5 aa, Entamoeba invadens
YRGTE

SEQ ID NO: 2784325 - protein, 10 aa, Entamoeba invadens
YRGTSCTKCE

SEQ ID NO: 2784326 - protein, 9 aa, Entamoeba invadens
YRHKEPNNS

SEQ ID NO: 2784327 - protein, 7 aa, Entamoeba invadens
YRKQNDC

SEQ ID NO: 2784328 - protein, 5 aa, Entamoeba invadens
YRKYG

SEQ ID NO: 2784329 - protein, 4 aa, Entamoeba invadens
YRLE

SEQ ID NO: 2784330 - protein, 7 aa, Entamoeba invadens
YRLTESN

SEQ ID NO: 2784331 - protein, 13 aa, Entamoeba invadens
YRMNTQKECVKSN

SEQ ID NO: 2784332 - protein, 7 aa, Entamoeba invadens
YRNGNDC

SEQ ID NO: 2784333 - protein, 7 aa, Entamoeba invadens
YRNNSEK

SEQ ID NO: 2784334 - protein, 5 aa, Entamoeba invadens
YRNQA

SEQ ID NO: 2784335 - protein, 11 aa, Entamoeba invadens
YRNSNEISETS

SEQ ID NO: 2784336 - protein, 12 aa, Entamoeba invadens
YRNYNCGTSVTK

SEQ ID NO: 2784337 - protein, 7 aa, Entamoeba invadens
YRQNGIE

SEQ ID NO: 2784338 - protein, 6 aa, Entamoeba invadens
YRRPNN

SEQ ID NO: 2784339 - protein, 4 aa, Entamoeba invadens
YRSG

SEQ ID NO: 2784340 - protein, 5 aa, Entamoeba invadens
YRSGN

SEQ ID NO: 2784341 - protein, 5 aa, Entamoeba invadens
YRSKS

SEQ ID NO: 2784342 - protein, 4 aa, Entamoeba invadens
YRSP

SEQ ID NO: 2784343 - protein, 9 aa, Entamoeba invadens
YRTKTRREE

SEQ ID NO: 2784344 - protein, 11 aa, Entamoeba invadens
YRTPNLEPKEI

SEQ ID NO: 2784345 - protein, 7 aa, Entamoeba invadens
YRTPNNI

SEQ ID NO: 2784346 - protein, 16 aa, Entamoeba invadens
YRTPNNNTKLCNPQTE

SEQ ID NO: 2784347 - protein, 7 aa, Entamoeba invadens
YRTPQTI

SEQ ID NO: 2784348 - protein, 4 aa, Entamoeba invadens
YRTR

SEQ ID NO: 2784349 - protein, 13 aa, Entamoeba invadens
YRTSNDECKPQSD

SEQ ID NO: 2784350 - protein, 15 aa, Entamoeba invadens
YRTSSTSSKYCSPQS

SEQ ID NO: 2784351 - protein, 5 aa, Entamoeba invadens
YRVSN

SEQ ID NO: 2784352 - protein, 11 aa, Entamoeba invadens
YSAEDNSCGPN

SEQ ID NO: 2784353 - protein, 7 aa, Entamoeba invadens
YSANNNK

SEQ ID NO: 2784354 - protein, 10 aa, Entamoeba invadens
YSASTSAKTA

SEQ ID NO: 2784355 - protein, 7 aa, Entamoeba invadens
YSATGGC

SEQ ID NO: 2784356 - protein, 5 aa, Entamoeba invadens
YSCPD

SEQ ID NO: 2784357 - protein, 10 aa, Entamoeba invadens
YSCPDGQYLN

SEQ ID NO: 2784358 - protein, 11 aa, Entamoeba invadens
YSCPDGQYLSN

SEQ ID NO: 2784359 - protein, 9 aa, Entamoeba invadens
YSCSGSSTY

SEQ ID NO: 2784360 - protein, 17 aa, Entamoeba invadens
YSDANDCELSESKGHPL

SEQ ID NO: 2784361 - protein, 9 aa, Entamoeba invadens
YSDDGSKTV

SEQ ID NO: 2784362 - protein, 9 aa, Entamoeba invadens
YSDDSGKCQ

SEQ ID NO: 2784363 - protein, 14 aa, Entamoeba invadens
YSDEENYESMPPIP

SEQ ID NO: 2784364 - protein, 5 aa, Entamoeba invadens
YSDES

SEQ ID NO: 2784365 - protein, 6 aa, Entamoeba invadens
YSDGSV

SEQ ID NO: 2784366 - protein, 8 aa, Entamoeba invadens
YSDKSDCK

SEQ ID NO: 2784367 - protein, 4 aa, Entamoeba invadens
YSDP

SEQ ID NO: 2784368 - protein, 6 aa, Entamoeba invadens
YSDPER

SEQ ID NO: 2784369 - protein, 8 aa, Entamoeba invadens
YSDRPDFD

SEQ ID NO: 2784370 - protein, 8 aa, Entamoeba invadens
YSDSNSTQ

SEQ ID NO: 2784371 - protein, 4 aa, Entamoeba invadens
YSDV

SEQ ID NO: 2784372 - protein, 10 aa, Entamoeba invadens
YSEDNATSCV

SEQ ID NO: 2784373 - protein, 4 aa, Entamoeba invadens
YSEG

SEQ ID NO: 2784374 - protein, 4 aa, Entamoeba invadens
YSEI

SEQ ID NO: 2784375 - protein, 4 aa, Entamoeba invadens
YSEK

SEQ ID NO: 2784376 - protein, 11 aa, Entamoeba invadens
YSEKSVTKKTD

SEQ ID NO: 2784377 - protein, 10 aa, Entamoeba invadens
YSELKKAGDV

SEQ ID NO: 2784378 - protein, 6 aa, Entamoeba invadens
YSEMDN

SEQ ID NO: 2784379 - protein, 6 aa, Entamoeba invadens
YSENGE

SEQ ID NO: 2784380 - protein, 8 aa, Entamoeba invadens
YSESASFD

SEQ ID NO: 2784381 - protein, 7 aa, Entamoeba invadens
YSESGKY

SEQ ID NO: 2784382 - protein, 6 aa, Entamoeba invadens
YSESNA

SEQ ID NO: 2784383 - protein, 6 aa, Entamoeba invadens
YSETES

SEQ ID NO: 2784384 - protein, 9 aa, Entamoeba invadens
YSETKKLGN

SEQ ID NO: 2784385 - protein, 7 aa, Entamoeba invadens
YSFESDT

SEQ ID NO: 2784386 - protein, 5 aa, Entamoeba invadens
YSFNS

SEQ ID NO: 2784387 - protein, 5 aa, Entamoeba invadens
YSGEC

SEQ ID NO: 2784388 - protein, 8 aa, Entamoeba invadens
YSGGGTSL

SEQ ID NO: 2784389 - protein, 15 aa, Entamoeba invadens
YSGGLDTKNKKTGNK

SEQ ID NO: 2784390 - protein, 4 aa, Entamoeba invadens
YSGK

SEQ ID NO: 2784391 - protein, 10 aa, Entamoeba invadens
YSGKDDSNNA

SEQ ID NO: 2784392 - protein, 13 aa, Entamoeba invadens
YSGKGSDNSATYL

SEQ ID NO: 2784393 - protein, 4 aa, Entamoeba invadens
YSGN

SEQ ID NO: 2784394 - protein, 6 aa, Entamoeba invadens
YSGNGN

SEQ ID NO: 2784395 - protein, 8 aa, Entamoeba invadens
YSGPADLS

SEQ ID NO: 2784396 - protein, 9 aa, Entamoeba invadens
YSGSHRDAD

SEQ ID NO: 2784397 - protein, 6 aa, Entamoeba invadens
YSGSIN

SEQ ID NO: 2784398 - protein, 8 aa, Entamoeba invadens
YSGSINGA

SEQ ID NO: 2784399 - protein, 5 aa, Entamoeba invadens
YSGSS

SEQ ID NO: 2784400 - protein, 11 aa, Entamoeba invadens
YSGTKGMSKKT

SEQ ID NO: 2784401 - protein, 5 aa, Entamoeba invadens
YSGTS

SEQ ID NO: 2784402 - protein, 7 aa, Entamoeba invadens
YSHGGND

SEQ ID NO: 2784403 - protein, 12 aa, Entamoeba invadens
YSIDSKIKNTKF

SEQ ID NO: 2784404 - protein, 11 aa, Entamoeba invadens
YSIGKRRQTTC

SEQ ID NO: 2784405 - protein, 4 aa, Entamoeba invadens
YSIN

SEQ ID NO: 2784406 - protein, 8 aa, Entamoeba invadens
YSIQNNEN

SEQ ID NO: 2784407 - protein, 8 aa, Entamoeba invadens
YSIRTEPQ

SEQ ID NO: 2784408 - protein, 8 aa, Entamoeba invadens
YSKANSTI

SEQ ID NO: 2784409 - protein, 33 aa, Entamoeba invadens
YSKCSSSEKYEKTETLTNRQNDKRKVAKTQRDL

SEQ ID NO: 2784410 - protein, 7 aa, Entamoeba invadens
YSKEDGC

SEQ ID NO: 2784411 - protein, 6 aa, Entamoeba invadens
YSKEDI

SEQ ID NO: 2784412 - protein, 10 aa, Entamoeba invadens
YSKEKSEKCE

SEQ ID NO: 2784413 - protein, 7 aa, Entamoeba invadens
YSKGGIS

SEQ ID NO: 2784414 - protein, 6 aa, Entamoeba invadens
YSKKQV

SEQ ID NO: 2784415 - protein, 6 aa, Entamoeba invadens
YSKNSV

SEQ ID NO: 2784416 - protein, 6 aa, Entamoeba invadens
YSKPLS

SEQ ID NO: 2784417 - protein, 12 aa, Entamoeba invadens
YSKSENAKNEIK

SEQ ID NO: 2784418 - protein, 6 aa, Entamoeba invadens
YSKSSG

SEQ ID NO: 2784419 - protein, 8 aa, Entamoeba invadens
YSKSSIEG

SEQ ID NO: 2784420 - protein, 5 aa, Entamoeba invadens
YSKTQ

SEQ ID NO: 2784421 - protein, 4 aa, Entamoeba invadens
YSLG

SEQ ID NO: 2784422 - protein, 8 aa, Entamoeba invadens
YSLGGSSG

SEQ ID NO: 2784423 - protein, 14 aa, Entamoeba invadens
YSLGGSSGCSACST

SEQ ID NO: 2784424 - protein, 28 aa, Entamoeba invadens
YSLGGTTTSCTSCSAGSYSNSGASQCSK

SEQ ID NO: 2784425 - protein, 13 aa, Entamoeba invadens
YSLNGASSCDQCP

SEQ ID NO: 2784426 - protein, 25 aa, Entamoeba invadens
YSLSGSSGCSACSTSCKTCDQTNGN

SEQ ID NO: 2784427 - protein, 10 aa, Entamoeba invadens
YSLSGSSGCT

SEQ ID NO: 2784428 - protein, 25 aa, Entamoeba invadens
YSLSGSSGCTACSTSCKTCDQTNGN

SEQ ID NO: 2784429 - protein, 25 aa, Entamoeba invadens
YSLSGSSKCTACSTSCKTCDQTNGN

SEQ ID NO: 2784430 - protein, 12 aa, Entamoeba invadens
YSLTNKPPMDPQ

SEQ ID NO: 2784431 - protein, 13 aa, Entamoeba invadens
YSMNGSKYCSECP

SEQ ID NO: 2784432 - protein, 8 aa, Entamoeba invadens
YSMTTSGT

SEQ ID NO: 2784433 - protein, 7 aa, Entamoeba invadens
YSNACDS

SEQ ID NO: 2784434 - protein, 9 aa, Entamoeba invadens
YSNDDGKYY

SEQ ID NO: 2784435 - protein, 10 aa, Entamoeba invadens
YSNDKNKCEL

SEQ ID NO: 2784436 - protein, 8 aa, Entamoeba invadens
YSNETFSG

SEQ ID NO: 2784437 - protein, 9 aa, Entamoeba invadens
YSNGCKEGT

SEQ ID NO: 2784438 - protein, 9 aa, Entamoeba invadens
YSNGDYKSA

SEQ ID NO: 2784439 - protein, 5 aa, Entamoeba invadens
YSNGP

SEQ ID NO: 2784440 - protein, 6 aa, Entamoeba invadens
YSNGPQ

SEQ ID NO: 2784441 - protein, 7 aa, Entamoeba invadens
YSNGTKA

SEQ ID NO: 2784442 - protein, 14 aa, Entamoeba invadens
YSNINGTCTPCSNK

SEQ ID NO: 2784443 - protein, 25 aa, Entamoeba invadens
YSNISGSASCTPCSDGTYTNTTSST

SEQ ID NO: 2784444 - protein, 7 aa, Entamoeba invadens
YSNKNKT

SEQ ID NO: 2784445 - protein, 12 aa, Entamoeba invadens
YSNNRAASQMQK

SEQ ID NO: 2784446 - protein, 5 aa, Entamoeba invadens
YSNPI

SEQ ID NO: 2784447 - protein, 52 aa, Entamoeba invadens
YSNQTLPATYPQQPQYNGYSQQPYIQQQNNTQQQYPPQPSYYQQTPQYVQPT

SEQ ID NO: 2784448 - protein, 52 aa, Entamoeba invadens
YSNQTPPATYPQQPQYNGYSQQPYIQQQNNTQQQYPPQPSYYQQTPQYVQPT

SEQ ID NO: 2784449 - protein, 4 aa, Entamoeba invadens
YSNR

SEQ ID NO: 2784450 - protein, 8 aa, Entamoeba invadens
YSNSCKGN

SEQ ID NO: 2784451 - protein, 8 aa, Entamoeba invadens
YSNSKNLI

SEQ ID NO: 2784452 - protein, 14 aa, Entamoeba invadens
YSNSSYIPNYSPQT

SEQ ID NO: 2784453 - protein, 26 aa, Entamoeba invadens
YSNTSKTCERCSNPKCKRCDSDPSIC

SEQ ID NO: 2784454 - protein, 7 aa, Entamoeba invadens
YSNTTCS

SEQ ID NO: 2784455 - protein, 6 aa, Entamoeba invadens
YSPAGV

SEQ ID NO: 2784456 - protein, 8 aa, Entamoeba invadens
YSPAIKSN

SEQ ID NO: 2784457 - protein, 10 aa, Entamoeba invadens
YSPDDGTFNR

SEQ ID NO: 2784458 - protein, 5 aa, Entamoeba invadens
YSPEG

SEQ ID NO: 2784459 - protein, 6 aa, Entamoeba invadens
YSPEVT

SEQ ID NO: 2784460 - protein, 14 aa, Entamoeba invadens
YSPEYTKDSDVDAN

SEQ ID NO: 2784461 - protein, 10 aa, Entamoeba invadens
YSPINDGSRE

SEQ ID NO: 2784462 - protein, 6 aa, Entamoeba invadens
YSPKTL

SEQ ID NO: 2784463 - protein, 9 aa, Entamoeba invadens
YSPNGPSFN

SEQ ID NO: 2784464 - protein, 6 aa, Entamoeba invadens
YSPNKE

SEQ ID NO: 2784465 - protein, 6 aa, Entamoeba invadens
YSPPEI

SEQ ID NO: 2784466 - protein, 6 aa, Entamoeba invadens
YSPPGL

SEQ ID NO: 2784467 - protein, 9 aa, Entamoeba invadens
YSPSNNPFG

SEQ ID NO: 2784468 - protein, 6 aa, Entamoeba invadens
YSPTDK

SEQ ID NO: 2784469 - protein, 15 aa, Entamoeba invadens
YSQCDECADGYTTVN

SEQ ID NO: 2784470 - protein, 21 aa, Entamoeba invadens
YSQCGGSVTESKCRCNADTNN

SEQ ID NO: 2784471 - protein, 20 aa, Entamoeba invadens
YSQCGGTVTESKCRCNADTK

SEQ ID NO: 2784472 - protein, 21 aa, Entamoeba invadens
YSQCGGTVTESKCRCNADTKN

SEQ ID NO: 2784473 - protein, 10 aa, Entamoeba invadens
YSQEDKEYYE

SEQ ID NO: 2784474 - protein, 5 aa, Entamoeba invadens
YSQEK

SEQ ID NO: 2784475 - protein, 5 aa, Entamoeba invadens
YSQHQ

SEQ ID NO: 2784476 - protein, 14 aa, Entamoeba invadens
YSQRIDTDTMKGNM

SEQ ID NO: 2784477 - protein, 6 aa, Entamoeba invadens
YSQRNF

SEQ ID NO: 2784478 - protein, 6 aa, Entamoeba invadens
YSQRTF

SEQ ID NO: 2784479 - protein, 8 aa, Entamoeba invadens
YSQSFNNK

SEQ ID NO: 2784480 - protein, 19 aa, Entamoeba invadens
YSQSQRGQTECKECQPGTF

SEQ ID NO: 2784481 - protein, 4 aa, Entamoeba invadens
YSQT

SEQ ID NO: 2784482 - protein, 6 aa, Entamoeba invadens
YSQTEG

SEQ ID NO: 2784483 - protein, 6 aa, Entamoeba invadens
YSQTTI

SEQ ID NO: 2784484 - protein, 5 aa, Entamoeba invadens
YSQVG

SEQ ID NO: 2784485 - protein, 11 aa, Entamoeba invadens
YSRAEYEETQQ

SEQ ID NO: 2784486 - protein, 5 aa, Entamoeba invadens
YSRPS

SEQ ID NO: 2784487 - protein, 16 aa, Entamoeba invadens
YSRTSDFGDFGTTKGN

SEQ ID NO: 2784488 - protein, 6 aa, Entamoeba invadens
YSRTSY

SEQ ID NO: 2784489 - protein, 5 aa, Entamoeba invadens
YSSDD

SEQ ID NO: 2784490 - protein, 7 aa, Entamoeba invadens
YSSEDQI

SEQ ID NO: 2784491 - protein, 5 aa, Entamoeba invadens
YSSEK

SEQ ID NO: 2784492 - protein, 8 aa, Entamoeba invadens
YSSETEQT

SEQ ID NO: 2784493 - protein, 8 aa, Entamoeba invadens
YSSGGTSL

SEQ ID NO: 2784494 - protein, 10 aa, Entamoeba invadens
YSSHGGTSTC

SEQ ID NO: 2784495 - protein, 6 aa, Entamoeba invadens
YSSKET

SEQ ID NO: 2784496 - protein, 12 aa, Entamoeba invadens
YSSKSSSDCQKS

SEQ ID NO: 2784497 - protein, 11 aa, Entamoeba invadens
YSSNSSCEKID

SEQ ID NO: 2784498 - protein, 17 aa, Entamoeba invadens
YSSPKLRNLPSSEGITS

SEQ ID NO: 2784499 - protein, 10 aa, Entamoeba invadens
YSSPNNISQL

SEQ ID NO: 2784500 - protein, 22 aa, Entamoeba invadens
YSSQGAPKRRATVASAAEAIRK

SEQ ID NO: 2784501 - protein, 5 aa, Entamoeba invadens
YSSSK

SEQ ID NO: 2784502 - protein, 8 aa, Entamoeba invadens
YSSSPKSL

SEQ ID NO: 2784503 - protein, 8 aa, Entamoeba invadens
YSSSSGFS

SEQ ID NO: 2784504 - protein, 9 aa, Entamoeba invadens
YSSSSNGDT

SEQ ID NO: 2784505 - protein, 12 aa, Entamoeba invadens
YSSTGSSSCTQC

SEQ ID NO: 2784506 - protein, 8 aa, Entamoeba invadens
YSSTPEQV

SEQ ID NO: 2784507 - protein, 14 aa, Entamoeba invadens
YSSTYKSTKCTPCA

SEQ ID NO: 2784508 - protein, 5 aa, Entamoeba invadens
YSSYN

SEQ ID NO: 2784509 - protein, 25 aa, Entamoeba invadens
YSTAHSSSCKNCSQGYYTDEVGTSE

SEQ ID NO: 2784510 - protein, 4 aa, Entamoeba invadens
YSTD

SEQ ID NO: 2784511 - protein, 5 aa, Entamoeba invadens
YSTEE

SEQ ID NO: 2784512 - protein, 9 aa, Entamoeba invadens
YSTEGSSNC

SEQ ID NO: 2784513 - protein, 7 aa, Entamoeba invadens
YSTEYQT

SEQ ID NO: 2784514 - protein, 7 aa, Entamoeba invadens
YSTGGTF

SEQ ID NO: 2784515 - protein, 7 aa, Entamoeba invadens
YSTGGTT

SEQ ID NO: 2784516 - protein, 11 aa, Entamoeba invadens
YSTKDQKKRKE

SEQ ID NO: 2784517 - protein, 6 aa, Entamoeba invadens
YSTKGS

SEQ ID NO: 2784518 - protein, 11 aa, Entamoeba invadens
YSTKSCDKCST

SEQ ID NO: 2784519 - protein, 8 aa, Entamoeba invadens
YSTLGSSG

SEQ ID NO: 2784520 - protein, 4 aa, Entamoeba invadens
YSTN

SEQ ID NO: 2784521 - protein, 18 aa, Entamoeba invadens
YSTNPNSTLNPQSFPSLN

SEQ ID NO: 2784522 - protein, 4 aa, Entamoeba invadens
YSTP

SEQ ID NO: 2784523 - protein, 5 aa, Entamoeba invadens
YSTPH

SEQ ID NO: 2784524 - protein, 7 aa, Entamoeba invadens
YSTPQSA

SEQ ID NO: 2784525 - protein, 4 aa, Entamoeba invadens
YSTQ

SEQ ID NO: 2784526 - protein, 4 aa, Entamoeba invadens
YSTS

SEQ ID NO: 2784527 - protein, 10 aa, Entamoeba invadens
YSTTLNKNES

SEQ ID NO: 2784528 - protein, 10 aa, Entamoeba invadens
YSTTSEPNKA

SEQ ID NO: 2784529 - protein, 5 aa, Entamoeba invadens
YSTTT

SEQ ID NO: 2784530 - protein, 7 aa, Entamoeba invadens
YSTTTSA

SEQ ID NO: 2784531 - protein, 8 aa, Entamoeba invadens
YSVGPTKE

SEQ ID NO: 2784532 - protein, 10 aa, Entamoeba invadens
YSVKGTVDEC

SEQ ID NO: 2784533 - protein, 8 aa, Entamoeba invadens
YSVNGENQ

SEQ ID NO: 2784534 - protein, 15 aa, Entamoeba invadens
YSVNGNECAKCESTC

SEQ ID NO: 2784535 - protein, 6 aa, Entamoeba invadens
YSVRSG

SEQ ID NO: 2784536 - protein, 21 aa, Entamoeba invadens
YSVSPYSNEAEKLAQFSDGST

SEQ ID NO: 2784537 - protein, 11 aa, Entamoeba invadens
YSVSSGSAKCT

SEQ ID NO: 2784538 - protein, 4 aa, Entamoeba invadens
YSVT

SEQ ID NO: 2784539 - protein, 6 aa, Entamoeba invadens
YSYAAN

SEQ ID NO: 2784540 - protein, 9 aa, Entamoeba invadens
YSYANNNGV

SEQ ID NO: 2784541 - protein, 12 aa, Entamoeba invadens
YSYANSEGKCTE

SEQ ID NO: 2784542 - protein, 11 aa, Entamoeba invadens
YSYASNGKCTE

SEQ ID NO: 2784543 - protein, 4 aa, Entamoeba invadens
YSYD

SEQ ID NO: 2784544 - protein, 6 aa, Entamoeba invadens
YSYDSE

SEQ ID NO: 2784545 - protein, 11 aa, Entamoeba invadens
YSYDSSNKKCS

SEQ ID NO: 2784546 - protein, 5 aa, Entamoeba invadens
YSYEG

SEQ ID NO: 2784547 - protein, 9 aa, Entamoeba invadens
YSYGGTTTS

SEQ ID NO: 2784548 - protein, 11 aa, Entamoeba invadens
YSYKDDLNNRK

SEQ ID NO: 2784549 - protein, 31 aa, Entamoeba invadens
YSYKESSACTPCSAGTYSTSTGSSTCTKCNT

SEQ ID NO: 2784550 - protein, 12 aa, Entamoeba invadens
YSYPNTNGDCTT

SEQ ID NO: 2784551 - protein, 6 aa, Entamoeba invadens
YSYPQG

SEQ ID NO: 2784552 - protein, 10 aa, Entamoeba invadens
YSYTNNKGEC

SEQ ID NO: 2784553 - protein, 6 aa, Entamoeba invadens
YSYTRN

SEQ ID NO: 2784554 - protein, 4 aa, Entamoeba invadens
YSYY

SEQ ID NO: 2784555 - protein, 5 aa, Entamoeba invadens
YTADN

SEQ ID NO: 2784556 - protein, 13 aa, Entamoeba invadens
YTAEAKKKEEIDA

SEQ ID NO: 2784557 - protein, 6 aa, Entamoeba invadens
YTAGTF

SEQ ID NO: 2784558 - protein, 8 aa, Entamoeba invadens
YTAGTFGG

SEQ ID NO: 2784559 - protein, 7 aa, Entamoeba invadens
YTANNER

SEQ ID NO: 2784560 - protein, 5 aa, Entamoeba invadens
YTATQ

SEQ ID NO: 2784561 - protein, 4 aa, Entamoeba invadens
YTAV

SEQ ID NO: 2784562 - protein, 4 aa, Entamoeba invadens
YTCT

SEQ ID NO: 2784563 - protein, 10 aa, Entamoeba invadens
YTDEVSMQKK

SEQ ID NO: 2784564 - protein, 10 aa, Entamoeba invadens
YTDKEASPYC

SEQ ID NO: 2784565 - protein, 8 aa, Entamoeba invadens
YTDPTQVP

SEQ ID NO: 2784566 - protein, 7 aa, Entamoeba invadens
YTDSNKN

SEQ ID NO: 2784567 - protein, 7 aa, Entamoeba invadens
YTDTNTV

SEQ ID NO: 2784568 - protein, 8 aa, Entamoeba invadens
YTDTTTTI

SEQ ID NO: 2784569 - protein, 8 aa, Entamoeba invadens
YTEDDPEC

SEQ ID NO: 2784570 - protein, 9 aa, Entamoeba invadens
YTEEGNIGS

SEQ ID NO: 2784571 - protein, 10 aa, Entamoeba invadens
YTEKADSTRG

SEQ ID NO: 2784572 - protein, 6 aa, Entamoeba invadens
YTEKTS

SEQ ID NO: 2784573 - protein, 8 aa, Entamoeba invadens
YTENKGRQ

SEQ ID NO: 2784574 - protein, 7 aa, Entamoeba invadens
YTENSKC

SEQ ID NO: 2784575 - protein, 6 aa, Entamoeba invadens
YTEQHK

SEQ ID NO: 2784576 - protein, 5 aa, Entamoeba invadens
YTETG

SEQ ID NO: 2784577 - protein, 15 aa, Entamoeba invadens
YTEYKKRTIIGIPFL

SEQ ID NO: 2784578 - protein, 6 aa, Entamoeba invadens
YTFNNN

SEQ ID NO: 2784579 - protein, 12 aa, Entamoeba invadens
YTFSSGNTCGTC

SEQ ID NO: 2784580 - protein, 19 aa, Entamoeba invadens
YTFTTKKSVHGKKQRITSV

SEQ ID NO: 2784581 - protein, 8 aa, Entamoeba invadens
YTGDTPKC

SEQ ID NO: 2784582 - protein, 11 aa, Entamoeba invadens
YTGRDGGWGDG

SEQ ID NO: 2784583 - protein, 7 aa, Entamoeba invadens
YTGRSDF

SEQ ID NO: 2784584 - protein, 20 aa, Entamoeba invadens
YTGSNKYTKYVKDGKKARIF

SEQ ID NO: 2784585 - protein, 30 aa, Entamoeba invadens
YTGSNTYTKYVKDGKKTRRYSSNNCDNWDD

SEQ ID NO: 2784586 - protein, 11 aa, Entamoeba invadens
YTGTSSSVSQI

SEQ ID NO: 2784587 - protein, 12 aa, Entamoeba invadens
YTHEKSCDECSD

SEQ ID NO: 2784588 - protein, 4 aa, Entamoeba invadens
YTHK

SEQ ID NO: 2784589 - protein, 12 aa, Entamoeba invadens
YTIDAGGVSCSK

SEQ ID NO: 2784590 - protein, 19 aa, Entamoeba invadens
YTIDDNGNCIQNNGEIEQS

SEQ ID NO: 2784591 - protein, 27 aa, Entamoeba invadens
YTIDDNGNCIQNNGEIEQSNCKETTQY

SEQ ID NO: 2784592 - protein, 10 aa, Entamoeba invadens
YTIKSGVAKT

SEQ ID NO: 2784593 - protein, 11 aa, Entamoeba invadens
YTINPSNPKQC

SEQ ID NO: 2784594 - protein, 4 aa, Entamoeba invadens
YTIP

SEQ ID NO: 2784595 - protein, 9 aa, Entamoeba invadens
YTITSTPGI

SEQ ID NO: 2784596 - protein, 7 aa, Entamoeba invadens
YTITTDS

SEQ ID NO: 2784597 - protein, 10 aa, Entamoeba invadens
YTKDASNDLT

SEQ ID NO: 2784598 - protein, 12 aa, Entamoeba invadens
YTKDQNNTGSCM

SEQ ID NO: 2784599 - protein, 6 aa, Entamoeba invadens
YTKEQT

SEQ ID NO: 2784600 - protein, 11 aa, Entamoeba invadens
YTKKAEESQID

SEQ ID NO: 2784601 - protein, 12 aa, Entamoeba invadens
YTKKGGDEAKCY

SEQ ID NO: 2784602 - protein, 4 aa, Entamoeba invadens
YTKP

SEQ ID NO: 2784603 - protein, 6 aa, Entamoeba invadens
YTKQAD

SEQ ID NO: 2784604 - protein, 8 aa, Entamoeba invadens
YTKRNGKC

SEQ ID NO: 2784605 - protein, 6 aa, Entamoeba invadens
YTKSAD

SEQ ID NO: 2784606 - protein, 6 aa, Entamoeba invadens
YTKTST

SEQ ID NO: 2784607 - protein, 7 aa, Entamoeba invadens
YTKVNEQ

SEQ ID NO: 2784608 - protein, 5 aa, Entamoeba invadens
YTLAN

SEQ ID NO: 2784609 - protein, 5 aa, Entamoeba invadens
YTLDA

SEQ ID NO: 2784610 - protein, 12 aa, Entamoeba invadens
YTLEGRTEGSCV

SEQ ID NO: 2784611 - protein, 5 aa, Entamoeba invadens
YTLNN

SEQ ID NO: 2784612 - protein, 8 aa, Entamoeba invadens
YTLNSNPK

SEQ ID NO: 2784613 - protein, 4 aa, Entamoeba invadens
YTLR

SEQ ID NO: 2784614 - protein, 31 aa, Entamoeba invadens
YTLSSNGKSCDQCASTSYYDSTTNQCVNRNT

SEQ ID NO: 2784615 - protein, 32 aa, Entamoeba invadens
YTLSSNGNSCDQCDSASYYDKTTNRCVNKNTT

SEQ ID NO: 2784616 - protein, 32 aa, Entamoeba invadens
YTLSSNSKSCDQCASTSYYDRTTNQCVNRNTT

SEQ ID NO: 2784617 - protein, 11 aa, Entamoeba invadens
YTLTSNSTNSV

SEQ ID NO: 2784618 - protein, 6 aa, Entamoeba invadens
YTNDDA

SEQ ID NO: 2784619 - protein, 21 aa, Entamoeba invadens
YTNDEEKKKEVTTKIETTEEL

SEQ ID NO: 2784620 - protein, 11 aa, Entamoeba invadens
YTNDKFGNNTV

SEQ ID NO: 2784621 - protein, 9 aa, Entamoeba invadens
YTNDKTDTF

SEQ ID NO: 2784622 - protein, 8 aa, Entamoeba invadens
YTNDNGAM

SEQ ID NO: 2784623 - protein, 8 aa, Entamoeba invadens
YTNEKSLD

SEQ ID NO: 2784624 - protein, 6 aa, Entamoeba invadens
YTNEQN

SEQ ID NO: 2784625 - protein, 6 aa, Entamoeba invadens
YTNEYN

SEQ ID NO: 2784626 - protein, 4 aa, Entamoeba invadens
YTNG

SEQ ID NO: 2784627 - protein, 10 aa, Entamoeba invadens
YTNKSGDDTK

SEQ ID NO: 2784628 - protein, 4 aa, Entamoeba invadens
YTNN

SEQ ID NO: 2784629 - protein, 9 aa, Entamoeba invadens
YTNPADPLS

SEQ ID NO: 2784630 - protein, 6 aa, Entamoeba invadens
YTNQID

SEQ ID NO: 2784631 - protein, 5 aa, Entamoeba invadens
YTNSK

SEQ ID NO: 2784632 - protein, 21 aa, Entamoeba invadens
YTNSTQTTNTIKKQQHKSSTR

SEQ ID NO: 2784633 - protein, 29 aa, Entamoeba invadens
YTPDKKKEEKIKTRNVKPQHKDTYDETYS

SEQ ID NO: 2784634 - protein, 8 aa, Entamoeba invadens
YTPDPETG

SEQ ID NO: 2784635 - protein, 5 aa, Entamoeba invadens
YTPGG

SEQ ID NO: 2784636 - protein, 19 aa, Entamoeba invadens
YTPHPDEAIKDSPKPLESP

SEQ ID NO: 2784637 - protein, 4 aa, Entamoeba invadens
YTPK

SEQ ID NO: 2784638 - protein, 9 aa, Entamoeba invadens
YTPNKKGEC

SEQ ID NO: 2784639 - protein, 6 aa, Entamoeba invadens
YTPQSN

SEQ ID NO: 2784640 - protein, 7 aa, Entamoeba invadens
YTPTNKL

SEQ ID NO: 2784641 - protein, 8 aa, Entamoeba invadens
YTPTTGTS

SEQ ID NO: 2784642 - protein, 12 aa, Entamoeba invadens
YTPTYKPSDGDT

SEQ ID NO: 2784643 - protein, 12 aa, Entamoeba invadens
YTPTYNPSDGDT

SEQ ID NO: 2784644 - protein, 7 aa, Entamoeba invadens
YTQDNTT

SEQ ID NO: 2784645 - protein, 8 aa, Entamoeba invadens
YTQDPPKC

SEQ ID NO: 2784646 - protein, 4 aa, Entamoeba invadens
YTQF

SEQ ID NO: 2784647 - protein, 7 aa, Entamoeba invadens
YTQNDKT

SEQ ID NO: 2784648 - protein, 8 aa, Entamoeba invadens
YTQNTSST

SEQ ID NO: 2784649 - protein, 5 aa, Entamoeba invadens
YTQPK

SEQ ID NO: 2784650 - protein, 15 aa, Entamoeba invadens
YTQQKKNKDIPEGGA

SEQ ID NO: 2784651 - protein, 5 aa, Entamoeba invadens
YTQRG

SEQ ID NO: 2784652 - protein, 7 aa, Entamoeba invadens
YTQSADY

SEQ ID NO: 2784653 - protein, 5 aa, Entamoeba invadens
YTQSE

SEQ ID NO: 2784654 - protein, 10 aa, Entamoeba invadens
YTRGSDENGY

SEQ ID NO: 2784655 - protein, 4 aa, Entamoeba invadens
YTRN

SEQ ID NO: 2784656 - protein, 6 aa, Entamoeba invadens
YTSAGD

SEQ ID NO: 2784657 - protein, 15 aa, Entamoeba invadens
YTSDSLDLNDTTNFR

SEQ ID NO: 2784658 - protein, 9 aa, Entamoeba invadens
YTSDSTHEI

SEQ ID NO: 2784659 - protein, 6 aa, Entamoeba invadens
YTSEAA

SEQ ID NO: 2784660 - protein, 19 aa, Entamoeba invadens
YTSETPENDPAQGCVNSNG

SEQ ID NO: 2784661 - protein, 10 aa, Entamoeba invadens
YTSKNRGESF

SEQ ID NO: 2784662 - protein, 10 aa, Entamoeba invadens
YTSKTFNPEA

SEQ ID NO: 2784663 - protein, 10 aa, Entamoeba invadens
YTSKTGSSIC

SEQ ID NO: 2784664 - protein, 8 aa, Entamoeba invadens
YTSLQGSY

SEQ ID NO: 2784665 - protein, 8 aa, Entamoeba invadens
YTSNNNAI

SEQ ID NO: 2784666 - protein, 9 aa, Entamoeba invadens
YTSPGTGAW

SEQ ID NO: 2784667 - protein, 9 aa, Entamoeba invadens
YTSPGTKAW

SEQ ID NO: 2784668 - protein, 8 aa, Entamoeba invadens
YTSQKNTV

SEQ ID NO: 2784669 - protein, 10 aa, Entamoeba invadens
YTSQRPSPYS

SEQ ID NO: 2784670 - protein, 9 aa, Entamoeba invadens
YTSSYGSSE

SEQ ID NO: 2784671 - protein, 9 aa, Entamoeba invadens
YTSTGNAQE

SEQ ID NO: 2784672 - protein, 11 aa, Entamoeba invadens
YTSTKFGENEV

SEQ ID NO: 2784673 - protein, 7 aa, Entamoeba invadens
YTSTTSD

SEQ ID NO: 2784674 - protein, 6 aa, Entamoeba invadens
YTSTTT

SEQ ID NO: 2784675 - protein, 16 aa, Entamoeba invadens
YTTADPSKNPAQGCID

SEQ ID NO: 2784676 - protein, 12 aa, Entamoeba invadens
YTTDDALSTYDT

SEQ ID NO: 2784677 - protein, 11 aa, Entamoeba invadens
YTTDDNGNCVS

SEQ ID NO: 2784678 - protein, 8 aa, Entamoeba invadens
YTTDDSGN

SEQ ID NO: 2784679 - protein, 20 aa, Entamoeba invadens
YTTDKVRKNNKVQKKTYKRK

SEQ ID NO: 2784680 - protein, 14 aa, Entamoeba invadens
YTTDQQNCSKCYSG

SEQ ID NO: 2784681 - protein, 5 aa, Entamoeba invadens
YTTEI

SEQ ID NO: 2784682 - protein, 5 aa, Entamoeba invadens
YTTKI

SEQ ID NO: 2784683 - protein, 9 aa, Entamoeba invadens
YTTKQKKDH

SEQ ID NO: 2784684 - protein, 26 aa, Entamoeba invadens
YTTNKSTSKCENIENNTNCDVKTTKG

SEQ ID NO: 2784685 - protein, 12 aa, Entamoeba invadens
YTTNSGSFAISG

SEQ ID NO: 2784686 - protein, 10 aa, Entamoeba invadens
YTTQKTTPIV

SEQ ID NO: 2784687 - protein, 10 aa, Entamoeba invadens
YTTQSSEEVS

SEQ ID NO: 2784688 - protein, 6 aa, Entamoeba invadens
YTTSDT

SEQ ID NO: 2784689 - protein, 11 aa, Entamoeba invadens
YTTSEATFDTT

SEQ ID NO: 2784690 - protein, 9 aa, Entamoeba invadens
YTTSESGEE

SEQ ID NO: 2784691 - protein, 6 aa, Entamoeba invadens
YTTSGD

SEQ ID NO: 2784692 - protein, 7 aa, Entamoeba invadens
YTTTSTA

SEQ ID NO: 2784693 - protein, 11 aa, Entamoeba invadens
YTTTTTTDQNI

SEQ ID NO: 2784694 - protein, 9 aa, Entamoeba invadens
YTTYDQETT

SEQ ID NO: 2784695 - protein, 4 aa, Entamoeba invadens
YTVE

SEQ ID NO: 2784696 - protein, 10 aa, Entamoeba invadens
YTVGNPTDTF

SEQ ID NO: 2784697 - protein, 6 aa, Entamoeba invadens
YTVNTS

SEQ ID NO: 2784698 - protein, 10 aa, Entamoeba invadens
YTVPETANEG

SEQ ID NO: 2784699 - protein, 14 aa, Entamoeba invadens
YTVTECPEDPLGSD

SEQ ID NO: 2784700 - protein, 7 aa, Entamoeba invadens
YTYGDDD

SEQ ID NO: 2784701 - protein, 8 aa, Entamoeba invadens
YTYPSLTT

SEQ ID NO: 2784702 - protein, 6 aa, Entamoeba invadens
YTYSGD

SEQ ID NO: 2784703 - protein, 12 aa, Entamoeba invadens
YVARSRNSTESV

SEQ ID NO: 2784704 - protein, 10 aa, Entamoeba invadens
YVDNTSGTGI

SEQ ID NO: 2784705 - protein, 8 aa, Entamoeba invadens
YVDSTTKK

SEQ ID NO: 2784706 - protein, 7 aa, Entamoeba invadens
YVDTNEG

SEQ ID NO: 2784707 - protein, 7 aa, Entamoeba invadens
YVDTTTK

SEQ ID NO: 2784708 - protein, 4 aa, Entamoeba invadens
YVDY

SEQ ID NO: 2784709 - protein, 10 aa, Entamoeba invadens
YVGGKNKKCY

SEQ ID NO: 2784710 - protein, 9 aa, Entamoeba invadens
YVGGNPSLL

SEQ ID NO: 2784711 - protein, 11 aa, Entamoeba invadens
YVHSTSDQKVC

SEQ ID NO: 2784712 - protein, 8 aa, Entamoeba invadens
YVKETTEL

SEQ ID NO: 2784713 - protein, 12 aa, Entamoeba invadens
YVKPSEGGQGCE

SEQ ID NO: 2784714 - protein, 11 aa, Entamoeba invadens
YVKQSENATKC

SEQ ID NO: 2784715 - protein, 12 aa, Entamoeba invadens
YVPATTNEDMDY

SEQ ID NO: 2784716 - protein, 9 aa, Entamoeba invadens
YVPNDPQNE

SEQ ID NO: 2784717 - protein, 8 aa, Entamoeba invadens
YVPNNQGG

SEQ ID NO: 2784718 - protein, 8 aa, Entamoeba invadens
YVPPPEKF

SEQ ID NO: 2784719 - protein, 8 aa, Entamoeba invadens
YVPPSEGS

SEQ ID NO: 2784720 - protein, 7 aa, Entamoeba invadens
YVPSNTN

SEQ ID NO: 2784721 - protein, 9 aa, Entamoeba invadens
YVPTASPSL

SEQ ID NO: 2784722 - protein, 7 aa, Entamoeba invadens
YVPTEDG

SEQ ID NO: 2784723 - protein, 6 aa, Entamoeba invadens
YVPTLS

SEQ ID NO: 2784724 - protein, 5 aa, Entamoeba invadens
YVPTP

SEQ ID NO: 2784725 - protein, 5 aa, Entamoeba invadens
YVPYT

SEQ ID NO: 2784726 - protein, 8 aa, Entamoeba invadens
YVPYTSNS

SEQ ID NO: 2784727 - protein, 9 aa, Entamoeba invadens
YVREEGDDC

SEQ ID NO: 2784728 - protein, 9 aa, Entamoeba invadens
YVRNDSDDY

SEQ ID NO: 2784729 - protein, 8 aa, Entamoeba invadens
YVSAPDTA

SEQ ID NO: 2784730 - protein, 11 aa, Entamoeba invadens
YVTDPKDVNSC

SEQ ID NO: 2784731 - protein, 25 aa, Entamoeba invadens
YVTDTTSQSGNCVKSNNNCVKTSNE

SEQ ID NO: 2784732 - protein, 12 aa, Entamoeba invadens
YVTGKTKVEEIT

SEQ ID NO: 2784733 - protein, 9 aa, Entamoeba invadens
YVTKNSGFK

SEQ ID NO: 2784734 - protein, 10 aa, Entamoeba invadens
YVTNSTNCQK

SEQ ID NO: 2784735 - protein, 11 aa, Entamoeba invadens
YVTNSTNCQKC

SEQ ID NO: 2784736 - protein, 10 aa, Entamoeba invadens
YVTQQNKMTQ

SEQ ID NO: 2784737 - protein, 12 aa, Entamoeba invadens
YVTTDQNTNCEI

SEQ ID NO: 2784738 - protein, 6 aa, Entamoeba invadens
YWDQTQ

SEQ ID NO: 2784739 - protein, 5 aa, Entamoeba invadens
YWEEN

SEQ ID NO: 2784740 - protein, 9 aa, Entamoeba invadens
YYANSSVSS

SEQ ID NO: 2784741 - protein, 4 aa, Entamoeba invadens
YYDE

SEQ ID NO: 2784742 - protein, 9 aa, Entamoeba invadens
YYDEKTKKC

SEQ ID NO: 2784743 - protein, 8 aa, Entamoeba invadens
YYDNSSNS

SEQ ID NO: 2784744 - protein, 8 aa, Entamoeba invadens
YYDQPKIS

SEQ ID NO: 2784745 - protein, 14 aa, Entamoeba invadens
YYDQTTNTCASCQD

SEQ ID NO: 2784746 - protein, 9 aa, Entamoeba invadens
YYDTSKKTC

SEQ ID NO: 2784747 - protein, 4 aa, Entamoeba invadens
YYEP

SEQ ID NO: 2784748 - protein, 4 aa, Entamoeba invadens
YYES

SEQ ID NO: 2784749 - protein, 10 aa, Entamoeba invadens
YYETNENGIA

SEQ ID NO: 2784750 - protein, 9 aa, Entamoeba invadens
YYGDSCESR

SEQ ID NO: 2784751 - protein, 7 aa, Entamoeba invadens
YYGDYST

SEQ ID NO: 2784752 - protein, 12 aa, Entamoeba invadens
YYGKDTDTSSLT

SEQ ID NO: 2784753 - protein, 4 aa, Entamoeba invadens
YYIS

SEQ ID NO: 2784754 - protein, 10 aa, Entamoeba invadens
YYISDDKTQC

SEQ ID NO: 2784755 - protein, 17 aa, Entamoeba invadens
YYKDPSSNSCKGCSTTF

SEQ ID NO: 2784756 - protein, 16 aa, Entamoeba invadens
YYKDTSSNSCKRCSTT

SEQ ID NO: 2784757 - protein, 7 aa, Entamoeba invadens
YYKEGTD

SEQ ID NO: 2784758 - protein, 7 aa, Entamoeba invadens
YYKEPAD

SEQ ID NO: 2784759 - protein, 5 aa, Entamoeba invadens
YYKER

SEQ ID NO: 2784760 - protein, 10 aa, Entamoeba invadens
YYKGSNGSFC

SEQ ID NO: 2784761 - protein, 4 aa, Entamoeba invadens
YYKK

SEQ ID NO: 2784762 - protein, 4 aa, Entamoeba invadens
YYKQ

SEQ ID NO: 2784763 - protein, 5 aa, Entamoeba invadens
YYKQE

SEQ ID NO: 2784764 - protein, 6 aa, Entamoeba invadens
YYKREK

SEQ ID NO: 2784765 - protein, 6 aa, Entamoeba invadens
YYKRET

SEQ ID NO: 2784766 - protein, 7 aa, Entamoeba invadens
YYKSTKY

SEQ ID NO: 2784767 - protein, 7 aa, Entamoeba invadens
YYKTDTE

SEQ ID NO: 2784768 - protein, 9 aa, Entamoeba invadens
YYKTGKEPI

SEQ ID NO: 2784769 - protein, 11 aa, Entamoeba invadens
YYKTNNGDCLP

SEQ ID NO: 2784770 - protein, 6 aa, Entamoeba invadens
YYKTPA

SEQ ID NO: 2784771 - protein, 13 aa, Entamoeba invadens
YYKTSTGDCMSKS

SEQ ID NO: 2784772 - protein, 4 aa, Entamoeba invadens
YYNH

SEQ ID NO: 2784773 - protein, 7 aa, Entamoeba invadens
YYNNDNN

SEQ ID NO: 2784774 - protein, 13 aa, Entamoeba invadens
YYNPNSKSCQSND

SEQ ID NO: 2784775 - protein, 4 aa, Entamoeba invadens
YYNS

SEQ ID NO: 2784776 - protein, 5 aa, Entamoeba invadens
YYNSE

SEQ ID NO: 2784777 - protein, 6 aa, Entamoeba invadens
YYNSSN

SEQ ID NO: 2784778 - protein, 9 aa, Entamoeba invadens
YYPAEDGSL

SEQ ID NO: 2784779 - protein, 6 aa, Entamoeba invadens
YYPDQS

SEQ ID NO: 2784780 - protein, 6 aa, Entamoeba invadens
YYPDSN

SEQ ID NO: 2784781 - protein, 8 aa, Entamoeba invadens
YYPDTNGK

SEQ ID NO: 2784782 - protein, 5 aa, Entamoeba invadens
YYPGI

SEQ ID NO: 2784783 - protein, 7 aa, Entamoeba invadens
YYPGSDG

SEQ ID NO: 2784784 - protein, 8 aa, Entamoeba invadens
YYPGTTGK

SEQ ID NO: 2784785 - protein, 8 aa, Entamoeba invadens
YYPGTTGQ

SEQ ID NO: 2784786 - protein, 7 aa, Entamoeba invadens
YYPHNSQ

SEQ ID NO: 2784787 - protein, 7 aa, Entamoeba invadens
YYPHPES

SEQ ID NO: 2784788 - protein, 4 aa, Entamoeba invadens
YYPK

SEQ ID NO: 2784789 - protein, 7 aa, Entamoeba invadens
YYPKQGQ

SEQ ID NO: 2784790 - protein, 9 aa, Entamoeba invadens
YYPKTNGDF

SEQ ID NO: 2784791 - protein, 9 aa, Entamoeba invadens
YYPKTSGDY

SEQ ID NO: 2784792 - protein, 4 aa, Entamoeba invadens
YYPN

SEQ ID NO: 2784793 - protein, 5 aa, Entamoeba invadens
YYPND

SEQ ID NO: 2784794 - protein, 9 aa, Entamoeba invadens
YYPNESGTC

SEQ ID NO: 2784795 - protein, 10 aa, Entamoeba invadens
YYPQTNSPFT

SEQ ID NO: 2784796 - protein, 13 aa, Entamoeba invadens
YYPSNNKSKKAMK

SEQ ID NO: 2784797 - protein, 13 aa, Entamoeba invadens
YYPTTSDSQRYQP

SEQ ID NO: 2784798 - protein, 7 aa, Entamoeba invadens
YYPYGDT

SEQ ID NO: 2784799 - protein, 4 aa, Entamoeba invadens
YYQA

SEQ ID NO: 2784800 - protein, 6 aa, Entamoeba invadens
YYQDQN

SEQ ID NO: 2784801 - protein, 17 aa, Entamoeba invadens
YYQGGECVRNDDGCSNQ

SEQ ID NO: 2784802 - protein, 12 aa, Entamoeba invadens
YYQKNASTVTDC

SEQ ID NO: 2784803 - protein, 7 aa, Entamoeba invadens
YYQNGGT

SEQ ID NO: 2784804 - protein, 9 aa, Entamoeba invadens
YYQPNSGQS

SEQ ID NO: 2784805 - protein, 11 aa, Entamoeba invadens
YYQPNSSTFTD

SEQ ID NO: 2784806 - protein, 13 aa, Entamoeba invadens
YYQTDAENVEKKY

SEQ ID NO: 2784807 - protein, 12 aa, Entamoeba invadens
YYQTDAKNIEDK

SEQ ID NO: 2784808 - protein, 12 aa, Entamoeba invadens
YYQTDAKNVENK

SEQ ID NO: 2784809 - protein, 12 aa, Entamoeba invadens
YYQTDSKNIENK

SEQ ID NO: 2784810 - protein, 4 aa, Entamoeba invadens
YYRD

SEQ ID NO: 2784811 - protein, 6 aa, Entamoeba invadens
YYREGT

SEQ ID NO: 2784812 - protein, 6 aa, Entamoeba invadens
YYRKNT

SEQ ID NO: 2784813 - protein, 5 aa, Entamoeba invadens
YYRQQ

SEQ ID NO: 2784814 - protein, 7 aa, Entamoeba invadens
YYRSGDG

SEQ ID NO: 2784815 - protein, 8 aa, Entamoeba invadens
YYRTPNNI

SEQ ID NO: 2784816 - protein, 17 aa, Entamoeba invadens
YYRTPNNNTELCNPQTE

SEQ ID NO: 2784817 - protein, 10 aa, Entamoeba invadens
YYRTPNNNTK

SEQ ID NO: 2784818 - protein, 17 aa, Entamoeba invadens
YYRTPNNNTKLCNPQTD

SEQ ID NO: 2784819 - protein, 17 aa, Entamoeba invadens
YYRTPNNNTKLCNPQTE

SEQ ID NO: 2784820 - protein, 18 aa, Entamoeba invadens
YYRTPNNNTKLCNSQTEL

SEQ ID NO: 2784821 - protein, 8 aa, Entamoeba invadens
YYRTPQNI

SEQ ID NO: 2784822 - protein, 8 aa, Entamoeba invadens
YYRTPQNS

SEQ ID NO: 2784823 - protein, 5 aa, Entamoeba invadens
YYSGS

SEQ ID NO: 2784824 - protein, 14 aa, Entamoeba invadens
YYSLGGSGGCTTCS

SEQ ID NO: 2784825 - protein, 11 aa, Entamoeba invadens
YYSNEENLTEC

SEQ ID NO: 2784826 - protein, 10 aa, Entamoeba invadens
YYSNGGTSKC

SEQ ID NO: 2784827 - protein, 7 aa, Entamoeba invadens
YYSNNGT

SEQ ID NO: 2784828 - protein, 8 aa, Entamoeba invadens
YYSNNGTC

SEQ ID NO: 2784829 - protein, 6 aa, Entamoeba invadens
YYSPGG

SEQ ID NO: 2784830 - protein, 10 aa, Entamoeba invadens
YYSPGGTQSC

SEQ ID NO: 2784831 - protein, 12 aa, Entamoeba invadens
YYSPGVKSSCSK

SEQ ID NO: 2784832 - protein, 5 aa, Entamoeba invadens
YYSPS

SEQ ID NO: 2784833 - protein, 9 aa, Entamoeba invadens
YYSPSGSIS

SEQ ID NO: 2784834 - protein, 4 aa, Entamoeba invadens
YYSQ

SEQ ID NO: 2784835 - protein, 5 aa, Entamoeba invadens
YYSQN

SEQ ID NO: 2784836 - protein, 24 aa, Entamoeba invadens
YYSSDKTCKKCDSNCKTCDQTSTQ

SEQ ID NO: 2784837 - protein, 6 aa, Entamoeba invadens
YYSSGG

SEQ ID NO: 2784838 - protein, 9 aa, Entamoeba invadens
YYSSGGTLS

SEQ ID NO: 2784839 - protein, 7 aa, Entamoeba invadens
YYSSGSK

SEQ ID NO: 2784840 - protein, 13 aa, Entamoeba invadens
YYSSSGSASCRKC

SEQ ID NO: 2784841 - protein, 13 aa, Entamoeba invadens
YYSSSGSASCTKC

SEQ ID NO: 2784842 - protein, 8 aa, Entamoeba invadens
YYSSSSGS

SEQ ID NO: 2784843 - protein, 9 aa, Entamoeba invadens
YYSTGGNGS

SEQ ID NO: 2784844 - protein, 9 aa, Entamoeba invadens
YYSTGGTAS

SEQ ID NO: 2784845 - protein, 10 aa, Entamoeba invadens
YYSTGGTDGC

SEQ ID NO: 2784846 - protein, 12 aa, Entamoeba invadens
YYSTGGTGSCKP

SEQ ID NO: 2784847 - protein, 10 aa, Entamoeba invadens
YYSTGKTGSC

SEQ ID NO: 2784848 - protein, 9 aa, Entamoeba invadens
YYSTNTPQK

SEQ ID NO: 2784849 - protein, 4 aa, Entamoeba invadens
YYSV

SEQ ID NO: 2784850 - protein, 13 aa, Entamoeba invadens
YYSVDTKNTEDNY

SEQ ID NO: 2784851 - protein, 11 aa, Entamoeba invadens
YYSVKGTVDEC

SEQ ID NO: 2784852 - protein, 10 aa, Entamoeba invadens
YYTEGSTENC

SEQ ID NO: 2784853 - protein, 4 aa, Entamoeba invadens
YYTN

SEQ ID NO: 2784854 - protein, 7 aa, Entamoeba invadens
YYTNNTS

SEQ ID NO: 2784855 - protein, 12 aa, Entamoeba invadens
YYTSSSSTNMEG

SEQ ID NO: 2784856 - protein, 8 aa, Entamoeba invadens
YYTSTSDN

SEQ ID NO: 2784857 - protein, 10 aa, Entamoeba invadens
YYVNGDKSTL

SEQ ID NO: 2784858 - protein, 11 aa, Entamoeba invadens
YYYEGNGKCAK

SEQ ID NO: 2784859 - protein, 6 aa, Entamoeba invadens
YYYTPD

SEQ ID NO: 2784860 - protein, 25 aa, Entamoeba invadens
TKGCLRCLSGYYLADRMCVKCEYPC

SEQ ID NO: 2784861 - protein, 17 aa, Entamoeba invadens
MLDKFRCDYIIHFYGAV

SEQ ID NO: 2784862 - protein, 18 aa, Entamoeba invadens
IKIPVKFASEMSTALDPD

SEQ ID NO: 2784863 - protein, 24 aa, Entamoeba invadens
IKKYKYPTFFPFFMSYSHTYNGNK

SEQ ID NO: 2784864 - protein, 20 aa, Entamoeba invadens
KDLQCLKCDEILTNCIKCGL

SEQ ID NO: 2784865 - protein, 22 aa, Entamoeba invadens
KKMENICVFKMSRSNIAMSVLD

SEQ ID NO: 2784866 - protein, 23 aa, Entamoeba invadens
KRLECLLCKTGYGFESLEHKKCV

SEQ ID NO: 2784867 - protein, 18 aa, Entamoeba invadens
NCSICPASYYSSGGTSLC

SEQ ID NO: 2784868 - protein, 24 aa, Entamoeba invadens
NGKCLTCAAGYGFDSGVCTLCGDL

SEQ ID NO: 2784869 - protein, 26 aa, Entamoeba invadens
NIINFGIRCEECFPPFVTVNGNCIKC

SEQ ID NO: 2784870 - protein, 19 aa, Entamoeba invadens
NYDGCAICKDGYKRSTDGK

SEQ ID NO: 2784871 - protein, 19 aa, Entamoeba invadens
SYECLACKDGYFNIPSEGK

SEQ ID NO: 2784872 - protein, 17 aa, Entamoeba invadens
AADGYCYTYKCDTKSGY

SEQ ID NO: 2784873 - protein, 24 aa, Entamoeba invadens
AASGRLDIYSSKIIFDDKTNFNVK

SEQ ID NO: 2784874 - protein, 25 aa, Entamoeba invadens
AEADKEAYCEWTFSKSDCKQCVIKP

SEQ ID NO: 2784875 - protein, 18 aa, Entamoeba invadens
CDKSCAICKNSISCSLCA

SEQ ID NO: 2784876 - protein, 20 aa, Entamoeba invadens
CLKVGYYGCEVCADGYYLSN

SEQ ID NO: 2784877 - protein, 19 aa, Entamoeba invadens
CVFEMKRSNIEMVQINSVL

SEQ ID NO: 2784878 - protein, 18 aa, Entamoeba invadens
DGDCVVCSDGYYRTPNNN

SEQ ID NO: 2784879 - protein, 25 aa, Entamoeba invadens
DTQYYCNIFKWAIDANILAEIKKYK

SEQ ID NO: 2784880 - protein, 20 aa, Entamoeba invadens
EGQTTCKLCDSSCASCNATN

SEQ ID NO: 2784881 - protein, 25 aa, Entamoeba invadens
GEGSFGIVFKGIFRGNIVAIKKMKN

SEQ ID NO: 2784882 - protein, 18 aa, Entamoeba invadens
GKYTRFATVNTYISSYQK

SEQ ID NO: 2784883 - protein, 18 aa, Entamoeba invadens
GNKCKRCANDYLMVKENQ

SEQ ID NO: 2784884 - protein, 19 aa, Entamoeba invadens
GVCSLCISGTMANQTTNKC

SEQ ID NO: 2784885 - protein, 18 aa, Entamoeba invadens
IRTEPKLVNLKSGEACEF

SEQ ID NO: 2784886 - protein, 24 aa, Entamoeba invadens
IVKSGVATRVYVPLTIADEKGTLQ

SEQ ID NO: 2784887 - protein, 24 aa, Entamoeba invadens
IYNRSGCPCNGRYCVTTITAEYTA

SEQ ID NO: 2784888 - protein, 17 aa, Entamoeba invadens
KCTECPDNTFLIEDTKK

SEQ ID NO: 2784889 - protein, 18 aa, Entamoeba invadens
KCTSCKNDFILNESSECV

SEQ ID NO: 2784890 - protein, 19 aa, Entamoeba invadens
KDECLSCKDGYFKIQSESN

SEQ ID NO: 2784891 - protein, 21 aa, Entamoeba invadens
KKMENICVFKMSRSNIAMSVL

SEQ ID NO: 2784892 - protein, 19 aa, Entamoeba invadens
KKMKNICVFEMKRSNIEMV

SEQ ID NO: 2784893 - protein, 21 aa, Entamoeba invadens
KRENCSYDRLSGCDECIEDHH

SEQ ID NO: 2784894 - protein, 20 aa, Entamoeba invadens
KSTKCISCSVFDTSCVSCNN

SEQ ID NO: 2784895 - protein, 18 aa, Entamoeba invadens
KVQFSVMEGCDYYEIRSV

SEQ ID NO: 2784896 - protein, 21 aa, Entamoeba invadens
LAIGLPVVFVIIIVTLIALSI

SEQ ID NO: 2784897 - protein, 17 aa, Entamoeba invadens
LELTSYVVTYASDIYHV

SEQ ID NO: 2784898 - protein, 24 aa, Entamoeba invadens
LYPNCKRLAFSTSKCVECNDLFKL

SEQ ID NO: 2784899 - protein, 19 aa, Entamoeba invadens
MLDKFRCEYIVHFYGAVLI

SEQ ID NO: 2784900 - protein, 22 aa, Entamoeba invadens
MTMYEAFTWDFAFKNTDVQFKH

SEQ ID NO: 2784901 - protein, 24 aa, Entamoeba invadens
MTVNGDAPVVFSIDTLTVGKTFEF

SEQ ID NO: 2784902 - protein, 17 aa, Entamoeba invadens
NCIKCGLLNYSNYNEVY

SEQ ID NO: 2784903 - protein, 19 aa, Entamoeba invadens
NCPAGNYIPSYILSTQTEL

SEQ ID NO: 2784904 - protein, 31 aa, Entamoeba invadens
NECNKCTDGVLFRCYGVDGVAAWSDPTEKAP

SEQ ID NO: 2784905 - protein, 25 aa, Entamoeba invadens
NSKCIKCSFWNAPSLDGTYCEKHTV

SEQ ID NO: 2784906 - protein, 37 aa, Entamoeba invadens
PEGTIKIVVDPSLPKDVPIFIMRVGLGKNFTAENGVK

SEQ ID NO: 2784907 - protein, 23 aa, Entamoeba invadens
PIGEGAFGMVFRGTYRGRDVAIK

SEQ ID NO: 2784908 - protein, 25 aa, Entamoeba invadens
PLVTLKPGYACEFEIFIKPLCTCVT

SEQ ID NO: 2784909 - protein, 21 aa, Entamoeba invadens
PNRQCYQCVSGMYPNTNKQCI

SEQ ID NO: 2784910 - protein, 25 aa, Entamoeba invadens
QEMPRFAVRVKLMLDASKGISYLHE

SEQ ID NO: 2784911 - protein, 21 aa, Entamoeba invadens
RKCVTCVSGYFVFENKCKKCD

SEQ ID NO: 2784912 - protein, 28 aa, Entamoeba invadens
SDVYSFAICMLEIWLGRDPYDPAKFPDS

SEQ ID NO: 2784913 - protein, 22 aa, Entamoeba invadens
SGIFCLLLARAIERDTQYYCNI

SEQ ID NO: 2784914 - protein, 20 aa, Entamoeba invadens
SGVCTLCGDLTYSEGGVLQC

SEQ ID NO: 2784915 - protein, 21 aa, Entamoeba invadens
SLSVIPLELTSYVVTYASDIY

SEQ ID NO: 2784916 - protein, 24 aa, Entamoeba invadens
SQSGCLKCSTGFYQQNQFCVSCNS

SEQ ID NO: 2784917 - protein, 19 aa, Entamoeba invadens
SSSCLSCKSGKYFVAQNKT

SEQ ID NO: 2784918 - protein, 25 aa, Entamoeba invadens
STYGCLICGDGYYLHTNVCDKCDDN

SEQ ID NO: 2784919 - protein, 23 aa, Entamoeba invadens
TENKARRGYGYKVVSEKNLNNMS

SEQ ID NO: 2784920 - protein, 24 aa, Entamoeba invadens
TFTCDANNGFYCKFIEFNKNDPLE

SEQ ID NO: 2784921 - protein, 23 aa, Entamoeba invadens
TKDSKCSSCTFWYSPSDDGTFCS

SEQ ID NO: 2784922 - protein, 26 aa, Entamoeba invadens
TMFDGKEFLDSWALLNTAGTDIELQK

SEQ ID NO: 2784923 - protein, 20 aa, Entamoeba invadens
TNSCKLCAAGTYSEQNATSC

SEQ ID NO: 2784924 - protein, 22 aa, Entamoeba invadens
VDAGAAVAFVGAWFCQMPSSWA

SEQ ID NO: 2784925 - protein, 19 aa, Entamoeba invadens
VDNCKTCDLNGFCVECKSS

SEQ ID NO: 2784926 - protein, 19 aa, Entamoeba invadens
VESETKMVFCVGNASRNVL

SEQ ID NO: 2784927 - protein, 25 aa, Entamoeba invadens
VMLKKKFACEFSIYLTPKCTCQINN

SEQ ID NO: 2784928 - protein, 18 aa, Entamoeba invadens
VVGIPIVSVFIIVLIIIG

SEQ ID NO: 2784929 - protein, 24 aa, Entamoeba invadens
VYPNCKRLAFSTSKCVECNDLFKL

SEQ ID NO: 2784930 - protein, 19 aa, Entamoeba invadens
WECADGYKLSDDKIECFAN

SEQ ID NO: 2784931 - protein, 17 aa, Entamoeba invadens
YKGIYRGNCVAIKKKKE

SEQ ID NO: 2784932 - protein, 22 aa, Entamoeba invadens
YRNGLDCNKCDISCASCNTNLR

SEQ ID NO: 2784933 - protein, 19 aa, Entamoeba invadens
YSCLTCNLTNYKTNSGDCL

SEQ ID NO: 2784934 - protein, 27 aa, Entamoeba invadens
YTDACFQEDFFFRYTILNEDGKNKLVK

SEQ ID NO: 2784935 - protein, 17 aa, Entamoeba invadens
YYTTSWGACVPCDRHIS

SEQ ID NO: 2784936 - protein, 22 aa, Entamoeba invadens
AAKGRTTIIIAHRLSTIKNATK

SEQ ID NO: 2784937 - protein, 18 aa, Entamoeba invadens
AATLRTWDTIRVQRSSPM

SEQ ID NO: 2784938 - protein, 23 aa, Entamoeba invadens
AEKCKTFLPSGVDCAACKDGYLL

SEQ ID NO: 2784939 - protein, 19 aa, Entamoeba invadens
AFMSCYLVFQSAYYNCYYD

SEQ ID NO: 2784940 - protein, 20 aa, Entamoeba invadens
AFPLECQFITKWLNKEDAPK

SEQ ID NO: 2784941 - protein, 23 aa, Entamoeba invadens
AFPNCISCSQTLRQCQTCSTGFY

SEQ ID NO: 2784942 - protein, 25 aa, Entamoeba invadens
AGIACGWHYIILYLVAVILNFPLII

SEQ ID NO: 2784943 - protein, 21 aa, Entamoeba invadens
AGKGRTTIIVAHRLSTVRNAD

SEQ ID NO: 2784944 - protein, 24 aa, Entamoeba invadens
AGSGYPANMLIPLDNPIMGKFVVD

SEQ ID NO: 2784945 - protein, 21 aa, Entamoeba invadens
AIIFVCLYIFVSKPIIELQRL

SEQ ID NO: 2784946 - protein, 24 aa, Entamoeba invadens
AIPELSCDLTSEFSGKVSSETKWK

SEQ ID NO: 2784947 - protein, 26 aa, Entamoeba invadens
AKIENCLYQKFNLCIKCKENYIFKYP

SEQ ID NO: 2784948 - protein, 29 aa, Entamoeba invadens
AKKTVGGCSLCLSGYFLKDGKCHPLSESN

SEQ ID NO: 2784949 - protein, 19 aa, Entamoeba invadens
AKLIFKEAAVFVVDTPELA

SEQ ID NO: 2784950 - protein, 19 aa, Entamoeba invadens
AKSGYLIRFGTSQKVFCHL

SEQ ID NO: 2784951 - protein, 17 aa, Entamoeba invadens
ANCTCSISSKIVIVSKD

SEQ ID NO: 2784952 - protein, 19 aa, Entamoeba invadens
ANDCSACITGKLFEEGTMK

SEQ ID NO: 2784953 - protein, 27 aa, Entamoeba invadens
APKSTGILFIFLTFCFQMIACSSSECA

SEQ ID NO: 2784954 - protein, 19 aa, Entamoeba invadens
APSGVKYLGFLGDKNTNCA

SEQ ID NO: 2784955 - protein, 18 aa, Entamoeba invadens
ARVWGTMCCLIYVVVFLV

SEQ ID NO: 2784956 - protein, 22 aa, Entamoeba invadens
ASEGRTTIIIAHRLSTIKNADV
